United States Patent 8,461,315 (MICRORNAS AND USES THEREOF) - sequence listing, part 13

SEQ ID NO: 341023 - RNA, 64 nt, Homo Sapiens
cuguuguguucuauuuccaccugagggucucaaagcacuuuaaauauucacguguacuguuuaa

SEQ ID NO: 341024 - RNA, 64 nt, Homo Sapiens
aaauauaagggagaaaaugaaaugaguuuuuaaagcacuuuagaucugaaaaauguguagauua

SEQ ID NO: 341025 - RNA, 64 nt, Homo Sapiens
cauacaaaauaaucaaaauacuaauccagucucagcacuuuauuuggaggcccauucuguauuc

SEQ ID NO: 341026 - RNA, 64 nt, Homo Sapiens
cauuugcacuuuucaaaugccuuuggaugacccagcacuuuaaucugaaaccugcaacaagacu

SEQ ID NO: 341027 - RNA, 64 nt, Homo Sapiens
ccucuggagccuauggcuuuaagcaagcacuacugcacuuuacagaauuaccccacuggauccu

SEQ ID NO: 341028 - RNA, 64 nt, Homo Sapiens
caggaguucuuagcuccucagcgagcaacagagagcacuuuagauggcaccuuucaccacuugg

SEQ ID NO: 341029 - RNA, 64 nt, Homo Sapiens
auucuauuuauaucuuauuacaauaaaauuaguggcacuuuauucauaaauauucaugagccug

SEQ ID NO: 341030 - RNA, 64 nt, Homo Sapiens
ucuuuauuuaaauuuuuuuuagagugcacugagugcacuuuacagugugaagguaguacuuuuu

SEQ ID NO: 341031 - RNA, 64 nt, Homo Sapiens
uaaccaaagcuuagcaguuuuacaucauugaacugcacuuuauagauuugaaugauugggauga

SEQ ID NO: 341032 - RNA, 64 nt, Homo Sapiens
cuaaugggucacaaaucuugugcacugaacauaagcacuuuauaccuucugagucugccuuuuu

SEQ ID NO: 341033 - RNA, 64 nt, Homo Sapiens
uuagacuugccacucugaaauccauuuaaaagaggcacuuuacucugaacaaaugaaacucuuc

SEQ ID NO: 341034 - RNA, 64 nt, Homo Sapiens
guccuguggcuugugaccucccaauaaauuucaugcacuuuaaaguauacaugcggcuucauug

SEQ ID NO: 341035 - RNA, 64 nt, Homo Sapiens
cauuucuuuuaaaaggucuaucaugcagagcaaagcacuuuaacggugccacccucucuggcau

SEQ ID NO: 341036 - RNA, 64 nt, Homo Sapiens
agguuuuguuucaguuuguaagauuucuuuucuggcacuuuaauggcuugagguaucauuauca

SEQ ID NO: 341037 - RNA, 64 nt, Homo Sapiens
uggcagggcacgguagcucacaccuguaaucccagcacuuuaggaggucaaggugggcagauca

SEQ ID NO: 341038 - RNA, 64 nt, Homo Sapiens
gacuuggauuuuguaaaucuauuugugauugaaagcacuuuagucaggcuuuuggucuuucaaa

SEQ ID NO: 341039 - RNA, 64 nt, Homo Sapiens
caguuaacuuggugcaaaacacgguuccuuaauggcacuuuaacuauuucauucuagaauggaa

SEQ ID NO: 341040 - RNA, 64 nt, Homo Sapiens
cgccgaagacagcccugcaguguauuccucaguagcacuuuaaaugaacuuacgugacaaugau

SEQ ID NO: 341041 - RNA, 64 nt, Homo Sapiens
uucgucaaguuucaagucugagaguuuugacagagcacuuuauuccagcugaaaaccugcugug

SEQ ID NO: 341042 - RNA, 64 nt, Homo Sapiens
gcaguggaccaagcaccaguggcuucagcgguggaccgagcacaggagcuggcuucggcggugg

SEQ ID NO: 341043 - RNA, 64 nt, Homo Sapiens
guggaccaaacacuggugcuggcuuuggugguggaccgagcaccagugcuggcuuuggcagugg

SEQ ID NO: 341044 - RNA, 64 nt, Homo Sapiens; identical to SEQ ID NO: 88257

SEQ ID NO: 341045 - RNA, 64 nt, Homo Sapiens; identical to SEQ ID NO: 88258

SEQ ID NO: 341046 - RNA, 64 nt, Homo Sapiens; identical to SEQ ID NO: 88259

SEQ ID NO: 341047 - RNA, 64 nt, Homo Sapiens; identical to SEQ ID NO: 88260

SEQ ID NO: 341048 - RNA, 64 nt, Homo Sapiens; identical to SEQ ID NO: 88261

SEQ ID NO: 341049 - RNA, 64 nt, Homo Sapiens; identical to SEQ ID NO: 88262

SEQ ID NO: 341050 - RNA, 64 nt, Homo Sapiens; identical to SEQ ID NO: 88263

SEQ ID NO: 341051 - RNA, 64 nt, Homo Sapiens; identical to SEQ ID NO: 88264

SEQ ID NO: 341052 - RNA, 64 nt, Homo Sapiens; identical to SEQ ID NO: 88265

SEQ ID NO: 341053 - RNA, 64 nt, Homo Sapiens; identical to SEQ ID NO: 88266

SEQ ID NO: 341054 - RNA, 64 nt, Homo Sapiens; identical to SEQ ID NO: 88267

SEQ ID NO: 341055 - RNA, 64 nt, Homo Sapiens; identical to SEQ ID NO: 88268

SEQ ID NO: 341056 - RNA, 64 nt, Homo Sapiens; identical to SEQ ID NO: 88269

SEQ ID NO: 341057 - RNA, 64 nt, Homo Sapiens; identical to SEQ ID NO: 88270

SEQ ID NO: 341058 - RNA, 64 nt, Homo Sapiens; identical to SEQ ID NO: 88271

SEQ ID NO: 341059 - RNA, 64 nt, Homo Sapiens; identical to SEQ ID NO: 88269

SEQ ID NO: 341060 - RNA, 64 nt, Homo Sapiens; identical to SEQ ID NO: 88273

SEQ ID NO: 341061 - RNA, 64 nt, Homo Sapiens; identical to SEQ ID NO: 88274

SEQ ID NO: 341062 - RNA, 64 nt, Homo Sapiens; identical to SEQ ID NO: 88275

SEQ ID NO: 341063 - RNA, 64 nt, Homo Sapiens; identical to SEQ ID NO: 88276

SEQ ID NO: 341064 - RNA, 64 nt, Homo Sapiens; identical to SEQ ID NO: 88277

SEQ ID NO: 341065 - RNA, 64 nt, Homo Sapiens; identical to SEQ ID NO: 88278

SEQ ID NO: 341066 - RNA, 64 nt, Homo Sapiens; identical to SEQ ID NO: 88279

SEQ ID NO: 341067 - RNA, 64 nt, Homo Sapiens; identical to SEQ ID NO: 88280

SEQ ID NO: 341068 - RNA, 64 nt, Homo Sapiens; identical to SEQ ID NO: 88281

SEQ ID NO: 341069 - RNA, 64 nt, Homo Sapiens; identical to SEQ ID NO: 88282

SEQ ID NO: 341070 - RNA, 64 nt, Homo Sapiens; identical to SEQ ID NO: 88283

SEQ ID NO: 341071 - RNA, 64 nt, Homo Sapiens; identical to SEQ ID NO: 88284

SEQ ID NO: 341072 - RNA, 64 nt, Homo Sapiens; identical to SEQ ID NO: 88285

SEQ ID NO: 341073 - RNA, 64 nt, Homo Sapiens; identical to SEQ ID NO: 88286

SEQ ID NO: 341074 - RNA, 64 nt, Homo Sapiens; identical to SEQ ID NO: 88287

SEQ ID NO: 341075 - RNA, 64 nt, Homo Sapiens; identical to SEQ ID NO: 88288

SEQ ID NO: 341076 - RNA, 64 nt, Homo Sapiens; identical to SEQ ID NO: 88289

SEQ ID NO: 341077 - RNA, 64 nt, Homo Sapiens; identical to SEQ ID NO: 88290

SEQ ID NO: 341078 - RNA, 64 nt, Homo Sapiens; identical to SEQ ID NO: 88291

SEQ ID NO: 341079 - RNA, 64 nt, Homo Sapiens; identical to SEQ ID NO: 88292

SEQ ID NO: 341080 - RNA, 64 nt, Homo Sapiens; identical to SEQ ID NO: 88293

SEQ ID NO: 341081 - RNA, 64 nt, Homo Sapiens; identical to SEQ ID NO: 88294

SEQ ID NO: 341082 - RNA, 64 nt, Homo Sapiens; identical to SEQ ID NO: 88295

SEQ ID NO: 341083 - RNA, 64 nt, Homo Sapiens; identical to SEQ ID NO: 88296

SEQ ID NO: 341084 - RNA, 64 nt, Homo Sapiens; identical to SEQ ID NO: 88297

SEQ ID NO: 341085 - RNA, 64 nt, Homo Sapiens; identical to SEQ ID NO: 88298

SEQ ID NO: 341086 - RNA, 64 nt, Homo Sapiens; identical to SEQ ID NO: 88299

SEQ ID NO: 341087 - RNA, 64 nt, Homo Sapiens; identical to SEQ ID NO: 88300

SEQ ID NO: 341088 - RNA, 64 nt, Homo Sapiens; identical to SEQ ID NO: 88298

SEQ ID NO: 341089 - RNA, 64 nt, Homo Sapiens; identical to SEQ ID NO: 88302

SEQ ID NO: 341090 - RNA, 64 nt, Homo Sapiens; identical to SEQ ID NO: 88300

SEQ ID NO: 341091 - RNA, 64 nt, Homo Sapiens; identical to SEQ ID NO: 88304

SEQ ID NO: 341092 - RNA, 64 nt, Homo Sapiens; identical to SEQ ID NO: 88305

SEQ ID NO: 341093 - RNA, 64 nt, Homo Sapiens; identical to SEQ ID NO: 88306

SEQ ID NO: 341094 - RNA, 64 nt, Homo Sapiens; identical to SEQ ID NO: 88307

SEQ ID NO: 341095 - RNA, 64 nt, Homo Sapiens; identical to SEQ ID NO: 88299

SEQ ID NO: 341096 - RNA, 64 nt, Homo Sapiens; identical to SEQ ID NO: 88309

SEQ ID NO: 341097 - RNA, 64 nt, Homo Sapiens; identical to SEQ ID NO: 88310

SEQ ID NO: 341098 - RNA, 64 nt, Homo Sapiens; identical to SEQ ID NO: 88311

SEQ ID NO: 341099 - RNA, 64 nt, Homo Sapiens; identical to SEQ ID NO: 88312

SEQ ID NO: 341100 - RNA, 64 nt, Homo Sapiens; identical to SEQ ID NO: 88313

SEQ ID NO: 341101 - RNA, 64 nt, Homo Sapiens; identical to SEQ ID NO: 88314

SEQ ID NO: 341102 - RNA, 64 nt, Homo Sapiens; identical to SEQ ID NO: 88315

SEQ ID NO: 341103 - RNA, 64 nt, Homo Sapiens; identical to SEQ ID NO: 88316

SEQ ID NO: 341104 - RNA, 64 nt, Homo Sapiens; identical to SEQ ID NO: 88317

SEQ ID NO: 341105 - RNA, 64 nt, Homo Sapiens; identical to SEQ ID NO: 88318

SEQ ID NO: 341106 - RNA, 64 nt, Homo Sapiens; identical to SEQ ID NO: 88319

SEQ ID NO: 341107 - RNA, 64 nt, Homo Sapiens; identical to SEQ ID NO: 88320

SEQ ID NO: 341108 - RNA, 64 nt, Homo Sapiens; identical to SEQ ID NO: 88321

SEQ ID NO: 341109 - RNA, 64 nt, Homo Sapiens; identical to SEQ ID NO: 88322

SEQ ID NO: 341110 - RNA, 64 nt, Homo Sapiens; identical to SEQ ID NO: 88323

SEQ ID NO: 341111 - RNA, 64 nt, Homo Sapiens; identical to SEQ ID NO: 88324

SEQ ID NO: 341112 - RNA, 64 nt, Homo Sapiens; identical to SEQ ID NO: 88325

SEQ ID NO: 341113 - RNA, 64 nt, Homo Sapiens; identical to SEQ ID NO: 88326

SEQ ID NO: 341114 - RNA, 64 nt, Homo Sapiens; identical to SEQ ID NO: 88327

SEQ ID NO: 341115 - RNA, 64 nt, Homo Sapiens; identical to SEQ ID NO: 88328

SEQ ID NO: 341116 - RNA, 64 nt, Homo Sapiens; identical to SEQ ID NO: 88329

SEQ ID NO: 341117 - RNA, 64 nt, Homo Sapiens; identical to SEQ ID NO: 88330

SEQ ID NO: 341118 - RNA, 65 nt, Homo Sapiens
gcagguuggugauucaguccgaccuucuuuagguaaccgagcauuuauuuaaccaacuauaccac

SEQ ID NO: 341119 - RNA, 65 nt, Homo Sapiens
uaccuagaccguuauaaagugugccacauggacuuaccgagcauggagagaggauuuuagcuagg

SEQ ID NO: 341120 - RNA, 65 nt, Homo Sapiens
aagcaauauaagugugauugcaagaaugguagaggaccgagcacagaaaucuuagagauuucuug

SEQ ID NO: 341121 - RNA, 65 nt, Homo Sapiens
agaagucauccuugguaaggucuccacucgccauuaccgagcaccugagcaccauagcaccauug

SEQ ID NO: 341122 - RNA, 65 nt, Homo Sapiens
ggcagcuucaugaccgaugugagcccccugaugccaccgagcaggagcaccucuccgagccaugu

SEQ ID NO: 341123 - RNA, 65 nt, Homo Sapiens
uggacucgaacucugugccgcagacugcaagcccgaccgagcacuggggugacaugggcccuagg

SEQ ID NO: 341124 - RNA, 65 nt, Homo Sapiens
acagaccagagcccaccacagcucccaggcccagcaccgagcagaagccaagcaugggaaucuuu

SEQ ID NO: 341125 - RNA, 65 nt, Homo Sapiens
aaacagaacuugggcuuccucuuccacuuaguuguaccgagcauacuugagacaaagugaaucaa

SEQ ID NO: 341126 - RNA, 65 nt, Homo Sapiens
uugugcgcacacucguuuccugucugugugcaucaaccgagcagaggggcagcugaacagaagga

SEQ ID NO: 341127 - RNA, 65 nt, Homo Sapiens
gaaaaggcacacacacacgugcugcagagaaaucuaccgagcaagaauugcaguccacguaacug

SEQ ID NO: 341128 - RNA, 65 nt, Homo Sapiens
gucugagcucuucuucagccggggcugcuguaauuaccgagcaagugaggguguggccuucacca

SEQ ID NO: 341129 - RNA, 65 nt, Homo Sapiens
ggaacaggggcuuuggacucgagugacuguggccaaccgagcagggacacaaccccgaggcagga

SEQ ID NO: 341130 - RNA, 65 nt, Homo Sapiens
cucgguuuggucccuaaaacaguguagcgcccccaaccgagcaacccaggcccccucacccucaa

SEQ ID NO: 341131 - RNA, 65 nt, Homo Sapiens
uucuccuccugagguccucgagaaaccgaguucagaccgagcaggggccucguggacugcugcug

SEQ ID NO: 341132 - RNA, 65 nt, Homo Sapiens
ccuucugaacuacacugcauuguugugccgagaacaccgagcacugaacuuugcaaagaccuucg

SEQ ID NO: 341133 - RNA, 65 nt, Homo Sapiens
uuguccaggcauggccuguggcccgagggccaaccaccgagcaggcacagcacagcagugacucg

SEQ ID NO: 341134 - RNA, 65 nt, Homo Sapiens
ccugcuggaauauggaggaagcggaaauguaccuaaccgagcaggacaucuuccuauacaccgag

SEQ ID NO: 341135 - RNA, 65 nt, Homo Sapiens
gagaggaaccaauaccuucaaggcucuucuuccucaccgagcaugcuucccuaggaucccgucuu

SEQ ID NO: 341136 - RNA, 65 nt, Homo Sapiens
agacgagugaugccauuuggagaaaaucaacaaagaccgagcaaagaaccgcaggaugaaaauga

SEQ ID NO: 341137 - RNA, 65 nt, Homo Sapiens
augcggggauggacccuagacaucugucagguggcaccgagcaggcauaccuaccuggggcauga

SEQ ID NO: 341138 - RNA, 65 nt, Homo Sapiens
ugccaggucuagcaaacauacuuugaaccuuauguaccgagcaaaaauaaaaaaaggaaaggaaa

SEQ ID NO: 341139 - RNA, 65 nt, Homo Sapiens
guuuccucuccaacuccucugcuggcaggagugaaaccgagcauaaccagggaauaggcuguugg

SEQ ID NO: 341140 - RNA, 65 nt, Homo Sapiens
ggagagaggacucaacugggacccacguggaaaagaccgagcaggccacagaggcucggucuccc

SEQ ID NO: 341141 - RNA, 65 nt, Homo Sapiens
cuuugggagcccgccuuguggauccaccacaccccaccgagcacuagaagcugcauaagcuacac

SEQ ID NO: 341142 - RNA, 65 nt, Homo Sapiens
gaugcuggacuucaugauuucaauauaugauuuaaaccgagcacuccucgugauaaguaugucac

SEQ ID NO: 341143 - RNA, 65 nt, Homo Sapiens
ccuccccacucgggagaagcagagcugaccuuaggaccgagcaccagggcagguugcgcugacuc

SEQ ID NO: 341144 - RNA, 65 nt, Homo Sapiens
uuucugcuaaaaaguccuuggccuuagauaaaagaaccgagcaauccuucacuuuacaaauucaa

SEQ ID NO: 341145 - RNA, 65 nt, Homo Sapiens
auuacguaauuagaggguuauuugcccacaugaccaccgagcauugaagucacccugugauucuc

SEQ ID NO: 341146 - RNA, 65 nt, Homo Sapiens
aacuuggccccugggguccuagggguccugccaccaccgagcaccgcagugggacagggggcugc

SEQ ID NO: 341147 - RNA, 65 nt, Homo Sapiens
uguggggccugcugggaaaccuccagccuccagagaccgagcagcacuccuguccccagccugac

SEQ ID NO: 341148 - RNA, 65 nt, Homo Sapiens
uaccaugugccacacaccuuacacaaaggcuauugaccgagcacaacuaccagagccguuacuac

SEQ ID NO: 341149 - RNA, 65 nt, Homo Sapiens
gguggaaaaauacuuuugcuaauuucuuaauuuucaccgagcagauaaaugcuguucuuacacau

SEQ ID NO: 341150 - RNA, 65 nt, Homo Sapiens
uuuuacacuuuaagguagcaaaugucaauuauuagaccgagcauauugugaagaauuaaacuaaa

SEQ ID NO: 341151 - RNA, 62 nt, Homo Sapiens
agaacgagagcaaagcaugaugggugaagagaaccgagcaaagaucaaaauaaaaagugaca

SEQ ID NO: 341152 - RNA, 65 nt, Homo Sapiens
gcugugugaaacaugguugucguggagaaaaucaaaccgagcaggcugaagacaauuaucaacca

SEQ ID NO: 341153 - RNA, 65 nt, Homo Sapiens
uucuggauaaggucacuguccuaggugcuagguggaccgagcaaaagacucaguggaugaacugg

SEQ ID NO: 341154 - RNA, 65 nt, Homo Sapiens
uggagggcucggucggcgaccucugaagagagugcaccgagcaaaccaagugccggagcaccagc

SEQ ID NO: 341155 - RNA, 65 nt, Homo Sapiens
aauaaaaaauggaaaggaaacuuugaaccuuauguaccgagcaaaugcaaggucuagcaaauaua

SEQ ID NO: 341156 - RNA, 65 nt, Homo Sapiens
ucaucaugcuguguggcacaaauguguuacauuugaccgagcauaugcaacucgcuacugaagaa

SEQ ID NO: 341157 - RNA, 65 nt, Homo Sapiens
acgcagcagcagagccgccguuugcuggguuguuuaccgagcacugugaccuuucuuucccugga

SEQ ID NO: 341158 - RNA, 65 nt, Homo Sapiens
gggaggaccaaggggaagggccaaucacuggggagaccgagcacaacucaggaugcuuuccaaag

SEQ ID NO: 341159 - RNA, 65 nt, Homo Sapiens
ccugcacauguucccaugcaugugugugcacucggaccgagcaucucccacgcaccucuacccca

SEQ ID NO: 341160 - RNA, 65 nt, Homo Sapiens
gcucccagggggcgcucaauccuccagcgucuguuaccgagcacuccgccccuccucaucggggu

SEQ ID NO: 341161 - RNA, 65 nt, Homo Sapiens
guucucuugaugccagugcauguuagccuuaaaccaccgagcagcuacaguguuacccuguaagg

SEQ ID NO: 341162 - RNA, 65 nt, Homo Sapiens
gugccccgugcagggaucaggagggcgggggagggaccgagcagcccucuugcccggucggguca

SEQ ID NO: 341163 - RNA, 65 nt, Homo Sapiens
uuauucagugcauagcuuuaugaaaagcaggauguaccgagcacuguguguauuuucauuccagg

SEQ ID NO: 341164 - RNA, 65 nt, Homo Sapiens
guggcacaugccuguaguccaaguuuuuuuaguucaccgagcauggagaccguaucacuacaaaa

SEQ ID NO: 341165 - RNA, 65 nt, Homo Sapiens
gggcaggccccauccugggcauuggagaugaugaaaccgagcagaccuggcccauguggagcugg

SEQ ID NO: 341166 - RNA, 65 nt, Homo Sapiens
gccagcauggcuggagaggcaggcauaggcagggaaccgagcagcaggucagagcaggcgagcug

SEQ ID NO: 341167 - RNA, 65 nt, Homo Sapiens
agccugcagagccacagucagccugcccacaugccaccgagcaaacgcaucuugcuuuucacauc

SEQ ID NO: 341168 - RNA, 65 nt, Homo Sapiens
guggguggcucuggcacgaggcccugcccacucuuaccgagcaagcgcuggccccucagcgguga

SEQ ID NO: 341169 - RNA, 65 nt, Homo Sapiens
gagacucgcuggagaggcggcucccguguccguccaccgagcacucagauggaugcugaucacca

SEQ ID NO: 341170 - RNA, 65 nt, Homo Sapiens
auggagaccaugucaugcagaauuaacaagguagcaccgagcauaucaauaaauauuauucugau

SEQ ID NO: 341171 - RNA, 65 nt, Homo Sapiens
aaaaggggagaagaucccacuuuauuuaaaaaaauaccgagcagcguugggggcgggguaauuau

SEQ ID NO: 341172 - RNA, 65 nt, Homo Sapiens
ugcaguggaccaagcaccaguggcuucagcgguggaccgagcacaggagcuggcuucggcggugg

SEQ ID NO: 341173 - RNA, 65 nt, Homo Sapiens
gguggaccaaacacuggugcuggcuuuggugguggaccgagcaccagugcuggcuuuggcagugg

SEQ ID NO: 341174 - RNA, 65 nt, Homo Sapiens
aguucgcccuucccccaccuccuugucuuuccccgaccgagcaccagacugcagaaugaggcaau

SEQ ID NO: 341175 - RNA, 65 nt, Homo Sapiens
uaaaacucagaggaaauuugcucaaucauggccauaccgagcagacguccaguaaagaagauaac

SEQ ID NO: 341176 - RNA, 65 nt, Homo Sapiens
uucuugucuucugaugguguauuaaauaaaauggcaccgagcagaguaaacugucuaguguuugc

SEQ ID NO: 341177 - RNA, 65 nt, Homo Sapiens
caaucuuuccagcccuccccgucagaaggauuugaaccgagcagcggagcaaggcuugccagcaa

SEQ ID NO: 341178 - RNA, 63 nt, Homo Sapiens
agggagcccagccuauucccguuggcuggcugggccccucagcugcugggccccaccucccca

SEQ ID NO: 341179 - RNA, 63 nt, Homo Sapiens
uuccagggggcucugcuccaaguucccuagcgggccccucagggagaaauagccucacgugca

SEQ ID NO: 341180 - RNA, 63 nt, Homo Sapiens
cugagaugugggaggugcagcauguuccccugggccccucagaaagucgagcuuggaggccag

SEQ ID NO: 341181 - RNA, 63 nt, Homo Sapiens
ccagaugucugcagcccucagcagcugcagaccgccccucaccaacccagagaaccugcuuua

SEQ ID NO: 341182 - RNA, 63 nt, Homo Sapiens
gcauuggugccaaguccaguggaugagaauccagccccucacaagcugugggauggggcuugg

SEQ ID NO: 341183 - RNA, 63 nt, Homo Sapiens
aggcaccgugggccuggcacuugcaaaaguguggccccucacucuaguguguggucccucuca

SEQ ID NO: 341184 - RNA, 63 nt, Homo Sapiens
ucuaacugggccuaaggugagcugagggcuugagccccucagcccagcgggggucccuuuuca

SEQ ID NO: 341185 - RNA, 63 nt, Homo Sapiens
acugcgggagccagcgcuccugccgccccucuugccccucagaccuugcauccacagaagcac

SEQ ID NO: 341186 - RNA, 63 nt, Homo Sapiens
agugauucucccagaagcacaaagcauacucuugccccucagguguugcuuguguacaucgua

SEQ ID NO: 341187 - RNA, 63 nt, Homo Sapiens
aggcaacaauagagacacaggcuggguuggucugccccucagucaggcccccuuacccaccca

SEQ ID NO: 341188 - RNA, 63 nt, Homo Sapiens
ccauggagugggaauccccagccgaggcccuaggccccucagcagggaagggauccccgggga

SEQ ID NO: 341189 - RNA, 63 nt, Homo Sapiens
cugcaucuuggaggcagggaggugagggcaggugccccucagacacuucaggaagguaguuug

SEQ ID NO: 341190 - RNA, 63 nt, Homo Sapiens
caaucaugugaaggacagaagcuuuugccaugggccccucacaucagggaaaaugaccuucac

SEQ ID NO: 341191 - RNA, 63 nt, Homo Sapiens
ugcccaccccucaaguguaaggaacugcguuccgccccucaggcccccaugggggcagggauc

SEQ ID NO: 341192 - RNA, 63 nt, Homo Sapiens
uugauaaaucagaggugcuacugaggaguuggugccccucauuccagaaucuccuacccccag

SEQ ID NO: 341193 - RNA, 63 nt, Homo Sapiens
uacuuauuucuggccaaaugaaucugcuucucugccccucaaacuuuuaguucacaauucauc

SEQ ID NO: 341194 - RNA, 63 nt, Homo Sapiens
aaagcacucuuauuuuuugaucuggccuauuuugccccucauuguguagccucaauuaacaca

SEQ ID NO: 341195 - RNA, 63 nt, Homo Sapiens
gccucugggaggagagggacuccuggggggccugccccucauacgccaucaccaaaaggaaag

SEQ ID NO: 341196 - RNA, 63 nt, Homo Sapiens
cuuccugcccuguguuaggagauagggauauuggccccucacugcagcugccagcacuugguc

SEQ ID NO: 341197 - RNA, 63 nt, Homo Sapiens
ccccuagccccuucccuccuccuggggccuccagccccucacacugcuguucccagugauauu

SEQ ID NO: 341198 - RNA, 63 nt, Homo Sapiens
augccgggaagccagagaccugcaggggccucggccccucacaucguguaugucucuccuuga

SEQ ID NO: 341199 - RNA, 63 nt, Homo Sapiens
cucugcucccuucuucaguaagcaaggagccccgccccucaggcccagccucuggcaagaggu

SEQ ID NO: 341200 - RNA, 59 nt, Homo Sapiens
gcuucgccaagcuggacugagccuuccaggccccucaugcagaccugggguccuccugg

SEQ ID NO: 341201 - RNA, 63 nt, Homo Sapiens
ggccugaacugccucugcuucccccccugaggggccccucacucuuacccaagacucuggauu

SEQ ID NO: 341202 - RNA, 63 nt, Homo Sapiens
uagcccagcccaucuaaauggaagcugggaauugccccucaccuccccuguguccuguccagc

SEQ ID NO: 341203 - RNA, 63 nt, Homo Sapiens
gcacacacugcaugccuuaacaagugugugcaagccccucagaacucaagacauccaaauuuu

SEQ ID NO: 341204 - RNA, 63 nt, Homo Sapiens
aaagauuucugaacagugauugucccguuaauagccccucagaagauguucccugcugauaac

SEQ ID NO: 341205 - RNA, 63 nt, Homo Sapiens
gucauaaaaaacaguggagcucuguauuagaaagccccucagaacugggaaggccagguaacu

SEQ ID NO: 341206 - RNA, 63 nt, Homo Sapiens
ucgguauauuaaguccaaaagaugguccgggcugccccucacaaaagcuucugcauccacgug

SEQ ID NO: 341207 - RNA, 63 nt, Homo Sapiens
agccugggacccuguuuacaguugcacaucugggccccucacuguggggauugaucauucuca

SEQ ID NO: 341208 - RNA, 63 nt, Homo Sapiens
acuccugggcuucagccucucccacccagcccugccccucaccugccugcccuccccuccccc

SEQ ID NO: 341209 - RNA, 63 nt, Homo Sapiens
gcuggaagaagccuuagagcucaacuucuucaagccccucacuuuacagaugaggaaauggag

SEQ ID NO: 341210 - RNA, 63 nt, Homo Sapiens
ggccagaagcaccagccugcugccagcggggcagccccucauaggaggcccaggagggagccc

SEQ ID NO: 341211 - RNA, 63 nt, Homo Sapiens
ccacagcccugagaugggccggcccccuuccuggccccucauggcgggacuggagaaaugguc

SEQ ID NO: 341212 - RNA, 63 nt, Homo Sapiens
ccggcccauaucccugguugccucauggccagcgccccucagccucugccacugugaaccggc

SEQ ID NO: 341213 - RNA, 63 nt, Homo Sapiens
gagagccucggaccucccaagcgcucccucucugccccucagcucugagcagccguguugggg

SEQ ID NO: 341214 - RNA, 63 nt, Homo Sapiens
ucggccccagccuauuucccacugcuguguucagccccucagccgaccugcugacccacgguc

SEQ ID NO: 341215 - RNA, 63 nt, Homo Sapiens
ccuugcccccaucccucggaauggcucaggcaagccccucagcgagagggcccagcuguagcc

SEQ ID NO: 341216 - RNA, 57 nt, Homo Sapiens
cugccuuaucuugcaccccaggccagggccccucaccuuuucuuuaaaacaucauaa

SEQ ID NO: 341217 - RNA, 63 nt, Homo Sapiens
ggaagcugcuaggggaaggacggggaccacugggccccucaggcuuuucgaacugugcuccca

SEQ ID NO: 341218 - RNA, 63 nt, Homo Sapiens
uggggcucccaccuuccccagggcugggugcaggccccucaguggaggggaggcggaucugag

SEQ ID NO: 341219 - RNA, 63 nt, Homo Sapiens
cacuggaaccccaucuucaguuguuucucagaggccccucagcuggggucccagggcccuucc

SEQ ID NO: 341220 - RNA, 63 nt, Homo Sapiens
ccaagcuuuggaaaaccuuccuuucugauccaggccccucagucagccucuuuccgucccucu

SEQ ID NO: 341221 - RNA, 63 nt, Homo Sapiens
ucuccuccagagucagaagugccaaacucaccugccccucaacgaagcacaugccucucucag

SEQ ID NO: 341222 - RNA, 63 nt, Homo Sapiens
agcaggaaacccucaaacccucaucuggaucgggccccucagacccagcugcagccacccuuc

SEQ ID NO: 341223 - RNA, 63 nt, Homo Sapiens
cucagaccucucccaccccacagagugugcccugccccucauguguccuacaucucccugaac

SEQ ID NO: 341224 - RNA, 63 nt, Homo Sapiens
cuuccagugaguccccaucuaggcucagcaacagccccucagguuuuuguauuucuggggcug

SEQ ID NO: 341225 - RNA, 63 nt, Homo Sapiens
ggcuuggggguuuucaaugugucuucuccaccagccccucacagugagaaagcuaaaauggug

SEQ ID NO: 341226 - RNA, 63 nt, Homo Sapiens
uugugaccaaguuguggguacgaguguucacuugccccucaguaaccagugcauucuacuucu

SEQ ID NO: 341227 - RNA, 63 nt, Homo Sapiens
ugaauccacucucuguauucguucagacugauugccccucacccaacuauagacuugcucauu

SEQ ID NO: 341228 - RNA, 63 nt, Homo Sapiens
aucucucugcuaacaccaguccuuaggcuuacagccccucaaucucuaucuuuagauuucaaa

SEQ ID NO: 341229 - RNA, 63 nt, Homo Sapiens
ccaaggggucuguauauacaccuccuggccggggccccucaccgaccccucccuugcucagug

SEQ ID NO: 341230 - RNA, 63 nt, Homo Sapiens
ugggccuuuccugugccaacaauguacagaguggccccucaccacauuaaucaccaaaguauu

SEQ ID NO: 341231 - RNA, 63 nt, Homo Sapiens
caaccacagacccuucucugggucuaagcuacagccccucagcguccauccuggagacccuga

SEQ ID NO: 341232 - RNA, 63 nt, Homo Sapiens
ugcagucagagagcaagcccccaggacccuggggccccucaacuuccuggcucgucucaaagg

SEQ ID NO: 341233 - RNA, 63 nt, Homo Sapiens
uaucccucaacccccagccccagcuuccauuucgccccucauuuaccugaccaacaguuccuu

SEQ ID NO: 341234 - RNA, 63 nt, Homo Sapiens
uuauuuguggucacccaggguccaauaaucauggccccucaauuaugcuacuuucucucagca

SEQ ID NO: 341235 - RNA, 63 nt, Homo Sapiens
agcaagaggcaugauuggaucuggacaggcccugccccucaccaaaaagugcggaggaaguag

SEQ ID NO: 341236 - RNA, 63 nt, Homo Sapiens
aacuccagagucaccugucugucagggcacggcgccccucaagccuuccugcucacauccaca

SEQ ID NO: 341237 - RNA, 63 nt, Homo Sapiens
ucacaagccagaaccuaagccuaggggcacauggccccucacacaaaacccaaguagaugccu

SEQ ID NO: 341238 - RNA, 63 nt, Homo Sapiens
gagacaguacuuugaaacucaaggcaucuaccggccccucacauuagccauccccuccucagc

SEQ ID NO: 341239 - RNA, 63 nt, Homo Sapiens
ccugugugcuagugucuggguaguucugugugugccccucaccagagaaaaacccuccucugg

SEQ ID NO: 341240 - RNA, 63 nt, Homo Sapiens
acccagggucccagcugcuguaggucuccaguggccccucagguugcccuugcaaaggcuucc

SEQ ID NO: 341241 - RNA, 63 nt, Homo Sapiens
acaacagggcuggccuuggaccugcucagaguggccccucagaagugacccuggcaguguuug

SEQ ID NO: 341242 - RNA, 63 nt, Homo Sapiens
cagggcugccagccaggccaaacaucgugaugggccccucagccccagucauccagcagcguc

SEQ ID NO: 341243 - RNA, 63 nt, Homo Sapiens
ccucuccugcuggucccuggacuuuucugagcggccccucagacgcgaagugaaggaugcguc

SEQ ID NO: 341244 - RNA, 57 nt, Homo Sapiens
ggcuccagaguugcaagugacaggagggccccucaggcagagauggaccaggcggug

SEQ ID NO: 341245 - RNA, 63 nt, Homo Sapiens
ucaaaauauauucagcaaaggguucacuuaguugccccucaugcuucacagguugacuaguau

SEQ ID NO: 341246 - RNA, 63 nt, Homo Sapiens
ugugaaugugccucguucaucccuggugcuugagccccucaagcuccagucaaugauccaguc

SEQ ID NO: 341247 - RNA, 63 nt, Homo Sapiens
ccacucucugcccacuaccuaugcuucuagaaagccccucaccucaggaccccagagggacca

SEQ ID NO: 341248 - RNA, 63 nt, Homo Sapiens
guguugcgcccggagcccgcccuucgccucccagccccucaagacaccgcuggcugcuggaca

SEQ ID NO: 341249 - RNA, 63 nt, Homo Sapiens
gcccggccccgccgcggcccggacccccagccagccccucacagcucuuccccagcuccgccu

SEQ ID NO: 341250 - RNA, 63 nt, Homo Sapiens
cacucuggccaaggagcucugaauugugagucugccccucaggggaauucggagcuagaggac

SEQ ID NO: 341251 - RNA, 63 nt, Homo Sapiens
ccuucccccauccaugguugggaaagaagcucagccccucacaguggccucaagugugaugcc

SEQ ID NO: 341252 - RNA, 63 nt, Homo Sapiens
gcgccccggcugggcggaggaggagacgcccaugccccucaggggaaaguggagaccgggaca

SEQ ID NO: 341253 - RNA, 63 nt, Homo Sapiens
gcugcacaugccagugugacccuugaagacagugccccucagagaccccaagaccuuagggau

SEQ ID NO: 341254 - RNA, 63 nt, Homo Sapiens
cuaaugacacccacuccuagcccugaggcucgugccccucagacuggggaagaguccaaggaa

SEQ ID NO: 341255 - RNA, 63 nt, Homo Sapiens
cuggggagggcccucuggccccaggcaaccuuagccccucagaacagggagucccaggaccca

SEQ ID NO: 341256 - RNA, 63 nt, Homo Sapiens
gcuccguaagaacucagaugccugggaagcccagccccucaggugcccccacacacagccuuc

SEQ ID NO: 341257 - RNA, 63 nt, Homo Sapiens
ugcugaacaagcauuuguaggcuacucaagagugccccucagcuuuauucacucuucagacac

SEQ ID NO: 341258 - RNA, 63 nt, Homo Sapiens
ccucuuuagcaauuccuagauccuuucuucucagccccucaccagaccucuuauugcccauuc

SEQ ID NO: 341259 - RNA, 63 nt, Homo Sapiens
uccuuuagggcaaauaacacgauucuucacucugccccucacuggcccacugagcugcacugg

SEQ ID NO: 341260 - RNA, 63 nt, Homo Sapiens
cagcccuggccucugcucaacaauuguuggagagccccucacacuuuuuauacuuuguaaaga

SEQ ID NO: 341261 - RNA, 63 nt, Homo Sapiens
gcuugggauguuaccuugccuaggagagacucagccccucacauuccugugcugcccugcacc

SEQ ID NO: 341262 - RNA, 63 nt, Homo Sapiens
uacauguuuaucuuuguuugguuuucucugagugccccucacuacuugccacaggagcgaugu

SEQ ID NO: 341263 - RNA, 63 nt, Homo Sapiens
aucagagacugggcgaagcacuagcccggcugugccccucacuucccacgccugcccacuuug

SEQ ID NO: 341264 - RNA, 63 nt, Homo Sapiens
ucaggaggggccuggagcagcggucccccugcugccccucacucuuccagccccuccaggacc

SEQ ID NO: 341265 - RNA, 63 nt, Homo Sapiens
uagguuuuuauuguugaauguacaucuaccccagccccucaaaagaaaaacuguuuacauaga

SEQ ID NO: 341266 - RNA, 63 nt, Homo Sapiens
gcuauuuuuauagcugauauaguuacaccucaagccccucagggguaacaacuaacaaacacc

SEQ ID NO: 341267 - RNA, 63 nt, Homo Sapiens
guuuucuagaagguugggauugucaggguccuggccccucagaacuggcuugaucaagggccu

SEQ ID NO: 341268 - RNA, 63 nt, Homo Sapiens
gaugcagccgucugaugaggccacaaccccuaggccccucaggagcuuugcagagaggaggac

SEQ ID NO: 341269 - RNA, 63 nt, Homo Sapiens
ugcuacucuuugagaaugaaguugucauucagggccccucauguagccaaaagaccaagaaaa

SEQ ID NO: 341270 - RNA, 63 nt, Homo Sapiens
auaugagcuacugaggaggggguuggacauccugccccucaccccccacccacacugcaggua

SEQ ID NO: 341271 - RNA, 63 nt, Homo Sapiens
guuuacauguguagccuauguugugguccaucagccccucacauuccuagggguuugagaugc

SEQ ID NO: 341272 - RNA, 63 nt, Homo Sapiens
caggguagggcugucgccuuagaucccgcccaagccccucauucccuccuugcacagaugcau

SEQ ID NO: 341273 - RNA, 63 nt, Homo Sapiens
ccuaggaaccgccgcugccugcuggggggccacgccccucaugcccuugucccaggcccgggg

SEQ ID NO: 341274 - RNA, 63 nt, Homo Sapiens
gccacaccagccuggauuucaaucccagaaucugccccucacgaggaugugaccuugggcaga

SEQ ID NO: 341275 - RNA, 63 nt, Homo Sapiens
ccgugcuucucccuugggcagccucucucuugagccccucacccuguuucuuucugugaagcg

SEQ ID NO: 341276 - RNA, 63 nt, Homo Sapiens
aauucuuucucauguugggagugagaaugccgggccccucagggcugucggugugcugucagc

SEQ ID NO: 341277 - RNA, 63 nt, Homo Sapiens
uucuagaacacuuggagccugaacucugaccaggccccucacuugagccuuugcuuucugcuc

SEQ ID NO: 341278 - RNA, 63 nt, Homo Sapiens
augacccacuaacguggcaacuuuaacccaaaggccccucagacauguuacagcaaaucugga

SEQ ID NO: 341279 - RNA, 63 nt, Homo Sapiens
gccuccgaggagaccaggaacccugcuucagcagccccucagggcuucccaaggauguccagc

SEQ ID NO: 341280 - RNA, 63 nt, Homo Sapiens
uguggccacagcucuggagugggaggguugguugccccucaccucagagcucccccaaaggcc

SEQ ID NO: 341281 - RNA, 63 nt, Homo Sapiens
ggauuaggagagggggugaugaccccuccccaagccccucagggcccagaccuuccugcucuc

SEQ ID NO: 341282 - RNA, 63 nt, Homo Sapiens
gcucgaccuugcucuuauuagucccucaccccugccccucaugaucucccacuuucucuagcu

SEQ ID NO: 341283 - RNA, 63 nt, Homo Sapiens
gaaggguggggcaggcaguauccagaacagucugccccucaaggucuccagaagucguggccu

SEQ ID NO: 341284 - RNA, 63 nt, Homo Sapiens
cugccugaagagaggaaacucugagccauggcggccccucagcggcuaagaaguucaccagcc

SEQ ID NO: 341285 - RNA, 63 nt, Homo Sapiens
accugaaguccucugcugugccaccuggggacggccccucaucgcuagguuaggcccugcacu

SEQ ID NO: 341286 - RNA, 63 nt, Homo Sapiens
ggcggugucuggggaggacucagccccugggcugccccucagacugcuccaaaaucaucaacu

SEQ ID NO: 341287 - RNA, 63 nt, Homo Sapiens
gaccucacgcugacgagcaaagaagcacuuguggccccucaaggcucgaguuccuggaugugc

SEQ ID NO: 341288 - RNA, 63 nt, Homo Sapiens
cugcccagcuucuacucagaauggauuggugcugccccucaugcaucagggaccuccaggugc

SEQ ID NO: 341289 - RNA, 63 nt, Homo Sapiens
ccuaggccgccuccaggugcgcacccuugagaagccccucaccugcaccucuggaggugcagg

SEQ ID NO: 341290 - RNA, 63 nt, Homo Sapiens
cuccuguggaacccagcaguguuggggauccuggccccucaaccgcuaaggaagauaucuagu

SEQ ID NO: 341291 - RNA, 63 nt, Homo Sapiens
uugggcugggggacugggggacccgaccuggcugccccucaccucuaauccuucucauuaccc

SEQ ID NO: 341292 - RNA, 63 nt, Homo Sapiens
auuaccaugucucccucucagagccucuguccagccccucagucuggcgcuugaggcucagaa

SEQ ID NO: 341293 - RNA, 63 nt, Homo Sapiens
acuggcuugguuuggucuacaggacaacaaacugccccucacuucaaaccauucuaauggaaa

SEQ ID NO: 341294 - RNA, 63 nt, Homo Sapiens
agcccuggggggaauccuaacugaggcagccaggccccucaccuccuccauugaggaugccca

SEQ ID NO: 341295 - RNA, 63 nt, Homo Sapiens
gcguccuccuaccgaaaccucugccuggggcgggccccucauccuuuagagcauugccauucc

SEQ ID NO: 341296 - RNA, 63 nt, Homo Sapiens
guuuuugauugccuucuauagugguccucuaaagccccucauuugcuuauuuguguaauggau

SEQ ID NO: 341297 - RNA, 63 nt, Homo Sapiens
uccccaccuccaggcuuucccacuucccacccugccccucagagacugaaauuacggguaccu

SEQ ID NO: 341298 - RNA, 63 nt, Homo Sapiens
gccuuucccaccuggagagaaacuuccagaccagccccucauaccacagccaagaggggccuu

SEQ ID NO: 341299 - RNA, 63 nt, Homo Sapiens
gccuuucccaccgguagagaaacuuccagaccagccccucacaccacagccaagagaagccuu

SEQ ID NO: 341300 - RNA, 63 nt, Homo Sapiens
gccuuuaccaccuggagagaagcuuccagaccagccccucacaccacagccaggagaggccuu

SEQ ID NO: 341301 - RNA, 63 nt, Homo Sapiens; identical to SEQ ID NO: 341298

SEQ ID NO: 341302 - RNA, 63 nt, Homo Sapiens
gccuuucucaccuggagagaaacuuccagaccagccccucacaccaccgccaggagaggccuu

SEQ ID NO: 341303 - RNA, 63 nt, Homo Sapiens
gccuuucccaccgggagagaaacuuccagaccagccccucacaccacagccaggagaggccuu

SEQ ID NO: 341304 - RNA, 63 nt, Homo Sapiens
gccuuucccaccgggagaggaacuuccagaccagccccucacaccacagccaggagaggccuu

SEQ ID NO: 341305 - RNA, 63 nt, Homo Sapiens
agaaccaccagcaaagccggcggcuggacuggcgccccucagagaccugcggaaagcccccuc

SEQ ID NO: 341306 - RNA, 63 nt, Homo Sapiens
uuuuccagaaauuucucaaaaugucugcugauagccccucacucauauuuuucauguggguuu

SEQ ID NO: 341307 - RNA, 63 nt, Homo Sapiens
ccucgugccucccccucacacacacacccaagugccccucacaucuguguuuccagaaggccc

SEQ ID NO: 341308 - RNA, 63 nt, Homo Sapiens
ccacccucccggcagcucaggugaccagugguggccccucagcugaccagcagaauccacccg

SEQ ID NO: 341309 - RNA, 63 nt, Homo Sapiens
uacccuuaaacaggugauccgacuccccuauccgccccucacuacuccagugcucuggcccgg

SEQ ID NO: 341310 - RNA, 63 nt, Homo Sapiens
auggaagaaaguaaacugcuauucuuuuccugugccccucauaauccacugaaggcuguguuu

SEQ ID NO: 341311 - RNA, 63 nt, Homo Sapiens
cgucgagugagcgucccgaggccacgugcggaggccccucacugugcugucaaaggccugugg

SEQ ID NO: 341312 - RNA, 63 nt, Homo Sapiens
gcuagaaaaucgaguuggcaaaaugggguuugggccccucagagcccugcccugcacccuugu

SEQ ID NO: 341313 - RNA, 63 nt, Homo Sapiens
cucgucacccaucacucccugcuuccgcagggcgccccucaguauucgcugccauaugucccu

SEQ ID NO: 341314 - RNA, 63 nt, Homo Sapiens
ggagauacugggggcagagcagacuuugccagugccccucaggucaaaccaagccaagagcac

SEQ ID NO: 341315 - RNA, 63 nt, Homo Sapiens
gcccacacacccugccuaggccaccccgccgcggccccucaggucgcccuggccacacucaca

SEQ ID NO: 341316 - RNA, 63 nt, Homo Sapiens
ccuaagacccaccgacucugugcuagaacaagcgccccucagagauucugaugccacugaagu

SEQ ID NO: 341317 - RNA, 63 nt, Homo Sapiens
gaggacagucuuuccccagcaggggucaggggggccccucaggaagccuaaggucgugcuagu

SEQ ID NO: 341318 - RNA, 63 nt, Homo Sapiens
cacucccuuuggcuacccuggccgugccuggcagccccucaggccccacagguggguccuggu

SEQ ID NO: 341319 - RNA, 63 nt, Homo Sapiens
cggaaaucucugggacaauggcuccuccagagggccccucagagccaggugcuggccagaugc

SEQ ID NO: 341320 - RNA, 63 nt, Homo Sapiens
uguagcccucugagcccucauccugcaggcagagccccucagugcucugagaaaccugcccug

SEQ ID NO: 341321 - RNA, 63 nt, Homo Sapiens
ugaggccuggcccugggcagggucuguggcugcgccccucaggccagcaguugagguccaucg

SEQ ID NO: 341322 - RNA, 63 nt, Homo Sapiens
agagaagccuccaccugaggggcggucuccgaggccccucaacugguccgcugagggcugggg

SEQ ID NO: 341323 - RNA, 63 nt, Homo Sapiens
uccaggagucaacaugccaacaucuuagaaauagccccucaauagaaaagccgaaaaagcaug

SEQ ID NO: 341324 - RNA, 63 nt, Homo Sapiens
aaggaccuuagaggcagggaaugaguuugggcggccccucauaggagaguaagaacuaaggga

SEQ ID NO: 341325 - RNA, 63 nt, Homo Sapiens
gggagagaaaagcuggaccuucaauguuaaucagccccucaaacuuguaauuguggauuaaug

SEQ ID NO: 341326 - RNA, 63 nt, Homo Sapiens
uacgccaaggaugagcucuauagaacaacaacugccccucauggccaugggcuaaauggguac

SEQ ID NO: 341327 - RNA, 63 nt, Homo Sapiens
aaggcuaacugugaugaugaauauuucccauaagccccucagagaaccuugcauauccuucac

SEQ ID NO: 341328 - RNA, 63 nt, Homo Sapiens
agccaagugugaccccacuguggacuucugugggccccucaacuggauauggugcagagaagc

SEQ ID NO: 341329 - RNA, 63 nt, Homo Sapiens
cccggcaugggcagugcgagaagucugagccaggccccucaggagcaguccccuuggauacua

SEQ ID NO: 341330 - RNA, 63 nt, Homo Sapiens
uucagcugugcuguguuucuuuuagaguccuaagccccucauguuuuuuaagcguuugcacua

SEQ ID NO: 341331 - RNA, 63 nt, Homo Sapiens
caccagcugccccaucccuggcuuuggagguuugccccucaccgaaggaugugagaggugggc

SEQ ID NO: 341332 - RNA, 63 nt, Homo Sapiens
ccagcacuucgcuugcagaaucaaggccagcaagccccucaggcgaggugcugauggagaugc

SEQ ID NO: 341333 - RNA, 63 nt, Homo Sapiens
ccuccucucagucuacucaagcccucugguccagccccucacgucacgccucgcucccuccug

SEQ ID NO: 341334 - RNA, 63 nt, Homo Sapiens
uuuguguacuuuuaaaauuguaucuuuccaggagccccucagauuguaccuugcuuucucacc

SEQ ID NO: 341335 - RNA, 63 nt, Homo Sapiens
gggggaguagaucuuucuaggagggagacacuggccccucaaaucguccagcgaccuuccuca

SEQ ID NO: 341336 - RNA, 63 nt, Homo Sapiens
gggacagugcugcagcucccuggcuucuguggggccccucaccuacuuacccagguggguccc

SEQ ID NO: 341337 - RNA, 63 nt, Homo Sapiens
ccccaaaaccuuuccccagacacauucuccugugccccucagagaggcaugugaugugcaagg

SEQ ID NO: 341338 - RNA, 63 nt, Homo Sapiens
gugaccucaaauguugccuuggaguccccuacagccccucagcagagggcagcacuugaaugc

SEQ ID NO: 341339 - RNA, 63 nt, Homo Sapiens
gggcccuccucccccaccagcucuccccacagggccccucagcaucauggagacccgcaggcg

SEQ ID NO: 341340 - RNA, 63 nt, Homo Sapiens
uuccaagagcaaggaugaaaaauugaagucacagccccucagcaccaagcagaaggugaggac

SEQ ID NO: 341341 - RNA, 63 nt, Homo Sapiens
ugucacaggcugggucaaaagagcccuggcucugccccucagggggccagcuggggagauggg

SEQ ID NO: 341342 - RNA, 63 nt, Homo Sapiens
acuggcugccaacuccugccgcccucugggacugccccucagucccaggagagcuaugaggcc

SEQ ID NO: 341343 - RNA, 63 nt, Homo Sapiens
cccaaagcaguuagacuauggagagccgacccagccccucaggaacccucauccuucaaagac

SEQ ID NO: 341344 - RNA, 63 nt, Homo Sapiens
uccccuagacucaggcuuccuuuggagauuaaggccccucagagaucaacagaccaacauuuu

SEQ ID NO: 341345 - RNA, 63 nt, Homo Sapiens
ugaggcuggcaaguggggcaacguguggaggaagccccucauaauuuggagaaaacuugauac

SEQ ID NO: 341346 - RNA, 63 nt, Homo Sapiens
auugccauacaauuuuaauuuauacaaguauuggccccucaagugguuggaaauuuuuuuuuu

SEQ ID NO: 341347 - RNA, 63 nt, Homo Sapiens
caugaauaggcguacuuucuguauuuaaaaauggccccucaagcaccguuaauuuacauucca

SEQ ID NO: 341348 - RNA, 63 nt, Homo Sapiens
gugcaguaauaaguaaguuguacauaucugggugccccucauacaaagguugggacucugucu

SEQ ID NO: 341349 - RNA, 61 nt, Homo Sapiens
auugucaccaaaaggaagcuggcucuuuucagagccccucaaagucuguccaaccccaaaa

SEQ ID NO: 341350 - RNA, 63 nt, Homo Sapiens
aucacaguuuaacacaagcuccucuguccaggugccccucauccucauugcccacggacccaa

SEQ ID NO: 341351 - RNA, 63 nt, Homo Sapiens
cagaucaccaccccuuacaaauuccaccacagugccccucagccuccuacuguuuaaauuccc

SEQ ID NO: 341352 - RNA, 54 nt, Homo Sapiens
gucacaggggugggggcucuucuugccccucaggacucugauaccuccaacuga

SEQ ID NO: 341353 - RNA, 58 nt, Homo Sapiens
gcccccagagcccgucagcgccccagcagccccucagcggaagcuggccugcgaguga

SEQ ID NO: 341354 - RNA, 63 nt, Homo Sapiens
ugcucuggcuucagaagugaagaugaaggcagcgccccucacuugccagcaagaaugaagcac

SEQ ID NO: 341355 - RNA, 63 nt, Homo Sapiens
accagugaaggacaugcuugcuucugagcccgagccccucauugccugguggagauucccugu

SEQ ID NO: 341356 - RNA, 63 nt, Homo Sapiens
caucggucuuguuuacuagacuccucuuuuccagccccucaacgacuuucaacuugcugacuc

SEQ ID NO: 341357 - RNA, 63 nt, Homo Sapiens
aauggggaagggcugaaagauaugugcaccccagccccucaaaagaugacccaaaucuuucac

SEQ ID NO: 341358 - RNA, 63 nt, Homo Sapiens
aaacaaugcagcagcuacuguuguugaccacacgccccucaccccagucauugacagacggac

SEQ ID NO: 341359 - RNA, 63 nt, Homo Sapiens
ccccagagucaaaaggaaaugcugcuuuaaggagccccucacuaguggcugaguucuuucuua

SEQ ID NO: 341360 - RNA, 63 nt, Homo Sapiens
cugcaucacugaagagcggcgaggcgccgcucagccccucaccccaagcagacuagaugggag

SEQ ID NO: 341361 - RNA, 63 nt, Homo Sapiens
cuguccugccacggccucccagccggugcgggagccccucacugcccugaccgacuccgcagu

SEQ ID NO: 341362 - RNA, 63 nt, Homo Sapiens
cuccacgugagaacaagggugaaggugagggaagccccucaccuugggucuuuugcugugccu

SEQ ID NO: 341363 - RNA, 63 nt, Homo Sapiens
aggaggugaaagaaagggacccaccugcuagucgccccucagagcaugaugggaggugugcca

SEQ ID NO: 341364 - RNA, 63 nt, Homo Sapiens
cccaugaugguaccacaccagggccucagccuggccccucaccacauacccuuugccuuuuag

SEQ ID NO: 341365 - RNA, 63 nt, Homo Sapiens
gugaggggccaggccauggccaaggggccagcugccccucauuuaucacucugaccuucacag

SEQ ID NO: 341366 - RNA, 63 nt, Homo Sapiens
caugaccagaggcuggaguggggguguguuagagccccucaccgggacuugcugugcggaugg

SEQ ID NO: 341367 - RNA, 63 nt, Homo Sapiens
ucaauguuucaucuccaacccucugccaguuuggccccucagagcuugguggcucaagacugu

SEQ ID NO: 341368 - RNA, 63 nt, Homo Sapiens
uccuggugccgccucggccccagccuguccccagccccucaaucuggugcagcagcaucuugu

SEQ ID NO: 341369 - RNA, 63 nt, Homo Sapiens
cucccuccuccagaucccugccuccuagugccagccccucacacgccuucauccugaaacagg

SEQ ID NO: 341370 - RNA, 63 nt, Homo Sapiens
gugccacauggguuccugugccacccuuuccccgccccucaaaucguccuuuaagucuuccuu

SEQ ID NO: 341371 - RNA, 63 nt, Homo Sapiens
aaugcccugccuauuaaaugccgaaccaacccugccccucagauccccuguaaaaugggaccu

SEQ ID NO: 341372 - RNA, 63 nt, Homo Sapiens
gccaggagccccccauggcccgccgcugcaacagccccucaugucgcccacccugugcccugg

SEQ ID NO: 341373 - RNA, 63 nt, Homo Sapiens
ugcgaaagaagagcccagacuguaagggggccugccccucaucagaaccugggccuaucagcg

SEQ ID NO: 341374 - RNA, 63 nt, Homo Sapiens
cauguggcacuucugagcucuucccgggccgcugccccucagcccuggcccugccucuggccc

SEQ ID NO: 341375 - RNA, 63 nt, Homo Sapiens
cggcauccccugcagagucaugaggggacugcugccccucacugcagagaggaggggaggucc

SEQ ID NO: 341376 - RNA, 63 nt, Homo Sapiens
auauuugccuucugcuccuacauggguuucauggccccucaugucuguuacuuccccuuuuuc

SEQ ID NO: 341377 - RNA, 63 nt, Homo Sapiens
cugccuuagcugcacucucucagccucuccccugccccucaacuugcugcaauacugcucccc

SEQ ID NO: 341378 - RNA, 63 nt, Homo Sapiens
cccgccuggcuucgaguuggaacccggacacuugccccucacugguguggauggaaaucugcc

SEQ ID NO: 341379 - RNA, 63 nt, Homo Sapiens
augcaacagggguguugcgggggcaacaugagagccccucacccccaacucuccacuuucagg

SEQ ID NO: 341380 - RNA, 63 nt, Homo Sapiens
ggcacacagaguucauguuugcgcccucucccugccccucaccccagagggugaggaggaaug

SEQ ID NO: 341381 - RNA, 63 nt, Homo Sapiens
agcaccagccaucguguggagcacuaccaaggggccccucagggccuuccugggaggaguccc

SEQ ID NO: 341382 - RNA, 63 nt, Homo Sapiens
cucccucuaauuacagaucccacuuccagccgggccccucauguauccacuggccgaccgcag

SEQ ID NO: 341383 - RNA, 63 nt, Homo Sapiens
cgaccuagaugaugauucuuccuguagcaucuggccccucacaaugucagaggauuuaauugu

SEQ ID NO: 341384 - RNA, 63 nt, Homo Sapiens
accccuccuuuucugagcgccgcuucggguuuggccccucagacgacgcggugcugcugccgc

SEQ ID NO: 341385 - RNA, 63 nt, Homo Sapiens
aguuugccucugaagccuuuuauaauaaaaaaugccccucagauuaaucaaccauauuaaauu

SEQ ID NO: 341386 - RNA, 63 nt, Homo Sapiens
uccagugauucacgcccgccccggugcuuccuggccccucagcagcagagcagaccugauguc

SEQ ID NO: 341387 - RNA, 63 nt, Homo Sapiens
ccuuuccuucccuuucucugccccccagggaaggccccucaugagcccccagccugugaccuu

SEQ ID NO: 341388 - RNA, 63 nt, Homo Sapiens
aaagggaggggagcaaguggggaccuggccauggccccucagcaaaaaccuauucacagcggg

SEQ ID NO: 341389 - RNA, 63 nt, Homo Sapiens
cugcuaggcagcccaggccuggucugggagacagccccucacccugccugggcucuuggccaa

SEQ ID NO: 341390 - RNA, 63 nt, Homo Sapiens
uucuuauuuauugcaugcgucgcuuccacaggggccccucaagagcugugacucgggagagcu

SEQ ID NO: 341391 - RNA, 63 nt, Homo Sapiens
ugucccuucagccggcagagcgagcccagcguggccccucaauuugaaaauggacgucuuuuc

SEQ ID NO: 341392 - RNA, 63 nt, Homo Sapiens
uuaaugaacaagguggaccaaagggcugaaccagccccucaaccaggacccuggggggccugc

SEQ ID NO: 341393 - RNA, 63 nt, Homo Sapiens
gguggcaggagagcggacuuagagcccccgagggccccucagcagaggaaggggaguccccuc

SEQ ID NO: 341394 - RNA, 63 nt, Homo Sapiens
cucgugacugcccagcgccccaggcuggacugagccccucacgccgcccugcagcccccaugc

SEQ ID NO: 341395 - RNA, 63 nt, Homo Sapiens
ugaccagaccacgggcagggccugccuccgugugccccucagcucagccccagcaagugugug

SEQ ID NO: 341396 - RNA, 63 nt, Homo Sapiens
aaugcaucuaucugucugccucuguccuaauuggccccucacccugagguuugggugguguga

SEQ ID NO: 341397 - RNA, 63 nt, Homo Sapiens
caucggaucacugccuucuuccaaccggguagugccccucaccgggaagccuggcaaagcugc

SEQ ID NO: 341398 - RNA, 63 nt, Homo Sapiens
aaaauaaggccuccagguauuuuuuaacccccagccccucaaagaauugucaucuuugguguu

SEQ ID NO: 341399 - RNA, 63 nt, Homo Sapiens
ugaccuuucaccucugucugccucuuugcuguggccccucauuaaggcuguggcugcuaguga

SEQ ID NO: 341400 - RNA, 63 nt, Homo Sapiens
cgcugagauccaguguccaagcgccccacagcugccccucagcacuuccgcaucugcccgugg

SEQ ID NO: 341401 - RNA, 63 nt, Homo Sapiens
ucuccaggacaggacaggacuucacaccagacagccccucauguucugucccuccuacuuucc

SEQ ID NO: 341402 - RNA, 63 nt, Homo Sapiens
ccuccguuccuccucagccuccgcaaguccccagccccucaacaugugcuugugccuaccugg

SEQ ID NO: 341403 - RNA, 63 nt, Homo Sapiens
cagcugccauuagcuuggcuagcuguuuucuuagccccucagcggaaacgggacaaaaccuua

SEQ ID NO: 341404 - RNA, 63 nt, Homo Sapiens
uccccuucccugagcuccuucacagucccacuggccccucaccuugcacaugcucacccccag

SEQ ID NO: 341405 - RNA, 63 nt, Homo Sapiens
ugugcccagcauuuugugugucagccccgcugagccccucauucacuggaugggauguacuuc

SEQ ID NO: 341406 - RNA, 63 nt, Homo Sapiens
caccugugccguguggccauagagcuaucccccgccccucaagcuucuccuugaggcagcugg

SEQ ID NO: 341407 - RNA, 63 nt, Homo Sapiens
gucuccuccucaccccaccccucaauucucuaagccccucagguggcgccccuucucuccaag

SEQ ID NO: 341408 - RNA, 63 nt, Homo Sapiens
cacacaccaccccaugucacuguccuccuggcagccccucaaaccgaagcaggcguccaucug

SEQ ID NO: 341409 - RNA, 63 nt, Homo Sapiens
guucaucuccagcagagacagugugguuacagcgccccucagucccgaugucacaggcagucu

SEQ ID NO: 341410 - RNA, 63 nt, Homo Sapiens
cgccccguggucggaagagcacucccuucccuggccccucauccagccuccggugcuguaaaa

SEQ ID NO: 341411 - RNA, 63 nt, Homo Sapiens
ccuuucuggcauccuggccucucgugguccucagccccucacccccaguacugcagaucucac

SEQ ID NO: 341412 - RNA, 63 nt, Homo Sapiens
cuccuuguggggucccagguccugcugccaagagccccucaagagaagggcugaaccugggga

SEQ ID NO: 341413 - RNA, 62 nt, Homo Sapiens
ugggggcacguuguccgugauaaaaguacaagugccccucaccgcccguggagauugcuuuc

SEQ ID NO: 341414 - RNA, 63 nt, Homo Sapiens
gacucccagcagcagagcccaagcacuggcuucgccccucagugcccuggggcauguucaggg

SEQ ID NO: 341415 - RNA, 63 nt, Homo Sapiens
cccgcauugaucuaaauaaacaguggaaugagggccccucagcccuggucccccuuugcccug

SEQ ID NO: 341416 - RNA, 63 nt, Homo Sapiens
cccucuggaugcuacaugggucccagaagcccagccccucaacugggcucagauacugugaca

SEQ ID NO: 341417 - RNA, 63 nt, Homo Sapiens
cugcccuggaaucaacaucuccucauccugucugccccucacuuguuggacuuuacagaagag

SEQ ID NO: 341418 - RNA, 63 nt, Homo Sapiens
cccuccuccuuaauuucccacccucugaggucggccccucagacucucgauuucucuaucugu

SEQ ID NO: 341419 - RNA, 63 nt, Homo Sapiens
cacguggaugauggggucagagaucacugagcugccccucaagggggccuggaacccgggugc

SEQ ID NO: 341420 - RNA, 63 nt, Homo Sapiens
agcccugcccgaggcugaggcugggccggcgcugccccucaucuuagcauugggcagacacca

SEQ ID NO: 341421 - RNA, 63 nt, Homo Sapiens
ccuuguuaaugaugcuccugccucugccucccagccccucacccagcacagcucugccuggac

SEQ ID NO: 341422 - RNA, 63 nt, Homo Sapiens
ggcagacccccaccaccauacaugcugucuguggccccucagacauucuguuucaucucccau

SEQ ID NO: 341423 - RNA, 63 nt, Homo Sapiens
cugucaccucccucucaccaacccggggucugagccccucauuccugaccguccguguucuca

SEQ ID NO: 341424 - RNA, 63 nt, Homo Sapiens
gauuuauaaguacugagcaugaaguacuugucugccccucauuucaaggccagaguuauuuuc

SEQ ID NO: 341425 - RNA, 63 nt, Homo Sapiens
cugguuagguggggacagaggauuucugcuuaggccccucaggacccagggaaugccagggac

SEQ ID NO: 341426 - RNA, 63 nt, Homo Sapiens
gguaucuuuggcaaggcuaccaguuggacguaagccccucaugcugacucagggugggcccug

SEQ ID NO: 341427 - RNA, 63 nt, Homo Sapiens
aagagcaccccaucuucaggccucucagccgaugccccucagcacagaccccagagccaggaa

SEQ ID NO: 341428 - RNA, 63 nt, Homo Sapiens
gcugugcccgcccugccccgagggaugucgagggccccucacacccgacgccggcggggaggc

SEQ ID NO: 341429 - RNA, 63 nt, Homo Sapiens
gucccccaaacacaagcacacagggagccgagugccccucagagccaggcagcggggcaggga

SEQ ID NO: 341430 - RNA, 63 nt, Homo Sapiens
uaaaucacaucuagugacugacucccuacaacagccccucaaaccugcaugcuguguauccua

SEQ ID NO: 341431 - RNA, 63 nt, Homo Sapiens
gucugcccagccaggcuccuggcggacccacaggccccucaggucgucuuccuccugcagaca

SEQ ID NO: 341432 - RNA, 63 nt, Homo Sapiens
uggcacaucuggagggcaggcagugcccacccagccccucaggcuucuugccuaccacuuggc

SEQ ID NO: 341433 - RNA, 63 nt, Homo Sapiens
augcagcugcauggguuuuuagggcaggagcaagccccucacagaugaaccugcuuauaccua

SEQ ID NO: 341434 - RNA, 63 nt, Homo Sapiens
cagcccccugccccgcaggcggcuggugccugagccccucagacaucagugccagccccugcu

SEQ ID NO: 341435 - RNA, 63 nt, Homo Sapiens
ccuggagaguuaucuacagacgaauuuuugacagccccucaggcaccagaauuuugaaaaucc

SEQ ID NO: 341436 - RNA, 63 nt, Homo Sapiens
ugcccuucccuggaggucucucccucccccagagccccucaugccacagugguacucuguguc

SEQ ID NO: 341437 - RNA, 63 nt, Homo Sapiens
gcccucaauccaccuucaggccccgccccaugggccccucaccgcugguuggaaagaguguug

SEQ ID NO: 341438 - RNA, 63 nt, Homo Sapiens
uggguugcugccugaugacaagggguuguuucagccccucagucaugcugccuucugcugcuc

SEQ ID NO: 341439 - RNA, 63 nt, Homo Sapiens
gagcugggccccagcccagugacuggcucauuugccccucaagcacgaguuugcauguuuagu

SEQ ID NO: 341440 - RNA, 63 nt, Homo Sapiens
gugguggggcugggccauggagcuggcccagaggccccucagcccuuuguaaagucugaugaa

SEQ ID NO: 341441 - RNA, 63 nt, Homo Sapiens
gaaccuaacaauuuaaagacacugggaacacuugccccucaguauaguacugucaagggaagc

SEQ ID NO: 341442 - RNA, 63 nt, Homo Sapiens
uuugcaaagagccacccuaggcuuccuuagcuugccccucagcaagggccccugaccugccug

SEQ ID NO: 341443 - RNA, 63 nt, Homo Sapiens
uuguccacguaucaggaaugcagagcgauugcggccccucaccccccaucuuuaaaaugcugc

SEQ ID NO: 341444 - RNA, 63 nt, Homo Sapiens
uagcugggacuacaggugcaaucucucgccucagccccucaagaaucucgacucacugcagcu

SEQ ID NO: 341445 - RNA, 63 nt, Homo Sapiens
uucuccuucuugauuccaaagccuagggccccugccccucacccuugaccagcgugcugacug

SEQ ID NO: 341446 - RNA, 63 nt, Homo Sapiens
uuccucuccucaucucuggcuccucuccuccgggccccucagugguucccacccuccuccacc

SEQ ID NO: 341447 - RNA, 63 nt, Homo Sapiens
uaauauagcacagaguuauguacauuuuucuuagccccucaagcuacuguguuucacugacca

SEQ ID NO: 341448 - RNA, 63 nt, Homo Sapiens
ccaagccugucccacuggggcuaccucccagaagccccucaugauggaggaggugugggcuga

SEQ ID NO: 341449 - RNA, 63 nt, Homo Sapiens
gcccucuccucaaacuccucacacaucacgccugccccucaccguagaggccucguuucugcc

SEQ ID NO: 341450 - RNA, 63 nt, Homo Sapiens
ucucugcccaacccuucccucugcacugaugcugccccucaucauuuggguucugccugccag

SEQ ID NO: 341451 - RNA, 51 nt, Homo Sapiens
uaugccaucuccauaagcacagccccucacccugccugcaguccuguguga

SEQ ID NO: 341452 - RNA, 63 nt, Homo Sapiens
ugcaucuucagauccaguacaucccaagacugugccccucaucgggaaguuccccaacacaua

SEQ ID NO: 341453 - RNA, 63 nt, Homo Sapiens
ccugcacucugggugucucccaggagugagugagccccucagaaugcuuucugccucugguaa

SEQ ID NO: 341454 - RNA, 63 nt, Homo Sapiens
gcaggcccacagcacucugagugcuugcuaugugccccucaugucagggccugcauuuaugga

SEQ ID NO: 341455 - RNA, 63 nt, Homo Sapiens
uggcagaguccauaguggagauucucaggcugggccccucaccagggcagccccagcagcugg

SEQ ID NO: 341456 - RNA, 63 nt, Homo Sapiens
gguuuccucggcccuccuggccucgggcuucucgccccucagucgcugugcccugguuucccu

SEQ ID NO: 341457 - RNA, 63 nt, Homo Sapiens
ccagaccccccuucuaaggagagucccuuggcagccccucaccccaggaugaccccacagcca

SEQ ID NO: 341458 - RNA, 63 nt, Homo Sapiens
uaccuggggaagaguaaaggccugaauucccccgccccucaguguuguuccucuguuaucaug

SEQ ID NO: 341459 - RNA, 63 nt, Homo Sapiens
gcccucaagugccuucugugcauuggcugcaaagccccucaaauuucccauugucacggaaaa

SEQ ID NO: 341460 - RNA, 63 nt, Homo Sapiens
gcacucggcccaguccugccgccguguccaggcgccccucacccccacaccugcugcauggcu

SEQ ID NO: 341461 - RNA, 63 nt, Homo Sapiens
cccccaacccccaacccccuauucuucuuccucgccccucagccgguuuuguuuuuguuucuc

SEQ ID NO: 341462 - RNA, 63 nt, Homo Sapiens
ggcugagugggagggcggcccuuuccagccucugccccucaggggaacccuguagcuuugugu

SEQ ID NO: 341463 - RNA, 63 nt, Homo Sapiens
aucucuccaaaccccauacccuucaaugcuguggccccucagugacuuccuugggugauccug

SEQ ID NO: 341464 - RNA, 63 nt, Homo Sapiens
auggcaggcuacaguugggaagucucagccugggccccucagccacccuuggucucaugcccc

SEQ ID NO: 341465 - RNA, 63 nt, Homo Sapiens
cccugccccauucuggugucuuuccacuccucagccccucaucuugccuccacccagcugcuc

SEQ ID NO: 341466 - RNA, 63 nt, Homo Sapiens
uccuucagccaccuggccauaccccuuaaauaagccccucaccuugcugccucaggaccuuca

SEQ ID NO: 341467 - RNA, 63 nt, Homo Sapiens
cuggcugcaagcuguggguucuuucuccucugugccccucaugcugaucuucuagaugccacu

SEQ ID NO: 341468 - RNA, 63 nt, Homo Sapiens
ccacacggccccuucccagccagcccgccgcccgccccucaguuugguagugccccaccuccc

SEQ ID NO: 341469 - RNA, 63 nt, Homo Sapiens
cgcccauccugcacacggggccgcugggcaggugccccucacacccccaggaugucagugcuc

SEQ ID NO: 341470 - RNA, 63 nt, Homo Sapiens
cugggcucuggaccaugagccugugcacagguagccccucauguacugaaaacugaccaaggc

SEQ ID NO: 341471 - RNA, 63 nt, Homo Sapiens
cucuucuuacuaagucucagggagagaggaguagccccucagacccaguaacuggggccacgg

SEQ ID NO: 341472 - RNA, 63 nt, Homo Sapiens
cuugcaccccagcacugagauugucccccaucggccccucagccugccuccuggugguggcca

SEQ ID NO: 341473 - RNA, 63 nt, Homo Sapiens
aaugcuccagcgauuccaaacugcagccccucugccccucaccaaaaccugcggggcugcuug

SEQ ID NO: 341474 - RNA, 63 nt, Homo Sapiens
ugugugucuguuuugguuugugagaaaguagcugccccucauucuggccaguucuuuccagua

SEQ ID NO: 341475 - RNA, 63 nt, Homo Sapiens
aguagugccgaugugccacacugcccaguugaggccccucacgcucugugccccuagauccuu

SEQ ID NO: 341476 - RNA, 63 nt, Homo Sapiens
cauggcaacucaaagugccuuccaaaccaaacugccccucaugagguuagggucccccacccu

SEQ ID NO: 341477 - RNA, 63 nt, Homo Sapiens
acuucccgagaacaaacaggccugcucacaacugccccucaaguucaaccccgggaccgccca

SEQ ID NO: 341478 - RNA, 63 nt, Homo Sapiens
uucgugacugaggccccucuuggggcacucacugccccucauccccagaaauuauuuuucuac

SEQ ID NO: 341479 - RNA, 63 nt, Homo Sapiens
aguccacuccuagccccggcauccugcucuagggccccucaugccccaggcuggagcagcucu

SEQ ID NO: 341480 - RNA, 63 nt, Homo Sapiens
ggagccaagaagcacagagacacagaggcgccugccccucagcuccgcuggucugucugugca

SEQ ID NO: 341481 - RNA, 63 nt, Homo Sapiens
gggcaggccauggccuacagacaccccauucuugccccucacucuccacugagcuccucuguc

SEQ ID NO: 341482 - RNA, 63 nt, Homo Sapiens
gguguccuuuuaaaaaauauaacaccagauggugccccucauuccagcuuucugguuaagguu

SEQ ID NO: 341483 - RNA, 63 nt, Homo Sapiens
cugggggaagaagagggccucacaguucucccugccccucagcgggaguccgggcaugguggg

SEQ ID NO: 341484 - RNA, 63 nt, Homo Sapiens
ccaaccccgcccuaggccugccucccagccccugccccucaugugacccaggcugccugagca

SEQ ID NO: 341485 - RNA, 63 nt, Homo Sapiens
acgucugagcccagcuuucugcgugcccuccuggccccucacucccggcagcgggccggccuc

SEQ ID NO: 341486 - RNA, 63 nt, Homo Sapiens
gaagggcccggugggacguggguagugugugaagccccucagccugggucccgccuagccuaa

SEQ ID NO: 341487 - RNA, 63 nt, Homo Sapiens
gcccggaggucccaaggucccugggaggacugggccccucaugccucgagcuuggcaaccgaa

SEQ ID NO: 341488 - RNA, 63 nt, Homo Sapiens
aggagaaggaugccugggugccaggcaagacaagccccucagcaggagagaggcccagaggcu

SEQ ID NO: 341489 - RNA, 63 nt, Homo Sapiens
uagguucaccugcaaaacaaaaaucuuacuccagccccucaaugccauccugacacacuuuau

SEQ ID NO: 341490 - RNA, 63 nt, Homo Sapiens
gccccuuuuguguuuugguucaaguuucucagagccccucagagcuucuacaucugugcauca

SEQ ID NO: 341491 - RNA, 63 nt, Homo Sapiens
cugggaucuccuucucccuccuguccuguccuugccccucaggacugcuggaaaauaaauccu

SEQ ID NO: 341492 - RNA, 63 nt, Homo Sapiens
gcaugccuggauggggcugcaccggcuggccuggccccucagggucccugguggcagcucacc

SEQ ID NO: 341493 - RNA, 63 nt, Homo Sapiens
ucgucauggaccgagguucccacucugggcaaagccccucacacugcaagggauuguagauaa

SEQ ID NO: 341494 - RNA, 63 nt, Homo Sapiens
ucagguucugccugagcccagccuaccaggcuugccccucagcucagcacuguugaccacgcu

SEQ ID NO: 341495 - RNA, 63 nt, Homo Sapiens
cacuggcccuggguggcucugucagggugcacagccccucaugccuggagcaaugagggucua

SEQ ID NO: 341496 - RNA, 63 nt, Homo Sapiens
cuaccccucaacagagaugacuuugaugacucugccccucagcagggcuuacuaagcacuacc

SEQ ID NO: 341497 - RNA, 63 nt, Homo Sapiens
agcacuaccccuuaacagggaugacuccgcacugccccucaacagggaugacucagcagagau

SEQ ID NO: 341498 - RNA, 63 nt, Homo Sapiens
gcagggaugacacagcaaggaugacucagcacugccccucagcaaggaugacucagcacugcc

SEQ ID NO: 341499 - RNA, 63 nt, Homo Sapiens
ucaacagacaugacucagggauggcuuaguacugccccucagcagggaugacucagcaccgcc

SEQ ID NO: 341500 - RNA, 63 nt, Homo Sapiens
acagggaugacucagcagggaugacucagcaccgccccucaacaggcaugacucugcagagau

SEQ ID NO: 341501 - RNA, 63 nt, Homo Sapiens; identical to SEQ ID NO: 341498

SEQ ID NO: 341502 - RNA, 63 nt, Homo Sapiens
ucaacagggaugacucagggauggcuuaguacugccccucaacagggaugacucagcagggau

SEQ ID NO: 341503 - RNA, 63 nt, Homo Sapiens; identical to SEQ ID NO: 341500

SEQ ID NO: 341504 - RNA, 63 nt, Homo Sapiens
acaggcaugacucugcagagaugacuuaguacugccccucagcagggaugacucaguacugcc

SEQ ID NO: 341505 - RNA, 63 nt, Homo Sapiens
aguacugccccucagcagggaugacucaguacugccccucagcagggaugacucagcacugcc

SEQ ID NO: 341506 - RNA, 63 nt, Homo Sapiens
aguacugccccucagcagggaugacucagcacugccccucaacagggaugacucagcagggau

SEQ ID NO: 341507 - RNA, 63 nt, Homo Sapiens
gcagugaugacacagcaaggaugacucagcacugccccucagcaaggaugacucagcacugcc

SEQ ID NO: 341508 - RNA, 63 nt, Homo Sapiens; identical to SEQ ID NO: 341499

SEQ ID NO: 341509 - RNA, 63 nt, Homo Sapiens
aguacugccccucagcagggaugacucagcaccgccccucaacagggaugacucagcacugcc

SEQ ID NO: 341510 - RNA, 63 nt, Homo Sapiens
agcaccgccccucaacagggaugacucagcacugccccucaacagggaugacucagcagggau

SEQ ID NO: 341511 - RNA, 63 nt, Homo Sapiens
gcagcgaugacacagcaaggaugacucagcacugccccucaccaaggaugacucagcacugcc

SEQ ID NO: 341512 - RNA, 63 nt, Homo Sapiens
ucaacagacaugacucagggauggcuuaguacugccccucagcagggaugacucagcagggau

SEQ ID NO: 341513 - RNA, 63 nt, Homo Sapiens
acagggaugacucagcagggaugacucagcacugccccucaacagggaugacugcagggauga

SEQ ID NO: 341514 - RNA, 63 nt, Homo Sapiens
caacagggaugacugcagggaugacucagcacugccccucagcagggaugacucagcacugcc

SEQ ID NO: 341515 - RNA, 63 nt, Homo Sapiens
agcacugccccucagcagggaugacucagcacugccccucagcagggaugacucagcagggau

SEQ ID NO: 341516 - RNA, 63 nt, Homo Sapiens
gcagggaugacucagcagggaugacucagcaccgccccucaacaggcaugacucugcagagau

SEQ ID NO: 341517 - RNA, 63 nt, Homo Sapiens
acaggcaugacucugcagagaugacucagcacugccccucagcagggauggcucagcagggau

SEQ ID NO: 341518 - RNA, 63 nt, Homo Sapiens
gcagggauggcucagcagggaugacucagcauugccccucaacagggaugacucagcagacuc

SEQ ID NO: 341519 - RNA, 63 nt, Homo Sapiens
acucagcagacucagcagggaugacucagcacugccccucaacagacaugacucagcagggau

SEQ ID NO: 341520 - RNA, 63 nt, Homo Sapiens
acagacaugacucagcagggaugacucagcaccgccccucagcaaggaugacucagcagggau

SEQ ID NO: 341521 - RNA, 63 nt, Homo Sapiens
gcucugugcagauccugucgcccugcguccucugccccucacugccugggagacccaucuggu

SEQ ID NO: 341522 - RNA, 63 nt, Homo Sapiens
gggcggcagaggcaacuucaggggccgccacaggccccucacgggccuggcugggcugggucu

SEQ ID NO: 341523 - RNA, 63 nt, Homo Sapiens
uggccaccugccagggcacccacuugugccucagccccucaccggcagccaaguuccugauag

SEQ ID NO: 341524 - RNA, 59 nt, Homo Sapiens
cccagcuggaaauuaagaaagcuuccugggccccucaccgaacaugcagaaggcacuaa

SEQ ID NO: 341525 - RNA, 63 nt, Homo Sapiens
caccauggaccagcccauuggccagagccucuggccccucaccuuuuacugccuguagcaaug

SEQ ID NO: 341526 - RNA, 63 nt, Homo Sapiens
cuuccucugggaccagaugucaagccccagagagccccucaucgacacaaggugggcugcccu

SEQ ID NO: 341527 - RNA, 63 nt, Homo Sapiens
gaagggagacuggcccugcccagccggucucuagccccucagcccccgcugggcacucucugu

SEQ ID NO: 341528 - RNA, 63 nt, Homo Sapiens
gugcagacaaauucagcaauaguaugcagaucagccccucaccaccucauuguucucaucugg

SEQ ID NO: 341529 - RNA, 63 nt, Homo Sapiens
ccccaacccucagacccucgccuuccaaggcaggccccucagccuggccugcucucaccaccu

SEQ ID NO: 341530 - RNA, 63 nt, Homo Sapiens
cuccuuccuggucuggcccagcuggcuuccccagccccucagccauccagggcuacccacugc

SEQ ID NO: 341531 - RNA, 63 nt, Homo Sapiens
cagccuuaacucgaugguccgucccugccaggugccccucacucuuccugaccccaaagccag

SEQ ID NO: 341532 - RNA, 63 nt, Homo Sapiens
gugcuccaggauaacaaagaagggcagguugaagccccucauggaaggagcuggcuuuguggg

SEQ ID NO: 341533 - RNA, 63 nt, Homo Sapiens
ggcacucaaugcagccagaccuauuccuccugggccccucaucugcucagcagcuauuugaau

SEQ ID NO: 341534 - RNA, 63 nt, Homo Sapiens
acauccugcaguccccaccaguccugaccgugggccccucaggggucugggagugugacguug

SEQ ID NO: 341535 - RNA, 63 nt, Homo Sapiens
aaccugugaugaggggaggaaacucaccugcuggccccucaccugggcaccuggggaguggga

SEQ ID NO: 341536 - RNA, 63 nt, Homo Sapiens
cggacugccgccucuggguccccccaccguggugccccucaccauccuccugggggagcaggg

SEQ ID NO: 341537 - RNA, 63 nt, Homo Sapiens
gaucuguagccagucagaggaggaggagaaggagccccucagcagaguggugcaguuucgcuc

SEQ ID NO: 341538 - RNA, 63 nt, Homo Sapiens
cugugaaaaggcuuccugugaccuccgauggcggccccucauuggccaagggcacuguggaug

SEQ ID NO: 341539 - RNA, 63 nt, Homo Sapiens
cugaagagcaagguuucguggcagcacggcccggccccucacccucuguccccacgaggggac

SEQ ID NO: 341540 - RNA, 63 nt, Homo Sapiens
cuucuuccccuucuaguugaucccuccagaauagccccucacccccuccuugcccgccuaccc

SEQ ID NO: 341541 - RNA, 63 nt, Homo Sapiens
cugccuugcagaccaaugggccccacauccaaagccccucagccucacaucccuuuccuaguc

SEQ ID NO: 341542 - RNA, 63 nt, Homo Sapiens
uaaaaacgguuauacuauaaugcccucucuuaggccccucauuacauaggacuaaccagccac

SEQ ID NO: 341543 - RNA, 63 nt, Homo Sapiens
ugggacccaggcguucucagagucccuggugcugccccucagggggagguugguggaccaugg

SEQ ID NO: 341544 - RNA, 63 nt, Homo Sapiens
acugagggcagaagaaauuggggaggauagggagccccucaugugcaccugggaccauaggau

SEQ ID NO: 341545 - RNA, 63 nt, Homo Sapiens
caggagccaguggcaggagcacccacagggccagccccucagcgccacugggugagcagaguc

SEQ ID NO: 341546 - RNA, 52 nt, Homo Sapiens
ccgcugccccgccuguccccaagccccucaccauucuuccaucuccuucuag

SEQ ID NO: 341547 - RNA, 63 nt, Homo Sapiens
ccuugaugcccaugcuaauguucccaacaaugugccccucaccggcagggaguugugagcgcc

SEQ ID NO: 341548 - RNA, 63 nt, Homo Sapiens
cuccaggcugcugugagaguggcgagccccucggccccucaccagccugggucagaaggggug

SEQ ID NO: 341549 - RNA, 63 nt, Homo Sapiens
agggcagggccaguccuggcccagugccaaaccgccccucagcccuuuccuuggcccucacug

SEQ ID NO: 341550 - RNA, 63 nt, Homo Sapiens
uccagcuugccuguuucuuccugggaaguccuagccccucacuuaguaugcccuguaauuuuu

SEQ ID NO: 341551 - RNA, 63 nt, Homo Sapiens
ggguucggaggagagucagggggggagccaccagccccucacuguuuuugagggggucaugcc

SEQ ID NO: 341552 - RNA, 63 nt, Homo Sapiens
ugaggaggagcuggccugcgcauucgaaucucugccccucacuuggccugggggaggucagaa

SEQ ID NO: 341553 - RNA, 63 nt, Homo Sapiens
ccugucacuaagcagcacgucaagccgacuaaggccccucaacacagugaggccaccuugagu

SEQ ID NO: 341554 - RNA, 63 nt, Homo Sapiens
ccugcuggaacagggucugcgggccacacggcugccccucagccaggugcugcacugaccgcu

SEQ ID NO: 341555 - RNA, 63 nt, Homo Sapiens
gaauggugcacugguuuaauuguguuggugucggccccucacaaaugcagccaagucauguaa

SEQ ID NO: 341556 - RNA, 63 nt, Homo Sapiens
ggugggauccugaaggcacuagcugacagacgggccccucaauccuguccucugaaggauugu

SEQ ID NO: 341557 - RNA, 63 nt, Homo Sapiens
uggcucugaggucacaucagcuagguuugggaggccccucagcuugguuugggagugcccgug

SEQ ID NO: 341558 - RNA, 63 nt, Homo Sapiens
cucaugacaaaggaagggacucaaagcagcaaugccccucauaguguaggcuaaggugaguuu

SEQ ID NO: 341559 - RNA, 63 nt, Homo Sapiens
cgcugagauuacaggugugagccaccgugcccagccccucaguagguuuuaaggagcccccag

SEQ ID NO: 341560 - RNA, 63 nt, Homo Sapiens
ccgggcccccgcgccucugccggacacggaccggccccucagcccccaccgaggacgcagcca

SEQ ID NO: 341561 - RNA, 63 nt, Homo Sapiens
auuugugcguuccagaaaagggcccagcucugagccccucacccuuccacacucacgaacucu

SEQ ID NO: 341562 - RNA, 63 nt, Homo Sapiens
uucuuucaguucucccaugcagccgaggcccgggccccucaggacuccaaggagacggugcag

SEQ ID NO: 341563 - RNA, 63 nt, Homo Sapiens
ccaugaaugaaaugacucagggaaguguuuguugccccucaugccuccuuucucacuuuagaa

SEQ ID NO: 341564 - RNA, 63 nt, Homo Sapiens
cucuggcagugaugaugguacuuccuguugucagccccucaagcccagcugcaaccagucugg

SEQ ID NO: 341565 - RNA, 63 nt, Homo Sapiens
ugcccucgcuccgccccaucaguuccugccccugccccucaugcagacugcccugcuggggcc

SEQ ID NO: 341566 - RNA, 63 nt, Homo Sapiens
cccuaggccaccucgcggaagccuucagccuccgccccucacugcagccccuugggacuugag

SEQ ID NO: 341567 - RNA, 63 nt, Homo Sapiens
gguguugggaaccaugccugccagccaguaugugccccucacccaggccuggcugggcccugg

SEQ ID NO: 341568 - RNA, 63 nt, Homo Sapiens
ccugcucugagcgcucaccccugcugaggcucagccccucaacccgguggcauucugggggag

SEQ ID NO: 341569 - RNA, 63 nt, Homo Sapiens
accgcuguugagcagccuggugguacuggccacgccccucaaggcaaggcuccuccccuuagg

SEQ ID NO: 341570 - RNA, 63 nt, Homo Sapiens
cucagcccagcugacugugccuguucugagugagccccucacucagccggggcccucccaccu

SEQ ID NO: 341571 - RNA, 63 nt, Homo Sapiens
uggggggucuugguuuaugcucccugcccuugagccccucagccguuugcccugcccccaccu

SEQ ID NO: 341572 - RNA, 63 nt, Homo Sapiens
acagcggugggaucucugcugccagcucucccagccccucagcuucgcagccuggcgcagcau

SEQ ID NO: 341573 - RNA, 63 nt, Homo Sapiens
uguccccaccccagggccacuuagcugacaccagccccucagaggaccagugcgccccauccc

SEQ ID NO: 341574 - RNA, 63 nt, Homo Sapiens
uccuugucucauccccgaagauccgucccccuggccccucaguguccaugucuugagcuuaau

SEQ ID NO: 341575 - RNA, 63 nt, Homo Sapiens
uccccuccuguucacucucccaacccugcuccagccccucagcuucccagacccucaugcagu

SEQ ID NO: 341576 - RNA, 63 nt, Homo Sapiens
ccagccuaggacgccaacuucucccaccccuuggccccucacauccucuccaggaagggagug

SEQ ID NO: 341577 - RNA, 63 nt, Homo Sapiens
cucuuucuccuucuucccugagucucucuccaugccccucaucucuuccuuuugcccucgccu

SEQ ID NO: 341578 - RNA, 63 nt, Homo Sapiens
cuucuggaccugcccccacuguggccugcaugcgccccucacgccccuggagcgcaucgccca

SEQ ID NO: 341579 - RNA, 63 nt, Homo Sapiens
ccagagcugaccccacuccaggaccuaggcccagccccucagccucaucuggagccccugaag

SEQ ID NO: 341580 - RNA, 63 nt, Homo Sapiens
cacauguuuucggcaacguguucccguguccuggccccucacgggcccccacacucuccugac

SEQ ID NO: 341581 - RNA, 63 nt, Homo Sapiens
ugcccccucucugagagcccuggccagcucuucgccccucaccucuuugaaacucuggacgua

SEQ ID NO: 341582 - RNA, 63 nt, Homo Sapiens
ugcaaacuucucccggguccagcgccuggggcugccccucaagauggucauguacucagcugu

SEQ ID NO: 341583 - RNA, 63 nt, Homo Sapiens
uuccuuggaccguaucacugguccaccuccugagccccucaauccuaucacagucuacugacu

SEQ ID NO: 341584 - RNA, 63 nt, Homo Sapiens
ccagcuucccaaugccuggcacgacgcacccaagccccucaguaaggccaccugacuccuauc

SEQ ID NO: 341585 - RNA, 63 nt, Homo Sapiens
ugagguuccaaguugcaacuaacauauauacuugccccucaggucuucuuccgacugguacug

SEQ ID NO: 341586 - RNA, 63 nt, Homo Sapiens
ggagccccgggaguguccaagcgggaaucaugugccccucagccaucucaaaagaaguccaaa

SEQ ID NO: 341587 - RNA, 63 nt, Homo Sapiens
acacccagaaccccaccccuuucccccagccccgccccucaggcugaguugggggagcgaccc

SEQ ID NO: 341588 - RNA, 63 nt, Homo Sapiens
ccucccagcccacuucugccccacagccccccagccccucagcacuuuucccuuccucuuucc

SEQ ID NO: 341589 - RNA, 63 nt, Homo Sapiens
caugggcccuacaguccccuacucucuccaggugccccucagcgaggcaguggcuggugggcc

SEQ ID NO: 341590 - RNA, 61 nt, Homo Sapiens
accagaguccccucuuacuguaaaagccuucaggccccucacacccuauggaccagucaaa

SEQ ID NO: 341591 - RNA, 63 nt, Homo Sapiens
uggagcugguugggccgcggagcucguuucacagccccucagggaggcugagguggcugcagg

SEQ ID NO: 341592 - RNA, 63 nt, Homo Sapiens
acccucucaacaccccccucucccuggggcugcgccccucaacaaccucuccccuaacccugc

SEQ ID NO: 341593 - RNA, 63 nt, Homo Sapiens
gacuuuuuuuuguuuguuuuaacaagccccacagccccucaaaagcagagcgggacucugucc

SEQ ID NO: 341594 - RNA, 63 nt, Homo Sapiens
ugugcugugcugugucugcaggugaaagggagggccccucaugugugcccugccuucagcuuu

SEQ ID NO: 341595 - RNA, 63 nt, Homo Sapiens
gccaaacagauggggaggcccaaagcaaggcuugccccucagaggagcucacgcagggcagga

SEQ ID NO: 341596 - RNA, 63 nt, Homo Sapiens
aguuuggcagcuugacuucugcagcuggaggaggccccucaggccggggaucuggggagggcu

SEQ ID NO: 341597 - RNA, 63 nt, Homo Sapiens
aacagccgacuuugagcauuguuucuucuaacugccccucaacuaccauuaucuucaagucaa

SEQ ID NO: 341598 - RNA, 63 nt, Homo Sapiens
gacagcaggccuggcacugggaggugggggugagccccucacagccuugccccuccccaaggc

SEQ ID NO: 341599 - RNA, 63 nt, Homo Sapiens
ggccacuggggccaccacccugaccaccacugugccccucauuguuacugccuugugagauaa

SEQ ID NO: 341600 - RNA, 63 nt, Homo Sapiens
cuuuuuuuuaggccccugccugucugcccaucugccccucacccacccgaggcucugcccacc

SEQ ID NO: 341601 - RNA, 63 nt, Homo Sapiens
ccuuuacuaaaacacuuucucugaaccccccuugccccucacugaucuugcuuuucccugguc

SEQ ID NO: 341602 - RNA, 63 nt, Homo Sapiens
cauguauauagguccugaugccuucccaaccccgccccucacccuguugccaccuuguuucau

SEQ ID NO: 341603 - RNA, 63 nt, Homo Sapiens
uccucucggugggaugggcaccacagacaggaggccccucaggcccgugcgggccacugucug

SEQ ID NO: 341604 - RNA, 63 nt, Homo Sapiens
aguuaccgagccgaagggagaugaugggccuucgccccucagugggauggcagcugagggggc

SEQ ID NO: 341605 - RNA, 63 nt, Homo Sapiens
caggagugggcucagagucuagcaaaugcuaaggccccucaggcugggcucugaacgaggacc

SEQ ID NO: 341606 - RNA, 63 nt, Homo Sapiens
ggucuuccucccaccuguccggaggaagucugagccccucauuggguugguguggauagcaaa

SEQ ID NO: 341607 - RNA, 63 nt, Homo Sapiens
agccuuuucagcagguuccacccacuccugucagccccucaucuaaagguccaugaacccugc

SEQ ID NO: 341608 - RNA, 63 nt, Homo Sapiens
uuccacagucaggcagggaacugggucacaggugccccucaccugucuguucucuggggauug

SEQ ID NO: 341609 - RNA, 63 nt, Homo Sapiens
agccgcagcggcuggugcccgguggagcauggugccccucacaaacugugaagguccccgugg

SEQ ID NO: 341610 - RNA, 63 nt, Homo Sapiens
ggcuggacuggaggcugggugguuggccagagggccccucacugccauggaggcgccuuccug

SEQ ID NO: 341611 - RNA, 63 nt, Homo Sapiens
gaugccccuaccuuuuggggcggaggacacgcugccccucagcaggugcccaacaccccccac

SEQ ID NO: 341612 - RNA, 63 nt, Homo Sapiens
ccugcgcugacaagggcccuagugcuggaaagcgccccucacuuucaccuuugucgcuggguc

SEQ ID NO: 341613 - RNA, 63 nt, Homo Sapiens
ggugagcccugcccacucuugggccaagcgcuggccccucagcggaguguggggauaggagcc

SEQ ID NO: 341614 - RNA, 63 nt, Homo Sapiens
agucucugucuccugggcccugcucugggaccugccccucacguucucuuggggacacccgag

SEQ ID NO: 341615 - RNA, 63 nt, Homo Sapiens
acucauccuguucaagaaacaaccuuucauguagccccucaacagaaugcauugcaucaucac

SEQ ID NO: 341616 - RNA, 63 nt, Homo Sapiens
guuuuuaaucaguuaucuugggaacuuaaccuggccccucaccucuucugcaccccccgcccc

SEQ ID NO: 341617 - RNA, 63 nt, Homo Sapiens
ucucuuaauuuucaggaagaaagggaaauugcagccccucagcccccaggauugaccucuggg

SEQ ID NO: 341618 - RNA, 63 nt, Homo Sapiens
gcccugcacaugaugggguuugguggacccagugccccucacggcugccgcaagucugcugca

SEQ ID NO: 341619 - RNA, 63 nt, Homo Sapiens
ggugagcuuccugcagccuguggauguccugcagccccucagcccuacccccaaguuucuccu

SEQ ID NO: 341620 - RNA, 63 nt, Homo Sapiens
acggacacggacagaggaccgcgggugggcacagccccucaccccggugcuccucucuaggca

SEQ ID NO: 341621 - RNA, 63 nt, Homo Sapiens
gcgccgaugucgagggcaccagcaccaggcagagccccucaggugggguguggauggggcugc

SEQ ID NO: 341622 - RNA, 63 nt, Homo Sapiens
auuagggauauuaucaaaauauguaaccaugaggccccucagguccugaucagucagaaugga

SEQ ID NO: 341623 - RNA, 63 nt, Homo Sapiens
ccugacucugucacucaagccuuucuccaccaggccccucaucugaauaccaagcacagaaau

SEQ ID NO: 341624 - RNA, 63 nt, Homo Sapiens
ggcccccggccacugucucggggcccaccucucgccccucaucuugguaauuagccagccuca

SEQ ID NO: 341625 - RNA, 63 nt, Homo Sapiens
uccuuugcagaacuucagggacugggagcagaggccccucacucaacgacguuugugcgacau

SEQ ID NO: 341626 - RNA, 63 nt, Homo Sapiens
ugcucaucacgggaggauaccugugugccggcagccccucagggacucucagcccuggcacug

SEQ ID NO: 341627 - RNA, 63 nt, Homo Sapiens
auggggggcuggaccaccauggccacugacccagccccucagaaucccacacuccaauccuuu

SEQ ID NO: 341628 - RNA, 63 nt, Homo Sapiens
acggucccagggccccaccuaggugcagagccggccccucaccuaacagcugguuccuaccag

SEQ ID NO: 341629 - RNA, 63 nt, Homo Sapiens
ucccccuucccuggggcuucuagagcucucucugccccucagguccuggcccuuggguccuug

SEQ ID NO: 341630 - RNA, 63 nt, Homo Sapiens
ggguccagggaggggcgccugcugagcacuuccgccccucacccugcccagccccugccauga

SEQ ID NO: 341631 - RNA, 63 nt, Homo Sapiens
ccuugaaaugagaccacgucagagacauguacugccccucacauuuucucaccuaaaccagca

SEQ ID NO: 341632 - RNA, 63 nt, Homo Sapiens
cccuuccuugaguggucuagaaggcacugcguggccccucagaugcugggacacaacagaccc

SEQ ID NO: 341633 - RNA, 63 nt, Homo Sapiens
cagcagagcucaggacauucccccacagagcuugccccucaguuccuaccuccaagggggagg

SEQ ID NO: 341634 - RNA, 63 nt, Homo Sapiens
ugucagcugguuuugauggcgccccgggcccaggccccucagccaccccuucccuucccuggc

SEQ ID NO: 341635 - RNA, 63 nt, Homo Sapiens
uugccgcgguggcuggcagcggcacaggccacagccccucaccggaugcugcugggaguccau

SEQ ID NO: 341636 - RNA, 63 nt, Homo Sapiens
gaaugaucacccugaauucagaagcaccucucagccccucagaaugugguagugaaaaucgag

SEQ ID NO: 341637 - RNA, 59 nt, Homo Sapiens
gggcugaggccagccccuaggugccugcggccccucacaagaaggcaaggccggaguga

SEQ ID NO: 341638 - RNA, 63 nt, Homo Sapiens
ccuguagcugcagggggaggccccugcccaccugccccucaacaggcaggagagagagcagcu

SEQ ID NO: 341639 - RNA, 63 nt, Homo Sapiens
cuaucccguuccuucugccugagcccccaucaugccccucaacgugcagacaagagguggcga

SEQ ID NO: 341640 - RNA, 63 nt, Homo Sapiens
ccccucucaccggcccagugccaggugcucucugccccucaugucagacacugaugucugucc

SEQ ID NO: 341641 - RNA, 63 nt, Homo Sapiens
cuccugccuuccugagggccugcugcaucccaagccccucaugggaacgugcaaauuugcagg

SEQ ID NO: 341642 - RNA, 63 nt, Homo Sapiens
cugccccaccccgagaacccucacacuggcccagccccucacaugcccguuggacuuugcccc

SEQ ID NO: 341643 - RNA, 63 nt, Homo Sapiens
cuggcccagccccucacacucccguuggacuuugccccucacacaggccgcaggagugggaug

SEQ ID NO: 341644 - RNA, 63 nt, Homo Sapiens
cuucaagggcuuuccuggaucaaccagcaaagcgccccucaguaggcccuuccucccuuggcc

SEQ ID NO: 341645 - RNA, 63 nt, Homo Sapiens
gcccaggccugagugagugcgguccccccacaugccccucaggcacagccaggaacccggcca

SEQ ID NO: 341646 - RNA, 63 nt, Homo Sapiens
ucuuuagucuuugucccuuccuuuucacuaagugccccucauccuuuucaaucucauugucac

SEQ ID NO: 341647 - RNA, 63 nt, Homo Sapiens
ccuuuccuuccucuccucccaccuccucccucagccccucauucuccuugggaaucugcagag

SEQ ID NO: 341648 - RNA, 63 nt, Homo Sapiens
ccgccagagucccagacaccgguuuuccuagaagccccucacccccacuggcccacugguggc

SEQ ID NO: 341649 - RNA, 63 nt, Homo Sapiens
cugccaagcgagaaugcaggccccgcccccucggccccucaccaccucuuucuacagccuaau

SEQ ID NO: 341650 - RNA, 63 nt, Homo Sapiens
augaggagagcuucaggccccaggacugugggggccccucaggucagcucacugagcugggug

SEQ ID NO: 341651 - RNA, 63 nt, Homo Sapiens
uauuggcaaggggaguggaaaugacaccaagaagccccucaugcucaugguuggacagagagc

SEQ ID NO: 341652 - RNA, 63 nt, Homo Sapiens
ccaauguuccacaccaucgagcuuaggcauuuugccccucaccauuugccucccuccagcucu

SEQ ID NO: 341653 - RNA, 63 nt, Homo Sapiens
cccacgccccgccccuacaaugaugaggcccaugccccucacccauucuccagucagaguaga

SEQ ID NO: 341654 - RNA, 63 nt, Homo Sapiens
acagucaccucacaaaccugcuugcccuccccugccccucacauggcaccugccacucugccc

SEQ ID NO: 341655 - RNA, 63 nt, Homo Sapiens
ucccacuuucacaccuaaccuggguguaccaaugccccucaucaugacugcagcagaccuccu

SEQ ID NO: 341656 - RNA, 63 nt, Homo Sapiens
guaguuagaaaauaaacagacaaucacuuaguagccccucaaaaauaaaguauaaaacauuuc

SEQ ID NO: 341657 - RNA, 63 nt, Homo Sapiens
uggcguggagcugccugguuaaccccaugacucgccccucacccucaccguggcaaacacagg

SEQ ID NO: 341658 - RNA, 63 nt, Homo Sapiens
ccuggcccaggccccuuuugccacauccugccugccccucagcugcacacagggaugcccgcu

SEQ ID NO: 341659 - RNA, 63 nt, Homo Sapiens
gugcaacucugggagcagccgcccugggugccugccccucacuccaucuugaguccuggaacg

SEQ ID NO: 341660 - RNA, 63 nt, Homo Sapiens
ucuuaacauauuccugugucaugauuucauccugccccucacuccucuaaauaccuacccuag

SEQ ID NO: 341661 - RNA, 65 nt, Homo Sapiens
ccagggagcccagccuauucccguuggcuggcugggccccucagcugcugggccccaccucccca

SEQ ID NO: 341662 - RNA, 65 nt, Homo Sapiens
guuuccagggggcucugcuccaaguucccuagcgggccccucagggagaaauagccucacgugca

SEQ ID NO: 341663 - RNA, 65 nt, Homo Sapiens
accugagaugugggaggugcagcauguuccccugggccccucagaaagucgagcuuggaggccag

SEQ ID NO: 341664 - RNA, 65 nt, Homo Sapiens
ucccagaugucugcagcccucagcagcugcagaccgccccucaccaacccagagaaccugcuuua

SEQ ID NO: 341665 - RNA, 65 nt, Homo Sapiens
gggcauuggugccaaguccaguggaugagaauccagccccucacaagcugugggauggggcuugg

SEQ ID NO: 341666 - RNA, 65 nt, Homo Sapiens
ggaggcaccgugggccuggcacuugcaaaaguguggccccucacucuaguguguggucccucuca

SEQ ID NO: 341667 - RNA, 65 nt, Homo Sapiens
uuucuaacugggccuaaggugagcugagggcuugagccccucagcccagcgggggucccuuuuca

SEQ ID NO: 341668 - RNA, 65 nt, Homo Sapiens
ggacugcgggagccagcgcuccugccgccccucuugccccucagaccuugcauccacagaagcac

SEQ ID NO: 341669 - RNA, 65 nt, Homo Sapiens
aaagugauucucccagaagcacaaagcauacucuugccccucagguguugcuuguguacaucgua

SEQ ID NO: 341670 - RNA, 65 nt, Homo Sapiens
agaggcaacaauagagacacaggcuggguuggucugccccucagucaggcccccuuacccaccca

SEQ ID NO: 341671 - RNA, 65 nt, Homo Sapiens
ugccauggagugggaauccccagccgaggcccuaggccccucagcagggaagggauccccgggga

SEQ ID NO: 341672 - RNA, 65 nt, Homo Sapiens
gucugcaucuuggaggcagggaggugagggcaggugccccucagacacuucaggaagguaguuug

SEQ ID NO: 341673 - RNA, 65 nt, Homo Sapiens
gccaaucaugugaaggacagaagcuuuugccaugggccccucacaucagggaaaaugaccuucac

SEQ ID NO: 341674 - RNA, 65 nt, Homo Sapiens
ggugcccaccccucaaguguaaggaacugcguuccgccccucaggcccccaugggggcagggauc

SEQ ID NO: 341675 - RNA, 65 nt, Homo Sapiens
aauugauaaaucagaggugcuacugaggaguuggugccccucauuccagaaucuccuacccccag

SEQ ID NO: 341676 - RNA, 65 nt, Homo Sapiens
aauacuuauuucuggccaaaugaaucugcuucucugccccucaaacuuuuaguucacaauucauc

SEQ ID NO: 341677 - RNA, 65 nt, Homo Sapiens
auaaagcacucuuauuuuuugaucuggccuauuuugccccucauuguguagccucaauuaacaca

SEQ ID NO: 341678 - RNA, 65 nt, Homo Sapiens
gugccucugggaggagagggacuccuggggggccugccccucauacgccaucaccaaaaggaaag

SEQ ID NO: 341679 - RNA, 65 nt, Homo Sapiens
cccuuccugcccuguguuaggagauagggauauuggccccucacugcagcugccagcacuugguc

SEQ ID NO: 341680 - RNA, 65 nt, Homo Sapiens
agccccuagccccuucccuccuccuggggccuccagccccucacacugcuguucccagugauauu

SEQ ID NO: 341681 - RNA, 65 nt, Homo Sapiens
ccaugccgggaagccagagaccugcaggggccucggccccucacaucguguaugucucuccuuga

SEQ ID NO: 341682 - RNA, 65 nt, Homo Sapiens
cucucugcucccuucuucaguaagcaaggagccccgccccucaggcccagccucuggcaagaggu

SEQ ID NO: 341683 - RNA, 59 nt, Homo Sapiens; identical to SEQ ID NO: 341200

SEQ ID NO: 341684 - RNA, 65 nt, Homo Sapiens
ggggccugaacugccucugcuucccccccugaggggccccucacucuuacccaagacucuggauu

SEQ ID NO: 341685 - RNA, 65 nt, Homo Sapiens
uguagcccagcccaucuaaauggaagcugggaauugccccucaccuccccuguguccuguccagc

SEQ ID NO: 341686 - RNA, 65 nt, Homo Sapiens
uagcacacacugcaugccuuaacaagugugugcaagccccucagaacucaagacauccaaauuuu

SEQ ID NO: 341687 - RNA, 65 nt, Homo Sapiens
ugaaagauuucugaacagugauugucccguuaauagccccucagaagauguucccugcugauaac

SEQ ID NO: 341688 - RNA, 65 nt, Homo Sapiens
cugucauaaaaaacaguggagcucuguauuagaaagccccucagaacugggaaggccagguaacu

SEQ ID NO: 341689 - RNA, 65 nt, Homo Sapiens
uaucgguauauuaaguccaaaagaugguccgggcugccccucacaaaagcuucugcauccacgug

SEQ ID NO: 341690 - RNA, 65 nt, Homo Sapiens
ggagccugggacccuguuuacaguugcacaucugggccccucacuguggggauugaucauucuca

SEQ ID NO: 341691 - RNA, 65 nt, Homo Sapiens
agacuccugggcuucagccucucccacccagcccugccccucaccugccugcccuccccuccccc

SEQ ID NO: 341692 - RNA, 65 nt, Homo Sapiens
gagcuggaagaagccuuagagcucaacuucuucaagccccucacuuuacagaugaggaaauggag

SEQ ID NO: 341693 - RNA, 65 nt, Homo Sapiens
cuggccagaagcaccagccugcugccagcggggcagccccucauaggaggcccaggagggagccc

SEQ ID NO: 341694 - RNA, 65 nt, Homo Sapiens
ucccacagcccugagaugggccggcccccuuccuggccccucauggcgggacuggagaaaugguc

SEQ ID NO: 341695 - RNA, 65 nt, Homo Sapiens
acccggcccauaucccugguugccucauggccagcgccccucagccucugccacugugaaccggc

SEQ ID NO: 341696 - RNA, 65 nt, Homo Sapiens
gagagccucggaccucccaagggcgcucccucucugccccucagcugucugagcagccguguugg

SEQ ID NO: 341697 - RNA, 65 nt, Homo Sapiens
ucggccccagccuauuucccucacugcuguguucagccccucagcggcgaccugcugacccacgg

SEQ ID NO: 341698 - RNA, 65 nt, Homo Sapiens
ccuugcccccaucccucggaccauggcucaggcaagccccucagccagagagggcccagcuguag

SEQ ID NO: 341699 - RNA, 57 nt, Homo Sapiens; identical to SEQ ID NO: 341216

SEQ ID NO: 341700 - RNA, 65 nt, Homo Sapiens
ggaagcugcuaggggaaggacacggggaccacugggccccucaggagcuuuucgaacugugcucc

SEQ ID NO: 341701 - RNA, 65 nt, Homo Sapiens
uggggcucccaccuuccccaaggggcugggugcaggccccucaguugggaggggaggcggaucug

SEQ ID NO: 341702 - RNA, 65 nt, Homo Sapiens
cacuggaaccccaucuucagccuuguuucucagaggccccucagcccuggggucccagggcccuu

SEQ ID NO: 341703 - RNA, 65 nt, Homo Sapiens
ccaagcuuuggaaaaccuuccucuuucugauccaggccccucagucacagccucuuuccgucccu

SEQ ID NO: 341704 - RNA, 65 nt, Homo Sapiens
ucuccuccagagucagaaguaggccaaacucaccugccccucaacaggaagcacaugccucucuc

SEQ ID NO: 341705 - RNA, 65 nt, Homo Sapiens
agcaggaaacccucaaacccucucaucuggaucgggccccucagaggcccagcugcagccacccu

SEQ ID NO: 341706 - RNA, 65 nt, Homo Sapiens
cucagaccucucccaccccaaccagagugugcccugccccucauguuuguccuacaucucccuga

SEQ ID NO: 341707 - RNA, 65 nt, Homo Sapiens
cuuccagugaguccccaucuugaggcucagcaacagccccucaggacuuuuuguauuucuggggc

SEQ ID NO: 341708 - RNA, 65 nt, Homo Sapiens
ggcuuggggguuuucaauguuggucuucuccaccagccccucacaaugugagaaagcuaaaaugg

SEQ ID NO: 341709 - RNA, 65 nt, Homo Sapiens
uugugaccaaguuguggguacucgaguguucacuugccccucagucaaaccagugcauucuacuu

SEQ ID NO: 341710 - RNA, 65 nt, Homo Sapiens
ugaauccacucucuguauucuuguucagacugauugccccucaccgacaacuauagacuugcuca

SEQ ID NO: 341711 - RNA, 65 nt, Homo Sapiens
aucucucugcuaacaccaguaaccuuaggcuuacagccccucaaucacucuaucuuuagauuuca

SEQ ID NO: 341712 - RNA, 65 nt, Homo Sapiens
ccaaggggucuguauauacaugccuccuggccggggccccucaccuggaccccucccuugcucag

SEQ ID NO: 341713 - RNA, 65 nt, Homo Sapiens
ugggccuuuccugugccaacuuaauguacagaguggccccucaccaaacauuaaucaccaaagua

SEQ ID NO: 341714 - RNA, 65 nt, Homo Sapiens
caaccacagacccuucucuggaggucuaagcuacagccccucagcggguccauccuggagacccu

SEQ ID NO: 341715 - RNA, 65 nt, Homo Sapiens
ugcagucagagagcaagcccggccaggacccuggggccccucaacccuuccuggcucgucucaaa

SEQ ID NO: 341716 - RNA, 65 nt, Homo Sapiens
uaucccucaacccccagcccuucagcuuccauuucgccccucauuucuaccugaccaacaguucc

SEQ ID NO: 341717 - RNA, 65 nt, Homo Sapiens
uuauuuguggucacccagggcauccaauaaucauggccccucaauaguaugcuacuuucucucag

SEQ ID NO: 341718 - RNA, 65 nt, Homo Sapiens
agcaagaggcaugauuggauagcuggacaggcccugccccucaccucaaaaagugcggaggaagu

SEQ ID NO: 341719 - RNA, 65 nt, Homo Sapiens
aacuccagagucaccugucucagucagggcacggcgccccucaagcuccuuccugcucacaucca

SEQ ID NO: 341720 - RNA, 65 nt, Homo Sapiens
ucacaagccagaaccuaagccucuaggggcacauggccccucacaagcaaaacccaaguagaugc

SEQ ID NO: 341721 - RNA, 65 nt, Homo Sapiens
gagacaguacuuugaaacucgcaaggcaucuaccggccccucacaacuuagccauccccuccuca

SEQ ID NO: 341722 - RNA, 65 nt, Homo Sapiens
ccugugugcuagugucuggggguaguucugugugugccccucaccaaagagaaaaacccuccucu

SEQ ID NO: 341723 - RNA, 65 nt, Homo Sapiens
acccagggucccagcugcugccuaggucuccaguggccccucagguuuugcccuugcaaaggcuu

SEQ ID NO: 341724 - RNA, 65 nt, Homo Sapiens
acaacagggcuggccuuggaugccugcucagaguggccccucagaugagugacccuggcaguguu

SEQ ID NO: 341725 - RNA, 65 nt, Homo Sapiens
cagggcugccagccaggccaucaacaucgugaugggccccucagccacccagucauccagcagcg

SEQ ID NO: 341726 - RNA, 65 nt, Homo Sapiens
ccucuccugcuggucccuggucacuuuucugagcggccccucagacgcgcgaagugaaggaugcg

SEQ ID NO: 341727 - RNA, 57 nt, Homo Sapiens; identical to SEQ ID NO: 341244

SEQ ID NO: 341728 - RNA, 65 nt, Homo Sapiens
ccucaaaauauauucagcaaaggguucacuuaguugccccucaugcuucacagguugacuaguau

SEQ ID NO: 341729 - RNA, 65 nt, Homo Sapiens
ccugugaaugugccucguucaucccuggugcuugagccccucaagcuccagucaaugauccaguc

SEQ ID NO: 341730 - RNA, 65 nt, Homo Sapiens
agccacucucugcccacuaccuaugcuucuagaaagccccucaccucaggaccccagagggacca

SEQ ID NO: 341731 - RNA, 65 nt, Homo Sapiens
uuguguugcgcccggagcccgcccuucgccucccagccccucaagacaccgcuggcugcuggaca

SEQ ID NO: 341732 - RNA, 65 nt, Homo Sapiens
ccgcccggccccgccgcggcccggacccccagccagccccucacagcucuuccccagcuccgccu

SEQ ID NO: 341733 - RNA, 65 nt, Homo Sapiens
cucacucuggccaaggagcucugaauugugagucugccccucaggggaauucggagcuagaggac

SEQ ID NO: 341734 - RNA, 65 nt, Homo Sapiens
gcccuucccccauccaugguugggaaagaagcucagccccucacaguggccucaagugugaugcc

SEQ ID NO: 341735 - RNA, 65 nt, Homo Sapiens
cagcgccccggcugggcggaggaggagacgcccaugccccucaggggaaaguggagaccgggaca

SEQ ID NO: 341736 - RNA, 64 nt, Homo Sapiens
agcugcacaugccagugugacccuugaagacagugccccucagagaccccaagaccuuagggau

SEQ ID NO: 341737 - RNA, 65 nt, Homo Sapiens
cccuaaugacacccacuccuagcccugaggcucgugccccucagacuggggaagaguccaaggaa

SEQ ID NO: 341738 - RNA, 65 nt, Homo Sapiens
cccuggggagggcccucuggccccaggcaaccuuagccccucagaacagggagucccaggaccca

SEQ ID NO: 341739 - RNA, 65 nt, Homo Sapiens
gggcuccguaagaacucagaugccugggaagcccagccccucaggugcccccacacacagccuuc

SEQ ID NO: 341740 - RNA, 65 nt, Homo Sapiens
ugcugaacaagcauuuguagacgcuacucaagagugccccucagcuuuuuauucacucuucagac

SEQ ID NO: 341741 - RNA, 65 nt, Homo Sapiens
ccucuuuagcaauuccuagaucuccuuucuucucagccccucaccccagaccucuuauugcccau

SEQ ID NO: 341742 - RNA, 65 nt, Homo Sapiens
uccuuuagggcaaauaacacgggauucuucacucugccccucacuugggcccacugagcugcacu

SEQ ID NO: 341743 - RNA, 65 nt, Homo Sapiens
cagcccuggccucugcucaagacaauuguuggagagccccucacagacuuuuuauacuuuguaaa

SEQ ID NO: 341744 - RNA, 65 nt, Homo Sapiens
gcuugggauguuaccuugccccuaggagagacucagccccucacaaguuccugugcugcccugca

SEQ ID NO: 341745 - RNA, 65 nt, Homo Sapiens
uacauguuuaucuuuguuugguguuuucucugagugccccucacuaaacuugccacaggagcgau

SEQ ID NO: 341746 - RNA, 65 nt, Homo Sapiens
aucagagacugggcgaagcaugcuagcccggcugugccccucacugcucccacgccugcccacuu

SEQ ID NO: 341747 - RNA, 65 nt, Homo Sapiens
ucaggaggggccuggagcagcccggucccccugcugccccucacugccuuccagccccuccagga

SEQ ID NO: 341748 - RNA, 65 nt, Homo Sapiens
aauagguuuuuauuguugaauguacaucuaccccagccccucaaaagaaaaacuguuuacauaga

SEQ ID NO: 341749 - RNA, 65 nt, Homo Sapiens
uugcuauuuuuauagcugauauaguuacaccucaagccccucagggguaacaacuaacaaacacc

SEQ ID NO: 341750 - RNA, 65 nt, Homo Sapiens
gaguuuucuagaagguugggauugucaggguccuggccccucagaacuggcuugaucaagggccu

SEQ ID NO: 341751 - RNA, 65 nt, Homo Sapiens
aagaugcagccgucugaugaggccacaaccccuaggccccucaggagcuuugcagagaggaggac

SEQ ID NO: 341752 - RNA, 65 nt, Homo Sapiens
cuugcuacucuuugagaaugaaguugucauucagggccccucauguagccaaaagaccaagaaaa

SEQ ID NO: 341753 - RNA, 65 nt, Homo Sapiens
aaauaugagcuacugaggaggggguuggacauccugccccucaccccccacccacacugcaggua

SEQ ID NO: 341754 - RNA, 65 nt, Homo Sapiens
guguuuacauguguagccuauguugugguccaucagccccucacauuccuagggguuugagaugc

SEQ ID NO: 341755 - RNA, 65 nt, Homo Sapiens
agcaggguagggcugucgccuuagaucccgcccaagccccucauucccuccuugcacagaugcau

SEQ ID NO: 341756 - RNA, 65 nt, Homo Sapiens
aaccuaggaaccgccgcugccugcuggggggccacgccccucaugcccuugucccaggcccgggg

SEQ ID NO: 341757 - RNA, 65 nt, Homo Sapiens
gagccacaccagccuggauuucaaucccagaaucugccccucacgaggaugugaccuugggcaga

SEQ ID NO: 341758 - RNA, 65 nt, Homo Sapiens
ucccgugcuucucccuugggcagccucucucuugagccccucacccuguuucuuucugugaagcg

SEQ ID NO: 341759 - RNA, 65 nt, Homo Sapiens
uuaauucuuucucauguugggagugagaaugccgggccccucagggcugucggugugcugucagc

SEQ ID NO: 341760 - RNA, 65 nt, Homo Sapiens
uauucuagaacacuuggagccugaacucugaccaggccccucacuugagccuuugcuuucugcuc

SEQ ID NO: 341761 - RNA, 65 nt, Homo Sapiens
acaugacccacuaacguggcaacuuuaacccaaaggccccucagacauguuacagcaaaucugga

SEQ ID NO: 341762 - RNA, 65 nt, Homo Sapiens
cagccuccgaggagaccaggaacccugcuucagcagccccucagggcuucccaaggauguccagc

SEQ ID NO: 341763 - RNA, 65 nt, Homo Sapiens
ccuguggccacagcucuggagugggaggguugguugccccucaccucagagcucccccaaaggcc

SEQ ID NO: 341764 - RNA, 65 nt, Homo Sapiens
auggauuaggagagggggugaugaccccuccccaagccccucagggcccagaccuuccugcucuc

SEQ ID NO: 341765 - RNA, 65 nt, Homo Sapiens
gagcucgaccuugcucuuauuagucccucaccccugccccucaugaucucccacuuucucuagcu

SEQ ID NO: 341766 - RNA, 65 nt, Homo Sapiens
gaaggguggggcaggcaguacuuccagaacagucugccccucaagcugucuccagaagucguggc

SEQ ID NO: 341767 - RNA, 65 nt, Homo Sapiens
cugccugaagagaggaaacucccugagccauggcggccccucagcggggcuaagaaguucaccag

SEQ ID NO: 341768 - RNA, 65 nt, Homo Sapiens
accugaaguccucugcugugcuccaccuggggacggccccucaucaggcuagguuaggcccugca

SEQ ID NO: 341769 - RNA, 65 nt, Homo Sapiens
ggcggugucuggggaggacucucagccccugggcugccccucagaagcugcuccaaaaucaucaa

SEQ ID NO: 341770 - RNA, 65 nt, Homo Sapiens
gaccucacgcugacgagcaagcagaagcacuuguggccccucaagcugcucgaguuccuggaugu

SEQ ID NO: 341771 - RNA, 65 nt, Homo Sapiens
cugcccagcuucuacucagagcauggauuggugcugccccucaugcccaucagggaccuccaggu

SEQ ID NO: 341772 - RNA, 65 nt, Homo Sapiens
ccuaggccgccuccaggugcgggcacccuugagaagccccucaccacugcaccucuggaggugca

SEQ ID NO: 341773 - RNA, 65 nt, Homo Sapiens
cuccuguggaacccagcaguguguuggggauccuggccccucaaccccgcuaaggaagauaucua

SEQ ID NO: 341774 - RNA, 65 nt, Homo Sapiens
uugggcugggggacugggggccacccgaccuggcugccccucaccggucuaauccuucucauuac

SEQ ID NO: 341775 - RNA, 65 nt, Homo Sapiens
auuaccaugucucccucucaaagagccucuguccagccccucagucccuggcgcuugaggcucag

SEQ ID NO: 341776 - RNA, 65 nt, Homo Sapiens
acuggcuugguuuggucuacaaaggacaacaaacugccccucacuaaucaaaccauucuaaugga

SEQ ID NO: 341777 - RNA, 65 nt, Homo Sapiens
agcccuggggggaauccuaacacugaggcagccaggccccucaccaguccuccauugaggaugcc

SEQ ID NO: 341778 - RNA, 65 nt, Homo Sapiens
gcguccuccuaccgaaaccucccugccuggggcgggccccucaucuucuuuagagcauugccauu

SEQ ID NO: 341779 - RNA, 65 nt, Homo Sapiens
guuuuugauugccuucuauaaugugguccucuaaagccccucauuguugcuuauuuguguaaugg

SEQ ID NO: 341780 - RNA, 65 nt, Homo Sapiens
ccuccccaccuccaggcuuucccacuucccacccugccccucagagacugaaauuacggguaccu

SEQ ID NO: 341781 - RNA, 65 nt, Homo Sapiens
gggccuuucccaccuggagagaaacuuccagaccagccccucauaccacagccaagaggggccuu

SEQ ID NO: 341782 - RNA, 65 nt, Homo Sapiens
aggccuuucccaccgguagagaaacuuccagaccagccccucacaccacagccaagagaagccuu

SEQ ID NO: 341783 - RNA, 65 nt, Homo Sapiens
aggccuuuaccaccuggagagaagcuuccagaccagccccucacaccacagccaggagaggccuu

SEQ ID NO: 341784 - RNA, 65 nt, Homo Sapiens
aggccuuucccaccuggagagaaacuuccagaccagccccucauaccacagccaagaggggccuu

SEQ ID NO: 341785 - RNA, 65 nt, Homo Sapiens
gggccuuucucaccuggagagaaacuuccagaccagccccucacaccaccgccaggagaggccuu

SEQ ID NO: 341786 - RNA, 65 nt, Homo Sapiens
aggccuuucccaccgggagagaaacuuccagaccagccccucacaccacagccaggagaggccuu

SEQ ID NO: 341787 - RNA, 65 nt, Homo Sapiens
aggccuuucccaccgggagaggaacuuccagaccagccccucacaccacagccaggagaggccuu

SEQ ID NO: 341788 - RNA, 65 nt, Homo Sapiens
acagaaccaccagcaaagccggcggcuggacuggcgccccucagagaccugcggaaagcccccuc

SEQ ID NO: 341789 - RNA, 65 nt, Homo Sapiens
uauuuuccagaaauuucucaaaaugucugcugauagccccucacucauauuuuucauguggguuu

SEQ ID NO: 341790 - RNA, 65 nt, Homo Sapiens
ccucgugccucccccucacacccacacacccaagugccccucacaucucuguguuuccagaaggc

SEQ ID NO: 341791 - RNA, 65 nt, Homo Sapiens
ccacccucccggcagcucagcggugaccagugguggccccucagcucugaccagcagaauccacc

SEQ ID NO: 341792 - RNA, 65 nt, Homo Sapiens
uacccuuaaacaggugauccgggacuccccuauccgccccucacucgacuccagugcucuggccc

SEQ ID NO: 341793 - RNA, 65 nt, Homo Sapiens
auggaagaaaguaaacugcuuuauucuuuuccugugccccucauaccauccacugaaggcugugu

SEQ ID NO: 341794 - RNA, 65 nt, Homo Sapiens
ugcgucgagugagcgucccgaggccacgugcggaggccccucacugugcugucaaaggccugugg

SEQ ID NO: 341795 - RNA, 65 nt, Homo Sapiens
augcuagaaaaucgaguuggcaaaaugggguuugggccccucagagcccugcccugcacccuugu

SEQ ID NO: 341796 - RNA, 65 nt, Homo Sapiens
cucucgucacccaucacucccugcuuccgcagggcgccccucaguauucgcugccauaugucccu

SEQ ID NO: 341797 - RNA, 65 nt, Homo Sapiens
agggagauacugggggcagagcagacuuugccagugccccucaggucaaaccaagccaagagcac

SEQ ID NO: 341798 - RNA, 64 nt, Homo Sapiens
ggcccacacacccugccuaggccaccccgccgcggccccucaggucgcccuggccacacucaca

SEQ ID NO: 341799 - RNA, 65 nt, Homo Sapiens
ccccuaagacccaccgacucugugcuagaacaagcgccccucagagauucugaugccacugaagu

SEQ ID NO: 341800 - RNA, 65 nt, Homo Sapiens
gggaggacagucuuuccccagcaggggucaggggggccccucaggaagccuaaggucgugcuagu

SEQ ID NO: 341801 - RNA, 65 nt, Homo Sapiens
cucacucccuuuggcuacccuggccgugccuggcagccccucaggccccacagguggguccuggu

SEQ ID NO: 341802 - RNA, 65 nt, Homo Sapiens
aacggaaaucucugggacaauggcuccuccagagggccccucagagccaggugcuggccagaugc

SEQ ID NO: 341803 - RNA, 65 nt, Homo Sapiens
cuuguagcccucugagcccucauccugcaggcagagccccucagugcucugagaaaccugcccug

SEQ ID NO: 341804 - RNA, 65 nt, Homo Sapiens
ggugaggccuggcccugggcagggucuguggcugcgccccucaggccagcaguugagguccaucg

SEQ ID NO: 341805 - RNA, 65 nt, Homo Sapiens
agagaagccuccaccugaggggggcggucuccgaggccccucaaccaugguccgcugagggcugg

SEQ ID NO: 341806 - RNA, 65 nt, Homo Sapiens
uccaggagucaacaugccaaugcaucuuagaaauagccccucaauugagaaaagccgaaaaagca

SEQ ID NO: 341807 - RNA, 65 nt, Homo Sapiens
aaggaccuuagaggcagggagaaugaguuugggcggccccucauaugggagaguaagaacuaagg

SEQ ID NO: 341808 - RNA, 65 nt, Homo Sapiens
gggagagaaaagcuggaccuugucaauguuaaucagccccucaaagucuuguaauuguggauuaa

SEQ ID NO: 341809 - RNA, 65 nt, Homo Sapiens
uacgccaaggaugagcucuaacuagaacaacaacugccccucauggagccaugggcuaaaugggu

SEQ ID NO: 341810 - RNA, 65 nt, Homo Sapiens
aaggcuaacugugaugaugaacauauuucccauaagccccucagacugaaccuugcauauccuuc

SEQ ID NO: 341811 - RNA, 65 nt, Homo Sapiens
agccaagugugaccccacuggcuggacuucugugggccccucaacgguggauauggugcagagaa

SEQ ID NO: 341812 - RNA, 65 nt, Homo Sapiens
cccggcaugggcagugcgaguaaagucugagccaggccccucagggcagcaguccccuuggauac

SEQ ID NO: 341813 - RNA, 65 nt, Homo Sapiens
uucagcugugcuguguuucuuauuuagaguccuaagccccucaugauuuuuuuaagcguuugcac

SEQ ID NO: 341814 - RNA, 65 nt, Homo Sapiens
caccagcugccccaucccuggcgcuuuggagguuugccccucaccaagaaggaugugagaggugg

SEQ ID NO: 341815 - RNA, 65 nt, Homo Sapiens
ccagcacuucgcuugcagaagcucaaggccagcaagccccucaggcccgaggugcugauggagau

SEQ ID NO: 341816 - RNA, 65 nt, Homo Sapiens
ccuccucucagucuacucaauggcccucugguccagccccucacgcaucacgccucgcucccucc

SEQ ID NO: 341817 - RNA, 65 nt, Homo Sapiens
cuuuuguguacuuuuaaaauuguaucuuuccaggagccccucagauuguaccuugcuuucucacc

SEQ ID NO: 341818 - RNA, 65 nt, Homo Sapiens
augggggaguagaucuuucuaggagggagacacuggccccucaaaucguccagcgaccuuccuca

SEQ ID NO: 341819 - RNA, 65 nt, Homo Sapiens
gcgggacagugcugcagcucccuggcuucuguggggccccucaccuacuuacccagguggguccc

SEQ ID NO: 341820 - RNA, 65 nt, Homo Sapiens
cuccccaaaaccuuuccccagacacauucuccugugccccucagagaggcaugugaugugcaagg

SEQ ID NO: 341821 - RNA, 65 nt, Homo Sapiens
cagugaccucaaauguugccuuggaguccccuacagccccucagcagagggcagcacuugaaugc

SEQ ID NO: 341822 - RNA, 65 nt, Homo Sapiens
cagggcccuccucccccaccagcucuccccacagggccccucagcaucauggagacccgcaggcg

SEQ ID NO: 341823 - RNA, 65 nt, Homo Sapiens
auuuccaagagcaaggaugaaaaauugaagucacagccccucagcaccaagcagaaggugaggac

SEQ ID NO: 341824 - RNA, 65 nt, Homo Sapiens
ucugucacaggcugggucaaaagagcccuggcucugccccucagggggccagcuggggagauggg

SEQ ID NO: 341825 - RNA, 65 nt, Homo Sapiens
ccacuggcugccaacuccugccgcccucugggacugccccucagucccaggagagcuaugaggcc

SEQ ID NO: 341826 - RNA, 65 nt, Homo Sapiens
uccccaaagcaguuagacuauggagagccgacccagccccucaggaacccucauccuucaaagac

SEQ ID NO: 341827 - RNA, 65 nt, Homo Sapiens
ucuccccuagacucaggcuuccuuuggagauuaaggccccucagagaucaacagaccaacauuuu

SEQ ID NO: 341828 - RNA, 65 nt, Homo Sapiens
ccugaggcuggcaaguggggcaacguguggaggaagccccucauaauuuggagaaaacuugauac

SEQ ID NO: 341829 - RNA, 65 nt, Homo Sapiens
auauugccauacaauuuuaauuuauacaaguauuggccccucaagugguuggaaauuuuuuuuuu

SEQ ID NO: 341830 - RNA, 65 nt, Homo Sapiens
uucaugaauaggcguacuuucuguauuuaaaaauggccccucaagcaccguuaauuuacauucca

SEQ ID NO: 341831 - RNA, 65 nt, Homo Sapiens
gugcaguaauaaguaaguugcuuacauaucugggugccccucauaaccaaagguugggacucugu

SEQ ID NO: 341832 - RNA, 63 nt, Homo Sapiens
auugucaccaaaaggaagcuaaggcucuuuucagagccccucaagaagucuguccaaccccaa

SEQ ID NO: 341833 - RNA, 65 nt, Homo Sapiens
aucacaguuuaacacaagcuaaccucuguccaggugccccucaucuucucauugcccacggaccc

SEQ ID NO: 341834 - RNA, 65 nt, Homo Sapiens
cagaucaccaccccuuacaaccauuccaccacagugccccucagccucuccuacuguuuaaauuc

SEQ ID NO: 341835 - RNA, 54 nt, Homo Sapiens; identical to SEQ ID NO: 341352

SEQ ID NO: 341836 - RNA, 58 nt, Homo Sapiens; identical to SEQ ID NO: 341353

SEQ ID NO: 341837 - RNA, 65 nt, Homo Sapiens
ugcucuggcuucagaagugaacagaugaaggcagcgccccucacuuaugccagcaagaaugaagc

SEQ ID NO: 341838 - RNA, 65 nt, Homo Sapiens
accagugaaggacaugcuuggucuucugagcccgagccccucauugggccugguggagauucccu

SEQ ID NO: 341839 - RNA, 65 nt, Homo Sapiens
caucggucuuguuuacuagauccuccucuuuuccagccccucaacgugacuuucaacuugcugac

SEQ ID NO: 341840 - RNA, 65 nt, Homo Sapiens
aauggggaagggcugaaagaacuaugugcaccccagccccucaaaugagaugacccaaaucuuuc

SEQ ID NO: 341841 - RNA, 65 nt, Homo Sapiens
aaacaaugcagcagcuacugacuuguugaccacacgccccucaccggccagucauugacagacgg

SEQ ID NO: 341842 - RNA, 65 nt, Homo Sapiens
ccccagagucaaaaggaaauuagcugcuuuaaggagccccucacuuuaguggcugaguucuuucu

SEQ ID NO: 341843 - RNA, 65 nt, Homo Sapiens
cugcaucacugaagagcggcaggaggcgccgcucagccccucaccccccaagcagacuagauggg

SEQ ID NO: 341844 - RNA, 65 nt, Homo Sapiens
accuguccugccacggccucccagccggugcgggagccccucacugcccugaccgacuccgcagu

SEQ ID NO: 341845 - RNA, 65 nt, Homo Sapiens
accuccacgugagaacaagggugaaggugagggaagccccucaccuugggucuuuugcugugccu

SEQ ID NO: 341846 - RNA, 65 nt, Homo Sapiens
ggaggaggugaaagaaagggacccaccugcuagucgccccucagagcaugaugggaggugugcca

SEQ ID NO: 341847 - RNA, 65 nt, Homo Sapiens
ugcccaugaugguaccacaccagggccucagccuggccccucaccacauacccuuugccuuuuag

SEQ ID NO: 341848 - RNA, 65 nt, Homo Sapiens
gggugaggggccaggccauggccaaggggccagcugccccucauuuaucacucugaccuucacag

SEQ ID NO: 341849 - RNA, 65 nt, Homo Sapiens
uccaugaccagaggcuggaguggggguguguuagagccccucaccgggacuugcugugcggaugg

SEQ ID NO: 341850 - RNA, 65 nt, Homo Sapiens
aaucaauguuucaucuccaacccucugccaguuuggccccucagagcuugguggcucaagacugu

SEQ ID NO: 341851 - RNA, 65 nt, Homo Sapiens
gcuccuggugccgccucggccccagccuguccccagccccucaaucuggugcagcagcaucuugu

SEQ ID NO: 341852 - RNA, 65 nt, Homo Sapiens
cucucccuccuccagaucccugccuccuagugccagccccucacacgccuucauccugaaacagg

SEQ ID NO: 341853 - RNA, 65 nt, Homo Sapiens
gggugccacauggguuccugugccacccuuuccccgccccucaaaucguccuuuaagucuuccuu

SEQ ID NO: 341854 - RNA, 65 nt, Homo Sapiens
aaugcccugccuauuaaaugcuccgaaccaacccugccccucagaccuccccuguaaaaugggac

SEQ ID NO: 341855 - RNA, 65 nt, Homo Sapiens
gccaggagccccccauggccggcgccgcugcaacagccccucaugucucgcccacccugugcccu

SEQ ID NO: 341856 - RNA, 65 nt, Homo Sapiens
ugcgaaagaagagcccagaccguguaagggggccugccccucaucaaagaaccugggccuaucag

SEQ ID NO: 341857 - RNA, 65 nt, Homo Sapiens
cauguggcacuucugagcucccuucccgggccgcugccccucagccuccuggcccugccucuggc

SEQ ID NO: 341858 - RNA, 65 nt, Homo Sapiens
cggcauccccugcagagucaccugaggggacugcugccccucacuaggcagagaggaggggaggu

SEQ ID NO: 341859 - RNA, 65 nt, Homo Sapiens
auauuugccuucugcuccuauccauggguuucauggccccucaugcaucuguuacuuccccuuuu

SEQ ID NO: 341860 - RNA, 65 nt, Homo Sapiens
cugccuuagcugcacucucucccagccucuccccugccccucaaccauugcugcaauacugcucc

SEQ ID NO: 341861 - RNA, 65 nt, Homo Sapiens
ggcccgccuggcuucgaguuggaacccggacacuugccccucacugguguggauggaaaucugcc

SEQ ID NO: 341862 - RNA, 65 nt, Homo Sapiens
gaaugcaacagggguguugcgggggcaacaugagagccccucacccccaacucuccacuuucagg

SEQ ID NO: 341863 - RNA, 65 nt, Homo Sapiens
cuggcacacagaguucauguuugcgcccucucccugccccucaccccagagggugaggaggaaug

SEQ ID NO: 341864 - RNA, 65 nt, Homo Sapiens
aaagcaccagccaucguguggagcacuaccaaggggccccucagggccuuccugggaggaguccc

SEQ ID NO: 341865 - RNA, 65 nt, Homo Sapiens
uucucccucuaauuacagaucccacuuccagccgggccccucauguauccacuggccgaccgcag

SEQ ID NO: 341866 - RNA, 65 nt, Homo Sapiens
uccgaccuagaugaugauucuuccuguagcaucuggccccucacaaugucagaggauuuaauugu

SEQ ID NO: 341867 - RNA, 65 nt, Homo Sapiens
accccuccuuuucugagcgcgccgcuucggguuuggccccucagagccgacgcggugcugcugcc

SEQ ID NO: 341868 - RNA, 65 nt, Homo Sapiens
aguuugccucugaagccuuuuuuauaauaaaaaaugccccucagacauuaaucaaccauauuaaa

SEQ ID NO: 341869 - RNA, 65 nt, Homo Sapiens
uccagugauucacgcccgccucccggugcuuccuggccccucagcgcagcagagcagaccugaug

SEQ ID NO: 341870 - RNA, 65 nt, Homo Sapiens
ccuuuccuucccuuucucuguuccccccagggaaggccccucauguuagcccccagccugugacc

SEQ ID NO: 341871 - RNA, 65 nt, Homo Sapiens
ccaaagggaggggagcaaguggggaccuggccauggccccucagcaaaaaccuauucacagcggg

SEQ ID NO: 341872 - RNA, 65 nt, Homo Sapiens
cucugcuaggcagcccaggccuggucugggagacagccccucacccugccugggcucuuggccaa

SEQ ID NO: 341873 - RNA, 65 nt, Homo Sapiens
uguucuuauuuauugcaugcgucgcuuccacaggggccccucaagagcugugacucgggagagcu

SEQ ID NO: 341874 - RNA, 65 nt, Homo Sapiens
ucugucccuucagccggcagagcgagcccagcguggccccucaauuugaaaauggacgucuuuuc

SEQ ID NO: 341875 - RNA, 65 nt, Homo Sapiens
uuuuaaugaacaagguggaccaaagggcugaaccagccccucaaccaggacccuggggggccugc

SEQ ID NO: 341876 - RNA, 65 nt, Homo Sapiens
uggguggcaggagagcggacuuagagcccccgagggccccucagcagaggaaggggaguccccuc

SEQ ID NO: 341877 - RNA, 65 nt, Homo Sapiens
gacucgugacugcccagcgccccaggcuggacugagccccucacgccgcccugcagcccccaugc

SEQ ID NO: 341878 - RNA, 65 nt, Homo Sapiens
gcugaccagaccacgggcagggccugccuccgugugccccucagcucagccccagcaagugugug

SEQ ID NO: 341879 - RNA, 65 nt, Homo Sapiens
aaugcaucuaucugucugccgaucuguccuaauuggccccucaccggcugagguuuggguggugu

SEQ ID NO: 341880 - RNA, 65 nt, Homo Sapiens
caucggaucacugccuucuugcccaaccggguagugccccucaccaugggaagccuggcaaagcu

SEQ ID NO: 341881 - RNA, 65 nt, Homo Sapiens
aaaauaaggccuccagguauuuuuuuuaacccccagccccucaaaaugaauugucaucuuuggug

SEQ ID NO: 341882 - RNA, 65 nt, Homo Sapiens
ugaccuuucaccucugucuggaccucuuugcuguggccccucauuagaaggcuguggcugcuagu

SEQ ID NO: 341883 - RNA, 65 nt, Homo Sapiens
cgcugagauccaguguccaagggcgccccacagcugccccucagcgcacuuccgcaucugcccgu

SEQ ID NO: 341884 - RNA, 65 nt, Homo Sapiens
ucuccaggacaggacaggacccuucacaccagacagccccucauguuuucugucccuccuacuuu

SEQ ID NO: 341885 - RNA, 65 nt, Homo Sapiens
ccuccguuccuccucagccuggccgcaaguccccagccccucaacucaugugcuugugccuaccu

SEQ ID NO: 341886 - RNA, 65 nt, Homo Sapiens
cagcugccauuagcuuggcuuaagcuguuuucuuagccccucagcaaggaaacgggacaaaaccu

SEQ ID NO: 341887 - RNA, 65 nt, Homo Sapiens
uccccuucccugagcuccuuagcacagucccacuggccccucacccuuugcacaugcucaccccc

SEQ ID NO: 341888 - RNA, 65 nt, Homo Sapiens
ugugcccagcauuuugugugucucagccccgcugagccccucauuggcacuggaugggauguacu

SEQ ID NO: 341889 - RNA, 65 nt, Homo Sapiens
caccugugccguguggccauggagagcuaucccccgccccucaagcacuucuccuugaggcagcu

SEQ ID NO: 341890 - RNA, 65 nt, Homo Sapiens
gucuccuccucaccccacccagcucaauucucuaagccccucaggccuggcgccccuucucucca

SEQ ID NO: 341891 - RNA, 65 nt, Homo Sapiens
cacacaccaccccaugucacuguguccuccuggcagccccucaaaacccgaagcaggcguccauc

SEQ ID NO: 341892 - RNA, 65 nt, Homo Sapiens
guucaucuccagcagagacacugugugguuacagcgccccucagucucccgaugucacaggcagu

SEQ ID NO: 341893 - RNA, 65 nt, Homo Sapiens
cccgccccguggucggaagagcacucccuucccuggccccucauccagccuccggugcuguaaaa

SEQ ID NO: 341894 - RNA, 65 nt, Homo Sapiens
cuccuuucuggcauccuggccucucgugguccucagccccucacccccaguacugcagaucucac

SEQ ID NO: 341895 - RNA, 65 nt, Homo Sapiens
cucuccuuguggggucccagguccugcugccaagagccccucaagagaagggcugaaccugggga

SEQ ID NO: 341896 - RNA, 64 nt, Homo Sapiens
gaugggggcacguuguccgugauaaaaguacaagugccccucaccgcccguggagauugcuuuc

SEQ ID NO: 341897 - RNA, 65 nt, Homo Sapiens
gagacucccagcagcagagcccaagcacuggcuucgccccucagugcccuggggcauguucaggg

SEQ ID NO: 341898 - RNA, 65 nt, Homo Sapiens
cccgcauugaucuaaauaaaugcaguggaaugagggccccucagcggccuggucccccuuugccc

SEQ ID NO: 341899 - RNA, 65 nt, Homo Sapiens
cccucuggaugcuacaugggcaucccagaagcccagccccucaacucugggcucagauacuguga

SEQ ID NO: 341900 - RNA, 65 nt, Homo Sapiens
cugcccuggaaucaacaucuagccucauccugucugccccucacuucuguuggacuuuacagaag

SEQ ID NO: 341901 - RNA, 65 nt, Homo Sapiens
cccuccuccuuaauuucccagucccucugaggucggccccucagacgcucucgauuucucuaucu

SEQ ID NO: 341902 - RNA, 65 nt, Homo Sapiens
gacacguggaugauggggucagagaucacugagcugccccucaagggggccuggaacccgggugc

SEQ ID NO: 341903 - RNA, 65 nt, Homo Sapiens
agagcccugcccgaggcugaggcugggccggcgcugccccucaucuuagcauugggcagacacca

SEQ ID NO: 341904 - RNA, 65 nt, Homo Sapiens
acccuuguuaaugaugcuccugccucugccucccagccccucacccagcacagcucugccuggac

SEQ ID NO: 341905 - RNA, 65 nt, Homo Sapiens
gaggcagacccccaccaccauacaugcugucuguggccccucagacauucuguuucaucucccau

SEQ ID NO: 341906 - RNA, 65 nt, Homo Sapiens
cccugucaccucccucucaccaacccggggucugagccccucauuccugaccguccguguucuca

SEQ ID NO: 341907 - RNA, 65 nt, Homo Sapiens
gugauuuauaaguacugagcaugaaguacuugucugccccucauuucaaggccagaguuauuuuc

SEQ ID NO: 341908 - RNA, 65 nt, Homo Sapiens
uccugguuagguggggacagaggauuucugcuuaggccccucaggacccagggaaugccagggac

SEQ ID NO: 341909 - RNA, 65 nt, Homo Sapiens
cagguaucuuuggcaaggcuaccaguuggacguaagccccucaugcugacucagggugggcccug

SEQ ID NO: 341910 - RNA, 65 nt, Homo Sapiens
aagagcaccccaucuucaggaaccucucagccgaugccccucagcgcacagaccccagagccagg

SEQ ID NO: 341911 - RNA, 65 nt, Homo Sapiens
gcugugcccgcccugccccggcagggaugucgagggccccucacagccccgacgccggcggggag

SEQ ID NO: 341912 - RNA, 65 nt, Homo Sapiens
gucccccaaacacaagcacagacagggagccgagugccccucagagggccaggcagcggggcagg

SEQ ID NO: 341913 - RNA, 65 nt, Homo Sapiens
uaaaucacaucuagugacuguaacucccuacaacagccccucaaaucccugcaugcuguguaucc

SEQ ID NO: 341914 - RNA, 65 nt, Homo Sapiens
gucugcccagccaggcuccucaggcggacccacaggccccucaggucucgucuuccuccugcaga

SEQ ID NO: 341915 - RNA, 65 nt, Homo Sapiens
uggcacaucuggagggcagggccagugcccacccagccccucaggugcuucuugccuaccacuug

SEQ ID NO: 341916 - RNA, 65 nt, Homo Sapiens
augcagcugcauggguuuuuuaagggcaggagcaagccccucacagugaugaaccugcuuauacc

SEQ ID NO: 341917 - RNA, 65 nt, Homo Sapiens
cagcccccugccccgcaggccuggcuggugccugagccccucagacccaucagugccagccccug

SEQ ID NO: 341918 - RNA, 65 nt, Homo Sapiens
ccuggagaguuaucuacagacccgaauuuuugacagccccucaggaacaccagaauuuugaaaau

SEQ ID NO: 341919 - RNA, 65 nt, Homo Sapiens
ggugcccuucccuggaggucucucccucccccagagccccucaugccacagugguacucuguguc

SEQ ID NO: 341920 - RNA, 65 nt, Homo Sapiens
aggcccucaauccaccuucaggccccgccccaugggccccucaccgcugguuggaaagaguguug

SEQ ID NO: 341921 - RNA, 65 nt, Homo Sapiens
aguggguugcugccugaugacaagggguuguuucagccccucagucaugcugccuucugcugcuc

SEQ ID NO: 341922 - RNA, 65 nt, Homo Sapiens
cugagcugggccccagcccagugacuggcucauuugccccucaagcacgaguuugcauguuuagu

SEQ ID NO: 341923 - RNA, 65 nt, Homo Sapiens
aggugguggggcugggccauggagcuggcccagaggccccucagcccuuuguaaagucugaugaa

SEQ ID NO: 341924 - RNA, 65 nt, Homo Sapiens
gagaaccuaacaauuuaaagacacugggaacacuugccccucaguauaguacugucaagggaagc

SEQ ID NO: 341925 - RNA, 65 nt, Homo Sapiens
uuugcaaagagccacccuaguggcuuccuuagcuugccccucagcgaaagggccccugaccugcc

SEQ ID NO: 341926 - RNA, 65 nt, Homo Sapiens
uuguccacguaucaggaauggccagagcgauugcggccccucaccuuccccaucuuuaaaaugcu

SEQ ID NO: 341927 - RNA, 65 nt, Homo Sapiens
uagcugggacuacaggugcacuaucucucgccucagccccucaagacaaucucgacucacugcag

SEQ ID NO: 341928 - RNA, 65 nt, Homo Sapiens
uucuccuucuugauuccaaauggccuagggccccugccccucaccagcuugaccagcgugcugac

SEQ ID NO: 341929 - RNA, 65 nt, Homo Sapiens
uuccucuccucaucucuggcccuccucuccuccgggccccucaguccgguucccacccuccucca

SEQ ID NO: 341930 - RNA, 65 nt, Homo Sapiens
uaauauagcacagaguuaugcauacauuuuucuuagccccucaagcacuacuguguuucacugac

SEQ ID NO: 341931 - RNA, 65 nt, Homo Sapiens
ccaagccugucccacugggggacuaccucccagaagccccucaugagauggaggaggugugggcu

SEQ ID NO: 341932 - RNA, 65 nt, Homo Sapiens
gcccucuccucaaacuccucccacacaucacgccugccccucaccgaguagaggccucguuucug

SEQ ID NO: 341933 - RNA, 65 nt, Homo Sapiens
ucucugcccaacccuucccuagcugcacugaugcugccccucaucgaauuuggguucugccugcc

SEQ ID NO: 341934 - RNA, 51 nt, Homo Sapiens; identical to SEQ ID NO: 341451

SEQ ID NO: 341935 - RNA, 65 nt, Homo Sapiens
ugcaucuucagauccaguacuaaucccaagacugugccccucaucuggggaaguuccccaacaca

SEQ ID NO: 341936 - RNA, 65 nt, Homo Sapiens
ccugcacucugggugucuccaacaggagugagugagccccucagagcaugcuuucugccucuggu

SEQ ID NO: 341937 - RNA, 65 nt, Homo Sapiens
gcaggcccacagcacucugagagugcuugcuaugugccccucaugcaucagggccugcauuuaug

SEQ ID NO: 341938 - RNA, 65 nt, Homo Sapiens
uggcagaguccauaguggagggauucucaggcugggccccucacccaagggcagccccagcagcu

SEQ ID NO: 341939 - RNA, 65 nt, Homo Sapiens
gguuuccucggcccuccuggcuccucgggcuucucgccccucagugucgcugugcccugguuucc

SEQ ID NO: 341940 - RNA, 65 nt, Homo Sapiens
ccagaccccccuucuaaggacagagucccuuggcagccccucacccaccaggaugaccccacagc

SEQ ID NO: 341941 - RNA, 65 nt, Homo Sapiens
uaccuggggaagaguaaaggugccugaauucccccgccccucaguaaguuguuccucuguuauca

SEQ ID NO: 341942 - RNA, 65 nt, Homo Sapiens
gcccucaagugccuucugugaacauuggcugcaaagccccucaaaaguuucccauugucacggaa

SEQ ID NO: 341943 - RNA, 65 nt, Homo Sapiens
gugcacucggcccaguccugccgccguguccaggcgccccucacccccacaccugcugcauggcu

SEQ ID NO: 341944 - RNA, 65 nt, Homo Sapiens
cccccaacccccaacccccuucauucuucuuccucgccccucagcgucgguuuuguuuuuguuuc

SEQ ID NO: 341945 - RNA, 65 nt, Homo Sapiens
agggcugagugggagggcggcccuuuccagccucugccccucaggggaacccuguagcuuugugu

SEQ ID NO: 341946 - RNA, 65 nt, Homo Sapiens
cuaucucuccaaaccccauacccuucaaugcuguggccccucagugacuuccuugggugauccug

SEQ ID NO: 341947 - RNA, 65 nt, Homo Sapiens
agauggcaggcuacaguugggaagucucagccugggccccucagccacccuuggucucaugcccc

SEQ ID NO: 341948 - RNA, 65 nt, Homo Sapiens
cucccugccccauucuggugucuuuccacuccucagccccucaucuugccuccacccagcugcuc

SEQ ID NO: 341949 - RNA, 65 nt, Homo Sapiens
ccuccuucagccaccuggccauaccccuuaaauaagccccucaccuugcugccucaggaccuuca

SEQ ID NO: 341950 - RNA, 65 nt, Homo Sapiens
ugcuggcugcaagcuguggguucuuucuccucugugccccucaugcugaucuucuagaugccacu

SEQ ID NO: 341951 - RNA, 65 nt, Homo Sapiens
gcccacacggccccuucccagccagcccgccgcccgccccucaguuugguagugccccaccuccc

SEQ ID NO: 341952 - RNA, 65 nt, Homo Sapiens
accgcccauccugcacacggggccgcugggcaggugccccucacacccccaggaugucagugcuc

SEQ ID NO: 341953 - RNA, 65 nt, Homo Sapiens
cugggcucuggaccaugagcgccugugcacagguagccccucaugcauacugaaaacugaccaag

SEQ ID NO: 341954 - RNA, 65 nt, Homo Sapiens
cucuucuuacuaagucucagggggagagaggaguagccccucagacacccaguaacuggggccac

SEQ ID NO: 341955 - RNA, 65 nt, Homo Sapiens
cuugcaccccagcacugagacauugucccccaucggccccucagcggcugccuccuggugguggc

SEQ ID NO: 341956 - RNA, 65 nt, Homo Sapiens
ugaaugcuccagcgauuccaaacugcagccccucugccccucaccaaaaccugcggggcugcuug

SEQ ID NO: 341957 - RNA, 65 nt, Homo Sapiens
agugugugucuguuuugguuugugagaaaguagcugccccucauucuggccaguucuuuccagua

SEQ ID NO: 341958 - RNA, 65 nt, Homo Sapiens
ccaguagugccgaugugccacacugcccaguugaggccccucacgcucugugccccuagauccuu

SEQ ID NO: 341959 - RNA, 65 nt, Homo Sapiens
cccauggcaacucaaagugccuuccaaaccaaacugccccucaugagguuagggucccccacccu

SEQ ID NO: 341960 - RNA, 65 nt, Homo Sapiens
caacuucccgagaacaaacaggccugcucacaacugccccucaaguucaaccccgggaccgccca

SEQ ID NO: 341961 - RNA, 65 nt, Homo Sapiens
cauucgugacugaggccccucuuggggcacucacugccccucauccccagaaauuauuuuucuac

SEQ ID NO: 341962 - RNA, 65 nt, Homo Sapiens
gcaguccacuccuagccccggcauccugcucuagggccccucaugccccaggcuggagcagcucu

SEQ ID NO: 341963 - RNA, 65 nt, Homo Sapiens
cuggagccaagaagcacagagacacagaggcgccugccccucagcuccgcuggucugucugugca

SEQ ID NO: 341964 - RNA, 65 nt, Homo Sapiens
gggcaggccauggccuacagucacaccccauucuugccccucacuugcuccacugagcuccucug

SEQ ID NO: 341965 - RNA, 65 nt, Homo Sapiens
gguguccuuuuaaaaaauauuuaacaccagauggugccccucauuaaccagcuuucugguuaagg

SEQ ID NO: 341966 - RNA, 65 nt, Homo Sapiens
cugggggaagaagagggccuggcacaguucucccugccccucagcccgggaguccgggcauggug

SEQ ID NO: 341967 - RNA, 65 nt, Homo Sapiens
ccaaccccgcccuaggccugcaccucccagccccugccccucauggaugacccaggcugccugag

SEQ ID NO: 341968 - RNA, 65 nt, Homo Sapiens
ggacgucugagcccagcuuucugcgugcccuccuggccccucacucccggcagcgggccggccuc

SEQ ID NO: 341969 - RNA, 65 nt, Homo Sapiens
cggaagggcccggugggacguggguagugugugaagccccucagccugggucccgccuagccuaa

SEQ ID NO: 341970 - RNA, 65 nt, Homo Sapiens
gggcccggaggucccaaggucccugggaggacugggccccucaugccucgagcuuggcaaccgaa

SEQ ID NO: 341971 - RNA, 65 nt, Homo Sapiens
agaggagaaggaugccugggugccaggcaagacaagccccucagcaggagagaggcccagaggcu

SEQ ID NO: 341972 - RNA, 65 nt, Homo Sapiens
uuuagguucaccugcaaaacaaaaaucuuacuccagccccucaaugccauccugacacacuuuau

SEQ ID NO: 341973 - RNA, 65 nt, Homo Sapiens
acgccccuuuuguguuuugguucaaguuucucagagccccucagagcuucuacaucugugcauca

SEQ ID NO: 341974 - RNA, 65 nt, Homo Sapiens
uccugggaucuccuucucccuccuguccuguccuugccccucaggacugcuggaaaauaaauccu

SEQ ID NO: 341975 - RNA, 65 nt, Homo Sapiens
gagcaugccuggauggggcugcaccggcuggccuggccccucagggucccugguggcagcucacc

SEQ ID NO: 341976 - RNA, 65 nt, Homo Sapiens
cuucgucauggaccgagguucccacucugggcaaagccccucacacugcaagggauuguagauaa

SEQ ID NO: 341977 - RNA, 65 nt, Homo Sapiens
ccucagguucugccugagcccagccuaccaggcuugccccucagcucagcacuguugaccacgcu

SEQ ID NO: 341978 - RNA, 65 nt, Homo Sapiens
gccacuggcccuggguggcucugucagggugcacagccccucaugccuggagcaaugagggucua

SEQ ID NO: 341979 - RNA, 65 nt, Homo Sapiens
cacuaccccucaacagagaugacuuugaugacucugccccucagcagggcuuacuaagcacuacc

SEQ ID NO: 341980 - RNA, 65 nt, Homo Sapiens
uaagcacuaccccuuaacagggaugacuccgcacugccccucaacagggaugacucagcagagau

SEQ ID NO: 341981 - RNA, 65 nt, Homo Sapiens
uagcagggaugacacagcaaggaugacucagcacugccccucagcaaggaugacucagcacugcc

SEQ ID NO: 341982 - RNA, 65 nt, Homo Sapiens
gcucaacagacaugacucagggauggcuuaguacugccccucagcagggaugacucagcaccgcc

SEQ ID NO: 341983 - RNA, 65 nt, Homo Sapiens
caacagggaugacucagcagggaugacucagcaccgccccucaacaggcaugacucugcagagau

SEQ ID NO: 341984 - RNA, 65 nt, Homo Sapiens; identical to SEQ ID NO: 341981

SEQ ID NO: 341985 - RNA, 65 nt, Homo Sapiens
gcucaacagggaugacucagggauggcuuaguacugccccucaacagggaugacucagcagggau

SEQ ID NO: 341986 - RNA, 65 nt, Homo Sapiens; identical to SEQ ID NO: 341983

SEQ ID NO: 341987 - RNA, 65 nt, Homo Sapiens
caacaggcaugacucugcagagaugacuuaguacugccccucagcagggaugacucaguacugcc

SEQ ID NO: 341988 - RNA, 65 nt, Homo Sapiens
uuaguacugccccucagcagggaugacucaguacugccccucagcagggaugacucagcacugcc

SEQ ID NO: 341989 - RNA, 65 nt, Homo Sapiens
ucaguacugccccucagcagggaugacucagcacugccccucaacagggaugacucagcagggau

SEQ ID NO: 341990 - RNA, 65 nt, Homo Sapiens
uagcagugaugacacagcaaggaugacucagcacugccccucagcaaggaugacucagcacugcc

SEQ ID NO: 341991 - RNA, 65 nt, Homo Sapiens; identical to SEQ ID NO: 341982

SEQ ID NO: 341992 - RNA, 65 nt, Homo Sapiens
uuaguacugccccucagcagggaugacucagcaccgccccucaacagggaugacucagcacugcc

SEQ ID NO: 341993 - RNA, 65 nt, Homo Sapiens
ucagcaccgccccucaacagggaugacucagcacugccccucaacagggaugacucagcagggau

SEQ ID NO: 341994 - RNA, 65 nt, Homo Sapiens
uagcagcgaugacacagcaaggaugacucagcacugccccucaccaaggaugacucagcacugcc

SEQ ID NO: 341995 - RNA, 65 nt, Homo Sapiens
gcucaacagacaugacucagggauggcuuaguacugccccucagcagggaugacucagcagggau

SEQ ID NO: 341996 - RNA, 65 nt, Homo Sapiens
caacagggaugacucagcagggaugacucagcacugccccucaacagggaugacugcagggauga

SEQ ID NO: 341997 - RNA, 65 nt, Homo Sapiens
cucaacagggaugacugcagggaugacucagcacugccccucagcagggaugacucagcacugcc

SEQ ID NO: 341998 - RNA, 65 nt, Homo Sapiens
ucagcacugccccucagcagggaugacucagcacugccccucagcagggaugacucagcagggau

SEQ ID NO: 341999 - RNA, 65 nt, Homo Sapiens
cagcagggaugacucagcagggaugacucagcaccgccccucaacaggcaugacucugcagagau

SEQ ID NO: 342000 - RNA, 65 nt, Homo Sapiens
caacaggcaugacucugcagagaugacucagcacugccccucagcagggauggcucagcagggau

SEQ ID NO: 342001 - RNA, 65 nt, Homo Sapiens
cagcagggauggcucagcagggaugacucagcauugccccucaacagggaugacucagcagacuc

SEQ ID NO: 342002 - RNA, 65 nt, Homo Sapiens
ugacucagcagacucagcagggaugacucagcacugccccucaacagacaugacucagcagggau

SEQ ID NO: 342003 - RNA, 65 nt, Homo Sapiens
caacagacaugacucagcagggaugacucagcaccgccccucagcaaggaugacucagcagggau

SEQ ID NO: 342004 - RNA, 65 nt, Homo Sapiens
gcucugugcagauccugucggucccugcguccucugccccucacuuggccugggagacccaucug

SEQ ID NO: 342005 - RNA, 65 nt, Homo Sapiens
gggcggcagaggcaacuucacuggggccgccacaggccccucacgcuggccuggcugggcugggu

SEQ ID NO: 342006 - RNA, 65 nt, Homo Sapiens
uggccaccugccagggcaccagcacuugugccucagccccucaccggggcagccaaguuccugau

SEQ ID NO: 342007 - RNA, 59 nt, Homo Sapiens; identical to SEQ ID NO: 341524

SEQ ID NO: 342008 - RNA, 65 nt, Homo Sapiens
caccauggaccagcccauuguggccagagccucuggccccucaccaguuuuacugccuguagcaa

SEQ ID NO: 342009 - RNA, 65 nt, Homo Sapiens
cuuccucugggaccagaugucucaagccccagagagccccucaucaggacacaaggugggcugcc

SEQ ID NO: 342010 - RNA, 65 nt, Homo Sapiens
gggaagggagacuggcccugcccagccggucucuagccccucagcccccgcugggcacucucugu

SEQ ID NO: 342011 - RNA, 65 nt, Homo Sapiens
gggugcagacaaauucagcaauaguaugcagaucagccccucaccaccucauuguucucaucugg

SEQ ID NO: 342012 - RNA, 65 nt, Homo Sapiens
agccccaacccucagacccucgccuuccaaggcaggccccucagccuggccugcucucaccaccu

SEQ ID NO: 342013 - RNA, 65 nt, Homo Sapiens
ggcuccuuccuggucuggcccagcuggcuuccccagccccucagccauccagggcuacccacugc

SEQ ID NO: 342014 - RNA, 65 nt, Homo Sapiens
uccagccuuaacucgaugguccgucccugccaggugccccucacucuuccugaccccaaagccag

SEQ ID NO: 342015 - RNA, 65 nt, Homo Sapiens
aggugcuccaggauaacaaagaagggcagguugaagccccucauggaaggagcuggcuuuguggg

SEQ ID NO: 342016 - RNA, 65 nt, Homo Sapiens
caggcacucaaugcagccagaccuauuccuccugggccccucaucugcucagcagcuauuugaau

SEQ ID NO: 342017 - RNA, 65 nt, Homo Sapiens
ugacauccugcaguccccaccaguccugaccgugggccccucaggggucugggagugugacguug

SEQ ID NO: 342018 - RNA, 65 nt, Homo Sapiens
ucaaccugugaugaggggaggaaacucaccugcuggccccucaccugggcaccuggggaguggga

SEQ ID NO: 342019 - RNA, 65 nt, Homo Sapiens
gacggacugccgccucuggguccccccaccguggugccccucaccauccuccugggggagcaggg

SEQ ID NO: 342020 - RNA, 65 nt, Homo Sapiens
cagaucuguagccagucagaggaggaggagaaggagccccucagcagaguggugcaguuucgcuc

SEQ ID NO: 342021 - RNA, 65 nt, Homo Sapiens
gacugugaaaaggcuuccugugaccuccgauggcggccccucauuggccaagggcacuguggaug

SEQ ID NO: 342022 - RNA, 65 nt, Homo Sapiens
agcugaagagcaagguuucguggcagcacggcccggccccucacccucuguccccacgaggggac

SEQ ID NO: 342023 - RNA, 65 nt, Homo Sapiens
cuucuuccccuucuaguugaccucccuccagaauagccccucaccaccccuccuugcccgccuac

SEQ ID NO: 342024 - RNA, 65 nt, Homo Sapiens
cugccuugcagaccaaugggucccccacauccaaagccccucagcgacucacaucccuuuccuag

SEQ ID NO: 342025 - RNA, 65 nt, Homo Sapiens
uaaaaacgguuauacuauaaacugcccucucuuaggccccucauuuaacauaggacuaaccagcc

SEQ ID NO: 342026 - RNA, 65 nt, Homo Sapiens
ugggacccaggcguucucagggagucccuggugcugccccucagggggggagguugguggaccau

SEQ ID NO: 342027 - RNA, 65 nt, Homo Sapiens
acugagggcagaagaaauugaugggaggauagggagccccucauggcugcaccugggaccauagg

SEQ ID NO: 342028 - RNA, 65 nt, Homo Sapiens
caggagccaguggcaggagcucacccacagggccagccccucagcaagccacugggugagcagag

SEQ ID NO: 342029 - RNA, 52 nt, Homo Sapiens; identical to SEQ ID NO: 341546

SEQ ID NO: 342030 - RNA, 65 nt, Homo Sapiens
ccuugaugcccaugcuaaugccuucccaacaaugugccccucaccccggcagggaguugugagcg

SEQ ID NO: 342031 - RNA, 65 nt, Homo Sapiens
cuccaggcugcugugagaguugggcgagccccucggccccucaccccagccugggucagaagggg

SEQ ID NO: 342032 - RNA, 65 nt, Homo Sapiens
agggcagggccaguccuggcugccagugccaaaccgccccucagcugccuuuccuuggcccucac

SEQ ID NO: 342033 - RNA, 65 nt, Homo Sapiens
uccagcuugccuguuucuucuucugggaaguccuagccccucacuccuaguaugcccuguaauuu

SEQ ID NO: 342034 - RNA, 65 nt, Homo Sapiens
ggguucggaggagagucaggccgggggagccaccagccccucacuucguuuuugagggggucaug

SEQ ID NO: 342035 - RNA, 65 nt, Homo Sapiens
ugaggaggagcuggccugcgaacauucgaaucucugccccucacuuuuggccugggggaggucag

SEQ ID NO: 342036 - RNA, 65 nt, Homo Sapiens
ccugucacuaagcagcacgugucaagccgacuaaggccccucaacccacagugaggccaccuuga

SEQ ID NO: 342037 - RNA, 65 nt, Homo Sapiens
ccugcuggaacagggucugccugggccacacggcugccccucagcaccaggugcugcacugaccg

SEQ ID NO: 342038 - RNA, 65 nt, Homo Sapiens
cugaauggugcacugguuuaauuguguuggugucggccccucacaaaugcagccaagucauguaa

SEQ ID NO: 342039 - RNA, 65 nt, Homo Sapiens
caggugggauccugaaggcacuagcugacagacgggccccucaauccuguccucugaaggauugu

SEQ ID NO: 342040 - RNA, 65 nt, Homo Sapiens
ccuggcucugaggucacaucagcuagguuugggaggccccucagcuugguuugggagugcccgug

SEQ ID NO: 342041 - RNA, 65 nt, Homo Sapiens
accucaugacaaaggaagggacucaaagcagcaaugccccucauaguguaggcuaaggugaguuu

SEQ ID NO: 342042 - RNA, 65 nt, Homo Sapiens
agcgcugagauuacaggugugagccaccgugcccagccccucaguagguuuuaaggagcccccag

SEQ ID NO: 342043 - RNA, 65 nt, Homo Sapiens
ccccgggcccccgcgccucugccggacacggaccggccccucagcccccaccgaggacgcagcca

SEQ ID NO: 342044 - RNA, 65 nt, Homo Sapiens
guauuugugcguuccagaaaagggcccagcucugagccccucacccuuccacacucacgaacucu

SEQ ID NO: 342045 - RNA, 65 nt, Homo Sapiens
cuuucuuucaguucucccaugcagccgaggcccgggccccucaggacuccaaggagacggugcag

SEQ ID NO: 342046 - RNA, 65 nt, Homo Sapiens
cuccaugaaugaaaugacucagggaaguguuuguugccccucaugccuccuuucucacuuuagaa

SEQ ID NO: 342047 - RNA, 65 nt, Homo Sapiens
agcucuggcagugaugaugguacuuccuguugucagccccucaagcccagcugcaaccagucugg

SEQ ID NO: 342048 - RNA, 65 nt, Homo Sapiens
ggugcccucgcuccgccccaucaguuccugccccugccccucaugcagacugcccugcuggggcc

SEQ ID NO: 342049 - RNA, 65 nt, Homo Sapiens
ggcccuaggccaccucgcggaagccuucagccuccgccccucacugcagccccuugggacuugag

SEQ ID NO: 342050 - RNA, 65 nt, Homo Sapiens
cggguguugggaaccaugccugccagccaguaugugccccucacccaggccuggcugggcccugg

SEQ ID NO: 342051 - RNA, 65 nt, Homo Sapiens
uuccugcucugagcgcucaccccugcugaggcucagccccucaacccgguggcauucugggggag

SEQ ID NO: 342052 - RNA, 65 nt, Homo Sapiens
gcaccgcuguugagcagccuggugguacuggccacgccccucaaggcaaggcuccuccccuuagg

SEQ ID NO: 342053 - RNA, 65 nt, Homo Sapiens
cgcucagcccagcugacugugccuguucugagugagccccucacucagccggggcccucccaccu

SEQ ID NO: 342054 - RNA, 65 nt, Homo Sapiens
uuuggggggucuugguuuaugcucccugcccuugagccccucagccguuugcccugcccccaccu

SEQ ID NO: 342055 - RNA, 65 nt, Homo Sapiens
auacagcggugggaucucugcugccagcucucccagccccucagcuucgcagccuggcgcagcau

SEQ ID NO: 342056 - RNA, 65 nt, Homo Sapiens
aguguccccaccccagggccacuuagcugacaccagccccucagaggaccagugcgccccauccc

SEQ ID NO: 342057 - RNA, 65 nt, Homo Sapiens
ccuccuugucucauccccgaagauccgucccccuggccccucaguguccaugucuugagcuuaau

SEQ ID NO: 342058 - RNA, 65 nt, Homo Sapiens
aauccccuccuguucacucucccaacccugcuccagccccucagcuucccagacccucaugcagu

SEQ ID NO: 342059 - RNA, 65 nt, Homo Sapiens
ccccagccuaggacgccaacuucucccaccccuuggccccucacauccucuccaggaagggagug

SEQ ID NO: 342060 - RNA, 65 nt, Homo Sapiens
ugcucuuucuccuucuucccugagucucucuccaugccccucaucucuuccuuuugcccucgccu

SEQ ID NO: 342061 - RNA, 65 nt, Homo Sapiens
accuucuggaccugcccccacuguggccugcaugcgccccucacgccccuggagcgcaucgccca

SEQ ID NO: 342062 - RNA, 65 nt, Homo Sapiens
ucccagagcugaccccacuccaggaccuaggcccagccccucagccucaucuggagccccugaag

SEQ ID NO: 342063 - RNA, 65 nt, Homo Sapiens
uacacauguuuucggcaacguguucccguguccuggccccucacgggcccccacacucuccugac

SEQ ID NO: 342064 - RNA, 65 nt, Homo Sapiens
ccugcccccucucugagagcccuggccagcucuucgccccucaccucuuugaaacucuggacgua

SEQ ID NO: 342065 - RNA, 65 nt, Homo Sapiens
cuugcaaacuucucccggguccagcgccuggggcugccccucaagauggucauguacucagcugu

SEQ ID NO: 342066 - RNA, 65 nt, Homo Sapiens
gguuccuuggaccguaucacugguccaccuccugagccccucaauccuaucacagucuacugacu

SEQ ID NO: 342067 - RNA, 65 nt, Homo Sapiens
ccagcuucccaaugccuggcucacgacgcacccaagccccucaguccaaggccaccugacuccua

SEQ ID NO: 342068 - RNA, 65 nt, Homo Sapiens
ugagguuccaaguugcaacuugaacauauauacuugccccucaggauucuucuuccgacugguac

SEQ ID NO: 342069 - RNA, 65 nt, Homo Sapiens
ggagccccgggaguguccaaaagcgggaaucaugugccccucagcgacaucucaaaagaagucca

SEQ ID NO: 342070 - RNA, 65 nt, Homo Sapiens
acacccagaaccccaccccuccuucccccagccccgccccucaggcccugaguugggggagcgac

SEQ ID NO: 342071 - RNA, 65 nt, Homo Sapiens
ccucccagcccacuucugccccccacagccccccagccccucagcccacuuuucccuuccucuuu

SEQ ID NO: 342072 - RNA, 65 nt, Homo Sapiens
caugggcccuacaguccccuccacucucuccaggugccccucagcuggaggcaguggcugguggg

SEQ ID NO: 342073 - RNA, 63 nt, Homo Sapiens
accagaguccccucuuacugaauaaaagccuucaggccccucacccacccuauggaccaguca

SEQ ID NO: 342074 - RNA, 65 nt, Homo Sapiens
uggagcugguugggccgcggggagcucguuucacagccccucagguggaggcugagguggcugca

SEQ ID NO: 342075 - RNA, 65 nt, Homo Sapiens
acccucucaacaccccccucgcucccuggggcugcgccccucaacacaaccucuccccuaacccu

SEQ ID NO: 342076 - RNA, 65 nt, Homo Sapiens
gacuuuuuuuuguuuguuuuccaacaagccccacagccccucaaaugagcagagcgggacucugu

SEQ ID NO: 342077 - RNA, 65 nt, Homo Sapiens
ugugcugugcugugucugcauuggugaaagggagggccccucaugacugugcccugccuucagcu

SEQ ID NO: 342078 - RNA, 65 nt, Homo Sapiens
cagccaaacagauggggaggcccaaagcaaggcuugccccucagaggagcucacgcagggcagga

SEQ ID NO: 342079 - RNA, 65 nt, Homo Sapiens
gcaguuuggcagcuugacuucugcagcuggaggaggccccucaggccggggaucuggggagggcu

SEQ ID NO: 342080 - RNA, 65 nt, Homo Sapiens
ugaacagccgacuuugagcauuguuucuucuaacugccccucaacuaccauuaucuucaagucaa

SEQ ID NO: 342081 - RNA, 65 nt, Homo Sapiens
uggacagcaggccuggcacugggaggugggggugagccccucacagccuugccccuccccaaggc

SEQ ID NO: 342082 - RNA, 65 nt, Homo Sapiens
uuggccacuggggccaccacccugaccaccacugugccccucauuguuacugccuugugagauaa

SEQ ID NO: 342083 - RNA, 65 nt, Homo Sapiens
aucuuuuuuuuaggccccugccugucugcccaucugccccucacccacccgaggcucugcccacc

SEQ ID NO: 342084 - RNA, 65 nt, Homo Sapiens
caccuuuacuaaaacacuuucucugaaccccccuugccccucacugaucuugcuuuucccugguc

SEQ ID NO: 342085 - RNA, 65 nt, Homo Sapiens
cccauguauauagguccugaugccuucccaaccccgccccucacccuguugccaccuuguuucau

SEQ ID NO: 342086 - RNA, 65 nt, Homo Sapiens
gauccucucggugggaugggcaccacagacaggaggccccucaggcccgugcgggccacugucug

SEQ ID NO: 342087 - RNA, 65 nt, Homo Sapiens
gcaguuaccgagccgaagggagaugaugggccuucgccccucagugggauggcagcugagggggc

SEQ ID NO: 342088 - RNA, 65 nt, Homo Sapiens
cucaggagugggcucagagucuagcaaaugcuaaggccccucaggcugggcucugaacgaggacc

SEQ ID NO: 342089 - RNA, 65 nt, Homo Sapiens
ggucuuccucccaccuguccaaggaggaagucugagccccucauucuggguugguguggauagca

SEQ ID NO: 342090 - RNA, 65 nt, Homo Sapiens
agccuuuucagcagguuccagccccacuccugucagccccucaucgguaaagguccaugaacccu

SEQ ID NO: 342091 - RNA, 65 nt, Homo Sapiens
uuccacagucaggcagggaaugcugggucacaggugccccucaccugugucuguucucuggggau

SEQ ID NO: 342092 - RNA, 65 nt, Homo Sapiens
agccgcagcggcuggugcccgggguggagcauggugccccucacaccaacugugaagguccccgu

SEQ ID NO: 342093 - RNA, 65 nt, Homo Sapiens
ggcuggacuggaggcuggguuggguuggccagagggccccucacucugccauggaggcgccuucc

SEQ ID NO: 342094 - RNA, 65 nt, Homo Sapiens
gaugccccuaccuuuuggggaccggaggacacgcugccccucagcgcaggugcccaacacccccc

SEQ ID NO: 342095 - RNA, 65 nt, Homo Sapiens
ccugcgcugacaagggcccuucagugcuggaaagcgccccucacuccuucaccuuugucgcuggg

SEQ ID NO: 342096 - RNA, 65 nt, Homo Sapiens
ggugagcccugcccacucuuccgggccaagcgcuggccccucagcacggaguguggggauaggag

SEQ ID NO: 342097 - RNA, 65 nt, Homo Sapiens
ucagucucugucuccugggcccugcucugggaccugccccucacguucucuuggggacacccgag

SEQ ID NO: 342098 - RNA, 65 nt, Homo Sapiens
aaacucauccuguucaagaaacaaccuuucauguagccccucaacagaaugcauugcaucaucac

SEQ ID NO: 342099 - RNA, 65 nt, Homo Sapiens
ugguuuuuaaucaguuaucuugggaacuuaaccuggccccucaccucuucugcaccccccgcccc

SEQ ID NO: 342100 - RNA, 65 nt, Homo Sapiens
guucucuuaauuuucaggaagaaagggaaauugcagccccucagcccccaggauugaccucuggg

SEQ ID NO: 342101 - RNA, 65 nt, Homo Sapiens
gggcccugcacaugaugggguuugguggacccagugccccucacggcugccgcaagucugcugca

SEQ ID NO: 342102 - RNA, 65 nt, Homo Sapiens
ccggugagcuuccugcagccuguggauguccugcagccccucagcccuacccccaaguuucuccu

SEQ ID NO: 342103 - RNA, 65 nt, Homo Sapiens
acggacacggacagaggacccagcgggugggcacagccccucacccaccggugcuccucucuagg

SEQ ID NO: 342104 - RNA, 65 nt, Homo Sapiens
gcgccgaugucgagggcaccgcagcaccaggcagagccccucaggugugggguguggauggggcu

SEQ ID NO: 342105 - RNA, 65 nt, Homo Sapiens
uaauuagggauauuaucaaaauauguaaccaugaggccccucagguccugaucagucagaaugga

SEQ ID NO: 342106 - RNA, 65 nt, Homo Sapiens
caccugacucugucacucaagccuuucuccaccaggccccucaucugaauaccaagcacagaaau

SEQ ID NO: 342107 - RNA, 65 nt, Homo Sapiens
cuggcccccggccacugucucggggcccaccucucgccccucaucuugguaauuagccagccuca

SEQ ID NO: 342108 - RNA, 65 nt, Homo Sapiens
auuccuuugcagaacuucagggacugggagcagaggccccucacucaacgacguuugugcgacau

SEQ ID NO: 342109 - RNA, 65 nt, Homo Sapiens
ucugcucaucacgggaggauaccugugugccggcagccccucagggacucucagcccuggcacug

SEQ ID NO: 342110 - RNA, 65 nt, Homo Sapiens
ccauggggggcuggaccaccauggccacugacccagccccucagaaucccacacuccaauccuuu

SEQ ID NO: 342111 - RNA, 65 nt, Homo Sapiens
gcacggucccagggccccaccuaggugcagagccggccccucaccuaacagcugguuccuaccag

SEQ ID NO: 342112 - RNA, 65 nt, Homo Sapiens
ucucccccuucccuggggcuucuagagcucucucugccccucagguccuggcccuuggguccuug

SEQ ID NO: 342113 - RNA, 65 nt, Homo Sapiens
caggguccagggaggggcgccugcugagcacuuccgccccucacccugcccagccccugccauga

SEQ ID NO: 342114 - RNA, 65 nt, Homo Sapiens
uaccuugaaaugagaccacgucagagacauguacugccccucacauuuucucaccuaaaccagca

SEQ ID NO: 342115 - RNA, 65 nt, Homo Sapiens
ugcccuuccuugaguggucuagaaggcacugcguggccccucagaugcugggacacaacagaccc

SEQ ID NO: 342116 - RNA, 65 nt, Homo Sapiens
cgcagcagagcucaggacauucccccacagagcuugccccucaguuccuaccuccaagggggagg

SEQ ID NO: 342117 - RNA, 65 nt, Homo Sapiens
ugucagcugguuuugauggcgcgccccgggcccaggccccucagccccaccccuucccuucccug

SEQ ID NO: 342118 - RNA, 65 nt, Homo Sapiens
uugccgcgguggcuggcagcauggcacaggccacagccccucaccagggaugcugcugggagucc

SEQ ID NO: 342119 - RNA, 65 nt, Homo Sapiens
gaaugaucacccugaauucaaggaagcaccucucagccccucagauaaugugguagugaaaaucg

SEQ ID NO: 342120 - RNA, 59 nt, Homo Sapiens; identical to SEQ ID NO: 341637

SEQ ID NO: 342121 - RNA, 65 nt, Homo Sapiens
ccuguagcugcagggggaggcuccccugcccaccugccccucaacgaaggcaggagagagagcag

SEQ ID NO: 342122 - RNA, 65 nt, Homo Sapiens
cuaucccguuccuucugccugagagcccccaucaugccccucaacaggugcagacaagagguggc

SEQ ID NO: 342123 - RNA, 65 nt, Homo Sapiens
ccccucucaccggcccagugccccaggugcucucugccccucaugccucagacacugaugucugu

SEQ ID NO: 342124 - RNA, 65 nt, Homo Sapiens
cuccugccuuccugagggccggugcugcaucccaagccccucaugcaggaacgugcaaauuugca

SEQ ID NO: 342125 - RNA, 65 nt, Homo Sapiens
cugccccaccccgagaacccccucacacuggcccagccccucacagaugcccguuggacuuugcc

SEQ ID NO: 342126 - RNA, 65 nt, Homo Sapiens
cuggcccagccccucacacuugcccguuggacuuugccccucacacccaggccgcaggaguggga

SEQ ID NO: 342127 - RNA, 65 nt, Homo Sapiens
cuucaagggcuuuccuggaucccaaccagcaaagcgccccucagugcaggcccuuccucccuugg

SEQ ID NO: 342128 - RNA, 65 nt, Homo Sapiens
gcccaggccugagugagugccagguccccccacaugccccucagggacacagccaggaacccggc

SEQ ID NO: 342129 - RNA, 65 nt, Homo Sapiens
ucucuuuagucuuugucccuuccuuuucacuaagugccccucauccuuuucaaucucauugucac

SEQ ID NO: 342130 - RNA, 65 nt, Homo Sapiens
ccccuuuccuuccucuccucccaccuccucccucagccccucauucuccuugggaaucugcagag

SEQ ID NO: 342131 - RNA, 65 nt, Homo Sapiens
aaccgccagagucccagacaccgguuuuccuagaagccccucacccccacuggcccacugguggc

SEQ ID NO: 342132 - RNA, 65 nt, Homo Sapiens
gccugccaagcgagaaugcaggccccgcccccucggccccucaccaccucuuucuacagccuaau

SEQ ID NO: 342133 - RNA, 65 nt, Homo Sapiens
guaugaggagagcuucaggccccaggacugugggggccccucaggucagcucacugagcugggug

SEQ ID NO: 342134 - RNA, 65 nt, Homo Sapiens
aauauuggcaaggggaguggaaaugacaccaagaagccccucaugcucaugguuggacagagagc

SEQ ID NO: 342135 - RNA, 65 nt, Homo Sapiens
ccaauguuccacaccaucgacugcuuaggcauuuugccccucaccccauuugccucccuccagcu

SEQ ID NO: 342136 - RNA, 65 nt, Homo Sapiens
cccacgccccgccccuacaagaugaugaggcccaugccccucaccuccauucuccagucagagua

SEQ ID NO: 342137 - RNA, 65 nt, Homo Sapiens
acagucaccucacaaaccugcccuugcccuccccugccccucacagguggcaccugccacucugc

SEQ ID NO: 342138 - RNA, 65 nt, Homo Sapiens
ucccacuuucacaccuaacccuuggguguaccaaugccccucaucugaugacugcagcagaccuc

SEQ ID NO: 342139 - RNA, 65 nt, Homo Sapiens
guaguuagaaaauaaacagauccaaucacuuaguagccccucaaaaaaauaaaguauaaaacauu

SEQ ID NO: 342140 - RNA, 65 nt, Homo Sapiens
uggcguggagcugccugguuggaaccccaugacucgccccucaccugcucaccguggcaaacaca

SEQ ID NO: 342141 - RNA, 65 nt, Homo Sapiens
ccuggcccaggccccuuuugcuccacauccugccugccccucagccgugcacacagggaugcccg

SEQ ID NO: 342142 - RNA, 65 nt, Homo Sapiens
gugcaacucugggagcagcccggcccugggugccugccccucacuccccaucuugaguccuggaa

SEQ ID NO: 342143 - RNA, 65 nt, Homo Sapiens
ucuuaacauauuccugugucagaugauuucauccugccccucacuucccucuaaauaccuacccu

SEQ ID NO: 342144 - RNA, 64 nt, Homo Sapiens
uuuuauuaaaucuuccuuagacauuagugagaaagaaaaagaucgcuauuucagucucucagau

SEQ ID NO: 342145 - RNA, 64 nt, Homo Sapiens
acaggagaaaggcccuauccaugucaagcuuguggaaaaagauuuagcaggcuagaccaucuaa

SEQ ID NO: 342146 - RNA, 64 nt, Homo Sapiens
gugacagagcaagugagacccugucucaaaaaaagaaaaagaaaaagaaaaaauauuuucccua

SEQ ID NO: 342147 - RNA, 64 nt, Homo Sapiens
gagcaagugagacccugucucaaaaaaagaaaaagaaaaagaaaaaauauuuucccuauuagag

SEQ ID NO: 342148 - RNA, 64 nt, Homo Sapiens
cauaaggaaugaaguuggaaccacaggcagaucugaaaaagaaccaaauagagcuccuaaaaau

SEQ ID NO: 342149 - RNA, 64 nt, Homo Sapiens
accaaauacaagauuuuaaaagcaaccauggggagaaaaagaucagugaaagcaagacagucaa

SEQ ID NO: 342150 - RNA, 64 nt, Homo Sapiens
agguggcaccaugaagaggacucaggaaagggaagaaaaagaaggagagcaaaccaaucagucc

SEQ ID NO: 342151 - RNA, 64 nt, Homo Sapiens
aggaggcagaaagaggaggaccccccaaaaaaaagaaaaagaaaaacugcagucagagagcaag

SEQ ID NO: 342152 - RNA, 64 nt, Homo Sapiens
aauagaagacauauaaauuacccccaaaaaaagagaaaaagaaaugaauuugucacauguauca

SEQ ID NO: 342153 - RNA, 64 nt, Homo Sapiens
gggugaccuggaucucugcuggauuugcagagaugaaaaagacugcacaaauuuuggugaauug

SEQ ID NO: 342154 - RNA, 64 nt, Homo Sapiens
cccauuccucuuuauaguggcagccuuagcaucugaaaaagaagguuauucuagaaguucagga

SEQ ID NO: 342155 - RNA, 64 nt, Homo Sapiens
aaccuguccuacccucaaagagggauaagguggggaaaaagacuugggcacugggccgggcucc

SEQ ID NO: 342156 - RNA, 64 nt, Homo Sapiens
ccacugaaauucuaaguuuguuaaacugcaagaggaaaaagacuugugauauuugacuuuugcu

SEQ ID NO: 342157 - RNA, 55 nt, Homo Sapiens
ugauauuugacuuuugcuuugucuugaaaaagaugaaccugaaucaucuuuguga

SEQ ID NO: 342158 - RNA, 64 nt, Homo Sapiens
cuacaaaauuugucguaggacgaugauugaaugggaaaaagagacuguaauagaaaaccugaaa

SEQ ID NO: 342159 - RNA, 64 nt, Homo Sapiens
uuuacuuggacuuacaguuccccgagacugggaagaaaaagaggaugcugcugauaaagacgua

SEQ ID NO: 342160 - RNA, 64 nt, Homo Sapiens
augcugcauacauucuguaaaagagagagagagagaaaaagacccaguuccguucugagagaaa

SEQ ID NO: 342161 - RNA, 64 nt, Homo Sapiens
gagagagagaaaaagaccauguuccguucugagagaaaaagagacaaacauguugcuguuucca

SEQ ID NO: 342162 - RNA, 64 nt, Homo Sapiens
ugcuuaauuaauuauucuguuugauuugcuuuuggaaaaagaaauagcaagaaaggagagugac

SEQ ID NO: 342163 - RNA, 64 nt, Homo Sapiens
uagucuaauuugaugccuucauauauuuugaggagaaaaagacacugaauucugaguuuugaaa

SEQ ID NO: 342164 - RNA, 64 nt, Homo Sapiens
ggauugccacucacccacccucccugagaaaggagaaaaagauggaauggcccuagaguucuuu

SEQ ID NO: 342165 - RNA, 64 nt, Homo Sapiens
cugcaucaaugcaagccuggaaaccagcaggucugaaaaagaggcuuccaagucaguccuuugg

SEQ ID NO: 342166 - RNA, 64 nt, Homo Sapiens
aaaaagaaggagaaaguggaacccccuccuuccugaaaaagagcagaagaaaaagaaauuccga

SEQ ID NO: 342167 - RNA, 64 nt, Homo Sapiens
uuccgaacccccuccuuccuucucccucaaagaagaaaaagaaacagagggcucaccuuccaag

SEQ ID NO: 342168 - RNA, 64 nt, Homo Sapiens
ucuguaguuugagguaugacaaacacuugaauuggaaaaagaacaaaaucgcaguuaaagcaug

SEQ ID NO: 342169 - RNA, 64 nt, Homo Sapiens
aaauaaaaucgcaguuaaagaaaagagacuaucugaaaaagaagaaauaaggcuaguguacuac

SEQ ID NO: 342170 - RNA, 64 nt, Homo Sapiens
aaagaauacccaggugugguaaaaaaaagaaaaagaaaaagaaacccggucuguacuaaaaaaa

SEQ ID NO: 342171 - RNA, 64 nt, Homo Sapiens
aagaaaaaagaauacccaggaaaaaaaaaaaaaagaaaaagaaagugaaacccggucuguacua

SEQ ID NO: 342172 - RNA, 64 nt, Homo Sapiens
uuuaaugauucuaauaagagugauagcaucucuugaaaaagaauuaugacaacuuuauauuuuu

SEQ ID NO: 342173 - RNA, 64 nt, Homo Sapiens
aaaccaaauuaaaguucugaggaagcugacuuaggaaaaagagaacauguauguaaaacacaua

SEQ ID NO: 342174 - RNA, 64 nt, Homo Sapiens
uuccuaaauugcacauuuuuaacguauacaaacagaaaaagagccugguuuguguugcuaagca

SEQ ID NO: 342175 - RNA, 64 nt, Homo Sapiens
gaaaaccauucucuauuuuuguauuggucagaaagaaaaagaaaauauuugauuucuugagcau

SEQ ID NO: 342176 - RNA, 64 nt, Homo Sapiens
cuguguaccuugaauucuacaaaagucguuuaaugaaaaagagaguuuccugaaauaauuagag

SEQ ID NO: 342177 - RNA, 64 nt, Homo Sapiens
uuuguuuugcaaaagaaaagagcgugacugcaaagaaaaagacucuccagcagccucgucuuac

SEQ ID NO: 342178 - RNA, 64 nt, Homo Sapiens
uuggcacagaucuuugagaaucucauacaucugugaaaaagauaaugugaaauaaacaguaaaa

SEQ ID NO: 342179 - RNA, 64 nt, Homo Sapiens
caacuauucagaggacugugugaaguaguuacuggaaaaagaacuugaauuaugcauuuauugg

SEQ ID NO: 342180 - RNA, 64 nt, Homo Sapiens
auugcagaagugaggucauccuugaaaaguggcagaaaaagaaaauagcagagauggguccagu

SEQ ID NO: 342181 - RNA, 64 nt, Homo Sapiens
gaacuucuccaugucaagcagcaggugucagcaggaaaaagaucacaagccugccacgauggcu

SEQ ID NO: 342182 - RNA, 64 nt, Homo Sapiens
uggggcuuugcugcauucccuaagauaauuacaggaaaaagaaaauguaaaagugcuaacaagg

SEQ ID NO: 342183 - RNA, 64 nt, Homo Sapiens
cuguucauuuaaucugccuguuuugaucuguuuugaaaaagauaaagagccucaaaucagacca

SEQ ID NO: 342184 - RNA, 64 nt, Homo Sapiens
aagcaaacugcccuuuguccucaaagaaauuguugaaaaagaaaacuuuuuaaagagauuuuuu

SEQ ID NO: 342185 - RNA, 64 nt, Homo Sapiens
uuggacauacauuccaagcuuuucaacucuaggagaaaaagaaaaucauguuuuccuguauugu

SEQ ID NO: 342186 - RNA, 64 nt, Homo Sapiens
ccuguucagccggcacugagaagaacgaacacaagaaaaagauaagaaauacuagaguaaaggc

SEQ ID NO: 342187 - RNA, 64 nt, Homo Sapiens
uuuuaguugcaugaaauuuugccugcaacagagagaaaaagauuguauuacuuuaaugauuaua

SEQ ID NO: 342188 - RNA, 64 nt, Homo Sapiens
aaaguugguggauucacacuuccaaauaagccuugaaaaagaacaaugcaagggacccagaaua

SEQ ID NO: 342189 - RNA, 64 nt, Homo Sapiens
uaaauguauccagauaggaaaagcauuugggaaagaaaaagaaauuaagaagcuaauguuuaag

SEQ ID NO: 342190 - RNA, 64 nt, Homo Sapiens
augucccuguggaaauguccuuaacuuggaaaaggaaaaagaagcagucgagcugaagacaauu

SEQ ID NO: 342191 - RNA, 64 nt, Homo Sapiens
uuuuuaagagugacuauuaccacgaaaauuucuagaaaaagaagugaaacauuccaccuggcua

SEQ ID NO: 342192 - RNA, 64 nt, Homo Sapiens
aaaaguacacauucagaauccaugagugcauuuugaaaaagaaagaauaugaacuuugguucuu

SEQ ID NO: 342193 - RNA, 64 nt, Homo Sapiens
aaaccucacuuuuccuuuauagaaguacguuaaagaaaaagaaagaccaagaagcucaaagaaa

SEQ ID NO: 342194 - RNA, 64 nt, Homo Sapiens
cccacuuauucuuaguuaaucucuguacaaaggagaaaaagaacgcuccuagugaaagaaaaau

SEQ ID NO: 342195 - RNA, 64 nt, Homo Sapiens
accguggcuauaaccauaacgagaccgcccuagagaaaaagauucugaaggaacucacuuccaa

SEQ ID NO: 342196 - RNA, 64 nt, Homo Sapiens
uuugcuguauuaacugaugauaaaacuaauggcagaaaaagaaguugagcaauuucuauguaau

SEQ ID NO: 342197 - RNA, 64 nt, Homo Sapiens
acaaccaaagaaaauugguaugaacauuaauguugaaaaagaaacuaccuggcuacaauuacuu

SEQ ID NO: 342198 - RNA, 64 nt, Homo Sapiens
auauugccaaauauuaagaagauauuuuuugauggaaaaagaaugacaguguuuuaggugccug

SEQ ID NO: 342199 - RNA, 64 nt, Homo Sapiens
aagcauuuuauauuacuacugcacuuguaacaaugaaaaagaaacauguuggcaaucaaagcau

SEQ ID NO: 342200 - RNA, 64 nt, Homo Sapiens
aaaaagaacguugcaaauuuaaaaaaaaaaaacagaaaaagaaacugaauuaggcagucuuaaa

SEQ ID NO: 342201 - RNA, 64 nt, Homo Sapiens
cugaguggacuggccucaaagcaagcauucagaagaaaaagaagcaaccucaguaauuuagaaa

SEQ ID NO: 342202 - RNA, 64 nt, Homo Sapiens
ugagagcauugggauaucuccugaaaagguuuaugaaaaagaagaaucucaucucagugaagaa

SEQ ID NO: 342203 - RNA, 64 nt, Homo Sapiens
uaauuuaaagccacaaccacauacaacacaaagagaaaaagaaaugcaaaaaucucugcgugca

SEQ ID NO: 342204 - RNA, 64 nt, Homo Sapiens
uucaaagcugcuuuauucaauaaaaaaaagaaaugaaaaagauauaugaauaugacaaaguauu

SEQ ID NO: 342205 - RNA, 64 nt, Homo Sapiens
guuuacagauaacucucuucacuauuccuaggaggaaaaagaaaugcauucgguacuuacccgg

SEQ ID NO: 342206 - RNA, 64 nt, Homo Sapiens
acauauucuaguguaacacugcaagaagucuugagaaaaagauuauuguaguguucaaaauauu

SEQ ID NO: 342207 - RNA, 64 nt, Homo Sapiens
gagacucugucucagaaaaaaaaaaaaagaaaaggaaaaagaaaaauauauauucuauauuuuu

SEQ ID NO: 342208 - RNA, 64 nt, Homo Sapiens
aaauugcaaagcacagauaaauggaaauaaacaggaaaaagaaucaccuauaaccucaccaucc

SEQ ID NO: 342209 - RNA, 64 nt, Homo Sapiens
cuucuaccucccuccuuugaaugaggguaugguagaaaaagaucuggcccaauggcauaaguuu

SEQ ID NO: 342210 - RNA, 64 nt, Homo Sapiens
aagguuugaauggaguugaaaguuuuacauaagugaaaaagaaaguuuaucuugggaguugagu

SEQ ID NO: 342211 - RNA, 64 nt, Homo Sapiens
aauaaaaccuuugaaaguagccuuaauauugugugaaaaagaguuuuaauuuuaagacugaaac

SEQ ID NO: 342212 - RNA, 64 nt, Homo Sapiens
gcaagcuuuccugccaauuugaaggaaggaagaagaaaaagacucuugaugaaagaaaaagaca

SEQ ID NO: 342213 - RNA, 64 nt, Homo Sapiens
gaaggaaggaaggaaggaagugcucuugaugaaagaaaaagacauuaaaaagcccucuuaauga

SEQ ID NO: 342214 - RNA, 64 nt, Homo Sapiens
gacuggguucgaucagcccuccuaaagcuggcuggaaaaagaagccccagcccagccugccuca

SEQ ID NO: 342215 - RNA, 64 nt, Homo Sapiens
cauuuuuaguuacuuaccuugaacauauucgugugaaaaagaauacaucauuucucacagucuu

SEQ ID NO: 342216 - RNA, 64 nt, Homo Sapiens
aagaugaaaauaggaacaaaaaagggaaaaagaagaaaaagagagaagggagggaaacagggag

SEQ ID NO: 342217 - RNA, 64 nt, Homo Sapiens
aaaaagagaaagaugaaaauaacagggagaaagggaaaaagaagggaaggaaagaagggaggga

SEQ ID NO: 342218 - RNA, 64 nt, Homo Sapiens
gaacagacaaagguuugaaaccaucaaagaagaagaaaaagaagcuuuuaauauuuuaugauug

SEQ ID NO: 342219 - RNA, 64 nt, Homo Sapiens
agugagugaacagcaaggaacccacgccuuuuaggaaaaagaaaccugggaucccucugucaac

SEQ ID NO: 342220 - RNA, 64 nt, Homo Sapiens
uacccuuuggccuacagaucgaguaauuaauaaagaaaaagaaguugcuguggccuagacuucu

SEQ ID NO: 342221 - RNA, 64 nt, Homo Sapiens
auuugugcauuuuauugacuuggccauguauuaugaaaaagauuuucaagugauaggauaaagu

SEQ ID NO: 342222 - RNA, 64 nt, Homo Sapiens
acauggcagaaguugaaacauaaaaaguaaaaaugaaaaagacgcaauuuaguuaccucccaac

SEQ ID NO: 342223 - RNA, 64 nt, Homo Sapiens
ugucuuucuuguuagugaacauuuaaaacacgaagaaaaagaaaguuuauguuuguguucuuaa

SEQ ID NO: 342224 - RNA, 64 nt, Homo Sapiens
auguuuauguucuuauagaaugcugcugugcguggaaaaagacgagaauaaauuaauauuguau

SEQ ID NO: 342225 - RNA, 64 nt, Homo Sapiens
aaaacuauaaauacaaaucuaaccuguagaugcagaaaaagaaauuacaugcauaaaaggguca

SEQ ID NO: 342226 - RNA, 64 nt, Homo Sapiens
auaaaaauuaaauuaaaaaaggcucacagaaaaagaaaaagaaaaaguuucaauacaagccaua

SEQ ID NO: 342227 - RNA, 64 nt, Homo Sapiens
aagaaaauaaaaauuaaauugccauaggcucacagaaaaagaaaaaccuaaaguuucaauacaa

SEQ ID NO: 342228 - RNA, 64 nt, Homo Sapiens
cuuaaggaucugcucuaugaaggagaagaaagaggaaaaagaaguaaaggaguuaggaggagac

SEQ ID NO: 342229 - RNA, 64 nt, Homo Sapiens
ccguuggucggaaacuuuuccaucugucgcccuagaaaaagagaaagcuuaccaucgagggugu

SEQ ID NO: 342230 - RNA, 64 nt, Homo Sapiens
uagaaaaggaaacuaguagggccaaaaaaaaaaagaaaaagaaaaagaaaaaagaaaaaaaaag

SEQ ID NO: 342231 - RNA, 64 nt, Homo Sapiens
aggaaacuaguagggccaaaaaaaaaaagaaaaagaaaaagaaaaaagaaaaaaaaagaaaaaa

SEQ ID NO: 342232 - RNA, 64 nt, Homo Sapiens
uugaacccauccacucugggcagguaagagaaaagaaaaagauaaggaaagaagagagaagaga

SEQ ID NO: 342233 - RNA, 64 nt, Homo Sapiens
acuacagaccaaaacagaagaagaagaaaaaaaagaaaaagaaaucuaagcaacaugguaagua

SEQ ID NO: 342234 - RNA, 64 nt, Homo Sapiens
gcagaacgaaguuaccagcaggauggaccuaauagaaaaagaagucgaugguaauuuaagaaag

SEQ ID NO: 342235 - RNA, 64 nt, Homo Sapiens
ugaacauaaucaaguaaggaugauacaguuuucagaaaaagaaaaacuccauuacucugauuuu

SEQ ID NO: 342236 - RNA, 64 nt, Homo Sapiens
auauacaugaagaauagaaacagaaaaaaagagugaaaaagagaaugguuaauuucauguaaaa

SEQ ID NO: 342237 - RNA, 64 nt, Homo Sapiens
ugggagcuggucacacaggggguuggggaagcuagaaaaagaaaucuuuuaguaaggcauuugg

SEQ ID NO: 342238 - RNA, 64 nt, Homo Sapiens
augaaaaguauuauuaagcuuccuuaugaaacaagaaaaagaaaagaacauuuggcaggaauug

SEQ ID NO: 342239 - RNA, 64 nt, Homo Sapiens
ugcaagagggaaggugauugguagugaguuaaaagaaaaagagaggaaaagagaguaguuuugu

SEQ ID NO: 342240 - RNA, 64 nt, Homo Sapiens
uuagauaaauuuucguggauuuagucauaagauggaaaaagacuggugaaucuuuuauuacaaa

SEQ ID NO: 342241 - RNA, 64 nt, Homo Sapiens
cauuuguauuugcauuacuauaauacuuugaguugaaaaagaguuucauuguggagagaaaaag

SEQ ID NO: 342242 - RNA, 64 nt, Homo Sapiens
guuuuaauugagguauaaauuaaugagacaaagugaaaaagaaauuauauucagauaggacugc

SEQ ID NO: 342243 - RNA, 64 nt, Homo Sapiens
ucaagcagcuaacagaaauaagaagaaaacaggugaaaaagacagugugauaaggccauggugg

SEQ ID NO: 342244 - RNA, 64 nt, Homo Sapiens
ccugcaucgaacugccaacauaguacaccuuuuagaaaaagauucuuguugcaaaaguaccaua

SEQ ID NO: 342245 - RNA, 64 nt, Homo Sapiens
uucagaaauuggguuuugguucagugauucucaagaaaaagaucucuugcccauuaagaagugu

SEQ ID NO: 342246 - RNA, 64 nt, Homo Sapiens
acgcugcugauaaagacauaccugagaccaggaagaaaaagagguuuaauuggacuuacaguuc

SEQ ID NO: 342247 - RNA, 64 nt, Homo Sapiens
cacugcugauaaagacauuccucaagauugugaagaaaaagagguuuaauuggacuuacaguuc

SEQ ID NO: 342248 - RNA, 62 nt, Homo Sapiens
cauaccaaguagcuggugcuaaucaguuuaaucagaaaaagaugaaguagacaguguggugg

SEQ ID NO: 342249 - RNA, 64 nt, Homo Sapiens
guauucauacagaaauuacccuuaagguguauaagaaaaagaaagcagauaacagcaggaagga

SEQ ID NO: 342250 - RNA, 64 nt, Homo Sapiens
uucuucucauccaguaauuucaccuuauucuucugaaaaagacucugagaaaaagaaugagaac

SEQ ID NO: 342251 - RNA, 64 nt, Homo Sapiens
gagaaccaccuuauucuucuccagauggcacugagaaaaagaauaguuuaccuuuugacuggaa

SEQ ID NO: 342252 - RNA, 64 nt, Homo Sapiens
cccagaauguugcuucuauucuguaggaucuuaagaaaaagaguugugugugcauaaauucauu

SEQ ID NO: 342253 - RNA, 64 nt, Homo Sapiens
cauucuacguauccuugugguuauuucuggaggggaaaaagaucacaauucuuuccuggggaaa

SEQ ID NO: 342254 - RNA, 64 nt, Homo Sapiens
aagaagcagcuuugcugaguaaaaaaaagaaaaagaaaaagaggcuuuuuuuuccucucaaaaa

SEQ ID NO: 342255 - RNA, 64 nt, Homo Sapiens
aagaggaagaagcagcuuugcaaaaaaaaaaaaagaaaaagaaaagugggcuuuuuuuuccucu

SEQ ID NO: 342256 - RNA, 64 nt, Homo Sapiens
aaauaaccccuauuuuuccuguuuuuaauaaggggaaaaagauaaccuugguuugguaguucuu

SEQ ID NO: 342257 - RNA, 64 nt, Homo Sapiens
aacaaaaucuccgcagugucucggacuaaaaaaggaaaaagaaaccaucuggaggaaaaccaga

SEQ ID NO: 342258 - RNA, 64 nt, Homo Sapiens
uagucaauaugaggauggugguuuauucucagaagaaaaagauauguaaggucuuuuagcuccu

SEQ ID NO: 342259 - RNA, 64 nt, Homo Sapiens
aguguugucaaguaacaguuacugaaagagcugagaaaaagaacaaugaacagcaacgaucuug

SEQ ID NO: 342260 - RNA, 64 nt, Homo Sapiens
uggguguaggauaugaaauuguacuuagauuuaagaaaaagagaaaaucagauguauuuauuug

SEQ ID NO: 342261 - RNA, 64 nt, Homo Sapiens
gcccugagucaaaaggauagccaaggguggaguggaaaaagauauggugaaggcagaacugcuc

SEQ ID NO: 342262 - RNA, 64 nt, Homo Sapiens
auccagggaaugguacaacagcauuauucugauggaaaaagauuaggcaaagagggagcacaca

SEQ ID NO: 342263 - RNA, 64 nt, Homo Sapiens
cauggauccuugaggagcugcugccagauagauagaaaaagaagaagaaacagaagaacucaug

SEQ ID NO: 342264 - RNA, 64 nt, Homo Sapiens
guagaguagaggccuauugcaagaaagagaagaagaaaaagaagauccugaacggaaaaggaag

SEQ ID NO: 342265 - RNA, 64 nt, Homo Sapiens
aaagaagaggauccugaacggaucacaagaagaagaaaaagaaacagaaacaccaucugauuca

SEQ ID NO: 342266 - RNA, 64 nt, Homo Sapiens
cgcuuguaugauuuucaaaaacaccuaacuuuaagaaaaagaacauuuuuaauugaguguaaac

SEQ ID NO: 342267 - RNA, 64 nt, Homo Sapiens
auuuucaaauaaaacccaaaacaaaauacuccaagaaaaagaaacuguaguaguuggucuagaa

SEQ ID NO: 342268 - RNA, 64 nt, Homo Sapiens
aacauacuaccuaaagggaaccugcaauaaucuugaaaaagaaaaagagaaaaauuuuaaaauc

SEQ ID NO: 342269 - RNA, 64 nt, Homo Sapiens
cuaccuaaagggaaccugcaauaaucuugaaaaagaaaaagagaaaaauuuuaaaauccugcua

SEQ ID NO: 342270 - RNA, 64 nt, Homo Sapiens
aaguugaccuuugcacuggcauuaaagagucauagaaaaagaaucauggauauuuaugaauuaa

SEQ ID NO: 342271 - RNA, 64 nt, Homo Sapiens
agugucacugcugucuucuagucaaacuuguaaagaaaaagauuccaguucaguauuugcagca

SEQ ID NO: 342272 - RNA, 64 nt, Homo Sapiens
gcaaagauccaccgagagaagaagagaaagaaaagaaaaagaaaaagcacaaaaaaagaucucg

SEQ ID NO: 342273 - RNA, 64 nt, Homo Sapiens
cuccagccaggagcgcuccaggggagucucucaggaaaaagaagcccagaucucuucagcaauc

SEQ ID NO: 342274 - RNA, 64 nt, Homo Sapiens
cugaauaccuaagauuucugcuagcaaugccugugaaaaagaaaccagaguuuugguuuuugaa

SEQ ID NO: 342275 - RNA, 64 nt, Homo Sapiens
ucaaagacaaaguguguaaugaugguaaaaagaagaaaaagaagauaaagaaaagaugagcaaa

SEQ ID NO: 342276 - RNA, 64 nt, Homo Sapiens
gaucaugaggucagcaguugagaccagccaaaaggaaaaagaaaauuaugagaguuacuuaaag

SEQ ID NO: 342277 - RNA, 64 nt, Homo Sapiens
cauuguaacuuuuuguuagagaugaucccauuuagaaaaagacugguagaaauuggagugaaag

SEQ ID NO: 342278 - RNA, 64 nt, Homo Sapiens
aaaagcaaucucgcaguacauauugauggaaaaagaaaaagaagaggcauuccagccccuaugu

SEQ ID NO: 342279 - RNA, 64 nt, Homo Sapiens
aagaagaaaagcaaucucgccuauguuauugauggaaaaagaaaaaaaagaggcauuccagccc

SEQ ID NO: 342280 - RNA, 64 nt, Homo Sapiens
aagauagccuucacguuccccaucugucuucagagaaaaagagcugggacaccaagaacaagcu

SEQ ID NO: 342281 - RNA, 62 nt, Homo Sapiens
ccauguacagcuggcaucuaauaaauguuuucaugaaaaagauuuucuagccaaggucccuu

SEQ ID NO: 342282 - RNA, 64 nt, Homo Sapiens
gcccaaggcaaagaaggggguaaaaagaagaaacgaaaaagaaaaaaaauuuugaaaaagaaga

SEQ ID NO: 342283 - RNA, 64 nt, Homo Sapiens
auaaaaagaagaaacgaaaacaccaaaaaauuuugaaaaagaagaugauguuccacugagaaaa

SEQ ID NO: 342284 - RNA, 64 nt, Homo Sapiens
ugagaguagugguuuuccuuuaaccgugugcuuagaaaaagagggcuuuaaucucuacuugcua

SEQ ID NO: 342285 - RNA, 64 nt, Homo Sapiens
aaugaaagaaccaaggagaguuuuuuaaagaacagaaaaagaugauuccaaaguuuuauuuuac

SEQ ID NO: 342286 - RNA, 64 nt, Homo Sapiens
acaaugcuuuccauauugugaauuuaauuuaguggaaaaagaagacuguggcacuuuucaccau

SEQ ID NO: 342287 - RNA, 64 nt, Homo Sapiens
gcuacugugccuuguguuacuguugcaacauaaugaaaaagauguuaucgaggcacgugaucag

SEQ ID NO: 342288 - RNA, 64 nt, Homo Sapiens
cugucuaugccaaucauguaaaaugacguuucuugaaaaagauucagugguucagcuuugucag

SEQ ID NO: 342289 - RNA, 64 nt, Homo Sapiens
ugaugggggcuguguaaugggggcagaggccagggaaaaagaugcuguucacccacccucagcu

SEQ ID NO: 342290 - RNA, 64 nt, Homo Sapiens
agaaacuagaaacaguuaaagccuuccaagagaagaaaaagaaguaaagaauuugucaauccua

SEQ ID NO: 342291 - RNA, 64 nt, Homo Sapiens
cugcuuucaaaacgaaagcucaauagaaucacucgaaaaagaaugaaugagaaaaauccuaacc

SEQ ID NO: 342292 - RNA, 64 nt, Homo Sapiens
gacucagagacccgggagggaaauugaguccaaggaaaaagagacaacucaggagugagcagga

SEQ ID NO: 342293 - RNA, 64 nt, Homo Sapiens
gaaagagaaauaggaggagggaagaaggaagaaagaaaaagacaaaaagaaaaagaaaaagcaa

SEQ ID NO: 342294 - RNA, 64 nt, Homo Sapiens
aagcaagaagaaggaagaaauuucuuaaaaaaaagaaaaagaaagauucaaaucucuugcuuuc

SEQ ID NO: 342295 - RNA, 64 nt, Homo Sapiens
agugcuguuucuuuuuuuuuuuuucucuugaccagaaaaagauuuguuuaccuaccauuucauu

SEQ ID NO: 342296 - RNA, 64 nt, Homo Sapiens
uuggugcaaagaaguauaaacauauaucacuaaggaaaaagaaaguuugucuugcccuucugac

SEQ ID NO: 342297 - RNA, 64 nt, Homo Sapiens
uccaaacugcuuuguguauuguauauuuuuuuaagaaaaagaaaagccuuauuugacuuaugcu

SEQ ID NO: 342298 - RNA, 64 nt, Homo Sapiens
ggugaaucuagagccuacuuuuauuuugguuaaagaaaaagaaaauaucaauaauucaauuuug

SEQ ID NO: 342299 - RNA, 64 nt, Homo Sapiens
augaguuacacugagaaugagaguuacagaaaaugaaaaagaaaguggaguaauagggaaagaa

SEQ ID NO: 342300 - RNA, 64 nt, Homo Sapiens
auuucuuuuacuguguuuaauuaucuugcacaaagaaaaagaaagaaaaggucuucugacacac

SEQ ID NO: 342301 - RNA, 64 nt, Homo Sapiens
gaaagaaagaaagggaaagauggaaggaaggaaggaaaaagaaagagaaagagagagagagaga

SEQ ID NO: 342302 - RNA, 64 nt, Homo Sapiens
aggaaaaagaaagagaaagagagagagagagaaagaaaaagaaagaaaaguaagaaagaaaaaa

SEQ ID NO: 342303 - RNA, 64 nt, Homo Sapiens
gaaagaaaaagaaagaaaaguaagaaagaaaaaagaaaaagaaagaaaaguaagaaagaaaaaa

SEQ ID NO: 342304 - RNA, 64 nt, Homo Sapiens
aaaacgaaaagaagaaacaacugaaauugaaaaagaaaaagaagagaaauugagaaguauguug

SEQ ID NO: 342305 - RNA, 64 nt, Homo Sapiens
aagaagaaaacgaaaagaagauguugcugaaauugaaaaagaaauccugaagaaauugagaagu

SEQ ID NO: 342306 - RNA, 64 nt, Homo Sapiens
auguagauguugcccuacuaaagaacgagagcaagaaaaagauguuugcuguuuuaugguugug

SEQ ID NO: 342307 - RNA, 64 nt, Homo Sapiens
gaauuucaaaagaauccggccuaauuucaaucuggaaaaagaucagaaacuucuacagauauua

SEQ ID NO: 342308 - RNA, 64 nt, Homo Sapiens
gaaucauacuaaagacauuugcgcuuacuuuguugaaaaagaaaaagaaauuaaauuugaacac

SEQ ID NO: 342309 - RNA, 64 nt, Homo Sapiens
uacuaaagacauuugcgcuuacuuuguugaaaaagaaaaagaaauuaaauuugaacacagugaa

SEQ ID NO: 342310 - RNA, 64 nt, Homo Sapiens
uguguaagucacccccaccaaaaacaaaagagaagaaaaagaauagaaagaauuauccaguguc

SEQ ID NO: 342311 - RNA, 64 nt, Homo Sapiens
aaggcagggaauagacuucuagaaaaccugagaggaaaaagaauucuuuuuacaggaggcagca

SEQ ID NO: 342312 - RNA, 64 nt, Homo Sapiens
ucucuuuccaauuucacuuugguggucugaagaagaaaaagaaauuuuauguauguauguguaa

SEQ ID NO: 342313 - RNA, 64 nt, Homo Sapiens
ccuacucaagaaaagacagaacaagaacuuaagagaaaaagaaaaacaacacuaacaugagaac

SEQ ID NO: 342314 - RNA, 64 nt, Homo Sapiens
ucuguugaagaaaggacagaaagcacaggaaagagaaaaagaaaccuccgagaaagaagaacgu

SEQ ID NO: 342315 - RNA, 64 nt, Homo Sapiens
uaugaagauacagauuuagauccaagcauaaaaggaaaaagaguaaaggccagagaaagagcag

SEQ ID NO: 342316 - RNA, 64 nt, Homo Sapiens
uaaugcaugcgggguuuaauggggagagcaguaggaaaaagagcauaaacuaaauuaauuuuua

SEQ ID NO: 342317 - RNA, 64 nt, Homo Sapiens
ccaagucugucuugacaacuuuacuagaauguuggaaaaagaugucucaguuccuuccuuuggg

SEQ ID NO: 342318 - RNA, 64 nt, Homo Sapiens
aaauaaaacugucuuuggcagugaguaaauagcauauuuugaaguagaguuguauacuuuuuca

SEQ ID NO: 342319 - RNA, 64 nt, Homo Sapiens
aggaaaaaaagaaaaaaaccuuaucucuugcccuuauuuugaauuuuccacucuuucauuaauu

SEQ ID NO: 342320 - RNA, 64 nt, Homo Sapiens
gaacaucuuaaugcagccugcauagugaaaugguuauuuugagaucaccgcucuguagcuaacc

SEQ ID NO: 342321 - RNA, 64 nt, Homo Sapiens
ugcuggguacaaugcuucuaugaauauuuccauguauuuugacuggggagaggcauggagaaga

SEQ ID NO: 342322 - RNA, 64 nt, Homo Sapiens
ugguuuucuuuuuucagccuuugcgcuuuuucaguauuuugaccauagggagauaauuuuuuua

SEQ ID NO: 342323 - RNA, 64 nt, Homo Sapiens
gugauuguuuuaaaaucuaaugggaaguaaaauauauuuugauuuuacccagcuuaaucuguaa

SEQ ID NO: 342324 - RNA, 64 nt, Homo Sapiens
caaaucguuggugccaucagugauuuacaaacaauauuuugauauugcagaugacuugcuuacu

SEQ ID NO: 342325 - RNA, 64 nt, Homo Sapiens
auacuuuuaaagacaguuuuaauguugaauuugguauuuugaaggguuauuuuuaauguauuuu

SEQ ID NO: 342326 - RNA, 64 nt, Homo Sapiens
uuacauuauauauguauugugaacuuuaaaagacuauuuugauaaauuuauaaauauauaaaau

SEQ ID NO: 342327 - RNA, 64 nt, Homo Sapiens
uauaaauauauaaaauuauguaaaaacuacacuauauuuugauuuagauuuuccugcuguuugc

SEQ ID NO: 342328 - RNA, 64 nt, Homo Sapiens
aauauuagccuucuagucuguaauggaaauuguauauuuugauagaaguuuuuucuccauuggu

SEQ ID NO: 342329 - RNA, 64 nt, Homo Sapiens
cuggaacauccaaaaccaagcaaagggaugugacuauuuugaaugaaucagaaugucaacuugu

SEQ ID NO: 342330 - RNA, 64 nt, Homo Sapiens
aauuaguggagaaauggcauuuuuguuuuguuuuuauuuugauaaggcaaaguagccaagagcc

SEQ ID NO: 342331 - RNA, 64 nt, Homo Sapiens
ucuccugucuuuuuaaacuuugccaggauugaauuauuuugaaaaguuuuggaguuugaauuuc

SEQ ID NO: 342332 - RNA, 64 nt, Homo Sapiens
auauuuuuacagugagcuuuaucuuauguagaaauauuuugauaucuaaaaaugaaagcaagau

SEQ ID NO: 342333 - RNA, 64 nt, Homo Sapiens
uucccuaugcuaagggugcccaacuguaaaugucuauuuugaaauaaacuauguuguaagcagc

SEQ ID NO: 342334 - RNA, 64 nt, Homo Sapiens
ugguuuuacuuuaauuucuccuaaaauguauaaauauuuugauuauauccuuuuugucccaucu

SEQ ID NO: 342335 - RNA, 64 nt, Homo Sapiens
uauagggauacauaaauuuauuaauugcccuuaauauuuugacaaaaccucauagucauuuuuc

SEQ ID NO: 342336 - RNA, 64 nt, Homo Sapiens
gacuuacaaacucuucuuaauguacuaggcauuuuauuuugauuaaucccaaagacuuuuccua

SEQ ID NO: 342337 - RNA, 64 nt, Homo Sapiens
gagaacuuuucauucuauaacccagugaaaaguguauuuugauaugucuauuuuauuuauuuuu

SEQ ID NO: 342338 - RNA, 64 nt, Homo Sapiens
aauagauacaaacucaauuuugcauagaaagguguauuuugaauaguucccauguuguguucuc

SEQ ID NO: 342339 - RNA, 64 nt, Homo Sapiens
agugaauuuucaauauggaccaggaaggcauauguauuuugaacuugagugaaaagguugaagu

SEQ ID NO: 342340 - RNA, 64 nt, Homo Sapiens
aagcaauaugauguacauuacuuuugagaaacaguauuuugacuaggaccucucuuauuuguca

SEQ ID NO: 342341 - RNA, 64 nt, Homo Sapiens
uuauaacugaaucuaaguauuagacugcuacucauauuuugaacugcagguguaggacaguguu

SEQ ID NO: 342342 - RNA, 64 nt, Homo Sapiens
ugauacacagaugucuuuccuagcaguaaaucaauauuuugaagcauaaauucagagugauguu

SEQ ID NO: 342343 - RNA, 64 nt, Homo Sapiens
aaaacuuggcugucgaaacaauucugucacauaauauuuugaaguagccggugaauugagucgu

SEQ ID NO: 342344 - RNA, 64 nt, Homo Sapiens
augcuuuagaaagguuuugacaccaaaaaagcuguauuuugaaagccaaccuauuuugaaguac

SEQ ID NO: 342345 - RNA, 64 nt, Homo Sapiens
uaccaccaaaaaagcuguauguuuugugccaaccuauuuugaaggagaccaaaugucacguuuu

SEQ ID NO: 342346 - RNA, 64 nt, Homo Sapiens
uguuuuccuuuaguuugaaaguaucuucuuuuaauauuuugauuguacacuuuuagauuagaca

SEQ ID NO: 342347 - RNA, 64 nt, Homo Sapiens
agaaaaagacauagucuaaugaguuuugaaaauauauuuugaggguaucagucuucugaauucu

SEQ ID NO: 342348 - RNA, 64 nt, Homo Sapiens
agugaaguaaaugcuauugaguuagcauauaauguauuuugaagcuuauaaagugauaguacau

SEQ ID NO: 342349 - RNA, 64 nt, Homo Sapiens
auauauugagaagaauuaagaggaaggaaggaaauauuuugagaagaaaagacagaaaaggaag

SEQ ID NO: 342350 - RNA, 64 nt, Homo Sapiens
gcaacaccucaacucaucuuguuauguuuaauuuuauuuugaaaugacuucauccaaucucuau

SEQ ID NO: 342351 - RNA, 64 nt, Homo Sapiens
auauccauuaaggacccaggguuaaagugccucauauuuugaaaaguuuuuuuauaguuuaaaa

SEQ ID NO: 342352 - RNA, 64 nt, Homo Sapiens
uccccaauacauugauuuugccccuaugagaagauauuuugaucaaguuguauuugcuauuuuu

SEQ ID NO: 342353 - RNA, 64 nt, Homo Sapiens
gcauuucucuuaaauggaucgaugguuauugccuuauuuugacuaagaaaaguacagauaggcu

SEQ ID NO: 342354 - RNA, 64 nt, Homo Sapiens
uugaguuauaacuaguauuacacagcuuuuacacuauuuugacuuacccccuacaaaagcacuc

SEQ ID NO: 342355 - RNA, 64 nt, Homo Sapiens
cacuaagaauuuucauuuuuaggggucaaaaaccuauuuugaaaauaguguugugugaaugcug

SEQ ID NO: 342356 - RNA, 64 nt, Homo Sapiens
gaaacaauuuugccuccauauuucagugcaaauauauuuugaaguuacuuuuaaauauuuauuu

SEQ ID NO: 342357 - RNA, 64 nt, Homo Sapiens
aaaauaauugaagcuuccaugagaaagaaaacacuauuuugauaaauuggaucacuuauaggaa

SEQ ID NO: 342358 - RNA, 64 nt, Homo Sapiens
ugcauuucguauuguucuguauauuucaaaaugguauuuugaugccaucaaaugcccaggaaau

SEQ ID NO: 342359 - RNA, 64 nt, Homo Sapiens
gcuaucgcaacaauccuggcagacaauugaguaauauuuugaugauuuauuuuguuuguaauua

SEQ ID NO: 342360 - RNA, 64 nt, Homo Sapiens
ucaaaagagagaaaccuguauaauaguaagaucuuauuuugaauaaaaacgucuauaauuacaa

SEQ ID NO: 342361 - RNA, 64 nt, Homo Sapiens
cuauacccuaaguaaaaugaggacgaaagacaaauauuuugaaagccuaguccaucagaauguu

SEQ ID NO: 342362 - RNA, 64 nt, Homo Sapiens
cuuuuuaauguuuacagaaauuuuaauuuuuuucuauuuugaaauuugaggcuuguuuacauug

SEQ ID NO: 342363 - RNA, 64 nt, Homo Sapiens
uggacaguuuauucauuugcugauaguacuuuuguauuuugauaugaaagucagaggugauuau

SEQ ID NO: 342364 - RNA, 64 nt, Homo Sapiens
ccuuuuaguacuaaaauuuuuuucugucacuaauuauuuugagguuagcaaauuaauaacacua

SEQ ID NO: 342365 - RNA, 64 nt, Homo Sapiens
uuuugaaugagauauauaauaagaauguggccauuauuuugauuggagaauuccuugcuguuag

SEQ ID NO: 342366 - RNA, 64 nt, Homo Sapiens
aucaaugccuaugaauucuuuauguugaaauucuuauuuugaccacucuucugucauuugcugc

SEQ ID NO: 342367 - RNA, 64 nt, Homo Sapiens
ugcuaaaaccucaauuuaagucuuuaaaagguuguauuuugaauguaaccaaaaguuuacaguu

SEQ ID NO: 342368 - RNA, 64 nt, Homo Sapiens
uuuauauuugauuuugaaauguauuuuuguacuuuauuuugaauaucauccauaugucugacau

SEQ ID NO: 342369 - RNA, 64 nt, Homo Sapiens
uguggguacugcuuucauaaaacaguuuuuucaguauuuugagaauugccauauuaauuuuuau

SEQ ID NO: 342370 - RNA, 64 nt, Homo Sapiens
ugauucacauaguuuuaugcauuuccugcuaauuuauuuugaguuuuaagaaaacaaccaaaac

SEQ ID NO: 342371 - RNA, 64 nt, Homo Sapiens
aacaauuccaaugaaaauuuuaguaacaauuguuuauuuugaggguauuuguucauaacauuaa

SEQ ID NO: 342372 - RNA, 64 nt, Homo Sapiens
aaauuaggaaauauauaugaaugucguugaagucuauuuugagacugcuaaagcuauuaauuga

SEQ ID NO: 342373 - RNA, 64 nt, Homo Sapiens
uauauagauuauauuuguauucauucuaaauauauauuuugaaauucuguagauuauuugaaaa

SEQ ID NO: 342374 - RNA, 64 nt, Homo Sapiens
auaauuuaauucuuuuauuguacuugaaucucauuauuuugacauaaaguuuugacauuuaaau

SEQ ID NO: 342375 - RNA, 64 nt, Homo Sapiens
gaugcauguuuuuuuuaaauuaguggagucugguuauuuugacagcuaacagauuuguaugguu

SEQ ID NO: 342376 - RNA, 64 nt, Homo Sapiens
ugcuuugacagcuaacagauacuuggaggaugcauauuuugauacuaagucacauuggaaguga

SEQ ID NO: 342377 - RNA, 64 nt, Homo Sapiens
agauuuauuggaagauacuuacaggggaaauuaauauuuugacuauuuuuauauauaaagaaga

SEQ ID NO: 342378 - RNA, 64 nt, Homo Sapiens
ugauuuuuauggauauaguagaagaaaugugcuguauuuugauaaaauucacuuauuguaugug

SEQ ID NO: 342379 - RNA, 64 nt, Homo Sapiens
caucuuuuucuuuucuuuuuuuuagaauagcugauauuuugauaacaaucucuaauuugcaugg

SEQ ID NO: 342380 - RNA, 64 nt, Homo Sapiens
uaaaaauaucuaaaauaauguucauggugaaucuuauuuugagaaauacauguuaaaaaaggaa

SEQ ID NO: 342381 - RNA, 64 nt, Homo Sapiens
acgggugcacgccaccaugcccagcuaauuuuuguauuuugaguagagacaggguuucaccgug

SEQ ID NO: 342382 - RNA, 64 nt, Homo Sapiens
gaugauuaucugcuaaguaagucugaaaauguaauauuuugauaauacuguaauauaccuguca

SEQ ID NO: 342383 - RNA, 64 nt, Homo Sapiens
gaaucagucgaaucauucuguggaugccaaagaauauuuugaccauaauacagcacagccugga

SEQ ID NO: 342384 - RNA, 64 nt, Homo Sapiens
ugugcaagaaaaguauuuuuauguaucauaaauguauuuugaaacaaaugagaagaagaaaggu

SEQ ID NO: 342385 - RNA, 64 nt, Homo Sapiens
aacaaaaacgccuuuucuugguucuuuuuucaguuauuuugaagguccagcauccugauuaaau

SEQ ID NO: 342386 - RNA, 64 nt, Homo Sapiens
cagcagcagcuuucagcucuuaaaaagacacuuauauuuugauuuuacaugcugguuaccuguu

SEQ ID NO: 342387 - RNA, 64 nt, Homo Sapiens
agaguauauuuaaguauauauugugguucauguauauuuugaccugguagguagaaguuaauau

SEQ ID NO: 342388 - RNA, 64 nt, Homo Sapiens
auauuuaaauauugcacuucuaguuacuguguuuuauuuugaaauaaguuauugugauucauuu

SEQ ID NO: 342389 - RNA, 64 nt, Homo Sapiens
aaauauggaacaaaucaauuuauaacauuauuauuauuuugauaguuauaacucuuuaguugga

SEQ ID NO: 342390 - RNA, 64 nt, Homo Sapiens
ccaaagcuuuucagaacuucagugugagguuuccuauuuugacaaguuaacuuguaaauacuca

SEQ ID NO: 342391 - RNA, 64 nt, Homo Sapiens
aauuuaccuaauagaccaaacuaacucauggagauauuuugaacuauuauuuagguacaaacuu

SEQ ID NO: 342392 - RNA, 64 nt, Homo Sapiens
auauuucaugggaauauucaaauaucuaugguaauauuuugacccuuuauauuuguucuaaaau

SEQ ID NO: 342393 - RNA, 64 nt, Homo Sapiens
aagucaaaaugugaaaauaauauuaaaucuaagauauuuugaacuaagcaucuuuauaugcuug

SEQ ID NO: 342394 - RNA, 64 nt, Homo Sapiens
uacugucauuagguugucuuuuaauacuuuaaguuauuuugacgaaaaguaauagagaaaauuu

SEQ ID NO: 342395 - RNA, 64 nt, Homo Sapiens
uaggggaaaauaaaagaauaaaucacuauacugauauuuugauacaagcaagcacuuacauggu

SEQ ID NO: 342396 - RNA, 64 nt, Homo Sapiens
aguugacuaaauuuuauauuucuuguccucuaaauauuuugauaauuucuggauugaugcagug

SEQ ID NO: 342397 - RNA, 64 nt, Homo Sapiens
aucaguuugauucuguaaugagcacagcaccuaauauuuugaggagcucuguuuugaggaccaa

SEQ ID NO: 342398 - RNA, 64 nt, Homo Sapiens
uaggacuguuaucuguauuguuaauuuugugccauauuuugaauugcaacauuaugcuaaguau

SEQ ID NO: 342399 - RNA, 64 nt, Homo Sapiens
auaaaauauauaaacauaaauaaauuagguaguguauuuugaguggcaucagucucacucaucu

SEQ ID NO: 342400 - RNA, 64 nt, Homo Sapiens
uuuuuuuagugucccaaagauaucuuagauaaacuauuuugaaguucagauuucagaugaggca

SEQ ID NO: 342401 - RNA, 64 nt, Homo Sapiens
ucuuuggucuaaaacauuauuaaauuuuuguaaauauuuugauuuaaugugucuuagauccuca

SEQ ID NO: 342402 - RNA, 64 nt, Homo Sapiens
agcaauaauuguaaaugguuaccauacuguaagauauuuugauaaaaauuaacuaguaauacuu

SEQ ID NO: 342403 - RNA, 64 nt, Homo Sapiens
agaacuuaacauuuugcacagaauauaucaaauauauuuugagaaaaaaaguacggcaugaguu

SEQ ID NO: 342404 - RNA, 64 nt, Homo Sapiens
uuguacagcuuggugacuguaauuaacaacaauguauuuugaaagucacugaguaaauuuuaag

SEQ ID NO: 342405 - RNA, 64 nt, Homo Sapiens
cuacgucauuuuuuaaaauuauauuuaauuuuuuuauuuugaaaguuuuuucacagaucuuuuu

SEQ ID NO: 342406 - RNA, 64 nt, Homo Sapiens
auuauuuuucaguguguauuuaaacgaggcaguuuauuuugauauguaucuauucaugauugaa

SEQ ID NO: 342407 - RNA, 64 nt, Homo Sapiens
ucccaguguucugaguuauugaaaggcuuucuuuuauuuugagagcuuuaggucuuuuugggau

SEQ ID NO: 342408 - RNA, 64 nt, Homo Sapiens
uuuuaaaacuggaccuguauuauccugaauacacuauuuugaaaauuuuuaaaaaugacuucuu

SEQ ID NO: 342409 - RNA, 64 nt, Homo Sapiens
aaauaagcacuauuaacagauucagcacuacaaguauuuugaauguuguugcuguuggucauuu

SEQ ID NO: 342410 - RNA, 64 nt, Homo Sapiens
acauugucucucuauaucugcuuguggauauuguuauuuugaagagaaaugguuugugguuguc

SEQ ID NO: 342411 - RNA, 64 nt, Homo Sapiens
guguuuguaaaagcuugaugaaaggacaguuaaguauuuugaucacugcauuuuguuugaaacu

SEQ ID NO: 342412 - RNA, 64 nt, Homo Sapiens
aagcauaugcuaucauuguauucuuuaagaaccuuauuuugauaaaauguaaauuuguugaacc

SEQ ID NO: 342413 - RNA, 64 nt, Homo Sapiens
ucgaaugggagaaaaagcaaaucgcacaaugacauauuuugaguaauaaccguauuuuucacag

SEQ ID NO: 342414 - RNA, 64 nt, Homo Sapiens
aucaggugguuaaacggguaaacaaaauauacuguauuuugagaaauggcacaaaaacaggcag

SEQ ID NO: 342415 - RNA, 64 nt, Homo Sapiens
aucugauuuuuuuuaaugggacaauuuacaucaauauuuugaauaaaggauuaauuuaaacuuu

SEQ ID NO: 342416 - RNA, 64 nt, Homo Sapiens
augugaaaggauuaauuuaaacaauuuagaucaauauuuugaauauguaaaaggauuaaacuuu

SEQ ID NO: 342417 - RNA, 64 nt, Homo Sapiens
ugugagaauaauuuuguugcuuccuuggagcauauauuuugaaucauaaucaucacuuuaacuu

SEQ ID NO: 342418 - RNA, 64 nt, Homo Sapiens
auauggaaccuuaugaaaaauguacauuauauaguauuuugaaguaagccacuaucugcaauuu

SEQ ID NO: 342419 - RNA, 64 nt, Homo Sapiens
aaaguuuaaaacacauaugaauaucuuucaugacuauuuugacaccucauuaugcaaaaauaac

SEQ ID NO: 342420 - RNA, 64 nt, Homo Sapiens
uagcaaaaugagaagaugugaccugugccaaaacuauuuugagaauuuuaaaugugaccauuuu

SEQ ID NO: 342421 - RNA, 64 nt, Homo Sapiens
auagacuuugucuuauaaacauuuuuucauuuuuuauuuugaaaaauugcaaaucuacagcaaa

SEQ ID NO: 342422 - RNA, 64 nt, Homo Sapiens
uuuaaaaagaugaauagguggaggacauuauuuuuauuuugagcgcacucaauugcagagauuu

SEQ ID NO: 342423 - RNA, 64 nt, Homo Sapiens
aaacagaaagaaauuuugggucuauguguauuuuuauuuugaauuaaaccuauauuuucauaau

SEQ ID NO: 342424 - RNA, 64 nt, Homo Sapiens
aaaacacaacauuuuaauacaaggcacugugaacuauuuugaaggccauauuuuaaaaaaucaa

SEQ ID NO: 342425 - RNA, 64 nt, Homo Sapiens
aaaauguuuguacuuuuuaaaaaagauggaguuguauuuugacauugaauuaaucuagaaaaug

SEQ ID NO: 342426 - RNA, 64 nt, Homo Sapiens
gagaauugcuuucuuuaguguuaagaccuacucauauuuugaagaaaucuugaguuaagugagu

SEQ ID NO: 342427 - RNA, 64 nt, Homo Sapiens
uuuguauugugacaaauucauaagauaacauugauauuuugauuuguaauauuucuaauuggua

SEQ ID NO: 342428 - RNA, 64 nt, Homo Sapiens
aacaaaacgggguggguauucuuaacugugacuauauuuugacaauugguagaaggugcacauu

SEQ ID NO: 342429 - RNA, 64 nt, Homo Sapiens
auacagaauuagaaaaaaaaaauucuuguugaaauauuuugaaaacaaauucccuacuaucauc

SEQ ID NO: 342430 - RNA, 64 nt, Homo Sapiens
guaaagaagucacucuauaucugcuaaauauaguuauuuugaaggauauuaggcuccuugaaag

SEQ ID NO: 342431 - RNA, 64 nt, Homo Sapiens
uuuucuugaaaauuaaaauuguuuaccaaaacaguauuuugaagcaagaucauauuuuugucug

SEQ ID NO: 342432 - RNA, 64 nt, Homo Sapiens
aaaucuuuuccaauuuugcacauguguaucaccuuauuuugauuagaauacuaauauuuugaug

SEQ ID NO: 342433 - RNA, 64 nt, Homo Sapiens
cauguguaucaccuuauuuucuucagaauacuaauauuuugaugguucugugaaaaauuuuuuu

SEQ ID NO: 342434 - RNA, 64 nt, Homo Sapiens
uuuucucccaagaaaccugacucaauuauuugcauauuuugagaaacugcugcagauuaguucu

SEQ ID NO: 342435 - RNA, 64 nt, Homo Sapiens
uccagagcaaccagaaggagguuauaccaggauuuauuuugagcucagccccaacucuuuauca

SEQ ID NO: 342436 - RNA, 64 nt, Homo Sapiens
cugcuugguuaccaaguguccagggaaacccuuguauuuugaugacuaaaaagagcacuuugcc

SEQ ID NO: 342437 - RNA, 64 nt, Homo Sapiens
aaaauaccaucuaaaaggagaaugugaauaguuguauuuugaaaugaugugucaggaaaaguuu

SEQ ID NO: 342438 - RNA, 64 nt, Homo Sapiens
uaacuuacugauaagauguuuaugaaguauggcauauuuugauuuuuuuaauuguaauaaauau

SEQ ID NO: 342439 - RNA, 64 nt, Homo Sapiens
uacauauauaaauauacacacacuuacauguauguauuuugauagauauuacauggacuaaauu

SEQ ID NO: 342440 - RNA, 64 nt, Homo Sapiens
auguauuauuuuuauaacuguuuuguaaguugucuauuuugauaucccuugguggauuuuugug

SEQ ID NO: 342441 - RNA, 64 nt, Homo Sapiens
caaagaccaaauguuaggccgugaaggggggaaauauuuugaaccuuugcagcauuaaaaaaug

SEQ ID NO: 342442 - RNA, 64 nt, Homo Sapiens
uuggcuuuaaaauaaaaccacuuugaaacaauauuauuuugaaaucuaaaguaaaccagcuuau

SEQ ID NO: 342443 - RNA, 64 nt, Homo Sapiens
aaaguucuuuuaacaugucugauuucuuaugguuuauuuugaugucugacuaaagucaaagaau

SEQ ID NO: 342444 - RNA, 64 nt, Homo Sapiens
guacuuauuacauuauuuuuaacgaaaauuguuauauuuugaaaagccaccuguuauaugggag

SEQ ID NO: 342445 - RNA, 64 nt, Homo Sapiens
aagaauguaaauauuuccaagacucugaaaguaauauuuugacuuuuuguuuuuaaaaccuuua

SEQ ID NO: 342446 - RNA, 64 nt, Homo Sapiens
acauagaauuuguauuucuuguuugagccauugcuauuuugauuacaaaacucaugaaugugca

SEQ ID NO: 342447 - RNA, 64 nt, Homo Sapiens
aauuuuuauaucaaauauacauuucuauaguacauauuuugaaguuuaguacauauuuugaaga

SEQ ID NO: 342448 - RNA, 64 nt, Homo Sapiens
aauuucuauaguacauauuuguauuuuuaguacauauuuugaagaccuuagauucacaaacuuu

SEQ ID NO: 342449 - RNA, 64 nt, Homo Sapiens
auuuacaucuuuucacaguuaaucuucuauuggauauuuugacugacucaaucauaauucauuu

SEQ ID NO: 342450 - RNA, 64 nt, Homo Sapiens
aauaucauuuguccuuuuacagaaccaauguuaauauuuugauaagucauccuacuauguugaa

SEQ ID NO: 342451 - RNA, 64 nt, Homo Sapiens
uuuuauuuugugcucauuuaaguuucaaacuuacuauuuugacaguuauuuugauaacaaugac

SEQ ID NO: 342452 - RNA, 64 nt, Homo Sapiens
cucauuuaaguuucaaacuuacuauuuugacaguuauuuugauaacaaugacacuagaaaacuu

SEQ ID NO: 342453 - RNA, 64 nt, Homo Sapiens
aaaaacuuucuaagaggcaacaauuuagaauggauauuuugacgaaucggcaugaguguaacag

SEQ ID NO: 342454 - RNA, 64 nt, Homo Sapiens
acuuaaagaacagacaguuuacuuggccuaaaaauauuuugauguuuacucaaaaaguaccucu

SEQ ID NO: 342455 - RNA, 64 nt, Homo Sapiens
gaagaaauuucuucacucucgguggcauaaugaguauuuugaaaaaaauacuuacauugaaccu

SEQ ID NO: 342456 - RNA, 64 nt, Homo Sapiens
cuuagcaauuguauugcuggaagcaugaccacuuuauuuugaaacuacaguacaauauauuaug

SEQ ID NO: 342457 - RNA, 64 nt, Homo Sapiens
ucugcagcacaaugacuguaucugaaaacaugaguauuuugaguuauuuggcuccuuuaauucc

SEQ ID NO: 342458 - RNA, 64 nt, Homo Sapiens
cugagucuugcucugucgccuuuauuuauuuauuuauuuugagauaacuuuuauuuuauuuuau

SEQ ID NO: 342459 - RNA, 64 nt, Homo Sapiens
ugggagcuuuuauguuuuacugggauuuuguucauauuuugaaaccguaaacacccauaugauc

SEQ ID NO: 342460 - RNA, 64 nt, Homo Sapiens
uagacugcuuugagauaucauuguuaaaaccuuuuauuuugaacauuguccauaugccaauuuu

SEQ ID NO: 342461 - RNA, 64 nt, Homo Sapiens
uacuacaagguuuagacaguuuuagaaaggguaauauuuugaaagauuaggaccacagauuugg

SEQ ID NO: 342462 - RNA, 54 nt, Homo Sapiens
cacuaagauguuucuacugcauaguauuuugagaaucagcaggguucuuuguaa

SEQ ID NO: 342463 - RNA, 64 nt, Homo Sapiens
gguaccuuguaugucuuaauuuauuuuaaauauuuauuuugaaugaguuugauagaaagcuagu

SEQ ID NO: 342464 - RNA, 64 nt, Homo Sapiens
auuaaauuaggugacauggugacaucuaucccuuuauuuugacacuaaaacauggacacaacua

SEQ ID NO: 342465 - RNA, 64 nt, Homo Sapiens
gccccccccccaaaauccucauguuucugcuucauauuuugaaaaauaacaauuaaaacagaca

SEQ ID NO: 342466 - RNA, 64 nt, Homo Sapiens
gggaaaagaccccggagagggaagaaaaucucaguauuuugaaaauugagauuacuucagagcc

SEQ ID NO: 342467 - RNA, 64 nt, Homo Sapiens
cagcuggcagguuuguugaaauacaguuuugaguuauuuugauguggcuuuuuaaaaaaguuaa

SEQ ID NO: 342468 - RNA, 64 nt, Homo Sapiens
auuuuaaacauuuaauuaaauguaauuugggggauauuuugaacuuuaauauuagugaucaaau

SEQ ID NO: 342469 - RNA, 64 nt, Homo Sapiens
uuugucuauucuuuauuucucucaggguggccaguauuuugacuuauuuauccugcuugaaagc

SEQ ID NO: 342470 - RNA, 64 nt, Homo Sapiens
gggugcuuuuuauuguauaaagcagcgucuuauguauuuugauauaccauuguuugaacuuccg

SEQ ID NO: 342471 - RNA, 64 nt, Homo Sapiens
uuugucaauuaaaaaagcguaaaaaauugggcuauauuuugaaucucaccaaaaaaggcauuac

SEQ ID NO: 342472 - RNA, 64 nt, Homo Sapiens
uugaauuagacgacaaagcaaguagggugugaauuauuuugauguguuguuauuuuuaaaguac

SEQ ID NO: 342473 - RNA, 64 nt, Homo Sapiens
agacaaaucuccugugaucuuuuuguuacaaguuuauuuugaaguuauuucaagauaaguguaa

SEQ ID NO: 342474 - RNA, 64 nt, Homo Sapiens
guuuucauacuauaaccaggaaacugacauuuucuauuuugacuaacacauagaucucuuuccu

SEQ ID NO: 342475 - RNA, 64 nt, Homo Sapiens
guuggaugaaaagagaugggcaaauaggcuuaacuauuuugaagugaagguuaggugagauggg

SEQ ID NO: 342476 - RNA, 64 nt, Homo Sapiens
guuaggugagaugggcaaauguuuuuguuuuaacuauuuugaaguauauagcuaguuuggguuu

SEQ ID NO: 342477 - RNA, 64 nt, Homo Sapiens
acaaaauuauuuuugcuuggauauguuuuucuguuauuuugaagaugcuuuaaacaaacaaaaa

SEQ ID NO: 342478 - RNA, 64 nt, Homo Sapiens
cagggucuugcucugucuccguuuacuguuuauuuauuuugagguauuucuuuguuauuguugu

SEQ ID NO: 342479 - RNA, 64 nt, Homo Sapiens
gaauuauuuuuauuaaaauaaaaaaacucuguuguauuuugacaauuguacuugagagacaaaa

SEQ ID NO: 342480 - RNA, 64 nt, Homo Sapiens
gggggguuuuguuuugaggacauguagcgccuucuauuuugaaacaguauuggcugguuacucu

SEQ ID NO: 342481 - RNA, 64 nt, Homo Sapiens
cgcucgacauuuuacacaacccggauauguuguauauuuugacccaaaguuacagguagguuua

SEQ ID NO: 342482 - RNA, 64 nt, Homo Sapiens
uaucuuuguucuuguuugcugcuauuuucuguccuauuuugagaaauauaaauacauagaaaug

SEQ ID NO: 342483 - RNA, 64 nt, Homo Sapiens
uuaaaauaguuaacuugaagaguagaaacaauuguauuuugaagucucauacaagcugucugau

SEQ ID NO: 342484 - RNA, 64 nt, Homo Sapiens
aguuuugcuuuguuugcauguccacugguuuuuuuauuuugauauuugucuuuuuuuaaauuuu

SEQ ID NO: 342485 - RNA, 64 nt, Homo Sapiens
ugugcuuuucauuucaauauuuaguuauauuugauauuuugaaacugucugcuuuuugcuauuu

SEQ ID NO: 342486 - RNA, 64 nt, Homo Sapiens
uaacuguuacuucuuaaagcagcauuuuaucuucuauuuugaagacuauuuauuguaauaauua

SEQ ID NO: 342487 - RNA, 64 nt, Homo Sapiens
uuagucuuuuuuaaaaaauuuccacuaauuuuuuuauuuugauaaguuuugcuuuguuugcaug

SEQ ID NO: 342488 - RNA, 64 nt, Homo Sapiens
ucucaugcaaguugucugauaguaguaguaauuuuauuuugaaguuaaaauaguuaacuuuaag

SEQ ID NO: 342489 - RNA, 64 nt, Homo Sapiens
uuugucuuuuuuuuaaauuuuccacuaauuuuuuuauuuugauaaguuuugcuuuguuugcaug

SEQ ID NO: 342490 - RNA, 64 nt, Homo Sapiens
ucucauacaagcucuccgauaguaguaaucauuuuauuuugaaguuaaaauaguuaacuuuaag

SEQ ID NO: 342491 - RNA, 64 nt, Homo Sapiens
uguugcaucauaauuuagcacugaugucugcuuuuauuuugaucaucuuuguccacccuuauua

SEQ ID NO: 342492 - RNA, 64 nt, Homo Sapiens
uguguguguguuggaaccuccuggggacauguuauauuuugaagugauuaaacuauuuaauugu

SEQ ID NO: 342493 - RNA, 64 nt, Homo Sapiens
uuucagauuccuaaagaaauagacauuuuacuguuauuuugaaagggcaucuuuugauuuuuuu

SEQ ID NO: 342494 - RNA, 64 nt, Homo Sapiens
uggaauuuuaaacuuuuguucuugcuggguuauuuauuuugauuuuagcauuaaaugucaucuc

SEQ ID NO: 342495 - RNA, 64 nt, Homo Sapiens
ucacuauacucauuuuugaaacacuguugguuuuuauuuugauucuaaggucaaaaguggaaag

SEQ ID NO: 342496 - RNA, 64 nt, Homo Sapiens
guauauuuaucuguuaacauuuuuauugcuugcuuauuuugaagcaugguauuuuuggaaacau

SEQ ID NO: 342497 - RNA, 64 nt, Homo Sapiens
cagaaaguaugucuuuaaaguauagaagagcauuuauuuugaaaaaaacauuacacauaugaag

SEQ ID NO: 342498 - RNA, 64 nt, Homo Sapiens
auaauauguguauauauguaugccauauaugguauauuuugaugcaggcauacucuauauaaua

SEQ ID NO: 342499 - RNA, 64 nt, Homo Sapiens
caugggguugguguuuacaacuguggagaaaaacuauuuugagcuuuuuucuuuuaauguugua

SEQ ID NO: 342500 - RNA, 64 nt, Homo Sapiens
acuccagcuggugcccccagguggcccagguggcuauuuugagaugcuccagcaagcaaacagg

SEQ ID NO: 342501 - RNA, 64 nt, Homo Sapiens
caagaauacaguauauaauaugcaauauauggcauauuuugauaauaauaugaguauauauuca

SEQ ID NO: 342502 - RNA, 64 nt, Homo Sapiens
aagaacauuguaguagaauuuuuaaagugaagaguauuuugaagucuuuaagaaaauauaagcu

SEQ ID NO: 342503 - RNA, 64 nt, Homo Sapiens
uagagccuugcucugucaccuggauuuauuuauuuauuuugagaaccgcacccagccugguuau

SEQ ID NO: 342504 - RNA, 64 nt, Homo Sapiens
caacauauuccccccaaaaauuaaauuucuacuuuauuuugauaauccaauuguugacuucucu

SEQ ID NO: 342505 - RNA, 64 nt, Homo Sapiens
acauaaaccauaguuuuugcgaaauuauuuugcauauuuugaaaaaaucaagguauuauauagu

SEQ ID NO: 342506 - RNA, 64 nt, Homo Sapiens
gucuucccaacccuauugcugauuuaauggccaauauuuugaagcuaagaauaauuuuacuuau

SEQ ID NO: 342507 - RNA, 64 nt, Homo Sapiens
gccuuuuguguuccuuggcaccaaucaacaaacauauuuugaguaccuuucuuccuuguaaacu

SEQ ID NO: 342508 - RNA, 64 nt, Homo Sapiens
ccaguuuaaugggauacaacguacauguuauauuuauuuugaaauuuuuuuuuguuguuguugu

SEQ ID NO: 342509 - RNA, 64 nt, Homo Sapiens
acacuauuuuuaauuaaaguaucugauguaaaauuauuuugaguuuuuaauauuuugauaaacg

SEQ ID NO: 342510 - RNA, 64 nt, Homo Sapiens
aaguaucugauguaaaauuauuuugaguuuuuaauauuuugauaaacguguauuccugaaacuu

SEQ ID NO: 342511 - RNA, 64 nt, Homo Sapiens
guuuaggcuucauuaauagauugguauaaaacaauauuuugacaucauaaguacauacauucuu

SEQ ID NO: 342512 - RNA, 64 nt, Homo Sapiens
guauuugacuacauauagcauuugggggcagaucuauuuugacaggugccaaaauaugcuucau

SEQ ID NO: 342513 - RNA, 64 nt, Homo Sapiens
auaaacaucugguugagguuugguguaggccguauauuuugaaaauuaucucccuuuauaaacu

SEQ ID NO: 342514 - RNA, 64 nt, Homo Sapiens
caauccuuucauuacgaaagauuuuuagaauauuuauuuugaauauucauuaguguuugacaua

SEQ ID NO: 342515 - RNA, 64 nt, Homo Sapiens
uauauuuacuguuuauaauagguggagacuaacuuauuuugauuguuugaugaauaaaauguuu

SEQ ID NO: 342516 - RNA, 64 nt, Homo Sapiens
ggaaauuugugugcuucacacaaagugaaauuaguauuuugagccuuauuaaaauauuuucuua

SEQ ID NO: 342517 - RNA, 64 nt, Homo Sapiens
agccuuuccuauugggccuuccccacaauuagaauauuuugacuuaguguccugucccccuugg

SEQ ID NO: 342518 - RNA, 64 nt, Homo Sapiens
ucuaugcauagauguaaugcuaaccuucugaauauauuuugaauacauuuauauauucacuguu

SEQ ID NO: 342519 - RNA, 64 nt, Homo Sapiens
auuaaacuauuuugugauggcguuuaucauuuuauauuuugaaaggauuauuuuguaaggaaua

SEQ ID NO: 342520 - RNA, 64 nt, Homo Sapiens
ugccuauauuguaacaauuauuuuuaaugcauuguauuuugaaguaacgguucaguuaaauuuu

SEQ ID NO: 342521 - RNA, 64 nt, Homo Sapiens
ggcacagcauucgaagccaauguaauugugcagauauuuugaaaugaagauuuccuuauuucuu

SEQ ID NO: 342522 - RNA, 64 nt, Homo Sapiens
aacacauuguaauauguugguuuguuguuguuguuauuuugaaauggugcuuucaaguuuuuau

SEQ ID NO: 342523 - RNA, 64 nt, Homo Sapiens
cccucugcccuucuaagucauagacuagguaggaaggcccuauauugguccccagcaucuacug

SEQ ID NO: 342524 - RNA, 64 nt, Homo Sapiens
caacagguuacuggcaaugccagugaguuucuguaggcccuaagcugaagaagugaggcaguga

SEQ ID NO: 342525 - RNA, 64 nt, Homo Sapiens
ccaggauacuucaugagaacgaaccccuucagagaggcccuacaaaacagauuagagggaagac

SEQ ID NO: 342526 - RNA, 64 nt, Homo Sapiens
agauggcucagcggggcugcaccaaggggccaagaggcccuacccgugucuaaacccuccucuc

SEQ ID NO: 342527 - RNA, 64 nt, Homo Sapiens
gcucagggugaaugcagcugugcucauggccaccaggcccuacuggcugugaguuccaggucug

SEQ ID NO: 342528 - RNA, 64 nt, Homo Sapiens
caagucugcugcugcccucuggcuaguuucaaacaggcccuaaauuugaagguuuccucuccua

SEQ ID NO: 342529 - RNA, 64 nt, Homo Sapiens
acccccaacacgucacccgaguagaagcugggcaaggcccuaccauccuggccgucuguucaca

SEQ ID NO: 342530 - RNA, 64 nt, Homo Sapiens
ggguuagagagucuguuuugauugauguuuucugaggcccuagaggaguuuguaucaauuugug

SEQ ID NO: 342531 - RNA, 64 nt, Homo Sapiens; identical to SEQ ID NO: 106040

SEQ ID NO: 342532 - RNA, 64 nt, Homo Sapiens; identical to SEQ ID NO: 106041

SEQ ID NO: 342533 - RNA, 64 nt, Homo Sapiens; identical to SEQ ID NO: 106042

SEQ ID NO: 342534 - RNA, 64 nt, Homo Sapiens; identical to SEQ ID NO: 106043

SEQ ID NO: 342535 - RNA, 64 nt, Homo Sapiens; identical to SEQ ID NO: 106044

SEQ ID NO: 342536 - RNA, 64 nt, Homo Sapiens; identical to SEQ ID NO: 106045

SEQ ID NO: 342537 - RNA, 64 nt, Homo Sapiens; identical to SEQ ID NO: 106046

SEQ ID NO: 342538 - RNA, 64 nt, Homo Sapiens; identical to SEQ ID NO: 106047

SEQ ID NO: 342539 - RNA, 64 nt, Homo Sapiens; identical to SEQ ID NO: 106048

SEQ ID NO: 342540 - RNA, 64 nt, Homo Sapiens; identical to SEQ ID NO: 106049

SEQ ID NO: 342541 - RNA, 64 nt, Homo Sapiens; identical to SEQ ID NO: 106050

SEQ ID NO: 342542 - RNA, 64 nt, Homo Sapiens; identical to SEQ ID NO: 106051

SEQ ID NO: 342543 - RNA, 64 nt, Homo Sapiens; identical to SEQ ID NO: 106052

SEQ ID NO: 342544 - RNA, 64 nt, Homo Sapiens; identical to SEQ ID NO: 106053

SEQ ID NO: 342545 - RNA, 64 nt, Homo Sapiens; identical to SEQ ID NO: 106054

SEQ ID NO: 342546 - RNA, 64 nt, Homo Sapiens; identical to SEQ ID NO: 106055

SEQ ID NO: 342547 - RNA, 64 nt, Homo Sapiens; identical to SEQ ID NO: 106056

SEQ ID NO: 342548 - RNA, 64 nt, Homo Sapiens; identical to SEQ ID NO: 106057

SEQ ID NO: 342549 - RNA, 64 nt, Homo Sapiens; identical to SEQ ID NO: 106058

SEQ ID NO: 342550 - RNA, 64 nt, Homo Sapiens; identical to SEQ ID NO: 106059

SEQ ID NO: 342551 - RNA, 64 nt, Homo Sapiens; identical to SEQ ID NO: 106060

SEQ ID NO: 342552 - RNA, 64 nt, Homo Sapiens; identical to SEQ ID NO: 106061

SEQ ID NO: 342553 - RNA, 64 nt, Homo Sapiens; identical to SEQ ID NO: 106062

SEQ ID NO: 342554 - RNA, 64 nt, Homo Sapiens; identical to SEQ ID NO: 106063

SEQ ID NO: 342555 - RNA, 64 nt, Homo Sapiens; identical to SEQ ID NO: 106064

SEQ ID NO: 342556 - RNA, 64 nt, Homo Sapiens; identical to SEQ ID NO: 106065

SEQ ID NO: 342557 - RNA, 64 nt, Homo Sapiens; identical to SEQ ID NO: 106066

SEQ ID NO: 342558 - RNA, 64 nt, Homo Sapiens; identical to SEQ ID NO: 106067

SEQ ID NO: 342559 - RNA, 64 nt, Homo Sapiens; identical to SEQ ID NO: 106068

SEQ ID NO: 342560 - RNA, 64 nt, Homo Sapiens; identical to SEQ ID NO: 106069

SEQ ID NO: 342561 - RNA, 64 nt, Homo Sapiens; identical to SEQ ID NO: 106070

SEQ ID NO: 342562 - RNA, 64 nt, Homo Sapiens; identical to SEQ ID NO: 106071

SEQ ID NO: 342563 - RNA, 64 nt, Homo Sapiens; identical to SEQ ID NO: 106072

SEQ ID NO: 342564 - RNA, 64 nt, Homo Sapiens; identical to SEQ ID NO: 106073

SEQ ID NO: 342565 - RNA, 64 nt, Homo Sapiens; identical to SEQ ID NO: 106074

SEQ ID NO: 342566 - RNA, 64 nt, Homo Sapiens; identical to SEQ ID NO: 106075

SEQ ID NO: 342567 - RNA, 64 nt, Homo Sapiens; identical to SEQ ID NO: 106076

SEQ ID NO: 342568 - RNA, 64 nt, Homo Sapiens; identical to SEQ ID NO: 106077

SEQ ID NO: 342569 - RNA, 64 nt, Homo Sapiens; identical to SEQ ID NO: 106078

SEQ ID NO: 342570 - RNA, 64 nt, Homo Sapiens; identical to SEQ ID NO: 106079

SEQ ID NO: 342571 - RNA, 64 nt, Homo Sapiens; identical to SEQ ID NO: 106080

SEQ ID NO: 342572 - RNA, 64 nt, Homo Sapiens; identical to SEQ ID NO: 106081

SEQ ID NO: 342573 - RNA, 64 nt, Homo Sapiens; identical to SEQ ID NO: 106082

SEQ ID NO: 342574 - RNA, 64 nt, Homo Sapiens; identical to SEQ ID NO: 106083

SEQ ID NO: 342575 - RNA, 64 nt, Homo Sapiens; identical to SEQ ID NO: 106084

SEQ ID NO: 342576 - RNA, 64 nt, Homo Sapiens; identical to SEQ ID NO: 106085

SEQ ID NO: 342577 - RNA, 64 nt, Homo Sapiens; identical to SEQ ID NO: 106086

SEQ ID NO: 342578 - RNA, 64 nt, Homo Sapiens; identical to SEQ ID NO: 106087

SEQ ID NO: 342579 - RNA, 64 nt, Homo Sapiens; identical to SEQ ID NO: 106088

SEQ ID NO: 342580 - RNA, 64 nt, Homo Sapiens; identical to SEQ ID NO: 56835

SEQ ID NO: 342581 - RNA, 64 nt, Homo Sapiens; identical to SEQ ID NO: 56836

SEQ ID NO: 342582 - RNA, 64 nt, Homo Sapiens; identical to SEQ ID NO: 56837

SEQ ID NO: 342583 - RNA, 64 nt, Homo Sapiens; identical to SEQ ID NO: 56838

SEQ ID NO: 342584 - RNA, 64 nt, Homo Sapiens; identical to SEQ ID NO: 56839

SEQ ID NO: 342585 - RNA, 64 nt, Homo Sapiens; identical to SEQ ID NO: 56840

SEQ ID NO: 342586 - RNA, 64 nt, Homo Sapiens; identical to SEQ ID NO: 56841

SEQ ID NO: 342587 - RNA, 64 nt, Homo Sapiens
gcuggaaaguugggccccugcgagaacccugagcaggguccacacuccaccagcaaggggaccc

SEQ ID NO: 342588 - RNA, 64 nt, Homo Sapiens
uggagaguacauuugcuuuacggcucugggccugaggguccaccgauucaccccccucugcugc

SEQ ID NO: 342589 - RNA, 64 nt, Homo Sapiens
gggugccagccucucacccugaucuggccagucaaggguccacagcagggaggccccaggaggg

SEQ ID NO: 342590 - RNA, 64 nt, Homo Sapiens
cugcagggaggccccaggaggcuguuacaaaggcaggguccagcccaugcuggggugcugcuca

SEQ ID NO: 342591 - RNA, 64 nt, Homo Sapiens; identical to SEQ ID NO: 183939

SEQ ID NO: 342592 - RNA, 64 nt, Homo Sapiens; identical to SEQ ID NO: 183940

SEQ ID NO: 342593 - RNA, 64 nt, Homo Sapiens; identical to SEQ ID NO: 183941

SEQ ID NO: 342594 - RNA, 64 nt, Homo Sapiens; identical to SEQ ID NO: 183942

SEQ ID NO: 342595 - RNA, 64 nt, Homo Sapiens; identical to SEQ ID NO: 183943

SEQ ID NO: 342596 - RNA, 64 nt, Homo Sapiens; identical to SEQ ID NO: 183944

SEQ ID NO: 342597 - RNA, 64 nt, Homo Sapiens; identical to SEQ ID NO: 183945

SEQ ID NO: 342598 - RNA, 64 nt, Homo Sapiens; identical to SEQ ID NO: 183946

SEQ ID NO: 342599 - RNA, 64 nt, Homo Sapiens; identical to SEQ ID NO: 183947

SEQ ID NO: 342600 - RNA, 64 nt, Homo Sapiens; identical to SEQ ID NO: 183948

SEQ ID NO: 342601 - RNA, 64 nt, Homo Sapiens; identical to SEQ ID NO: 183949

SEQ ID NO: 342602 - RNA, 64 nt, Homo Sapiens; identical to SEQ ID NO: 183950

SEQ ID NO: 342603 - RNA, 64 nt, Homo Sapiens; identical to SEQ ID NO: 183951

SEQ ID NO: 342604 - RNA, 64 nt, Homo Sapiens; identical to SEQ ID NO: 183952

SEQ ID NO: 342605 - RNA, 64 nt, Homo Sapiens; identical to SEQ ID NO: 183953

SEQ ID NO: 342606 - RNA, 64 nt, Homo Sapiens; identical to SEQ ID NO: 183954

SEQ ID NO: 342607 - RNA, 64 nt, Homo Sapiens; identical to SEQ ID NO: 183955

SEQ ID NO: 342608 - RNA, 64 nt, Homo Sapiens; identical to SEQ ID NO: 183956

SEQ ID NO: 342609 - RNA, 64 nt, Homo Sapiens; identical to SEQ ID NO: 183957

SEQ ID NO: 342610 - RNA, 64 nt, Homo Sapiens; identical to SEQ ID NO: 183958

SEQ ID NO: 342611 - RNA, 64 nt, Homo Sapiens; identical to SEQ ID NO: 183959

SEQ ID NO: 342612 - RNA, 64 nt, Homo Sapiens; identical to SEQ ID NO: 183960

SEQ ID NO: 342613 - RNA, 64 nt, Homo Sapiens; identical to SEQ ID NO: 183961

SEQ ID NO: 342614 - RNA, 64 nt, Homo Sapiens; identical to SEQ ID NO: 183962

SEQ ID NO: 342615 - RNA, 64 nt, Homo Sapiens; identical to SEQ ID NO: 183963

SEQ ID NO: 342616 - RNA, 64 nt, Homo Sapiens; identical to SEQ ID NO: 183964

SEQ ID NO: 342617 - RNA, 64 nt, Homo Sapiens; identical to SEQ ID NO: 183965

SEQ ID NO: 342618 - RNA, 64 nt, Homo Sapiens; identical to SEQ ID NO: 183966

SEQ ID NO: 342619 - RNA, 64 nt, Homo Sapiens; identical to SEQ ID NO: 324923

SEQ ID NO: 342620 - RNA, 64 nt, Homo Sapiens; identical to SEQ ID NO: 324924

SEQ ID NO: 342621 - RNA, 64 nt, Homo Sapiens; identical to SEQ ID NO: 324925

SEQ ID NO: 342622 - RNA, 64 nt, Homo Sapiens; identical to SEQ ID NO: 324926

SEQ ID NO: 342623 - RNA, 64 nt, Homo Sapiens; identical to SEQ ID NO: 324927

SEQ ID NO: 342624 - RNA, 64 nt, Homo Sapiens; identical to SEQ ID NO: 324928

SEQ ID NO: 342625 - RNA, 64 nt, Homo Sapiens; identical to SEQ ID NO: 324929

SEQ ID NO: 342626 - RNA, 64 nt, Homo Sapiens; identical to SEQ ID NO: 324930

SEQ ID NO: 342627 - RNA, 64 nt, Homo Sapiens; identical to SEQ ID NO: 324931

SEQ ID NO: 342628 - RNA, 64 nt, Homo Sapiens; identical to SEQ ID NO: 324932

SEQ ID NO: 342629 - RNA, 64 nt, Homo Sapiens; identical to SEQ ID NO: 324933

SEQ ID NO: 342630 - RNA, 64 nt, Homo Sapiens; identical to SEQ ID NO: 324934

SEQ ID NO: 342631 - RNA, 64 nt, Homo Sapiens; identical to SEQ ID NO: 324935

SEQ ID NO: 342632 - RNA, 64 nt, Homo Sapiens; identical to SEQ ID NO: 324936

SEQ ID NO: 342633 - RNA, 64 nt, Homo Sapiens; identical to SEQ ID NO: 324937

SEQ ID NO: 342634 - RNA, 64 nt, Homo Sapiens; identical to SEQ ID NO: 324938

SEQ ID NO: 342635 - RNA, 64 nt, Homo Sapiens; identical to SEQ ID NO: 324939

SEQ ID NO: 342636 - RNA, 64 nt, Homo Sapiens; identical to SEQ ID NO: 324940

SEQ ID NO: 342637 - RNA, 64 nt, Homo Sapiens; identical to SEQ ID NO: 324941

SEQ ID NO: 342638 - RNA, 64 nt, Homo Sapiens; identical to SEQ ID NO: 324942

SEQ ID NO: 342639 - RNA, 64 nt, Homo Sapiens; identical to SEQ ID NO: 324943

SEQ ID NO: 342640 - RNA, 64 nt, Homo Sapiens; identical to SEQ ID NO: 324944

SEQ ID NO: 342641 - RNA, 64 nt, Homo Sapiens; identical to SEQ ID NO: 324945

SEQ ID NO: 342642 - RNA, 64 nt, Homo Sapiens; identical to SEQ ID NO: 324946

SEQ ID NO: 342643 - RNA, 64 nt, Homo Sapiens; identical to SEQ ID NO: 324947

SEQ ID NO: 342644 - RNA, 64 nt, Homo Sapiens; identical to SEQ ID NO: 324948

SEQ ID NO: 342645 - RNA, 59 nt, Homo Sapiens; identical to SEQ ID NO: 324949

SEQ ID NO: 342646 - RNA, 64 nt, Homo Sapiens; identical to SEQ ID NO: 324950

SEQ ID NO: 342647 - RNA, 64 nt, Homo Sapiens; identical to SEQ ID NO: 324951

SEQ ID NO: 342648 - RNA, 64 nt, Homo Sapiens; identical to SEQ ID NO: 324952

SEQ ID NO: 342649 - RNA, 64 nt, Homo Sapiens; identical to SEQ ID NO: 324953

SEQ ID NO: 342650 - RNA, 64 nt, Homo Sapiens; identical to SEQ ID NO: 324954

SEQ ID NO: 342651 - RNA, 64 nt, Homo Sapiens; identical to SEQ ID NO: 324955

SEQ ID NO: 342652 - RNA, 64 nt, Homo Sapiens
aucgaacaaauugaaaaucugaagaccgaugcugcaagcagaccauaugcagaugugcgaguua

SEQ ID NO: 342653 - RNA, 64 nt, Homo Sapiens
uguuuugaagcaggauauggcaacggaacauccucaagcagagguaguaaaacaggaaagcagc

SEQ ID NO: 342654 - RNA, 64 nt, Homo Sapiens
cuugaaugaagagaaugguggcagaaugagugagcaagcagauugccccagaggggccgguaau

SEQ ID NO: 342655 - RNA, 64 nt, Homo Sapiens
uuuuuuauuuugauuuuauuaaaugggaagaaagcaagcagaaauaguaaaauucaguagguuu

SEQ ID NO: 342656 - RNA, 64 nt, Homo Sapiens
gagaaguuaaaauacccuuacccuuaaggagguucaagcagagucagagugagaaguuaaaaua

SEQ ID NO: 342657 - RNA, 64 nt, Homo Sapiens
gagaaguuaaaauacccuuagaaggacggagguucaagcagaguucccugaauccuugcguccc

SEQ ID NO: 342658 - RNA, 64 nt, Homo Sapiens
gcauggggcucugggggaaugcugggaaaaugggcaagcagagugcacagcccucguucugcca

SEQ ID NO: 342659 - RNA, 64 nt, Homo Sapiens
uacuggacuuucaacuggcuuuccuuaggucaggcaagcagacagcuccccacugaagaggucu

SEQ ID NO: 342660 - RNA, 64 nt, Homo Sapiens
ggagacugagugccucagccacugugcaagcacccaagcagaagccacugcucuggccaauggg

SEQ ID NO: 342661 - RNA, 64 nt, Homo Sapiens
gucccaaccgccugcuguacucuuugcugaagagcaagcagagguaucccuuucucucccaagc

SEQ ID NO: 342662 - RNA, 64 nt, Homo Sapiens
cugaacaccugcggaaggaguggagcagcagcuacaagcagaggcccagcagggcccuccgagg

SEQ ID NO: 342663 - RNA, 64 nt, Homo Sapiens
cugaacaccugcggaaggaguggaacagcagcuacaagcagaggcccagcagggcccuccgagg

SEQ ID NO: 342664 - RNA, 64 nt, Homo Sapiens
ccaugagaaggagaguucaggccagccugcuggacaagcagagacugcccgggagaaagcccag

SEQ ID NO: 342665 - RNA, 64 nt, Homo Sapiens
caugaccagggacacagcuggcuuuagggaagagcaagcagagucagauuuuccuauuuuaauu

SEQ ID NO: 342666 - RNA, 64 nt, Homo Sapiens
aacaggaucagugggucuaacugcacaccagagacaagcagaguuaauccagcaaagugauucc

SEQ ID NO: 342667 - RNA, 64 nt, Homo Sapiens
aacuaauuucauuucaaggccugccacacggaagcaagcagaugcacagccgcgggccaggagg

SEQ ID NO: 342668 - RNA, 64 nt, Homo Sapiens
ugaggccccacguuuccaaccuugccugguuuaucaagcagagcuacuccacccucagcucuuc

SEQ ID NO: 342669 - RNA, 64 nt, Homo Sapiens
gaauuuggacucaguuacaguggcuaugacgcagcaagcagaaucuccuugucucucaacguau

SEQ ID NO: 342670 - RNA, 64 nt, Homo Sapiens
gagcacucaguggaugacuauggagaagagccugcaagcagagaccaacuacccuuaggucuac

SEQ ID NO: 342671 - RNA, 64 nt, Homo Sapiens
uuuguuggccaaugggacauuaacaaguaugauacaagcagaggcuugagaagugccugcacaa

SEQ ID NO: 342672 - RNA, 62 nt, Homo Sapiens
gaucauaucauugcuacuuuauaccuuauuugcuacaacauauauacugugaagacuuuguu

SEQ ID NO: 342673 - RNA, 62 nt, Homo Sapiens
uuagcuuuugcccaucuaaauagucgucuuuccuacaacauuagaaauagugagguaguagu

SEQ ID NO: 342674 - RNA, 62 nt, Homo Sapiens
uuuggaaaaccucuguggggauuuuagucaagcuacaacagguaaaaucauacauucugaac

SEQ ID NO: 342675 - RNA, 62 nt, Homo Sapiens
ucugccugguucuccgggauccagccagucaucuacaacaaauggaacgaagacuaaccuca

SEQ ID NO: 342676 - RNA, 64 nt, Homo Sapiens; identical to SEQ ID NO: 223145

SEQ ID NO: 342677 - RNA, 64 nt, Homo Sapiens; identical to SEQ ID NO: 223146

SEQ ID NO: 342678 - RNA, 64 nt, Homo Sapiens; identical to SEQ ID NO: 223147

SEQ ID NO: 342679 - RNA, 64 nt, Homo Sapiens; identical to SEQ ID NO: 223148

SEQ ID NO: 342680 - RNA, 64 nt, Homo Sapiens; identical to SEQ ID NO: 223149

SEQ ID NO: 342681 - RNA, 64 nt, Homo Sapiens; identical to SEQ ID NO: 223150

SEQ ID NO: 342682 - RNA, 64 nt, Homo Sapiens; identical to SEQ ID NO: 223151

SEQ ID NO: 342683 - RNA, 64 nt, Homo Sapiens; identical to SEQ ID NO: 223152

SEQ ID NO: 342684 - RNA, 64 nt, Homo Sapiens; identical to SEQ ID NO: 223153

SEQ ID NO: 342685 - RNA, 64 nt, Homo Sapiens; identical to SEQ ID NO: 223154

SEQ ID NO: 342686 - RNA, 64 nt, Homo Sapiens; identical to SEQ ID NO: 223155

SEQ ID NO: 342687 - RNA, 64 nt, Homo Sapiens; identical to SEQ ID NO: 223156

SEQ ID NO: 342688 - RNA, 64 nt, Homo Sapiens; identical to SEQ ID NO: 223157

SEQ ID NO: 342689 - RNA, 64 nt, Homo Sapiens; identical to SEQ ID NO: 223158

SEQ ID NO: 342690 - RNA, 64 nt, Homo Sapiens; identical to SEQ ID NO: 223159

SEQ ID NO: 342691 - RNA, 64 nt, Homo Sapiens; identical to SEQ ID NO: 223160

SEQ ID NO: 342692 - RNA, 64 nt, Homo Sapiens; identical to SEQ ID NO: 223161

SEQ ID NO: 342693 - RNA, 64 nt, Homo Sapiens; identical to SEQ ID NO: 223162

SEQ ID NO: 342694 - RNA, 64 nt, Homo Sapiens; identical to SEQ ID NO: 223163

SEQ ID NO: 342695 - RNA, 64 nt, Homo Sapiens; identical to SEQ ID NO: 223164

SEQ ID NO: 342696 - RNA, 64 nt, Homo Sapiens; identical to SEQ ID NO: 223165

SEQ ID NO: 342697 - RNA, 64 nt, Homo Sapiens; identical to SEQ ID NO: 223166

SEQ ID NO: 342698 - RNA, 64 nt, Homo Sapiens; identical to SEQ ID NO: 223167

SEQ ID NO: 342699 - RNA, 64 nt, Homo Sapiens; identical to SEQ ID NO: 223168

SEQ ID NO: 342700 - RNA, 64 nt, Homo Sapiens; identical to SEQ ID NO: 223169

SEQ ID NO: 342701 - RNA, 64 nt, Homo Sapiens; identical to SEQ ID NO: 223170

SEQ ID NO: 342702 - RNA, 64 nt, Homo Sapiens; identical to SEQ ID NO: 223171

SEQ ID NO: 342703 - RNA, 64 nt, Homo Sapiens; identical to SEQ ID NO: 223172

SEQ ID NO: 342704 - RNA, 64 nt, Homo Sapiens; identical to SEQ ID NO: 223173

SEQ ID NO: 342705 - RNA, 64 nt, Homo Sapiens; identical to SEQ ID NO: 223174

SEQ ID NO: 342706 - RNA, 64 nt, Homo Sapiens; identical to SEQ ID NO: 223175

SEQ ID NO: 342707 - RNA, 64 nt, Homo Sapiens; identical to SEQ ID NO: 223176

SEQ ID NO: 342708 - RNA, 64 nt, Homo Sapiens; identical to SEQ ID NO: 223177

SEQ ID NO: 342709 - RNA, 64 nt, Homo Sapiens; identical to SEQ ID NO: 223178

SEQ ID NO: 342710 - RNA, 64 nt, Homo Sapiens; identical to SEQ ID NO: 223179

SEQ ID NO: 342711 - RNA, 64 nt, Homo Sapiens; identical to SEQ ID NO: 223180

SEQ ID NO: 342712 - RNA, 64 nt, Homo Sapiens; identical to SEQ ID NO: 223181

SEQ ID NO: 342713 - RNA, 64 nt, Homo Sapiens; identical to SEQ ID NO: 223182

SEQ ID NO: 342714 - RNA, 64 nt, Homo Sapiens; identical to SEQ ID NO: 223183

SEQ ID NO: 342715 - RNA, 64 nt, Homo Sapiens; identical to SEQ ID NO: 223184

SEQ ID NO: 342716 - RNA, 64 nt, Homo Sapiens; identical to SEQ ID NO: 223185

SEQ ID NO: 342717 - RNA, 64 nt, Homo Sapiens; identical to SEQ ID NO: 223186

SEQ ID NO: 342718 - RNA, 64 nt, Homo Sapiens; identical to SEQ ID NO: 223187

SEQ ID NO: 342719 - RNA, 64 nt, Homo Sapiens; identical to SEQ ID NO: 223188

SEQ ID NO: 342720 - RNA, 64 nt, Homo Sapiens; identical to SEQ ID NO: 223189

SEQ ID NO: 342721 - RNA, 64 nt, Homo Sapiens; identical to SEQ ID NO: 223190

SEQ ID NO: 342722 - RNA, 64 nt, Homo Sapiens; identical to SEQ ID NO: 223191

SEQ ID NO: 342723 - RNA, 64 nt, Homo Sapiens; identical to SEQ ID NO: 223192

SEQ ID NO: 342724 - RNA, 64 nt, Homo Sapiens; identical to SEQ ID NO: 223193

SEQ ID NO: 342725 - RNA, 64 nt, Homo Sapiens; identical to SEQ ID NO: 223194

SEQ ID NO: 342726 - RNA, 64 nt, Homo Sapiens; identical to SEQ ID NO: 223195

SEQ ID NO: 342727 - RNA, 57 nt, Homo Sapiens; identical to SEQ ID NO: 223196

SEQ ID NO: 342728 - RNA, 64 nt, Homo Sapiens; identical to SEQ ID NO: 223197

SEQ ID NO: 342729 - RNA, 54 nt, Homo Sapiens; identical to SEQ ID NO: 223198

SEQ ID NO: 342730 - RNA, 64 nt, Homo Sapiens; identical to SEQ ID NO: 237917

SEQ ID NO: 342731 - RNA, 64 nt, Homo Sapiens; identical to SEQ ID NO: 237918

SEQ ID NO: 342732 - RNA, 64 nt, Homo Sapiens; identical to SEQ ID NO: 237919

SEQ ID NO: 342733 - RNA, 64 nt, Homo Sapiens; identical to SEQ ID NO: 237920

SEQ ID NO: 342734 - RNA, 64 nt, Homo Sapiens; identical to SEQ ID NO: 237921

SEQ ID NO: 342735 - RNA, 64 nt, Homo Sapiens; identical to SEQ ID NO: 237922

SEQ ID NO: 342736 - RNA, 64 nt, Homo Sapiens; identical to SEQ ID NO: 237923

SEQ ID NO: 342737 - RNA, 64 nt, Homo Sapiens; identical to SEQ ID NO: 237924

SEQ ID NO: 342738 - RNA, 64 nt, Homo Sapiens; identical to SEQ ID NO: 237925

SEQ ID NO: 342739 - RNA, 64 nt, Homo Sapiens; identical to SEQ ID NO: 237926

SEQ ID NO: 342740 - RNA, 64 nt, Homo Sapiens; identical to SEQ ID NO: 237927

SEQ ID NO: 342741 - RNA, 64 nt, Homo Sapiens; identical to SEQ ID NO: 237928

SEQ ID NO: 342742 - RNA, 64 nt, Homo Sapiens; identical to SEQ ID NO: 237927

SEQ ID NO: 342743 - RNA, 64 nt, Homo Sapiens; identical to SEQ ID NO: 237930

SEQ ID NO: 342744 - RNA, 64 nt, Homo Sapiens; identical to SEQ ID NO: 237931

SEQ ID NO: 342745 - RNA, 64 nt, Homo Sapiens; identical to SEQ ID NO: 237932

SEQ ID NO: 342746 - RNA, 64 nt, Homo Sapiens; identical to SEQ ID NO: 237933

SEQ ID NO: 342747 - RNA, 64 nt, Homo Sapiens; identical to SEQ ID NO: 237934

SEQ ID NO: 342748 - RNA, 64 nt, Homo Sapiens; identical to SEQ ID NO: 237935

SEQ ID NO: 342749 - RNA, 64 nt, Homo Sapiens; identical to SEQ ID NO: 237936

SEQ ID NO: 342750 - RNA, 64 nt, Homo Sapiens; identical to SEQ ID NO: 237937

SEQ ID NO: 342751 - RNA, 64 nt, Homo Sapiens; identical to SEQ ID NO: 237938

SEQ ID NO: 342752 - RNA, 64 nt, Homo Sapiens; identical to SEQ ID NO: 237939

SEQ ID NO: 342753 - RNA, 64 nt, Homo Sapiens; identical to SEQ ID NO: 237940

SEQ ID NO: 342754 - RNA, 64 nt, Homo Sapiens; identical to SEQ ID NO: 237941

SEQ ID NO: 342755 - RNA, 64 nt, Homo Sapiens; identical to SEQ ID NO: 237942

SEQ ID NO: 342756 - RNA, 64 nt, Homo Sapiens; identical to SEQ ID NO: 237943

SEQ ID NO: 342757 - RNA, 64 nt, Homo Sapiens; identical to SEQ ID NO: 237944

SEQ ID NO: 342758 - RNA, 64 nt, Homo Sapiens; identical to SEQ ID NO: 237945

SEQ ID NO: 342759 - RNA, 64 nt, Homo Sapiens; identical to SEQ ID NO: 237946

SEQ ID NO: 342760 - RNA, 64 nt, Homo Sapiens; identical to SEQ ID NO: 237947

SEQ ID NO: 342761 - RNA, 64 nt, Homo Sapiens; identical to SEQ ID NO: 237948

SEQ ID NO: 342762 - RNA, 64 nt, Homo Sapiens; identical to SEQ ID NO: 237949

SEQ ID NO: 342763 - RNA, 64 nt, Homo Sapiens; identical to SEQ ID NO: 237950

SEQ ID NO: 342764 - RNA, 64 nt, Homo Sapiens; identical to SEQ ID NO: 237951

SEQ ID NO: 342765 - RNA, 64 nt, Homo Sapiens; identical to SEQ ID NO: 237952

SEQ ID NO: 342766 - RNA, 64 nt, Homo Sapiens; identical to SEQ ID NO: 237953

SEQ ID NO: 342767 - RNA, 64 nt, Homo Sapiens; identical to SEQ ID NO: 237954

SEQ ID NO: 342768 - RNA, 64 nt, Homo Sapiens; identical to SEQ ID NO: 237955

SEQ ID NO: 342769 - RNA, 64 nt, Homo Sapiens; identical to SEQ ID NO: 237956

SEQ ID NO: 342770 - RNA, 64 nt, Homo Sapiens; identical to SEQ ID NO: 237957

SEQ ID NO: 342771 - RNA, 64 nt, Homo Sapiens; identical to SEQ ID NO: 237958

SEQ ID NO: 342772 - RNA, 64 nt, Homo Sapiens; identical to SEQ ID NO: 237959

SEQ ID NO: 342773 - RNA, 64 nt, Homo Sapiens; identical to SEQ ID NO: 237960

SEQ ID NO: 342774 - RNA, 64 nt, Homo Sapiens; identical to SEQ ID NO: 237961

SEQ ID NO: 342775 - RNA, 64 nt, Homo Sapiens; identical to SEQ ID NO: 237962

SEQ ID NO: 342776 - RNA, 64 nt, Homo Sapiens; identical to SEQ ID NO: 237963

SEQ ID NO: 342777 - RNA, 64 nt, Homo Sapiens; identical to SEQ ID NO: 237964

SEQ ID NO: 342778 - RNA, 64 nt, Homo Sapiens; identical to SEQ ID NO: 237965

SEQ ID NO: 342779 - RNA, 64 nt, Homo Sapiens; identical to SEQ ID NO: 237966

SEQ ID NO: 342780 - RNA, 64 nt, Homo Sapiens; identical to SEQ ID NO: 237967

SEQ ID NO: 342781 - RNA, 64 nt, Homo Sapiens; identical to SEQ ID NO: 218345

SEQ ID NO: 342782 - RNA, 64 nt, Homo Sapiens; identical to SEQ ID NO: 218346

SEQ ID NO: 342783 - RNA, 64 nt, Homo Sapiens; identical to SEQ ID NO: 218347

SEQ ID NO: 342784 - RNA, 64 nt, Homo Sapiens; identical to SEQ ID NO: 218348

SEQ ID NO: 342785 - RNA, 64 nt, Homo Sapiens; identical to SEQ ID NO: 218349

SEQ ID NO: 342786 - RNA, 64 nt, Homo Sapiens; identical to SEQ ID NO: 218350

SEQ ID NO: 342787 - RNA, 64 nt, Homo Sapiens; identical to SEQ ID NO: 218351

SEQ ID NO: 342788 - RNA, 64 nt, Homo Sapiens; identical to SEQ ID NO: 218352

SEQ ID NO: 342789 - RNA, 64 nt, Homo Sapiens; identical to SEQ ID NO: 218353

SEQ ID NO: 342790 - RNA, 64 nt, Homo Sapiens; identical to SEQ ID NO: 218354

SEQ ID NO: 342791 - RNA, 64 nt, Homo Sapiens; identical to SEQ ID NO: 218355

SEQ ID NO: 342792 - RNA, 64 nt, Homo Sapiens; identical to SEQ ID NO: 218356

SEQ ID NO: 342793 - RNA, 64 nt, Homo Sapiens; identical to SEQ ID NO: 218357

SEQ ID NO: 342794 - RNA, 64 nt, Homo Sapiens; identical to SEQ ID NO: 218358

SEQ ID NO: 342795 - RNA, 64 nt, Homo Sapiens; identical to SEQ ID NO: 218359

SEQ ID NO: 342796 - RNA, 64 nt, Homo Sapiens; identical to SEQ ID NO: 218360

SEQ ID NO: 342797 - RNA, 64 nt, Homo Sapiens; identical to SEQ ID NO: 218361

SEQ ID NO: 342798 - RNA, 64 nt, Homo Sapiens; identical to SEQ ID NO: 218362

SEQ ID NO: 342799 - RNA, 60 nt, Homo Sapiens
aagugucacaccaccucccucagcacuuccccaucacaacaaccuaugucacugacucag

SEQ ID NO: 342800 - RNA, 60 nt, Homo Sapiens
ugauuagaucgggucucggaagggaaguagccaucacaccauuaaaaagccuguggaccu

SEQ ID NO: 342801 - RNA, 60 nt, Homo Sapiens
gacugcaccagaguucugaagggaucuuaaccaucacaaguuuuuacccucuuccuucau

SEQ ID NO: 342802 - RNA, 60 nt, Homo Sapiens
gccuuuucccuuccuauuucacuuugccucccaucacacaacugcguguaaaugguguca

SEQ ID NO: 342803 - RNA, 60 nt, Homo Sapiens
gucucgcccuaccauccuggguaaauucacccaucacaggggcccuugguaucaagugag

SEQ ID NO: 342804 - RNA, 60 nt, Homo Sapiens
gaaagugaccguacggguuuagggagacagccaucacauaccgcuaugcagucuggugag

SEQ ID NO: 342805 - RNA, 60 nt, Homo Sapiens
acaagguuggaugccuacuuaugagcuugaccaucacagcuaucgguaaucagaaauaug

SEQ ID NO: 342806 - RNA, 60 nt, Homo Sapiens
auuugaauaucacuuccccucugcauuuucccaucacauagaagacuuugaccugugaag

SEQ ID NO: 342807 - RNA, 60 nt, Homo Sapiens
uuaauucugaaguuggaguuggugccccugccaucacaaacaacacgagagccaauugug

SEQ ID NO: 342808 - RNA, 60 nt, Homo Sapiens
uucagcuuauucaccccacccccccaccccccaucacacgugcuccugugaacuuuccau

SEQ ID NO: 342809 - RNA, 60 nt, Homo Sapiens
ccacuucagcacaccuugccccaccugggaccaucacacgugaagcaccaggcugggaga

SEQ ID NO: 342810 - RNA, 60 nt, Homo Sapiens
uuccaccaccucuccggcugccccugcccuccaucacagacagcagagccgggcagcuuu

SEQ ID NO: 342811 - RNA, 64 nt, Homo Sapiens
agagaucugggccucauguagcucaccccggucacgcaugaaggcaaaagcaggucagaagcga

SEQ ID NO: 342812 - RNA, 64 nt, Homo Sapiens
augcuucaugcccuguuccccaaaacuagaagugcgcaugaaggggaagagaccauaaaggcuu

SEQ ID NO: 342813 - RNA, 64 nt, Homo Sapiens
gucccagugaagugccagguuugauugugaaguccgcaugaaacacugcaccaggcagggcuuu

SEQ ID NO: 342814 - RNA, 64 nt, Homo Sapiens
gauccggaacgucagccagcucccagccacauggcgcaugaaggagagcccagucucccuccag

SEQ ID NO: 342815 - RNA, 64 nt, Homo Sapiens
uacuguacacuuucaauccugccaccacgucccccgcaugaaugaccagccaugcacccgccca

SEQ ID NO: 342816 - RNA, 64 nt, Homo Sapiens
ucagccucuaguacugaugagaacgaugacaggucgcaugaagagaaccauuuuguagaagaag

SEQ ID NO: 342817 - RNA, 64 nt, Homo Sapiens
gucuauguaaagucacaaauuaaugaaaaaaauucgcaugaaaaugacagauaacacuguaguu

SEQ ID NO: 342818 - RNA, 64 nt, Homo Sapiens
uucccauuggaaaguggcagcuaaacauuaaauucgcaugaaccacagaugcuggagaucacca

SEQ ID NO: 342819 - RNA, 64 nt, Homo Sapiens
uauguaguguguaggcacugcaggucucucuaaacgcaugaaugacuacuuacgcagggagaug

SEQ ID NO: 342820 - RNA, 64 nt, Homo Sapiens
aacagccucuauugauacuuauacucccacagcucgcaugaaggucuguuauucaaugauguau

SEQ ID NO: 342821 - RNA, 64 nt, Homo Sapiens
ugugaagguggaaauaaacuauaauggucagaggcgcaugaauuuuuaauucauguugccuugc

SEQ ID NO: 342822 - RNA, 64 nt, Homo Sapiens
cucuucuaacauuuaaggaauagagccuaauuagcgcaugaauacguguugaacugugaaugaa

SEQ ID NO: 342823 - RNA, 64 nt, Homo Sapiens
cucuaaguuggaaauugaagcaacuuaaaugcugcgcaugaaacguuuguugcuuacaguuuga

SEQ ID NO: 342824 - RNA, 64 nt, Homo Sapiens
agauuuaguaacugauuuuuuagacacugccuaucgcaugaacuguaaagcuguguguauuagg

SEQ ID NO: 342825 - RNA, 64 nt, Homo Sapiens
guuuguuuuuacaguuuagccuaagaaugauugucgcaugaaguaguucguucuuguguuugac

SEQ ID NO: 342826 - RNA, 64 nt, Homo Sapiens
aaucuacugaacaaauauugggauaacuccaaaccgcaugaaaggguguaauugcagcaugagu

SEQ ID NO: 342827 - RNA, 64 nt, Homo Sapiens
acuacugaccuguuguaggcagcuaucuuacagacgcaugaauguaagaguaggaagggguggg

SEQ ID NO: 342828 - RNA, 64 nt, Homo Sapiens
ugagcaggucagauucaaggcagugaggucaggccgcaugaaccuggaggggaaucggggacuu

SEQ ID NO: 342829 - RNA, 64 nt, Homo Sapiens
ugaauuaaauauccaguuacuugaauggguauaacgcaugaauauuugugugucugugugugug

SEQ ID NO: 342830 - RNA, 64 nt, Homo Sapiens
uuggucuguagguguuaaauucucuuguguguuacgcaugaacuagguguuuguuaaagagccu

SEQ ID NO: 342831 - RNA, 64 nt, Homo Sapiens
gggguuaugggguggggguggucccacuguuacacgcaugaauguuggucaugacagugugccu

SEQ ID NO: 342832 - RNA, 64 nt, Homo Sapiens
acaaagggaaagccucuggccgucacacguaggacgcaugaaggucacucguggugaggcugac

SEQ ID NO: 342833 - RNA, 64 nt, Homo Sapiens
aggucggagcugugaggacuuccagaacuggaaacgcaugaacgacccagaauaccaggcccag

SEQ ID NO: 342834 - RNA, 64 nt, Homo Sapiens
guauggugaccucuccggccuggccuuuuccauucgcaugaacaaugggagcacauagcccugu

SEQ ID NO: 342835 - RNA, 64 nt, Homo Sapiens
uacuuuuuguauaaaccgacgaacagcugaugaccgcaugaaugcucacacaaggggaaagggc

SEQ ID NO: 342836 - RNA, 64 nt, Homo Sapiens
agauuauguugugcucuuuaaaguggcacgaugacgcaugaaggcagagcuggcuggcucagcu

SEQ ID NO: 342837 - RNA, 64 nt, Homo Sapiens
cuggagcuuauuccgccgccaguccugugaguggcgcaugaacguaagugcaguggggguaagc

SEQ ID NO: 342838 - RNA, 64 nt, Homo Sapiens
uccccaggaccccauccuguucucggggacccugcgcaugaaccuggaccccuucggcagcuac

SEQ ID NO: 342839 - RNA, 64 nt, Homo Sapiens
aagccauauccuuuugcaguuucgaguagugauacgcaugaacagcccaccaacgagucccggc

SEQ ID NO: 342840 - RNA, 64 nt, Homo Sapiens
ggaaaaaggagagcaaacuggguuccagaaccgacgcaugaaguggagaggcagaucaagauau

SEQ ID NO: 342841 - RNA, 64 nt, Homo Sapiens
uuagucugacuugacuauuguuuuuccuuucuggcgcaugaauccauacaucauuccuggaagu

SEQ ID NO: 342842 - RNA, 64 nt, Homo Sapiens
uacuuguaagcacacaugauacuuggagaaagaccgcaugaagaucggaguccuuggugguuga

SEQ ID NO: 342843 - RNA, 64 nt, Homo Sapiens
aguaguucuugacccgaggucgcccugaaggugucgcaugaagagcuugcuucacacacaacag

SEQ ID NO: 342844 - RNA, 62 nt, Homo Sapiens
ccuuucauccggcagagccuuccugcguuugcagcagagaggaggccccacagcuugcccuu

SEQ ID NO: 342845 - RNA, 62 nt, Homo Sapiens
gguggcaaaauggcacugaauauccccuuggcagcagagaaaacccacugaaagaucguaga

SEQ ID NO: 342846 - RNA, 62 nt, Homo Sapiens
cagccagugucugggcucccagcacuuaaaggagcagagaugcccuuaccccaaauucauug

SEQ ID NO: 342847 - RNA, 62 nt, Homo Sapiens
aaugaggagaaguuuaauaugggaauguucucagcagagaagagcugccagagugcacuggg

SEQ ID NO: 342848 - RNA, 62 nt, Homo Sapiens
agagcacacacuggcucaagcggggcuagggaagcagagagcguaagggaugagaaggaugg

SEQ ID NO: 342849 - RNA, 62 nt, Homo Sapiens
agagcaugcagugauggaaguggaaccagggaagcagagagcgugaggaaacuuuuaggugg

SEQ ID NO: 342850 - RNA, 62 nt, Homo Sapiens
aaaccaaucagucccucaggggggaauugaauagcagagagccugcaggaacaagugggcuu

SEQ ID NO: 342851 - RNA, 62 nt, Homo Sapiens
ugacuaucaguggcaaaaaagaacaaaaucugagcagagaugauuuugaaccagauauuuug

SEQ ID NO: 342852 - RNA, 62 nt, Homo Sapiens
ucgcuugaacccuggagauggagguugcagugagcagagaucgcaccacugcacuccagccu

SEQ ID NO: 342853 - RNA, 62 nt, Homo Sapiens
cuuccuguucugccuucaccuaugccgggauaagcagagaucucaucaauuagcucuucucu

SEQ ID NO: 342854 - RNA, 62 nt, Homo Sapiens
uaucaagccuggaugcagcugcugcugcuuagagcagagaugaagaaaguguucugcauaag

SEQ ID NO: 342855 - RNA, 62 nt, Homo Sapiens
ggccagcuugugccuaauagaagguugagaccagcagagacugcugugaguuucucccggcu

SEQ ID NO: 342856 - RNA, 62 nt, Homo Sapiens
cucggauucuuuugcaugaugggguaaagcuuagcagagaaucaugggagcuaaccuuuauc

SEQ ID NO: 342857 - RNA, 62 nt, Homo Sapiens
uacuauuuuggcugcucuuggggacugcgagaagcagagagaaugagagaccaguggcaacu

SEQ ID NO: 342858 - RNA, 62 nt, Homo Sapiens
gagaaugagagaccaguggcaacugccugcacagcagagauaacccucuucccuugcuuccu

SEQ ID NO: 342859 - RNA, 62 nt, Homo Sapiens
ccucuggggaagagagggaagagaaagcacagagcagagaagcagagauguuccuugaacug

SEQ ID NO: 342860 - RNA, 62 nt, Homo Sapiens
gaagagagggaagagaaagcacagagcagagaagcagagauguuccuugaacugcccacaag

SEQ ID NO: 342861 - RNA, 62 nt, Homo Sapiens
gucucuguacacagccccguggccaucgugucagcagagagagucauacacgaagggcgugu

SEQ ID NO: 342862 - RNA, 62 nt, Homo Sapiens
gucucuguacacagccccguggccaucgugucagcagagagagucauacgcgaaggccauau

SEQ ID NO: 342863 - RNA, 62 nt, Homo Sapiens
aauaaaacuccuugaaaccauuauguucuugcagcagagagagucucaccaggaaauucugu

SEQ ID NO: 342864 - RNA, 54 nt, Homo Sapiens
aagaccccaggaagucauccagggagcagagacggccacuggcucaagguguag

SEQ ID NO: 342865 - RNA, 62 nt, Homo Sapiens
uuaaacuugcuguguccgggaauucuauguacagcagagacagaggagggggaaagggucuu

SEQ ID NO: 342866 - RNA, 62 nt, Homo Sapiens
acacacugacccuccgcccugcccagcaccacagcagagaucggcuuaacuccuaagccccu

SEQ ID NO: 342867 - RNA, 62 nt, Homo Sapiens
cugcugauguggcugcgcuuagacgacaagagagcagagaaugcauugggauggguggagaa

SEQ ID NO: 342868 - RNA, 62 nt, Homo Sapiens
cuuuaauuaaacugauuugucuacauuaucucagcagagagaaucuggaauccuagcaguca

SEQ ID NO: 342869 - RNA, 62 nt, Homo Sapiens
auguauucacaggaggccauaagggaggguaaagcagagagaugcggcagcagggggguggg

SEQ ID NO: 342870 - RNA, 62 nt, Homo Sapiens
gacgggagcuggcguagcucugcuuagaaaggagcagagaagugugccuugccugacagaau

SEQ ID NO: 342871 - RNA, 62 nt, Homo Sapiens
acggaggaggcucccaccagguguucaucuccagcagagacaugugguuacagcgccccuca

SEQ ID NO: 342872 - RNA, 62 nt, Homo Sapiens
gacuggugguugaaccuggauacccugggcacagcagagacauacucacagcccccgggcuc

SEQ ID NO: 342873 - RNA, 62 nt, Homo Sapiens
uggccccgaaucauagcucccugagagggccaagcagagaguacuggaaaccucccuaccaa

SEQ ID NO: 342874 - RNA, 62 nt, Homo Sapiens
uuugggccgauguauuuuaaagcagaguggacagcagagagucaauuucccuuucguuggga

SEQ ID NO: 342875 - RNA, 62 nt, Homo Sapiens
ugaggcauccaagaaauguucuggcuggcccaagcagagagcuugcacuggggagguggcug

SEQ ID NO: 342876 - RNA, 62 nt, Homo Sapiens
cuggagcacaggagaguaggcccuuccccagcagcagagaccuuuacuucauaccccaggac

SEQ ID NO: 342877 - RNA, 62 nt, Homo Sapiens
agcccucuccuacggcgcuagggagcacuggaagcagagaugccagcccuggcugagcguag

SEQ ID NO: 342878 - RNA, 62 nt, Homo Sapiens
caucaccggccuucuccuggcaggagaggaggagcagagagcuggguccugggcugggauuc

SEQ ID NO: 342879 - RNA, 62 nt, Homo Sapiens
gggccaggaggugccuuggagaagccagccagagcagagagggcugcugacuuccgugugga

SEQ ID NO: 342880 - RNA, 62 nt, Homo Sapiens
cagagcagagagggcugcugacuuccguguggagcagagaggccugagggccuccuaaaagg

SEQ ID NO: 342881 - RNA, 62 nt, Homo Sapiens
cacaaugguacugaauuugcaucugcacagucagcagagauaacaaguguugaacugaccuu

SEQ ID NO: 342882 - RNA, 62 nt, Homo Sapiens
gacuccgcacugccccucaacagggaugacucagcagagaugacucagcacugucccuuagc

SEQ ID NO: 342883 - RNA, 62 nt, Homo Sapiens
ccucagcaaggaugacucagcagggaugauucagcagagauaacucggggaugacucugauu

SEQ ID NO: 342884 - RNA, 62 nt, Homo Sapiens
uccuuaggaaguggagcuacauggaugaugugagcagagacgcauaacauccaauucugaga

SEQ ID NO: 342885 - RNA, 62 nt, Homo Sapiens
uuuuaaucauuagguuuuagauuuccuuuagcagcagagacugacuugcuguauagagggaa

SEQ ID NO: 342886 - RNA, 62 nt, Homo Sapiens
aggcacuaacgguuccucuuucugauauucugagcagagaaauauccacagucuguuccugu

SEQ ID NO: 342887 - RNA, 62 nt, Homo Sapiens
aguaaaggagccuccuggucugucugucuccaagcagagaccucucaggguggaccacucug

SEQ ID NO: 342888 - RNA, 62 nt, Homo Sapiens
ugucaccacacccagcucaguauuguauuuuuagcagagaugggguuucaccauuuugccca

SEQ ID NO: 342889 - RNA, 62 nt, Homo Sapiens
cagagcgcuggggacuccagacuccccacagcagcagagacucgggacugaggcauccucug

SEQ ID NO: 342890 - RNA, 62 nt, Homo Sapiens
cccccaaccccuucacaaacucagucccagggagcagagaccgucgagcagcaggggcccau

SEQ ID NO: 342891 - RNA, 62 nt, Homo Sapiens
agcugacaggguaccugcucagaggauccuucagcagagagggcucaguuucugcccccagg

SEQ ID NO: 342892 - RNA, 62 nt, Homo Sapiens
aggacaccagagcccaccagacagugccggccagcagagaagcagagagccagcgccacaca

SEQ ID NO: 342893 - RNA, 62 nt, Homo Sapiens
agagcccaccagacagugccggccagcagagaagcagagagccagcgccacacaacaucaag

SEQ ID NO: 342894 - RNA, 64 nt, Homo Sapiens; identical to SEQ ID NO: 301795

SEQ ID NO: 342895 - RNA, 64 nt, Homo Sapiens; identical to SEQ ID NO: 301796

SEQ ID NO: 342896 - RNA, 64 nt, Homo Sapiens; identical to SEQ ID NO: 301797

SEQ ID NO: 342897 - RNA, 64 nt, Homo Sapiens; identical to SEQ ID NO: 301798

SEQ ID NO: 342898 - RNA, 64 nt, Homo Sapiens; identical to SEQ ID NO: 301799

SEQ ID NO: 342899 - RNA, 64 nt, Homo Sapiens; identical to SEQ ID NO: 301800

SEQ ID NO: 342900 - RNA, 64 nt, Homo Sapiens; identical to SEQ ID NO: 301801

SEQ ID NO: 342901 - RNA, 64 nt, Homo Sapiens; identical to SEQ ID NO: 301802

SEQ ID NO: 342902 - RNA, 64 nt, Homo Sapiens; identical to SEQ ID NO: 301803

SEQ ID NO: 342903 - RNA, 64 nt, Homo Sapiens; identical to SEQ ID NO: 286103

SEQ ID NO: 342904 - RNA, 64 nt, Homo Sapiens; identical to SEQ ID NO: 286104

SEQ ID NO: 342905 - RNA, 64 nt, Homo Sapiens; identical to SEQ ID NO: 286105

SEQ ID NO: 342906 - RNA, 64 nt, Homo Sapiens; identical to SEQ ID NO: 286106

SEQ ID NO: 342907 - RNA, 64 nt, Homo Sapiens; identical to SEQ ID NO: 286107

SEQ ID NO: 342908 - RNA, 64 nt, Homo Sapiens; identical to SEQ ID NO: 286108

SEQ ID NO: 342909 - RNA, 64 nt, Homo Sapiens; identical to SEQ ID NO: 286109

SEQ ID NO: 342910 - RNA, 64 nt, Homo Sapiens; identical to SEQ ID NO: 286110

SEQ ID NO: 342911 - RNA, 64 nt, Homo Sapiens; identical to SEQ ID NO: 286111

SEQ ID NO: 342912 - RNA, 64 nt, Homo Sapiens; identical to SEQ ID NO: 286112

SEQ ID NO: 342913 - RNA, 64 nt, Homo Sapiens; identical to SEQ ID NO: 286113

SEQ ID NO: 342914 - RNA, 64 nt, Homo Sapiens; identical to SEQ ID NO: 286114

SEQ ID NO: 342915 - RNA, 64 nt, Homo Sapiens; identical to SEQ ID NO: 286115

SEQ ID NO: 342916 - RNA, 64 nt, Homo Sapiens; identical to SEQ ID NO: 286116

SEQ ID NO: 342917 - RNA, 64 nt, Homo Sapiens; identical to SEQ ID NO: 286117

SEQ ID NO: 342918 - RNA, 64 nt, Homo Sapiens; identical to SEQ ID NO: 286118

SEQ ID NO: 342919 - RNA, 64 nt, Homo Sapiens; identical to SEQ ID NO: 286119

SEQ ID NO: 342920 - RNA, 64 nt, Homo Sapiens; identical to SEQ ID NO: 286120

SEQ ID NO: 342921 - RNA, 64 nt, Homo Sapiens; identical to SEQ ID NO: 286121

SEQ ID NO: 342922 - RNA, 64 nt, Homo Sapiens; identical to SEQ ID NO: 286122

SEQ ID NO: 342923 - RNA, 64 nt, Homo Sapiens; identical to SEQ ID NO: 286123

SEQ ID NO: 342924 - RNA, 64 nt, Homo Sapiens; identical to SEQ ID NO: 286124

SEQ ID NO: 342925 - RNA, 64 nt, Homo Sapiens; identical to SEQ ID NO: 150696

SEQ ID NO: 342926 - RNA, 64 nt, Homo Sapiens; identical to SEQ ID NO: 150697

SEQ ID NO: 342927 - RNA, 64 nt, Homo Sapiens; identical to SEQ ID NO: 150698

SEQ ID NO: 342928 - RNA, 64 nt, Homo Sapiens; identical to SEQ ID NO: 150699

SEQ ID NO: 342929 - RNA, 62 nt, Homo Sapiens
ugcuuuaugucacuuacacggucaccuggagccggcucaaguggcuaaagcauccuggggcc

SEQ ID NO: 342930 - RNA, 62 nt, Homo Sapiens
gucgcccaggcuagaguggauuggcgugaucucggcucaaugcaaaucuccaggguucaauc

SEQ ID NO: 342931 - RNA, 64 nt, Homo Sapiens
gacucuuuuaaggguauuuuaaaaauuaguaaauuugaaugaacuaaagauauaucucuaccuu

SEQ ID NO: 342932 - RNA, 64 nt, Homo Sapiens
uagauuaauucacuaagauuuuauuagagauuguuugaaugaugcauguuauugacaaggcaaa

SEQ ID NO: 342933 - RNA, 64 nt, Homo Sapiens
aggguuuguauucugcuaaaaggagaugccaauguugaaugaagucugaaacucuaguaugugc

SEQ ID NO: 342934 - RNA, 64 nt, Homo Sapiens
uauuuuuuaaacugugauaauacaacagauagcuuugaaugaucugccauaacaugugguaaca

SEQ ID NO: 342935 - RNA, 64 nt, Homo Sapiens
aauaugaauggcuuuucaauugaagaucaaaaaauugaaugauauuuggagaauucauaacauu

SEQ ID NO: 342936 - RNA, 64 nt, Homo Sapiens
uuggauaccagauuguccucgcucaguaacacacuugaaugaauacauauguuguugcuaaaca

SEQ ID NO: 342937 - RNA, 64 nt, Homo Sapiens
uuaaaaugacaguaaauauuacuaaggcaguauuuugaaugaguuugacacugccggcuuccuu

SEQ ID NO: 342938 - RNA, 64 nt, Homo Sapiens
uuguuagaaucacaggaggcaaaaaauggaacgguugaaugaaauuuuacucuuucugugaaag

SEQ ID NO: 342939 - RNA, 64 nt, Homo Sapiens
agagaaaaaaugguaaugugugccuuuauugaacuugaaugacagaacuugaaauuuuuaacac

SEQ ID NO: 342940 - RNA, 64 nt, Homo Sapiens
cuuaauuauuaucaguuuaaauuuuuuuuguuuguugaaugacaaaggcaauaaaaauaaauuu

SEQ ID NO: 342941 - RNA, 64 nt, Homo Sapiens
uaaaauauaauaauguuuucauuacuuuuauuauuugaaugauuuaguaaaguugacugaaucu

SEQ ID NO: 342942 - RNA, 64 nt, Homo Sapiens
uguuaauauaauguguaaagggagauuaaaaaguuugaaugauuauccuaccauguagucauua

SEQ ID NO: 342943 - RNA, 64 nt, Homo Sapiens
ugguaggggcuuaaaagaaacuauaaaguuuuauuugaaugaacacuaugcacugcuguaacug

SEQ ID NO: 342944 - RNA, 64 nt, Homo Sapiens
ucuggaacaaauuuguaggaaaaaauuacuccaauugaaugacugauguauguaaucaacuuca

SEQ ID NO: 342945 - RNA, 64 nt, Homo Sapiens
gugagggcaucccugcugggagagacgauaaacauugaaugaggagguucuaaaggaauugaaa

SEQ ID NO: 342946 - RNA, 64 nt, Homo Sapiens
cagggugugaaguuuuuaauaaucuugaccauuguugaaugagcuugaaauaagacaucgugaa

SEQ ID NO: 342947 - RNA, 64 nt, Homo Sapiens
cagaaguguuugcccacacauaaaguuccuggcuuugaaugaacagagucccucuggaaccaua

SEQ ID NO: 342948 - RNA, 64 nt, Homo Sapiens
aggaguaggaaggaaaauggcuauauaugauuauuugaaugaagauuuuuccagcuuuaagugc

SEQ ID NO: 342949 - RNA, 64 nt, Homo Sapiens
auguuuuauaagaaaugucuaauuuucacuagguuugaaugauccuauuuaaaacagugaauua

SEQ ID NO: 342950 - RNA, 64 nt, Homo Sapiens
acuauaugcaaaacucugugauuucaacuauuuauugaaugauuugcaaagauucacauaguuu

SEQ ID NO: 342951 - RNA, 64 nt, Homo Sapiens
ucuaccgacucacuugugagcucuuagaauaauuuugaaugagauaagauucuuaaauuugggc

SEQ ID NO: 342952 - RNA, 64 nt, Homo Sapiens
aaaguuuaauacaacaggugcuuuuaauuuuuguuugaaugagauugauauuuuacugccuuuc

SEQ ID NO: 342953 - RNA, 64 nt, Homo Sapiens
uuguggcacaaaaucuguucgaaugacaaacccuuugaaugaaaauccagcacaaucauaaagu

SEQ ID NO: 342954 - RNA, 64 nt, Homo Sapiens
guuuuacauaagaaauuauuuaaaucuuuuggguuugaaugaaguuuuccccccaaguuagucu

SEQ ID NO: 342955 - RNA, 64 nt, Homo Sapiens
acuuuauuuacauacuacauaagguagcaaacuguugaaugaguuugaagguaucacuuauuuu

SEQ ID NO: 342956 - RNA, 64 nt, Homo Sapiens
gggugucauuggguuccagcugcucuccuccacauugaaugauaucuuguuaauuuauaggcac

SEQ ID NO: 342957 - RNA, 64 nt, Homo Sapiens
uuauuaaucuacuguaucaauaaaauucuguaauuugaaugaguuuuuaauagucuagaauguu

SEQ ID NO: 342958 - RNA, 64 nt, Homo Sapiens
aucagcuacuguaguugucacagucuugugaacuuugaaugaaauuccacuuuguccagauugg

SEQ ID NO: 342959 - RNA, 64 nt, Homo Sapiens
cacuuggaaagauuuuccacgaaaaaaaaacauauugaaugaaggaucagacaaaaugcagaag

SEQ ID NO: 342960 - RNA, 64 nt, Homo Sapiens
ugcuggggcagugguaugugaugcuaacgacaacuugaaugaacaagcacaacuaaaauuucac

SEQ ID NO: 342961 - RNA, 64 nt, Homo Sapiens
uuuaaaugaauacauuaaugggguuuuuauccuuuugaaugacuuuucagacacuagacauaaa

SEQ ID NO: 342962 - RNA, 64 nt, Homo Sapiens
cagcaagaaggcggggagcagcagagccuugccuuugaaugaggcagcuugugaggcaagcauu

SEQ ID NO: 342963 - RNA, 64 nt, Homo Sapiens
uuguauuuaguugacuguauuauuugauuucggauugaaugaauguaaauagaaauuaaaugca

SEQ ID NO: 342964 - RNA, 64 nt, Homo Sapiens
auugaaugaauguaaauagaaauuaaaugcaaauuugaaugaacauaaauagaagugauuuauu

SEQ ID NO: 342965 - RNA, 64 nt, Homo Sapiens
gucagagggcagacgaauguaaguuggagggacauugaaugauguuaaggagaagacuugaaug

SEQ ID NO: 342966 - RNA, 64 nt, Homo Sapiens
uuggagggacauugaaugauuuuaaggagaagacuugaaugaagcaugaagauuaggaaacagu

SEQ ID NO: 342967 - RNA, 64 nt, Homo Sapiens
auccccaguaaugaaaguacuuagaaaauaauuauugaaugaaugaaaucuaaacugugaaccu

SEQ ID NO: 342968 - RNA, 63 nt, Homo Sapiens
ccgcucuuaagacauggcuggagcucagucuucauugaaugaaguuugcugugguauugcaua

SEQ ID NO: 342969 - RNA, 64 nt, Homo Sapiens; identical to SEQ ID NO: 23154

SEQ ID NO: 342970 - RNA, 64 nt, Homo Sapiens; identical to SEQ ID NO: 23155

SEQ ID NO: 342971 - RNA, 64 nt, Homo Sapiens; identical to SEQ ID NO: 23156

SEQ ID NO: 342972 - RNA, 64 nt, Homo Sapiens; identical to SEQ ID NO: 23157

SEQ ID NO: 342973 - RNA, 64 nt, Homo Sapiens; identical to SEQ ID NO: 307517

SEQ ID NO: 342974 - RNA, 64 nt, Homo Sapiens; identical to SEQ ID NO: 307518

SEQ ID NO: 342975 - RNA, 64 nt, Homo Sapiens; identical to SEQ ID NO: 307519

SEQ ID NO: 342976 - RNA, 64 nt, Homo Sapiens; identical to SEQ ID NO: 307520

SEQ ID NO: 342977 - RNA, 64 nt, Homo Sapiens; identical to SEQ ID NO: 307521

SEQ ID NO: 342978 - RNA, 64 nt, Homo Sapiens; identical to SEQ ID NO: 307522

SEQ ID NO: 342979 - RNA, 64 nt, Homo Sapiens; identical to SEQ ID NO: 307523

SEQ ID NO: 342980 - RNA, 64 nt, Homo Sapiens; identical to SEQ ID NO: 233668

SEQ ID NO: 342981 - RNA, 64 nt, Homo Sapiens; identical to SEQ ID NO: 233669

SEQ ID NO: 342982 - RNA, 64 nt, Homo Sapiens; identical to SEQ ID NO: 233670

SEQ ID NO: 342983 - RNA, 64 nt, Homo Sapiens; identical to SEQ ID NO: 233671

SEQ ID NO: 342984 - RNA, 64 nt, Homo Sapiens; identical to SEQ ID NO: 233672

SEQ ID NO: 342985 - RNA, 64 nt, Homo Sapiens; identical to SEQ ID NO: 233673

SEQ ID NO: 342986 - RNA, 64 nt, Homo Sapiens; identical to SEQ ID NO: 229362

SEQ ID NO: 342987 - RNA, 64 nt, Homo Sapiens; identical to SEQ ID NO: 229363

SEQ ID NO: 342988 - RNA, 64 nt, Homo Sapiens; identical to SEQ ID NO: 229364

SEQ ID NO: 342989 - RNA, 64 nt, Homo Sapiens; identical to SEQ ID NO: 229365

SEQ ID NO: 342990 - RNA, 64 nt, Homo Sapiens; identical to SEQ ID NO: 229366

SEQ ID NO: 342991 - RNA, 64 nt, Homo Sapiens; identical to SEQ ID NO: 229367

SEQ ID NO: 342992 - RNA, 64 nt, Homo Sapiens; identical to SEQ ID NO: 229368

SEQ ID NO: 342993 - RNA, 64 nt, Homo Sapiens; identical to SEQ ID NO: 229369

SEQ ID NO: 342994 - RNA, 63 nt, Homo Sapiens; identical to SEQ ID NO: 98265

SEQ ID NO: 342995 - RNA, 63 nt, Homo Sapiens
cagcaauacaguccucuugaggcacucaagccugagaggaagcucaggaucugacauguucuu

SEQ ID NO: 342996 - RNA, 63 nt, Homo Sapiens
guuguagcuaaauguugauuaugcuggacccaagagaggaaaacaugaauaucaaaucuuuug

SEQ ID NO: 342997 - RNA, 63 nt, Homo Sapiens
uuuuaccucucaaagggugauaccuguuuaggagagaggaagaguucccaaaucaauuauagg

SEQ ID NO: 342998 - RNA, 63 nt, Homo Sapiens
aauugaggaagugaaagaagggaagggagaagggagaggaaugaggaaaaaaaggaagagaga

SEQ ID NO: 342999 - RNA, 63 nt, Homo Sapiens
gagaagggagaggaaugaauaaaaaaaggaagagagaggaaggaaaagggaaaagcagaaagg

SEQ ID NO: 343000 - RNA, 63 nt, Homo Sapiens
ccugcugaagccaggagggucuucccaagauaggagaggaaccgcagguggugagcggcuggg

SEQ ID NO: 343001 - RNA, 63 nt, Homo Sapiens
uugauucuucaaauuaaaaguucuugagagaaggagaggaagauacagcagacauaggacuga

SEQ ID NO: 343002 - RNA, 63 nt, Homo Sapiens
ugggggaauggguugcaaaaauuugagaggaaagagaggaaaacaccauauguauuuucuagg

SEQ ID NO: 343003 - RNA, 63 nt, Homo Sapiens
agaggaaaaugggggaaugguuuucuaggauuugagaggaaaguagcuuccccaccauaugua

SEQ ID NO: 343004 - RNA, 63 nt, Homo Sapiens
gaagggaaggaaguguuuguagagaggaagaacgagaggaagauuggaugaacagagaaggga

SEQ ID NO: 343005 - RNA, 63 nt, Homo Sapiens
acgagaggaagagaagggaaacagagaagggaagagaggaagauuuugaggcaaguuggauga

SEQ ID NO: 343006 - RNA, 63 nt, Homo Sapiens
ucuuuauacuaaaaauauaggcucuugggauuggagaggaaaaauuagaggugauuuucagau

SEQ ID NO: 343007 - RNA, 63 nt, Homo Sapiens
uuaagaaaaagcaagauaauuuugaagaaggacgagaggaagaggcaugaacuuguccuaaca

SEQ ID NO: 343008 - RNA, 63 nt, Homo Sapiens
gaguggacugugggggucuguagagacaguguugagaggaaaggggagguccugcugauuccu

SEQ ID NO: 343009 - RNA, 63 nt, Homo Sapiens
gaggccuacaggguucaccaggauguaagaggagagaggaauccacaggaccaccagagagga

SEQ ID NO: 343010 - RNA, 63 nt, Homo Sapiens
aaaggaauuuaugcuguacauugugccauucaggagaggaaaaccuaccaucaagccauuguu

SEQ ID NO: 343011 - RNA, 63 nt, Homo Sapiens
uuuacagcaguuucaaaaauaggcuguuccauugagaggaauggaacuuuauuuguugggcag

SEQ ID NO: 343012 - RNA, 63 nt, Homo Sapiens
agugcccccuucccggacggguggcaggcccuggagaggaacugagugucacccugaucucag

SEQ ID NO: 343013 - RNA, 63 nt, Homo Sapiens
uguuuguuuguuucaggaaaaaagaaagggagagagaggaaaauagaggguuguccacuccuc

SEQ ID NO: 343014 - RNA, 63 nt, Homo Sapiens
cugcuggcagggaaaucgagcagaagaaugagagagaggaagaucccugguucugcagagggc

SEQ ID NO: 343015 - RNA, 63 nt, Homo Sapiens
aaaagcuguguccuggcagacaagccugagagggagaggaaacggagagaacuucuguauggg

SEQ ID NO: 343016 - RNA, 63 nt, Homo Sapiens
aguuaauuguuucugaauauaugcaggaugugugagaggaagcuugggauacaaaugaaacuu

SEQ ID NO: 343017 - RNA, 63 nt, Homo Sapiens
augccaagcugcuucuuaaugguuuuguacuuggagaggaaaggaacaggguugaaaacccag

SEQ ID NO: 343018 - RNA, 63 nt, Homo Sapiens
ccccuggccaucacucauguguaguccagguuugagaggaacuggaaggggggugaggguggg

SEQ ID NO: 343019 - RNA, 63 nt, Homo Sapiens
ugugauucucccagcccuugcaguccgcuaggugagaggaaaagcucuuuacuuccgccccug

SEQ ID NO: 343020 - RNA, 63 nt, Homo Sapiens
cgggggaggccgaggcaggggcugggcagaggggagaggaagcacaagaagugggagugggag

SEQ ID NO: 343021 - RNA, 63 nt, Homo Sapiens
agaggggagaggaagcacaagaagugggagugggagaggaagccacgugcuggagaguagaca

SEQ ID NO: 343022 - RNA, 63 nt, Homo Sapiens
gagggaggggagaagcccagauggggugggggagagaggaaagaacacauuuugauucugauc

SEQ ID NO: 343023 - RNA, 63 nt, Homo Sapiens
aguuguucucccacuggaagucacaggggaagggagaggaaagauuccuuccucccccucauc

SEQ ID NO: 343024 - RNA, 63 nt, Homo Sapiens
ccucacucacccacugcgucaaagcagagacaggagaggaaggagcgucgccaggcaaugagg

SEQ ID NO: 343025 - RNA, 63 nt, Homo Sapiens
uuuucauauuaaugacaaaauuuugggcaacaugagaggaaccuagaaaccuaaggaaaaugc

SEQ ID NO: 343026 - RNA, 63 nt, Homo Sapiens
cacccaaggaacauuugaucuagcagcagggaugagaggaaagcagaaaugaaugaacuguga

SEQ ID NO: 343027 - RNA, 63 nt, Homo Sapiens
aacacccugccuacaaggagauguuuugaaauggagaggaaaauuggcaccucaucuuuuaaa

SEQ ID NO: 343028 - RNA, 63 nt, Homo Sapiens
uaauuucagagccauacaaaacugaggcauagggagaggaaguucugccccugccccuuagcu

SEQ ID NO: 343029 - RNA, 63 nt, Homo Sapiens
gccaaaacaaaucacgagaacugcagaaccaaagagaggaaucgggcaggugggucacguggu

SEQ ID NO: 343030 - RNA, 63 nt, Homo Sapiens
ccauuuuccugaaucaaauucugcaguggaauggagaggaaaauacuucuaggcaagcagcua

SEQ ID NO: 343031 - RNA, 63 nt, Homo Sapiens
ugacaacaacuuccaaauuggcucuuuggaggcgagaggaaggggagaacuuggagaauaguu

SEQ ID NO: 343032 - RNA, 64 nt, Homo Sapiens; identical to SEQ ID NO: 93178

SEQ ID NO: 343033 - RNA, 64 nt, Homo Sapiens; identical to SEQ ID NO: 93179

SEQ ID NO: 343034 - RNA, 64 nt, Homo Sapiens; identical to SEQ ID NO: 93180

SEQ ID NO: 343035 - RNA, 64 nt, Homo Sapiens; identical to SEQ ID NO: 93181

SEQ ID NO: 343036 - RNA, 64 nt, Homo Sapiens; identical to SEQ ID NO: 21758

SEQ ID NO: 343037 - RNA, 64 nt, Homo Sapiens; identical to SEQ ID NO: 21759

SEQ ID NO: 343038 - RNA, 64 nt, Homo Sapiens; identical to SEQ ID NO: 21760

SEQ ID NO: 343039 - RNA, 64 nt, Homo Sapiens; identical to SEQ ID NO: 21761

SEQ ID NO: 343040 - RNA, 64 nt, Homo Sapiens; identical to SEQ ID NO: 21762

SEQ ID NO: 343041 - RNA, 64 nt, Homo Sapiens; identical to SEQ ID NO: 21763

SEQ ID NO: 343042 - RNA, 64 nt, Homo Sapiens; identical to SEQ ID NO: 21764

SEQ ID NO: 343043 - RNA, 64 nt, Homo Sapiens; identical to SEQ ID NO: 21765

SEQ ID NO: 343044 - RNA, 64 nt, Homo Sapiens; identical to SEQ ID NO: 21766

SEQ ID NO: 343045 - RNA, 64 nt, Homo Sapiens; identical to SEQ ID NO: 21767

SEQ ID NO: 343046 - RNA, 64 nt, Homo Sapiens; identical to SEQ ID NO: 21768

SEQ ID NO: 343047 - RNA, 64 nt, Homo Sapiens; identical to SEQ ID NO: 21769

SEQ ID NO: 343048 - RNA, 64 nt, Homo Sapiens; identical to SEQ ID NO: 21770

SEQ ID NO: 343049 - RNA, 64 nt, Homo Sapiens; identical to SEQ ID NO: 21771

SEQ ID NO: 343050 - RNA, 64 nt, Homo Sapiens; identical to SEQ ID NO: 21772

SEQ ID NO: 343051 - RNA, 64 nt, Homo Sapiens; identical to SEQ ID NO: 21773

SEQ ID NO: 343052 - RNA, 64 nt, Homo Sapiens; identical to SEQ ID NO: 21774

SEQ ID NO: 343053 - RNA, 64 nt, Homo Sapiens; identical to SEQ ID NO: 21775

SEQ ID NO: 343054 - RNA, 64 nt, Homo Sapiens; identical to SEQ ID NO: 21776

SEQ ID NO: 343055 - RNA, 64 nt, Homo Sapiens; identical to SEQ ID NO: 21777

SEQ ID NO: 343056 - RNA, 64 nt, Homo Sapiens; identical to SEQ ID NO: 21778

SEQ ID NO: 343057 - RNA, 64 nt, Homo Sapiens; identical to SEQ ID NO: 21779

SEQ ID NO: 343058 - RNA, 64 nt, Homo Sapiens; identical to SEQ ID NO: 21780

SEQ ID NO: 343059 - RNA, 64 nt, Homo Sapiens; identical to SEQ ID NO: 21781

SEQ ID NO: 343060 - RNA, 64 nt, Homo Sapiens; identical to SEQ ID NO: 97841

SEQ ID NO: 343061 - RNA, 64 nt, Homo Sapiens; identical to SEQ ID NO: 97842

SEQ ID NO: 343062 - RNA, 64 nt, Homo Sapiens; identical to SEQ ID NO: 97843

SEQ ID NO: 343063 - RNA, 64 nt, Homo Sapiens; identical to SEQ ID NO: 97844

SEQ ID NO: 343064 - RNA, 64 nt, Homo Sapiens; identical to SEQ ID NO: 97845

SEQ ID NO: 343065 - RNA, 64 nt, Homo Sapiens; identical to SEQ ID NO: 97846

SEQ ID NO: 343066 - RNA, 64 nt, Homo Sapiens; identical to SEQ ID NO: 97847

SEQ ID NO: 343067 - RNA, 64 nt, Homo Sapiens; identical to SEQ ID NO: 97848

SEQ ID NO: 343068 - RNA, 64 nt, Homo Sapiens
uggaaggagacagaaggaaauugacccacucuccuaucuccagaccuuuaccuagccccuccag

SEQ ID NO: 343069 - RNA, 64 nt, Homo Sapiens
uccauuguacuagcaaaucuaugggggguaauuuuaucuccaucuuuaacuuuuaaaguacuuc

SEQ ID NO: 343070 - RNA, 64 nt, Homo Sapiens
ggauugaguaaugggauuugaaucaauguauuaauaucuccauagcugggaaacguggguucaa

SEQ ID NO: 343071 - RNA, 64 nt, Homo Sapiens
caauacucucugaguacauugugcccuugauuuuuaucuccaaguggcaguuuuuaaaauuggc

SEQ ID NO: 343072 - RNA, 64 nt, Homo Sapiens
gcuguuugcagcucucccagcuccccgccucucuuaucuccaugagacucagucacuguguucc

SEQ ID NO: 343073 - RNA, 64 nt, Homo Sapiens
uggucacugcaggugccaacagcugccugcauuguaucuccaucuggucaccaagcaugguagc

SEQ ID NO: 343074 - RNA, 64 nt, Homo Sapiens
cgcugguggcagggcguuuucccaccgggauacgggaagccaccugugucagggcuaggcccug

SEQ ID NO: 343075 - RNA, 64 nt, Homo Sapiens
agcaguaauauuucagcaagaggagguggucaugggaagccagcacagcagaggcucccugacc

SEQ ID NO: 343076 - RNA, 64 nt, Homo Sapiens
aauacagguuuucuugaugaucauguguauacaaggaagccagggccuuguuucucuagucaca

SEQ ID NO: 343077 - RNA, 64 nt, Homo Sapiens
ugcagugcugguguguccuggggcccugggagaaggaagccauugccuucuuuucuaucccuuu

SEQ ID NO: 343078 - RNA, 64 nt, Homo Sapiens
cacaaacacacaccugcugggugaaauguugacuggaagccaccuuuuuuuaaggggcuguggg

SEQ ID NO: 343079 - RNA, 64 nt, Homo Sapiens
guugggugcuuauuuaucugagaccaagcacucuggaagccagguuaugcccaucuccauagcc

SEQ ID NO: 343080 - RNA, 64 nt, Homo Sapiens
gagguagcagguagcucucuagcaaagacgugaaggaagccaggaacugagaaggugaaaugug

SEQ ID NO: 343081 - RNA, 64 nt, Homo Sapiens
gcugugguucagagagggugaguggccuugggaaggaagccaugugcguuguugggaagccagc

SEQ ID NO: 343082 - RNA, 64 nt, Homo Sapiens
aguggccuugggaaggaagcaaucugcguuguugggaagccagcagaucccacagucagaacug

SEQ ID NO: 343083 - RNA, 64 nt, Homo Sapiens
ccccuguugcucuccuuaguaaaccaaaggaaauggaagccauuugucuugggcuuucgucauu

SEQ ID NO: 343084 - RNA, 64 nt, Homo Sapiens
cccccaccccuccccacccaccaccgcucccgcgggaagccagcccgugcaacggaagccaggc

SEQ ID NO: 343085 - RNA, 64 nt, Homo Sapiens
accaccgcucccgcgggaagccagcccgugcaacggaagccaggccaacugccccgcgucuuca

SEQ ID NO: 343086 - RNA, 64 nt, Homo Sapiens
ucugugccucuccccaggaagcauccagggcagaggaagccacaucucccggugcccccaaccc

SEQ ID NO: 343087 - RNA, 64 nt, Homo Sapiens
guggggagcagggaguugcccuuccccucccucgggaagccaccuaagaauguuuacaugccaa

SEQ ID NO: 343088 - RNA, 64 nt, Homo Sapiens
cauccugcaccuguccaccccaccccaacacccuggaagccacugucaaugauuagaucggguc

SEQ ID NO: 343089 - RNA, 64 nt, Homo Sapiens
agacacagcaggaggagaggacuuacauuuguggggaagccaacucgacagcccuggcuaacua

SEQ ID NO: 343090 - RNA, 64 nt, Homo Sapiens
cugcugucgcucuguggggggcuggccgcggauuggaagccagcgacucgagcuccuaccagug

SEQ ID NO: 343091 - RNA, 64 nt, Homo Sapiens
aggaaaacaaacuagagguagaggaccuucucauggaagccauuacuguuauauaauuuauugu

SEQ ID NO: 343092 - RNA, 64 nt, Homo Sapiens
cacauauucauaaaaaaaauagcaacuucccuggggaagccaaacuuucguuuguuuaccagca

SEQ ID NO: 343093 - RNA, 64 nt, Homo Sapiens
cagccuccaggacguggcaccagagcccagcugaggaagccacaucagaccucugagugggccc

SEQ ID NO: 343094 - RNA, 64 nt, Homo Sapiens
ccugagcgagccuguccucucagcgucccaggaaggaagccaacuggcgaccgugccucugugc

SEQ ID NO: 343095 - RNA, 64 nt, Homo Sapiens
ugacaaguccaaggucacgaaaacugaggcucagggaagccaagcuccacuuuuucagacaagg

SEQ ID NO: 343096 - RNA, 64 nt, Homo Sapiens
acugaugccucccacugugauucacagucgaaaaggaagccacccugaccagcuggcccaggau

SEQ ID NO: 343097 - RNA, 64 nt, Homo Sapiens
uucuacacacuugccucucgcucacuuuuagaucggaagccaguacaccucucugcgguucccu

SEQ ID NO: 343098 - RNA, 64 nt, Homo Sapiens
cucuuugcuuggcuucucuuacuugaccucggguggaagccaggggacgccauccgaagacagc

SEQ ID NO: 343099 - RNA, 64 nt, Homo Sapiens
agccugaggacccccgccuaccaccucgagaacuggaagccaaccucuaaccuccugaccucau

SEQ ID NO: 343100 - RNA, 64 nt, Homo Sapiens
accagugcccaagucucuauggagaaugagaacuggaagccacugcuaccgucuacccagcacc

SEQ ID NO: 343101 - RNA, 64 nt, Homo Sapiens
aggcgcgggggccacugaggggcccagucucaaaggaagccacaaagacucuguuccugcccua

SEQ ID NO: 343102 - RNA, 64 nt, Homo Sapiens
gugcagagagcagccuggcccggccuaggaggcaggaagccaagccaaggccacaaggggaccc

SEQ ID NO: 343103 - RNA, 64 nt, Homo Sapiens
ucccuuugagaagauauuuucccacaaaggggugggaagccaggagugagaaggaauucaggga

SEQ ID NO: 343104 - RNA, 64 nt, Homo Sapiens
aaguggcugcguuuccuggggcccuggguuuuggggaagccaguuagcugcugcuuuggcacug

SEQ ID NO: 343105 - RNA, 64 nt, Homo Sapiens
guucagguguggacgggacagugaguggcugggaggaagccagaaucaacagcuccagcccucu

SEQ ID NO: 343106 - RNA, 64 nt, Homo Sapiens
cuucaggcacuaagaggggcuggaccuggcggcaggaagccaaagagacugggccuaggccagg

SEQ ID NO: 343107 - RNA, 64 nt, Homo Sapiens
gucaagagggccaucccuaacagaaaggccaggcggaagccaaguccgccauuuugguagcuuc

SEQ ID NO: 343108 - RNA, 64 nt, Homo Sapiens
gagggcagcguccaggagagguggcugagcacguggaagccauuccccacuugguggccggaca

SEQ ID NO: 343109 - RNA, 64 nt, Homo Sapiens; identical to SEQ ID NO: 125533

SEQ ID NO: 343110 - RNA, 64 nt, Homo Sapiens; identical to SEQ ID NO: 125534

SEQ ID NO: 343111 - RNA, 64 nt, Homo Sapiens; identical to SEQ ID NO: 125535

SEQ ID NO: 343112 - RNA, 64 nt, Homo Sapiens; identical to SEQ ID NO: 125536

SEQ ID NO: 343113 - RNA, 64 nt, Homo Sapiens; identical to SEQ ID NO: 125537

SEQ ID NO: 343114 - RNA, 64 nt, Homo Sapiens; identical to SEQ ID NO: 125538

SEQ ID NO: 343115 - RNA, 64 nt, Homo Sapiens; identical to SEQ ID NO: 125539

SEQ ID NO: 343116 - RNA, 64 nt, Homo Sapiens; identical to SEQ ID NO: 125540

SEQ ID NO: 343117 - RNA, 64 nt, Homo Sapiens; identical to SEQ ID NO: 125541

SEQ ID NO: 343118 - RNA, 64 nt, Homo Sapiens; identical to SEQ ID NO: 125542

SEQ ID NO: 343119 - RNA, 64 nt, Homo Sapiens; identical to SEQ ID NO: 125543

SEQ ID NO: 343120 - RNA, 64 nt, Homo Sapiens; identical to SEQ ID NO: 125544

SEQ ID NO: 343121 - RNA, 64 nt, Homo Sapiens; identical to SEQ ID NO: 125545

SEQ ID NO: 343122 - RNA, 64 nt, Homo Sapiens; identical to SEQ ID NO: 125546

SEQ ID NO: 343123 - RNA, 64 nt, Homo Sapiens; identical to SEQ ID NO: 125547

SEQ ID NO: 343124 - RNA, 64 nt, Homo Sapiens; identical to SEQ ID NO: 125548

SEQ ID NO: 343125 - RNA, 64 nt, Homo Sapiens; identical to SEQ ID NO: 125549

SEQ ID NO: 343126 - RNA, 64 nt, Homo Sapiens; identical to SEQ ID NO: 125550

SEQ ID NO: 343127 - RNA, 64 nt, Homo Sapiens; identical to SEQ ID NO: 125551

SEQ ID NO: 343128 - RNA, 64 nt, Homo Sapiens; identical to SEQ ID NO: 125552

SEQ ID NO: 343129 - RNA, 64 nt, Homo Sapiens; identical to SEQ ID NO: 125553

SEQ ID NO: 343130 - RNA, 64 nt, Homo Sapiens; identical to SEQ ID NO: 125554

SEQ ID NO: 343131 - RNA, 64 nt, Homo Sapiens; identical to SEQ ID NO: 125555

SEQ ID NO: 343132 - RNA, 64 nt, Homo Sapiens; identical to SEQ ID NO: 125556

SEQ ID NO: 343133 - RNA, 64 nt, Homo Sapiens; identical to SEQ ID NO: 125557

SEQ ID NO: 343134 - RNA, 64 nt, Homo Sapiens; identical to SEQ ID NO: 125558

SEQ ID NO: 343135 - RNA, 64 nt, Homo Sapiens; identical to SEQ ID NO: 125559

SEQ ID NO: 343136 - RNA, 64 nt, Homo Sapiens; identical to SEQ ID NO: 125560

SEQ ID NO: 343137 - RNA, 64 nt, Homo Sapiens; identical to SEQ ID NO: 125561

SEQ ID NO: 343138 - RNA, 64 nt, Homo Sapiens; identical to SEQ ID NO: 125562

SEQ ID NO: 343139 - RNA, 64 nt, Homo Sapiens; identical to SEQ ID NO: 125563

SEQ ID NO: 343140 - RNA, 64 nt, Homo Sapiens; identical to SEQ ID NO: 125564

SEQ ID NO: 343141 - RNA, 64 nt, Homo Sapiens; identical to SEQ ID NO: 125565

SEQ ID NO: 343142 - RNA, 64 nt, Homo Sapiens; identical to SEQ ID NO: 125566

SEQ ID NO: 343143 - RNA, 64 nt, Homo Sapiens; identical to SEQ ID NO: 125567

SEQ ID NO: 343144 - RNA, 64 nt, Homo Sapiens; identical to SEQ ID NO: 125568

SEQ ID NO: 343145 - RNA, 64 nt, Homo Sapiens
gucacagcaaugcucuccuugucaaggcauggaccagggucauucagacacauucagauacugc

SEQ ID NO: 343146 - RNA, 64 nt, Homo Sapiens
ugcacuggcgggucucuccaugcaggccacaacacagggucaguguucaccuggugucacuucc

SEQ ID NO: 343147 - RNA, 64 nt, Homo Sapiens
cccccuccucuccccaguuuccagcugggggauccagggucagggucccucuagccuguggaca

SEQ ID NO: 343148 - RNA, 64 nt, Homo Sapiens
uuuguuugauuuguccagucaagaaggagcucuacagggucagcaccuuagaagaagugggaag

SEQ ID NO: 343149 - RNA, 64 nt, Homo Sapiens
aggugugacugcucugacaaccuguggcaugcugcagggucaggcuccugauaggaggauuuca

SEQ ID NO: 343150 - RNA, 64 nt, Homo Sapiens
cagaauaugcucacugcuaagcuacaaacucggacagggucagaaacagaggugucccauccca

SEQ ID NO: 343151 - RNA, 64 nt, Homo Sapiens
uuuugugccaguauucaagugguauagcucugagcagggucacauuuggccaaaccugacacug

SEQ ID NO: 343152 - RNA, 64 nt, Homo Sapiens
acacugucuugcugcauucuccuuuggcaaacaucagggucagaauucaggauagcccuuccua

SEQ ID NO: 343153 - RNA, 64 nt, Homo Sapiens
cuuuuccaaguuuaucaguggcaugaugaaauuccagggucacaccugcugcaguaaauauuuu

SEQ ID NO: 343154 - RNA, 64 nt, Homo Sapiens
ggaagggggcccugugcuucaggcaguagccagacagggucaugcaggcagcuucaugaugugc

SEQ ID NO: 343155 - RNA, 64 nt, Homo Sapiens
ucuagaaauagcccaccaagacagcacacagggucagggucacuuuuaacaugagaaggcgcca

SEQ ID NO: 343156 - RNA, 64 nt, Homo Sapiens
gucacuucuagaaauagcccgcgccaacagcacacagggucagggagugguuuaacaugagaag

SEQ ID NO: 343157 - RNA, 64 nt, Homo Sapiens
aucgugggcauguguauagcagagagguccgggacagggucagugggcucuggccuucucaugc

SEQ ID NO: 343158 - RNA, 64 nt, Homo Sapiens
gccccaacagaagcagcaguuuccaucagaauuccagggucacaugccccuucagaccagcugc

SEQ ID NO: 343159 - RNA, 64 nt, Homo Sapiens
gucugaacuacucagauuggcaucccaugcuaagcagggucaugccugccucugcuuucuccug

SEQ ID NO: 343160 - RNA, 64 nt, Homo Sapiens
ucccagguucuaugaccaaagugucagcucuguacagggucagagcucuaugagugggccccua

SEQ ID NO: 343161 - RNA, 64 nt, Homo Sapiens
ggcuaugcuggggucccaggguggccgcagcagucagggucacugugggagcccugggguggag

SEQ ID NO: 343162 - RNA, 64 nt, Homo Sapiens
ggcugugacuccguggggcucagccaggcuccagcagggucagacgugcuguuaagagcaaagc

SEQ ID NO: 343163 - RNA, 64 nt, Homo Sapiens
gcagguuaugagauccuuggucagggucaauacucagggucagucacucgggcucagaggucac

SEQ ID NO: 343164 - RNA, 64 nt, Homo Sapiens
acucagggucagugcagguugcucagaggucacucagggucaaucaagcaucagggccacucgg

SEQ ID NO: 343165 - RNA, 64 nt, Homo Sapiens
uugcccaccagggggcuggugcaccugcugaccucagggucacaguugagucauuugccaguug

SEQ ID NO: 343166 - RNA, 64 nt, Homo Sapiens
ggcagcccccaggaaggccuuccagaucuggcuccagggucaccaccugucacagcaauaccug

SEQ ID NO: 343167 - RNA, 64 nt, Homo Sapiens
aacuuuuuucuuuagugaagaggagcccggggagcagggucauggcauugaggcaagccuggag

SEQ ID NO: 343168 - RNA, 64 nt, Homo Sapiens
aacuuuuucuucuuugcaaaaggagccaagggagcagggucauugaggccaggcaagcauggac

SEQ ID NO: 343169 - RNA, 64 nt, Homo Sapiens
uggagccucagugcccguuuggccugcugcucucgcugacaauaaagagcccuugcguugcacu

SEQ ID NO: 343170 - RNA, 64 nt, Homo Sapiens
acuguagaaauacuuuuucagaaacgaauccauagcugacaaauucacucagugcccaauauau

SEQ ID NO: 343171 - RNA, 64 nt, Homo Sapiens
ucaggauggaggccagccugugcagaaggcugcagcugacaacagcgaccccaccugccauuac

SEQ ID NO: 343172 - RNA, 64 nt, Homo Sapiens
caucagccucccucacaugggagaccccaacccagcugacaauguggagcccccagaacuucag

SEQ ID NO: 343173 - RNA, 64 nt, Homo Sapiens
auauguauauauuuaauauauauauaaaaccagagcugacaaugacacucuggaacauugcaua

SEQ ID NO: 343174 - RNA, 64 nt, Homo Sapiens
uugccuuguagauuccucuggugcuggucuccaggcugacaaggauucaaaguugucucugaaa

SEQ ID NO: 343175 - RNA, 64 nt, Homo Sapiens
caggaccgauggugaggcccucgaccgggcuuuugcugacaaccguucaagcacaucaaggccu

SEQ ID NO: 343176 - RNA, 64 nt, Homo Sapiens
ucucaagaagaacuuaugagaaacagauugcgucgcugacaagugucuugugcucuucaagaca

SEQ ID NO: 343177 - RNA, 64 nt, Homo Sapiens
uuuuaaaacuucagugcuuccuuuugucauuugagcugacaaguuuaugugaccagauuaagug

SEQ ID NO: 343178 - RNA, 64 nt, Homo Sapiens
auauuuuccuagcaucaguaagauuuuacaaaaugcugacaaaaaaauauugguugaaaguuag

SEQ ID NO: 343179 - RNA, 64 nt, Homo Sapiens
uuugaggcugggaggagagcccugcucugguggagcugacaacccuggcaugaggagagaagac

SEQ ID NO: 343180 - RNA, 64 nt, Homo Sapiens
gggauagggaggggauuagaauuccauugagaaagcugacaacuuuaagcuauauccccuuguc

SEQ ID NO: 343181 - RNA, 64 nt, Homo Sapiens
agagaagaaacagaaaaugugaaauacaucugcagcugacaaugaaauuguacuugauccugcu

SEQ ID NO: 343182 - RNA, 64 nt, Homo Sapiens
ccugggaauuuggguuguguauuaacauugaucugcugacaaaaaaaaaaaaacuugauuuguu

SEQ ID NO: 343183 - RNA, 64 nt, Homo Sapiens
aauauauuauacagcaguuuacacacaugaacuugcugacaaugauaacauuggauggcaauuu

SEQ ID NO: 343184 - RNA, 64 nt, Homo Sapiens
cugccaugcccaccaucgggccaacugcaggaaugcugacaaugcaccaauuccacuuccugcc

SEQ ID NO: 343185 - RNA, 64 nt, Homo Sapiens
gggugauuccaagaucaucccacuccuuccuggggcugacaaaauuucuagaagccacuccagc

SEQ ID NO: 343186 - RNA, 64 nt, Homo Sapiens
uccaaagcagccugugaagucuuuggugcuaggagcugacaauugaugaucuucagauuaaacc

SEQ ID NO: 343187 - RNA, 64 nt, Homo Sapiens
cucagggcucucuuaccuucugaggacagaaacagcugacaagaguaccauuuggggucucagu

SEQ ID NO: 343188 - RNA, 64 nt, Homo Sapiens
auugaagguuggaaugguguacuaaaccaaaaaagcugacaacugagaguuuuagaagauuaga

SEQ ID NO: 343189 - RNA, 64 nt, Homo Sapiens
cauguuuggaguaucaucucugucugggaucugggcugacaaauuaaaaccuagaguagugcuu

SEQ ID NO: 343190 - RNA, 64 nt, Homo Sapiens
caaucuucccaauacuuucaccauuugucccagugcugacaaccugggguccugauacucauuc

SEQ ID NO: 343191 - RNA, 64 nt, Homo Sapiens
ugaaugggcacugccugccccagcugagguugccgcugacaagagcucacuccauucgggucca

SEQ ID NO: 343192 - RNA, 64 nt, Homo Sapiens
auuaaagucagaaguuuuacgagagaauguauuugcugacaacccucauuguguuucuaccgga

SEQ ID NO: 343193 - RNA, 64 nt, Homo Sapiens
agguuugacagaggggaacaauugaaaggaagaggcugacaauauuuaagaccuuguauaccau

SEQ ID NO: 343194 - RNA, 64 nt, Homo Sapiens
ggcuguggggaugguggggugaugggcaagauucgcugacaaauggggcuccugggcucauuug

SEQ ID NO: 343195 - RNA, 64 nt, Homo Sapiens
ucacugggagggccaacuuggaggaucagugcuggcugacaagcccuccgccuccuugccugca

SEQ ID NO: 343196 - RNA, 64 nt, Homo Sapiens
gaguggguacggccagccacucagcccauuggcagcugacaacgcagacacgcucuacggaggc

SEQ ID NO: 343197 - RNA, 64 nt, Homo Sapiens
uuauugugugccuuucuguguuuaccucacucaagcugacaacauuguuuaugggaaucuaucc

SEQ ID NO: 343198 - RNA, 64 nt, Homo Sapiens
ugaguaggcugucaucagaacaaagggcuccacugcugacaagguuugagaacugcuggcuuga

SEQ ID NO: 343199 - RNA, 64 nt, Homo Sapiens
aaugccaacagacaggccacucuuuggucagccugcugacaaauuuaagugcugguaccugugg

SEQ ID NO: 343200 - RNA, 64 nt, Homo Sapiens
cuggaaugcuggguaugcucugugacaaggcuacgcugacaaucaguuaaacacaccggagaag

SEQ ID NO: 343201 - RNA, 64 nt, Homo Sapiens
cuuucugguuuuacaucaugaggaucaguuagcugcugacaagaaaagucaucuugugucuuuu

SEQ ID NO: 343202 - RNA, 64 nt, Homo Sapiens
cuauuuagcauaugcaaaucggaccucuucagcugcugacaaucuacuaguccaaucaccccca

SEQ ID NO: 343203 - RNA, 64 nt, Homo Sapiens
cuuggaagagccugcagguggcccaaguuguggugcugacaaagaccuggcacugcugugcugu

SEQ ID NO: 343204 - RNA, 64 nt, Homo Sapiens
uggggaacaauccuugccaguggcuuccucugaugcugacaaggguguguccugccuguauaug

SEQ ID NO: 343205 - RNA, 64 nt, Homo Sapiens
gcgggacacccugguucccaccauucccugccuugcugacaauaaagauauuuccaagaacccg

SEQ ID NO: 343206 - RNA, 53 nt, Homo Sapiens
cucuagaaggcaaaauuuagccugcugacaauuucccacaccguguaaaccaa

SEQ ID NO: 343207 - RNA, 64 nt, Homo Sapiens
gcugaagcccgcuuucagcacgccguaaccaggggcugacaaugcgaggucgcaacugagaucu

SEQ ID NO: 343208 - RNA, 64 nt, Homo Sapiens
gggcuuaugaggucuauguauaugaagaauaugugcugacaacaauaaaaggaagaugaguauu

SEQ ID NO: 343209 - RNA, 64 nt, Homo Sapiens
ugcuuauagaauuucuuaacagccuauacauuuagcugacaaaggcauucauuuugaauugaga

SEQ ID NO: 343210 - RNA, 64 nt, Homo Sapiens
gaagauccaggugccaaucccaaaacugcagcuggcugacaauguuugacccacguaaacugag

SEQ ID NO: 343211 - RNA, 64 nt, Homo Sapiens
cgagggcgagggguuagaacgacuucugcgggcggcugacaacggacaagcuagaggcucugcg

SEQ ID NO: 343212 - RNA, 64 nt, Homo Sapiens
uuccuggugcugaauaaaggguguugcugucaaggcugacaauuuguaaguuuguuucuuucau

SEQ ID NO: 343213 - RNA, 64 nt, Homo Sapiens
uggauuccaaacugcuaugcccucuauaccaguggcugacaaggcauauagggauauaugccau

SEQ ID NO: 343214 - RNA, 64 nt, Homo Sapiens
auauugucauguuuggcccugagggugggugauugcugacaauuuugccaaugcugcuguauuu

SEQ ID NO: 343215 - RNA, 64 nt, Homo Sapiens
ucuuuccccugcuaggaaaaaauugcacugaaaugcugacaaaaaauaaugaaaugaaguggcu

SEQ ID NO: 343216 - RNA, 64 nt, Homo Sapiens
gcccaaagguugggaguaggagacaguaucccaggcugacaagggcuugcccuuuaccuugggc

SEQ ID NO: 343217 - RNA, 64 nt, Homo Sapiens
uccacauaaggauaaccuuacgugaaaccuuccugcugacaaccaugcagaggaauuuuuccac

SEQ ID NO: 343218 - RNA, 64 nt, Homo Sapiens
uaaauucaugguguaacacaaauucaacauagaggcugacaaccucugaugcuucaguguuaua

SEQ ID NO: 343219 - RNA, 64 nt, Homo Sapiens
cagauaaaaucuacuccaaauucagcuugguagagcugacaaagaacagcguuuuuaacaagau

SEQ ID NO: 343220 - RNA, 64 nt, Homo Sapiens
uuucaauauuauuuuagcuuacuggucagcccuagcugacaaaaacccuguggaaaacguaacc

SEQ ID NO: 343221 - RNA, 64 nt, Homo Sapiens
caaugaaaaggcuuaaaaaguucgguuugagccggcugacaauaaagaaaaacgagcaugaaaa

SEQ ID NO: 343222 - RNA, 64 nt, Homo Sapiens
cugcugccuuacccgccauaccccaggugcaggugcugacaauacugcaguuccaucagguccc

SEQ ID NO: 343223 - RNA, 64 nt, Homo Sapiens
ccggaggggcuguauuaauuuguauugccccauggcugacaaaagccuuuuuuuuugguuuuga

SEQ ID NO: 343224 - RNA, 64 nt, Homo Sapiens
caacuucagggugauuuuuuuagcaguaaccagagcugacaaucuaacuccccuccaccgcccc

SEQ ID NO: 343225 - RNA, 64 nt, Homo Sapiens
cagcuggaaucaggggagugcaucauccucgggagcugacaacagccaggcuacaccagggcac

SEQ ID NO: 343226 - RNA, 64 nt, Homo Sapiens
guauugcaaagucaggaaucaucaggaacguuuagcugacaaaauacuugucuguuuuaaaaac

SEQ ID NO: 343227 - RNA, 64 nt, Homo Sapiens
cuacagcugacccuugaacauggggguuaggggagcugacaauucguggguccgcaaaaucuua

SEQ ID NO: 343228 - RNA, 64 nt, Homo Sapiens
auuuauugggcaccuacuauacugcccacaaauggcugacaaaucccuaugauccauugucccc

SEQ ID NO: 343229 - RNA, 64 nt, Homo Sapiens
guggggcuggugggcuggggagcugucaggcccagcugacaagcgaauagaaaacaagagcagc

SEQ ID NO: 343230 - RNA, 64 nt, Homo Sapiens
ccuuguaaagcucacuccucgaaguacagagccagcugacaagugugaaggaaccagcccaaua

SEQ ID NO: 343231 - RNA, 64 nt, Homo Sapiens
auacugauagaaaaagugaugcaauucaaaucaugcugacaaggaagaguagguacucuugaga

SEQ ID NO: 343232 - RNA, 64 nt, Homo Sapiens
cuuuuuucuucacaugaguaagccauugugcccggcugacaagggugcugggauuacaggcgug

SEQ ID NO: 343233 - RNA, 64 nt, Homo Sapiens
aaccaaagugauucuuaauuauauaauaaauuuggcugacaagaaaaaagacaauaaaauugua

SEQ ID NO: 343234 - RNA, 64 nt, Homo Sapiens
ugcacaauguugaacauagccauuaaaaggccuugcugacaacuucauacaugagaaauguaca

SEQ ID NO: 343235 - RNA, 64 nt, Homo Sapiens
aggcacuugccucugcacuuuucuauauuguucagcugacaaaguaguauuuuagaaaaguucu

SEQ ID NO: 343236 - RNA, 64 nt, Homo Sapiens
cgccagucaugggaggcagagcugggggagcgaggcugacaaugacuccuguuuucacgcugag

SEQ ID NO: 343237 - RNA, 64 nt, Homo Sapiens
gugcugggauuacaggcaugaaccacugugcccagcugacaaaaugaguucuuaaacuuuuuuu

SEQ ID NO: 343238 - RNA, 64 nt, Homo Sapiens
aacaggaguaugaaaugagaguuagaccauaugggcugacaacaccauaaauaacaagaaaagg

SEQ ID NO: 343239 - RNA, 64 nt, Homo Sapiens
ucgcucucccuccuccuccuccuccgagcugcuagcugacaaauacaauucugaaggaauccaa

SEQ ID NO: 343240 - RNA, 64 nt, Homo Sapiens
uauaguaugagguaaggauccugcuacaguguuagcugacaacauuuaugugauucauauacca

SEQ ID NO: 343241 - RNA, 64 nt, Homo Sapiens
augaccugcugcuguugagucggaaccugaaggugcugacaaaggggaccaguggcagggaccc

SEQ ID NO: 343242 - RNA, 64 nt, Homo Sapiens
cugagcggagcgguggagaggcaggagcggcucggcugacaagcagacagcgggccucgcgcgg

SEQ ID NO: 343243 - RNA, 64 nt, Homo Sapiens
auauugggagaugaauuugcgagaauaucacuaagcugacaaugaauugaaauuuuaaaauaug

SEQ ID NO: 343244 - RNA, 64 nt, Homo Sapiens
ugaguucuuaaacuuuuuuuaaccacugugcccagcugacaaaagugcugggauuacaggcaug

SEQ ID NO: 343245 - RNA, 64 nt, Homo Sapiens
uggaagaguaaccauuucaguggaaaacugaauggcugacaagacauuguccuuacuuuugcag

SEQ ID NO: 343246 - RNA, 64 nt, Homo Sapiens
ucguaagcccuugcuuagaaaguccuuugucagggcugacaacccaaggugaagaggacuccga

SEQ ID NO: 343247 - RNA, 64 nt, Homo Sapiens
cuaacuaagcuuuaaaaggucaagaaguuuuauggcugacaaaggacucgcgcaacgcagaagg

SEQ ID NO: 343248 - RNA, 64 nt, Homo Sapiens
caagcuggccauuugguaccggauaagacaacaggcugacaaacaucugaccacagucauggug

SEQ ID NO: 343249 - RNA, 64 nt, Homo Sapiens
agccggccuauaaaucuccuaauauauuguguuugcugacaaucgagcaaaugcuaauacagua

SEQ ID NO: 343250 - RNA, 64 nt, Homo Sapiens
aucagaauucuauuucucauccauagacuggguugcugacaaaccaggaugcucuaagaaaacg

SEQ ID NO: 343251 - RNA, 64 nt, Homo Sapiens
caggccgcugcuucccagcucugacuuucaagaggcugacaaucaucccuuccgcacucucucc

SEQ ID NO: 343252 - RNA, 64 nt, Homo Sapiens
agcacaugcgggcucgcccauacccgugacaguggcugacaagggacuagugagucagcaccuu

SEQ ID NO: 343253 - RNA, 64 nt, Homo Sapiens
uaccaguucaccugaucagaguuacuagcguaaagcugacaaguuaacugcagggaagagacug

SEQ ID NO: 343254 - RNA, 64 nt, Homo Sapiens
aagaaauuucagagugaaggagaaaacaguuuuagcugacaaagucaccuaaggaaacugaccc

SEQ ID NO: 343255 - RNA, 64 nt, Homo Sapiens
cccaauguuauccacucugucugaauucugaauagcugacaacccuacuuccuuggaaccaucu

SEQ ID NO: 343256 - RNA, 64 nt, Homo Sapiens
ggguggcugcugugggcaagaccucuaugaggcugcugacaaguccaggacaacgugcgcgagg

SEQ ID NO: 343257 - RNA, 64 nt, Homo Sapiens
agucugggacuggaaaagagaugucugacugcaagcugacaaugccacucugggaccccugaug

SEQ ID NO: 343258 - RNA, 64 nt, Homo Sapiens
ccggauuucuaacaguccuugcuuuggggggugugcugacaacuuagcucaggugccuuacauc

SEQ ID NO: 343259 - RNA, 64 nt, Homo Sapiens
ucagccccugugccaaauuugccuagguuuuccagcugacaaugaauacugggaguuaaaacgc

SEQ ID NO: 343260 - RNA, 64 nt, Homo Sapiens
gcaacaacaaaaacacaaauccacuggguauacugcugacaaccccaucccugaacacggcugg

SEQ ID NO: 343261 - RNA, 64 nt, Homo Sapiens
gacucagcuuccuuagcauccagucagagucagggcugacaaagcuuggcuccugucugccucu

SEQ ID NO: 343262 - RNA, 64 nt, Homo Sapiens
guguccuugauccacacugcuguguguggcaugcgcugacaaauugcauguguguaugugugug

SEQ ID NO: 343263 - RNA, 64 nt, Homo Sapiens
acccauagugagguaauugaugggcccgagagaagcugacaauuugcagugugccucugcccca

SEQ ID NO: 343264 - RNA, 64 nt, Homo Sapiens
cgacuucagauuccauacugccagaggugucugugcugacaaggccacaggucuucuggggacc

SEQ ID NO: 343265 - RNA, 64 nt, Homo Sapiens
aaagauccauuuuuuagguucuuuucggucuccagcugacaacccaacuggacaaugaucuguc

SEQ ID NO: 343266 - RNA, 64 nt, Homo Sapiens
uccucuccagcaccuugcugugcugcccucugcugcugacaaggugaauaacagccccaagacc

SEQ ID NO: 343267 - RNA, 64 nt, Homo Sapiens
ugggcagggaauauagccuuccugggcacaacuagcugacaaugacagguugacuguguacccc

SEQ ID NO: 343268 - RNA, 64 nt, Homo Sapiens
gaaguccugggcaugcaucugggacccccguggagcugacaaguuuuccuugcuuuccugauac

SEQ ID NO: 343269 - RNA, 64 nt, Homo Sapiens
cacucacauccucacuuugcugccccaccaucuugcugacaacuuccagagaagccaugguuuu

SEQ ID NO: 343270 - RNA, 64 nt, Homo Sapiens
aauuguugacuuuuuuaacuauauuaaguguuaagcugacaacugucaaagaagaccauguugu

SEQ ID NO: 343271 - RNA, 64 nt, Homo Sapiens
uauggaagccagggcuugucacagggaaaaugaagcugacaauuggaauaacauaucaaaugaa

SEQ ID NO: 343272 - RNA, 64 nt, Homo Sapiens
aguuaucccagggccugagguggauccuugaggagcugacaacagauagauagaaaaagaagca

SEQ ID NO: 343273 - RNA, 64 nt, Homo Sapiens
acugcauucaacggggccaucacugaguuaugaagcugacaaugcagcacacacaugaucagcc

SEQ ID NO: 343274 - RNA, 64 nt, Homo Sapiens
uuuugcuccccagugaaggcgaggccaggacagagcugacaaaaaggugccuugcucaauggaa

SEQ ID NO: 343275 - RNA, 64 nt, Homo Sapiens
ggcaggaugguggggacagccccuugcagcugcagcugacaacagucuccccauaugcaggcug

SEQ ID NO: 343276 - RNA, 64 nt, Homo Sapiens
ggcugucuuggggccgaacagcgcccuggcaaaggcugacaacucaucuuccccgcccugucca

SEQ ID NO: 343277 - RNA, 64 nt, Homo Sapiens
aaguugcucugaguuuggagaacgcuccgcccacgcugacaauaucaugacugaggugccuccc

SEQ ID NO: 343278 - RNA, 64 nt, Homo Sapiens
cgucucuucaaacaguuccaugauaucuuugagggcugacaagggggcuuuuaagaaacacggc

SEQ ID NO: 343279 - RNA, 64 nt, Homo Sapiens
gagaugaggauucacuguaccuguggcuaaccaggcugacaacuaugucaccagucggacugug

SEQ ID NO: 343280 - RNA, 64 nt, Homo Sapiens
ucuuccucuuccuaccguggguuuccuaacuuaugcugacaaguagcagccauuucccuacccu

SEQ ID NO: 343281 - RNA, 64 nt, Homo Sapiens
ggccccugacucaccccggugcgcuuccucuggggcugacaacacccaccaucggccaggucca

SEQ ID NO: 343282 - RNA, 64 nt, Homo Sapiens
aggucauccaggagggcuggaaggagggugugaggcugacaaccgcucaugcucucacuccuag

SEQ ID NO: 343283 - RNA, 64 nt, Homo Sapiens
ugauuauuagauaacuuaaaguuuauuuuuaaaagcugacaacuuuuuaugaaucuucgaguug

SEQ ID NO: 343284 - RNA, 64 nt, Homo Sapiens
cccuccuaccucacccgcagggggaaggagggaggcugacaagccuugaauaaaacacaagccu

SEQ ID NO: 343285 - RNA, 64 nt, Homo Sapiens
uugggcugaaaggugauaauggcauugcgugguagcugacaaugagcaccuucgguuccaugug

SEQ ID NO: 343286 - RNA, 64 nt, Homo Sapiens
uaugaaugaccaguguuuuuggucgccaaauguugcugacaaacuuaucccaaaacuuuagugg

SEQ ID NO: 343287 - RNA, 64 nt, Homo Sapiens
aagccucgggggaaaugguauuugccuguguggggcugacaaccguuccauugagugguuccau

SEQ ID NO: 343288 - RNA, 64 nt, Homo Sapiens
caagagcauugcuuuuguuuucuguggugguccugcugacaaauucaacaagauacaaucucac

SEQ ID NO: 343289 - RNA, 64 nt, Homo Sapiens
uggaagcaaagcaagaggugcacuggcagcacaggcugacaaaagacccagagaagcuaaaagc

SEQ ID NO: 343290 - RNA, 64 nt, Homo Sapiens
gggcauggagcaucucuucccucucuugcugucugcugacaaggcaggucacucugccccagug

SEQ ID NO: 343291 - RNA, 64 nt, Homo Sapiens
auguucuuccucuuccccgauucuacaagggccagcugacaaagugaagcaccuuccuaacuuc

SEQ ID NO: 343292 - RNA, 64 nt, Homo Sapiens
acacuccugaggucuuuguuggucucuuccuuuagcugacaaggugucaggaguggcugucucu

SEQ ID NO: 343293 - RNA, 64 nt, Homo Sapiens
guuuguggaauguaaucuugccugauuuccgaaggcugacaauccugacauacaggcacacuga

SEQ ID NO: 343294 - RNA, 64 nt, Homo Sapiens
agagccagaagccagagggccagggauaugagaggcugacaaacaucaggggacaucuggggag

SEQ ID NO: 343295 - RNA, 64 nt, Homo Sapiens
aauuguauggagaaugguaucccuauguaaauaugcugacaauaauuuuaaagugugaacacuc

SEQ ID NO: 343296 - RNA, 64 nt, Homo Sapiens
gcagucuccaguuuagaauacccuggugccacaggcugacaacucuacccuauuuuucccuguu

SEQ ID NO: 343297 - RNA, 64 nt, Homo Sapiens
aauuuuaagccaguuuuacauguugagaaauucugcugacaaaauuauuugcuauaggguuaga

SEQ ID NO: 343298 - RNA, 64 nt, Homo Sapiens
aaggaacuaauccucacugugccacaguucugacgcugacaauauaagagaagaggcuggccaa

SEQ ID NO: 343299 - RNA, 64 nt, Homo Sapiens
guaaaggccuccccugagaacacaggacaggccugcugacaaggcugagucuaccuuggcaaag

SEQ ID NO: 343300 - RNA, 64 nt, Homo Sapiens; identical to SEQ ID NO: 343299

SEQ ID NO: 343301 - RNA, 64 nt, Homo Sapiens
uuuuuuuuuaaagaaaaaaggacuuuuaaccuuugcugacaagguuuugucuguuucaguuaua

SEQ ID NO: 343302 - RNA, 64 nt, Homo Sapiens
aauacagugguuuuguuuuuuuuuuucuuuuagugcugacaaaauaaaauacucauuuuugcau

SEQ ID NO: 343303 - RNA, 64 nt, Homo Sapiens
caaacauuuaagcuguggucaaggcuacagaugugcugacaaggcacuucauguaaagugucag

SEQ ID NO: 343304 - RNA, 64 nt, Homo Sapiens
uuacuggaaucuauuggugcugcugcaugagucugcugacaaccugacugcacaaggacugggu

SEQ ID NO: 343305 - RNA, 64 nt, Homo Sapiens
gugaugauggauuaauuccacuaacggugccacugcugacaauggggauucccagaaaaccugc

SEQ ID NO: 343306 - RNA, 64 nt, Homo Sapiens
aaugugaaauuuccacaaaaguaacaaucccgcagcugacaaaagagaugaaagguuuuuuugg

SEQ ID NO: 343307 - RNA, 64 nt, Homo Sapiens
ccccauuuuuuuuuucuuuuguucucccuuccuugcugacaaaggccuacccaucagccauuuc

SEQ ID NO: 343308 - RNA, 64 nt, Homo Sapiens
cgugaaaaugagucacauucuauuaucucacucagcugacaagaugcccaauuccauauguccc

SEQ ID NO: 343309 - RNA, 64 nt, Homo Sapiens
ucuugguuuuacugucaauaaugccaggacaccagcugacaauuucccaccucagcacuagucc

SEQ ID NO: 343310 - RNA, 64 nt, Homo Sapiens
gcuguguuacuagcacuauauaauuccggucagugcugacaaauaacauuuaacaaguauugca

SEQ ID NO: 343311 - RNA, 64 nt, Homo Sapiens
ugcauuccucuaccuuucagaagaucaguagcuggcugacaaucuuugccaaaucuuccuugcu

SEQ ID NO: 343312 - RNA, 62 nt, Homo Sapiens
guauuaauugccuauuaaagaauaaaauguccaagcugacaaauuuuuagcaugauacugga

SEQ ID NO: 343313 - RNA, 64 nt, Homo Sapiens
gccuuuaguugaagagcacaggcuguagguggccgcugacaagugcucaccaggccuagagaau

SEQ ID NO: 343314 - RNA, 64 nt, Homo Sapiens
ucuauuuuaaaaaacaagaccuauauagucuaaugcugacaacuaacagccaagauuacagaau

SEQ ID NO: 343315 - RNA, 64 nt, Homo Sapiens
ccaagaagcuucacgugugguuacgccaacaauagcugacaauuggcucuacauuuaccagguc

SEQ ID NO: 343316 - RNA, 64 nt, Homo Sapiens
ugugaaacaucccagaauuauguagaagguuaaagcugacaacacagaggagagggccuguguc

SEQ ID NO: 343317 - RNA, 64 nt, Homo Sapiens
gaggaggacgggcugacuccucuccuguaauaaagcugacaagaguucuagaggauucugcuuc

SEQ ID NO: 343318 - RNA, 64 nt, Homo Sapiens
cuccuaacgugggagcgggaggggcggggucccggcugacaagccagcauagggcauucggugg

SEQ ID NO: 343319 - RNA, 64 nt, Homo Sapiens
uuguugggggccuggccacuuccuugcuucucaagcugacaauucucacuuugcaauaaauagu

SEQ ID NO: 343320 - RNA, 64 nt, Homo Sapiens
cccauuccacuuucccugccuccuuccuuaaauagcugacaaucaaauucaugcuaugguguga

SEQ ID NO: 343321 - RNA, 64 nt, Homo Sapiens
gcgagguucccucccaaagccugcucugguugaagcugacaagugggugcugacgaaauccaag

SEQ ID NO: 343322 - RNA, 64 nt, Homo Sapiens
cgggccugagggccaggccggagcccaggucucugcugacaauggggguucaaggaagacgucg

SEQ ID NO: 343323 - RNA, 64 nt, Homo Sapiens
cgggucaagcuagccuguggcccagccacaacuagcugacaaagcuuccuggccuucccuuuaa

SEQ ID NO: 343324 - RNA, 64 nt, Homo Sapiens
aaaaguucucaguggggccagacuggcuccuggagcugacaagcgaccccguggugaggagaaa

SEQ ID NO: 343325 - RNA, 64 nt, Homo Sapiens
uccuuuauuaacguacuuuguuggucagcacugggcugacaaaaauuuuuucuugcuaauaaau

SEQ ID NO: 343326 - RNA, 64 nt, Homo Sapiens
cuauuuagcaugacaagccccaggcaggcugugcgcugacaaccaccgcuccccagcccagggu

SEQ ID NO: 343327 - RNA, 64 nt, Homo Sapiens
gccuaacaagugccaacuuaugccaguuaucaaugcugacaagaaacugggcugcaauaaaaca

SEQ ID NO: 343328 - RNA, 64 nt, Homo Sapiens
ugcugaaguggccucuccaucccuggacaaaguugcugacaagcuggagaggaauccuucccuc

SEQ ID NO: 343329 - RNA, 64 nt, Homo Sapiens
uccuggaagaagcuaugcugcugacauauuuacggcugacaaacaguaaagagucuauuuaugg

SEQ ID NO: 343330 - RNA, 64 nt, Homo Sapiens
uugcuuaaacaggauaguagagaaauuccuuuuagcugacaacauggaccacuuuaguuuaauc

SEQ ID NO: 343331 - RNA, 64 nt, Homo Sapiens
cuuucuagaaauucuacugccucaucagcaaaccgcugacaaguccgacucugucuccaggagu

SEQ ID NO: 343332 - RNA, 64 nt, Homo Sapiens
caucauggagaauggagugagcucuuccagcacagcugacaagucccagaagcagucccugacc

SEQ ID NO: 343333 - RNA, 64 nt, Homo Sapiens
gugaaguaacaaauauaauggacuuauuaauuuugcugacaaaaaaauuuuaaaauuuugaaag

SEQ ID NO: 343334 - RNA, 64 nt, Homo Sapiens
uucugugccuuuuccuuucucagaaguaauagcagcugacaacuguccaguuguggcagcucuc

SEQ ID NO: 343335 - RNA, 58 nt, Homo Sapiens
cgggccagaccaauggcugagagccacagcugacaaagucugcauguccgaggacggc

SEQ ID NO: 343336 - RNA, 64 nt, Homo Sapiens
aauggaugcagcccuaacugcaaaagucagagaggcugacaaggaccaaugcuucuuuaucugg

SEQ ID NO: 343337 - RNA, 64 nt, Homo Sapiens
ggaaucguugcaggugaguccaucagaaacaggagcugacaaccugcugggcacccgaagacca

SEQ ID NO: 343338 - RNA, 64 nt, Homo Sapiens
aguucuuaguccaguuuugauguuaacuuccauagcugacaaagcuuguuaaguaagaauuaag

SEQ ID NO: 343339 - RNA, 64 nt, Homo Sapiens
gcugugucccggcagauccgggacuugaggggcagcugacaaucacccaucuccagaugccaaa

SEQ ID NO: 343340 - RNA, 64 nt, Homo Sapiens
ggaaguaccaucaucacugcgcugggcuugaggggcugacaacaauggccccagacugguugca

SEQ ID NO: 343341 - RNA, 64 nt, Homo Sapiens
augggccggggcaagcacuugaaugggccgagcagcugacaaaguggagauggauaagaccagg

SEQ ID NO: 343342 - RNA, 64 nt, Homo Sapiens
caaccucccguacggcgcccaccccaucuaugcugcugacaagccccaaccgccggccuuagug

SEQ ID NO: 343343 - RNA, 64 nt, Homo Sapiens
gucucugcaggucucugccccacgcguucccgucgcugacaaagccaccagcugccuccuuuaa

SEQ ID NO: 343344 - RNA, 64 nt, Homo Sapiens
ccugcucacagagaugacaaacuggcauccuugagcugacaacacuuuuccaugaccauagguc

SEQ ID NO: 343345 - RNA, 64 nt, Homo Sapiens
gaccaaggugguggcugugaggagggcagcaaaugcugacaaggaugaaaagcacauggaaaaa

SEQ ID NO: 343346 - RNA, 64 nt, Homo Sapiens
ggguuuacacuacauuugggagucauugucuaaugcugacaagcacacccucucccauuauuug

SEQ ID NO: 343347 - RNA, 64 nt, Homo Sapiens
aauuuuaaaccuuuuuucagcagauauggagagagcugacaaucaauucacauuuuuuaagcca

SEQ ID NO: 343348 - RNA, 64 nt, Homo Sapiens
ugaauuugaaaaaugauggccaguuuucagaagugcugacaaauucauauugguaugcaaaagc

SEQ ID NO: 343349 - RNA, 64 nt, Homo Sapiens
aauccaggaacaaaauacucuccaggcggacaaggcugacaagcaccugcuggcuacugauugc

SEQ ID NO: 343350 - RNA, 64 nt, Homo Sapiens
gcccuucucuacugucugugccccucacuccugcgcugacaaggugggucagugcuggaaagcg

SEQ ID NO: 343351 - RNA, 64 nt, Homo Sapiens
gccugccggcuacugagugcuccaggaggacaaggcugacaagcaauccagggacaagauacuc

SEQ ID NO: 343352 - RNA, 64 nt, Homo Sapiens
gucuugguaggugccugcaucugucugccuucuggcugacaauccuggaaaucuguucuccaga

SEQ ID NO: 343353 - RNA, 64 nt, Homo Sapiens
gcugggugagcuacugaagccaaggugggaggcagcugacaacaccacccacggcccaugcaga

SEQ ID NO: 343354 - RNA, 64 nt, Homo Sapiens; identical to SEQ ID NO: 343351

SEQ ID NO: 343355 - RNA, 64 nt, Homo Sapiens
agcuggugaagaugggccacagaccuggucuagggcugacaaagacagggacagccuuuguuuu

SEQ ID NO: 343356 - RNA, 64 nt, Homo Sapiens
aauccagggacaagauacucuccaggcagacaaggcugacaagcaccugcuggcuacugauugc

SEQ ID NO: 343357 - RNA, 64 nt, Homo Sapiens
agaacguggccaccugcccaaagagugcgagcuggcugacaauagacaaggcuagucuaggggc

SEQ ID NO: 343358 - RNA, 64 nt, Homo Sapiens
ucugaggauuacagcucugcagggggaacugaaggcugacaaguggcagugcucaguucagaca

SEQ ID NO: 343359 - RNA, 64 nt, Homo Sapiens
auuccacuguuagagcccuuagaaguuccuuugcgcugacaaggaguuggcauaagcaacauuu

SEQ ID NO: 343360 - RNA, 64 nt, Homo Sapiens
auguaguuuccaucagucaaccauggagcugguggcugacaaagcccuguccccagcacugucc

SEQ ID NO: 343361 - RNA, 64 nt, Homo Sapiens
aaggacuaugcugcccuuuugacaucaaagaccugcugacaauggaggccacgccugcuucucc

SEQ ID NO: 343362 - RNA, 64 nt, Homo Sapiens
cagcccaggacugccgagacacauuuugcacauaaggcaccaaaagagaguggugcagcgccag

SEQ ID NO: 343363 - RNA, 64 nt, Homo Sapiens
uuucugcucccuuucuccaggaggagaagccagcaggcaccacuucuucaggcugccaggggag

SEQ ID NO: 343364 - RNA, 64 nt, Homo Sapiens
ucgcuuucaugucccguguguccucucgucuagaaggcaccaccggagguccacacuacagcug

SEQ ID NO: 343365 - RNA, 64 nt, Homo Sapiens
uuguagcaacuugggcaccauccuuggcaagggcaggcaccacuaaggcgacuaagagacagcc

SEQ ID NO: 343366 - RNA, 64 nt, Homo Sapiens
aagccagaagcucagggcccaccuacuauguaccaggcaccagguuguccucaauccagucaac

SEQ ID NO: 343367 - RNA, 64 nt, Homo Sapiens
ucaagaggggaggagcggggggacagaugugagaaggcaccaccgcugaauccuugcagccucu

SEQ ID NO: 343368 - RNA, 64 nt, Homo Sapiens
cgugcucauagugaucagcugugcaggagccaugaggcaccaaccucuccccgcagggcaaagc

SEQ ID NO: 343369 - RNA, 64 nt, Homo Sapiens
uauuauagaugccaauccaaaaccucagaauuucaggcaccacaaaaacagguaauuuucuauc

SEQ ID NO: 343370 - RNA, 64 nt, Homo Sapiens
guuugaacccugugagccugagacagagagggccaggcaccaaccacaaggcgggaaaguccau

SEQ ID NO: 343371 - RNA, 64 nt, Homo Sapiens
gcuggggugggggccugagcagacacagaggugcaggcaccaggauucuccacuucuuccagcc

SEQ ID NO: 343372 - RNA, 64 nt, Homo Sapiens
ccacucuguauuggacaaaggcuagcacagggcuaggcaccaauaaagauuucuaaugaugcac

SEQ ID NO: 343373 - RNA, 64 nt, Homo Sapiens
cccauuucguugcuacccaaguggauucugagacaggcaccaucuccuuguucccccucucucu

SEQ ID NO: 343374 - RNA, 64 nt, Homo Sapiens
uccugaagcccuacagaguuagggaauggagcccaggcaccaggggucuaaagugugagccacu

SEQ ID NO: 343375 - RNA, 64 nt, Homo Sapiens
gggguggaggggagugugugcagcguuuuuaccuaggcaccaucauuuaaugugacaguguuca

SEQ ID NO: 343376 - RNA, 64 nt, Homo Sapiens
aaugugacaguguucaguaaacaaaucaguuggcaggcaccagaagaagaauggauuguauguc

SEQ ID NO: 343377 - RNA, 64 nt, Homo Sapiens
uaacaauuucaggacgucccuaagcugagcuaggaggcaccacgcacaggccggaggcaccacg

SEQ ID NO: 343378 - RNA, 64 nt, Homo Sapiens
uaagcugagcuaggaggcaccacgcacaggccggaggcaccacgcacaggccagagucucccaa

SEQ ID NO: 343379 - RNA, 64 nt, Homo Sapiens
uaaugcucacgcucccaacacaaggugggcagggaggcaccauucaggaaccuggaccaaagcu

SEQ ID NO: 343380 - RNA, 64 nt, Homo Sapiens
aagaccugacucaggcaucauuccaccauggcuaaggcaccagccggggaagacuugaaagaaa

SEQ ID NO: 343381 - RNA, 64 nt, Homo Sapiens
gcccagcauugacuguccacccagccuugcuguuaggcaccaugacuccaagaugaagaugugg

SEQ ID NO: 343382 - RNA, 64 nt, Homo Sapiens
acaaggccaugcaggugaugauacgucggaauagaggcaccagcccugguaacugcaucuucuc

SEQ ID NO: 343383 - RNA, 64 nt, Homo Sapiens
uuccccacugggcguccuaccccagugagguugaaggcaccaauuccaagaaucccuccaaccu

SEQ ID NO: 343384 - RNA, 64 nt, Homo Sapiens
agagaggugucaacagcaagggcucuuaggggucaggcaccagcauggagaccucaugacaaag

SEQ ID NO: 343385 - RNA, 64 nt, Homo Sapiens
guccccagagcaggucagcgauugagcaauaggcaggcaccaccuuuauuuauugaagugugaa

SEQ ID NO: 343386 - RNA, 64 nt, Homo Sapiens
gggaauggaccaaagaguuuuguuucguaagcccaggcaccaauuccagagaaggacacaaacg

SEQ ID NO: 343387 - RNA, 64 nt, Homo Sapiens
auugcuugaacccaggagguuauucaggaggcugaggcaccagaugcgugccuguaaucccagc

SEQ ID NO: 343388 - RNA, 64 nt, Homo Sapiens
ugggaugggcuuucucaguguguucuagagugacaggcaccagacucugaggaguggaguucuc

SEQ ID NO: 343389 - RNA, 64 nt, Homo Sapiens
gugugcgauggaaauguguuccugccggagucugaggcaccagggugugcucaaaggcuggccc

SEQ ID NO: 343390 - RNA, 64 nt, Homo Sapiens
agguuggggagccucgcugugucuugcuguucccaggcaccaccacagcaggugcugccauacu

SEQ ID NO: 343391 - RNA, 64 nt, Homo Sapiens; identical to SEQ ID NO: 48356

SEQ ID NO: 343392 - RNA, 64 nt, Homo Sapiens; identical to SEQ ID NO: 48357

SEQ ID NO: 343393 - RNA, 64 nt, Homo Sapiens; identical to SEQ ID NO: 48358

SEQ ID NO: 343394 - RNA, 64 nt, Homo Sapiens; identical to SEQ ID NO: 48359

SEQ ID NO: 343395 - RNA, 64 nt, Homo Sapiens; identical to SEQ ID NO: 182986

SEQ ID NO: 343396 - RNA, 64 nt, Homo Sapiens; identical to SEQ ID NO: 182987

SEQ ID NO: 343397 - RNA, 64 nt, Homo Sapiens; identical to SEQ ID NO: 182988

SEQ ID NO: 343398 - RNA, 64 nt, Homo Sapiens; identical to SEQ ID NO: 182989

SEQ ID NO: 343399 - RNA, 64 nt, Homo Sapiens; identical to SEQ ID NO: 182990

SEQ ID NO: 343400 - RNA, 64 nt, Homo Sapiens; identical to SEQ ID NO: 182991

SEQ ID NO: 343401 - RNA, 64 nt, Homo Sapiens; identical to SEQ ID NO: 182992

SEQ ID NO: 343402 - RNA, 64 nt, Homo Sapiens; identical to SEQ ID NO: 182993

SEQ ID NO: 343403 - RNA, 64 nt, Homo Sapiens; identical to SEQ ID NO: 182994

SEQ ID NO: 343404 - RNA, 64 nt, Homo Sapiens; identical to SEQ ID NO: 182995

SEQ ID NO: 343405 - RNA, 64 nt, Homo Sapiens; identical to SEQ ID NO: 182996

SEQ ID NO: 343406 - RNA, 64 nt, Homo Sapiens; identical to SEQ ID NO: 182997

SEQ ID NO: 343407 - RNA, 64 nt, Homo Sapiens; identical to SEQ ID NO: 182998

SEQ ID NO: 343408 - RNA, 64 nt, Homo Sapiens; identical to SEQ ID NO: 182999

SEQ ID NO: 343409 - RNA, 64 nt, Homo Sapiens; identical to SEQ ID NO: 183000

SEQ ID NO: 343410 - RNA, 64 nt, Homo Sapiens; identical to SEQ ID NO: 183001

SEQ ID NO: 343411 - RNA, 64 nt, Homo Sapiens; identical to SEQ ID NO: 183002

SEQ ID NO: 343412 - RNA, 64 nt, Homo Sapiens; identical to SEQ ID NO: 183003

SEQ ID NO: 343413 - RNA, 64 nt, Homo Sapiens; identical to SEQ ID NO: 183004

SEQ ID NO: 343414 - RNA, 64 nt, Homo Sapiens; identical to SEQ ID NO: 183005

SEQ ID NO: 343415 - RNA, 64 nt, Homo Sapiens; identical to SEQ ID NO: 183006

SEQ ID NO: 343416 - RNA, 64 nt, Homo Sapiens; identical to SEQ ID NO: 183007

SEQ ID NO: 343417 - RNA, 64 nt, Homo Sapiens; identical to SEQ ID NO: 183008

SEQ ID NO: 343418 - RNA, 64 nt, Homo Sapiens; identical to SEQ ID NO: 183009

SEQ ID NO: 343419 - RNA, 64 nt, Homo Sapiens; identical to SEQ ID NO: 183010

SEQ ID NO: 343420 - RNA, 64 nt, Homo Sapiens; identical to SEQ ID NO: 183011

SEQ ID NO: 343421 - RNA, 64 nt, Homo Sapiens; identical to SEQ ID NO: 183012

SEQ ID NO: 343422 - RNA, 64 nt, Homo Sapiens; identical to SEQ ID NO: 183013

SEQ ID NO: 343423 - RNA, 64 nt, Homo Sapiens; identical to SEQ ID NO: 183014

SEQ ID NO: 343424 - RNA, 64 nt, Homo Sapiens; identical to SEQ ID NO: 183015

SEQ ID NO: 343425 - RNA, 64 nt, Homo Sapiens; identical to SEQ ID NO: 183016

SEQ ID NO: 343426 - RNA, 64 nt, Homo Sapiens; identical to SEQ ID NO: 183017

SEQ ID NO: 343427 - RNA, 64 nt, Homo Sapiens; identical to SEQ ID NO: 183018

SEQ ID NO: 343428 - RNA, 64 nt, Homo Sapiens; identical to SEQ ID NO: 183019

SEQ ID NO: 343429 - RNA, 64 nt, Homo Sapiens; identical to SEQ ID NO: 183020

SEQ ID NO: 343430 - RNA, 64 nt, Homo Sapiens; identical to SEQ ID NO: 183021

SEQ ID NO: 343431 - RNA, 64 nt, Homo Sapiens; identical to SEQ ID NO: 183022

SEQ ID NO: 343432 - RNA, 64 nt, Homo Sapiens; identical to SEQ ID NO: 183023

SEQ ID NO: 343433 - RNA, 64 nt, Homo Sapiens; identical to SEQ ID NO: 183024

SEQ ID NO: 343434 - RNA, 64 nt, Homo Sapiens; identical to SEQ ID NO: 183025

SEQ ID NO: 343435 - RNA, 64 nt, Homo Sapiens; identical to SEQ ID NO: 183026

SEQ ID NO: 343436 - RNA, 64 nt, Homo Sapiens; identical to SEQ ID NO: 183027

SEQ ID NO: 343437 - RNA, 64 nt, Homo Sapiens; identical to SEQ ID NO: 183028

SEQ ID NO: 343438 - RNA, 64 nt, Homo Sapiens; identical to SEQ ID NO: 183029

SEQ ID NO: 343439 - RNA, 64 nt, Homo Sapiens; identical to SEQ ID NO: 183030

SEQ ID NO: 343440 - RNA, 64 nt, Homo Sapiens; identical to SEQ ID NO: 183031

SEQ ID NO: 343441 - RNA, 64 nt, Homo Sapiens; identical to SEQ ID NO: 183032

SEQ ID NO: 343442 - RNA, 64 nt, Homo Sapiens; identical to SEQ ID NO: 183033

SEQ ID NO: 343443 - RNA, 64 nt, Homo Sapiens; identical to SEQ ID NO: 183034

SEQ ID NO: 343444 - RNA, 64 nt, Homo Sapiens; identical to SEQ ID NO: 183035

SEQ ID NO: 343445 - RNA, 64 nt, Homo Sapiens; identical to SEQ ID NO: 183036

SEQ ID NO: 343446 - RNA, 64 nt, Homo Sapiens; identical to SEQ ID NO: 183037

SEQ ID NO: 343447 - RNA, 64 nt, Homo Sapiens; identical to SEQ ID NO: 183038

SEQ ID NO: 343448 - RNA, 64 nt, Homo Sapiens; identical to SEQ ID NO: 183039

SEQ ID NO: 343449 - RNA, 64 nt, Homo Sapiens; identical to SEQ ID NO: 183040

SEQ ID NO: 343450 - RNA, 64 nt, Homo Sapiens; identical to SEQ ID NO: 183041

SEQ ID NO: 343451 - RNA, 64 nt, Homo Sapiens; identical to SEQ ID NO: 183042

SEQ ID NO: 343452 - RNA, 64 nt, Homo Sapiens; identical to SEQ ID NO: 183043

SEQ ID NO: 343453 - RNA, 64 nt, Homo Sapiens; identical to SEQ ID NO: 183044

SEQ ID NO: 343454 - RNA, 64 nt, Homo Sapiens; identical to SEQ ID NO: 183045

SEQ ID NO: 343455 - RNA, 64 nt, Homo Sapiens; identical to SEQ ID NO: 183046

SEQ ID NO: 343456 - RNA, 64 nt, Homo Sapiens; identical to SEQ ID NO: 183047

SEQ ID NO: 343457 - RNA, 64 nt, Homo Sapiens; identical to SEQ ID NO: 183048

SEQ ID NO: 343458 - RNA, 64 nt, Homo Sapiens; identical to SEQ ID NO: 183049

SEQ ID NO: 343459 - RNA, 64 nt, Homo Sapiens; identical to SEQ ID NO: 183050

SEQ ID NO: 343460 - RNA, 64 nt, Homo Sapiens; identical to SEQ ID NO: 183051

SEQ ID NO: 343461 - RNA, 64 nt, Homo Sapiens; identical to SEQ ID NO: 183052

SEQ ID NO: 343462 - RNA, 64 nt, Homo Sapiens; identical to SEQ ID NO: 183053

SEQ ID NO: 343463 - RNA, 64 nt, Homo Sapiens; identical to SEQ ID NO: 183054

SEQ ID NO: 343464 - RNA, 64 nt, Homo Sapiens; identical to SEQ ID NO: 183055

SEQ ID NO: 343465 - RNA, 64 nt, Homo Sapiens; identical to SEQ ID NO: 183056

SEQ ID NO: 343466 - RNA, 64 nt, Homo Sapiens; identical to SEQ ID NO: 183057

SEQ ID NO: 343467 - RNA, 64 nt, Homo Sapiens; identical to SEQ ID NO: 183058

SEQ ID NO: 343468 - RNA, 64 nt, Homo Sapiens; identical to SEQ ID NO: 183059

SEQ ID NO: 343469 - RNA, 64 nt, Homo Sapiens; identical to SEQ ID NO: 183060

SEQ ID NO: 343470 - RNA, 64 nt, Homo Sapiens; identical to SEQ ID NO: 183061

SEQ ID NO: 343471 - RNA, 64 nt, Homo Sapiens; identical to SEQ ID NO: 183062

SEQ ID NO: 343472 - RNA, 64 nt, Homo Sapiens; identical to SEQ ID NO: 183063

SEQ ID NO: 343473 - RNA, 64 nt, Homo Sapiens; identical to SEQ ID NO: 183064

SEQ ID NO: 343474 - RNA, 64 nt, Homo Sapiens; identical to SEQ ID NO: 183065

SEQ ID NO: 343475 - RNA, 64 nt, Homo Sapiens; identical to SEQ ID NO: 183066

SEQ ID NO: 343476 - RNA, 64 nt, Homo Sapiens; identical to SEQ ID NO: 183067

SEQ ID NO: 343477 - RNA, 64 nt, Homo Sapiens; identical to SEQ ID NO: 183068

SEQ ID NO: 343478 - RNA, 64 nt, Homo Sapiens; identical to SEQ ID NO: 183069

SEQ ID NO: 343479 - RNA, 64 nt, Homo Sapiens; identical to SEQ ID NO: 183070

SEQ ID NO: 343480 - RNA, 64 nt, Homo Sapiens; identical to SEQ ID NO: 183071

SEQ ID NO: 343481 - RNA, 64 nt, Homo Sapiens; identical to SEQ ID NO: 183072

SEQ ID NO: 343482 - RNA, 64 nt, Homo Sapiens; identical to SEQ ID NO: 183073

SEQ ID NO: 343483 - RNA, 64 nt, Homo Sapiens; identical to SEQ ID NO: 183074

SEQ ID NO: 343484 - RNA, 64 nt, Homo Sapiens; identical to SEQ ID NO: 183075

SEQ ID NO: 343485 - RNA, 64 nt, Homo Sapiens; identical to SEQ ID NO: 183076

SEQ ID NO: 343486 - RNA, 64 nt, Homo Sapiens; identical to SEQ ID NO: 183077

SEQ ID NO: 343487 - RNA, 64 nt, Homo Sapiens; identical to SEQ ID NO: 183078

SEQ ID NO: 343488 - RNA, 64 nt, Homo Sapiens; identical to SEQ ID NO: 183079

SEQ ID NO: 343489 - RNA, 64 nt, Homo Sapiens; identical to SEQ ID NO: 183080

SEQ ID NO: 343490 - RNA, 64 nt, Homo Sapiens; identical to SEQ ID NO: 183081

SEQ ID NO: 343491 - RNA, 64 nt, Homo Sapiens; identical to SEQ ID NO: 183082

SEQ ID NO: 343492 - RNA, 64 nt, Homo Sapiens; identical to SEQ ID NO: 183083

SEQ ID NO: 343493 - RNA, 64 nt, Homo Sapiens; identical to SEQ ID NO: 183084

SEQ ID NO: 343494 - RNA, 64 nt, Homo Sapiens; identical to SEQ ID NO: 183085

SEQ ID NO: 343495 - RNA, 64 nt, Homo Sapiens; identical to SEQ ID NO: 183086

SEQ ID NO: 343496 - RNA, 64 nt, Homo Sapiens; identical to SEQ ID NO: 183087

SEQ ID NO: 343497 - RNA, 64 nt, Homo Sapiens; identical to SEQ ID NO: 183088

SEQ ID NO: 343498 - RNA, 64 nt, Homo Sapiens; identical to SEQ ID NO: 183089

SEQ ID NO: 343499 - RNA, 64 nt, Homo Sapiens; identical to SEQ ID NO: 183090

SEQ ID NO: 343500 - RNA, 64 nt, Homo Sapiens; identical to SEQ ID NO: 183091

SEQ ID NO: 343501 - RNA, 64 nt, Homo Sapiens; identical to SEQ ID NO: 183092

SEQ ID NO: 343502 - RNA, 64 nt, Homo Sapiens; identical to SEQ ID NO: 183093

SEQ ID NO: 343503 - RNA, 64 nt, Homo Sapiens; identical to SEQ ID NO: 183094

SEQ ID NO: 343504 - RNA, 64 nt, Homo Sapiens; identical to SEQ ID NO: 183095

SEQ ID NO: 343505 - RNA, 64 nt, Homo Sapiens; identical to SEQ ID NO: 183096

SEQ ID NO: 343506 - RNA, 64 nt, Homo Sapiens; identical to SEQ ID NO: 183097

SEQ ID NO: 343507 - RNA, 64 nt, Homo Sapiens; identical to SEQ ID NO: 183098

SEQ ID NO: 343508 - RNA, 64 nt, Homo Sapiens; identical to SEQ ID NO: 183099

SEQ ID NO: 343509 - RNA, 64 nt, Homo Sapiens; identical to SEQ ID NO: 183100

SEQ ID NO: 343510 - RNA, 64 nt, Homo Sapiens; identical to SEQ ID NO: 183101

SEQ ID NO: 343511 - RNA, 64 nt, Homo Sapiens; identical to SEQ ID NO: 183102

SEQ ID NO: 343512 - RNA, 64 nt, Homo Sapiens; identical to SEQ ID NO: 183103

SEQ ID NO: 343513 - RNA, 64 nt, Homo Sapiens; identical to SEQ ID NO: 183104

SEQ ID NO: 343514 - RNA, 64 nt, Homo Sapiens; identical to SEQ ID NO: 183105

SEQ ID NO: 343515 - RNA, 64 nt, Homo Sapiens; identical to SEQ ID NO: 183106

SEQ ID NO: 343516 - RNA, 64 nt, Homo Sapiens; identical to SEQ ID NO: 183107

SEQ ID NO: 343517 - RNA, 64 nt, Homo Sapiens; identical to SEQ ID NO: 183108

SEQ ID NO: 343518 - RNA, 64 nt, Homo Sapiens; identical to SEQ ID NO: 183109

SEQ ID NO: 343519 - RNA, 64 nt, Homo Sapiens; identical to SEQ ID NO: 183110

SEQ ID NO: 343520 - RNA, 64 nt, Homo Sapiens; identical to SEQ ID NO: 183111

SEQ ID NO: 343521 - RNA, 64 nt, Homo Sapiens; identical to SEQ ID NO: 183112

SEQ ID NO: 343522 - RNA, 64 nt, Homo Sapiens; identical to SEQ ID NO: 183113

SEQ ID NO: 343523 - RNA, 64 nt, Homo Sapiens; identical to SEQ ID NO: 183114

SEQ ID NO: 343524 - RNA, 64 nt, Homo Sapiens; identical to SEQ ID NO: 183115

SEQ ID NO: 343525 - RNA, 64 nt, Homo Sapiens; identical to SEQ ID NO: 183116

SEQ ID NO: 343526 - RNA, 64 nt, Homo Sapiens; identical to SEQ ID NO: 183117

SEQ ID NO: 343527 - RNA, 64 nt, Homo Sapiens; identical to SEQ ID NO: 183118

SEQ ID NO: 343528 - RNA, 64 nt, Homo Sapiens; identical to SEQ ID NO: 183119

SEQ ID NO: 343529 - RNA, 64 nt, Homo Sapiens; identical to SEQ ID NO: 183120

SEQ ID NO: 343530 - RNA, 64 nt, Homo Sapiens; identical to SEQ ID NO: 183121

SEQ ID NO: 343531 - RNA, 64 nt, Homo Sapiens; identical to SEQ ID NO: 183122

SEQ ID NO: 343532 - RNA, 64 nt, Homo Sapiens; identical to SEQ ID NO: 183123

SEQ ID NO: 343533 - RNA, 64 nt, Homo Sapiens; identical to SEQ ID NO: 183124

SEQ ID NO: 343534 - RNA, 64 nt, Homo Sapiens; identical to SEQ ID NO: 183125

SEQ ID NO: 343535 - RNA, 64 nt, Homo Sapiens; identical to SEQ ID NO: 183126

SEQ ID NO: 343536 - RNA, 64 nt, Homo Sapiens; identical to SEQ ID NO: 183127

SEQ ID NO: 343537 - RNA, 64 nt, Homo Sapiens; identical to SEQ ID NO: 183128

SEQ ID NO: 343538 - RNA, 64 nt, Homo Sapiens; identical to SEQ ID NO: 183129

SEQ ID NO: 343539 - RNA, 64 nt, Homo Sapiens; identical to SEQ ID NO: 183130

SEQ ID NO: 343540 - RNA, 64 nt, Homo Sapiens; identical to SEQ ID NO: 183131

SEQ ID NO: 343541 - RNA, 64 nt, Homo Sapiens; identical to SEQ ID NO: 183132

SEQ ID NO: 343542 - RNA, 64 nt, Homo Sapiens; identical to SEQ ID NO: 183133

SEQ ID NO: 343543 - RNA, 64 nt, Homo Sapiens; identical to SEQ ID NO: 183134

SEQ ID NO: 343544 - RNA, 64 nt, Homo Sapiens; identical to SEQ ID NO: 183135

SEQ ID NO: 343545 - RNA, 64 nt, Homo Sapiens; identical to SEQ ID NO: 183136

SEQ ID NO: 343546 - RNA, 64 nt, Homo Sapiens; identical to SEQ ID NO: 183137

SEQ ID NO: 343547 - RNA, 64 nt, Homo Sapiens; identical to SEQ ID NO: 183138

SEQ ID NO: 343548 - RNA, 64 nt, Homo Sapiens; identical to SEQ ID NO: 183139

SEQ ID NO: 343549 - RNA, 64 nt, Homo Sapiens; identical to SEQ ID NO: 183140

SEQ ID NO: 343550 - RNA, 64 nt, Homo Sapiens; identical to SEQ ID NO: 183141

SEQ ID NO: 343551 - RNA, 64 nt, Homo Sapiens; identical to SEQ ID NO: 183142

SEQ ID NO: 343552 - RNA, 64 nt, Homo Sapiens; identical to SEQ ID NO: 183143

SEQ ID NO: 343553 - RNA, 64 nt, Homo Sapiens; identical to SEQ ID NO: 183144

SEQ ID NO: 343554 - RNA, 64 nt, Homo Sapiens; identical to SEQ ID NO: 183145

SEQ ID NO: 343555 - RNA, 64 nt, Homo Sapiens; identical to SEQ ID NO: 183146

SEQ ID NO: 343556 - RNA, 64 nt, Homo Sapiens; identical to SEQ ID NO: 183147

SEQ ID NO: 343557 - RNA, 64 nt, Homo Sapiens; identical to SEQ ID NO: 183148

SEQ ID NO: 343558 - RNA, 64 nt, Homo Sapiens; identical to SEQ ID NO: 183149

SEQ ID NO: 343559 - RNA, 64 nt, Homo Sapiens; identical to SEQ ID NO: 183150

SEQ ID NO: 343560 - RNA, 64 nt, Homo Sapiens; identical to SEQ ID NO: 183151

SEQ ID NO: 343561 - RNA, 64 nt, Homo Sapiens; identical to SEQ ID NO: 183152

SEQ ID NO: 343562 - RNA, 64 nt, Homo Sapiens; identical to SEQ ID NO: 183153

SEQ ID NO: 343563 - RNA, 64 nt, Homo Sapiens; identical to SEQ ID NO: 183154

SEQ ID NO: 343564 - RNA, 64 nt, Homo Sapiens; identical to SEQ ID NO: 183155

SEQ ID NO: 343565 - RNA, 64 nt, Homo Sapiens; identical to SEQ ID NO: 183156

SEQ ID NO: 343566 - RNA, 64 nt, Homo Sapiens; identical to SEQ ID NO: 183157

SEQ ID NO: 343567 - RNA, 64 nt, Homo Sapiens; identical to SEQ ID NO: 183158

SEQ ID NO: 343568 - RNA, 64 nt, Homo Sapiens; identical to SEQ ID NO: 183159

SEQ ID NO: 343569 - RNA, 64 nt, Homo Sapiens; identical to SEQ ID NO: 183160

SEQ ID NO: 343570 - RNA, 64 nt, Homo Sapiens; identical to SEQ ID NO: 183161

SEQ ID NO: 343571 - RNA, 64 nt, Homo Sapiens; identical to SEQ ID NO: 183162

SEQ ID NO: 343572 - RNA, 64 nt, Homo Sapiens; identical to SEQ ID NO: 183163

SEQ ID NO: 343573 - RNA, 64 nt, Homo Sapiens; identical to SEQ ID NO: 183164

SEQ ID NO: 343574 - RNA, 64 nt, Homo Sapiens; identical to SEQ ID NO: 183165

SEQ ID NO: 343575 - RNA, 64 nt, Homo Sapiens; identical to SEQ ID NO: 183166

SEQ ID NO: 343576 - RNA, 64 nt, Homo Sapiens; identical to SEQ ID NO: 183167

SEQ ID NO: 343577 - RNA, 64 nt, Homo Sapiens; identical to SEQ ID NO: 183168

SEQ ID NO: 343578 - RNA, 64 nt, Homo Sapiens; identical to SEQ ID NO: 183169

SEQ ID NO: 343579 - RNA, 64 nt, Homo Sapiens; identical to SEQ ID NO: 183170

SEQ ID NO: 343580 - RNA, 64 nt, Homo Sapiens; identical to SEQ ID NO: 183171

SEQ ID NO: 343581 - RNA, 64 nt, Homo Sapiens; identical to SEQ ID NO: 183172

SEQ ID NO: 343582 - RNA, 64 nt, Homo Sapiens; identical to SEQ ID NO: 183173

SEQ ID NO: 343583 - RNA, 64 nt, Homo Sapiens; identical to SEQ ID NO: 183174

SEQ ID NO: 343584 - RNA, 64 nt, Homo Sapiens; identical to SEQ ID NO: 183175

SEQ ID NO: 343585 - RNA, 64 nt, Homo Sapiens; identical to SEQ ID NO: 183176

SEQ ID NO: 343586 - RNA, 64 nt, Homo Sapiens; identical to SEQ ID NO: 183177

SEQ ID NO: 343587 - RNA, 64 nt, Homo Sapiens; identical to SEQ ID NO: 183178

SEQ ID NO: 343588 - RNA, 64 nt, Homo Sapiens; identical to SEQ ID NO: 183179

SEQ ID NO: 343589 - RNA, 64 nt, Homo Sapiens; identical to SEQ ID NO: 183180

SEQ ID NO: 343590 - RNA, 64 nt, Homo Sapiens; identical to SEQ ID NO: 183181

SEQ ID NO: 343591 - RNA, 64 nt, Homo Sapiens; identical to SEQ ID NO: 183182

SEQ ID NO: 343592 - RNA, 64 nt, Homo Sapiens; identical to SEQ ID NO: 183183

SEQ ID NO: 343593 - RNA, 64 nt, Homo Sapiens; identical to SEQ ID NO: 183184

SEQ ID NO: 343594 - RNA, 64 nt, Homo Sapiens; identical to SEQ ID NO: 183185

SEQ ID NO: 343595 - RNA, 64 nt, Homo Sapiens; identical to SEQ ID NO: 183186

SEQ ID NO: 343596 - RNA, 64 nt, Homo Sapiens; identical to SEQ ID NO: 183187

SEQ ID NO: 343597 - RNA, 64 nt, Homo Sapiens; identical to SEQ ID NO: 183188

SEQ ID NO: 343598 - RNA, 64 nt, Homo Sapiens; identical to SEQ ID NO: 183189

SEQ ID NO: 343599 - RNA, 64 nt, Homo Sapiens; identical to SEQ ID NO: 183190

SEQ ID NO: 343600 - RNA, 64 nt, Homo Sapiens; identical to SEQ ID NO: 183191

SEQ ID NO: 343601 - RNA, 64 nt, Homo Sapiens; identical to SEQ ID NO: 183192

SEQ ID NO: 343602 - RNA, 64 nt, Homo Sapiens; identical to SEQ ID NO: 183193

SEQ ID NO: 343603 - RNA, 64 nt, Homo Sapiens; identical to SEQ ID NO: 183194

SEQ ID NO: 343604 - RNA, 64 nt, Homo Sapiens; identical to SEQ ID NO: 183195

SEQ ID NO: 343605 - RNA, 64 nt, Homo Sapiens; identical to SEQ ID NO: 183196

SEQ ID NO: 343606 - RNA, 64 nt, Homo Sapiens; identical to SEQ ID NO: 183197

SEQ ID NO: 343607 - RNA, 64 nt, Homo Sapiens; identical to SEQ ID NO: 183198

SEQ ID NO: 343608 - RNA, 64 nt, Homo Sapiens; identical to SEQ ID NO: 183199

SEQ ID NO: 343609 - RNA, 64 nt, Homo Sapiens; identical to SEQ ID NO: 183200

SEQ ID NO: 343610 - RNA, 64 nt, Homo Sapiens; identical to SEQ ID NO: 183201

SEQ ID NO: 343611 - RNA, 64 nt, Homo Sapiens; identical to SEQ ID NO: 183202

SEQ ID NO: 343612 - RNA, 64 nt, Homo Sapiens; identical to SEQ ID NO: 183203

SEQ ID NO: 343613 - RNA, 64 nt, Homo Sapiens; identical to SEQ ID NO: 183204

SEQ ID NO: 343614 - RNA, 64 nt, Homo Sapiens; identical to SEQ ID NO: 183205

SEQ ID NO: 343615 - RNA, 64 nt, Homo Sapiens; identical to SEQ ID NO: 183206

SEQ ID NO: 343616 - RNA, 64 nt, Homo Sapiens; identical to SEQ ID NO: 183207

SEQ ID NO: 343617 - RNA, 64 nt, Homo Sapiens; identical to SEQ ID NO: 183208

SEQ ID NO: 343618 - RNA, 64 nt, Homo Sapiens; identical to SEQ ID NO: 183209

SEQ ID NO: 343619 - RNA, 64 nt, Homo Sapiens; identical to SEQ ID NO: 183210

SEQ ID NO: 343620 - RNA, 64 nt, Homo Sapiens; identical to SEQ ID NO: 183211

SEQ ID NO: 343621 - RNA, 64 nt, Homo Sapiens; identical to SEQ ID NO: 183212

SEQ ID NO: 343622 - RNA, 64 nt, Homo Sapiens; identical to SEQ ID NO: 183213

SEQ ID NO: 343623 - RNA, 64 nt, Homo Sapiens; identical to SEQ ID NO: 183214

SEQ ID NO: 343624 - RNA, 64 nt, Homo Sapiens; identical to SEQ ID NO: 183215

SEQ ID NO: 343625 - RNA, 64 nt, Homo Sapiens; identical to SEQ ID NO: 183216

SEQ ID NO: 343626 - RNA, 64 nt, Homo Sapiens; identical to SEQ ID NO: 183217

SEQ ID NO: 343627 - RNA, 64 nt, Homo Sapiens; identical to SEQ ID NO: 183218

SEQ ID NO: 343628 - RNA, 64 nt, Homo Sapiens; identical to SEQ ID NO: 183219

SEQ ID NO: 343629 - RNA, 64 nt, Homo Sapiens; identical to SEQ ID NO: 183220

SEQ ID NO: 343630 - RNA, 64 nt, Homo Sapiens; identical to SEQ ID NO: 183221

SEQ ID NO: 343631 - RNA, 64 nt, Homo Sapiens; identical to SEQ ID NO: 183222

SEQ ID NO: 343632 - RNA, 64 nt, Homo Sapiens; identical to SEQ ID NO: 183223

SEQ ID NO: 343633 - RNA, 64 nt, Homo Sapiens; identical to SEQ ID NO: 183224

SEQ ID NO: 343634 - RNA, 64 nt, Homo Sapiens; identical to SEQ ID NO: 183225

SEQ ID NO: 343635 - RNA, 64 nt, Homo Sapiens; identical to SEQ ID NO: 183226

SEQ ID NO: 343636 - RNA, 64 nt, Homo Sapiens; identical to SEQ ID NO: 183227

SEQ ID NO: 343637 - RNA, 64 nt, Homo Sapiens; identical to SEQ ID NO: 183228

SEQ ID NO: 343638 - RNA, 64 nt, Homo Sapiens; identical to SEQ ID NO: 183229

SEQ ID NO: 343639 - RNA, 64 nt, Homo Sapiens; identical to SEQ ID NO: 183230

SEQ ID NO: 343640 - RNA, 64 nt, Homo Sapiens; identical to SEQ ID NO: 183231

SEQ ID NO: 343641 - RNA, 64 nt, Homo Sapiens; identical to SEQ ID NO: 183232

SEQ ID NO: 343642 - RNA, 64 nt, Homo Sapiens; identical to SEQ ID NO: 183233

SEQ ID NO: 343643 - RNA, 64 nt, Homo Sapiens; identical to SEQ ID NO: 183234

SEQ ID NO: 343644 - RNA, 64 nt, Homo Sapiens; identical to SEQ ID NO: 183235

SEQ ID NO: 343645 - RNA, 64 nt, Homo Sapiens; identical to SEQ ID NO: 183236

SEQ ID NO: 343646 - RNA, 64 nt, Homo Sapiens; identical to SEQ ID NO: 183237

SEQ ID NO: 343647 - RNA, 64 nt, Homo Sapiens; identical to SEQ ID NO: 183238

SEQ ID NO: 343648 - RNA, 64 nt, Homo Sapiens; identical to SEQ ID NO: 183239

SEQ ID NO: 343649 - RNA, 64 nt, Homo Sapiens; identical to SEQ ID NO: 183240

SEQ ID NO: 343650 - RNA, 64 nt, Homo Sapiens; identical to SEQ ID NO: 183241

SEQ ID NO: 343651 - RNA, 64 nt, Homo Sapiens; identical to SEQ ID NO: 183242

SEQ ID NO: 343652 - RNA, 64 nt, Homo Sapiens; identical to SEQ ID NO: 183243

SEQ ID NO: 343653 - RNA, 64 nt, Homo Sapiens; identical to SEQ ID NO: 183244

SEQ ID NO: 343654 - RNA, 64 nt, Homo Sapiens; identical to SEQ ID NO: 183245

SEQ ID NO: 343655 - RNA, 64 nt, Homo Sapiens; identical to SEQ ID NO: 183246

SEQ ID NO: 343656 - RNA, 64 nt, Homo Sapiens; identical to SEQ ID NO: 183247

SEQ ID NO: 343657 - RNA, 64 nt, Homo Sapiens; identical to SEQ ID NO: 183248

SEQ ID NO: 343658 - RNA, 64 nt, Homo Sapiens; identical to SEQ ID NO: 183249

SEQ ID NO: 343659 - RNA, 64 nt, Homo Sapiens; identical to SEQ ID NO: 183250

SEQ ID NO: 343660 - RNA, 64 nt, Homo Sapiens; identical to SEQ ID NO: 183251

SEQ ID NO: 343661 - RNA, 64 nt, Homo Sapiens; identical to SEQ ID NO: 183252

SEQ ID NO: 343662 - RNA, 64 nt, Homo Sapiens; identical to SEQ ID NO: 183253

SEQ ID NO: 343663 - RNA, 64 nt, Homo Sapiens; identical to SEQ ID NO: 183254

SEQ ID NO: 343664 - RNA, 64 nt, Homo Sapiens; identical to SEQ ID NO: 183255

SEQ ID NO: 343665 - RNA, 64 nt, Homo Sapiens; identical to SEQ ID NO: 183256

SEQ ID NO: 343666 - RNA, 64 nt, Homo Sapiens; identical to SEQ ID NO: 183257

SEQ ID NO: 343667 - RNA, 64 nt, Homo Sapiens; identical to SEQ ID NO: 183258

SEQ ID NO: 343668 - RNA, 64 nt, Homo Sapiens; identical to SEQ ID NO: 183259

SEQ ID NO: 343669 - RNA, 64 nt, Homo Sapiens; identical to SEQ ID NO: 183260

SEQ ID NO: 343670 - RNA, 64 nt, Homo Sapiens; identical to SEQ ID NO: 183261

SEQ ID NO: 343671 - RNA, 64 nt, Homo Sapiens; identical to SEQ ID NO: 183262

SEQ ID NO: 343672 - RNA, 64 nt, Homo Sapiens; identical to SEQ ID NO: 183263

SEQ ID NO: 343673 - RNA, 64 nt, Homo Sapiens; identical to SEQ ID NO: 183264

SEQ ID NO: 343674 - RNA, 64 nt, Homo Sapiens; identical to SEQ ID NO: 183265

SEQ ID NO: 343675 - RNA, 64 nt, Homo Sapiens; identical to SEQ ID NO: 183266

SEQ ID NO: 343676 - RNA, 64 nt, Homo Sapiens; identical to SEQ ID NO: 183267

SEQ ID NO: 343677 - RNA, 64 nt, Homo Sapiens; identical to SEQ ID NO: 183268

SEQ ID NO: 343678 - RNA, 64 nt, Homo Sapiens; identical to SEQ ID NO: 183269

SEQ ID NO: 343679 - RNA, 64 nt, Homo Sapiens; identical to SEQ ID NO: 183270

SEQ ID NO: 343680 - RNA, 64 nt, Homo Sapiens; identical to SEQ ID NO: 183271

SEQ ID NO: 343681 - RNA, 64 nt, Homo Sapiens; identical to SEQ ID NO: 183272

SEQ ID NO: 343682 - RNA, 64 nt, Homo Sapiens; identical to SEQ ID NO: 183273

SEQ ID NO: 343683 - RNA, 64 nt, Homo Sapiens; identical to SEQ ID NO: 183274

SEQ ID NO: 343684 - RNA, 64 nt, Homo Sapiens; identical to SEQ ID NO: 183275

SEQ ID NO: 343685 - RNA, 64 nt, Homo Sapiens; identical to SEQ ID NO: 183276

SEQ ID NO: 343686 - RNA, 64 nt, Homo Sapiens; identical to SEQ ID NO: 183277

SEQ ID NO: 343687 - RNA, 64 nt, Homo Sapiens; identical to SEQ ID NO: 183278

SEQ ID NO: 343688 - RNA, 64 nt, Homo Sapiens; identical to SEQ ID NO: 183279

SEQ ID NO: 343689 - RNA, 64 nt, Homo Sapiens; identical to SEQ ID NO: 183280

SEQ ID NO: 343690 - RNA, 64 nt, Homo Sapiens; identical to SEQ ID NO: 183281

SEQ ID NO: 343691 - RNA, 64 nt, Homo Sapiens; identical to SEQ ID NO: 183282

SEQ ID NO: 343692 - RNA, 64 nt, Homo Sapiens; identical to SEQ ID NO: 183283

SEQ ID NO: 343693 - RNA, 64 nt, Homo Sapiens; identical to SEQ ID NO: 183284

SEQ ID NO: 343694 - RNA, 64 nt, Homo Sapiens; identical to SEQ ID NO: 183285

SEQ ID NO: 343695 - RNA, 64 nt, Homo Sapiens; identical to SEQ ID NO: 183286

SEQ ID NO: 343696 - RNA, 64 nt, Homo Sapiens; identical to SEQ ID NO: 183287

SEQ ID NO: 343697 - RNA, 64 nt, Homo Sapiens; identical to SEQ ID NO: 183288

SEQ ID NO: 343698 - RNA, 64 nt, Homo Sapiens; identical to SEQ ID NO: 183289

SEQ ID NO: 343699 - RNA, 64 nt, Homo Sapiens; identical to SEQ ID NO: 183290

SEQ ID NO: 343700 - RNA, 64 nt, Homo Sapiens; identical to SEQ ID NO: 183291

SEQ ID NO: 343701 - RNA, 64 nt, Homo Sapiens; identical to SEQ ID NO: 183292

SEQ ID NO: 343702 - RNA, 64 nt, Homo Sapiens; identical to SEQ ID NO: 183293

SEQ ID NO: 343703 - RNA, 64 nt, Homo Sapiens; identical to SEQ ID NO: 183294

SEQ ID NO: 343704 - RNA, 64 nt, Homo Sapiens; identical to SEQ ID NO: 183295

SEQ ID NO: 343705 - RNA, 64 nt, Homo Sapiens; identical to SEQ ID NO: 183296

SEQ ID NO: 343706 - RNA, 64 nt, Homo Sapiens; identical to SEQ ID NO: 183297

SEQ ID NO: 343707 - RNA, 64 nt, Homo Sapiens; identical to SEQ ID NO: 183298

SEQ ID NO: 343708 - RNA, 64 nt, Homo Sapiens; identical to SEQ ID NO: 183299

SEQ ID NO: 343709 - RNA, 64 nt, Homo Sapiens; identical to SEQ ID NO: 183300

SEQ ID NO: 343710 - RNA, 64 nt, Homo Sapiens; identical to SEQ ID NO: 183301

SEQ ID NO: 343711 - RNA, 64 nt, Homo Sapiens; identical to SEQ ID NO: 183302

SEQ ID NO: 343712 - RNA, 64 nt, Homo Sapiens; identical to SEQ ID NO: 183303

SEQ ID NO: 343713 - RNA, 64 nt, Homo Sapiens; identical to SEQ ID NO: 183304

SEQ ID NO: 343714 - RNA, 64 nt, Homo Sapiens; identical to SEQ ID NO: 183305

SEQ ID NO: 343715 - RNA, 64 nt, Homo Sapiens; identical to SEQ ID NO: 183306

SEQ ID NO: 343716 - RNA, 64 nt, Homo Sapiens; identical to SEQ ID NO: 183307

SEQ ID NO: 343717 - RNA, 64 nt, Homo Sapiens; identical to SEQ ID NO: 183308

SEQ ID NO: 343718 - RNA, 64 nt, Homo Sapiens; identical to SEQ ID NO: 183309

SEQ ID NO: 343719 - RNA, 64 nt, Homo Sapiens; identical to SEQ ID NO: 183310

SEQ ID NO: 343720 - RNA, 64 nt, Homo Sapiens; identical to SEQ ID NO: 183311

SEQ ID NO: 343721 - RNA, 64 nt, Homo Sapiens; identical to SEQ ID NO: 183312

SEQ ID NO: 343722 - RNA, 64 nt, Homo Sapiens; identical to SEQ ID NO: 183313

SEQ ID NO: 343723 - RNA, 64 nt, Homo Sapiens; identical to SEQ ID NO: 183314

SEQ ID NO: 343724 - RNA, 64 nt, Homo Sapiens; identical to SEQ ID NO: 183315

SEQ ID NO: 343725 - RNA, 64 nt, Homo Sapiens; identical to SEQ ID NO: 183316

SEQ ID NO: 343726 - RNA, 64 nt, Homo Sapiens; identical to SEQ ID NO: 183317

SEQ ID NO: 343727 - RNA, 64 nt, Homo Sapiens; identical to SEQ ID NO: 183318

SEQ ID NO: 343728 - RNA, 64 nt, Homo Sapiens; identical to SEQ ID NO: 183319

SEQ ID NO: 343729 - RNA, 64 nt, Homo Sapiens; identical to SEQ ID NO: 183320

SEQ ID NO: 343730 - RNA, 64 nt, Homo Sapiens; identical to SEQ ID NO: 183321

SEQ ID NO: 343731 - RNA, 64 nt, Homo Sapiens; identical to SEQ ID NO: 183322

SEQ ID NO: 343732 - RNA, 64 nt, Homo Sapiens; identical to SEQ ID NO: 183323

SEQ ID NO: 343733 - RNA, 64 nt, Homo Sapiens; identical to SEQ ID NO: 183324

SEQ ID NO: 343734 - RNA, 64 nt, Homo Sapiens; identical to SEQ ID NO: 183325

SEQ ID NO: 343735 - RNA, 64 nt, Homo Sapiens; identical to SEQ ID NO: 183326

SEQ ID NO: 343736 - RNA, 64 nt, Homo Sapiens; identical to SEQ ID NO: 183327

SEQ ID NO: 343737 - RNA, 64 nt, Homo Sapiens; identical to SEQ ID NO: 183328

SEQ ID NO: 343738 - RNA, 64 nt, Homo Sapiens; identical to SEQ ID NO: 183329

SEQ ID NO: 343739 - RNA, 64 nt, Homo Sapiens; identical to SEQ ID NO: 183330

SEQ ID NO: 343740 - RNA, 64 nt, Homo Sapiens; identical to SEQ ID NO: 183331

SEQ ID NO: 343741 - RNA, 64 nt, Homo Sapiens; identical to SEQ ID NO: 183332

SEQ ID NO: 343742 - RNA, 64 nt, Homo Sapiens; identical to SEQ ID NO: 183333

SEQ ID NO: 343743 - RNA, 64 nt, Homo Sapiens; identical to SEQ ID NO: 183334

SEQ ID NO: 343744 - RNA, 64 nt, Homo Sapiens; identical to SEQ ID NO: 183335

SEQ ID NO: 343745 - RNA, 64 nt, Homo Sapiens; identical to SEQ ID NO: 183336

SEQ ID NO: 343746 - RNA, 64 nt, Homo Sapiens; identical to SEQ ID NO: 183337

SEQ ID NO: 343747 - RNA, 64 nt, Homo Sapiens; identical to SEQ ID NO: 183338

SEQ ID NO: 343748 - RNA, 64 nt, Homo Sapiens; identical to SEQ ID NO: 183339

SEQ ID NO: 343749 - RNA, 64 nt, Homo Sapiens; identical to SEQ ID NO: 183340

SEQ ID NO: 343750 - RNA, 64 nt, Homo Sapiens; identical to SEQ ID NO: 183341

SEQ ID NO: 343751 - RNA, 64 nt, Homo Sapiens; identical to SEQ ID NO: 183342

SEQ ID NO: 343752 - RNA, 64 nt, Homo Sapiens; identical to SEQ ID NO: 183343

SEQ ID NO: 343753 - RNA, 64 nt, Homo Sapiens; identical to SEQ ID NO: 183344

SEQ ID NO: 343754 - RNA, 64 nt, Homo Sapiens; identical to SEQ ID NO: 183345

SEQ ID NO: 343755 - RNA, 64 nt, Homo Sapiens; identical to SEQ ID NO: 183346

SEQ ID NO: 343756 - RNA, 64 nt, Homo Sapiens; identical to SEQ ID NO: 183347

SEQ ID NO: 343757 - RNA, 64 nt, Homo Sapiens; identical to SEQ ID NO: 183348

SEQ ID NO: 343758 - RNA, 64 nt, Homo Sapiens; identical to SEQ ID NO: 183349

SEQ ID NO: 343759 - RNA, 64 nt, Homo Sapiens; identical to SEQ ID NO: 183350

SEQ ID NO: 343760 - RNA, 64 nt, Homo Sapiens; identical to SEQ ID NO: 183351

SEQ ID NO: 343761 - RNA, 64 nt, Homo Sapiens; identical to SEQ ID NO: 183352

SEQ ID NO: 343762 - RNA, 64 nt, Homo Sapiens; identical to SEQ ID NO: 183353

SEQ ID NO: 343763 - RNA, 64 nt, Homo Sapiens; identical to SEQ ID NO: 183354

SEQ ID NO: 343764 - RNA, 64 nt, Homo Sapiens; identical to SEQ ID NO: 183355

SEQ ID NO: 343765 - RNA, 64 nt, Homo Sapiens; identical to SEQ ID NO: 183356

SEQ ID NO: 343766 - RNA, 64 nt, Homo Sapiens; identical to SEQ ID NO: 183357

SEQ ID NO: 343767 - RNA, 64 nt, Homo Sapiens; identical to SEQ ID NO: 183358

SEQ ID NO: 343768 - RNA, 64 nt, Homo Sapiens; identical to SEQ ID NO: 183359

SEQ ID NO: 343769 - RNA, 64 nt, Homo Sapiens; identical to SEQ ID NO: 183360

SEQ ID NO: 343770 - RNA, 64 nt, Homo Sapiens; identical to SEQ ID NO: 183361

SEQ ID NO: 343771 - RNA, 64 nt, Homo Sapiens; identical to SEQ ID NO: 183362

SEQ ID NO: 343772 - RNA, 64 nt, Homo Sapiens; identical to SEQ ID NO: 183363

SEQ ID NO: 343773 - RNA, 64 nt, Homo Sapiens; identical to SEQ ID NO: 183364

SEQ ID NO: 343774 - RNA, 64 nt, Homo Sapiens; identical to SEQ ID NO: 183365

SEQ ID NO: 343775 - RNA, 64 nt, Homo Sapiens; identical to SEQ ID NO: 183366

SEQ ID NO: 343776 - RNA, 64 nt, Homo Sapiens; identical to SEQ ID NO: 183367

SEQ ID NO: 343777 - RNA, 64 nt, Homo Sapiens; identical to SEQ ID NO: 183368

SEQ ID NO: 343778 - RNA, 63 nt, Homo Sapiens; identical to SEQ ID NO: 183369

SEQ ID NO: 343779 - RNA, 64 nt, Homo Sapiens; identical to SEQ ID NO: 183370

SEQ ID NO: 343780 - RNA, 64 nt, Homo Sapiens; identical to SEQ ID NO: 183371

SEQ ID NO: 343781 - RNA, 64 nt, Homo Sapiens; identical to SEQ ID NO: 183372

SEQ ID NO: 343782 - RNA, 64 nt, Homo Sapiens; identical to SEQ ID NO: 183373

SEQ ID NO: 343783 - RNA, 64 nt, Homo Sapiens; identical to SEQ ID NO: 183374

SEQ ID NO: 343784 - RNA, 64 nt, Homo Sapiens; identical to SEQ ID NO: 183375

SEQ ID NO: 343785 - RNA, 64 nt, Homo Sapiens; identical to SEQ ID NO: 183376

SEQ ID NO: 343786 - RNA, 64 nt, Homo Sapiens; identical to SEQ ID NO: 183377

SEQ ID NO: 343787 - RNA, 64 nt, Homo Sapiens; identical to SEQ ID NO: 183378

SEQ ID NO: 343788 - RNA, 64 nt, Homo Sapiens; identical to SEQ ID NO: 183379

SEQ ID NO: 343789 - RNA, 64 nt, Homo Sapiens; identical to SEQ ID NO: 183380

SEQ ID NO: 343790 - RNA, 64 nt, Homo Sapiens; identical to SEQ ID NO: 183381

SEQ ID NO: 343791 - RNA, 64 nt, Homo Sapiens; identical to SEQ ID NO: 183382

SEQ ID NO: 343792 - RNA, 64 nt, Homo Sapiens; identical to SEQ ID NO: 183383

SEQ ID NO: 343793 - RNA, 64 nt, Homo Sapiens; identical to SEQ ID NO: 183384

SEQ ID NO: 343794 - RNA, 64 nt, Homo Sapiens; identical to SEQ ID NO: 183385

SEQ ID NO: 343795 - RNA, 64 nt, Homo Sapiens; identical to SEQ ID NO: 183386

SEQ ID NO: 343796 - RNA, 64 nt, Homo Sapiens; identical to SEQ ID NO: 183387

SEQ ID NO: 343797 - RNA, 64 nt, Homo Sapiens; identical to SEQ ID NO: 183388

SEQ ID NO: 343798 - RNA, 64 nt, Homo Sapiens; identical to SEQ ID NO: 183389

SEQ ID NO: 343799 - RNA, 64 nt, Homo Sapiens; identical to SEQ ID NO: 183390

SEQ ID NO: 343800 - RNA, 64 nt, Homo Sapiens; identical to SEQ ID NO: 183391

SEQ ID NO: 343801 - RNA, 64 nt, Homo Sapiens; identical to SEQ ID NO: 183392

SEQ ID NO: 343802 - RNA, 64 nt, Homo Sapiens; identical to SEQ ID NO: 183393

SEQ ID NO: 343803 - RNA, 64 nt, Homo Sapiens; identical to SEQ ID NO: 183394

SEQ ID NO: 343804 - RNA, 64 nt, Homo Sapiens; identical to SEQ ID NO: 183395

SEQ ID NO: 343805 - RNA, 64 nt, Homo Sapiens; identical to SEQ ID NO: 183396

SEQ ID NO: 343806 - RNA, 64 nt, Homo Sapiens; identical to SEQ ID NO: 183397

SEQ ID NO: 343807 - RNA, 64 nt, Homo Sapiens; identical to SEQ ID NO: 183398

SEQ ID NO: 343808 - RNA, 64 nt, Homo Sapiens; identical to SEQ ID NO: 183399

SEQ ID NO: 343809 - RNA, 64 nt, Homo Sapiens; identical to SEQ ID NO: 183400

SEQ ID NO: 343810 - RNA, 64 nt, Homo Sapiens; identical to SEQ ID NO: 183401

SEQ ID NO: 343811 - RNA, 64 nt, Homo Sapiens; identical to SEQ ID NO: 183402

SEQ ID NO: 343812 - RNA, 64 nt, Homo Sapiens; identical to SEQ ID NO: 183403

SEQ ID NO: 343813 - RNA, 64 nt, Homo Sapiens; identical to SEQ ID NO: 183404

SEQ ID NO: 343814 - RNA, 64 nt, Homo Sapiens; identical to SEQ ID NO: 183405

SEQ ID NO: 343815 - RNA, 64 nt, Homo Sapiens; identical to SEQ ID NO: 183406

SEQ ID NO: 343816 - RNA, 64 nt, Homo Sapiens; identical to SEQ ID NO: 183407

SEQ ID NO: 343817 - RNA, 64 nt, Homo Sapiens; identical to SEQ ID NO: 183408

SEQ ID NO: 343818 - RNA, 64 nt, Homo Sapiens; identical to SEQ ID NO: 183409

SEQ ID NO: 343819 - RNA, 64 nt, Homo Sapiens; identical to SEQ ID NO: 183410

SEQ ID NO: 343820 - RNA, 64 nt, Homo Sapiens; identical to SEQ ID NO: 183411

SEQ ID NO: 343821 - RNA, 64 nt, Homo Sapiens; identical to SEQ ID NO: 183412

SEQ ID NO: 343822 - RNA, 64 nt, Homo Sapiens; identical to SEQ ID NO: 183413

SEQ ID NO: 343823 - RNA, 64 nt, Homo Sapiens; identical to SEQ ID NO: 183414

SEQ ID NO: 343824 - RNA, 64 nt, Homo Sapiens; identical to SEQ ID NO: 183415

SEQ ID NO: 343825 - RNA, 64 nt, Homo Sapiens; identical to SEQ ID NO: 183416

SEQ ID NO: 343826 - RNA, 64 nt, Homo Sapiens; identical to SEQ ID NO: 183417

SEQ ID NO: 343827 - RNA, 64 nt, Homo Sapiens; identical to SEQ ID NO: 183418

SEQ ID NO: 343828 - RNA, 64 nt, Homo Sapiens; identical to SEQ ID NO: 183419

SEQ ID NO: 343829 - RNA, 64 nt, Homo Sapiens; identical to SEQ ID NO: 183420

SEQ ID NO: 343830 - RNA, 64 nt, Homo Sapiens; identical to SEQ ID NO: 183421

SEQ ID NO: 343831 - RNA, 64 nt, Homo Sapiens; identical to SEQ ID NO: 183422

SEQ ID NO: 343832 - RNA, 64 nt, Homo Sapiens; identical to SEQ ID NO: 183423

SEQ ID NO: 343833 - RNA, 64 nt, Homo Sapiens; identical to SEQ ID NO: 183424

SEQ ID NO: 343834 - RNA, 64 nt, Homo Sapiens; identical to SEQ ID NO: 183425

SEQ ID NO: 343835 - RNA, 64 nt, Homo Sapiens; identical to SEQ ID NO: 183426

SEQ ID NO: 343836 - RNA, 64 nt, Homo Sapiens; identical to SEQ ID NO: 183427

SEQ ID NO: 343837 - RNA, 64 nt, Homo Sapiens; identical to SEQ ID NO: 183428

SEQ ID NO: 343838 - RNA, 64 nt, Homo Sapiens; identical to SEQ ID NO: 183429

SEQ ID NO: 343839 - RNA, 64 nt, Homo Sapiens; identical to SEQ ID NO: 183430

SEQ ID NO: 343840 - RNA, 64 nt, Homo Sapiens; identical to SEQ ID NO: 183431

SEQ ID NO: 343841 - RNA, 64 nt, Homo Sapiens; identical to SEQ ID NO: 183432

SEQ ID NO: 343842 - RNA, 64 nt, Homo Sapiens; identical to SEQ ID NO: 183433

SEQ ID NO: 343843 - RNA, 64 nt, Homo Sapiens; identical to SEQ ID NO: 183434

SEQ ID NO: 343844 - RNA, 64 nt, Homo Sapiens; identical to SEQ ID NO: 183435

SEQ ID NO: 343845 - RNA, 64 nt, Homo Sapiens; identical to SEQ ID NO: 183436

SEQ ID NO: 343846 - RNA, 64 nt, Homo Sapiens; identical to SEQ ID NO: 183437

SEQ ID NO: 343847 - RNA, 64 nt, Homo Sapiens; identical to SEQ ID NO: 183438

SEQ ID NO: 343848 - RNA, 64 nt, Homo Sapiens; identical to SEQ ID NO: 183439

SEQ ID NO: 343849 - RNA, 64 nt, Homo Sapiens; identical to SEQ ID NO: 183440

SEQ ID NO: 343850 - RNA, 64 nt, Homo Sapiens; identical to SEQ ID NO: 183441

SEQ ID NO: 343851 - RNA, 64 nt, Homo Sapiens; identical to SEQ ID NO: 183442

SEQ ID NO: 343852 - RNA, 64 nt, Homo Sapiens; identical to SEQ ID NO: 183443

SEQ ID NO: 343853 - RNA, 64 nt, Homo Sapiens; identical to SEQ ID NO: 183444

SEQ ID NO: 343854 - RNA, 64 nt, Homo Sapiens; identical to SEQ ID NO: 183445

SEQ ID NO: 343855 - RNA, 64 nt, Homo Sapiens; identical to SEQ ID NO: 183446

SEQ ID NO: 343856 - RNA, 64 nt, Homo Sapiens; identical to SEQ ID NO: 183447

SEQ ID NO: 343857 - RNA, 64 nt, Homo Sapiens; identical to SEQ ID NO: 183448

SEQ ID NO: 343858 - RNA, 64 nt, Homo Sapiens; identical to SEQ ID NO: 183449

SEQ ID NO: 343859 - RNA, 64 nt, Homo Sapiens; identical to SEQ ID NO: 183450

SEQ ID NO: 343860 - RNA, 64 nt, Homo Sapiens; identical to SEQ ID NO: 183451

SEQ ID NO: 343861 - RNA, 64 nt, Homo Sapiens; identical to SEQ ID NO: 183452

SEQ ID NO: 343862 - RNA, 64 nt, Homo Sapiens; identical to SEQ ID NO: 183453

SEQ ID NO: 343863 - RNA, 64 nt, Homo Sapiens; identical to SEQ ID NO: 183454

SEQ ID NO: 343864 - RNA, 64 nt, Homo Sapiens; identical to SEQ ID NO: 183455

SEQ ID NO: 343865 - RNA, 64 nt, Homo Sapiens; identical to SEQ ID NO: 183456

SEQ ID NO: 343866 - RNA, 64 nt, Homo Sapiens; identical to SEQ ID NO: 183457

SEQ ID NO: 343867 - RNA, 64 nt, Homo Sapiens; identical to SEQ ID NO: 183458

SEQ ID NO: 343868 - RNA, 64 nt, Homo Sapiens; identical to SEQ ID NO: 183459

SEQ ID NO: 343869 - RNA, 64 nt, Homo Sapiens; identical to SEQ ID NO: 183460

SEQ ID NO: 343870 - RNA, 64 nt, Homo Sapiens; identical to SEQ ID NO: 183461

SEQ ID NO: 343871 - RNA, 64 nt, Homo Sapiens; identical to SEQ ID NO: 183462

SEQ ID NO: 343872 - RNA, 64 nt, Homo Sapiens; identical to SEQ ID NO: 183463

SEQ ID NO: 343873 - RNA, 64 nt, Homo Sapiens; identical to SEQ ID NO: 183464

SEQ ID NO: 343874 - RNA, 64 nt, Homo Sapiens; identical to SEQ ID NO: 183465

SEQ ID NO: 343875 - RNA, 64 nt, Homo Sapiens; identical to SEQ ID NO: 183466

SEQ ID NO: 343876 - RNA, 64 nt, Homo Sapiens; identical to SEQ ID NO: 183467

SEQ ID NO: 343877 - RNA, 64 nt, Homo Sapiens; identical to SEQ ID NO: 183468

SEQ ID NO: 343878 - RNA, 64 nt, Homo Sapiens; identical to SEQ ID NO: 183469

SEQ ID NO: 343879 - RNA, 64 nt, Homo Sapiens; identical to SEQ ID NO: 183470

SEQ ID NO: 343880 - RNA, 64 nt, Homo Sapiens; identical to SEQ ID NO: 183471

SEQ ID NO: 343881 - RNA, 64 nt, Homo Sapiens; identical to SEQ ID NO: 183472

SEQ ID NO: 343882 - RNA, 64 nt, Homo Sapiens; identical to SEQ ID NO: 183473

SEQ ID NO: 343883 - RNA, 64 nt, Homo Sapiens; identical to SEQ ID NO: 183474

SEQ ID NO: 343884 - RNA, 64 nt, Homo Sapiens; identical to SEQ ID NO: 183475

SEQ ID NO: 343885 - RNA, 64 nt, Homo Sapiens; identical to SEQ ID NO: 183476

SEQ ID NO: 343886 - RNA, 64 nt, Homo Sapiens; identical to SEQ ID NO: 183477

SEQ ID NO: 343887 - RNA, 64 nt, Homo Sapiens; identical to SEQ ID NO: 183478

SEQ ID NO: 343888 - RNA, 64 nt, Homo Sapiens; identical to SEQ ID NO: 183479

SEQ ID NO: 343889 - RNA, 64 nt, Homo Sapiens; identical to SEQ ID NO: 183480

SEQ ID NO: 343890 - RNA, 64 nt, Homo Sapiens; identical to SEQ ID NO: 183481

SEQ ID NO: 343891 - RNA, 64 nt, Homo Sapiens; identical to SEQ ID NO: 183482

SEQ ID NO: 343892 - RNA, 64 nt, Homo Sapiens; identical to SEQ ID NO: 183483

SEQ ID NO: 343893 - RNA, 64 nt, Homo Sapiens; identical to SEQ ID NO: 183484

SEQ ID NO: 343894 - RNA, 64 nt, Homo Sapiens; identical to SEQ ID NO: 183485

SEQ ID NO: 343895 - RNA, 64 nt, Homo Sapiens; identical to SEQ ID NO: 183486

SEQ ID NO: 343896 - RNA, 64 nt, Homo Sapiens; identical to SEQ ID NO: 183487

SEQ ID NO: 343897 - RNA, 64 nt, Homo Sapiens; identical to SEQ ID NO: 183488

SEQ ID NO: 343898 - RNA, 64 nt, Homo Sapiens; identical to SEQ ID NO: 183489

SEQ ID NO: 343899 - RNA, 64 nt, Homo Sapiens; identical to SEQ ID NO: 183490

SEQ ID NO: 343900 - RNA, 64 nt, Homo Sapiens; identical to SEQ ID NO: 183491

SEQ ID NO: 343901 - RNA, 64 nt, Homo Sapiens; identical to SEQ ID NO: 183492

SEQ ID NO: 343902 - RNA, 64 nt, Homo Sapiens; identical to SEQ ID NO: 183493

SEQ ID NO: 343903 - RNA, 64 nt, Homo Sapiens; identical to SEQ ID NO: 183494

SEQ ID NO: 343904 - RNA, 64 nt, Homo Sapiens; identical to SEQ ID NO: 183495

SEQ ID NO: 343905 - RNA, 64 nt, Homo Sapiens; identical to SEQ ID NO: 183496

SEQ ID NO: 343906 - RNA, 64 nt, Homo Sapiens; identical to SEQ ID NO: 183497

SEQ ID NO: 343907 - RNA, 64 nt, Homo Sapiens; identical to SEQ ID NO: 183498

SEQ ID NO: 343908 - RNA, 64 nt, Homo Sapiens; identical to SEQ ID NO: 183499

SEQ ID NO: 343909 - RNA, 64 nt, Homo Sapiens; identical to SEQ ID NO: 183500

SEQ ID NO: 343910 - RNA, 64 nt, Homo Sapiens; identical to SEQ ID NO: 183501

SEQ ID NO: 343911 - RNA, 64 nt, Homo Sapiens; identical to SEQ ID NO: 183502

SEQ ID NO: 343912 - RNA, 64 nt, Homo Sapiens; identical to SEQ ID NO: 183503

SEQ ID NO: 343913 - RNA, 64 nt, Homo Sapiens; identical to SEQ ID NO: 183504

SEQ ID NO: 343914 - RNA, 64 nt, Homo Sapiens; identical to SEQ ID NO: 183505

SEQ ID NO: 343915 - RNA, 64 nt, Homo Sapiens; identical to SEQ ID NO: 183506

SEQ ID NO: 343916 - RNA, 64 nt, Homo Sapiens; identical to SEQ ID NO: 183507

SEQ ID NO: 343917 - RNA, 64 nt, Homo Sapiens; identical to SEQ ID NO: 183508

SEQ ID NO: 343918 - RNA, 64 nt, Homo Sapiens; identical to SEQ ID NO: 183509

SEQ ID NO: 343919 - RNA, 64 nt, Homo Sapiens; identical to SEQ ID NO: 183510

SEQ ID NO: 343920 - RNA, 64 nt, Homo Sapiens; identical to SEQ ID NO: 183511

SEQ ID NO: 343921 - RNA, 64 nt, Homo Sapiens; identical to SEQ ID NO: 183512

SEQ ID NO: 343922 - RNA, 64 nt, Homo Sapiens; identical to SEQ ID NO: 183513

SEQ ID NO: 343923 - RNA, 64 nt, Homo Sapiens; identical to SEQ ID NO: 183514

SEQ ID NO: 343924 - RNA, 64 nt, Homo Sapiens; identical to SEQ ID NO: 183515

SEQ ID NO: 343925 - RNA, 64 nt, Homo Sapiens; identical to SEQ ID NO: 183516

SEQ ID NO: 343926 - RNA, 64 nt, Homo Sapiens; identical to SEQ ID NO: 183517

SEQ ID NO: 343927 - RNA, 64 nt, Homo Sapiens; identical to SEQ ID NO: 183518

SEQ ID NO: 343928 - RNA, 64 nt, Homo Sapiens; identical to SEQ ID NO: 183519

SEQ ID NO: 343929 - RNA, 64 nt, Homo Sapiens; identical to SEQ ID NO: 183520

SEQ ID NO: 343930 - RNA, 64 nt, Homo Sapiens; identical to SEQ ID NO: 183521

SEQ ID NO: 343931 - RNA, 64 nt, Homo Sapiens; identical to SEQ ID NO: 183522

SEQ ID NO: 343932 - RNA, 64 nt, Homo Sapiens; identical to SEQ ID NO: 183523

SEQ ID NO: 343933 - RNA, 64 nt, Homo Sapiens; identical to SEQ ID NO: 183524

SEQ ID NO: 343934 - RNA, 64 nt, Homo Sapiens; identical to SEQ ID NO: 183525

SEQ ID NO: 343935 - RNA, 64 nt, Homo Sapiens; identical to SEQ ID NO: 183526

SEQ ID NO: 343936 - RNA, 64 nt, Homo Sapiens; identical to SEQ ID NO: 183527

SEQ ID NO: 343937 - RNA, 64 nt, Homo Sapiens; identical to SEQ ID NO: 183528

SEQ ID NO: 343938 - RNA, 64 nt, Homo Sapiens; identical to SEQ ID NO: 183529

SEQ ID NO: 343939 - RNA, 64 nt, Homo Sapiens; identical to SEQ ID NO: 183530

SEQ ID NO: 343940 - RNA, 64 nt, Homo Sapiens; identical to SEQ ID NO: 183531

SEQ ID NO: 343941 - RNA, 64 nt, Homo Sapiens; identical to SEQ ID NO: 183532

SEQ ID NO: 343942 - RNA, 64 nt, Homo Sapiens; identical to SEQ ID NO: 183533

SEQ ID NO: 343943 - RNA, 64 nt, Homo Sapiens; identical to SEQ ID NO: 183534

SEQ ID NO: 343944 - RNA, 64 nt, Homo Sapiens; identical to SEQ ID NO: 183535

SEQ ID NO: 343945 - RNA, 64 nt, Homo Sapiens; identical to SEQ ID NO: 183536

SEQ ID NO: 343946 - RNA, 64 nt, Homo Sapiens; identical to SEQ ID NO: 183537

SEQ ID NO: 343947 - RNA, 64 nt, Homo Sapiens; identical to SEQ ID NO: 183538

SEQ ID NO: 343948 - RNA, 64 nt, Homo Sapiens; identical to SEQ ID NO: 183539

SEQ ID NO: 343949 - RNA, 64 nt, Homo Sapiens; identical to SEQ ID NO: 183540

SEQ ID NO: 343950 - RNA, 64 nt, Homo Sapiens; identical to SEQ ID NO: 183541

SEQ ID NO: 343951 - RNA, 64 nt, Homo Sapiens; identical to SEQ ID NO: 183542

SEQ ID NO: 343952 - RNA, 64 nt, Homo Sapiens; identical to SEQ ID NO: 183543

SEQ ID NO: 343953 - RNA, 64 nt, Homo Sapiens; identical to SEQ ID NO: 183544

SEQ ID NO: 343954 - RNA, 64 nt, Homo Sapiens; identical to SEQ ID NO: 183545

SEQ ID NO: 343955 - RNA, 64 nt, Homo Sapiens; identical to SEQ ID NO: 183546

SEQ ID NO: 343956 - RNA, 64 nt, Homo Sapiens; identical to SEQ ID NO: 183547

SEQ ID NO: 343957 - RNA, 64 nt, Homo Sapiens; identical to SEQ ID NO: 183548

SEQ ID NO: 343958 - RNA, 64 nt, Homo Sapiens; identical to SEQ ID NO: 183549

SEQ ID NO: 343959 - RNA, 64 nt, Homo Sapiens; identical to SEQ ID NO: 183550

SEQ ID NO: 343960 - RNA, 64 nt, Homo Sapiens; identical to SEQ ID NO: 183551

SEQ ID NO: 343961 - RNA, 64 nt, Homo Sapiens; identical to SEQ ID NO: 183552

SEQ ID NO: 343962 - RNA, 64 nt, Homo Sapiens; identical to SEQ ID NO: 183553

SEQ ID NO: 343963 - RNA, 64 nt, Homo Sapiens; identical to SEQ ID NO: 183554

SEQ ID NO: 343964 - RNA, 64 nt, Homo Sapiens; identical to SEQ ID NO: 183555

SEQ ID NO: 343965 - RNA, 64 nt, Homo Sapiens; identical to SEQ ID NO: 183556

SEQ ID NO: 343966 - RNA, 64 nt, Homo Sapiens; identical to SEQ ID NO: 183557

SEQ ID NO: 343967 - RNA, 64 nt, Homo Sapiens; identical to SEQ ID NO: 183558

SEQ ID NO: 343968 - RNA, 64 nt, Homo Sapiens; identical to SEQ ID NO: 183559

SEQ ID NO: 343969 - RNA, 64 nt, Homo Sapiens; identical to SEQ ID NO: 183560

SEQ ID NO: 343970 - RNA, 64 nt, Homo Sapiens; identical to SEQ ID NO: 183561

SEQ ID NO: 343971 - RNA, 64 nt, Homo Sapiens; identical to SEQ ID NO: 183562

SEQ ID NO: 343972 - RNA, 64 nt, Homo Sapiens; identical to SEQ ID NO: 183563

SEQ ID NO: 343973 - RNA, 64 nt, Homo Sapiens; identical to SEQ ID NO: 183564

SEQ ID NO: 343974 - RNA, 64 nt, Homo Sapiens; identical to SEQ ID NO: 183565

SEQ ID NO: 343975 - RNA, 64 nt, Homo Sapiens; identical to SEQ ID NO: 183566

SEQ ID NO: 343976 - RNA, 64 nt, Homo Sapiens; identical to SEQ ID NO: 183567

SEQ ID NO: 343977 - RNA, 64 nt, Homo Sapiens; identical to SEQ ID NO: 183568

SEQ ID NO: 343978 - RNA, 64 nt, Homo Sapiens; identical to SEQ ID NO: 183569

SEQ ID NO: 343979 - RNA, 64 nt, Homo Sapiens; identical to SEQ ID NO: 183570

SEQ ID NO: 343980 - RNA, 64 nt, Homo Sapiens; identical to SEQ ID NO: 183571

SEQ ID NO: 343981 - RNA, 64 nt, Homo Sapiens; identical to SEQ ID NO: 183572

SEQ ID NO: 343982 - RNA, 64 nt, Homo Sapiens; identical to SEQ ID NO: 183573

SEQ ID NO: 343983 - RNA, 64 nt, Homo Sapiens; identical to SEQ ID NO: 183574

SEQ ID NO: 343984 - RNA, 64 nt, Homo Sapiens; identical to SEQ ID NO: 183575

SEQ ID NO: 343985 - RNA, 64 nt, Homo Sapiens; identical to SEQ ID NO: 183576

SEQ ID NO: 343986 - RNA, 64 nt, Homo Sapiens; identical to SEQ ID NO: 183577

SEQ ID NO: 343987 - RNA, 64 nt, Homo Sapiens; identical to SEQ ID NO: 183578

SEQ ID NO: 343988 - RNA, 64 nt, Homo Sapiens; identical to SEQ ID NO: 183579

SEQ ID NO: 343989 - RNA, 64 nt, Homo Sapiens; identical to SEQ ID NO: 183580

SEQ ID NO: 343990 - RNA, 64 nt, Homo Sapiens; identical to SEQ ID NO: 183581

SEQ ID NO: 343991 - RNA, 64 nt, Homo Sapiens; identical to SEQ ID NO: 183582

SEQ ID NO: 343992 - RNA, 64 nt, Homo Sapiens; identical to SEQ ID NO: 183583

SEQ ID NO: 343993 - RNA, 64 nt, Homo Sapiens; identical to SEQ ID NO: 183584

SEQ ID NO: 343994 - RNA, 64 nt, Homo Sapiens; identical to SEQ ID NO: 183585

SEQ ID NO: 343995 - RNA, 64 nt, Homo Sapiens; identical to SEQ ID NO: 183586

SEQ ID NO: 343996 - RNA, 64 nt, Homo Sapiens; identical to SEQ ID NO: 183587

SEQ ID NO: 343997 - RNA, 64 nt, Homo Sapiens; identical to SEQ ID NO: 183588

SEQ ID NO: 343998 - RNA, 64 nt, Homo Sapiens; identical to SEQ ID NO: 183589

SEQ ID NO: 343999 - RNA, 64 nt, Homo Sapiens; identical to SEQ ID NO: 183590

SEQ ID NO: 344000 - RNA, 64 nt, Homo Sapiens; identical to SEQ ID NO: 183591

SEQ ID NO: 344001 - RNA, 64 nt, Homo Sapiens; identical to SEQ ID NO: 183592

SEQ ID NO: 344002 - RNA, 64 nt, Homo Sapiens; identical to SEQ ID NO: 183593

SEQ ID NO: 344003 - RNA, 64 nt, Homo Sapiens; identical to SEQ ID NO: 183594

SEQ ID NO: 344004 - RNA, 64 nt, Homo Sapiens; identical to SEQ ID NO: 183595

SEQ ID NO: 344005 - RNA, 64 nt, Homo Sapiens; identical to SEQ ID NO: 183596

SEQ ID NO: 344006 - RNA, 64 nt, Homo Sapiens; identical to SEQ ID NO: 183597

SEQ ID NO: 344007 - RNA, 64 nt, Homo Sapiens; identical to SEQ ID NO: 183598

SEQ ID NO: 344008 - RNA, 64 nt, Homo Sapiens; identical to SEQ ID NO: 183599

SEQ ID NO: 344009 - RNA, 64 nt, Homo Sapiens; identical to SEQ ID NO: 183600

SEQ ID NO: 344010 - RNA, 64 nt, Homo Sapiens; identical to SEQ ID NO: 183601

SEQ ID NO: 344011 - RNA, 64 nt, Homo Sapiens; identical to SEQ ID NO: 183602

SEQ ID NO: 344012 - RNA, 64 nt, Homo Sapiens; identical to SEQ ID NO: 183603

SEQ ID NO: 344013 - RNA, 64 nt, Homo Sapiens
uccuuuuauaagauuuaauuguaauugucucaaagcaucaaauaauacaucuuuaucauuaaac

SEQ ID NO: 344014 - RNA, 64 nt, Homo Sapiens
ggacugcaauaucaacaacaaguuguuucaaacagcaucaaaauacaacuucauugcuacacuu

SEQ ID NO: 344015 - RNA, 64 nt, Homo Sapiens
cggaacaucacaggguuuauaagcuuuuacccaggcaucaaaaccaaauguaacgugcaugcuu

SEQ ID NO: 344016 - RNA, 64 nt, Homo Sapiens
cuuuuuugaugaaaccauaccaaagucucacuaggcaucaaaaagauagagauuuuccgcaggc

SEQ ID NO: 344017 - RNA, 64 nt, Homo Sapiens
cugaggccgagcuugcauguagaaaagcugaguguugggagaagcaccuguaucucuuguuggg

SEQ ID NO: 344018 - RNA, 64 nt, Homo Sapiens
agcugaguguugggagaagcaccuguaucucuuguugggagaaaugucuaccugucuccuaccc

SEQ ID NO: 344019 - RNA, 64 nt, Homo Sapiens
gccaggcccaggguggcugcauggggugcggugcuugggagacagggcugguguggaggugcuc

SEQ ID NO: 344020 - RNA, 64 nt, Homo Sapiens
cugggggggccaagggcacaucugguggaacaaguugggagaggguucuucuugcagaaugugc

SEQ ID NO: 344021 - RNA, 64 nt, Homo Sapiens
auuaccuuaaucuuuguugcucaagugccagagguugggagaaggauugcagguugggagaggu

SEQ ID NO: 344022 - RNA, 64 nt, Homo Sapiens
cucaagugccagagguugggagaaggauugcagguugggagaggugggaaauagcagugaauuu

SEQ ID NO: 344023 - RNA, 64 nt, Homo Sapiens
uuuuuuuccuucugcaauacauuugaaaacuuguuugggagacucugcauuuuuuauugugguu

SEQ ID NO: 344024 - RNA, 64 nt, Homo Sapiens
guugguuuauacaagcaugcguugcacuucuuuuuugggagauguguguuguugauguucuaug

SEQ ID NO: 344025 - RNA, 64 nt, Homo Sapiens
aauaaaacuacauuuuuuccaauuugccaauauuuugggagaacaaagauuaaaaguuacuuua

SEQ ID NO: 344026 - RNA, 64 nt, Homo Sapiens
guuaggaacaguuuguacagugucguuagucuuuuugggagacuaauuggugacuauguauagc

SEQ ID NO: 344027 - RNA, 64 nt, Homo Sapiens
aaacuuccuucaacccaggaagcgucuuuggugcuugggagaccaagaaaccaagaaauuaaca

SEQ ID NO: 344028 - RNA, 64 nt, Homo Sapiens
uuauaaucccaugaaaauguaaauuacaguuuacuugggagagccagauuuucucugugcucuu

SEQ ID NO: 344029 - RNA, 64 nt, Homo Sapiens
cccaucacaaaagguacccucagaacaugacuccuugggagaucucuuugaugagcuggucccu

SEQ ID NO: 344030 - RNA, 64 nt, Homo Sapiens
agggcccgggguuugggaggggagauauuggagauugggagaccagacauauggcuugagaagc

SEQ ID NO: 344031 - RNA, 64 nt, Homo Sapiens
ccuggaaggagccuauuauagaggguugguuauguugggagauugggccugaauuucuccacag

SEQ ID NO: 344032 - RNA, 64 nt, Homo Sapiens
ccuacuauccucccacucgagaguucacuucugguugggagacaggauuccuagcaccuccggu

SEQ ID NO: 344033 - RNA, 64 nt, Homo Sapiens
aauaaaucauaccucaaaggauggagugcaucaauugggagaaaaggagacauagcccaaaccc

SEQ ID NO: 344034 - RNA, 64 nt, Homo Sapiens
gauaaggggugggagugugauuuuaaaugcucuuuugggagaacaaagaaauuaauguaaauaa

SEQ ID NO: 344035 - RNA, 64 nt, Homo Sapiens
aaucuugucuuaccacaguguuuuauaggagagauugggagaaaucauccuguuuucucuguga

SEQ ID NO: 344036 - RNA, 64 nt, Homo Sapiens
ugcugauaaaauaugagccgguuauuacuucuguuugggagacugugcucucuguggugccucu

SEQ ID NO: 344037 - RNA, 64 nt, Homo Sapiens
gugguaauauuuggagcuuuauagccuguauuccuugggagaaaaaaaugggaauuggaguaaa

SEQ ID NO: 344038 - RNA, 64 nt, Homo Sapiens
aauuucagaugacaguguggucagaagauguuuuuugggagaaccuaguguuugcugggcacua

SEQ ID NO: 344039 - RNA, 64 nt, Homo Sapiens
guggggagggauuuggggcucagagugggguagguugggagaaugucaguauguggaagugugg

SEQ ID NO: 344040 - RNA, 64 nt, Homo Sapiens
uucucugggauauugauacuguuuguguuuuuaguugggagaucugagagaccuggcuuuggca

SEQ ID NO: 344041 - RNA, 64 nt, Homo Sapiens
aagagaagguuuuuaaggaggggcuucugaauacuugggagauacggaacggaccaaggaccac

SEQ ID NO: 344042 - RNA, 64 nt, Homo Sapiens
aaauuaugagugagcuguuaacucuaaaauguacuugggagauaggccaagcgagaggucaugg

SEQ ID NO: 344043 - RNA, 64 nt, Homo Sapiens
acuuggugggaaguaagcugugccaucaccuccacuguaccaaguugcuggauacuugcaguuc

SEQ ID NO: 344044 - RNA, 64 nt, Homo Sapiens
gacauagaacauucuuuguaaccuccgggcucaucuguaccaaguacuaccccuguagcuguga

SEQ ID NO: 344045 - RNA, 64 nt, Homo Sapiens
uugcaauagaaagccuucagacagagcauugaaucuguaccaauagucuuaaagucugcuauuu

SEQ ID NO: 344046 - RNA, 64 nt, Homo Sapiens
uauuuuauggaauaucuaaauucaguaggugccucuguaccaaauuucuuugagaagcaaauua

SEQ ID NO: 344047 - RNA, 64 nt, Homo Sapiens
gcauuccagccugggugacgggagugagccaugacuguaccacugagcccaggagguugaggcu

SEQ ID NO: 344048 - RNA, 64 nt, Homo Sapiens
ucuggguuuggggugauggcgcucaaguuugauucuguaccagauuggaucuuuuacauuugau

SEQ ID NO: 344049 - RNA, 64 nt, Homo Sapiens
cuaaggauuuuccuuuaauuucucuggaguaauacuguaccauacuggucuuugcuuuuaguaa

SEQ ID NO: 344050 - RNA, 64 nt, Homo Sapiens
ucuaaauuguguguucuguacaugugauguuugacuguaccauugacuguuauggaaguucagc

SEQ ID NO: 344051 - RNA, 64 nt, Homo Sapiens
aguuuguguuucuuuguugccaguguuaccuuugcuguaccauagacuuaaaauuccucuauug

SEQ ID NO: 344052 - RNA, 64 nt, Homo Sapiens
uacugcuuguauaguggccucaucuuccuuccugcuguaccacagauggcccaggagaggcacu

SEQ ID NO: 344053 - RNA, 64 nt, Homo Sapiens; identical to SEQ ID NO: 99154

SEQ ID NO: 344054 - RNA, 64 nt, Homo Sapiens; identical to SEQ ID NO: 99155

SEQ ID NO: 344055 - RNA, 64 nt, Homo Sapiens; identical to SEQ ID NO: 99156

SEQ ID NO: 344056 - RNA, 64 nt, Homo Sapiens; identical to SEQ ID NO: 99157

SEQ ID NO: 344057 - RNA, 64 nt, Homo Sapiens; identical to SEQ ID NO: 99158

SEQ ID NO: 344058 - RNA, 64 nt, Homo Sapiens; identical to SEQ ID NO: 99159

SEQ ID NO: 344059 - RNA, 64 nt, Homo Sapiens; identical to SEQ ID NO: 99160

SEQ ID NO: 344060 - RNA, 64 nt, Homo Sapiens; identical to SEQ ID NO: 99161

SEQ ID NO: 344061 - RNA, 64 nt, Homo Sapiens; identical to SEQ ID NO: 99162

SEQ ID NO: 344062 - RNA, 64 nt, Homo Sapiens; identical to SEQ ID NO: 99163

SEQ ID NO: 344063 - RNA, 64 nt, Homo Sapiens; identical to SEQ ID NO: 99164

SEQ ID NO: 344064 - RNA, 64 nt, Homo Sapiens; identical to SEQ ID NO: 99165

SEQ ID NO: 344065 - RNA, 64 nt, Homo Sapiens; identical to SEQ ID NO: 99166

SEQ ID NO: 344066 - RNA, 64 nt, Homo Sapiens; identical to SEQ ID NO: 99167

SEQ ID NO: 344067 - RNA, 64 nt, Homo Sapiens; identical to SEQ ID NO: 99168

SEQ ID NO: 344068 - RNA, 64 nt, Homo Sapiens; identical to SEQ ID NO: 99169

SEQ ID NO: 344069 - RNA, 64 nt, Homo Sapiens; identical to SEQ ID NO: 99170

SEQ ID NO: 344070 - RNA, 64 nt, Homo Sapiens; identical to SEQ ID NO: 99171

SEQ ID NO: 344071 - RNA, 64 nt, Homo Sapiens; identical to SEQ ID NO: 99172

SEQ ID NO: 344072 - RNA, 64 nt, Homo Sapiens; identical to SEQ ID NO: 99173

SEQ ID NO: 344073 - RNA, 64 nt, Homo Sapiens; identical to SEQ ID NO: 99174

SEQ ID NO: 344074 - RNA, 64 nt, Homo Sapiens; identical to SEQ ID NO: 99175

SEQ ID NO: 344075 - RNA, 64 nt, Homo Sapiens; identical to SEQ ID NO: 99176

SEQ ID NO: 344076 - RNA, 64 nt, Homo Sapiens; identical to SEQ ID NO: 99177

SEQ ID NO: 344077 - RNA, 64 nt, Homo Sapiens; identical to SEQ ID NO: 99178

SEQ ID NO: 344078 - RNA, 64 nt, Homo Sapiens; identical to SEQ ID NO: 99179

SEQ ID NO: 344079 - RNA, 64 nt, Homo Sapiens; identical to SEQ ID NO: 123308

SEQ ID NO: 344080 - RNA, 64 nt, Homo Sapiens; identical to SEQ ID NO: 123309

SEQ ID NO: 344081 - RNA, 64 nt, Homo Sapiens; identical to SEQ ID NO: 123310

SEQ ID NO: 344082 - RNA, 64 nt, Homo Sapiens; identical to SEQ ID NO: 123311

SEQ ID NO: 344083 - RNA, 64 nt, Homo Sapiens; identical to SEQ ID NO: 123312

SEQ ID NO: 344084 - RNA, 64 nt, Homo Sapiens; identical to SEQ ID NO: 123313

SEQ ID NO: 344085 - RNA, 64 nt, Homo Sapiens; identical to SEQ ID NO: 123314

SEQ ID NO: 344086 - RNA, 64 nt, Homo Sapiens; identical to SEQ ID NO: 123315

SEQ ID NO: 344087 - RNA, 64 nt, Homo Sapiens; identical to SEQ ID NO: 123316

SEQ ID NO: 344088 - RNA, 64 nt, Homo Sapiens; identical to SEQ ID NO: 123317

SEQ ID NO: 344089 - RNA, 64 nt, Homo Sapiens; identical to SEQ ID NO: 123318

SEQ ID NO: 344090 - RNA, 64 nt, Homo Sapiens; identical to SEQ ID NO: 123319

SEQ ID NO: 344091 - RNA, 64 nt, Homo Sapiens; identical to SEQ ID NO: 123320

SEQ ID NO: 344092 - RNA, 64 nt, Homo Sapiens; identical to SEQ ID NO: 123321

SEQ ID NO: 344093 - RNA, 64 nt, Homo Sapiens; identical to SEQ ID NO: 123322

SEQ ID NO: 344094 - RNA, 64 nt, Homo Sapiens; identical to SEQ ID NO: 123323

SEQ ID NO: 344095 - RNA, 64 nt, Homo Sapiens; identical to SEQ ID NO: 123324

SEQ ID NO: 344096 - RNA, 64 nt, Homo Sapiens; identical to SEQ ID NO: 123325

SEQ ID NO: 344097 - RNA, 64 nt, Homo Sapiens; identical to SEQ ID NO: 123326

SEQ ID NO: 344098 - RNA, 64 nt, Homo Sapiens; identical to SEQ ID NO: 123327

SEQ ID NO: 344099 - RNA, 64 nt, Homo Sapiens; identical to SEQ ID NO: 123328

SEQ ID NO: 344100 - RNA, 64 nt, Homo Sapiens; identical to SEQ ID NO: 123329

SEQ ID NO: 344101 - RNA, 64 nt, Homo Sapiens; identical to SEQ ID NO: 123330

SEQ ID NO: 344102 - RNA, 64 nt, Homo Sapiens; identical to SEQ ID NO: 123331

SEQ ID NO: 344103 - RNA, 64 nt, Homo Sapiens; identical to SEQ ID NO: 123332

SEQ ID NO: 344104 - RNA, 64 nt, Homo Sapiens; identical to SEQ ID NO: 123333

SEQ ID NO: 344105 - RNA, 64 nt, Homo Sapiens; identical to SEQ ID NO: 123334

SEQ ID NO: 344106 - RNA, 64 nt, Homo Sapiens; identical to SEQ ID NO: 123335

SEQ ID NO: 344107 - RNA, 64 nt, Homo Sapiens; identical to SEQ ID NO: 123336

SEQ ID NO: 344108 - RNA, 64 nt, Homo Sapiens; identical to SEQ ID NO: 123337

SEQ ID NO: 344109 - RNA, 64 nt, Homo Sapiens; identical to SEQ ID NO: 123338

SEQ ID NO: 344110 - RNA, 64 nt, Homo Sapiens; identical to SEQ ID NO: 123339

SEQ ID NO: 344111 - RNA, 64 nt, Homo Sapiens; identical to SEQ ID NO: 123340

SEQ ID NO: 344112 - RNA, 64 nt, Homo Sapiens; identical to SEQ ID NO: 123341

SEQ ID NO: 344113 - RNA, 61 nt, Homo Sapiens; identical to SEQ ID NO: 123342

SEQ ID NO: 344114 - RNA, 64 nt, Homo Sapiens; identical to SEQ ID NO: 123343

SEQ ID NO: 344115 - RNA, 64 nt, Homo Sapiens; identical to SEQ ID NO: 123344

SEQ ID NO: 344116 - RNA, 64 nt, Homo Sapiens; identical to SEQ ID NO: 123345

SEQ ID NO: 344117 - RNA, 64 nt, Homo Sapiens; identical to SEQ ID NO: 123346

SEQ ID NO: 344118 - RNA, 64 nt, Homo Sapiens; identical to SEQ ID NO: 123347

SEQ ID NO: 344119 - RNA, 64 nt, Homo Sapiens; identical to SEQ ID NO: 123348

SEQ ID NO: 344120 - RNA, 64 nt, Homo Sapiens; identical to SEQ ID NO: 123349

SEQ ID NO: 344121 - RNA, 64 nt, Homo Sapiens; identical to SEQ ID NO: 123350

SEQ ID NO: 344122 - RNA, 64 nt, Homo Sapiens; identical to SEQ ID NO: 123351

SEQ ID NO: 344123 - RNA, 64 nt, Homo Sapiens; identical to SEQ ID NO: 123352

SEQ ID NO: 344124 - RNA, 64 nt, Homo Sapiens; identical to SEQ ID NO: 123353

SEQ ID NO: 344125 - RNA, 64 nt, Homo Sapiens; identical to SEQ ID NO: 123354

SEQ ID NO: 344126 - RNA, 64 nt, Homo Sapiens; identical to SEQ ID NO: 123355

SEQ ID NO: 344127 - RNA, 64 nt, Homo Sapiens; identical to SEQ ID NO: 123356

SEQ ID NO: 344128 - RNA, 64 nt, Homo Sapiens; identical to SEQ ID NO: 123357

SEQ ID NO: 344129 - RNA, 64 nt, Homo Sapiens; identical to SEQ ID NO: 123358

SEQ ID NO: 344130 - RNA, 64 nt, Homo Sapiens; identical to SEQ ID NO: 123359

SEQ ID NO: 344131 - RNA, 64 nt, Homo Sapiens; identical to SEQ ID NO: 123360

SEQ ID NO: 344132 - RNA, 64 nt, Homo Sapiens; identical to SEQ ID NO: 123361

SEQ ID NO: 344133 - RNA, 64 nt, Homo Sapiens; identical to SEQ ID NO: 123362

SEQ ID NO: 344134 - RNA, 64 nt, Homo Sapiens; identical to SEQ ID NO: 123363

SEQ ID NO: 344135 - RNA, 64 nt, Homo Sapiens; identical to SEQ ID NO: 123364

SEQ ID NO: 344136 - RNA, 64 nt, Homo Sapiens; identical to SEQ ID NO: 123365

SEQ ID NO: 344137 - RNA, 64 nt, Homo Sapiens; identical to SEQ ID NO: 123366

SEQ ID NO: 344138 - RNA, 64 nt, Homo Sapiens; identical to SEQ ID NO: 123367

SEQ ID NO: 344139 - RNA, 64 nt, Homo Sapiens; identical to SEQ ID NO: 123368

SEQ ID NO: 344140 - RNA, 64 nt, Homo Sapiens; identical to SEQ ID NO: 123369

SEQ ID NO: 344141 - RNA, 64 nt, Homo Sapiens; identical to SEQ ID NO: 21574

SEQ ID NO: 344142 - RNA, 64 nt, Homo Sapiens; identical to SEQ ID NO: 21575

SEQ ID NO: 344143 - RNA, 64 nt, Homo Sapiens; identical to SEQ ID NO: 21576

SEQ ID NO: 344144 - RNA, 64 nt, Homo Sapiens; identical to SEQ ID NO: 21577

SEQ ID NO: 344145 - RNA, 64 nt, Homo Sapiens; identical to SEQ ID NO: 21578

SEQ ID NO: 344146 - RNA, 64 nt, Homo Sapiens; identical to SEQ ID NO: 21579

SEQ ID NO: 344147 - RNA, 64 nt, Homo Sapiens; identical to SEQ ID NO: 21580

SEQ ID NO: 344148 - RNA, 64 nt, Homo Sapiens; identical to SEQ ID NO: 21581

SEQ ID NO: 344149 - RNA, 64 nt, Homo Sapiens; identical to SEQ ID NO: 21582

SEQ ID NO: 344150 - RNA, 64 nt, Homo Sapiens; identical to SEQ ID NO: 21583

SEQ ID NO: 344151 - RNA, 64 nt, Homo Sapiens; identical to SEQ ID NO: 21584

SEQ ID NO: 344152 - RNA, 64 nt, Homo Sapiens; identical to SEQ ID NO: 21585

SEQ ID NO: 344153 - RNA, 64 nt, Homo Sapiens; identical to SEQ ID NO: 21586

SEQ ID NO: 344154 - RNA, 64 nt, Homo Sapiens; identical to SEQ ID NO: 21587

SEQ ID NO: 344155 - RNA, 64 nt, Homo Sapiens; identical to SEQ ID NO: 21588

SEQ ID NO: 344156 - RNA, 64 nt, Homo Sapiens; identical to SEQ ID NO: 21589

SEQ ID NO: 344157 - RNA, 64 nt, Homo Sapiens; identical to SEQ ID NO: 21590

SEQ ID NO: 344158 - RNA, 64 nt, Homo Sapiens; identical to SEQ ID NO: 21591

SEQ ID NO: 344159 - RNA, 64 nt, Homo Sapiens; identical to SEQ ID NO: 21592

SEQ ID NO: 344160 - RNA, 64 nt, Homo Sapiens; identical to SEQ ID NO: 21593

SEQ ID NO: 344161 - RNA, 64 nt, Homo Sapiens; identical to SEQ ID NO: 21594

SEQ ID NO: 344162 - RNA, 64 nt, Homo Sapiens; identical to SEQ ID NO: 21595

SEQ ID NO: 344163 - RNA, 64 nt, Homo Sapiens; identical to SEQ ID NO: 21596

SEQ ID NO: 344164 - RNA, 64 nt, Homo Sapiens; identical to SEQ ID NO: 21597

SEQ ID NO: 344165 - RNA, 64 nt, Homo Sapiens; identical to SEQ ID NO: 21598

SEQ ID NO: 344166 - RNA, 64 nt, Homo Sapiens; identical to SEQ ID NO: 21599

SEQ ID NO: 344167 - RNA, 64 nt, Homo Sapiens; identical to SEQ ID NO: 21600

SEQ ID NO: 344168 - RNA, 64 nt, Homo Sapiens; identical to SEQ ID NO: 21601

SEQ ID NO: 344169 - RNA, 64 nt, Homo Sapiens; identical to SEQ ID NO: 21602

SEQ ID NO: 344170 - RNA, 64 nt, Homo Sapiens; identical to SEQ ID NO: 21603

SEQ ID NO: 344171 - RNA, 64 nt, Homo Sapiens; identical to SEQ ID NO: 21604

SEQ ID NO: 344172 - RNA, 64 nt, Homo Sapiens; identical to SEQ ID NO: 21605

SEQ ID NO: 344173 - RNA, 64 nt, Homo Sapiens; identical to SEQ ID NO: 21606

SEQ ID NO: 344174 - RNA, 64 nt, Homo Sapiens; identical to SEQ ID NO: 21607

SEQ ID NO: 344175 - RNA, 64 nt, Homo Sapiens; identical to SEQ ID NO: 21608

SEQ ID NO: 344176 - RNA, 64 nt, Homo Sapiens; identical to SEQ ID NO: 21609

SEQ ID NO: 344177 - RNA, 64 nt, Homo Sapiens; identical to SEQ ID NO: 21610

SEQ ID NO: 344178 - RNA, 64 nt, Homo Sapiens; identical to SEQ ID NO: 21611

SEQ ID NO: 344179 - RNA, 64 nt, Homo Sapiens; identical to SEQ ID NO: 21612

SEQ ID NO: 344180 - RNA, 64 nt, Homo Sapiens; identical to SEQ ID NO: 21613

SEQ ID NO: 344181 - RNA, 64 nt, Homo Sapiens; identical to SEQ ID NO: 21614

SEQ ID NO: 344182 - RNA, 64 nt, Homo Sapiens; identical to SEQ ID NO: 21615

SEQ ID NO: 344183 - RNA, 64 nt, Homo Sapiens; identical to SEQ ID NO: 21616

SEQ ID NO: 344184 - RNA, 64 nt, Homo Sapiens; identical to SEQ ID NO: 21617

SEQ ID NO: 344185 - RNA, 64 nt, Homo Sapiens; identical to SEQ ID NO: 21618

SEQ ID NO: 344186 - RNA, 64 nt, Homo Sapiens; identical to SEQ ID NO: 21619

SEQ ID NO: 344187 - RNA, 64 nt, Homo Sapiens; identical to SEQ ID NO: 21620

SEQ ID NO: 344188 - RNA, 64 nt, Homo Sapiens; identical to SEQ ID NO: 21621

SEQ ID NO: 344189 - RNA, 64 nt, Homo Sapiens; identical to SEQ ID NO: 21622

SEQ ID NO: 344190 - RNA, 64 nt, Homo Sapiens; identical to SEQ ID NO: 21623

SEQ ID NO: 344191 - RNA, 64 nt, Homo Sapiens; identical to SEQ ID NO: 21624

SEQ ID NO: 344192 - RNA, 64 nt, Homo Sapiens; identical to SEQ ID NO: 21625

SEQ ID NO: 344193 - RNA, 64 nt, Homo Sapiens; identical to SEQ ID NO: 21626

SEQ ID NO: 344194 - RNA, 64 nt, Homo Sapiens; identical to SEQ ID NO: 21627

SEQ ID NO: 344195 - RNA, 64 nt, Homo Sapiens; identical to SEQ ID NO: 21628

SEQ ID NO: 344196 - RNA, 64 nt, Homo Sapiens; identical to SEQ ID NO: 21629

SEQ ID NO: 344197 - RNA, 64 nt, Homo Sapiens; identical to SEQ ID NO: 21630

SEQ ID NO: 344198 - RNA, 57 nt, Homo Sapiens; identical to SEQ ID NO: 21631

SEQ ID NO: 344199 - RNA, 64 nt, Homo Sapiens; identical to SEQ ID NO: 21632

SEQ ID NO: 344200 - RNA, 64 nt, Homo Sapiens; identical to SEQ ID NO: 21633

SEQ ID NO: 344201 - RNA, 64 nt, Homo Sapiens; identical to SEQ ID NO: 21634

SEQ ID NO: 344202 - RNA, 64 nt, Homo Sapiens; identical to SEQ ID NO: 21635

SEQ ID NO: 344203 - RNA, 64 nt, Homo Sapiens; identical to SEQ ID NO: 21636

SEQ ID NO: 344204 - RNA, 64 nt, Homo Sapiens; identical to SEQ ID NO: 21637

SEQ ID NO: 344205 - RNA, 64 nt, Homo Sapiens; identical to SEQ ID NO: 21638

SEQ ID NO: 344206 - RNA, 64 nt, Homo Sapiens; identical to SEQ ID NO: 21639

SEQ ID NO: 344207 - RNA, 64 nt, Homo Sapiens; identical to SEQ ID NO: 21640

SEQ ID NO: 344208 - RNA, 64 nt, Homo Sapiens; identical to SEQ ID NO: 21641

SEQ ID NO: 344209 - RNA, 64 nt, Homo Sapiens; identical to SEQ ID NO: 21642

SEQ ID NO: 344210 - RNA, 64 nt, Homo Sapiens; identical to SEQ ID NO: 21643

SEQ ID NO: 344211 - RNA, 64 nt, Homo Sapiens; identical to SEQ ID NO: 21644

SEQ ID NO: 344212 - RNA, 64 nt, Homo Sapiens; identical to SEQ ID NO: 21645

SEQ ID NO: 344213 - RNA, 64 nt, Homo Sapiens; identical to SEQ ID NO: 21646

SEQ ID NO: 344214 - RNA, 64 nt, Homo Sapiens; identical to SEQ ID NO: 21647

SEQ ID NO: 344215 - RNA, 64 nt, Homo Sapiens; identical to SEQ ID NO: 21648

SEQ ID NO: 344216 - RNA, 64 nt, Homo Sapiens; identical to SEQ ID NO: 21649

SEQ ID NO: 344217 - RNA, 64 nt, Homo Sapiens; identical to SEQ ID NO: 21650

SEQ ID NO: 344218 - RNA, 64 nt, Homo Sapiens; identical to SEQ ID NO: 21651

SEQ ID NO: 344219 - RNA, 64 nt, Homo Sapiens; identical to SEQ ID NO: 21652

SEQ ID NO: 344220 - RNA, 64 nt, Homo Sapiens; identical to SEQ ID NO: 21653

SEQ ID NO: 344221 - RNA, 64 nt, Homo Sapiens; identical to SEQ ID NO: 21654

SEQ ID NO: 344222 - RNA, 64 nt, Homo Sapiens; identical to SEQ ID NO: 21655

SEQ ID NO: 344223 - RNA, 64 nt, Homo Sapiens; identical to SEQ ID NO: 21656

SEQ ID NO: 344224 - RNA, 64 nt, Homo Sapiens; identical to SEQ ID NO: 21657

SEQ ID NO: 344225 - RNA, 64 nt, Homo Sapiens; identical to SEQ ID NO: 21658

SEQ ID NO: 344226 - RNA, 64 nt, Homo Sapiens; identical to SEQ ID NO: 21659

SEQ ID NO: 344227 - RNA, 64 nt, Homo Sapiens; identical to SEQ ID NO: 21660

SEQ ID NO: 344228 - RNA, 64 nt, Homo Sapiens; identical to SEQ ID NO: 21661

SEQ ID NO: 344229 - RNA, 64 nt, Homo Sapiens; identical to SEQ ID NO: 21662

SEQ ID NO: 344230 - RNA, 64 nt, Homo Sapiens; identical to SEQ ID NO: 21663

SEQ ID NO: 344231 - RNA, 64 nt, Homo Sapiens; identical to SEQ ID NO: 21664

SEQ ID NO: 344232 - RNA, 64 nt, Homo Sapiens; identical to SEQ ID NO: 21665

SEQ ID NO: 344233 - RNA, 64 nt, Homo Sapiens; identical to SEQ ID NO: 21666

SEQ ID NO: 344234 - RNA, 64 nt, Homo Sapiens; identical to SEQ ID NO: 21667

SEQ ID NO: 344235 - RNA, 64 nt, Homo Sapiens; identical to SEQ ID NO: 21668

SEQ ID NO: 344236 - RNA, 64 nt, Homo Sapiens; identical to SEQ ID NO: 21669

SEQ ID NO: 344237 - RNA, 64 nt, Homo Sapiens; identical to SEQ ID NO: 21670

SEQ ID NO: 344238 - RNA, 64 nt, Homo Sapiens; identical to SEQ ID NO: 21671

SEQ ID NO: 344239 - RNA, 64 nt, Homo Sapiens; identical to SEQ ID NO: 21672

SEQ ID NO: 344240 - RNA, 64 nt, Homo Sapiens; identical to SEQ ID NO: 21673

SEQ ID NO: 344241 - RNA, 64 nt, Homo Sapiens; identical to SEQ ID NO: 21674

SEQ ID NO: 344242 - RNA, 64 nt, Homo Sapiens; identical to SEQ ID NO: 21675

SEQ ID NO: 344243 - RNA, 64 nt, Homo Sapiens; identical to SEQ ID NO: 21676

SEQ ID NO: 344244 - RNA, 64 nt, Homo Sapiens; identical to SEQ ID NO: 21677

SEQ ID NO: 344245 - RNA, 64 nt, Homo Sapiens; identical to SEQ ID NO: 21678

SEQ ID NO: 344246 - RNA, 64 nt, Homo Sapiens; identical to SEQ ID NO: 21679

SEQ ID NO: 344247 - RNA, 64 nt, Homo Sapiens; identical to SEQ ID NO: 21680

SEQ ID NO: 344248 - RNA, 64 nt, Homo Sapiens; identical to SEQ ID NO: 21681

SEQ ID NO: 344249 - RNA, 64 nt, Homo Sapiens; identical to SEQ ID NO: 21682

SEQ ID NO: 344250 - RNA, 64 nt, Homo Sapiens
agggggagguagggcuuugaagggagacagagggucgucccaacgugccgccagugguccaagg

SEQ ID NO: 344251 - RNA, 64 nt, Homo Sapiens
cccaagugagucacgcuuccaccggauuucgguaucgucccagaggcaggggaugggguggggu

SEQ ID NO: 344252 - RNA, 64 nt, Homo Sapiens
uuaaugugcuuuuuuuguauaaagugcaaacauuucgucccaaagucuaaguacuuuagugcag

SEQ ID NO: 344253 - RNA, 64 nt, Homo Sapiens
ucuguaucuccagccacuccucacuuuucaggggucgucccaacgccgugcagacgaccuuggu

SEQ ID NO: 344254 - RNA, 64 nt, Homo Sapiens
cucagcuuugcgugugcccagccgugugcacagcucgucccaacuccugcggguggcaccugcc

SEQ ID NO: 344255 - RNA, 64 nt, Homo Sapiens
acccuggcgccaggaaggagcauguguuagcgucucgucccaccuggaauuguaauaaauacau

SEQ ID NO: 344256 - RNA, 64 nt, Homo Sapiens
aagaaaaucuuuuuuaguuauuuguuuguuuacuucgucccaugugcuaacuaucuuauauaua

SEQ ID NO: 344257 - RNA, 64 nt, Homo Sapiens
gauugcaaauggcuucagaggucaccaaguucagucgucccaaaacauggguguguuucaaaau

SEQ ID NO: 344258 - RNA, 64 nt, Homo Sapiens
ggggccaucagggcuaaccacuucacaccuaccaucgucccauggggauccaagaccugagaua

SEQ ID NO: 344259 - RNA, 64 nt, Homo Sapiens
cucucagccuggcagauguggaaacucaaauuucucgucccacuccagguuuuggcuagccaac

SEQ ID NO: 344260 - RNA, 64 nt, Homo Sapiens
agcaccucagccaucuguagaaggcaaagcucagucgucccagcccaguucuuugggcuggguc

SEQ ID NO: 344261 - RNA, 64 nt, Homo Sapiens
gcccucagauuccacaaagccucucuccccucccucgucccacccccacccaggcaggaagccc

SEQ ID NO: 344262 - RNA, 64 nt, Homo Sapiens
gccagcuggcaccugccucuaucccagacugcccucgucccagcucucuguccaacuguugauu

SEQ ID NO: 344263 - RNA, 64 nt, Homo Sapiens
cuagcagagauggauagcuuaagaggcuuuucugucgucccaggaacgcugcaguuccuuuaug

SEQ ID NO: 344264 - RNA, 64 nt, Homo Sapiens
ugucuccagccuggcucuaucuuccuccuugugaucgucccauccccacaucccgugcaccccc

SEQ ID NO: 344265 - RNA, 64 nt, Homo Sapiens
cacacaggccuccagcugggccaugucagucucaucgucccaaggcuugaaauccagcaggaug

SEQ ID NO: 344266 - RNA, 64 nt, Homo Sapiens
gugucuagggguucugccuggucaacguuauuugucgucccaucuuuuggcagcaaaaccaccu

SEQ ID NO: 344267 - RNA, 64 nt, Homo Sapiens
uagcuuacccucccaguuggcuuagcacaccugcucgucccauuccccagccaugcggccaccc

SEQ ID NO: 344268 - RNA, 64 nt, Homo Sapiens
gcaggcugcaggagggcacuggagcugggaggucucgucccagcccuccccaucucggggcugc

SEQ ID NO: 344269 - RNA, 64 nt, Homo Sapiens
gggcacccuggccacccugguccuuggauccccuucgucccaccugguccaccccagaugcuga

SEQ ID NO: 344270 - RNA, 64 nt, Homo Sapiens
cauccucccugaggcaccuguucccugagucaguucgucccacaggugaaagcauuucuuaugg

SEQ ID NO: 344271 - RNA, 64 nt, Homo Sapiens
ggccucuguacauuucccugcaagcuuccaaagcucgucccacuguugccuuccugaaggugac

SEQ ID NO: 344272 - RNA, 64 nt, Homo Sapiens
cuccgcccgccgggcucugcguccccacguccccucgucccauccccacguccccucaucccgu

SEQ ID NO: 344273 - RNA, 64 nt, Homo Sapiens
cuccugacuggggcuugcgacucacaggauugcaucgucccagcugcuaacuuggggccggggc

SEQ ID NO: 344274 - RNA, 64 nt, Homo Sapiens
uggaacuuaccauugggauucugucccacagcccucgucccaugcuccuggugacagguggcac

SEQ ID NO: 344275 - RNA, 64 nt, Homo Sapiens
aagugcuggacugcaggcugcagugaucccucuuucgucccacccccucuucccucagcagccc

SEQ ID NO: 344276 - RNA, 64 nt, Homo Sapiens
ugccagucagccgaggauguaguuguugcugccgucgucccaccaccucagggaccagagggcu

SEQ ID NO: 344277 - RNA, 64 nt, Homo Sapiens
guuuccugcuuaagccugguccuauuaaagaaccucgucccaguuuauuuuucucuuuccuacu

SEQ ID NO: 344278 - RNA, 64 nt, Homo Sapiens
auauugaauacugacaagagaauacccauacaaaucgucccaccgcccuagaggccacagaauu

SEQ ID NO: 344279 - RNA, 64 nt, Homo Sapiens
uuucucuccaaccagggcagaaaggagggaggauucgucccauuacaauaaugaaauaaugaua

SEQ ID NO: 344280 - RNA, 64 nt, Homo Sapiens
uucuuuuacuguuauagaauagccugagguccccucgucccauccagcuaccaccacggccacc

SEQ ID NO: 344281 - RNA, 64 nt, Homo Sapiens
caaaaaauuagccgggugugguggugggcaccugucgucccagcuacuagggaggcugaggcag

SEQ ID NO: 344282 - RNA, 64 nt, Homo Sapiens
caucauucacccugagugacaagacaggcaacucucgucccaacuaugagacaggcacuggcug

SEQ ID NO: 344283 - RNA, 64 nt, Homo Sapiens
gcuuucugcccauuguuucuagccugcugugcuuucgucccacaaggaucuccagccucccaga

SEQ ID NO: 344284 - RNA, 64 nt, Homo Sapiens
ccagguucacugaggggcccuggucuccccgcagucgucccaggcugccggcuccccucgacag

SEQ ID NO: 344285 - RNA, 64 nt, Homo Sapiens
acaggcucuagagagagggagaaacaaguggaccucgucccaucuucacucuucacuugaguug

SEQ ID NO: 344286 - RNA, 64 nt, Homo Sapiens
ucucucucccaguacaccagcugaugguucccccucgucccaaaauuccuggcuucauuuuuug

SEQ ID NO: 344287 - RNA, 64 nt, Homo Sapiens
gcaccgccuggcugagggcgcccaauacgcugcuucgucccacugugccgaugcucuggcccuc

SEQ ID NO: 344288 - RNA, 64 nt, Homo Sapiens
cggagggcacagacaccggcggggccugggucucucgucccaccgagugccgaccuuggguggc

SEQ ID NO: 344289 - RNA, 64 nt, Homo Sapiens
ggaaggagagcuccugacucuguauguuguauugucgucccaacgaccauggaccucuuuuguu

SEQ ID NO: 344290 - RNA, 64 nt, Homo Sapiens
auagcaaaggucuucuucccucgccccuucuccaucgucccaggaaucccagggggcagcacag

SEQ ID NO: 344291 - RNA, 64 nt, Homo Sapiens
uccguaggaaaaagucggaaugcucucgacggccucgucccagccugggacaggcccccuuucc

SEQ ID NO: 344292 - RNA, 64 nt, Homo Sapiens
gggcaucagggugagguccgggacucuugggucaucgucccacaguggcugaucggcugccaag

SEQ ID NO: 344293 - RNA, 64 nt, Homo Sapiens
cuccucgcgccucagguggaagagaccaaaggagucgucccaggagguuuuugcgaaccccaga

SEQ ID NO: 344294 - RNA, 64 nt, Homo Sapiens
uuauggauguggaaacugaguguggguaaggaagucgucccauuaauuaaaaaacacguguagc

SEQ ID NO: 344295 - RNA, 64 nt, Homo Sapiens
gagugcauucaccaccuuuuuguuguuaucugugucgucccacuaauuugcuggaguguucacc

SEQ ID NO: 344296 - RNA, 64 nt, Homo Sapiens
gcacuccagccugggcaacagcagugagccgagaucgucccacugaacccgggagguggagguu

SEQ ID NO: 344297 - RNA, 64 nt, Homo Sapiens
uuggaaauaaagcaacagacaaagaugacuaauaucgucccauuuugugggacucaccugacuc

SEQ ID NO: 344298 - RNA, 64 nt, Homo Sapiens
acuggggacuaagguugcaggccuuagccucgucucgucccagaggcauuggaucaggagaaug

SEQ ID NO: 344299 - RNA, 64 nt, Homo Sapiens
gaacccuggagguggagguugcagugagcugagaucgucccacugcacuccagcccgggcaaca

SEQ ID NO: 344300 - RNA, 64 nt, Homo Sapiens
uccuggagcagccugggcccuucagccccugugcucgucccacccuagggacucagccacuugc

SEQ ID NO: 344301 - RNA, 64 nt, Homo Sapiens
cuaaauguaagccaguugggucuuaggccuagccucgucccaaggggaggacagcucuggcccu

SEQ ID NO: 344302 - RNA, 64 nt, Homo Sapiens
aaauagaagugaaauugucuguucuagggguuauucgucccaggggggagaaagggaagucagg

SEQ ID NO: 344303 - RNA, 64 nt, Homo Sapiens
ucagguuugagucaggaggcucccuguacuggagucgucccacuauuccucaagaaaucuuaga

SEQ ID NO: 344304 - RNA, 64 nt, Homo Sapiens
aucccuuuuucaaugaauuuccaagacaaaaagccacaaugaaccccuaucccuaggcacuuaa

SEQ ID NO: 344305 - RNA, 64 nt, Homo Sapiens
uugaauuucacugucuuuaacaagugaggugugucacaaugagauuacuguacaggguuaucug

SEQ ID NO: 344306 - RNA, 64 nt, Homo Sapiens
ggccagcaucauucuaauaccaaaaccugacaggcacaaugaaaaaagaaaacuucaggcuggu

SEQ ID NO: 344307 - RNA, 64 nt, Homo Sapiens
auaucgcuaaucauuaaggaaaugcaaucaaagccacaaugagauaccaucucagaccugucug

SEQ ID NO: 344308 - RNA, 64 nt, Homo Sapiens
gcauuaucaaaauaaaguagcagaccucucaauucacaaugaguuaacugauaaaacaaaacag

SEQ ID NO: 344309 - RNA, 64 nt, Homo Sapiens
uucuugaaaacauuaaugauacaugaaucuuggccacaaugagaaaaauaaaaaugaaaaaaga

SEQ ID NO: 344310 - RNA, 64 nt, Homo Sapiens
aaauacaguagaagcucacaaauagauuucuuugcacaaugauuuuuugcaaaauuuuacagua

SEQ ID NO: 344311 - RNA, 64 nt, Homo Sapiens
guuuugugacugagaaauuucugugcuuccaauccacaaugagaugcaugauuuuguuuucauc

SEQ ID NO: 344312 - RNA, 64 nt, Homo Sapiens
ccugcaguugcuggauggauagggacaccaggaagaggacaaacugcauggacucaagcgagcu

SEQ ID NO: 344313 - RNA, 64 nt, Homo Sapiens
uaacccaccauuuauugccuucugagaggugggugaggacaagcaugugccugugugugugugu

SEQ ID NO: 344314 - RNA, 64 nt, Homo Sapiens
aguggggucacguaaaggaauugcaggucggugagaggacaagagggacucccauguucuaagc

SEQ ID NO: 344315 - RNA, 64 nt, Homo Sapiens
aggcaaagaaauaucaaguaauuguuucccagaugaggacaauguuuaaaccugagagauaggu

SEQ ID NO: 344316 - RNA, 64 nt, Homo Sapiens
uggaggagggccgaggugggaaaaccugaagacugaggacaaagaggcccuagcggcagaaagg

SEQ ID NO: 344317 - RNA, 64 nt, Homo Sapiens
aaaacugcacaauaaaaccauauggcaucucauugaggacaaaguguauagugccaccacagcu

SEQ ID NO: 344318 - RNA, 64 nt, Homo Sapiens
cccucucaggcugucccaagagagggcuacaaaggaggacaagaccugccuccacccacagugg

SEQ ID NO: 344319 - RNA, 64 nt, Homo Sapiens
uggggcaggggagggagaaguaccauuuaauggggaggacaaaaugggaauuuuauugacacag

SEQ ID NO: 344320 - RNA, 64 nt, Homo Sapiens
gaaaaaagccagguuccacauuguuucuuucucugaggacaagauaaacagaggauaucggcau

SEQ ID NO: 344321 - RNA, 64 nt, Homo Sapiens
gaggucugcucagaccuuguuuuaaaccuggugagaggacaaguauuaagauuuauuuauugua

SEQ ID NO: 344322 - RNA, 64 nt, Homo Sapiens
ccaccaugcauuaagauuuaucauaggaacccaggaggacaaaagauccuaaaagguagccucu

SEQ ID NO: 344323 - RNA, 58 nt, Homo Sapiens
aagaugcagccgggaggugaacagcagagaggacaaugcauccuucagcgugguggag

SEQ ID NO: 344324 - RNA, 64 nt, Homo Sapiens
ucagggacagaucugaugaucccaggaggcucuggaggacaaucuaggaccuacauuaucugga

SEQ ID NO: 344325 - RNA, 64 nt, Homo Sapiens; identical to SEQ ID NO: 123292

SEQ ID NO: 344326 - RNA, 64 nt, Homo Sapiens; identical to SEQ ID NO: 123293

SEQ ID NO: 344327 - RNA, 64 nt, Homo Sapiens; identical to SEQ ID NO: 123294

SEQ ID NO: 344328 - RNA, 64 nt, Homo Sapiens; identical to SEQ ID NO: 123295

SEQ ID NO: 344329 - RNA, 64 nt, Homo Sapiens; identical to SEQ ID NO: 123296

SEQ ID NO: 344330 - RNA, 64 nt, Homo Sapiens; identical to SEQ ID NO: 123297

SEQ ID NO: 344331 - RNA, 64 nt, Homo Sapiens; identical to SEQ ID NO: 123298

SEQ ID NO: 344332 - RNA, 64 nt, Homo Sapiens; identical to SEQ ID NO: 123299

SEQ ID NO: 344333 - RNA, 64 nt, Homo Sapiens; identical to SEQ ID NO: 123300

SEQ ID NO: 344334 - RNA, 64 nt, Homo Sapiens; identical to SEQ ID NO: 123301

SEQ ID NO: 344335 - RNA, 64 nt, Homo Sapiens; identical to SEQ ID NO: 123302

SEQ ID NO: 344336 - RNA, 64 nt, Homo Sapiens; identical to SEQ ID NO: 123303

SEQ ID NO: 344337 - RNA, 64 nt, Homo Sapiens; identical to SEQ ID NO: 123304

SEQ ID NO: 344338 - RNA, 64 nt, Homo Sapiens; identical to SEQ ID NO: 123305

SEQ ID NO: 344339 - RNA, 64 nt, Homo Sapiens; identical to SEQ ID NO: 123306

SEQ ID NO: 344340 - RNA, 64 nt, Homo Sapiens; identical to SEQ ID NO: 123307

SEQ ID NO: 344341 - RNA, 62 nt, Homo Sapiens
agggucuguccccagaugcugugugcauagaccauuuccaggaagucuaaccagccucagca

SEQ ID NO: 344342 - RNA, 62 nt, Homo Sapiens
ucuguagaguuuauugucaagacacuuuugaacauuuccaguaaacagccagaagccaccuu

SEQ ID NO: 344343 - RNA, 62 nt, Homo Sapiens
cauguaccauguuuuauaaaaaguaucuaacucauuuccaaaucaguguguuuagacuuuuc

SEQ ID NO: 344344 - RNA, 62 nt, Homo Sapiens
cuugaaauauaggugugaaccuugcaaauaugcauuuccaaaugaauacuuuuguauugcug

SEQ ID NO: 344345 - RNA, 62 nt, Homo Sapiens
auuaaaaaaaaaauccauuuuacuagguguuucauuuccagaaagacaagaggaagggcagg

SEQ ID NO: 344346 - RNA, 62 nt, Homo Sapiens
gaccacaugugagcuucuuuccacagcuucagcauuuccagacugaaaauaaugucuacagu

SEQ ID NO: 344347 - RNA, 62 nt, Homo Sapiens
aguuuuucagaaaaugcaucccugauuucauucauuuccagcuugaaagccagccauauuac

SEQ ID NO: 344348 - RNA, 62 nt, Homo Sapiens
acucuagucccuaccaaacugcucuagaaggucauuuccauuuuguuugugauauuuagacg

SEQ ID NO: 344349 - RNA, 62 nt, Homo Sapiens
caccauggacucaaucugagaacaacagcauucauuuccauucauuuccauacuggcuuuug

SEQ ID NO: 344350 - RNA, 62 nt, Homo Sapiens
ucaaucugagaacaacagcauucauuuccauucauuuccauacuggcuuuugauuauaugca

SEQ ID NO: 344351 - RNA, 62 nt, Homo Sapiens
aguagcauaaacuuacgguggcuacauuuguucauuuccagccaacuuuucuuccuuauggg

SEQ ID NO: 344352 - RNA, 62 nt, Homo Sapiens
ugcaaagugacuagagaaaauuucaauucuuacauuuccauucuugaggguagagccacaaa

SEQ ID NO: 344353 - RNA, 62 nt, Homo Sapiens
caucuucugaaaacuaggcgugggcauugaggcauuuccauacccugcagcaaacguuugcc

SEQ ID NO: 344354 - RNA, 62 nt, Homo Sapiens
uacugcugcagcauuuugguugcaaaauaacucauuuccaacgugauugaacacuuuaguaa

SEQ ID NO: 344355 - RNA, 62 nt, Homo Sapiens
uaauguuuuuuucacuuaauauuuuauauauacauuuccauguauugauguaguuaguccac

SEQ ID NO: 344356 - RNA, 62 nt, Homo Sapiens
auguuuucauaggcuauuauauauucucgcagcauuuccaguuaagaggauauuagguauau

SEQ ID NO: 344357 - RNA, 62 nt, Homo Sapiens
auguuacccaaacucaucuucuaaaaucugugcauuuccaugguggcugacacacuugucau

SEQ ID NO: 344358 - RNA, 62 nt, Homo Sapiens
caaagugagcauuucuuuuuaaauuuucuugacauuuccaagcuuauuaugaauaauauugc

SEQ ID NO: 344359 - RNA, 62 nt, Homo Sapiens
aacuccacuguuucuauaauacaucacuaaaacauuuccacuccuuagauaucaguuaggau

SEQ ID NO: 344360 - RNA, 62 nt, Homo Sapiens
ugccuuauugcuacuucaaguauggaaaaugacauuuccauugagaaaagauaucacaacuc

SEQ ID NO: 344361 - RNA, 62 nt, Homo Sapiens
ccaccacaaaguugccacagcucacuguagcccauuuccacccaucccaacuucauuucccc

SEQ ID NO: 344362 - RNA, 62 nt, Homo Sapiens
uuguucuguauaggaacagagagcguccguagcauuuccaguaacuggaagugcaugaggca

SEQ ID NO: 344363 - RNA, 62 nt, Homo Sapiens
uaacuguuguguugaaucagucucacauuuuccauuuccaaaccaaccagauucaugagcuu

SEQ ID NO: 344364 - RNA, 62 nt, Homo Sapiens
ugaaggagaggcaaggaaaaaaaugagugugucauuuccacagcacugggcuuuaaagagcg

SEQ ID NO: 344365 - RNA, 62 nt, Homo Sapiens
ccuaccugcgcagucuaaacauagcuguggaucauuuccaacuuucaacuucacuccgggcc

SEQ ID NO: 344366 - RNA, 62 nt, Homo Sapiens
cgaggcugguuuccugugcagcagguggaguucauuuccaacccagagguccgugcacagaa

SEQ ID NO: 344367 - RNA, 62 nt, Homo Sapiens
uggauaaaccaaggauuuuguguuuaacaauccauuuccagugucuucgccacauaaaauag

SEQ ID NO: 344368 - RNA, 62 nt, Homo Sapiens
uaaaaggauaguuuaugaguaaucuuuaaaaccauuuccauaccaucuguauauaaccauuu

SEQ ID NO: 344369 - RNA, 62 nt, Homo Sapiens
uuuagauccuacuccauacccugcggccagcacauuuccacugggauuccaggcgugagcca

SEQ ID NO: 344370 - RNA, 62 nt, Homo Sapiens
uuauuuguuuguuuguuuauauggccuuccuacauuuccacucccugugcuccuuaagccuc

SEQ ID NO: 344371 - RNA, 62 nt, Homo Sapiens
agaaaaugggcagagagagaugaccucggaagcauuuccacagauggugucaggguuucaag

SEQ ID NO: 344372 - RNA, 62 nt, Homo Sapiens
gccaacuguggucaaaguucauaggugucguacauuuccauuauuugcuaaaaucaugcaau

SEQ ID NO: 344373 - RNA, 62 nt, Homo Sapiens
uuacuaucaaauuauaguaauuguaccagaaacauuuccaauagucuuugcaucagcuuacc

SEQ ID NO: 344374 - RNA, 62 nt, Homo Sapiens
accauggauucugccuuugggaagcaucguggcauuuccagaagaaugcccagaaagugcca

SEQ ID NO: 344375 - RNA, 62 nt, Homo Sapiens
uucauuuucgagccaucaguauauggcugcuacauuuccauuacagauccaaaguuagcagu

SEQ ID NO: 344376 - RNA, 62 nt, Homo Sapiens
aggaaagggaaagucaugauauuuuauucuugcauuuccauagguucauuguuuaaugaaau

SEQ ID NO: 344377 - RNA, 62 nt, Homo Sapiens
ucaucacuguuggagaucauugggggaggucccauuuccacuuugggcaaccuccuucgacg

SEQ ID NO: 344378 - RNA, 60 nt, Homo Sapiens; identical to SEQ ID NO: 59927

SEQ ID NO: 344379 - RNA, 62 nt, Homo Sapiens
ucaacucuaaaugaagucuugacagguuaugacauuuccaugaaguguucugaccagggagu

SEQ ID NO: 344380 - RNA, 62 nt, Homo Sapiens
ucuuuucagugaucuggauaaaaggacaaauacauuuccagauguauauacuuugccacugg

SEQ ID NO: 344381 - RNA, 62 nt, Homo Sapiens
aucguccauucuuuuaaauguugucucacuugcauuuccagucuuggccaucaaaucaauga

SEQ ID NO: 344382 - RNA, 62 nt, Homo Sapiens
acaaaguggcaucucauggugguuuuaauuugcauuuccauaauaucuaauuagguugagcu

SEQ ID NO: 344383 - RNA, 62 nt, Homo Sapiens
guguaggcaauuauguccugugacucaccccucauuuccagaaaauuuaauuuugaaaaagg

SEQ ID NO: 344384 - RNA, 62 nt, Homo Sapiens
aacguauuuauagcaugaagguuucuaccaaacauuuccagacgaaaaaagaaaagaaaucu

SEQ ID NO: 344385 - RNA, 64 nt, Homo Sapiens; identical to SEQ ID NO: 245086

SEQ ID NO: 344386 - RNA, 64 nt, Homo Sapiens; identical to SEQ ID NO: 245087

SEQ ID NO: 344387 - RNA, 64 nt, Homo Sapiens; identical to SEQ ID NO: 245088

SEQ ID NO: 344388 - RNA, 64 nt, Homo Sapiens
auguagaauaaaaauuuuaaaucucacuucacuuagccgacauuccaugcccugaccaauccua

SEQ ID NO: 344389 - RNA, 64 nt, Homo Sapiens
agaaagagaacaaggagcuugccaggcuucauguagccgacacacgucucaggauuuuaagucc

SEQ ID NO: 344390 - RNA, 64 nt, Homo Sapiens
uauuucggccuuuugggggucagcaucuguagucagccgacaacccaaaauaaaacaaagggca

SEQ ID NO: 344391 - RNA, 64 nt, Homo Sapiens
guuguuagaacucagaggaagaggcaggggcagcagccgacagggggcagcaugacccaagcaa

SEQ ID NO: 344392 - RNA, 64 nt, Homo Sapiens
ggggaggagccuuaucaaugauucagcaucagacagccgacacuuugaucagaggaugcauauu

SEQ ID NO: 344393 - RNA, 64 nt, Homo Sapiens
aagaguuuaguuuuuuuacuugcaucuauuucagagccgacaugagcgaauguaugaaugaaaa

SEQ ID NO: 344394 - RNA, 64 nt, Homo Sapiens
gagaccgguggccugcagaccauugcccaccgggagccgacaccugaccuagcacacacugaca

SEQ ID NO: 344395 - RNA, 64 nt, Homo Sapiens
cacucccgggccaagacagauggacacugccaagagccgacaaugcccugcuggccugucuccc

SEQ ID NO: 344396 - RNA, 64 nt, Homo Sapiens
ugcucaguccuaucccucguccagugccugugugagccgacaucccgcuguugaugugcaguuc

SEQ ID NO: 344397 - RNA, 64 nt, Homo Sapiens
aucucagggaauguagccccugggcccuggcuuaagccgacacuccugaccucucuguucaccc

SEQ ID NO: 344398 - RNA, 64 nt, Homo Sapiens
cucucugacuggggccccuggcccggccccacccagccgacauguuuucuuuggccuggguggu

SEQ ID NO: 344399 - RNA, 64 nt, Homo Sapiens
aagucaggccgcaccugucuguuuuuggaaggguagccgacaaauccuuccagagggaaaguuc

SEQ ID NO: 344400 - RNA, 64 nt, Homo Sapiens
cagggauguagcuaacaccacaccagcggccgucagccgacacucggcuuuucaggcuugcccu

SEQ ID NO: 344401 - RNA, 64 nt, Homo Sapiens
ccaaugacaggugaaacccagacacucuccuuagagccgacagguugauccugcuguguugaag

SEQ ID NO: 344402 - RNA, 64 nt, Homo Sapiens
cggacuccucggagcagccgucucggggcuggugagccgacagccuccaucuuuggcuccggcu

SEQ ID NO: 344403 - RNA, 64 nt, Homo Sapiens
ucucugccaucagcccuacguccagagggagaggagccgacacccccagagccagugccccauc

SEQ ID NO: 344404 - RNA, 52 nt, Homo Sapiens
uuuuuucaacagugaagacagaagccgacaccacaccgccuauauuaaguga

SEQ ID NO: 344405 - RNA, 64 nt, Homo Sapiens
cagggagacgggggccuggacccaccccagaacaagccgacacagcucugagacagagcaaaca

SEQ ID NO: 344406 - RNA, 64 nt, Homo Sapiens
ggggcugcagccuccucuuucugucucugaucagagccgacaccagacgugauuagcaggcgca

SEQ ID NO: 344407 - RNA, 64 nt, Homo Sapiens
uacaggaagaagugcgaguccauuguggagccaaagccgacauuaaaguauguguccuuugugg

SEQ ID NO: 344408 - RNA, 64 nt, Homo Sapiens
uuccuuuggucuuucugaauuugggggaugagugagccgacacugaagcuguucaaccacccgu

SEQ ID NO: 344409 - RNA, 64 nt, Homo Sapiens
cgaguguggugccugagcugugagaaguguccucagccgacacucacgagggcagugcaaggga

SEQ ID NO: 344410 - RNA, 64 nt, Homo Sapiens
cagaccaugaggagccaagaccagcaggucccacagccgacagugcccagagcaugcagggaac

SEQ ID NO: 344411 - RNA, 64 nt, Homo Sapiens
caagguguucguggggcuggcucaggaggccagaagccgacacugcuucagccacagagacaca

SEQ ID NO: 344412 - RNA, 64 nt, Homo Sapiens
cccaguccugugagcucaggucaggaggguccaaagccgacauuggaaucucaacaaccaggga

SEQ ID NO: 344413 - RNA, 64 nt, Homo Sapiens
cagaaagcgggcagcaggccccgauaccgggaagagccgacacagccacgaaccagacaagcag

SEQ ID NO: 344414 - RNA, 64 nt, Homo Sapiens
gaggcugagaacugggcagacaccccuggagcucagccgacaguuuugaugagcagggaagucu

SEQ ID NO: 344415 - RNA, 64 nt, Homo Sapiens
augccacugcacuccagccuuggagguugcagugagccgacaucaaucacuugaauucaggagg

SEQ ID NO: 344416 - RNA, 64 nt, Homo Sapiens
cucagccccaccgacccacucuacccuaacccucagccgacagugcuuccagacccuaccagca

SEQ ID NO: 344417 - RNA, 64 nt, Homo Sapiens
ucccucuugcccagggaacucuuccacaggacaaagccgacaucaagacucaacuccucuaacc

SEQ ID NO: 344418 - RNA, 64 nt, Homo Sapiens
gucucggaucaggcucccagguguguccccuugcagccgacacguagucaacaguacccugguu

SEQ ID NO: 344419 - RNA, 64 nt, Homo Sapiens
aguugcuuccauuggcaugguggaacaugaaaggagccgacaaagaucuccaggcccaugagga

SEQ ID NO: 344420 - RNA, 64 nt, Homo Sapiens
uuucaggauuucagucacauccuugugcugcaggagccgacaccguacccagauguaucauuau

SEQ ID NO: 344421 - RNA, 64 nt, Homo Sapiens
gguagcuucucaaguuaugagucuuuaaaagcauagccgacaaugcagcaagaauggaccugau

SEQ ID NO: 344422 - RNA, 64 nt, Homo Sapiens
agagacuggacugugggcccgcaagaccagcuuuagccgacaacccaggguagaggcugacggc

SEQ ID NO: 344423 - RNA, 64 nt, Homo Sapiens
cagcgccuaccaugugcagcgcuggugguuucauagccgacacagugaacagggcacgcggugg

SEQ ID NO: 344424 - RNA, 64 nt, Homo Sapiens
uaaagaggcugcuggagagugcguggccauagggagccgacaugcccgggaggaaagguguuga

SEQ ID NO: 344425 - RNA, 64 nt, Homo Sapiens
cccucuuacagccguggauguggcuauggagagcagccgacaccugaugauuuuugcagccacu

SEQ ID NO: 344426 - RNA, 64 nt, Homo Sapiens
uaauuauaucuguuuuguuucuugacucuguccaaucagagaauaaacaucauaguuucuuggc

SEQ ID NO: 344427 - RNA, 64 nt, Homo Sapiens
gguaugauuguaaagauugagcauuggaagggguaucagagaccauguaguucaacuuuccacu

SEQ ID NO: 344428 - RNA, 64 nt, Homo Sapiens
gcuucaguaauucucagugugugagcugccuaggaucagagagccuucauggaaguggccacua

SEQ ID NO: 344429 - RNA, 64 nt, Homo Sapiens
gaccaccagagaggagagggaaccagauaugcagaucagagauagaggaaguggaaccagagag

SEQ ID NO: 344430 - RNA, 64 nt, Homo Sapiens
ccauacuggugaaaaauuguacucugacuuacccaucagagaagugaaaaaagcuucuaacaaa

SEQ ID NO: 344431 - RNA, 64 nt, Homo Sapiens
ucauuaagaugaggacaaauaaaauuauuuauguaucagagaacaagcuguaauaccaauauua

SEQ ID NO: 344432 - RNA, 64 nt, Homo Sapiens
aaaacauuuuuucaaaaacuacagcuuggaaaacaucagagaguucauacuaaaauauauuuuu

SEQ ID NO: 344433 - RNA, 64 nt, Homo Sapiens
ucacaugugaaagcaagugaucuguuguugcugaaucagagauaugagagauucuuuuuuauag

SEQ ID NO: 344434 - RNA, 64 nt, Homo Sapiens
aaaagcuucagucuggacucuacuauugaugcagaucagagaguucuuagaauacagaauaccg

SEQ ID NO: 344435 - RNA, 64 nt, Homo Sapiens
aaaauuuuccaucagagcucagcccuuacuagacaucagagaauccauacuagagagaagcccu

SEQ ID NO: 344436 - RNA, 64 nt, Homo Sapiens
ucacacagguuaguguggaccaaacaccuuguacaucagagagucagaaacuccugccugaagu

SEQ ID NO: 344437 - RNA, 64 nt, Homo Sapiens
ccuuucaguauagugaaucaagaccucauuuuauaucagagaacgggaaggcuucucugaaguc

SEQ ID NO: 344438 - RNA, 64 nt, Homo Sapiens
uguggaaaagacauccuuucgaaccucaaauaugaucagagaauggaggcuagagagucaagga

SEQ ID NO: 344439 - RNA, 64 nt, Homo Sapiens
ucacauaggaaagaaaccagaacccucacugugaaucagagaauagaagacagucccagaagua

SEQ ID NO: 344440 - RNA, 64 nt, Homo Sapiens
cacaaaaaaccaauugagggauaccccauuugauaucagagauaaaauccuuuugacaaaagga

SEQ ID NO: 344441 - RNA, 64 nt, Homo Sapiens; identical to SEQ ID NO: 344430

SEQ ID NO: 344442 - RNA, 64 nt, Homo Sapiens; identical to SEQ ID NO: 344431

SEQ ID NO: 344443 - RNA, 64 nt, Homo Sapiens
ggacacacagcccguucgaaguugucuuucugccaucagagaagucagccgucuuucugcuggu

SEQ ID NO: 344444 - RNA, 64 nt, Homo Sapiens
cagaggauuuuaauuuuuagagguuuacaagaucaucagagaaaagguaauucaagcccucauc

SEQ ID NO: 344445 - RNA, 64 nt, Homo Sapiens
cauuguuaauguggaacaauuuaacacuaaucucaucagagagcgagaugaauguggcaauugc

SEQ ID NO: 344446 - RNA, 64 nt, Homo Sapiens
uaugcaggagcaguaaacuggcagaaaaccaggaaucagagaaagaaaauauaauuuaacuuua

SEQ ID NO: 344447 - RNA, 64 nt, Homo Sapiens
ugauuccaaagagcacagaagagcuauaugauuuaucagagaucaaaacauaugugaugaaauu

SEQ ID NO: 344448 - RNA, 64 nt, Homo Sapiens
aaaaacugggaagacauaaauacacagagaagagaucagagaggaggagaccacugcugacaga

SEQ ID NO: 344449 - RNA, 64 nt, Homo Sapiens
aaauucuuuguggacagcuguacacugaagagucaucagagaguucacacuggagaaagaccuu

SEQ ID NO: 344450 - RNA, 64 nt, Homo Sapiens
aaauccuuuagaugucgcuccacacuugauacacaucagagaauucacacuggugaaaggccuu

SEQ ID NO: 344451 - RNA, 64 nt, Homo Sapiens
aaaucauuucgccgaagcucuucacucuugcagcaucagagaguucacacuagagaaaggccuu

SEQ ID NO: 344452 - RNA, 64 nt, Homo Sapiens
aaaucauuucgccacaguucuucguuccgucgccaucagagaguucauacuggaaugaggccuu

SEQ ID NO: 344453 - RNA, 64 nt, Homo Sapiens
ucacaguggaaauaucuaagaagucuauguaaauaucagagaauuaaaacauuuaauccaaaau

SEQ ID NO: 344454 - RNA, 64 nt, Homo Sapiens
acuuaaaaaaaguauuauaaacaucuuacucaacaucagagaguaaagccauuaaugucugcuc

SEQ ID NO: 344455 - RNA, 64 nt, Homo Sapiens
uuacaguagaaauauguaaguuaagucuguaaauaucagagaauuuuuuuaaaaauuuuaauca

SEQ ID NO: 344456 - RNA, 64 nt, Homo Sapiens
ucauacucaauaaaaacauaacaucuuacucaacaucagagaguaaagccauuaauacaugcuc

SEQ ID NO: 344457 - RNA, 64 nt, Homo Sapiens
ucacacuagugagaaaccgucuaccuuaauagaaaucagagaauggaaggccuuugcuuguuuc

SEQ ID NO: 344458 - RNA, 64 nt, Homo Sapiens
ucacaaaggagagaaacccuugauuuuaauagacaucagagaauaaugccuucauuuguuuuuu

SEQ ID NO: 344459 - RNA, 56 nt, Homo Sapiens
ucacaguggggagaaacccuugagacaucagagaaucaagcauaaugcacaucuaa

SEQ ID NO: 344460 - RNA, 64 nt, Homo Sapiens
uucauucuugagagaauccucacuccuacacagcaucagagaaucaagguuuucagucacaauu

SEQ ID NO: 344461 - RNA, 64 nt, Homo Sapiens
aaccauacaaguauaauaaaaucaaagaauuuauaucagagagaaaguuuaaauccugugaguc

SEQ ID NO: 344462 - RNA, 64 nt, Homo Sapiens; identical to SEQ ID NO: 104452

SEQ ID NO: 344463 - RNA, 64 nt, Homo Sapiens; identical to SEQ ID NO: 104453

SEQ ID NO: 344464 - RNA, 64 nt, Homo Sapiens; identical to SEQ ID NO: 104454

SEQ ID NO: 344465 - RNA, 64 nt, Homo Sapiens; identical to SEQ ID NO: 104455

SEQ ID NO: 344466 - RNA, 64 nt, Homo Sapiens; identical to SEQ ID NO: 104456

SEQ ID NO: 344467 - RNA, 64 nt, Homo Sapiens; identical to SEQ ID NO: 104457

SEQ ID NO: 344468 - RNA, 64 nt, Homo Sapiens; identical to SEQ ID NO: 104458

SEQ ID NO: 344469 - RNA, 64 nt, Homo Sapiens; identical to SEQ ID NO: 104459

SEQ ID NO: 344470 - RNA, 64 nt, Homo Sapiens; identical to SEQ ID NO: 104460

SEQ ID NO: 344471 - RNA, 64 nt, Homo Sapiens; identical to SEQ ID NO: 104461

SEQ ID NO: 344472 - RNA, 64 nt, Homo Sapiens; identical to SEQ ID NO: 104462

SEQ ID NO: 344473 - RNA, 64 nt, Homo Sapiens; identical to SEQ ID NO: 104463

SEQ ID NO: 344474 - RNA, 64 nt, Homo Sapiens; identical to SEQ ID NO: 104464

SEQ ID NO: 344475 - RNA, 64 nt, Homo Sapiens; identical to SEQ ID NO: 104465

SEQ ID NO: 344476 - RNA, 64 nt, Homo Sapiens; identical to SEQ ID NO: 104466

SEQ ID NO: 344477 - RNA, 64 nt, Homo Sapiens; identical to SEQ ID NO: 104467

SEQ ID NO: 344478 - RNA, 64 nt, Homo Sapiens; identical to SEQ ID NO: 104468

SEQ ID NO: 344479 - RNA, 64 nt, Homo Sapiens; identical to SEQ ID NO: 104469

SEQ ID NO: 344480 - RNA, 64 nt, Homo Sapiens; identical to SEQ ID NO: 104470

SEQ ID NO: 344481 - RNA, 64 nt, Homo Sapiens; identical to SEQ ID NO: 104471

SEQ ID NO: 344482 - RNA, 64 nt, Homo Sapiens; identical to SEQ ID NO: 104472

SEQ ID NO: 344483 - RNA, 64 nt, Homo Sapiens; identical to SEQ ID NO: 104473

SEQ ID NO: 344484 - RNA, 64 nt, Homo Sapiens; identical to SEQ ID NO: 104474

SEQ ID NO: 344485 - RNA, 64 nt, Homo Sapiens; identical to SEQ ID NO: 104475

SEQ ID NO: 344486 - RNA, 64 nt, Homo Sapiens; identical to SEQ ID NO: 104476

SEQ ID NO: 344487 - RNA, 64 nt, Homo Sapiens; identical to SEQ ID NO: 104477

SEQ ID NO: 344488 - RNA, 64 nt, Homo Sapiens; identical to SEQ ID NO: 104478

SEQ ID NO: 344489 - RNA, 64 nt, Homo Sapiens; identical to SEQ ID NO: 104479

SEQ ID NO: 344490 - RNA, 64 nt, Homo Sapiens; identical to SEQ ID NO: 104480

SEQ ID NO: 344491 - RNA, 64 nt, Homo Sapiens; identical to SEQ ID NO: 167767

SEQ ID NO: 344492 - RNA, 64 nt, Homo Sapiens; identical to SEQ ID NO: 167768

SEQ ID NO: 344493 - RNA, 64 nt, Homo Sapiens; identical to SEQ ID NO: 167769

SEQ ID NO: 344494 - RNA, 64 nt, Homo Sapiens; identical to SEQ ID NO: 167770

SEQ ID NO: 344495 - RNA, 64 nt, Homo Sapiens; identical to SEQ ID NO: 167771

SEQ ID NO: 344496 - RNA, 64 nt, Homo Sapiens; identical to SEQ ID NO: 167772

SEQ ID NO: 344497 - RNA, 64 nt, Homo Sapiens; identical to SEQ ID NO: 167773

SEQ ID NO: 344498 - RNA, 64 nt, Homo Sapiens; identical to SEQ ID NO: 167774

SEQ ID NO: 344499 - RNA, 64 nt, Homo Sapiens; identical to SEQ ID NO: 167775

SEQ ID NO: 344500 - RNA, 64 nt, Homo Sapiens; identical to SEQ ID NO: 167776

SEQ ID NO: 344501 - RNA, 63 nt, Homo Sapiens
uauuuugaaauggacugugaaggaaaaggggacaggaacaaaggaccaaaaauaagcuacaug

SEQ ID NO: 344502 - RNA, 63 nt, Homo Sapiens
aaauguggaacauuauuaacuuacuuugugucuaggaacaauggauuuuguaucugauuuaaa

SEQ ID NO: 344503 - RNA, 63 nt, Homo Sapiens
augaucuuguuacugugauacccgcaauacuguaggaacaagcgcuuucacuuaagugucugg

SEQ ID NO: 344504 - RNA, 63 nt, Homo Sapiens
augucucucugccaagaucccuuuccaauccagaggaacaagcgauucccgagaguaaaucau

SEQ ID NO: 344505 - RNA, 63 nt, Homo Sapiens
agcuuucagugaaacacuacauacacgaagaaaaggaacaagguuuaacuauuuaagaaccau

SEQ ID NO: 344506 - RNA, 63 nt, Homo Sapiens
cacgaucaugucccuuuuuaagccuuaccugagaggaacaaugccuuaaaauaaaaaagcauu

SEQ ID NO: 344507 - RNA, 63 nt, Homo Sapiens
auuaauacagauacucagaauucauaugcuggcaggaacaacucaguuguguauuuguucauc

SEQ ID NO: 344508 - RNA, 63 nt, Homo Sapiens
gaaagagcugaaggccaccugcaauugcagcuaaggaacaaugggcucaucucaggacagaag

SEQ ID NO: 344509 - RNA, 63 nt, Homo Sapiens
ccccagaaaagaaagggaagugcaaguggacaaaggaacaagcaucuauagaaagaauuuagc

SEQ ID NO: 344510 - RNA, 63 nt, Homo Sapiens
gaggucccuguuaggguucuuggcaggacucacaggaacaaacagcacccauuaaacaagucc

SEQ ID NO: 344511 - RNA, 63 nt, Homo Sapiens
gucuuuugaacuuccaguagcaaccucagaaacaggaacaaucauuuucuugcauuuagaugu

SEQ ID NO: 344512 - RNA, 63 nt, Homo Sapiens
uagcacugaauuuuggguggauccacuugcccuaggaacaagugcacuguuccaguaguuaua

SEQ ID NO: 344513 - RNA, 63 nt, Homo Sapiens
aaagagcuccugaaggaagcacuaaacauggaaaggaacaacugauaccagccgcugcaaaau

SEQ ID NO: 344514 - RNA, 63 nt, Homo Sapiens
aguuggaaguaaagcacuccucagcaaauguaaaggaacaaaaauuauaacaaacugucucuc

SEQ ID NO: 344515 - RNA, 63 nt, Homo Sapiens
uccagaaucuacaaugaacucaaacaaauuuacaggaacaaacaaccccaucaaaaagucggc

SEQ ID NO: 344516 - RNA, 63 nt, Homo Sapiens
aaaugaaaaaagagcaggcauccauuuccauacaggaacaaaauaggaggcagcacuacagac

SEQ ID NO: 344517 - RNA, 63 nt, Homo Sapiens
guauauauuuacacaaauacauuugaucagacuaggaacaaguugauaccaaaaccugaaaag

SEQ ID NO: 344518 - RNA, 64 nt, Homo Sapiens
cuuuuaaaggaaugugaaauuuaaauaauagacauacagagauauacaaauauauuauauauuu

SEQ ID NO: 344519 - RNA, 64 nt, Homo Sapiens
gggaucaucugaacagaagugcacaggcuacuuguacagagaaaaaauuaauacucaaaggaaa

SEQ ID NO: 344520 - RNA, 64 nt, Homo Sapiens
uuagccuuuuuuccccagacuuguuggcguaggcuacagagaagccuucaagcucugagggaaa

SEQ ID NO: 344521 - RNA, 64 nt, Homo Sapiens
agaaaaacaggcacuuggcagccuugugaugucauacagagaagucacagggcaguaccugagg

SEQ ID NO: 344522 - RNA, 64 nt, Homo Sapiens
agguccaaugagcuuucugaacagcugguguagcuacagagaaaccagcuuccuucagagagca

SEQ ID NO: 344523 - RNA, 64 nt, Homo Sapiens
ugcuuauuuauuguauucugggguauggcguaaguacagagaagccaucaccucagauggcagc

SEQ ID NO: 344524 - RNA, 64 nt, Homo Sapiens
cuggccauggagaaagcugacuuggcuggugugguacagagaagccagcuuguuuacaugcuua

SEQ ID NO: 344525 - RNA, 64 nt, Homo Sapiens
gaagaagaaaguauuaaagccccuucugcucuacuacagagaguaauugugcaugguuuuggac

SEQ ID NO: 344526 - RNA, 64 nt, Homo Sapiens
guguguucugcaauaugccugcagaguugaaguuuacagagaugaacugaguggccuauuucau

SEQ ID NO: 344527 - RNA, 64 nt, Homo Sapiens
auagagcuagacaaagcccuuguugguaggugccuacagagacugguagcaggagaaggaccgg

SEQ ID NO: 344528 - RNA, 64 nt, Homo Sapiens
ucagcuugaagcuggaagcauggggucgaccccauacagagaacgaugguuuauugggaacugc

SEQ ID NO: 344529 - RNA, 64 nt, Homo Sapiens
cucaauguaauucccuucccagcuacccaaaugcuacagagaaauguuuucuacuuggccacua

SEQ ID NO: 344530 - RNA, 64 nt, Homo Sapiens
uccuuuuuuauuuuucuucuguacagucuaaagcuacagagaaaaaaaaaugcacucuucccuu

SEQ ID NO: 344531 - RNA, 64 nt, Homo Sapiens
aaacaugacagucugaguaaacuuggguuuaauuuacagagaugccacaggugauuuuuaagua

SEQ ID NO: 344532 - RNA, 64 nt, Homo Sapiens
cuaaaggugaaaauggaugauaaguuaaaaaaacuacagagacauaauuuuuuuuuuuuuuuug

SEQ ID NO: 344533 - RNA, 64 nt, Homo Sapiens
uuaccuuugcuuuaaaacucucauguauguuaucuacagagaggaucauuacagagacagacuc

SEQ ID NO: 344534 - RNA, 64 nt, Homo Sapiens
aacucucauguauguuaucuacagagaggaucauuacagagacagacucucccgagacaugggc

SEQ ID NO: 344535 - RNA, 64 nt, Homo Sapiens
cacucucucugaguaucccaaccucuuggauguauacagagauuuuauagaauagaaccuauag

SEQ ID NO: 344536 - RNA, 64 nt, Homo Sapiens
uggaaauaacucccaggcaguaucagguggucacuacagagacuuccacaaaaacuuuugaaug

SEQ ID NO: 344537 - RNA, 64 nt, Homo Sapiens
uuaaagucugccuuauuuguuauccaaggaggucuacagagaaauuuuuaaauuacuuaucuuc

SEQ ID NO: 344538 - RNA, 64 nt, Homo Sapiens
cacuauaaacaaguacacaagucaaaugcacauuuacagagagaauuuggauggaaucucuuug

SEQ ID NO: 344539 - RNA, 64 nt, Homo Sapiens
ugucaugguaagauuucauucaacauuucuuuccuacagagaggucaacuuagcacacgugaag

SEQ ID NO: 344540 - RNA, 64 nt, Homo Sapiens
gguccccaaaguggaguguaucaugaaauugcaguacagagaugugacuuguacguguuagccu

SEQ ID NO: 344541 - RNA, 64 nt, Homo Sapiens
ugguugauucuggacccagauggauacucauggguacagagaaaaaagaugagagagaacucug

SEQ ID NO: 344542 - RNA, 64 nt, Homo Sapiens
uggucgauuccagacccagauggaaacccguagauacagagaagaaagauggaagagaguucuu

SEQ ID NO: 344543 - RNA, 64 nt, Homo Sapiens; identical to SEQ ID NO: 247720

SEQ ID NO: 344544 - RNA, 64 nt, Homo Sapiens; identical to SEQ ID NO: 247721

SEQ ID NO: 344545 - RNA, 64 nt, Homo Sapiens; identical to SEQ ID NO: 247722

SEQ ID NO: 344546 - RNA, 64 nt, Homo Sapiens; identical to SEQ ID NO: 247723

SEQ ID NO: 344547 - RNA, 64 nt, Homo Sapiens; identical to SEQ ID NO: 247724

SEQ ID NO: 344548 - RNA, 64 nt, Homo Sapiens; identical to SEQ ID NO: 247725

SEQ ID NO: 344549 - RNA, 64 nt, Homo Sapiens; identical to SEQ ID NO: 247726

SEQ ID NO: 344550 - RNA, 64 nt, Homo Sapiens; identical to SEQ ID NO: 247727

SEQ ID NO: 344551 - RNA, 64 nt, Homo Sapiens; identical to SEQ ID NO: 247728

SEQ ID NO: 344552 - RNA, 64 nt, Homo Sapiens; identical to SEQ ID NO: 247729

SEQ ID NO: 344553 - RNA, 64 nt, Homo Sapiens; identical to SEQ ID NO: 247730

SEQ ID NO: 344554 - RNA, 64 nt, Homo Sapiens; identical to SEQ ID NO: 247731

SEQ ID NO: 344555 - RNA, 64 nt, Homo Sapiens; identical to SEQ ID NO: 247732

SEQ ID NO: 344556 - RNA, 64 nt, Homo Sapiens; identical to SEQ ID NO: 247733

SEQ ID NO: 344557 - RNA, 64 nt, Homo Sapiens; identical to SEQ ID NO: 247734

SEQ ID NO: 344558 - RNA, 64 nt, Homo Sapiens; identical to SEQ ID NO: 247735

SEQ ID NO: 344559 - RNA, 64 nt, Homo Sapiens; identical to SEQ ID NO: 247736

SEQ ID NO: 344560 - RNA, 64 nt, Homo Sapiens; identical to SEQ ID NO: 247737

SEQ ID NO: 344561 - RNA, 64 nt, Homo Sapiens; identical to SEQ ID NO: 247738

SEQ ID NO: 344562 - RNA, 64 nt, Homo Sapiens; identical to SEQ ID NO: 247739

SEQ ID NO: 344563 - RNA, 64 nt, Homo Sapiens; identical to SEQ ID NO: 247740

SEQ ID NO: 344564 - RNA, 64 nt, Homo Sapiens; identical to SEQ ID NO: 247741

SEQ ID NO: 344565 - RNA, 64 nt, Homo Sapiens; identical to SEQ ID NO: 247742

SEQ ID NO: 344566 - RNA, 64 nt, Homo Sapiens; identical to SEQ ID NO: 247743

SEQ ID NO: 344567 - RNA, 64 nt, Homo Sapiens; identical to SEQ ID NO: 247744

SEQ ID NO: 344568 - RNA, 64 nt, Homo Sapiens; identical to SEQ ID NO: 247745

SEQ ID NO: 344569 - RNA, 64 nt, Homo Sapiens; identical to SEQ ID NO: 247746

SEQ ID NO: 344570 - RNA, 64 nt, Homo Sapiens; identical to SEQ ID NO: 247747

SEQ ID NO: 344571 - RNA, 64 nt, Homo Sapiens; identical to SEQ ID NO: 247748

SEQ ID NO: 344572 - RNA, 64 nt, Homo Sapiens; identical to SEQ ID NO: 247749

SEQ ID NO: 344573 - RNA, 64 nt, Homo Sapiens; identical to SEQ ID NO: 247750

SEQ ID NO: 344574 - RNA, 64 nt, Homo Sapiens; identical to SEQ ID NO: 247751

SEQ ID NO: 344575 - RNA, 64 nt, Homo Sapiens; identical to SEQ ID NO: 247752

SEQ ID NO: 344576 - RNA, 64 nt, Homo Sapiens; identical to SEQ ID NO: 247753

SEQ ID NO: 344577 - RNA, 64 nt, Homo Sapiens; identical to SEQ ID NO: 247754

SEQ ID NO: 344578 - RNA, 64 nt, Homo Sapiens; identical to SEQ ID NO: 247755

SEQ ID NO: 344579 - RNA, 64 nt, Homo Sapiens; identical to SEQ ID NO: 247756

SEQ ID NO: 344580 - RNA, 64 nt, Homo Sapiens; identical to SEQ ID NO: 247757

SEQ ID NO: 344581 - RNA, 64 nt, Homo Sapiens; identical to SEQ ID NO: 247758

SEQ ID NO: 344582 - RNA, 64 nt, Homo Sapiens; identical to SEQ ID NO: 247759

SEQ ID NO: 344583 - RNA, 64 nt, Homo Sapiens; identical to SEQ ID NO: 247760

SEQ ID NO: 344584 - RNA, 64 nt, Homo Sapiens; identical to SEQ ID NO: 247761

SEQ ID NO: 344585 - RNA, 64 nt, Homo Sapiens; identical to SEQ ID NO: 247762

SEQ ID NO: 344586 - RNA, 64 nt, Homo Sapiens; identical to SEQ ID NO: 247763

SEQ ID NO: 344587 - RNA, 64 nt, Homo Sapiens; identical to SEQ ID NO: 247764

SEQ ID NO: 344588 - RNA, 64 nt, Homo Sapiens; identical to SEQ ID NO: 247765

SEQ ID NO: 344589 - RNA, 64 nt, Homo Sapiens; identical to SEQ ID NO: 247766

SEQ ID NO: 344590 - RNA, 64 nt, Homo Sapiens; identical to SEQ ID NO: 247767

SEQ ID NO: 344591 - RNA, 64 nt, Homo Sapiens; identical to SEQ ID NO: 247768

SEQ ID NO: 344592 - RNA, 64 nt, Homo Sapiens; identical to SEQ ID NO: 247769

SEQ ID NO: 344593 - RNA, 64 nt, Homo Sapiens; identical to SEQ ID NO: 247770

SEQ ID NO: 344594 - RNA, 64 nt, Homo Sapiens; identical to SEQ ID NO: 247771

SEQ ID NO: 344595 - RNA, 64 nt, Homo Sapiens; identical to SEQ ID NO: 247772

SEQ ID NO: 344596 - RNA, 64 nt, Homo Sapiens; identical to SEQ ID NO: 247773

SEQ ID NO: 344597 - RNA, 64 nt, Homo Sapiens; identical to SEQ ID NO: 247774

SEQ ID NO: 344598 - RNA, 64 nt, Homo Sapiens; identical to SEQ ID NO: 247775

SEQ ID NO: 344599 - RNA, 64 nt, Homo Sapiens; identical to SEQ ID NO: 247776

SEQ ID NO: 344600 - RNA, 64 nt, Homo Sapiens; identical to SEQ ID NO: 247777

SEQ ID NO: 344601 - RNA, 64 nt, Homo Sapiens; identical to SEQ ID NO: 247778

SEQ ID NO: 344602 - RNA, 64 nt, Homo Sapiens; identical to SEQ ID NO: 247779

SEQ ID NO: 344603 - RNA, 64 nt, Homo Sapiens; identical to SEQ ID NO: 247780

SEQ ID NO: 344604 - RNA, 64 nt, Homo Sapiens; identical to SEQ ID NO: 247781

SEQ ID NO: 344605 - RNA, 64 nt, Homo Sapiens; identical to SEQ ID NO: 247782

SEQ ID NO: 344606 - RNA, 64 nt, Homo Sapiens; identical to SEQ ID NO: 247783

SEQ ID NO: 344607 - RNA, 64 nt, Homo Sapiens; identical to SEQ ID NO: 247784

SEQ ID NO: 344608 - RNA, 64 nt, Homo Sapiens; identical to SEQ ID NO: 247785

SEQ ID NO: 344609 - RNA, 64 nt, Homo Sapiens; identical to SEQ ID NO: 247786

SEQ ID NO: 344610 - RNA, 64 nt, Homo Sapiens; identical to SEQ ID NO: 247787

SEQ ID NO: 344611 - RNA, 64 nt, Homo Sapiens; identical to SEQ ID NO: 247788

SEQ ID NO: 344612 - RNA, 64 nt, Homo Sapiens; identical to SEQ ID NO: 247789

SEQ ID NO: 344613 - RNA, 64 nt, Homo Sapiens; identical to SEQ ID NO: 247790

SEQ ID NO: 344614 - RNA, 64 nt, Homo Sapiens; identical to SEQ ID NO: 247791

SEQ ID NO: 344615 - RNA, 64 nt, Homo Sapiens; identical to SEQ ID NO: 247792

SEQ ID NO: 344616 - RNA, 64 nt, Homo Sapiens; identical to SEQ ID NO: 247793

SEQ ID NO: 344617 - RNA, 53 nt, Homo Sapiens; identical to SEQ ID NO: 247794

SEQ ID NO: 344618 - RNA, 64 nt, Homo Sapiens
uccuuucguuguaggaggaaucugugcucuacuuaccucucaauuccuggagaugccaacuuca

SEQ ID NO: 344619 - RNA, 64 nt, Homo Sapiens
gaccccaccuugagccuuauuuccuaauggguccaccucucaucugcaucuuucacaccuccca

SEQ ID NO: 344620 - RNA, 64 nt, Homo Sapiens
cgaugccccucagcaagagcccccagagccaggaaccucucagccggugggggcacagcacaga

SEQ ID NO: 344621 - RNA, 64 nt, Homo Sapiens
cgaugccccccgguaugggaccccagaggcaggaaccucucagccggugggggcacagcacaga

SEQ ID NO: 344622 - RNA, 64 nt, Homo Sapiens
cgaugccccccaguaugggaccccagagccaggaaccucucagccagugggggcacagcacaga

SEQ ID NO: 344623 - RNA, 64 nt, Homo Sapiens
cgaugccccccggugugggaccccaaagccaggaaccucucagccgguggggacacagcacaga

SEQ ID NO: 344624 - RNA, 63 nt, Homo Sapiens
ggagcuugguagaaaugcagaaucuuagccuaggcaacauagggagaccucaucucugcaaaa

SEQ ID NO: 344625 - RNA, 63 nt, Homo Sapiens
ggaccagucuuacacucgcuguaguucaaguaugcaacauaaauccuguuccuuccagcugug

SEQ ID NO: 344626 - RNA, 63 nt, Homo Sapiens
guuacguaugucuggcuugauuacauggccagagcaacauaaaagcccugcugggaacuucug

SEQ ID NO: 344627 - RNA, 63 nt, Homo Sapiens
caguuuggaucucuuaguauugccuuugaaacugcaacauaagcaacucaacaauauuaguug

SEQ ID NO: 344628 - RNA, 63 nt, Homo Sapiens
uggcuugaagccaguaguucaagaccagccugggcaacauaguaagaccccaucucuaugaag

SEQ ID NO: 344629 - RNA, 63 nt, Homo Sapiens
uugcuugaguccaggaguuugagaugcgccugggcaacauagaaaccugugucuacaaaaaau

SEQ ID NO: 344630 - RNA, 63 nt, Homo Sapiens
cuauucaccuugcugcuguuauuccccgaaugcgcaacauaccccccaucaauauaucucagu

SEQ ID NO: 344631 - RNA, 63 nt, Homo Sapiens
gaaaaacucaaagaauucuuaaaaggauucauagcaacauaaugugucccugaguagaggaug

SEQ ID NO: 344632 - RNA, 63 nt, Homo Sapiens
aaacaaaagcaauucaaugucaauagacauuaagcaacauaauagacaaacaucuccuaaggg

SEQ ID NO: 344633 - RNA, 63 nt, Homo Sapiens
cauggcaauuaaucacuaaugaauuaugcgaaagcaacauauuugauaaccguugcaguaaau

SEQ ID NO: 344634 - RNA, 63 nt, Homo Sapiens
gugauuucugagggucaccacugccagccucaggcaacauagagagccuccuguucuuucuau

SEQ ID NO: 344635 - RNA, 63 nt, Homo Sapiens
gagacucagucuccgaaaaagagaccagucuaagcaacauaauucgccugagcccaggaguuu

SEQ ID NO: 344636 - RNA, 63 nt, Homo Sapiens
ccaaagggcugagccuccugugcgguggucugagcaacauagcacaaagagcauuaagaaagc

SEQ ID NO: 344637 - RNA, 63 nt, Homo Sapiens
aauacuccgucucauaaaaaagaaucagccugggcaacauagccugcuugagcccaggaguuc

SEQ ID NO: 344638 - RNA, 63 nt, Homo Sapiens
auagaaaacaccugcuacuccucuugauuuccagcaacauacuauguaccauguuuuauaaac

SEQ ID NO: 344639 - RNA, 63 nt, Homo Sapiens
cacuccuaaaucaguguguuguucauugagacagcaacauacgauaugaacuauugacccauu

SEQ ID NO: 344640 - RNA, 63 nt, Homo Sapiens
gagaucccaucucaaaaaacgagaccagccugggcaacauaguucacuugaggccaggaguuu

SEQ ID NO: 344641 - RNA, 63 nt, Homo Sapiens
gagaccccugucucccaaaaaagaccagccugggcaacauaguucaguugaggccaggaguuu

SEQ ID NO: 344642 - RNA, 63 nt, Homo Sapiens
ucauggauuuuguggagguuaagguucuauucagcaacauaguaaaauagaagcagaauagua

SEQ ID NO: 344643 - RNA, 63 nt, Homo Sapiens
aagaguaugugaaggaagcaagcaauguguuuugcaacauauuaaacaaggggggaggguaau

SEQ ID NO: 344644 - RNA, 63 nt, Homo Sapiens
ggaaguuuauuuccugacagugucugccaaaaugcaacauacgcaacacauuuuuaagaugca

SEQ ID NO: 344645 - RNA, 63 nt, Homo Sapiens
gagaccccaucucuauuuaagagacuagccugggcaacauagugcauuuuuuaaauugaguuu

SEQ ID NO: 344646 - RNA, 63 nt, Homo Sapiens
ccacucagaaacauucagguaauuuuuuuuuuugcaacauaucauguaacuuggaucuaguuu

SEQ ID NO: 344647 - RNA, 63 nt, Homo Sapiens
caaauugacugagugcaguacuaaaaguacagugcaacauauaaagagagagaaccaacguuc

SEQ ID NO: 344648 - RNA, 63 nt, Homo Sapiens
cacuuugccccaguuacaaaaauaguagaacaagcaacauaaaacaaugaaggaaaaccucac

SEQ ID NO: 344649 - RNA, 63 nt, Homo Sapiens
ccuguaugaccagguugccaguguacuggucuagcaacauagggaaaugauccauauggaaaa

SEQ ID NO: 344650 - RNA, 63 nt, Homo Sapiens
aaacacuuuuuauauaaaauaaaauuauaccuagcaacauauuauaguaaaaaaugagguggg

SEQ ID NO: 344651 - RNA, 63 nt, Homo Sapiens
ucacuuagguccaggaguucgagacuagccugggcaacauagugagacaccggaucuacaaaa

SEQ ID NO: 344652 - RNA, 63 nt, Homo Sapiens
aagaucuugucucuuaaagaaagucccaccugggcaacauaguuugcuuaagcccaggagcuc

SEQ ID NO: 344653 - RNA, 63 nt, Homo Sapiens
acaguuguauuuguccuucauacaaauguuaaugcaacauagucuaauuuggaauggguaaag

SEQ ID NO: 344654 - RNA, 63 nt, Homo Sapiens
uacauggugcacccggaccucuugucaaagcuugcaacauagccaggccagaauggguaaaga

SEQ ID NO: 344655 - RNA, 63 nt, Homo Sapiens
aagauccugucucuccaaaaaagaccagccugggcaacauagcucucuugagaauaggaguuc

SEQ ID NO: 344656 - RNA, 63 nt, Homo Sapiens
uuauagaacauuuucauuaugcuacuguacugggcaacauacacaaaucacaggugguuagug

SEQ ID NO: 344657 - RNA, 63 nt, Homo Sapiens
aaaaucucaucucuacaaaacagaccagccugggcaacauagcucauuugagcucaggaguuc

SEQ ID NO: 344658 - RNA, 63 nt, Homo Sapiens
guaugaagcauauguagcacauuaucagauggggcaacauauuaagagcaccuuuguauuuuu

SEQ ID NO: 344659 - RNA, 63 nt, Homo Sapiens
auuucgucucauuaauguugguuguucuuaacugcaacauauuucuuauuuacuccaaagccu

SEQ ID NO: 344660 - RNA, 63 nt, Homo Sapiens
uucagaaauguacaacuuuuuaccuaguacaaggcaacauauagguuguaaauguguuuaaaa

SEQ ID NO: 344661 - RNA, 63 nt, Homo Sapiens
aaaucauggauaaacugugaaccaaaauauggugcaacauacgagacaugaauauaguccaac

SEQ ID NO: 344662 - RNA, 63 nt, Homo Sapiens
cauuaaaaaaccuuccagaaucaauaauccguggcaacauaucucuguaaaaacaaacacugu

SEQ ID NO: 344663 - RNA, 63 nt, Homo Sapiens
aaugggaucacagagucuguugcuagaaucuuggcaacauacagcaggaaagccuugauaaau

SEQ ID NO: 344664 - RNA, 63 nt, Homo Sapiens
aucacuugagcccaggaguaaagaccagccugggcaacauagugagacuccgucucuacaaaa

SEQ ID NO: 344665 - RNA, 63 nt, Homo Sapiens
ccuaguuugguaacacagcuuuaacuaugucaugcaacauauauauguugguaggauguuauu

SEQ ID NO: 344666 - RNA, 63 nt, Homo Sapiens
ucaguguugucagaguauuaccacacagcaacagcaacauacagaagauauguucacucagau

SEQ ID NO: 344667 - RNA, 63 nt, Homo Sapiens
uugccugaggccaggaguuugacaccagccugggcaacauagugagaccuugucucuacaaaa

SEQ ID NO: 344668 - RNA, 63 nt, Homo Sapiens
gagacccccaucucuacaauaagaccaaccugggcaacauaguucgcuugaagcugagaguuc

SEQ ID NO: 344669 - RNA, 63 nt, Homo Sapiens
gagacccugucucuacaaauaagaccagccugggcaacauagucugcuggaaacugagaguuc

SEQ ID NO: 344670 - RNA, 63 nt, Homo Sapiens
uggcuuguucccagacccaggcucaauucaguagcaacauagcugaguucauuuccuauugcu

SEQ ID NO: 344671 - RNA, 63 nt, Homo Sapiens
gagacccuaucccuacaaaaaagaucagccuaggcaacauagguugcuugagcccaggaguuc

SEQ ID NO: 344672 - RNA, 63 nt, Homo Sapiens
gagacccccauugcuacaaaaggaccagccugggcaacauagccuccuugaggccaggaguuc

SEQ ID NO: 344673 - RNA, 63 nt, Homo Sapiens
ugcagcacaauaaugauuugcaacccuuaucuggcaacauaauuguuaaccacuguauguaac

SEQ ID NO: 344674 - RNA, 63 nt, Homo Sapiens
uuuaaagccuuucagauuacagaaagcccaccagcaacauaauuaauuuccauguaaguuacc

SEQ ID NO: 344675 - RNA, 63 nt, Homo Sapiens
aaaacccugucucuacaaaagagaccagccugggcaacauagcuuguuugaggccagaaauuu

SEQ ID NO: 344676 - RNA, 63 nt, Homo Sapiens
aagaccccgucucuacaaaggagacuagacugggcaacauagcuagcuugaggccaggaguuu

SEQ ID NO: 344677 - RNA, 63 nt, Homo Sapiens
uggcaggguacaaguaccauuaaugaagggucugcaacauaaagccuuaaaaagacacacacu

SEQ ID NO: 344678 - RNA, 63 nt, Homo Sapiens
aacaaagguacauuuuuuaaaaugucauauauugcaacauauugaugcauuugucauacguuu

SEQ ID NO: 344679 - RNA, 63 nt, Homo Sapiens
uagcuugaggccaggaguuccagaccagccugggcaacauagugagauccugucucuacaaaa

SEQ ID NO: 344680 - RNA, 63 nt, Homo Sapiens
uuauggauauauacuuugugaauugugugaauagcaacauauauacuugaauauugcuuaaag

SEQ ID NO: 344681 - RNA, 63 nt, Homo Sapiens
gagacucugucucuaaaaagguuugagaucugggcaacauauuggaauugcuugaguucagaa

SEQ ID NO: 344682 - RNA, 63 nt, Homo Sapiens
aauucaauaaauaagacuuaccuauagaaaacagcaacauauaguaaaaaaagaaucuuaucu

SEQ ID NO: 344683 - RNA, 63 nt, Homo Sapiens
uugauuaccuguucucccaaacaagcacaaccugcaacauacucggaugacaucuguuuaaaa

SEQ ID NO: 344684 - RNA, 63 nt, Homo Sapiens
ucacuuaagcccaggagucugagaccagccugggcaacauagcaagacccccaucucugcaaa

SEQ ID NO: 344685 - RNA, 63 nt, Homo Sapiens
uugcuugaguucaggaguucaagaccagccugggcaacauagcaaaaccuuaucucuacaaaa

SEQ ID NO: 344686 - RNA, 63 nt, Homo Sapiens
ggguuuggaccacaucucuuuggaaaauaguuugcaacauauuuaagagauacuugaugccaa

SEQ ID NO: 344687 - RNA, 63 nt, Homo Sapiens
ucacuugaggccaggacuuugagaccagccagggcaacauaauaagacuuuucucuacuuuaa

SEQ ID NO: 344688 - RNA, 63 nt, Homo Sapiens
augccugugaauaaccacugcacuccagccagggcaacauaacaagacucuaucuaaaaaaaa

SEQ ID NO: 344689 - RNA, 63 nt, Homo Sapiens
gugaugauacgggaugacauucguacugaaaaagcaacauacuagcaggaaagcccauuaacu

SEQ ID NO: 344690 - RNA, 63 nt, Homo Sapiens
gaaaaauguauagaugcuuggagcagcuguuaugcaacauauacagaucuuuacugaaagaga

SEQ ID NO: 344691 - RNA, 63 nt, Homo Sapiens
uguaaaauggguguuacauccaucucugauguugcaacauacgauguuuuuaaagaaaaccag

SEQ ID NO: 344692 - RNA, 63 nt, Homo Sapiens
aagucacauuuugaaaggcuaguucacaauuuugcaacauagauagagaaagcaaaacauagu

SEQ ID NO: 344693 - RNA, 63 nt, Homo Sapiens
aaaaggggaagagaggcugaaaaggaagauugagcaacauagguguguaagaaccuaggaggg

SEQ ID NO: 344694 - RNA, 63 nt, Homo Sapiens
acagaguuuaggcuggugcugccaaaaagaaaagcaacauagaguuuaaguauccaguaguga

SEQ ID NO: 344695 - RNA, 63 nt, Homo Sapiens
ggaauagguaaagucuuugaugucagugaaguggcaacauagccaaaaaguuggguaccuuuu

SEQ ID NO: 344696 - RNA, 63 nt, Homo Sapiens
acauuugauauaacaaauguguugucauuguuggcaacauacaagauaaccaagaagcuggag

SEQ ID NO: 344697 - RNA, 63 nt, Homo Sapiens
ucuucuauuccaauaaaaaguccuuuuagcaaugcaacauauuaacaaaauugggugcauuca

SEQ ID NO: 344698 - RNA, 63 nt, Homo Sapiens
gaauuugagucugggaguuugaguccagcaugggcaacauaacaagaccccaucccuuauuaa

SEQ ID NO: 344699 - RNA, 63 nt, Homo Sapiens
aaaauugguacagaaauggaaauuugccuuguugcaacauacaauugcaaaagaugaguuuaa

SEQ ID NO: 344700 - RNA, 63 nt, Homo Sapiens
gauaucauccaaguauugaggauaagaagagaugcaacauacuacuuuugugucacaauuuau

SEQ ID NO: 344701 - RNA, 63 nt, Homo Sapiens
ucauuugagcccaggaguuugagaccagcuggggcaacauauggagacuccgucucuacagaa

SEQ ID NO: 344702 - RNA, 63 nt, Homo Sapiens
uucuuuuucagaauucuugaaggaaaaugauacgcaacauaauuaaauuuugaguucuacaua

SEQ ID NO: 344703 - RNA, 63 nt, Homo Sapiens
ccuuguccuugcugcacucgcagggaccucggcgcaacauaggcugaauggcauccgccaacc

SEQ ID NO: 344704 - RNA, 63 nt, Homo Sapiens
gagacugcaucucuacaaaaaagacuagccugggcaacauagcuugcuugaggccgaggguuc

SEQ ID NO: 344705 - RNA, 63 nt, Homo Sapiens
auauggagcuaauuuguagaaaaccauacuguagcaacauaaucuaauuauuuuauaucauuu

SEQ ID NO: 344706 - RNA, 63 nt, Homo Sapiens
aaguaguuugaucuaagagguuacagaaaauuugcaacauauaaaggcaugcagucaugagaa

SEQ ID NO: 344707 - RNA, 63 nt, Homo Sapiens
uccucuaaauaaaauuacauuauagccaagucagcaacauaauugccugugaucuucuuaggu

SEQ ID NO: 344708 - RNA, 63 nt, Homo Sapiens
uuugcauuuuuacaucagaucaugaagcauccugcaacauaaauuaaaccacuugaagggacu

SEQ ID NO: 344709 - RNA, 63 nt, Homo Sapiens
ugcuuucagggucaaauuugagaaaacaagauggcaacauauacuguggcccagcacugguca

SEQ ID NO: 344710 - RNA, 63 nt, Homo Sapiens
gcagagagugauggugcuuguuagggaucaagggcaacauaguacuucuccuucacccauagu

SEQ ID NO: 344711 - RNA, 63 nt, Homo Sapiens
accaccugaggguaggagucaagaucagccugggcaacauagugagacgcugucucuacaaaa

SEQ ID NO: 344712 - RNA, 63 nt, Homo Sapiens
ucauuugaggccaggaguuugagaccugccugggcaacauaaugaaacuuccuuuccagggag

SEQ ID NO: 344713 - RNA, 63 nt, Homo Sapiens
ccuguguguuguguggaucuguuccuaguauaggcaacauaaugagauacugugcuucccacc

SEQ ID NO: 344714 - RNA, 63 nt, Homo Sapiens
uugcuugaggccaggaguuugagaccagccugggcaacauagcgagaccccaucucuacaaaa

SEQ ID NO: 344715 - RNA, 63 nt, Homo Sapiens
uugcuugagcccaggaguucaagaccagccugggcaacauaccaagacccccgucucuuuaaa

SEQ ID NO: 344716 - RNA, 63 nt, Homo Sapiens
caggaaguacaucuuuacaucauagguucccaagcaacauagauuucccuaucuuucaggaaa

SEQ ID NO: 344717 - RNA, 63 nt, Homo Sapiens
gaaaaaaauuacacuucagaaaagacaucaaaggcaacauaugacaacaaguaauuuaugaau

SEQ ID NO: 344718 - RNA, 63 nt, Homo Sapiens
auguugaagcagagaaacauucacacacaaaaagcaacauagucauguggguccagauggccu

SEQ ID NO: 344719 - RNA, 63 nt, Homo Sapiens
aacaccccccaugucuacaaaagaccaaccugggcaacauagcuugcuugaagucaggaguuc

SEQ ID NO: 344720 - RNA, 63 nt, Homo Sapiens
agguaacaaaauaauguuuggucucacaugcuagcaacauaccgcgagcagaugcaaucucuu

SEQ ID NO: 344721 - RNA, 63 nt, Homo Sapiens
ucucaagauaccacuguauacaguguaaaucuugcaacauagcuuggaagacuuccuggaaau

SEQ ID NO: 344722 - RNA, 63 nt, Homo Sapiens
gaaaccccaucucuacaaaauagaccagccggggcaacauaguucgcuugaggccaggaauuu

SEQ ID NO: 344723 - RNA, 63 nt, Homo Sapiens
gacuuuagauccuaauuugauaacaacuaaagggcaacauauaucuauacauuauaagggacu

SEQ ID NO: 344724 - RNA, 63 nt, Homo Sapiens
aaaaccuagucccuaaaauuaaggccagccugggcaacauagccaccuugaggccaggaguuu

SEQ ID NO: 344725 - RNA, 63 nt, Homo Sapiens
ucacuuuccaucuuuuaaaaaauaaaaaucauggcaacauaauuguuuuuggaaauaauuugu

SEQ ID NO: 344726 - RNA, 63 nt, Homo Sapiens
auucuacagcaggguuaaucuugguuuuuaaaggcaacauagcgauuguggauaauaauugaa

SEQ ID NO: 344727 - RNA, 63 nt, Homo Sapiens
ucaacauaugucacugaaauaaaagcaaaaguagcaacauaugacuuggaaaaaaaaaacagc

SEQ ID NO: 344728 - RNA, 63 nt, Homo Sapiens
ucagagugaguggaugaaaacauuuguaaggcugcaacauaauauuaaaaugugaauaaauaa

SEQ ID NO: 344729 - RNA, 63 nt, Homo Sapiens
accuguaucauucaugguauaaauuuuacucuugcaacauaacuaccaucucucucuuaaaac

SEQ ID NO: 344730 - RNA, 63 nt, Homo Sapiens
uggucagaaugcuguuuuguuuaauaauauuacgcaacauaaaccauagguguuauuagaagu

SEQ ID NO: 344731 - RNA, 63 nt, Homo Sapiens
aguguuuugaaaauaaaguacuauguguuuuuugcaacauaugccccaccaaacuuuauuuuu

SEQ ID NO: 344732 - RNA, 63 nt, Homo Sapiens
ucuuccuucccuccuuuuaauguauccugaaaggcaacauaauuuucaggcuaucauauauac

SEQ ID NO: 344733 - RNA, 63 nt, Homo Sapiens
acucacuuuagguauuacuauggcauuaaugcagcaacauaauuugccaugggaaacauuuuu

SEQ ID NO: 344734 - RNA, 63 nt, Homo Sapiens
gagacuccugucucuacaaaaagaccagccugggcaacauaguucacuugagcccaggaguuc

SEQ ID NO: 344735 - RNA, 63 nt, Homo Sapiens
uucauugugcaugcauccagugauuauacauaagcaacauauguaaucugcuuauauauuuuu

SEQ ID NO: 344736 - RNA, 63 nt, Homo Sapiens
gagacuccaucucuauaaauaagaccagccugggcaacauagcuugcuugagcucaugaguuc

SEQ ID NO: 344737 - RNA, 63 nt, Homo Sapiens
uaccaucuagcauguaccacuauaguccucauagcaacauaacuugcuauaaggcuuugauca

SEQ ID NO: 344738 - RNA, 63 nt, Homo Sapiens
auuauaagaauucacuauacaaugguugccaaggcaacauaaagaaauuaaacuuguauacaa

SEQ ID NO: 344739 - RNA, 63 nt, Homo Sapiens
ggaaaagauauaagcugcagagauucauuucuugcaacauaguuucauauuaugggucaggau

SEQ ID NO: 344740 - RNA, 63 nt, Homo Sapiens
gugcaugugaauagccacugcacuccagccugggcaacauagcaagacuccaucucuaaguaa

SEQ ID NO: 344741 - RNA, 63 nt, Homo Sapiens
aaugugaauucaagugccugauuaauugagguggcaacauaguuugagacgagggcagagaac

SEQ ID NO: 344742 - RNA, 63 nt, Homo Sapiens
ggcugcgguguuuggcaaugcuaauucaaugccgcaacauauaguugaggccgaggauaaaga

SEQ ID NO: 344743 - RNA, 63 nt, Homo Sapiens
uauaugcaucaguacagcauuuucaacauauuggcaacauauuuuaaaugaaaacacuaaaac

SEQ ID NO: 344744 - RNA, 63 nt, Homo Sapiens
cucucaaugaacuuuuaugaguucuuuauuguagcaacauacaguacuccccuccccccaguu

SEQ ID NO: 344745 - RNA, 63 nt, Homo Sapiens
agucacacaggagaaaaaucauacuuuuguuuugcaacauagaaaggaaaccuuucagaaguc

SEQ ID NO: 344746 - RNA, 63 nt, Homo Sapiens
aagacccugucucuaaagaaaagaccagccugggcaacauagcucacuugagcccaggaguuu

SEQ ID NO: 344747 - RNA, 63 nt, Homo Sapiens
uaaauuuuucuaguuucuuacuacuuugaguaggcaacauaaccuacuuaacacuccuaaaga

SEQ ID NO: 344748 - RNA, 63 nt, Homo Sapiens
gagacccccaucucuacaaaaagaccagccuuggcaacauagcuuaccugaggccaggaguuu

SEQ ID NO: 344749 - RNA, 63 nt, Homo Sapiens
auucaugacuauggauaaacccacuguaucuaggcaacauaguuuucacuuucccgguguucc

SEQ ID NO: 344750 - RNA, 63 nt, Homo Sapiens
ucacugaagagcuguuagauuacuucugagcuugcaacauagcgacuugguucguuaguggau

SEQ ID NO: 344751 - RNA, 63 nt, Homo Sapiens
auucgaucuaaauggguuugagaauccauaucagcaacauacguguuuuuugacagaaaguga

SEQ ID NO: 344752 - RNA, 63 nt, Homo Sapiens
gcauaauuauaucuuaaucauauauggaaaugugcaacauaugguauuuguuaaauacguuug

SEQ ID NO: 344753 - RNA, 63 nt, Homo Sapiens
uacuaaugaaacuguguguacgugucugugcgugcaacauaaaaauacaguagcaccuaagga

SEQ ID NO: 344754 - RNA, 63 nt, Homo Sapiens
uugcuugagcccaggaguucgagaccagccagagcaacauagugagaccacaucucuaccagu

SEQ ID NO: 344755 - RNA, 63 nt, Homo Sapiens
gcacauaacuguggccugaagggauggggaguagcaacauaaaaagaaguggcucaagucuuc

SEQ ID NO: 344756 - RNA, 63 nt, Homo Sapiens
uguggagaggagggauuuuccugcucuauauaagcaacauauuuuuagacauuaaaauauaua

SEQ ID NO: 344757 - RNA, 63 nt, Homo Sapiens
gagaaugcaucucuacaaaaaagaccagccugggcaacauaguucacuugaggccaggaguuc

SEQ ID NO: 344758 - RNA, 63 nt, Homo Sapiens
aauucggcaguuggccaaaauugauuauuuugugcaacauaacuaacacccaaaagaauuaaa

SEQ ID NO: 344759 - RNA, 63 nt, Homo Sapiens
agaacaugugagguugaaagagcaccagccagggcaacauagcgugacccugucucuacaaaa

SEQ ID NO: 344760 - RNA, 63 nt, Homo Sapiens
uaaucaauucaggagaaacacauaucauuuaaagcaacauaggcuaaccuguagguaacacug

SEQ ID NO: 344761 - RNA, 63 nt, Homo Sapiens
uguuucuuuuucuuguauaacuuuuuguuuucagcaacauaaauugauuuuuagcuggcagac

SEQ ID NO: 344762 - RNA, 63 nt, Homo Sapiens
ugugaaucauuuuuuuaaacugaaauuuaaaaugcaacauaguuuaaucucugauuaaaaugu

SEQ ID NO: 344763 - RNA, 63 nt, Homo Sapiens
gaaaccccaucuccaaaaauaaguccagccuaagcaacauaguucgcuugagcccaggaguug

SEQ ID NO: 344764 - RNA, 63 nt, Homo Sapiens
aagauccugucucucaaaaaaaggccagccugggcaacauaacuggcuugaacacagguguuc

SEQ ID NO: 344765 - RNA, 63 nt, Homo Sapiens
gcucauagaaucuucuagaaacuuuugaucggagcaacauaaugguauuugaguagugagguu

SEQ ID NO: 344766 - RNA, 63 nt, Homo Sapiens
auuuugguguuuuuggaacucacucaauaaauugcaacauauuaauaucugucauauaguaaa

SEQ ID NO: 344767 - RNA, 63 nt, Homo Sapiens
gaaauauacuauaaauauuaugauuuauuuucagcaacauauaguauuuucuuaaagaaagga

SEQ ID NO: 344768 - RNA, 63 nt, Homo Sapiens
ccucuuggcccuucccauauuguagggccacuggcaacauacugacuucagcacacauggacu

SEQ ID NO: 344769 - RNA, 63 nt, Homo Sapiens
gaggaucccaucucuacgccaagaccggccugagcaacauaguuggcuugagcccaggaguuc

SEQ ID NO: 344770 - RNA, 63 nt, Homo Sapiens
gagacccugucucugcaaaaaagaccagcuugggcaacauaggucacuugagcccaggaguuc

SEQ ID NO: 344771 - RNA, 63 nt, Homo Sapiens
cuacuuuuauaaaaucaaaauuuagauacucaugcaacauagccagucgguuuuucagccacu

SEQ ID NO: 344772 - RNA, 63 nt, Homo Sapiens
uaagauuuccagcuccuuguuguggaagacugggcaacauauuagcccauguauggcauggau

SEQ ID NO: 344773 - RNA, 63 nt, Homo Sapiens
gcuauucaggaauauugcuugaguccagcuugggcaacauagcgagacccuaucuaaaauaac

SEQ ID NO: 344774 - RNA, 63 nt, Homo Sapiens
gugcuugaggccaggaguucaagaccagccugggcaacauagggagacccccaucuuuacaaa

SEQ ID NO: 344775 - RNA, 63 nt, Homo Sapiens
ugcaaaauuugcccagauccuuuuauccagauggcaacauauuaggcaucuauauuuaauaac

SEQ ID NO: 344776 - RNA, 63 nt, Homo Sapiens
cucugggaaagauuucauuucuguuuaacaaaagcaacauaaagagauucuaguacaaaguua

SEQ ID NO: 344777 - RNA, 63 nt, Homo Sapiens
aaaaccccaucucuacaaaagagaccagccugggcaacauagcuugcuucagcccaggaguuu

SEQ ID NO: 344778 - RNA, 63 nt, Homo Sapiens
agagaagauaguucuagccaauacaauguuuuugcaacauauguuguguuagcaccauggaga

SEQ ID NO: 344779 - RNA, 63 nt, Homo Sapiens
ccacauuuuuuaaaaaaaugcaguugaguaacagcaacauaaaaggacauuuguuuucaaaag

SEQ ID NO: 344780 - RNA, 63 nt, Homo Sapiens
agaagaaaaaaggcuuaucuaugcucuccuacagcaacauaugugcuuuccaaaagugaugau

SEQ ID NO: 344781 - RNA, 63 nt, Homo Sapiens
uugcuugaggccaggaguuugagaccagccugggcaacauagggagacccagucucuacaaaa

SEQ ID NO: 344782 - RNA, 63 nt, Homo Sapiens
auaagaaauuacucucaagaacuucagaaaucugcaacauaauuuuauaaauauauaaauaca

SEQ ID NO: 344783 - RNA, 63 nt, Homo Sapiens
caaaaauggguuccagaaauguuuugagcacuggcaacauauuugaaauaagugaauauuguc

SEQ ID NO: 344784 - RNA, 63 nt, Homo Sapiens
uacucuaugaugauugcuuccacccacacgacugcaacauacaggugccuuggggaaaugugg

SEQ ID NO: 344785 - RNA, 63 nt, Homo Sapiens
uuuaucaaauuugcagcacuugagcuauuaucagcaacauaaauauucauccaagaguacuuc

SEQ ID NO: 344786 - RNA, 63 nt, Homo Sapiens
cucagcaccuaaaauagugcauuuuuaaccaaugcaacauacuugaagacaggaauuuuguau

SEQ ID NO: 344787 - RNA, 63 nt, Homo Sapiens
uuugaauuuaaaagcacuuuaguuuucuuuagggcaacauauaucaggguuaaaguauauuuc

SEQ ID NO: 344788 - RNA, 63 nt, Homo Sapiens
aaaaccucaucucuauuuaagagaccagccugggcaacauagcgggagauugcuugaguccag

SEQ ID NO: 344789 - RNA, 63 nt, Homo Sapiens
agucgugucaccagcugguauuuuuaaaugggagcaacauaucccaaacguauuuuauuuuau

SEQ ID NO: 344790 - RNA, 63 nt, Homo Sapiens
aaaauuaugaaaacuaauagcuuguuuuugugugcaacauaagucuacguuuuagagaggaau

SEQ ID NO: 344791 - RNA, 63 nt, Homo Sapiens
ucccaugaaauaaaguccccuuuuuacaguucugcaacauaucugaaaugugacauuuucuaa

SEQ ID NO: 344792 - RNA, 63 nt, Homo Sapiens
gugcaacuccugguucuguacuguauuuuauaugcaacauauaugcuuuaauauuuuaauguu

SEQ ID NO: 344793 - RNA, 63 nt, Homo Sapiens
gaaaaagauggcuacugugccgugaucaguguugcaacauaauucagccauuuuaucgaggca

SEQ ID NO: 344794 - RNA, 63 nt, Homo Sapiens
gauaccccaucucuuaaaaagagaccagccugggcaacauaguuagcuugaguccaggaguuu

SEQ ID NO: 344795 - RNA, 63 nt, Homo Sapiens
ugaaucaggcugguaauucgaguuuuuuagcuagcaacauauuccaauaugugcuugcuuauu

SEQ ID NO: 344796 - RNA, 63 nt, Homo Sapiens
uaaacuacuugaaaauaguuaggacauguuagagcaacauaaguuaacagugcacuggugaag

SEQ ID NO: 344797 - RNA, 63 nt, Homo Sapiens
uauagccuucuguauuuaacauguggaauaugggcaacauauauaccaaacauaacccagagu

SEQ ID NO: 344798 - RNA, 63 nt, Homo Sapiens
ucgcugcagcccaggaguucgagacuagccugggcaacauagcgagaccucgucucuacaaaa

SEQ ID NO: 344799 - RNA, 63 nt, Homo Sapiens
ucuaaacacaaggauuuucuuuuuuauuaauaugcaacauagacauugccauaacagaauaau

SEQ ID NO: 344800 - RNA, 63 nt, Homo Sapiens
ucgcuugaggccaagaguucaagaccagccugggcaacauagcgagaccccuaucuguauuaa

SEQ ID NO: 344801 - RNA, 63 nt, Homo Sapiens
aaugggaagguuauuuaaaccucaacgggacaugcaacauaaaucaugcccuucggccacagg

SEQ ID NO: 344802 - RNA, 63 nt, Homo Sapiens
gggguuucugucaaucugucaaaaaaaagaaaagcaacauagucugucucaggaaaaaaaaaa

SEQ ID NO: 344803 - RNA, 63 nt, Homo Sapiens
gagauucuguuaaaaaaauagagaccaaccugggcaacauaguucauuugagcccaggaguuc

SEQ ID NO: 344804 - RNA, 63 nt, Homo Sapiens
gaggccccaucuuuacaaaaaagaccagccaaggcaacauaguuaacuugaaacuaggaguuc

SEQ ID NO: 344805 - RNA, 63 nt, Homo Sapiens
gagacccugucucuacuaaaaagacuagccuaggcaacauaguucacuugagcccaggaguuc

SEQ ID NO: 344806 - RNA, 63 nt, Homo Sapiens
gagaccucaucucaaacaaagagagcagacugggcaacauagcucacuggaggccaagaguug

SEQ ID NO: 344807 - RNA, 63 nt, Homo Sapiens
uuacuugaaacccacaguuugagaccagccugggcaacauagugagacccugucucuaaaaaa

SEQ ID NO: 344808 - RNA, 63 nt, Homo Sapiens
aggauugagaccaggaguucgagaagagccugggcaacauagugagaccccaucucuacaaag

SEQ ID NO: 344809 - RNA, 63 nt, Homo Sapiens
ucacuugagcucaggaguccuaaaccagccugggcaacauagugauaccuugucucuaccaaa

SEQ ID NO: 344810 - RNA, 63 nt, Homo Sapiens
gggacacuuggaaaaccauuccccauucugcuagcaacauacaugauuaggaauuagaccucu

SEQ ID NO: 344811 - RNA, 63 nt, Homo Sapiens
acauaacugaagugaaaaaacaaacuggaaaaugcaacauaccuugagcuuuaaagcauugaa

SEQ ID NO: 344812 - RNA, 63 nt, Homo Sapiens
gcauacaagaacauuugggaguagaauagaaaagcaacauagaguaaagcuaucagucauuua

SEQ ID NO: 344813 - RNA, 63 nt, Homo Sapiens
ccuggacuucuccuggguugugcuuuuuugggggcaacauaccuuggacaaagcugagcugac

SEQ ID NO: 344814 - RNA, 63 nt, Homo Sapiens
uugacauaaucuuggguaauggaacggagaucugcaacauaucuuuuaacaacacuuuuuucu

SEQ ID NO: 344815 - RNA, 63 nt, Homo Sapiens
ucagcauucuugcugugcucuaaguuggcccaugcaacauaucgucaaauucauguuuuuaag

SEQ ID NO: 344816 - RNA, 63 nt, Homo Sapiens
gagcuaugauuaugccacugcuuuccagccugggcaacauaguaagaccccaucucuuaaaaa

SEQ ID NO: 344817 - RNA, 63 nt, Homo Sapiens
uugcuugaagccaggaguuugggaccagccugggcaacauagggggaucccaucucuacacac

SEQ ID NO: 344818 - RNA, 63 nt, Homo Sapiens
uucaguuuggucuuauuauauugacauuguuaugcaacauaucacuagaguguuuuuuaucuu

SEQ ID NO: 344819 - RNA, 63 nt, Homo Sapiens
ucuacaccaugcucugagggacaggaggggaaggcaacauacacaccccggacuccuccgcau

SEQ ID NO: 344820 - RNA, 63 nt, Homo Sapiens
uacggauuuauuauauaaauauauauucaccuagcaacauaucucugccgucucuccugcucu

SEQ ID NO: 344821 - RNA, 63 nt, Homo Sapiens
uggcuugagcccaggaauucaagaccaguccgagcaacauagcaaaagcccuuaucugcaaaa

SEQ ID NO: 344822 - RNA, 63 nt, Homo Sapiens
uucuaaaccuguaagaucuauguuccagccugcgcaacauagugagaccccaacucuacaaaa

SEQ ID NO: 344823 - RNA, 63 nt, Homo Sapiens
cuguggaaagacaggaguucgaaaccagccugggcaacauagugagacccugccucauggcuu

SEQ ID NO: 344824 - RNA, 63 nt, Homo Sapiens
ucguuugaggccaggaggucaauaccagccugggcaacauaguaagacccugucucuauuaaa

SEQ ID NO: 344825 - RNA, 63 nt, Homo Sapiens
gccauaaaaaagaacaagacuguguccuuuacagcaacauagauggagcugaggcucuuaucc

SEQ ID NO: 344826 - RNA, 63 nt, Homo Sapiens
ucgcuuaagcccaggaauucgaaaucagccuaggcaacauaguaagaccucaucucuacuaaa

SEQ ID NO: 344827 - RNA, 63 nt, Homo Sapiens
gcuugugaggccaggaguuugagaccauccuaggcaacauaaugagacaccgucucuaaaaua

SEQ ID NO: 344828 - RNA, 63 nt, Homo Sapiens
uaguuggugcgaaaaucuccugugcuuguggaagcaacauaaguugggucccuuaacugucac

SEQ ID NO: 344829 - RNA, 63 nt, Homo Sapiens
uauaaaguguuaauuuugcaugcugucuuucaugcaacauaauuugaaauuuguccaugguau

SEQ ID NO: 344830 - RNA, 63 nt, Homo Sapiens
ucauuggaggccaggaguuagagaucagccugggcaacauagccagaccuccucucuacaaaa

SEQ ID NO: 344831 - RNA, 63 nt, Homo Sapiens
uuuuguuuuuuuccuuuuuuggguaaaguacaugcaacauaaaauuuaccauuucagucauua

SEQ ID NO: 344832 - RNA, 63 nt, Homo Sapiens
gagacucuguuauaaaaauuaagaccagccugggcaacauagucugcuuaagcccaggaguuc

SEQ ID NO: 344833 - RNA, 63 nt, Homo Sapiens
gucagccaaagcucauuugccaguaaaaagcaggcaacauagucucuuugccagccaugugua

SEQ ID NO: 344834 - RNA, 63 nt, Homo Sapiens
aagacccccaccaucucugagagaccagccugggcaacauagccugcuuaagcucaggaguuu

SEQ ID NO: 344835 - RNA, 63 nt, Homo Sapiens
auucucuaauauuguauacuaagaugagcaauugcaacauaauaugauuaugauggucagagu

SEQ ID NO: 344836 - RNA, 63 nt, Homo Sapiens
gaaaccgucuccacaaauaaaagaccagccugggcaacauaguucacuggagcucgggaguuc

SEQ ID NO: 344837 - RNA, 63 nt, Homo Sapiens
gagaccugcccccuaucucuaagaccagccugggcaacauaguuugcuugagcccaggaguuc

SEQ ID NO: 344838 - RNA, 63 nt, Homo Sapiens
ccccuccaucauccuucacccaggugaagcguugcaacauagcuuaccugccacugggaccag

SEQ ID NO: 344839 - RNA, 63 nt, Homo Sapiens
gagacuaccucuacaaaaaagagaccacccugggcaacauagcucacuugagcccgcaaguuu

SEQ ID NO: 344840 - RNA, 63 nt, Homo Sapiens
gagaccccaucucuacuuaaaagaccagccugggcaacauaguucgcuugagcccaggaguuc

SEQ ID NO: 344841 - RNA, 63 nt, Homo Sapiens
cauggccaguaaugcucuugguuauuugugauagcaacauacauuaggaaauauuaacuacua

SEQ ID NO: 344842 - RNA, 63 nt, Homo Sapiens
uccacuucccaagggagacuccggcaaccuucagcaacauauauccucgaccagaugcagugc

SEQ ID NO: 344843 - RNA, 63 nt, Homo Sapiens
uuccuugaggccaggguucgagaccaaccuugggcaacauagcaagaccccauuucuuaaaaa

SEQ ID NO: 344844 - RNA, 63 nt, Homo Sapiens
ucccuuuagcccaggaguuaaagaccagccugggcaacauagggagacccugucuuuuuuuug

SEQ ID NO: 344845 - RNA, 63 nt, Homo Sapiens
ugggaggaucccaggaguucaaauccugccugggcaacauagcaagacccugucucuuaaaaa

SEQ ID NO: 344846 - RNA, 63 nt, Homo Sapiens
guugcaccugugaauaacugcacuccagccugggcaacauagcgagaccucaucuccaaaaaa

SEQ ID NO: 344847 - RNA, 63 nt, Homo Sapiens
ccaaauaguuggguucuucacuugauaggagaggcaacauacuuuuugugcccccagaugccu

SEQ ID NO: 344848 - RNA, 63 nt, Homo Sapiens
uugguaaucucauuuaaucuuuacuacacuccugcaacauagacaguauuauuacauucagua

SEQ ID NO: 344849 - RNA, 63 nt, Homo Sapiens
gagacgucgucucuacaaaauuuguuaaaugaagcaacauaguccccgcccuuccuccccuua

SEQ ID NO: 344850 - RNA, 63 nt, Homo Sapiens
uuugcugguuguuucuacaggguucugaagcaugcaacauagaacagauaccuuuaaauuuag

SEQ ID NO: 344851 - RNA, 63 nt, Homo Sapiens
ucuucaugcaggagaccccaggcccuggaggcugcaacauaccucaauccugucccaggccgg

SEQ ID NO: 344852 - RNA, 63 nt, Homo Sapiens
gagcugagaucgcaccacugcacuccagccugggcaacauagcaaaauccugucucaaaaaaa

SEQ ID NO: 344853 - RNA, 63 nt, Homo Sapiens
ucacuugagcccaggaguucgagaccagccuaggcaacauagcaagacccugucuguacacaa

SEQ ID NO: 344854 - RNA, 63 nt, Homo Sapiens
gguaggucuucagcauaagcuaugauucaaugugcaacauacauuucugagggguucugaaag

SEQ ID NO: 344855 - RNA, 63 nt, Homo Sapiens
caucuaagauuugggcauuuuaugcugaauauagcaacauauguucacauugaaauaugucua

SEQ ID NO: 344856 - RNA, 63 nt, Homo Sapiens
uaggagguuugagcucaaaugcuuaaacugcuggcaacauauaauaaaugcaugcuauucaau

SEQ ID NO: 344857 - RNA, 63 nt, Homo Sapiens
uaaugcuuugauuuuaauaguugguucuguguugcaacauauaucuuuagugcugacacuaac

SEQ ID NO: 344858 - RNA, 63 nt, Homo Sapiens
gugcuugagguuaggcguuccagaccagccugggcaacauagugagacucuugucucuacaaa

SEQ ID NO: 344859 - RNA, 63 nt, Homo Sapiens
gagacgccccccccccccauaagaccagccugggcaacauaguuggcuugagaccaggaguuc

SEQ ID NO: 344860 - RNA, 63 nt, Homo Sapiens
agagggaaggaaagagagaacccuacccgcucagcaacauagauuucccuuccuaucccucug

SEQ ID NO: 344861 - RNA, 63 nt, Homo Sapiens
uugcuuaaggccaggaguuugagaccagcuugggcaacauagugaaacccugucuguauggaa

SEQ ID NO: 344862 - RNA, 65 nt, Homo Sapiens
ccugggggaggugauccuugaacuggcucccggggaacauucagagcaugauugguagacagaag

SEQ ID NO: 344863 - RNA, 65 nt, Homo Sapiens
acuuuguaaaaauaaaauauugugguuuuguuuuaaacauucaacguuucuuuuccuucuacaau

SEQ ID NO: 344864 - RNA, 65 nt, Homo Sapiens
ccucugguaugagaaauaaaaucugccaguuuuauaacauucacuuucugccucugaggaaagau

SEQ ID NO: 344865 - RNA, 65 nt, Homo Sapiens
acugaaaggugggauuagagucaggccagaaagagaacauucauccagagaucccagaguugggg

SEQ ID NO: 344866 - RNA, 65 nt, Homo Sapiens
gcuacauuguucagcaacucacaaaacguagcacaaacauucauuauggagaaagcaucaggacu

SEQ ID NO: 344867 - RNA, 65 nt, Homo Sapiens
cacucaucccuggucgucuaucccaguguguguuuaacauucacagcccagaaccacagaugugu

SEQ ID NO: 344868 - RNA, 65 nt, Homo Sapiens
aucaacauuccaggguugguaauguuggaugaugaaacauucauuuuuaccuuguggaugcuagu

SEQ ID NO: 344869 - RNA, 65 nt, Homo Sapiens
aacuacuuuggaaaacaguuuaucugcuguaauugaacauucagcuacccuauaacccaguuaau

SEQ ID NO: 344870 - RNA, 65 nt, Homo Sapiens
uguuguccccuucaaugguguuaccuuaggagcugaacauucaauucaguuacaccacuaugacu

SEQ ID NO: 344871 - RNA, 65 nt, Homo Sapiens
uuuuacugaaccagucuaacauuuacuuuccaagaaacauucaggacauauuccuuuaauucuaa

SEQ ID NO: 344872 - RNA, 65 nt, Homo Sapiens
cgaaguaaacugauguacugaauuccauaauacauaacauucaauuuuuaccacuucuguuuagc

SEQ ID NO: 344873 - RNA, 65 nt, Homo Sapiens
auuuuuuagaagcauuuuacccauuuauuuuuuuaaacauucaagaacugcugacguacugugga

SEQ ID NO: 344874 - RNA, 65 nt, Homo Sapiens
gaucuugaacagaaccaguaucugucauggaacugaacauucaucgauggucuccauguauucau

SEQ ID NO: 344875 - RNA, 65 nt, Homo Sapiens
uuuuuuuuuuaaaccagggaugucuguugaaauaaaacauucagucugacaaacauugccugccc

SEQ ID NO: 344876 - RNA, 65 nt, Homo Sapiens
uauguauuggucaaggcaggcaucucuguucucugaacauucauugcacuuucccaccucuauac

SEQ ID NO: 344877 - RNA, 65 nt, Homo Sapiens
auaucauagaguaacaagugcuggucagccaaagaaacauucacugcuggugaaccaauaccaua

SEQ ID NO: 344878 - RNA, 65 nt, Homo Sapiens
gcuuguuugaucccaaauggugcuuaucuugauugaacauucagaacaaggauauuauuuucagu

SEQ ID NO: 344879 - RNA, 65 nt, Homo Sapiens
acuaaggcauagaaguugggaaauacuugcuucagaacauucaugguaaauuugcacuucaucuu

SEQ ID NO: 344880 - RNA, 65 nt, Homo Sapiens
agaaaccuuuugcacaucgggagcaauuuccauaaaacauucacccccgcuuuccuuagugcuug

SEQ ID NO: 344881 - RNA, 65 nt, Homo Sapiens
uccauuuuuuaaaaagguuuguuguccaauucuguaacauucaucgguuuugaaaagcaguucgg

SEQ ID NO: 344882 - RNA, 65 nt, Homo Sapiens
uugucucauccccagucuacugacugagagcacuuaacauucagcuguggccccuaaacccagag

SEQ ID NO: 344883 - RNA, 65 nt, Homo Sapiens
cuugaauggaaaguugauuucauacuuguauauugaacauucaaauucagauuuuuuuucuuuuc

SEQ ID NO: 344884 - RNA, 65 nt, Homo Sapiens
aagauuugcguuaaugaagacuacaguaagagugaaacauucacauguaaaacauauucaagauc

SEQ ID NO: 344885 - RNA, 65 nt, Homo Sapiens
uuaguuucucacagaaucauaaaauucuuaaauaaaacauucacuaaugugaugaccaaaugaac

SEQ ID NO: 344886 - RNA, 65 nt, Homo Sapiens
gagacauauacuaagauguuaaaaaaaaaaaaaaaaacauucaaacucugucucaaaaaaaaaaa

SEQ ID NO: 344887 - RNA, 65 nt, Homo Sapiens
aacauccauacagcacugcuaugcagacagaccucaacauucaaccuuggcaugaaaaugagaaa

SEQ ID NO: 344888 - RNA, 65 nt, Homo Sapiens
uucaacuguuucuuugggccaaaccuacuauaaaaaacauucaagaucacuggcugcucuucauc

SEQ ID NO: 344889 - RNA, 65 nt, Homo Sapiens
ugugggcuuuagcuuguuuuuucaggaaaaaaaaaaacauucaaaaaagaauagggauuuaucau

SEQ ID NO: 344890 - RNA, 65 nt, Homo Sapiens
ccagggaacggaaagaagaggcuuugccaucaagaaacauucagaaaaucaacucucuccugguc

SEQ ID NO: 344891 - RNA, 55 nt, Homo Sapiens
aaccccuggaagagacucuuaauugaacauucaaauuggcugugauauuuacuag

SEQ ID NO: 344892 - RNA, 52 nt, Homo Sapiens
gaguauccaaaaugaaauaauuaacauucacucuuuuaaguuuccugguuaa

SEQ ID NO: 344893 - RNA, 65 nt, Homo Sapiens
aagcuguacauuuggugcacuguguucacacuguaaacauucauccugagugcuagcuagccagc

SEQ ID NO: 344894 - RNA, 65 nt, Homo Sapiens
ggagaugcaggugacauacaccgcaccaaaggggaaacauucaaaccuggggaguccccacacac

SEQ ID NO: 344895 - RNA, 65 nt, Homo Sapiens
uuugaagccagcccugauaacauaucccacucagaaacauucagguuuaauuuuuuuuuuugcaa

SEQ ID NO: 344896 - RNA, 65 nt, Homo Sapiens
aaucauuuauucguucauuuuggcuucuacccacaaacauucaccaggucaguuuuccucuuucu

SEQ ID NO: 344897 - RNA, 65 nt, Homo Sapiens
guuagagaguguaggcgcuguuugaucuuucuacuaacauucacuccuuuugugauucuaaaacc

SEQ ID NO: 344898 - RNA, 65 nt, Homo Sapiens
ugcuuugauuaucuuguauguuaacaauucuagaaaacauucaugaauucacaaaaauauguuac

SEQ ID NO: 344899 - RNA, 65 nt, Homo Sapiens
uaaaaaaaacccauacauaagaaacagccuccaagaacauucaagcagcagucagagagaaaaau

SEQ ID NO: 344900 - RNA, 65 nt, Homo Sapiens
aaggccccaccuuacucugaaagcuggggagccugaacauucacuccuuguccuccaugcugugg

SEQ ID NO: 344901 - RNA, 65 nt, Homo Sapiens
gaacuuggacuccaucguuaaaauuauuuauguguaacauucaaaugugugcauuaaauaugcuu

SEQ ID NO: 344902 - RNA, 65 nt, Homo Sapiens
caauucauaagcacaauaugauuuacagaauaauaaacauucauguacccacuaucagguuaaga

SEQ ID NO: 344903 - RNA, 65 nt, Homo Sapiens
gaucaguggggccccaaagcccagcccggcugaccaacauucaaaagcacaaacccuggggacuc

SEQ ID NO: 344904 - RNA, 65 nt, Homo Sapiens
aagaagccaucaauuuuaacauuugaugucuagauaacauucaugagauuggucauuaaauacua

SEQ ID NO: 344905 - RNA, 65 nt, Homo Sapiens
auuucaguuuuaaucacugaacaaaagaaacaggcaacauucacuucuguaguaugguuuccacc

SEQ ID NO: 344906 - RNA, 65 nt, Homo Sapiens
cauaaaauguagcaaaucgguacuguaaaacauuuaacauucauacaguuauauauaauauccuu

SEQ ID NO: 344907 - RNA, 65 nt, Homo Sapiens
aagaacaugccacgauuuugucuuucuguggacucaacauucacuucgauuaaaaauagcaauuu

SEQ ID NO: 344908 - RNA, 65 nt, Homo Sapiens
uuuuuagaaauggcauauguuuuugaugauaugucaacauucaaaauuguccuaauuaaauuguu

SEQ ID NO: 344909 - RNA, 65 nt, Homo Sapiens
uugugcuuccuaacccuaaaucuguccagaguaggaacauucaugguaaucgacugucugucauu

SEQ ID NO: 344910 - RNA, 65 nt, Homo Sapiens
agaagccugcauaauguuucuggauuucauacuguaacauucaggaauucuuggagaaaaugggu

SEQ ID NO: 344911 - RNA, 65 nt, Homo Sapiens
acauuuagagguuaaaagaaacagugagaaauguaaacauucaaaaugauaauugaaucucucag

SEQ ID NO: 344912 - RNA, 65 nt, Homo Sapiens
ugucuuuugaggauggcuuuguccuguugcugguuaacauucaccuuccucuuuugaggaguauu

SEQ ID NO: 344913 - RNA, 65 nt, Homo Sapiens
agguggaagaagugagggugcagcgugucagacacaacauucauguuacucuuacauuggaaucu

SEQ ID NO: 344914 - RNA, 65 nt, Homo Sapiens
cuuuugucugggcaguagugaaaauaacuacucacaacauucacuauguuugcaaggaauuaaca

SEQ ID NO: 344915 - RNA, 65 nt, Homo Sapiens
cuaaccauugaugagcacuccugauuuuuaucuagaacauucagauuuaccauaauguuccuuag

SEQ ID NO: 344916 - RNA, 65 nt, Homo Sapiens
ggacuugagagcauuuuauuuuuugaauuuguuggaacauucaaaaaaacauucagaaaaugaag

SEQ ID NO: 344917 - RNA, 65 nt, Homo Sapiens
aaaugaaguuuugaauuuguuucgcauuuauguaaaacauucagauuaccaaugcgaacagguag

SEQ ID NO: 344918 - RNA, 65 nt, Homo Sapiens
uaucaaacuaauauaaaaagaaauuaaguuggacuaacauucacgucauuuuguuucuccuucaa

SEQ ID NO: 344919 - RNA, 65 nt, Homo Sapiens
cguaauagacugagaauugagauucacugaugcaaaacauucacccccccaaaaucuguugaaau

SEQ ID NO: 344920 - RNA, 65 nt, Homo Sapiens
uguaggaagaggccgcugcacuuaggccagaggugaacauucaugggucuccaccucaggggaga

SEQ ID NO: 344921 - RNA, 65 nt, Homo Sapiens
uacugcagguggcucuguugcuuuaugaagaauaaaacauucauguguucuucauguuuuaagca

SEQ ID NO: 344922 - RNA, 65 nt, Homo Sapiens
caucugggacauucuuaagaucaugcaucauaaccaacauucacuaggagcacacuaaggugugg

SEQ ID NO: 344923 - RNA, 65 nt, Homo Sapiens
auaugucaauaaaauauuguuuuauauuuauacagaacauucaggagggguuggaaacuuagcac

SEQ ID NO: 344924 - RNA, 65 nt, Homo Sapiens
acuuuaugaaaaaaauauaucagaugaaaaaaguuaacauucagugcacauauauuuuuuacaaa

SEQ ID NO: 344925 - RNA, 65 nt, Homo Sapiens
ucuuauuuuauauugaaaugguaauacaguauuuuaacauucacccagauaaauguauucaacau

SEQ ID NO: 344926 - RNA, 65 nt, Homo Sapiens
gcuuauuuguuacagacugucaccaaccaaauucaaacauucacuugacuugcaucccagcuuuc

SEQ ID NO: 344927 - RNA, 65 nt, Homo Sapiens
ccguuuauguuucucaucuagcuucaaaccuucagaacauucaaaaagaaugaacacuauacuuu

SEQ ID NO: 344928 - RNA, 65 nt, Homo Sapiens
uucugauauacauugcuugagucauguuguuauaaaacauucaaauuuuaguaacaucuugcuua

SEQ ID NO: 344929 - RNA, 65 nt, Homo Sapiens
caguugcaauaaaauaguauaugcacaauuuagaaaacauucaucauccuguauauuauggugua

SEQ ID NO: 344930 - RNA, 65 nt, Homo Sapiens
uauggauucaugauggcuguuuuuuuuacaugauuaacauucacuuauauuacaaucauuuuaua

SEQ ID NO: 344931 - RNA, 65 nt, Homo Sapiens
aaaauaguaaguuucucuuuguuuaucacauaaaaaacauucaguugaaugucugaggcuaccag

SEQ ID NO: 344932 - RNA, 65 nt, Homo Sapiens
uuuaaaugcucagccucaaguuuuuguuacauaugaacauucauuacaaaaaauacaucauuuaa

SEQ ID NO: 344933 - RNA, 65 nt, Homo Sapiens
gcuuagggauagguccuuggaaaaagaaaaacacaaacauucaaaugcacauaaauugguauaau

SEQ ID NO: 344934 - RNA, 65 nt, Homo Sapiens
cagugaaacaaacaauaaaagacucucgcaagauaaacauucaaauauuuucucucaauucugua

SEQ ID NO: 344935 - RNA, 65 nt, Homo Sapiens
ggagacuuuguacaguggccucucuaaaaguacaaaacauucauaagagaaaccugcauacauuu

SEQ ID NO: 344936 - RNA, 65 nt, Homo Sapiens
cuuuaaauacugaggaaaauguggccuguuuacaaaacauucagcacguugaagaaaguguuccc

SEQ ID NO: 344937 - RNA, 65 nt, Homo Sapiens
gaggaaauuaaucuuuauauauuauuucuugcagaaacauucauuauuuuauuaauauugcccua

SEQ ID NO: 344938 - RNA, 65 nt, Homo Sapiens
uuuuuuuuuaauguuccagaagauggccaauagagaacauucaagggaaauggggaaacauaauu

SEQ ID NO: 344939 - RNA, 65 nt, Homo Sapiens
aaaaguaauacagaauugugauuuauuaauuuuaaaacauucagaacuuguugaaagaaaaauua

SEQ ID NO: 344940 - RNA, 65 nt, Homo Sapiens
aaaugauucuaagcaucuuggaaggguguguuuggaacauucauuaaauuuaccuguagcccagu

SEQ ID NO: 344941 - RNA, 65 nt, Homo Sapiens
uuccuuccaacccuucccaccauccuggccuggagaacauucaguccaggucucaucuugcaucu

SEQ ID NO: 344942 - RNA, 65 nt, Homo Sapiens
uagcuuccucagucucuccaacagcagugaacaugaacauucacuaccaauuauaaggaaaauuu

SEQ ID NO: 344943 - RNA, 65 nt, Homo Sapiens
accuuccuccuguaguccugcuauguugcaugauaaacauucaucgggauuuauuacuguuguau

SEQ ID NO: 344944 - RNA, 65 nt, Homo Sapiens
aauagauuuauacaccauuaaagguagucaggaaaaacauucaggauggaagguguugcuuuaga

SEQ ID NO: 344945 - RNA, 65 nt, Homo Sapiens
cauguucccaggucugaggguucuugucauccuuaaacauucaguugcuaucuaucgcugcucuc

SEQ ID NO: 344946 - RNA, 65 nt, Homo Sapiens
guggugguaucaggcacacuuguuaggccuuaaacaacauucacuaugcuuugcugaccacuguu

SEQ ID NO: 344947 - RNA, 65 nt, Homo Sapiens
caaguaacaggcaacaaagaccuuuuuuuucugcuaacauucagaaauauuucauaguuuucaag

SEQ ID NO: 344948 - RNA, 65 nt, Homo Sapiens
caaaugaggauauagucauuugguccugaaguaguaacauucaccaugggaugccccugcucauc

SEQ ID NO: 344949 - RNA, 65 nt, Homo Sapiens
gaguucuucaugucugucaauaguucaauucagcaaacauucaugagcaauguaacaguguaauc

SEQ ID NO: 344950 - RNA, 65 nt, Homo Sapiens
gacauagaaggauauagugggagcagugauacgcuaacauucauuacauucugcaguaaugaauc

SEQ ID NO: 344951 - RNA, 65 nt, Homo Sapiens
aaguggaagaguugaaacuugauugaaggacuuaaaacauucacaaccuuaagccgagguggggg

SEQ ID NO: 344952 - RNA, 65 nt, Homo Sapiens
auuaucacuuggauguggagguuuuacuuuuuaaaaacauucagcuuaauuaccuuaccuuaauu

SEQ ID NO: 344953 - RNA, 65 nt, Homo Sapiens
uccauggaaaauaaagauuuagaaaccagguggaaaacauucacuauuaagacuauugauauauu

SEQ ID NO: 344954 - RNA, 65 nt, Homo Sapiens
uuuccuaacaucagugagauacaucuuugaauuuaaacauucauauuuacugaguaccuacuagg

SEQ ID NO: 344955 - RNA, 65 nt, Homo Sapiens
aacaaggacucccauauacacucccuaauccaggaaacauucacauaauacauuuauguugacac

SEQ ID NO: 344956 - RNA, 65 nt, Homo Sapiens
gcagcagagagggaacuuugaacaguugggcugucaacauucaaaugcuaaacgacuccgagaac

SEQ ID NO: 344957 - RNA, 65 nt, Homo Sapiens
aaagcaaagaacgguuucaggauuuauuuuaaccaaacauucaccuucucauggagugaaacagu

SEQ ID NO: 344958 - RNA, 65 nt, Homo Sapiens
aaauuguguacaagauaaauucaccugcugcgaaaaacauucaacccggagucuuuggguuugau

SEQ ID NO: 344959 - RNA, 65 nt, Homo Sapiens
cauccuagaaacuagcaauaauuucugguuuagaaaacauucagcaauaaaguuccuuucuaacc

SEQ ID NO: 344960 - RNA, 65 nt, Homo Sapiens
gagggguggaguuuuaacuguuaaggcuaaaacuuaacauucauaugagcaaacuaacuugacuu

SEQ ID NO: 344961 - RNA, 52 nt, Homo Sapiens
ccaguccuauugaggcaugaggaacauucauucuguauuuuuuuucccuguu

SEQ ID NO: 344962 - RNA, 65 nt, Homo Sapiens
ugccuaguuccuguggccaggagguuggugacugaaacauucacacagggcucuuugauggaccc

SEQ ID NO: 344963 - RNA, 65 nt, Homo Sapiens
gggaauggaguaagucaccuucugacugcuuaguaaacauucaaagaaaugccuuggcuccagug

SEQ ID NO: 344964 - RNA, 65 nt, Homo Sapiens
aguguuuggugugguuugugucugaugaguuuuuuaacauucagguguagauuguuucagcuucu

SEQ ID NO: 344965 - RNA, 65 nt, Homo Sapiens
gagcuggucaaacauuccuuguguuaaaaaaaucaaacauucauauccacaaaauuuucugcuaa

SEQ ID NO: 344966 - RNA, 65 nt, Homo Sapiens
accauauaaaucaaguaccuauugggaacagacauaacauucaauuuuucauuuaugcuaaguga

SEQ ID NO: 344967 - RNA, 65 nt, Homo Sapiens
aucuuuugggauccuuaauuagagaugauuucuggaacauucagucuagaaagaaaacauuggaa

SEQ ID NO: 344968 - RNA, 65 nt, Homo Sapiens
uucaaaccugcaaggcaaaguaaaauuagagcaagaacauucaaaccaaauaagauauuuuucag

SEQ ID NO: 344969 - RNA, 65 nt, Homo Sapiens
uuauaauagauuuuuuuuaaaguuugguauuguaaaacauucacaccucugucccucaaaauuga

SEQ ID NO: 344970 - RNA, 65 nt, Homo Sapiens
gcaaaaguacuagaugguguuuuuuuguuguuguuaacauucauucuuucagguguuuagagauu

SEQ ID NO: 344971 - RNA, 65 nt, Homo Sapiens
uauaaagaaacccugcugauaggucucagcuucagaacauucacuuaacuccuaauuuacccuuc

SEQ ID NO: 344972 - RNA, 65 nt, Homo Sapiens
gauguagauuaauaauguaaaaaaugacuucauuuaacauucacuuuguacagucauaauuuguu

SEQ ID NO: 344973 - RNA, 65 nt, Homo Sapiens
ucaaccacgagguuguauauaguuaaguuaggguuaacauucauuaccggugaaaagaaacaggu

SEQ ID NO: 344974 - RNA, 65 nt, Homo Sapiens
cagucaucaaacauuauugaaaaucagagaucuuaaacauucagugcuuguaaucucacugagcc

SEQ ID NO: 344975 - RNA, 65 nt, Homo Sapiens
aauucauuucagcauguuaucauuaaaaagauaccaacauucagaccaaaagauggagaaaagca

SEQ ID NO: 344976 - RNA, 65 nt, Homo Sapiens
guaagguuuaauaaaauuaaaaaaucauaugccacaacauucauuaauaaauugucacacaaugg

SEQ ID NO: 344977 - RNA, 65 nt, Homo Sapiens
uuucuaaaauugucugccaaauuauugagaaauguaacauucaaaauauaauauauuguuuguga

SEQ ID NO: 344978 - RNA, 65 nt, Homo Sapiens
aaacuuguuuucacauggacugucagaaaauaguuaacauucaaagagcaacaguaacuccaaag

SEQ ID NO: 344979 - RNA, 65 nt, Homo Sapiens
acgcagcuccccaaucacacaaauuuaaauuaguuaacauucaaacauguaacuuuuuaagauuu

SEQ ID NO: 344980 - RNA, 65 nt, Homo Sapiens
aguaugcccacccagccccauaccuguggccuuuuaacauucaagucuuuuuucauggaaugcgc

SEQ ID NO: 344981 - RNA, 65 nt, Homo Sapiens
cauucaguaggauucaauucaauguggaaccauucaacauucaccucauuaaccuaaaaugucuc

SEQ ID NO: 344982 - RNA, 65 nt, Homo Sapiens
gagcaggcgacucaguggcccaaaacaggacccagaacauucauccguaaauggaaucugauaau

SEQ ID NO: 344983 - RNA, 65 nt, Homo Sapiens
uagugaaggguaggagagcucagccucggauggccaacauucaguuguucagguucauucgucaa

SEQ ID NO: 344984 - RNA, 65 nt, Homo Sapiens
ucuugucagaacauugggacaauuggucguucaaaaacauucauccucuuacugcaaguuuaucu

SEQ ID NO: 344985 - RNA, 65 nt, Homo Sapiens
gcucaauacucaagaaucuugcaagacaguuauuaaacauucauagcuugaaauugcccauggug

SEQ ID NO: 344986 - RNA, 65 nt, Homo Sapiens
uucauaggguuuggcaugcugcucgguacaugguuaacauucauaaauggugggggcccuuacug

SEQ ID NO: 344987 - RNA, 65 nt, Homo Sapiens
ucaaacuucagguugaaacuguuugaagcauuauaaacauucauuucacaacuagauuguauaag

SEQ ID NO: 344988 - RNA, 65 nt, Homo Sapiens
uggcaccaauccuagacucacgugugccccagaauaacauucagacucucagcuggucuuguguu

SEQ ID NO: 344989 - RNA, 65 nt, Homo Sapiens
uuugcaugacuccccauacauguugcagcuuugaaaacauucaucucagaguuagguauaaagac

SEQ ID NO: 344990 - RNA, 65 nt, Homo Sapiens
cuucuggguaaacacauacaagugacuugggaaauaacauucaagcacugagcuuucaacauuga

SEQ ID NO: 344991 - RNA, 65 nt, Homo Sapiens
auaaauaaaauuauucugugaagucuggagagaauaacauucauuaagaguaaacugaugaguug

SEQ ID NO: 344992 - RNA, 65 nt, Homo Sapiens
agagcucguuccuaccuggcuccuccaguuggaugaacauucaagaaggcagggcccagcauaau

SEQ ID NO: 344993 - RNA, 65 nt, Homo Sapiens
ccuacuuuuuaaaaacaaaugucuuuaugucucuuaacauucacaucuugugaauccuauaagca

SEQ ID NO: 344994 - RNA, 65 nt, Homo Sapiens
agugugcugucaaagugugccaauacagaaacuauaacauucaaugcagaugucuuuacauauuu

SEQ ID NO: 344995 - RNA, 65 nt, Homo Sapiens
uugcuauuuacaaaugaaguaguagucagaacuauaacauucaauacaaaaugaauaaaagugag

SEQ ID NO: 344996 - RNA, 65 nt, Homo Sapiens
ucacauuugagaaucaugguaguauuugcuacuguaacauucaauacucaucacaagaggucaaa

SEQ ID NO: 344997 - RNA, 65 nt, Homo Sapiens
cuuuccucgucuaauuaugaauauguaaguagaaaaacauucaucccucuaaaauauuuauagaa

SEQ ID NO: 344998 - RNA, 65 nt, Homo Sapiens
ugauucagagcuaaauauucagucuuagagauuuaaacauucauuccaaauucaacauuacugca

SEQ ID NO: 344999 - RNA, 65 nt, Homo Sapiens
uccucagauugcacccugauugaccugacagagagaacauucagaaagaugaguuugaccugugg

SEQ ID NO: 345000 - RNA, 65 nt, Homo Sapiens
acucuuuuacuucuggguauagaagaaugaacuagaacauucaagagagaguaccuaaaauggag

SEQ ID NO: 345001 - RNA, 65 nt, Homo Sapiens
aagaaauguuuaagacucagcuuuaaaaagaaguuaacauucauaucucuguuuugaaaucaaaa

SEQ ID NO: 345002 - RNA, 65 nt, Homo Sapiens
ucuaaacagacaucuaaauuuucgagacuuagaauaacauucacuaaaguuugauaaugucuuuu

SEQ ID NO: 345003 - RNA, 65 nt, Homo Sapiens
uguggcucagagauaacccuuggagaugugacuacaacauucacuaccucuacuacugguuaaag

SEQ ID NO: 345004 - RNA, 65 nt, Homo Sapiens
gaucagaguauauagaugaauaugaacaagaauggaacauucacuugucaacgcacuuucuaaau

SEQ ID NO: 345005 - RNA, 65 nt, Homo Sapiens
uaaagacaaagcauucuaaaugaacucaauauaaaaacauucauuuggaauguacauacugaaaa

SEQ ID NO: 345006 - RNA, 65 nt, Homo Sapiens
aauauauuuaaggguuuuuuuuuuuugacaaauucaacauucaacgaguagacaaaaugcuaauu

SEQ ID NO: 345007 - RNA, 65 nt, Homo Sapiens
uagaugugaaauuucugaaaauguugaagcagagaaacauucacacacaaaaagcaacauaguca

SEQ ID NO: 345008 - RNA, 65 nt, Homo Sapiens
auuugagcuccgggucucuucuaccugcauucuaaaacauucaaaguaauaaaaauuucuccaca

SEQ ID NO: 345009 - RNA, 65 nt, Homo Sapiens
uagaaguacaggagggcgcagauggcuaacugaguaacauucaugaaaugaggcuuucuguggcg

SEQ ID NO: 345010 - RNA, 65 nt, Homo Sapiens
auucugguuuugucauauuuuuguuugaugcaauaaacauucaacaaugauaaugaucaaguaag

SEQ ID NO: 345011 - RNA, 65 nt, Homo Sapiens
ugguagcaaaugacacaugcagaaaccagaacugaaacauucaccaaaaaaaaggaagacuaaac

SEQ ID NO: 345012 - RNA, 65 nt, Homo Sapiens
cugaucugcuaguccaacgagccaguuguggaggaaacauucacaaaucgucauaggaaagacgu

SEQ ID NO: 345013 - RNA, 65 nt, Homo Sapiens
augguaauaaacuuuucaaaaucuuuguuaaaccaaacauucaacacaaaauaaacuagaaggcc

SEQ ID NO: 345014 - RNA, 65 nt, Homo Sapiens
uucuuuuguauuuuuuuuuguuuguuuuguuuuuaaacauucaaaagcaauuaaugaucagacau

SEQ ID NO: 345015 - RNA, 65 nt, Homo Sapiens
aauuaucaggacuuuuuucaggaguggguuauaaaaacauucaaguuggucugacaguauuuugu

SEQ ID NO: 345016 - RNA, 65 nt, Homo Sapiens
uugaauaaugcuguuuuauauguagaguguuuuaaaacauucacaccauucgucaucacuccucu

SEQ ID NO: 345017 - RNA, 65 nt, Homo Sapiens
auccagggcugcaggcagcaacgcaagucaggcugaacauucagucuccagagacagcugugugg

SEQ ID NO: 345018 - RNA, 65 nt, Homo Sapiens
agaguugcccuacaaauuucauuuggcagcgccauaacauucauuuaaaaaguuuaugaaaacau

SEQ ID NO: 345019 - RNA, 65 nt, Homo Sapiens
gcagcgccauaacauucauuuaaaaaguuuaugaaaacauucauuugaaaguuccaugcagcuuu

SEQ ID NO: 345020 - RNA, 65 nt, Homo Sapiens
gauggauuauaauggucucuagcaaaugugugguaaacauucauauggccauuaauuuuaacauu

SEQ ID NO: 345021 - RNA, 65 nt, Homo Sapiens
gguuaggaauuugacaugaauugugcaaggauguaaacauucaguccauugcaauacguguuucu

SEQ ID NO: 345022 - RNA, 65 nt, Homo Sapiens
cuccuggucuuacauaugaauaacgagguagaagcaacauucauuucuaacacugauuuaauagc

SEQ ID NO: 345023 - RNA, 65 nt, Homo Sapiens
cuguugguguguuaaaaaauuuuaaaagcuucaagaacauucaagugcucacaguaaacucauug

SEQ ID NO: 345024 - RNA, 65 nt, Homo Sapiens
uaacucuccagccauuguaacacccccaaacacaaaacauucauguuccccugcuccccugagac

SEQ ID NO: 345025 - RNA, 65 nt, Homo Sapiens
gaaaaacuuguagaaugggauuauagaugucaggaaacauucaguacaugggcaggcacccucau

SEQ ID NO: 345026 - RNA, 65 nt, Homo Sapiens
uugauagaaaucuugccacacauaggaaacaagacaacauucaaugcaccuugggucucacccac

SEQ ID NO: 345027 - RNA, 65 nt, Homo Sapiens
uuuuuacuucauuuuuaaaagggguuaaauuggcaaacauucauaaguuuauugauuucacaaua

SEQ ID NO: 345028 - RNA, 65 nt, Homo Sapiens
ugaacacaguaguccccuagauuuugcagauuaaaaacauucauugaaaggacauuacuaaugac

SEQ ID NO: 345029 - RNA, 65 nt, Homo Sapiens
gagugccaagaaugugagaaauauagaucucagucaacauucacuaccuuguguagcauugcaca

SEQ ID NO: 345030 - RNA, 65 nt, Homo Sapiens
ccuaucucauuagaagaaauuguggacgugguuccaacauucacucggucggaggauuguguugc

SEQ ID NO: 345031 - RNA, 65 nt, Homo Sapiens
gugaaauuccuaugguaaauuuaaacauaugauagaacauucauguaucagauuccaaaucaagg

SEQ ID NO: 345032 - RNA, 65 nt, Homo Sapiens
uuuuaccuauagucugcucuuguucaaugcaaauaaacauucacuaacacccagaacauauuuuc

SEQ ID NO: 345033 - RNA, 65 nt, Homo Sapiens
uuuguuaacaguauuucucuuagaaaaauuauuagaacauucacugggauguggagguaguuggg

SEQ ID NO: 345034 - RNA, 65 nt, Homo Sapiens
gguuccagggauuaaggaauuuugccauguaaacuaacauucacuaacacaucugcaggacacau

SEQ ID NO: 345035 - RNA, 65 nt, Homo Sapiens
cauaaaauguagcaaaucaguacuguaaaacauuuaacauucauacaauuauauauaauauccuu

SEQ ID NO: 345036 - RNA, 65 nt, Homo Sapiens
auuguuguccauuuuuaaaguugaugauugcuggaaacauucacacgcuuaaaagcaauggugug

SEQ ID NO: 345037 - RNA, 65 nt, Homo Sapiens
aaauaaaacaacaacaaaaugcaucagagagccaaaacauucaguauugcauuuucacauaggug

SEQ ID NO: 345038 - RNA, 65 nt, Homo Sapiens
cuuaaaauacccauugccccagaccuggaagauauaacauucaguucccaccaucugauuaaaac

SEQ ID NO: 345039 - RNA, 65 nt, Homo Sapiens
ucugggggaacgauccuggccacagccgccaaacaaacauucacuaggccucuucuguuuucaua

SEQ ID NO: 345040 - RNA, 65 nt, Homo Sapiens
uaacagugggguuuuuuuugugcaacucuucuaaaaacauucauaaugcagucauguuuauuuuu

SEQ ID NO: 345041 - RNA, 65 nt, Homo Sapiens
caguuauauauaauauccuuuacuguaaaacauuuaacauucauacauaaaauguagcaaaucag

SEQ ID NO: 345042 - RNA, 65 nt, Homo Sapiens
cacagauugacuguaaauuaauguaacauugucucaacauucauuauuaauuguacagacacaua

SEQ ID NO: 345043 - RNA, 65 nt, Homo Sapiens
gcagaaguccucacacacuaccuuuucccuaguggaacauucaguagcucucucauuccaggaag

SEQ ID NO: 345044 - RNA, 65 nt, Homo Sapiens
uguauucagaugugaguagaucuuauaaagucuuuaacauucauuuacacugauaaauacacaga

SEQ ID NO: 345045 - RNA, 65 nt, Homo Sapiens
guaugagugugugaaucguuucaccuaauaaaaucaacauucauuuuggauuuauaaaagcagac

SEQ ID NO: 345046 - RNA, 65 nt, Homo Sapiens
uucugccucaucuggagggaagaauuuuuggaaccaacauucaaaugccaguggggguuugaaag

SEQ ID NO: 345047 - RNA, 65 nt, Homo Sapiens
agcuuccuguccucccagcuuacagggguucuggaaacauucagggcccaggugaguccuagagc

SEQ ID NO: 345048 - RNA, 65 nt, Homo Sapiens
gcuggucuuauuuguaaagcuuucuucuuuuuuuaaacauucauaguugaaguucguuuuuuugu

SEQ ID NO: 345049 - RNA, 65 nt, Homo Sapiens
aaauggaaaaguaguucacgcucuaguugagaaaaaacauucauaauauuuuuaauggagaaaga

SEQ ID NO: 345050 - RNA, 65 nt, Homo Sapiens
acagugagacggugagauggauucguuuugcacacaacauucaaaacacuucauauugcccccac

SEQ ID NO: 345051 - RNA, 65 nt, Homo Sapiens
uaugaauucacaccuugaguauaaaacuugcagagaacauucagcgauuuccaguccacugugag

SEQ ID NO: 345052 - RNA, 65 nt, Homo Sapiens
aacgaacacgaauccaucccaaccgagaugccauuaacauucaucuaaaaauguuaggcucuaaa

SEQ ID NO: 345053 - RNA, 65 nt, Homo Sapiens
aaauacuugauucuguuaaaaugcagaggugcuauaacauucaaagugucagauuccuugggagu

SEQ ID NO: 345054 - RNA, 65 nt, Homo Sapiens
cuuccuugagccuaguuuuuuuacgugauuuuuguaacauucauuuuuuuguacagauaacagga

SEQ ID NO: 345055 - RNA, 65 nt, Homo Sapiens
aauuaguuauaaauaaauaaccaaaaauguauguaaacauucaaaugauuaucugaacaaaugag

SEQ ID NO: 345056 - RNA, 65 nt, Homo Sapiens
uuugaguuauaugauguuuauuugaaugacuguugaacauucaaauuuguauuauuuggagauga

SEQ ID NO: 345057 - RNA, 65 nt, Homo Sapiens
uucaaauaucauuuuaccuuugaagaaaaccagaaaacauucaaaagaacuucaacaaaucauca

SEQ ID NO: 345058 - RNA, 65 nt, Homo Sapiens
ugggaaagcaauauauuaugcagccagucuguagaaacauucagaucccucuuccuuuacucaaa

SEQ ID NO: 345059 - RNA, 65 nt, Homo Sapiens
uaugccuggaggcucaacacaaaacuucccauccaaacauucagaugaacugagcgucuuacaca

SEQ ID NO: 345060 - RNA, 65 nt, Homo Sapiens
auuuaauugaaucgugugucguuucucuagggaguaacauucaacaucggagugggcaccucugu

SEQ ID NO: 345061 - RNA, 65 nt, Homo Sapiens
caguaaaaugacauccacguugccuucccuggggaaacauucaggagaaaauucuuuaucauguu

SEQ ID NO: 345062 - RNA, 65 nt, Homo Sapiens
ccccaccuucuugcugccagaaauguuggcuacccaacauucauuuuacgcugcaaaaaaaaaaa

SEQ ID NO: 345063 - RNA, 65 nt, Homo Sapiens
uaggagcccgaggaccagcacugcugcagggcaagaacauucaugggugggaauaugggcuggca

SEQ ID NO: 345064 - RNA, 65 nt, Homo Sapiens
ucaagcccaugaguacccacaaugccuaucccagaaacauucaaagguuuacagaugaaccggau

SEQ ID NO: 345065 - RNA, 65 nt, Homo Sapiens
uuucagacauugaauugagaucuuuuugauaugaaaacauucaugaggguggcagguacaucagu

SEQ ID NO: 345066 - RNA, 65 nt, Homo Sapiens
aguaucauucguguuuggauugaagauauaccaagaacauucauccaagucaugaaagaaguccu

SEQ ID NO: 345067 - RNA, 65 nt, Homo Sapiens
acugcagaaugggugaccucgggugggggguggacaacauucaacaaggaaaaaauggggguggg

SEQ ID NO: 345068 - RNA, 65 nt, Homo Sapiens
aauacgcuauuucuccaacaugaaaacaggugguaaacauucagucaccuuuuaaaaauuaugca

SEQ ID NO: 345069 - RNA, 65 nt, Homo Sapiens
ugucuugacuuaucuccugcaacugacucaucugcaacauucacaccauugcuuccuugugguuu

SEQ ID NO: 345070 - RNA, 65 nt, Homo Sapiens
gacuaugccugagucccagggugcggcagguaggaaacauucacagaugaagacagcagauuccc

SEQ ID NO: 345071 - RNA, 65 nt, Homo Sapiens
aggugcucagcuauuuaaaaacaaaacuauucucaaacauucaucauuagacaacuggaguuuuu

SEQ ID NO: 345072 - RNA, 65 nt, Homo Sapiens
gauucauaacaacaccaagaauugauuuuguagccaacauucauucaauacuguuauaucagagg

SEQ ID NO: 345073 - RNA, 65 nt, Homo Sapiens
cuuuuuuuucucucuuuuguuuauaaaaaacacuaaacauucaauuccagagaaccaaaaauccc

SEQ ID NO: 345074 - RNA, 65 nt, Homo Sapiens
guuuuaaauaaagaaucuuacauaagaauguugacaacauucacaguaagccauuggcagaaaau

SEQ ID NO: 345075 - RNA, 65 nt, Homo Sapiens
aaaguaaaaagggaauuaugaguuuuucaauuaguaacauucauguucuagucugcuuugguacu

SEQ ID NO: 345076 - RNA, 65 nt, Homo Sapiens
ucccagaaccuauucccuuucuugagggaguucaaaacauucauaggcaguaauguuccucccag

SEQ ID NO: 345077 - RNA, 65 nt, Homo Sapiens
ugcagugugcaucaauuuaaucuacagcagggguaaacauucaucuaucuaugcuguucuuuaaa

SEQ ID NO: 345078 - RNA, 65 nt, Homo Sapiens
ucugcauucugcacaagauaguaaaugauguguacaacauucaagcaaggccgauuuuuguaacu

SEQ ID NO: 345079 - RNA, 65 nt, Homo Sapiens
ccauagcagggucauaggccgcgugggaggggacaaacauucaaagcaaucgcauuucaacguga

SEQ ID NO: 345080 - RNA, 65 nt, Homo Sapiens
gcauagaugaugauuuacaguauauauuauauuuaaacauucauguuuagcuuuuucauauuaaa

SEQ ID NO: 345081 - RNA, 65 nt, Homo Sapiens
ggaagacaucuguagggaaugagagcaggaaugaaaacauucagauuugcucuuggaggcuuugg

SEQ ID NO: 345082 - RNA, 65 nt, Homo Sapiens
caacagcugaugcccuauaaaaaagcauaauguugaacauucauuaccucuucuaucuaauccuu

SEQ ID NO: 345083 - RNA, 65 nt, Homo Sapiens
auauagcauugguugccuauucaguccagagaccuaacauucagaagugggugggugggugggac

SEQ ID NO: 345084 - RNA, 65 nt, Homo Sapiens
ucuugcuuuaacuuucaacacuuagaaaaucuacaaacauucagaccugucuggguugguauugc

SEQ ID NO: 345085 - RNA, 65 nt, Homo Sapiens
acuuucuuauaaauuuggaucauguuaugauuuguaacauucacacaacaccucacuuuugaauc

SEQ ID NO: 345086 - RNA, 58 nt, Homo Sapiens
ugaaagcugggaaguuaugaaugaagauaacauucacccauaaccaagagaacucagg

SEQ ID NO: 345087 - RNA, 65 nt, Homo Sapiens
ccaaacacauucuccuuugaauuguuaaaauucagaacauucaaaauaacuguuuugcuacaacc

SEQ ID NO: 345088 - RNA, 65 nt, Homo Sapiens
cucagugugaguccucagagccuccaucugccaagaacauucaguuggauuccaucguuugguuu

SEQ ID NO: 345089 - RNA, 65 nt, Homo Sapiens
gcaaguggaugaguuggaaauuaugcacuuugaaaaacauucacuuuguuuaagcuuauuggguu

SEQ ID NO: 345090 - RNA, 65 nt, Homo Sapiens
auaguuuuuuaaaaaauuuaaugauggguaaucaaaacauucacauuuauucugcuggauuuaaa

SEQ ID NO: 345091 - RNA, 65 nt, Homo Sapiens
aacuuuuaaaaccauagacaagccuuauagaguagaacauucacagcaaagaagaauccugugaa

SEQ ID NO: 345092 - RNA, 65 nt, Homo Sapiens
uccacacuuuccugucucaaaauuuauucuaagcgaacauucaucaggacccgaguccaauaguc

SEQ ID NO: 345093 - RNA, 65 nt, Homo Sapiens
auguauuguucauuaagcuacauuucaugauuaagaacauucaacuaauuagaagguggaggagu

SEQ ID NO: 345094 - RNA, 65 nt, Homo Sapiens
caugaguauauguucuuggagagucucgggcaagaaacauucaugcaacuauagcaugcuuugaa

SEQ ID NO: 345095 - RNA, 65 nt, Homo Sapiens
uauuguaauguuuacuagcguugcuuauuuuucaaaacauucauuauuuuuugagguuuuuuugu

SEQ ID NO: 345096 - RNA, 65 nt, Homo Sapiens
gcaggaaacugugauuugcucauuuuuauuugauaaacauucagucuacccaguauuguuugaua

SEQ ID NO: 345097 - RNA, 65 nt, Homo Sapiens
uacggagaauguaagguuaccuuaauucuaguuaaaacauucacuccguuuccuuuuuccucuuc

SEQ ID NO: 345098 - RNA, 65 nt, Homo Sapiens
aguucacaucccuguuugggugccucugagcugaaaacauucaaaagguauuaggacgaccauac

SEQ ID NO: 345099 - RNA, 65 nt, Homo Sapiens
gguccuaccauuucuguucaugaaauucacuguaaaacauucaggcauaacuuaauuucuuuucc

SEQ ID NO: 345100 - RNA, 65 nt, Homo Sapiens
uggaaucagcugaaagcugugcuauguguuucaauaacauucacuauaguuucuuucauuugggg

SEQ ID NO: 345101 - RNA, 52 nt, Homo Sapiens
aggaauacuguugcagcugaaaaacauucagguuuucccccuuaaaucacag

SEQ ID NO: 345102 - RNA, 65 nt, Homo Sapiens
ugagaacaaucaaagcaguaauauuauuuuguauaaacauucaucauaaacuaaaugaagauaag

SEQ ID NO: 345103 - RNA, 65 nt, Homo Sapiens
cugucugugauuucucacauuuuuauuugcugagaaacauucagaaaauuauuccaaaaaugaag

SEQ ID NO: 345104 - RNA, 65 nt, Homo Sapiens
uauccuaagcauucacggcagugagcuccuuuacuaacauucauguuauggcaagaguuguccuc

SEQ ID NO: 345105 - RNA, 65 nt, Homo Sapiens
acuauaacaauguaguuacgcuacaacuugccuaaaacauucaaacuuguuuucuuuuuucuguu

SEQ ID NO: 345106 - RNA, 65 nt, Homo Sapiens
aauucaaugugauuaauuccuaaaaucauagcacuaacauucaguagucauguccagcucuuccu

SEQ ID NO: 345107 - RNA, 65 nt, Homo Sapiens
uugcccugccucugucccccagcuggaccgauuuuaacauucacaacaaaaugagaugaaagccg

SEQ ID NO: 345108 - RNA, 65 nt, Homo Sapiens
guuaagagaagaaugacaguauuggauuugugucaaacauucauuuguugacuuuuaacaucaaa

SEQ ID NO: 345109 - RNA, 65 nt, Homo Sapiens
uuccauuuccccucugcacccagaacagugguggcaacauucauugccaagggcccaaagaaaga

SEQ ID NO: 345110 - RNA, 65 nt, Homo Sapiens
guaguaacuaaugucaagucuacaucgacugguaaaacauucaaagaacaaacugacaaugaugu

SEQ ID NO: 345111 - RNA, 65 nt, Homo Sapiens
ugucaauuaaauauucaguuuuaugucuccaugcaaacauucaaagugcuuccaucagaacggag

SEQ ID NO: 345112 - RNA, 65 nt, Homo Sapiens
gucaacuugaaugugagggcuacggugugguuucaaacauucaugauggauguauuuuccuaccc

SEQ ID NO: 345113 - RNA, 65 nt, Homo Sapiens
acugcaacauacaggugccuuggggaaauguggagaacauucaaucuugccgucacuauucauca

SEQ ID NO: 345114 - RNA, 65 nt, Homo Sapiens
uugaacagagcauggaagacagagugauguuggccaacauucaauucuugccaggaggaggaaug

SEQ ID NO: 345115 - RNA, 65 nt, Homo Sapiens
gguuuuuguuuuguuagcuacuugaacauuuuuacaacauucacuaaacauagcuucuuacugaa

SEQ ID NO: 345116 - RNA, 65 nt, Homo Sapiens
uugaccuuauuuaugacuuuaggaaaaaaucccuaaacauucaccuuuaaaaaaaaaaaaaaaaa

SEQ ID NO: 345117 - RNA, 65 nt, Homo Sapiens
aacgggucugaaugucuagcugcucccuucuauccaacauucaacugaaauuuugugucugaugc

SEQ ID NO: 345118 - RNA, 65 nt, Homo Sapiens
uacuaacccuucuucaagauucauaucuacuuuauaacauucacagguuccaguccuucaacugu

SEQ ID NO: 345119 - RNA, 65 nt, Homo Sapiens
ucuggagaacagugguugccucuucugaagaucagaacauucagcauccagccacuucccccucu

SEQ ID NO: 345120 - RNA, 65 nt, Homo Sapiens
uacagguuuuuaugugaacaaauaaagcugcugugaacauucauguguuuucaguuuuuugcccu

SEQ ID NO: 345121 - RNA, 65 nt, Homo Sapiens
auagggcaaggauuuuaaaauuagucacuaucguaaacauucaugaauccagccaucguagugcu

SEQ ID NO: 345122 - RNA, 65 nt, Homo Sapiens
cugugcauuggccauacccuccugguguguucccuaacauucaaacuggugaaucuuuaacauua

SEQ ID NO: 345123 - RNA, 65 nt, Homo Sapiens
acuguuucuggccgaggacugaaaggcagagguucaacauucaggaaaauucagaccucucuccu

SEQ ID NO: 345124 - RNA, 65 nt, Homo Sapiens
uuuaguauuuuuacuauuauacggcguuuuuuuacaacauucaacgcugccgcugccgcugcacc

SEQ ID NO: 345125 - RNA, 65 nt, Homo Sapiens
gucuuuaguguaacaagaucacuggauuaaauauaaacauucagguuaauuaucuagauuuuugu

SEQ ID NO: 345126 - RNA, 65 nt, Homo Sapiens
aucaucacagaucuguagaacuauacaaaagugcuaacauucaugauuagggucucagaagguaa

SEQ ID NO: 345127 - RNA, 65 nt, Homo Sapiens
cuggagccccuggggcggugcuggccaaugcuggaaacauucacuuuccugcagccucuugggug

SEQ ID NO: 345128 - RNA, 65 nt, Homo Sapiens
uuguaugggauuuauaccaaauuauguauuugcuaaacauucacugcacacguguacagcggagu

SEQ ID NO: 345129 - RNA, 65 nt, Homo Sapiens
uaugucauccaaauaagagggcauuaagcauguauaacauucaaggucuguaguuguguuaguuu

SEQ ID NO: 345130 - RNA, 65 nt, Homo Sapiens
aauauagaaaaguauacaaacauguuuauuucaaaaacauucacauauugucuuuaaauguaacu

SEQ ID NO: 345131 - RNA, 65 nt, Homo Sapiens
uaguuuagacuccaaaccauggcacaccugagaucaacauucacauccauacucacagaaugaau

SEQ ID NO: 345132 - RNA, 65 nt, Homo Sapiens
gucuuuggagaaaugcuuaguggagguggaaaagcaacauucauauacuuuaauuuuguuuucug

SEQ ID NO: 345133 - RNA, 65 nt, Homo Sapiens
gagcuguuaauauguauaagaaaaugguaauaguuaacauucauuuuuguuacaaaaaguaauag

SEQ ID NO: 345134 - RNA, 65 nt, Homo Sapiens
guaaauaacuaaccaguuuucaggcaugauaacccaacauucaaggggugacggccgggcaggag

SEQ ID NO: 345135 - RNA, 65 nt, Homo Sapiens
guauauuguauagucaguguguauuuguauguguaaacauucaaugagaaccuuaucuuuaagau

SEQ ID NO: 345136 - RNA, 65 nt, Homo Sapiens
agguaaacaauuuuuuuccaucuacauaaacagguaacauucaauuuuuauuacaucuaaagagc

SEQ ID NO: 345137 - RNA, 65 nt, Homo Sapiens
cccaacccccugcccgccucuccgcacaauacuugaacauucaucuguacugaaguguuacuuga

SEQ ID NO: 345138 - RNA, 65 nt, Homo Sapiens
ggacacagaugaccgaccuggucacuccuccugccaacauucagucugguaugugaggcgugcgu

SEQ ID NO: 345139 - RNA, 65 nt, Homo Sapiens
cgggagaaacacaaaauaguauaacugaaaacauuaacauucagacacacucccuucugccuucc

SEQ ID NO: 345140 - RNA, 65 nt, Homo Sapiens
uguacugucuuuuuuuuuguuccauagacaaaugaaacauucagacuggaguaaucagguggaaa

SEQ ID NO: 345141 - RNA, 65 nt, Homo Sapiens
cagguugaauauuccuuauccuguuuuucccuaggaacauucauauggucuuauauuuuggcugu

SEQ ID NO: 345142 - RNA, 65 nt, Homo Sapiens
cagguugaauauuccuuauccuuuuuuucccuaggaacauucauauggucuuauauuuuggcugu

SEQ ID NO: 345143 - RNA, 65 nt, Homo Sapiens
cacugacucagcaaauacuugcagugguaagugaaaacauucauuccgugcuggacaucagaaau

SEQ ID NO: 345144 - RNA, 65 nt, Homo Sapiens
agagacacaguaggucucuggcagguucuggagagaacauucaugcacaccgaugagaugcucug

SEQ ID NO: 345145 - RNA, 65 nt, Homo Sapiens
auggcugcagugacccagauauugcacuaggucaaaacauucagguauagcugacaucuccucua

SEQ ID NO: 345146 - RNA, 65 nt, Homo Sapiens
ugaugggugggcuaguaauaaaauauuuaaaaaaaaacauucaaaaacauggccacauccaacau

SEQ ID NO: 345147 - RNA, 65 nt, Homo Sapiens
aaauaguagaggucagugaaggucugggguagggaaacauucagacuguccauugcauggcugug

SEQ ID NO: 345148 - RNA, 65 nt, Homo Sapiens
uguggaauuuccuaucuugcagcauccuguaaauaaacauucaaguccacccuuuucuugacuuc

SEQ ID NO: 345149 - RNA, 65 nt, Homo Sapiens
ucacuuuaaacuuuauaaaucaaagagauauuaggaacauucagaauuauuuguguuuuguuuuu

SEQ ID NO: 345150 - RNA, 65 nt, Homo Sapiens
gccaauagccuuguuauuaauguggaugauuuccaaacauucaaauguggcuuaguaaacuacuc

SEQ ID NO: 345151 - RNA, 65 nt, Homo Sapiens
agaagucugaagaagugcaacauucuaugugucagaacauucagauguuucaauuuuguuuugug

SEQ ID NO: 345152 - RNA, 65 nt, Homo Sapiens
cguuucuacuuugaaauucaucugcucccgagguuaacauucaaguaugcagucgcaauaacaug

SEQ ID NO: 345153 - RNA, 65 nt, Homo Sapiens
gacauuucugugguuugaauuuauacaauggaaauaacauucauuuguaggugacuuuuaaauga

SEQ ID NO: 345154 - RNA, 65 nt, Homo Sapiens
uucuaagaaguaggcuggacggaagcucaucacccaacauucagccucaagucaccagagagaau

SEQ ID NO: 345155 - RNA, 65 nt, Homo Sapiens
cagaacuagguagaaacagagguuccagugaugaaaacauucaaggcuccaguauuaaugaaaua

SEQ ID NO: 345156 - RNA, 65 nt, Homo Sapiens
gucaccugaaagagaaauggaggaaaacuuugaggaacauucaauauguaagaaaaaucugcuag

SEQ ID NO: 345157 - RNA, 65 nt, Homo Sapiens
ugguauuucauuuguaagaacauguuuucaaugaaaacauucacucuuuuuaaaauggagaaucg

SEQ ID NO: 345158 - RNA, 65 nt, Homo Sapiens
aaugauuacaguuuucauuuagaaaacauuuaauaaacauucaaucuuuuacuucaguuaacaaa

SEQ ID NO: 345159 - RNA, 65 nt, Homo Sapiens
uuuagguccuacuacauuguaaugaagaaccuccuaacauucaauucccacaggaagacccuuaa

SEQ ID NO: 345160 - RNA, 65 nt, Homo Sapiens
cuuguuugucccuggacugggccccuggaugcgcuaacauucacuuucuuccccuuaagcuuugu

SEQ ID NO: 345161 - RNA, 65 nt, Homo Sapiens
gggugucauaugcuuuccuaaccugauuuguaguuaacauucacagagccuacauuuucucauua

SEQ ID NO: 345162 - RNA, 65 nt, Homo Sapiens
gagguggacuggggagacagccuuggugcagcaagaacauucaacucaggaagcauuugacucgu

SEQ ID NO: 345163 - RNA, 65 nt, Homo Sapiens
cuuacauuaaaguccaauaugagaaauacauguuuaacauucaauaauaauuuuaaaaauuugag

SEQ ID NO: 345164 - RNA, 65 nt, Homo Sapiens
agugaauguguuagaauugcagugucauaccaaauaacauucaaaagaaaugagccauuaaguga

SEQ ID NO: 345165 - RNA, 65 nt, Homo Sapiens
ggaggguuacuuggggccaguaaaucaguagacugaacauucaauauaauaaaagaacaugggga

SEQ ID NO: 345166 - RNA, 65 nt, Homo Sapiens
cuugaguuugacauaggccuaaauacuuuagcaaaaacauucacuuacuaacauuuuaaaaauau

SEQ ID NO: 345167 - RNA, 65 nt, Homo Sapiens
uccaggagaacuuccccaaucuagcaaggcaggccaacauucagauucaggaaauacagagaacg

SEQ ID NO: 345168 - RNA, 65 nt, Homo Sapiens
ccucuaacccguccugaauucuuacuaaacauaagaacauucauacugaagaggaacccuaugag

SEQ ID NO: 345169 - RNA, 65 nt, Homo Sapiens
gagccuccuacccaugacaacaccccaauaaacagaacauucagagccaaugucguagagcuuuu

SEQ ID NO: 345170 - RNA, 65 nt, Homo Sapiens
auacucacguuuaagucaguaaggauacacauguuaacauucaggcuuuugucuugaugcccguc

SEQ ID NO: 345171 - RNA, 65 nt, Homo Sapiens
cucucacagucugugucaguuggcuuaaagcaacgaacauucacuaacaagucacccacacguag

SEQ ID NO: 345172 - RNA, 65 nt, Homo Sapiens
ugacuguauccagggcuucccuuccguucuuccgaaacauucagcuuccucaaugcacucugcuu

SEQ ID NO: 345173 - RNA, 65 nt, Homo Sapiens
uuuugaaggacaaguauaugaggaaugggagugagaacauucacucuaagggguaucucugcuac

SEQ ID NO: 345174 - RNA, 65 nt, Homo Sapiens
ucugaauuucucuguggcaauuggacacuuguuuaaacauucacaucccaucucaaaccuacacu

SEQ ID NO: 345175 - RNA, 65 nt, Homo Sapiens
accugugugaaaagcugggggucugcauuccagauaacauucaggguguagcucagagcacuugu

SEQ ID NO: 345176 - RNA, 65 nt, Homo Sapiens
uaauucauacuggagggaauccucaauccuuacuaaacauucauguggcaagccuuuuagcuguu

SEQ ID NO: 345177 - RNA, 65 nt, Homo Sapiens
ggagcucacauuuauggaauccccccagcaaggauaacauucaaaccaggccugggggcacagau

SEQ ID NO: 345178 - RNA, 65 nt, Homo Sapiens
auggccaggagaccacacaauugcugcccaacuucaacauucauauuaaaaauuaaaauguaaug

SEQ ID NO: 345179 - RNA, 65 nt, Homo Sapiens
agugugcucaaaaaugaaacacucucuguaugaagaacauucaaauuaguccccaguagaaaaau

SEQ ID NO: 345180 - RNA, 65 nt, Homo Sapiens
ccccuuuaugcaugagcagguugggaaaauucuagaacauucauucaggagaguugguaagagga

SEQ ID NO: 345181 - RNA, 65 nt, Homo Sapiens
guagaagacuuuuaggaaaagaaaaaacuuaugaaaacauucaaugugugcuaggaaauaaugca

SEQ ID NO: 345182 - RNA, 65 nt, Homo Sapiens
aacaucagagaauccauacuaccauuaugacuucaaacauucaucaaaaacacugagagugggaa

SEQ ID NO: 345183 - RNA, 65 nt, Homo Sapiens
ucccagguucaugcaauucuaucucgguucacugcaacauucacccguuggagugcagugaugug

SEQ ID NO: 345184 - RNA, 65 nt, Homo Sapiens
aaagugugguaaaaaaaaaacuuguuaacaacuugaacauucaucaggccuuucacuagccccac

SEQ ID NO: 345185 - RNA, 65 nt, Homo Sapiens
ugcacuuuccuaguucuuaagcauuugcguauguaaacauucauauuugcaauaaaaaagugagc

SEQ ID NO: 345186 - RNA, 65 nt, Homo Sapiens
cuaugaucuuaucuaggguuuuccuacccauccccaacauucagcucagcugccucuuucuugag

SEQ ID NO: 345187 - RNA, 65 nt, Homo Sapiens
uaaccaaauaaacaagucauccacaaucaaaauacaacauucaauacuuccaggugugucagacu

SEQ ID NO: 345188 - RNA, 65 nt, Homo Sapiens
agucuucuauuuacaaacuucaaaaaacacaaaacaacauucauguuuuaaaugcuuucuacuug

SEQ ID NO: 345189 - RNA, 65 nt, Homo Sapiens
aagaauuuguguuuaauuuuuugauaccaacacugaacauucaucagggaacuuuccugaaguuc

SEQ ID NO: 345190 - RNA, 65 nt, Homo Sapiens
gcaagcaaaugaaauuaagccacuuugggauaaugaacauucaguauaauucuacuuugucucau

SEQ ID NO: 345191 - RNA, 65 nt, Homo Sapiens
cuaaguuacaaauagcacuuacaaacacaaguuucaacauucaauguuccguaagugccugaaaa

SEQ ID NO: 345192 - RNA, 65 nt, Homo Sapiens
gugacuuuaauauuauaaaauagucacagcuuaaaaacauucagucagggcaauguuucaaaguu

SEQ ID NO: 345193 - RNA, 65 nt, Homo Sapiens
uuuaucauugcuauuuauuuuuaccuuuguuuuugaacauucaauccguucauuuuguauguaug

SEQ ID NO: 345194 - RNA, 65 nt, Homo Sapiens
caccuggcuucugcacacuccugcgaaagucggugaacauucacuccacauugaccccucccuag

SEQ ID NO: 345195 - RNA, 65 nt, Homo Sapiens
accucaucauuaugugggggcugauauuuaagagaaacauucaggaaaauuuuaacuggaauugu

SEQ ID NO: 345196 - RNA, 65 nt, Homo Sapiens
cagugccaucauccccaccccgcccaggguuccggaacauucauucccccaccggugaggaccug

SEQ ID NO: 345197 - RNA, 65 nt, Homo Sapiens
caaauguucagugaggaaaaguucagugaggaaaaaacauucagaagugugagugaggaaaacau

SEQ ID NO: 345198 - RNA, 65 nt, Homo Sapiens
aacauccugaagcugaucccauccugcuaccaucaaacauucacucggaaucaaaggugccaauu

SEQ ID NO: 345199 - RNA, 65 nt, Homo Sapiens
uuagcauuguucuuucagucagacaugauaugcgcaacauucagacaugauaugcgcaucauuca

SEQ ID NO: 345200 - RNA, 50 nt, Homo Sapiens
ccagccaagcaacccccuaaaacauucauaucuaggcaguauuuugcuuu

SEQ ID NO: 345201 - RNA, 65 nt, Homo Sapiens
cucugugcaggggugggggcgggucuaacugucuuaacauucaagucacugcucuucagaauaca

SEQ ID NO: 345202 - RNA, 65 nt, Homo Sapiens
ucuacugcuggacuuuucagagucuuucauaugcuaacauucauugugaaucucccaagaggcca

SEQ ID NO: 345203 - RNA, 65 nt, Homo Sapiens
guugaaauaauagauuaguuggguuuucacaugcaaacauucaaaaugaauacaaaauuaaaauu

SEQ ID NO: 345204 - RNA, 65 nt, Homo Sapiens
acaacuuaaacuuacuacuuuaggagaaaaaaaaaaacauucaauuucggacacugaguuauaua

SEQ ID NO: 345205 - RNA, 65 nt, Homo Sapiens
uuuaaaacuucaagcucaguaauuuugaacacugaaacauucaucuaggacauaauaacaaaguu

SEQ ID NO: 345206 - RNA, 65 nt, Homo Sapiens
uggaaagcaaacaugcuuccugcuauguaauugcuaacauucauauuagaugaugugcuguagcu

SEQ ID NO: 345207 - RNA, 65 nt, Homo Sapiens
acaguagucuauaguuaggauuaaaauaggaucugaacauucaaaagaaagcuuuggaaaaaaag

SEQ ID NO: 345208 - RNA, 65 nt, Homo Sapiens
caauguuccuucuaauggaugguguaaugaacuucaacauucauuuuauguaugacaguagacag

SEQ ID NO: 345209 - RNA, 65 nt, Homo Sapiens
aaaaauaagccauagacaugauaggauaucugaggaacauucaucgacugccuucauaagcgucc

SEQ ID NO: 345210 - RNA, 65 nt, Homo Sapiens
aaauuuauuacuuuuuaaaaauuuuuaaaaaugacaacauucacaguguugugauucuguauagg

SEQ ID NO: 345211 - RNA, 65 nt, Homo Sapiens
ccacgugagcacugucuuauguugugauugugaccaacauucagggcugggcuggauuaagcuuu

SEQ ID NO: 345212 - RNA, 65 nt, Homo Sapiens
aagucuggggugaagauuugggccccggccccuaaaacauucauucaaacagguacggcauucug

SEQ ID NO: 345213 - RNA, 65 nt, Homo Sapiens
agaacauuuuauugccuaguuuagaacaaagaagaaacauucagugcuaccaguguaugcaguaa

SEQ ID NO: 345214 - RNA, 65 nt, Homo Sapiens
ccauaucuacuuacacauacaccuacuaaacugaaaacauucauuguccauuguuugaggauguu

SEQ ID NO: 345215 - RNA, 65 nt, Homo Sapiens
ugggcuggacaguugcuugaaaugaccuaaccaaaaacauucaaggguucugcccccagauuucg

SEQ ID NO: 345216 - RNA, 65 nt, Homo Sapiens
gggagugguacaaaauggucugaugcuccuucaaaaacauucacuuuuuacaacgucaaggaauu

SEQ ID NO: 345217 - RNA, 65 nt, Homo Sapiens
acuauuuuuggagcuuaagauuuguuagagcuguuaacauucaaccuuauugauuauauugagag

SEQ ID NO: 345218 - RNA, 64 nt, Homo Sapiens
gagccguuuggccagggucuccaauuuaggcuuucaacauuaucucuaaagaagguuauacauu

SEQ ID NO: 345219 - RNA, 64 nt, Homo Sapiens
auggaugauaugcugcuucuguuuaacagugaugcaacauuauguggcugaaaaagaauauaaa

SEQ ID NO: 345220 - RNA, 64 nt, Homo Sapiens
auugucagucugacauuuaaugucuuucuauggacaacauuaaaucucccucccuucuguaauu

SEQ ID NO: 345221 - RNA, 64 nt, Homo Sapiens
cuuuuacauuuucccaacuagauggccuagaguccaacauuaccuuuugagaugacauuauugu

SEQ ID NO: 345222 - RNA, 64 nt, Homo Sapiens
aaaacaacugauauaauuacucaagaaauauuugcaacauuaguuuuuuuccagcaucagcaau

SEQ ID NO: 345223 - RNA, 64 nt, Homo Sapiens
augguagaaguaaaaaaaaaaaaaaaggacauagcaacauuaaaguaguggauuuuucugagua

SEQ ID NO: 345224 - RNA, 64 nt, Homo Sapiens
uucaucauccaaguuuguaguucauuuaaaaauacaacauuaaacacauuuugcuaggauguca

SEQ ID NO: 345225 - RNA, 64 nt, Homo Sapiens
gcaguuaccaucaaaggcagcauauuuccaauuccaacauuacuguuucuaccaagucccauua

SEQ ID NO: 345226 - RNA, 64 nt, Homo Sapiens
cuguauucgugggauugguguaggguuaaaucaucaacauuauuucauaaaauaagaauuuguu

SEQ ID NO: 345227 - RNA, 64 nt, Homo Sapiens
uuuguuuccuggcuuuaccuugggaaaaugcuagcaacauuauagaaauuuugccuuguugccu

SEQ ID NO: 345228 - RNA, 64 nt, Homo Sapiens
ucugggauuacaagugugagucacugcgacuggccaacauuaugugauuuaugugugaacuaua

SEQ ID NO: 345229 - RNA, 64 nt, Homo Sapiens
agcuuuaucuuuugaaacugcggugaaauaaagucaacauuauacuuugagcacaaaauuucca

SEQ ID NO: 345230 - RNA, 64 nt, Homo Sapiens
uaagugacuugguguuagaaauuuuaaaguuuugcaacauuaaaguuaauggaagaauucacca

SEQ ID NO: 345231 - RNA, 64 nt, Homo Sapiens
auaugugcuuccccaaguuuauaacaauauagaacaacauuauuuagauggcuugauauaccaa

SEQ ID NO: 345232 - RNA, 64 nt, Homo Sapiens
uccuuuaaaauacacagccuaaguuucuaauucacaacauuaauccagugguaguaacugugua

SEQ ID NO: 345233 - RNA, 64 nt, Homo Sapiens
cacaaagcuguugaaauauuuggaauuuaaggcccaacauuaaaacuauucacuaaaauuaauc

SEQ ID NO: 345234 - RNA, 64 nt, Homo Sapiens
gaaaagagacacaaauauaagugacaaagauuugcaacauuagauaauuauguuaaugucauua

SEQ ID NO: 345235 - RNA, 64 nt, Homo Sapiens
cuuaccuuauuucuuucaguuucucaacuuuauucaacauuagagccaagagccagcuucugcg

SEQ ID NO: 345236 - RNA, 64 nt, Homo Sapiens
ugaauguuuuauuauuuuuuacccaaaauugugacaacauuauggauacacaugcuuuuuuccc

SEQ ID NO: 345237 - RNA, 64 nt, Homo Sapiens
aguagacaaagaggauguggagagcugucuucagcaacauuauuacaaugcuugacuacaaaac

SEQ ID NO: 345238 - RNA, 64 nt, Homo Sapiens
ggauucuucuuuuguguccuuguuagccugcaaacaacauuaggcagguugcaguagcagugga

SEQ ID NO: 345239 - RNA, 64 nt, Homo Sapiens
cuuugaaauaaaaauuggcaaacuauuauuugugcaacauuacuuuguuguguaagacaaugau

SEQ ID NO: 345240 - RNA, 64 nt, Homo Sapiens
auugaugaugacuacgucccgaccuugcaauguucaacauuaacaguggcauuacauugagcgu

SEQ ID NO: 345241 - RNA, 64 nt, Homo Sapiens
ugccagcuauauaaggaauaaaguugauucauaucaacauuagaacuccagucccaaacuaauc

SEQ ID NO: 345242 - RNA, 64 nt, Homo Sapiens
cugcauuucaguuguauuauaguccaguucuuaucaacauuaaaaccuauagcaaucauuucaa

SEQ ID NO: 345243 - RNA, 64 nt, Homo Sapiens
cuacuauccauaaaugcaauaauaugcauguuaacaacauuaaaaacagcaaacagcaaucuaa

SEQ ID NO: 345244 - RNA, 64 nt, Homo Sapiens
cagcaagaacaguccauguuguauauaauacaaccaacauuauagaacuuuuaggguugugacu

SEQ ID NO: 345245 - RNA, 64 nt, Homo Sapiens
caugaacguuauuauauugucgaauuccuacugacaacauuauaacuguaugggagcuuaacuu

SEQ ID NO: 345246 - RNA, 64 nt, Homo Sapiens
ugaguugacuucugacaaaggugguaaauucagacaacauuaugaucuaauaaacuuuauuuuu

SEQ ID NO: 345247 - RNA, 64 nt, Homo Sapiens
uguauaaggcagguuuuauacaaccauuuagauucaacauuaaugguagaguggcauuuuacca

SEQ ID NO: 345248 - RNA, 64 nt, Homo Sapiens
aaauuguaccaaugaauacguaaacauacagugacaacauuaaacuuagaaaaguuuuaaaacu

SEQ ID NO: 345249 - RNA, 64 nt, Homo Sapiens
uauuuuuucuuuucuaugcaagauaagagauuaccaacauuacuugucuugaucuacccauauu

SEQ ID NO: 345250 - RNA, 64 nt, Homo Sapiens
uuuuucuucauccucaaaaggagacucuuuugcucaacauuaaauugugcuuccuaacccuaaa

SEQ ID NO: 345251 - RNA, 64 nt, Homo Sapiens
ugugguuauguuaccuuuaucuuguugaggaccacaacauuagcacggugccuugugcagaaua

SEQ ID NO: 345252 - RNA, 64 nt, Homo Sapiens
gaaaagaaagcuuuauuuuaacacucaucugaaucaacauuaaagccuuuucucucaaagcguu

SEQ ID NO: 345253 - RNA, 64 nt, Homo Sapiens
gcaaaaacagaacuuccaaaguaucuuucugugacaacauuagguucaggcuugaagucccuga

SEQ ID NO: 345254 - RNA, 64 nt, Homo Sapiens
ggaugcuugaagcuguacaagaacacuaccacugcaacauuaaucaguuaacucuagaaagaaa

SEQ ID NO: 345255 - RNA, 64 nt, Homo Sapiens
uaaucauugcuuucugcaacuaauacgaauaugccaacauuauaagggucaacuguacuauaaa

SEQ ID NO: 345256 - RNA, 64 nt, Homo Sapiens
acaauauuguuucuaauugcaaaaacaaagaagacaacauuaaauuuuacaauugaaaugacua

SEQ ID NO: 345257 - RNA, 64 nt, Homo Sapiens
ugcuaugcuagucacuuagcgcaaaguagagcggcaacauuaaguuuaggugcucugaguugag

SEQ ID NO: 345258 - RNA, 64 nt, Homo Sapiens
ucaagggcuacaauucaagccguauuuguacgcacaacauuaaaaugauuuccuuagcagaagc

SEQ ID NO: 345259 - RNA, 64 nt, Homo Sapiens
aucauauacgacugaaagaagaaaacuagauuuucaacauuacaggguugaaaugaaugaugag

SEQ ID NO: 345260 - RNA, 64 nt, Homo Sapiens
guguuacauuuaauauuuaauguaacuggucuagcaacauuaagggggauuucugaagccaacu

SEQ ID NO: 345261 - RNA, 64 nt, Homo Sapiens
auuaaaaaaaaauuuuaacugauaaaacuuagggcaacauuaauuaauguauauucuuaccuga

SEQ ID NO: 345262 - RNA, 64 nt, Homo Sapiens
acccuauuuaagagacugaucacacacguauacacaacauuacugaaagaacccugcgaaucaa

SEQ ID NO: 345263 - RNA, 64 nt, Homo Sapiens
uguaauagccaaaaaguggaaccaauguucauagcaacauuauuauacacacaaaaacuuguac

SEQ ID NO: 345264 - RNA, 64 nt, Homo Sapiens
auucauuagggaaaugcaagcaugaaaaaauacucaacauuauuaugcaaauggcuacuaagca

SEQ ID NO: 345265 - RNA, 64 nt, Homo Sapiens
guuggucuucucuugucaggcgauggaagaaugccaacauuagccuggcuuagggaacagggag

SEQ ID NO: 345266 - RNA, 64 nt, Homo Sapiens
uauuuuggguuuguuuaaaacagacauuuuuuaccaacauuaauaauaaaugaauagcuuauug

SEQ ID NO: 345267 - RNA, 64 nt, Homo Sapiens
auuuuaaauuagauauuuaucuauggcauauaugcaacauuaaaaccaucaugugauaauggua

SEQ ID NO: 345268 - RNA, 64 nt, Homo Sapiens
aaugguguuucucaaggaccuucaaaaaccaaaacaacauuauacauucuaagagucuaaaaau

SEQ ID NO: 345269 - RNA, 64 nt, Homo Sapiens
auuuugauauuagucuuaugauccuacacaguaucaacauuagauuuaaaauuacuucagugca

SEQ ID NO: 345270 - RNA, 64 nt, Homo Sapiens
aauacuaaaauacuugugugacaagagauucaugcaacauuaaagauauagggauauucauaug

SEQ ID NO: 345271 - RNA, 64 nt, Homo Sapiens
ccucuguacaaaagccucaagugagggucaaauucaacauuauccugaucuagacagcccccau

SEQ ID NO: 345272 - RNA, 64 nt, Homo Sapiens
aaggacuguguguaguaaugaaaauaccaaguugcaacauuacauguuuacaaaaaaaaaucug

SEQ ID NO: 345273 - RNA, 64 nt, Homo Sapiens
cuuuuagauuuggaaauugcuguuuacagucuaacaacauuaaaaugagagguagauucacaag

SEQ ID NO: 345274 - RNA, 64 nt, Homo Sapiens
ggcagccaaggauuauaaaccacuucccuaaaggcaacauuaaugcaaaaguccccagauggca

SEQ ID NO: 345275 - RNA, 64 nt, Homo Sapiens
caaaaaacuucaacaugcauaugauauauaguuacaacauuaauuuuaugaacuggagagcuuu

SEQ ID NO: 345276 - RNA, 64 nt, Homo Sapiens
uuugguuuguuuugcuauguuuugggauguauagcaacauuaaagaauugagacccauguuauc

SEQ ID NO: 345277 - RNA, 64 nt, Homo Sapiens
auauuguaacucacaugccucuaugccuucacuacaacauuagaaagaagggguagggauuugg

SEQ ID NO: 345278 - RNA, 64 nt, Homo Sapiens
uauucauacagaaaugcaaaauuuuuaaaaugcucaacauuaacuauacauggucaauaaguau

SEQ ID NO: 345279 - RNA, 64 nt, Homo Sapiens
uuauaagugccuggcaauagaaguacuaaagagccaacauuauuugcaucaaaauaaauuuacu

SEQ ID NO: 345280 - RNA, 64 nt, Homo Sapiens
uuauuuggaaaauggggaaaucauaaugucuguucaacauuaucgagaucaaauauaaaauuca

SEQ ID NO: 345281 - RNA, 64 nt, Homo Sapiens
uucuuucagacauuuauuuuuuucuaauaucuagcaacauuauauaaucagucugcacauccug

SEQ ID NO: 345282 - RNA, 64 nt, Homo Sapiens
uugucuuucaaaagacaccuguucaccaugcaggcaacauuaccgaucaacacuuuucuccagg

SEQ ID NO: 345283 - RNA, 64 nt, Homo Sapiens
aucucaccucuuucuuccuccucuguaccuuuaccaacauuaggacuugguuggcucccuuugu

SEQ ID NO: 345284 - RNA, 64 nt, Homo Sapiens
aacacuaaagagcuaggaaagaguugagcacaggcaacauuacaaacaaaggauuugaaaacac

SEQ ID NO: 345285 - RNA, 64 nt, Homo Sapiens
uguuuuaaaaaacuaaguguuuaggauuucaagacaacauuauacauggcucugaaauaucuga

SEQ ID NO: 345286 - RNA, 64 nt, Homo Sapiens
uaagacuuuuauaagacuagcuuaaaacaccaaccaacauuauuuuugcaaaagugaguuggac

SEQ ID NO: 345287 - RNA, 64 nt, Homo Sapiens
aaaaacaaaucuaacuuauuaauacuaggaauaccaacauuauuagggcacuugcagguuauuc

SEQ ID NO: 345288 - RNA, 64 nt, Homo Sapiens
auuaauuacacuagaaauauuuucaugucuugaacaacauuaauaguaauuagagguuuuucca

SEQ ID NO: 345289 - RNA, 64 nt, Homo Sapiens
acuaaaagucgaaagcacacaaaaaagucaaagacaacauuauagcuaaacacuguggaggcua

SEQ ID NO: 345290 - RNA, 64 nt, Homo Sapiens
guauuuuccacuuauuauuaugaguuugcuuucucaacauuauuuuuuucauugaucuaugcuu

SEQ ID NO: 345291 - RNA, 64 nt, Homo Sapiens
cugcccaccccacccccgucgugaaguccaccuccaacauuaacuugcuuucugcuuccuucug

SEQ ID NO: 345292 - RNA, 64 nt, Homo Sapiens
gagacuccgccucaaaaaaagaauacaaaugcuccaacauuauuuuuuauaacucuggauuacc

SEQ ID NO: 345293 - RNA, 64 nt, Homo Sapiens
gugaguaaugacaggacuacaacuaaaacauaaacaacauuaaugaugaccauaaaaagucaca

SEQ ID NO: 345294 - RNA, 64 nt, Homo Sapiens
cugacuggauuaaggaauaccuagacagcugguacaacauuauuucugggugugucugugagug

SEQ ID NO: 345295 - RNA, 64 nt, Homo Sapiens
gucucauuuagcaaguauggaaguugaggcagggcaacauuaagcaacuuacauaacucaugca

SEQ ID NO: 345296 - RNA, 64 nt, Homo Sapiens
aagacagacuaaaaagaguaauaaaucaauacaacaacauuaaaagccagacuagcggaguuug

SEQ ID NO: 345297 - RNA, 64 nt, Homo Sapiens
uaaguuggguauuuuuuuaaaaaaagaaaaacagcaacauuaauaaaagaagugguguguuuuu

SEQ ID NO: 345298 - RNA, 64 nt, Homo Sapiens
cuguauuguuaauuuugugccauauuuugaauugcaacauuaugcuaaguauaacuuugcaagu

SEQ ID NO: 345299 - RNA, 64 nt, Homo Sapiens
guuuuucuaaauaaauguaacuuuucacaagagucaacauuaaaaaauaaauuauuuaagaaca

SEQ ID NO: 345300 - RNA, 64 nt, Homo Sapiens
uaucauaugcagauacuuauauuacaaacaucugcaacauuaugguucaguaucuuuuauguaa

SEQ ID NO: 345301 - RNA, 64 nt, Homo Sapiens
uugcauucaccuuuacaaagacauuuccauguuucaacauuagucuucccucuuuuuuaaaguc

SEQ ID NO: 345302 - RNA, 64 nt, Homo Sapiens
gauuaauguuuauuuaaacgguguuuucagaauucaacauuaaaaccaacuaugauuuaugguu

SEQ ID NO: 345303 - RNA, 64 nt, Homo Sapiens
gagauugucguguauagucaaaacagccaucauccaacauuauuuucaucagaaugaaggggaa

SEQ ID NO: 345304 - RNA, 64 nt, Homo Sapiens
ggccauauuguaagauuucccaaauaaagacaaacaacauuaaggagaaagaugaaaauaggaa

SEQ ID NO: 345305 - RNA, 64 nt, Homo Sapiens
acucauaauuauuuuguugauaaauugacauaaccaacauuaaagggaagaccaaaauuacuaa

SEQ ID NO: 345306 - RNA, 64 nt, Homo Sapiens
agugguguaacauguaagcucauuucuuuguuuucaacauuagaugcaugaaaguuuaauuaga

SEQ ID NO: 345307 - RNA, 64 nt, Homo Sapiens
aauuuaauuuguuagcugcauuagaauaaugugacaacauuacaagauaaacuaaucaaauaaa

SEQ ID NO: 345308 - RNA, 64 nt, Homo Sapiens
uuuuaugauucuguuuugcccucacugcuuaacucaacauuaaauuggagaccuagacauucag

SEQ ID NO: 345309 - RNA, 64 nt, Homo Sapiens
gcaagucuuagagauuuaaauauccagccaaauucaacauuacuaaaauauuauaaccacaggg

SEQ ID NO: 345310 - RNA, 64 nt, Homo Sapiens
ugaagcaucaaaaauaaaugugauaguuuacuggcaacauuaaucaaugacugaaagucaaugc

SEQ ID NO: 345311 - RNA, 64 nt, Homo Sapiens
uucaugccaauaaaagauuuuuuggugccauuuacaacauuauuauaugcauuuaaguggaaua

SEQ ID NO: 345312 - RNA, 64 nt, Homo Sapiens
uucagaucaaguauuguugaaagcuauacauauacaacauuacagucugucuguauuuagauau

SEQ ID NO: 345313 - RNA, 64 nt, Homo Sapiens
auauguuacuaaaacaggcuccaccucaguuuaucaacauuauaaguuacuguucuaagaaaag

SEQ ID NO: 345314 - RNA, 64 nt, Homo Sapiens
uuuauagauaugagaaacauaauguucuaaccaacaacauuaugguauuugugugacuuuuauu

SEQ ID NO: 345315 - RNA, 64 nt, Homo Sapiens
uggaaaagccauuauuaucugcucagauuuuacucaacauuagagaguuaguacguaauaaaag

SEQ ID NO: 345316 - RNA, 64 nt, Homo Sapiens
acaguuggcuauucaucaucuucggcacuuaugacaacauuaacacagaaugccaguucaucag

SEQ ID NO: 345317 - RNA, 64 nt, Homo Sapiens
acauuguuuucaaccagaaauuaaaguagauauccaacauuauuuucagugcuuguacuucaug

SEQ ID NO: 345318 - RNA, 64 nt, Homo Sapiens
uguuuuuuuccccuagacaauaucagguuaccgucaacauuaauccauuuaaaaggacauggac

SEQ ID NO: 345319 - RNA, 64 nt, Homo Sapiens
auccaaaugugacuuugaaaauuguuagagaaaacaacauuagaaaauggcgcaaaaucguuag

SEQ ID NO: 345320 - RNA, 64 nt, Homo Sapiens
aucuucagaaaaggaagcaguuuccuaauacaagcaacauuaacguuucuauuuuagaugagug

SEQ ID NO: 345321 - RNA, 64 nt, Homo Sapiens
aauuuacagauucaguuuauuuguuuuuucuuuucaacauuaccucaguuuuguucuuacccaa

SEQ ID NO: 345322 - RNA, 64 nt, Homo Sapiens
auggcccuguagcucugaauuuguacaacaccagcaacauuauaauucauaccuucugaugaag

SEQ ID NO: 345323 - RNA, 64 nt, Homo Sapiens
gguaccagccugucacaacuauuggucugggaggcaacauuaauauauuuuacaaaugcuagau

SEQ ID NO: 345324 - RNA, 64 nt, Homo Sapiens
ucuaguugcuuucccuuaguuggaagacagguaacaacauuaaaacauuuaacuaugguauuua

SEQ ID NO: 345325 - RNA, 64 nt, Homo Sapiens
uuuuaacaucuuauuuuuuucauuaauuacauaucaacauuaauuuuguaucuugaagcaaauu

SEQ ID NO: 345326 - RNA, 64 nt, Homo Sapiens
ccagcugaccuucaaacccugcauuugaaccgaccaacauuaaguccagagaguaaacuugaau

SEQ ID NO: 345327 - RNA, 64 nt, Homo Sapiens
gucaacucuuuuaauuuauauacaaagcaaagaacaacauuaauggagaugcacaaugauuauu

SEQ ID NO: 345328 - RNA, 64 nt, Homo Sapiens
cucuaauuugaacugguauuguuuacguuugauacaacauuaaggaauuugaugauuuucauuu

SEQ ID NO: 345329 - RNA, 64 nt, Homo Sapiens
agcugcaaccuuucuguuuuauuuaaagaaagcccaacauuaaaggguuuucauugcaagcgug

SEQ ID NO: 345330 - RNA, 64 nt, Homo Sapiens
uuaaaagucaccccaacuguuaaagugagggauccaacauuacugguuauagugggaauauaaa

SEQ ID NO: 345331 - RNA, 64 nt, Homo Sapiens
cacaccaacgagacagaaaguaacaccccacugucaacauuagaaauaauaauaauggcaaacu

SEQ ID NO: 345332 - RNA, 64 nt, Homo Sapiens
ugauuuaaauaaaauugaaaucuucauaucaucacaacauuauuaugugguuucuaugcaaagu

SEQ ID NO: 345333 - RNA, 64 nt, Homo Sapiens
uauguggacugcuuaaaucauggcaauccuuaagcaacauuaucaagaauaacagaaugcaucg

SEQ ID NO: 345334 - RNA, 64 nt, Homo Sapiens
aaagagguggguucuguuuuuguuacugaaaaugcaacauuagccaaugcaguauucucaauug

SEQ ID NO: 345335 - RNA, 64 nt, Homo Sapiens
uguucaugaagacuuaagaaaaaugucacuacugcaacauuaggaauguccugcacuuaauaga

SEQ ID NO: 345336 - RNA, 64 nt, Homo Sapiens
agccccccaaaaauuaucuagccguuucgaauaucaacauuacccugguguauucacugcugua

SEQ ID NO: 345337 - RNA, 64 nt, Homo Sapiens
gggaauuuucauaauaguucauacauuugucagccaacauuaaaagguaaccaacuccucaggu

SEQ ID NO: 345338 - RNA, 64 nt, Homo Sapiens
gaggaucagagaugggaaaggacuagcccaaggccaacauuaacaagcccucuaacaaaaacuu

SEQ ID NO: 345339 - RNA, 64 nt, Homo Sapiens
cuguuugaauuaagaugggcuaagauggggcuugcaacauuaaacaugagcugagcauccauaa

SEQ ID NO: 345340 - RNA, 64 nt, Homo Sapiens
gaguggggggaucacaaagcgacggcagggaggucaacauuaaccuggccaagagagaagacug

SEQ ID NO: 345341 - RNA, 64 nt, Homo Sapiens
uuugaacuauauccuuccuauaaacugaaggacucaacauuacaauauuguuucaguguucaaa

SEQ ID NO: 345342 - RNA, 64 nt, Homo Sapiens
gcuaagaggaacacuucaacuagaaaaaugacugcaacauuaaacuuaacuccuuaguauuuca

SEQ ID NO: 345343 - RNA, 64 nt, Homo Sapiens
ccaagugcugugggcuuuucuguuuuugcaacugcaacauuaaauaugggauaggaacugucag

SEQ ID NO: 345344 - RNA, 64 nt, Homo Sapiens
cuagaggggucuuguucaaacaaaggcucaugagcaacauuaggcuugcguggaaugaaaacgc

SEQ ID NO: 345345 - RNA, 64 nt, Homo Sapiens
aaauugguguuucugaaugacaucaacauucccccaacauuacuccauuacuaaagacagaaaa

SEQ ID NO: 345346 - RNA, 64 nt, Homo Sapiens
auauaccagaguacuguaaaaucuagguuuuuuucaacauuagcaguaaauugagcacuguuua

SEQ ID NO: 345347 - RNA, 64 nt, Homo Sapiens
gccuguuggaauuaauuuaagcuuaaguauauaucaacauuauuuuauugugcaauuaaaacaa

SEQ ID NO: 345348 - RNA, 64 nt, Homo Sapiens
aagagguggacuuuacagauaauggagcagaagccaacauuaguaaaaggaaucccaacuucuu

SEQ ID NO: 345349 - RNA, 64 nt, Homo Sapiens
gaaugaagccaauaggaaauaaaaaacaggcacacaacauuauuuggggaaaaacaccucuagu

SEQ ID NO: 345350 - RNA, 64 nt, Homo Sapiens
caaaauaagugucgaguuaccacauucgguugagcaacauuauaaugcuauaauuauaguaucc

SEQ ID NO: 345351 - RNA, 64 nt, Homo Sapiens
auuuuaaaauaaaauaauuguuaccuggcacuagcaacauuagaaguaggcacucuuuaaucca

SEQ ID NO: 345352 - RNA, 64 nt, Homo Sapiens
agcugggaaggugucugaggccuuacccagaacacaacauuagccuagguugaaagauaggcag

SEQ ID NO: 345353 - RNA, 64 nt, Homo Sapiens
gaugucauugagacuauauuuauauuugacuuggcaacauuaacauguccuaagacuuagugca

SEQ ID NO: 345354 - RNA, 64 nt, Homo Sapiens
auaaauaaggaucacacuguauuagggguuauggcaacauuauugaauuuuuuauguacauaaa

SEQ ID NO: 345355 - RNA, 64 nt, Homo Sapiens
ccgaggucugcgagggcuucgacgaggagggccgcaacauuagcaagacccgcggguggcacag

SEQ ID NO: 345356 - RNA, 64 nt, Homo Sapiens
aggaacagauugggugucaguucaggauaaauaccaacauuaacagcagaaugaugcaaugaaa

SEQ ID NO: 345357 - RNA, 64 nt, Homo Sapiens
aaagagcacuucuguggcucauguugauuugcgucaacauuauaagugcauuucuauaauauaa

SEQ ID NO: 345358 - RNA, 64 nt, Homo Sapiens
ucuaauuaguucauuuccaaaguaaguuuauuuccaacauuagcaucaugcagccuauccaaua

SEQ ID NO: 345359 - RNA, 64 nt, Homo Sapiens
ggaccuuuaaaaggaaguaacauauccacuauaacaacauuaaacccuccauuuguguuuauug

SEQ ID NO: 345360 - RNA, 64 nt, Homo Sapiens
guauuuuauucuacucugucgcuuugugucaucacaacauuaaagagcagcggggcaguguggg

SEQ ID NO: 345361 - RNA, 64 nt, Homo Sapiens
gagaaauuguaccuuaaguugccaaagcccgagacaacauuaaguauccuuuaaacuaaauuuu

SEQ ID NO: 345362 - RNA, 64 nt, Homo Sapiens
gcaguaugauaucaugcuuguaaggggagcucuucaacauuaagugcuagcuaaaagacaaauu

SEQ ID NO: 345363 - RNA, 64 nt, Homo Sapiens
cccauggagaaacacuggcaauccugucccaugucaacauuauaaguccccacaacaaagaauc

SEQ ID NO: 345364 - RNA, 64 nt, Homo Sapiens
auuaaaaauaagaaauuaagagucagacaguuggcaacauuauaaucccugauccuucaagguc

SEQ ID NO: 345365 - RNA, 64 nt, Homo Sapiens
uuucuuggggcagagaagguggagaguaaagacccaacauuacuaacaaugauacaguugcaug

SEQ ID NO: 345366 - RNA, 64 nt, Homo Sapiens
cuucaaagaaauugagccagcacuaucuguacuccaacauuaccggaucuggauuggggagguu

SEQ ID NO: 345367 - RNA, 64 nt, Homo Sapiens
aaucaccaaaggagcuauggagagaauuaaaacucaacauuacuguuaacugugcguuaaauaa

SEQ ID NO: 345368 - RNA, 64 nt, Homo Sapiens
aggacaguugcaaaaggcuucaaggaauuuaucucaacauuauucuuucuauguccuaacuaaa

SEQ ID NO: 345369 - RNA, 64 nt, Homo Sapiens
cucagauaagaagaaaucaucucuacaauguagacaacauuauauuuuauagaauuuguuugaa

SEQ ID NO: 345370 - RNA, 64 nt, Homo Sapiens
ggcaaagccauggagaaaugcuccacagugagagcaacauuaagggaucccaggagacaacagu

SEQ ID NO: 345371 - RNA, 64 nt, Homo Sapiens
aauacuaaaaaauaaagacauaaagcaagucuaucaacauuaaaacuaaugauacacagauaga

SEQ ID NO: 345372 - RNA, 64 nt, Homo Sapiens
uccuugcacaaucaaauuaagaacuuaacuuacacaacauuaaauaaacuuaaaaggagauuuu

SEQ ID NO: 345373 - RNA, 64 nt, Homo Sapiens
ccauuaaagcuaaccuauuuuguuauuuauagaacaacauuaauuguuucaguuacaacuguaa

SEQ ID NO: 345374 - RNA, 64 nt, Homo Sapiens
gccccugucucucuucuguacuucauuccccuaucaacauuaccuucugcuccugcuucucucu

SEQ ID NO: 345375 - RNA, 64 nt, Homo Sapiens
uuaagaccaguacugcaggaagauuccccauuugcaacauuaggaauuaaccuuguugaaucuc

SEQ ID NO: 345376 - RNA, 64 nt, Homo Sapiens
cauaguuuaagucuuuuaucuaaauggaacucaccaacauuauuucugggaaauuguuauagcu

SEQ ID NO: 345377 - RNA, 64 nt, Homo Sapiens
ugaauugagcaccucaagcauuuaacucucaguccaacauuauuccuguucagucaacaaguau

SEQ ID NO: 345378 - RNA, 64 nt, Homo Sapiens
uccuaccucuguucucgcugaaacucucggauggcaacauuaagcucauucuuggccucgcaga

SEQ ID NO: 345379 - RNA, 64 nt, Homo Sapiens
aguaacuuucaaccuugccaguuuuuauagcuaucaacauuagggucuuguuauguacaaacua

SEQ ID NO: 345380 - RNA, 64 nt, Homo Sapiens
uuucuuucuuaaggcaaggcacuuuuuaaaccaucaacauuacuugcugcuucaaaaaguacuu

SEQ ID NO: 345381 - RNA, 64 nt, Homo Sapiens
uaaguaugagauacuugaugggggcuuuaucaugcaacauuaguuugcuuaccuuaagaauugc

SEQ ID NO: 345382 - RNA, 64 nt, Homo Sapiens
guggaggaaaggaggaaaaagugcuuauuaugugcaacauuaugauuaaucugauuauacacca

SEQ ID NO: 345383 - RNA, 64 nt, Homo Sapiens
cucuaauucuuuuccagugugccaacuccaaagucaacauuaaaaauguaaauggaccugugua

SEQ ID NO: 345384 - RNA, 64 nt, Homo Sapiens
cacuuacaguuaggauuugugguaagguaccucucaacauuaccaaaaucauuucuuuagaggg

SEQ ID NO: 345385 - RNA, 64 nt, Homo Sapiens
uaacaauuuuacgucaugucaaaggugaaaggaacaacauuaauaaaagaaggaaaaggaggua

SEQ ID NO: 345386 - RNA, 64 nt, Homo Sapiens
aauagauuugaaacauuuauuaauguucaacaagcaacauuaaauucuggaagugugaaaaugu

SEQ ID NO: 345387 - RNA, 64 nt, Homo Sapiens
ccuuacuagaaccacaagaaugucucuucuuauucaacauuaauuauauguacauucuaaugug

SEQ ID NO: 345388 - RNA, 64 nt, Homo Sapiens
ugaaguaguucuucaguuauaauucugugaauuucaacauuauucuauaacuauaaaucucuag

SEQ ID NO: 345389 - RNA, 64 nt, Homo Sapiens
aaccuguggagucacacguuaaaaacaaugacaacaacauuacuuggaauaauuccaacuuaac

SEQ ID NO: 345390 - RNA, 64 nt, Homo Sapiens
auuacuuuggauuuguaaucagugauucuguaaccaacauuagauuuuacugggggagugggaa

SEQ ID NO: 345391 - RNA, 64 nt, Homo Sapiens
uuguggccucuuucuacaccaauuuuuuuuuuaacaacauuaaccacuugguuagcagauguuu

SEQ ID NO: 345392 - RNA, 64 nt, Homo Sapiens
caauuuaaucacucuuggaauaaauucacauauacaacauuauauaacauguaaacaaaagugu

SEQ ID NO: 345393 - RNA, 64 nt, Homo Sapiens
cugugugauuacagcauaggauauucauacuuuccaacauuaucaccuuuaaaaaauaauuuag

SEQ ID NO: 345394 - RNA, 64 nt, Homo Sapiens
ugagcauuuacuuuguauuuuuuuuaaaucacuucaacauuauuuaaauauaugaguauuugag

SEQ ID NO: 345395 - RNA, 64 nt, Homo Sapiens
uaaaaugaguuacuugaaugauuaacaauaauaacaacauuaaguaaauuaggcacaguaagag

SEQ ID NO: 345396 - RNA, 64 nt, Homo Sapiens
uggagaucaguagugucaucuucauaaagcaagacaacauuaugacacuuuaaaacaguagcaa

SEQ ID NO: 345397 - RNA, 64 nt, Homo Sapiens
uuccuugcugucacagaugauagguucauguacacaacauuaauguuugauaaggaaagcauuu

SEQ ID NO: 345398 - RNA, 64 nt, Homo Sapiens
augacucagaccauaagcuuuucaugccagaugucaacauuaagcugcaacauccuaaccacca

SEQ ID NO: 345399 - RNA, 64 nt, Homo Sapiens
guggagacuaucagcccaagaugcuuuaagugcacaacauuacagggaaugccugagugccugg

SEQ ID NO: 345400 - RNA, 64 nt, Homo Sapiens
uuuuaaaaaucuuaaauccuacugagagcagcaacaacauuauuggguugucagugauuuguga

SEQ ID NO: 345401 - RNA, 64 nt, Homo Sapiens
ccagagagaauuuuauguuucacauauaguucaacaacauuaauaguuuauaauucccaccuuu

SEQ ID NO: 345402 - RNA, 64 nt, Homo Sapiens
aacaauggccacauuuaguuauaagaacauaaaccaacauuauaaugguaacuacauagauguu

SEQ ID NO: 345403 - RNA, 64 nt, Homo Sapiens
caacuauagaagagaggcuaacacaguggcaagacaacauuaccucacuugggagagauggcaa

SEQ ID NO: 345404 - RNA, 64 nt, Homo Sapiens
acucaggaccccaagauacacaggugggcgaugccaacauuaauuuggcagauaugaggauggu

SEQ ID NO: 345405 - RNA, 64 nt, Homo Sapiens
gaaguauagggauguauuuaauuuuacuaugcuccaacauuaaucaugacucuuuuguaaauua

SEQ ID NO: 345406 - RNA, 64 nt, Homo Sapiens
augaaguugaauuguuuuuagugaacuuacauagcaacauuaaagaacuuccagggauuuuauu

SEQ ID NO: 345407 - RNA, 64 nt, Homo Sapiens
aagacauucuuuuguaccuuagaucuaugaacuacaacauuauggccccuuccuucuguucccc

SEQ ID NO: 345408 - RNA, 64 nt, Homo Sapiens
gaaaauggacuuuuuuuauucauacuuuuuuguacaacauuaaauauuuacuuucgguucugcu

SEQ ID NO: 345409 - RNA, 64 nt, Homo Sapiens
aaccaugaccugcuccuccauuuccauuuauucucaacauuaaauaguuuuaucuuguuguugc

SEQ ID NO: 345410 - RNA, 64 nt, Homo Sapiens
aaaagcaguggcuccauugguguugacauacauccaacauuaaaagccacccccaaaugcccaa

SEQ ID NO: 345411 - RNA, 64 nt, Homo Sapiens
cuagauguguacuuuugagggacaugagguuaggcaacauuacagcaacacacacuggggcuau

SEQ ID NO: 345412 - RNA, 64 nt, Homo Sapiens
auuuucuacagcuugcugaguugucauuccuuugcaacauuaaaauacaugcugaacucauauu

SEQ ID NO: 345413 - RNA, 64 nt, Homo Sapiens
gauuuuuuuuucuguuugcauuuuucacaauuuucaacauuaguaacugcuuaaugguuggggu

SEQ ID NO: 345414 - RNA, 64 nt, Homo Sapiens
uuccccaccaucuuuaaaucaaaguuguuuaaaacaacauuaauuuuaaaaaauacauaaaagc

SEQ ID NO: 345415 - RNA, 64 nt, Homo Sapiens
ugacugcuuaagucagccaguucagcauggauaccaacauuagcuuuucuucuugguuauauca

SEQ ID NO: 345416 - RNA, 64 nt, Homo Sapiens
cgaguuacagacaaacaucaccguaaaugacucacaacauuauaaacaguugugagaaaauauu

SEQ ID NO: 345417 - RNA, 64 nt, Homo Sapiens
cugugauugacaguagcuguagguuaccagacggcaacauuagaaagugauuguaaauaacaug

SEQ ID NO: 345418 - RNA, 64 nt, Homo Sapiens
aaaucaauacuggauagaaagcucacaccuuacucaacauuagaugcuaaaacccuaaacuggu

SEQ ID NO: 345419 - RNA, 64 nt, Homo Sapiens
uaggauuuauucuucacaauuuuauuuaaauuagcaacauuacucucuuuguugaauuuuuguc

SEQ ID NO: 345420 - RNA, 64 nt, Homo Sapiens
aagacacagcugagaguugauuuggcaucucguacaacauuauucuguuacaaauccuucuugu

SEQ ID NO: 345421 - RNA, 64 nt, Homo Sapiens
acaauaauaaugggagacuuaaacaccccacugucaacauuagaucaaugagacagaaaguuaa

SEQ ID NO: 345422 - RNA, 64 nt, Homo Sapiens
cuucuuuccccacaugccccacuaaaccaucugacaacauuaaugaauaaaauggugaaaaugu

SEQ ID NO: 345423 - RNA, 64 nt, Homo Sapiens
uauuugacucuccguauuggagaaaauaaaauuacaacauuacgacauacuaaaaaaucaauau

SEQ ID NO: 345424 - RNA, 64 nt, Homo Sapiens
gauuaauauuggauauuacuguuuuuauuaucaucaacauuauuauuaguggauuucuuaauag

SEQ ID NO: 345425 - RNA, 64 nt, Homo Sapiens
gagagagauucuguuuccugaggcuuaauacacccaacauuauaacaaaggacuguagcaaggg

SEQ ID NO: 345426 - RNA, 64 nt, Homo Sapiens
aaaccaaauccaucugcacaucaaaaagcuaauccaacauuaucaagcaggcuuuaguguuggg

SEQ ID NO: 345427 - RNA, 64 nt, Homo Sapiens
acugaaaauggaaauaaacuauuuaugaaaaagucaacauuagaaguggagauuccaggugaau

SEQ ID NO: 345428 - RNA, 64 nt, Homo Sapiens
aaauauuuucacuccuuaaauuuaaagcacaugacaacauuagaacagacauuucauacauauc

SEQ ID NO: 345429 - RNA, 64 nt, Homo Sapiens
uaauguauagugugauuaauucucacaauauacucaacauuauacgauauguguaaagaucuac

SEQ ID NO: 345430 - RNA, 64 nt, Homo Sapiens
cucuccuuccucagugugcucugcugccuucccacaacauuaaagagcccgcacccuaagcauc

SEQ ID NO: 345431 - RNA, 64 nt, Homo Sapiens
ggcuuccuccuagaguguuggcacacacuuuucucaacauuauuuugagaaaccuuuagucaca

SEQ ID NO: 345432 - RNA, 64 nt, Homo Sapiens
uaaaacuucuauaaaucccuaaauuggauguagacaacauuacuuguagucuuccaugcuugac

SEQ ID NO: 345433 - RNA, 64 nt, Homo Sapiens
aagauaauggaaaucacgacgacuuaggugcugucaacauuagcgucucucuuuguuuuaaugu

SEQ ID NO: 345434 - RNA, 64 nt, Homo Sapiens
uucucuucuuccucagcuucacuacauugcaagucaacauuauucaaauuaucaguuaaucgaa

SEQ ID NO: 345435 - RNA, 64 nt, Homo Sapiens
aacugauacauagaaccaaggaaagauucuuugucaacauuagugugucccuuuuugguuucug

SEQ ID NO: 345436 - RNA, 64 nt, Homo Sapiens
aaauuuaaaagcuuaaauaucuuuuaaaaaauaccaacauuaugauuaagugaaccucccgugc

SEQ ID NO: 345437 - RNA, 64 nt, Homo Sapiens
uugccuuugaauuagcuuucccuaggccaugagucaacauuaguaguuuauacauccaaauugg

SEQ ID NO: 345438 - RNA, 64 nt, Homo Sapiens
aaauacucgaggcauaaauggguuauauucccaacaacauuaaaaauuuauuuuuauuuuuugu

SEQ ID NO: 345439 - RNA, 64 nt, Homo Sapiens
aucagugcuguuuguaauuuuucacuuugagaaccaacauuaauuccauaugaaucaaguguuu

SEQ ID NO: 345440 - RNA, 64 nt, Homo Sapiens
uaaauuuauaauuccauauuuauaauguuggccacaacauuaugauuauuccuugucuguacuu

SEQ ID NO: 345441 - RNA, 64 nt, Homo Sapiens
uuuuuuauaauaugauucacuuaugccacagauucaacauuagaauauguuuuaucucuacugu

SEQ ID NO: 345442 - RNA, 64 nt, Homo Sapiens
gaaaauuaaaggcguuuuacucacauggcuauuucaacauuaguuuuuuuuguuuguuucuuuu

SEQ ID NO: 345443 - RNA, 64 nt, Homo Sapiens
auauacaauauauauuuugugggcuuaauugaaacaacauuauuuuaaaaucaaaggggauaua

SEQ ID NO: 345444 - RNA, 64 nt, Homo Sapiens
aagcggauccaaagacccaggggaacuuggcauucaacauuaaagaggagccuuucgauaucug

SEQ ID NO: 345445 - RNA, 64 nt, Homo Sapiens
agaagagauccaucauguagacugaaacucuaugcaacauuaaaaguuagcccucacuagccaa

SEQ ID NO: 345446 - RNA, 64 nt, Homo Sapiens
uaggaaacaaagaacuuuaaaauacuucugcauacaacauuaaucaggaaaauuuaguuuacag

SEQ ID NO: 345447 - RNA, 64 nt, Homo Sapiens
guuaacagauuuuccuccguuccaaauugcuacccaacauuacuuucugucuacuaguaaacau

SEQ ID NO: 345448 - RNA, 64 nt, Homo Sapiens
acaaagguuuccucaguuuaaggacggcuuuuaccaacauuagccacugagaaccugcugagca

SEQ ID NO: 345449 - RNA, 64 nt, Homo Sapiens
auuuaauaugcuuuuguugaggucaaguaaagcacaacauuauguacggcugcaaaauggcuaa

SEQ ID NO: 345450 - RNA, 64 nt, Homo Sapiens
gaaaauuaaagguguuuuacucacauggauauuucaacauuaguuuuuuuuguuuguuucuuuu

SEQ ID NO: 345451 - RNA, 65 nt, Homo Sapiens
agagccguuuggccagggucuccaauuuaggcuuucaacauuaucucuaaagaagguuauacauu

SEQ ID NO: 345452 - RNA, 65 nt, Homo Sapiens
cauggaugauaugcugcuucuguuuaacagugaugcaacauuauguggcugaaaaagaauauaaa

SEQ ID NO: 345453 - RNA, 65 nt, Homo Sapiens
aauugucagucugacauuuaaugucuuucuauggacaacauuaaaucucccucccuucuguaauu

SEQ ID NO: 345454 - RNA, 65 nt, Homo Sapiens
acuuuuacauuuucccaacuagauggccuagaguccaacauuaccuuuugagaugacauuauugu

SEQ ID NO: 345455 - RNA, 65 nt, Homo Sapiens
aaaaacaacugauauaauuacucaagaaauauuugcaacauuaguuuuuuuccagcaucagcaau

SEQ ID NO: 345456 - RNA, 65 nt, Homo Sapiens
uaugguagaaguaaaaaaaaaaaaaaaggacauagcaacauuaaaguaguggauuuuucugagua

SEQ ID NO: 345457 - RNA, 65 nt, Homo Sapiens
uuucaucauccaaguuuguaguucauuuaaaaauacaacauuaaacacauuuugcuaggauguca

SEQ ID NO: 345458 - RNA, 65 nt, Homo Sapiens
agcaguuaccaucaaaggcagcauauuuccaauuccaacauuacuguuucuaccaagucccauua

SEQ ID NO: 345459 - RNA, 65 nt, Homo Sapiens
ccuguauucgugggauugguguaggguuaaaucaucaacauuauuucauaaaauaagaauuuguu

SEQ ID NO: 345460 - RNA, 65 nt, Homo Sapiens
guuuguuuccuggcuuuaccuugggaaaaugcuagcaacauuauagaaauuuugccuuguugccu

SEQ ID NO: 345461 - RNA, 65 nt, Homo Sapiens
uucugggauuacaagugugagucacugcgacuggccaacauuaugugauuuaugugugaacuaua

SEQ ID NO: 345462 - RNA, 65 nt, Homo Sapiens
agcuuuaucuuuugaaacugacggugaaauaaagucaacauuauaccuuugagcacaaaauuucc

SEQ ID NO: 345463 - RNA, 65 nt, Homo Sapiens
uaagugacuugguguuagaaaauuuuaaaguuuugcaacauuaaaaguuaauggaagaauucacc

SEQ ID NO: 345464 - RNA, 65 nt, Homo Sapiens
auaugugcuuccccaaguuuaauaacaauauagaacaacauuauuuuagauggcuugauauacca

SEQ ID NO: 345465 - RNA, 65 nt, Homo Sapiens
uccuuuaaaauacacagccuaaaguuucuaauucacaacauuaaugccagugguaguaacugugu

SEQ ID NO: 345466 - RNA, 65 nt, Homo Sapiens
cacaaagcuguugaaauauucuggaauuuaaggcccaacauuaaacacuauucacuaaaauuaau

SEQ ID NO: 345467 - RNA, 65 nt, Homo Sapiens
gaaaagagacacaaauauaaagugacaaagauuugcaacauuagaauaauuauguuaaugucauu

SEQ ID NO: 345468 - RNA, 65 nt, Homo Sapiens
cuuaccuuauuucuuucaguguucucaacuuuauucaacauuagaggccaagagccagcuucugc

SEQ ID NO: 345469 - RNA, 65 nt, Homo Sapiens
ugaauguuuuauuauuuuuucacccaaaauugugacaacauuaugagauacacaugcuuuuuucc

SEQ ID NO: 345470 - RNA, 65 nt, Homo Sapiens
aguagacaaagaggauguggcagagcugucuucagcaacauuauuuacaaugcuugacuacaaaa

SEQ ID NO: 345471 - RNA, 65 nt, Homo Sapiens
ggauucuucuuuuguguccuauguuagccugcaaacaacauuaggccagguugcaguagcagugg

SEQ ID NO: 345472 - RNA, 65 nt, Homo Sapiens
cuuugaaauaaaaauuggcauaacuauuauuugugcaacauuacuuuuguuguguaagacaauga

SEQ ID NO: 345473 - RNA, 65 nt, Homo Sapiens
auugaugaugacuacgucccugaccuugcaauguucaacauuaacaaguggcauuacauugagcg

SEQ ID NO: 345474 - RNA, 65 nt, Homo Sapiens
gugccagcuauauaaggaauaaaguugauucauaucaacauuagaacuccagucccaaacuaauc

SEQ ID NO: 345475 - RNA, 65 nt, Homo Sapiens
acugcauuucaguuguauuauaguccaguucuuaucaacauuaaaaccuauagcaaucauuucaa

SEQ ID NO: 345476 - RNA, 65 nt, Homo Sapiens
acuacuauccauaaaugcaauaauaugcauguuaacaacauuaaaaacagcaaacagcaaucuaa

SEQ ID NO: 345477 - RNA, 65 nt, Homo Sapiens
acagcaagaacaguccauguuguauauaauacaaccaacauuauagaacuuuuaggguugugacu

SEQ ID NO: 345478 - RNA, 65 nt, Homo Sapiens
ucaugaacguuauuauauugucgaauuccuacugacaacauuauaacuguaugggagcuuaacuu

SEQ ID NO: 345479 - RNA, 65 nt, Homo Sapiens
uugaguugacuucugacaaaggugguaaauucagacaacauuaugaucuaauaaacuuuauuuuu

SEQ ID NO: 345480 - RNA, 65 nt, Homo Sapiens
auguauaaggcagguuuuauacaaccauuuagauucaacauuaaugguagaguggcauuuuacca

SEQ ID NO: 345481 - RNA, 65 nt, Homo Sapiens
uaaauuguaccaaugaauacguaaacauacagugacaacauuaaacuuagaaaaguuuuaaaacu

SEQ ID NO: 345482 - RNA, 65 nt, Homo Sapiens
uuauuuuuucuuuucuaugcaagauaagagauuaccaacauuacuugucuugaucuacccauauu

SEQ ID NO: 345483 - RNA, 65 nt, Homo Sapiens
uuuuuucuucauccucaaaaggagacucuuuugcucaacauuaaauugugcuuccuaacccuaaa

SEQ ID NO: 345484 - RNA, 65 nt, Homo Sapiens
uugugguuauguuaccuuuaucuuguugaggaccacaacauuagcacggugccuugugcagaaua

SEQ ID NO: 345485 - RNA, 65 nt, Homo Sapiens
agaaaagaaagcuuuauuuuaacacucaucugaaucaacauuaaagccuuuucucucaaagcguu

SEQ ID NO: 345486 - RNA, 65 nt, Homo Sapiens
ggcaaaaacagaacuuccaaaguaucuuucugugacaacauuagguucaggcuugaagucccuga

SEQ ID NO: 345487 - RNA, 65 nt, Homo Sapiens
ggaugcuugaagcuguacaaagaacacuaccacugcaacauuaauacaguuaacucuagaaagaa

SEQ ID NO: 345488 - RNA, 65 nt, Homo Sapiens
uaaucauugcuuucugcaacauaauacgaauaugccaacauuauagagggucaacuguacuauaa

SEQ ID NO: 345489 - RNA, 65 nt, Homo Sapiens
acaauauuguuucuaauugcaaaaaacaaagaagacaacauuaaaauuuuacaauugaaaugacu

SEQ ID NO: 345490 - RNA, 65 nt, Homo Sapiens
ugcuaugcuagucacuuagcggcaaaguagagcggcaacauuaaguuuuaggugcucugaguuga

SEQ ID NO: 345491 - RNA, 65 nt, Homo Sapiens
ucaagggcuacaauucaagcccguauuuguacgcacaacauuaaaaaugauuuccuuagcagaag

SEQ ID NO: 345492 - RNA, 65 nt, Homo Sapiens
caucauauacgacugaaagaagaaaacuagauuuucaacauuacaggguugaaaugaaugaugag

SEQ ID NO: 345493 - RNA, 65 nt, Homo Sapiens
gguguuacauuuaauauuuaauguaacuggucuagcaacauuaagggggauuucugaagccaacu

SEQ ID NO: 345494 - RNA, 65 nt, Homo Sapiens
aauuaaaaaaaaauuuuaacugauaaaacuuagggcaacauuaauuaauguauauucuuaccuga

SEQ ID NO: 345495 - RNA, 65 nt, Homo Sapiens
aacccuauuuaagagacugaucacacacguauacacaacauuacugaaagaacccugcgaaucaa

SEQ ID NO: 345496 - RNA, 65 nt, Homo Sapiens
uguaauagccaaaaaguggacaccaauguucauagcaacauuauucauacacacaaaaacuugua

SEQ ID NO: 345497 - RNA, 65 nt, Homo Sapiens
auucauuagggaaaugcaagacaugaaaaaauacucaacauuauuuaugcaaauggcuacuaagc

SEQ ID NO: 345498 - RNA, 65 nt, Homo Sapiens
guuggucuucucuugucagggcgauggaagaaugccaacauuagcccuggcuuagggaacaggga

SEQ ID NO: 345499 - RNA, 65 nt, Homo Sapiens
uauuuuggguuuguuuaaaagcagacauuuuuuaccaacauuaaucaauaaaugaauagcuuauu

SEQ ID NO: 345500 - RNA, 65 nt, Homo Sapiens
auuuuaaauuagauauuuauacuauggcauauaugcaacauuaaacaccaucaugugauaauggu

SEQ ID NO: 345501 - RNA, 65 nt, Homo Sapiens
aaugguguuucucaaggaccuuucaaaaaccaaaacaacauuauaucauucuaagagucuaaaaa

SEQ ID NO: 345502 - RNA, 65 nt, Homo Sapiens
auuuugauauuagucuuaugaauccuacacaguaucaacauuagaauuuaaaauuacuucagugc

SEQ ID NO: 345503 - RNA, 65 nt, Homo Sapiens
aauacuaaaauacuuguguggacaagagauucaugcaacauuaaaugauauagggauauucauau

SEQ ID NO: 345504 - RNA, 65 nt, Homo Sapiens
uccucuguacaaaagccucaagugagggucaaauucaacauuauccugaucuagacagcccccau

SEQ ID NO: 345505 - RNA, 65 nt, Homo Sapiens
gaaggacuguguguaguaaugaaaauaccaaguugcaacauuacauguuuacaaaaaaaaaucug

SEQ ID NO: 345506 - RNA, 65 nt, Homo Sapiens
acuuuuagauuuggaaauugcuguuuacagucuaacaacauuaaaaugagagguagauucacaag

SEQ ID NO: 345507 - RNA, 65 nt, Homo Sapiens
gggcagccaaggauuauaaaccacuucccuaaaggcaacauuaaugcaaaaguccccagauggca

SEQ ID NO: 345508 - RNA, 65 nt, Homo Sapiens
gcaaaaaacuucaacaugcauaugauauauaguuacaacauuaauuuuaugaacuggagagcuuu

SEQ ID NO: 345509 - RNA, 65 nt, Homo Sapiens
uuugguuuguuuugcuaugucuuugggauguauagcaacauuaaaugaauugagacccauguuau

SEQ ID NO: 345510 - RNA, 65 nt, Homo Sapiens
auauuguaacucacaugccugcuaugccuucacuacaacauuagaaaagaagggguagggauuug

SEQ ID NO: 345511 - RNA, 65 nt, Homo Sapiens
uauucauacagaaaugcaaauauuuuuaaaaugcucaacauuaacauauacauggucaauaagua

SEQ ID NO: 345512 - RNA, 65 nt, Homo Sapiens
uuauaagugccuggcaauaguaaguacuaaagagccaacauuauuaugcaucaaaauaaauuuac

SEQ ID NO: 345513 - RNA, 65 nt, Homo Sapiens
uuauuuggaaaauggggaaaaucauaaugucuguucaacauuaucagagaucaaauauaaaauuc

SEQ ID NO: 345514 - RNA, 65 nt, Homo Sapiens
uucuuucagacauuuauuuuguuucuaauaucuagcaacauuauauuaaucagucugcacauccu

SEQ ID NO: 345515 - RNA, 65 nt, Homo Sapiens
uugucuuucaaaagacaccugguucaccaugcaggcaacauuaccagaucaacacuuuucuccag

SEQ ID NO: 345516 - RNA, 65 nt, Homo Sapiens
aucucaccucuuucuuccucucucuguaccuuuaccaacauuaggcacuugguuggcucccuuug

SEQ ID NO: 345517 - RNA, 65 nt, Homo Sapiens
gaacacuaaagagcuaggaaagaguugagcacaggcaacauuacaaacaaaggauuugaaaacac

SEQ ID NO: 345518 - RNA, 65 nt, Homo Sapiens
auguuuuaaaaaacuaaguguuuaggauuucaagacaacauuauacauggcucugaaauaucuga

SEQ ID NO: 345519 - RNA, 65 nt, Homo Sapiens
uuaagacuuuuauaagacuagcuuaaaacaccaaccaacauuauuuuugcaaaagugaguuggac

SEQ ID NO: 345520 - RNA, 65 nt, Homo Sapiens
aaaaaacaaaucuaacuuauuaauacuaggaauaccaacauuauuagggcacuugcagguuauuc

SEQ ID NO: 345521 - RNA, 65 nt, Homo Sapiens
auuaauuacacuagaaauauauuucaugucuugaacaacauuaauaaguaauuagagguuuuucc

SEQ ID NO: 345522 - RNA, 65 nt, Homo Sapiens
acuaaaagucgaaagcacacaaaaaaagucaaagacaacauuauacgcuaaacacuguggaggcu

SEQ ID NO: 345523 - RNA, 65 nt, Homo Sapiens
guauuuuccacuuauuauuauugaguuugcuuucucaacauuauuuuuuuucauugaucuaugcu

SEQ ID NO: 345524 - RNA, 65 nt, Homo Sapiens
cugcccaccccacccccgucggugaaguccaccuccaacauuaaccuugcuuucugcuuccuucu

SEQ ID NO: 345525 - RNA, 65 nt, Homo Sapiens
cgagacuccgccucaaaaaaagaauacaaaugcuccaacauuauuuuuuauaacucuggauuacc

SEQ ID NO: 345526 - RNA, 65 nt, Homo Sapiens
agugaguaaugacaggacuacaacuaaaacauaaacaacauuaaugaugaccauaaaaagucaca

SEQ ID NO: 345527 - RNA, 65 nt, Homo Sapiens
ccugacuggauuaaggaauaccuagacagcugguacaacauuauuucugggugugucugugagug

SEQ ID NO: 345528 - RNA, 65 nt, Homo Sapiens
agucucauuuagcaaguauggaaguugaggcagggcaacauuaagcaacuuacauaacucaugca

SEQ ID NO: 345529 - RNA, 65 nt, Homo Sapiens
aaagacagacuaaaaagaguaauaaaucaauacaacaacauuaaaagccagacuagcggaguuug

SEQ ID NO: 345530 - RNA, 65 nt, Homo Sapiens
uuaaguuggguauuuuuuuaaaaaaagaaaaacagcaacauuaauaaaagaagugguguguuuuu

SEQ ID NO: 345531 - RNA, 65 nt, Homo Sapiens
ucuguauuguuaauuuugugccauauuuugaauugcaacauuaugcuaaguauaacuuugcaagu

SEQ ID NO: 345532 - RNA, 65 nt, Homo Sapiens
aguuuuucuaaauaaauguaacuuuucacaagagucaacauuaaaaaauaaauuauuuaagaaca

SEQ ID NO: 345533 - RNA, 65 nt, Homo Sapiens
uaucauaugcagauacuuauaauuacaaacaucugcaacauuaugaguucaguaucuuuuaugua

SEQ ID NO: 345534 - RNA, 65 nt, Homo Sapiens
uugcauucaccuuuacaaagcacauuuccauguuucaacauuaguccuucccucuuuuuuaaagu

SEQ ID NO: 345535 - RNA, 65 nt, Homo Sapiens
gauuaauguuuauuuaaacguguguuuucagaauucaacauuaaaaaccaacuaugauuuauggu

SEQ ID NO: 345536 - RNA, 65 nt, Homo Sapiens
gagauugucguguauagucaaaaacagccaucauccaacauuauuguucaucagaaugaagggga

SEQ ID NO: 345537 - RNA, 65 nt, Homo Sapiens
ggccauauuguaagauuuccacaaauaaagacaaacaacauuaagagagaaagaugaaaauagga

SEQ ID NO: 345538 - RNA, 65 nt, Homo Sapiens
acucauaauuauuuuguugaauaaauugacauaaccaacauuaaaugggaagaccaaaauuacua

SEQ ID NO: 345539 - RNA, 65 nt, Homo Sapiens
agugguguaacauguaagcuacauuucuuuguuuucaacauuagacugcaugaaaguuuaauuag

SEQ ID NO: 345540 - RNA, 65 nt, Homo Sapiens
aauuuaauuuguuagcugcaauuagaauaaugugacaacauuacacagauaaacuaaucaaauaa

SEQ ID NO: 345541 - RNA, 65 nt, Homo Sapiens
uuuuaugauucuguuuugccgcucacugcuuaacucaacauuaaauuuggagaccuagacauuca

SEQ ID NO: 345542 - RNA, 65 nt, Homo Sapiens
gcaagucuuagagauuuaaaguauccagccaaauucaacauuacuuaaaauauuauaaccacagg

SEQ ID NO: 345543 - RNA, 65 nt, Homo Sapiens
ugaagcaucaaaaauaaaugcugauaguuuacuggcaacauuaauucaaugacugaaagucaaug

SEQ ID NO: 345544 - RNA, 65 nt, Homo Sapiens
uucaugccaauaaaagauuuauuuggugccauuuacaacauuauuuauaugcauuuaaguggaau

SEQ ID NO: 345545 - RNA, 65 nt, Homo Sapiens
auucagaucaaguauuguugaaagcuauacauauacaacauuacagucugucuguauuuagauau

SEQ ID NO: 345546 - RNA, 65 nt, Homo Sapiens
uauauguuacuaaaacaggcuccaccucaguuuaucaacauuauaaguuacuguucuaagaaaag

SEQ ID NO: 345547 - RNA, 65 nt, Homo Sapiens
auuuauagauaugagaaacauaauguucuaaccaacaacauuaugguauuugugugacuuuuauu

SEQ ID NO: 345548 - RNA, 65 nt, Homo Sapiens
guggaaaagccauuauuaucugcucagauuuuacucaacauuagagaguuaguacguaauaaaag

SEQ ID NO: 345549 - RNA, 65 nt, Homo Sapiens
aacaguuggcuauucaucaucuucggcacuuaugacaacauuaacacagaaugccaguucaucag

SEQ ID NO: 345550 - RNA, 65 nt, Homo Sapiens
uacauuguuuucaaccagaaauuaaaguagauauccaacauuauuuucagugcuuguacuucaug

SEQ ID NO: 345551 - RNA, 65 nt, Homo Sapiens
cuguuuuuuuccccuagacaauaucagguuaccgucaacauuaauccauuuaaaaggacauggac

SEQ ID NO: 345552 - RNA, 65 nt, Homo Sapiens
aauccaaaugugacuuugaaaauuguuagagaaaacaacauuagaaaauggcgcaaaaucguuag

SEQ ID NO: 345553 - RNA, 65 nt, Homo Sapiens
aucuucagaaaaggaagcagguuuccuaauacaagcaacauuaacuguuucuauuuuagaugagu

SEQ ID NO: 345554 - RNA, 65 nt, Homo Sapiens
aauuuacagauucaguuuauauuguuuuuucuuuucaacauuaccuucaguuuuguucuuaccca

SEQ ID NO: 345555 - RNA, 65 nt, Homo Sapiens
auggcccuguagcucugaauguuguacaacaccagcaacauuauauauucauaccuucugaugaa

SEQ ID NO: 345556 - RNA, 65 nt, Homo Sapiens
gguaccagccugucacaacuuauuggucugggaggcaacauuaauuauauuuuacaaaugcuaga

SEQ ID NO: 345557 - RNA, 65 nt, Homo Sapiens
ucuaguugcuuucccuuaguauggaagacagguaacaacauuaaaaacauuuaacuaugguauuu

SEQ ID NO: 345558 - RNA, 65 nt, Homo Sapiens
uuuuuaacaucuuauuuuuuucauuaauuacauaucaacauuaauuuuguaucuugaagcaaauu

SEQ ID NO: 345559 - RNA, 65 nt, Homo Sapiens
gccagcugaccuucaaacccugcauuugaaccgaccaacauuaaguccagagaguaaacuugaau

SEQ ID NO: 345560 - RNA, 65 nt, Homo Sapiens
ggucaacucuuuuaauuuauauacaaagcaaagaacaacauuaauggagaugcacaaugauuauu

SEQ ID NO: 345561 - RNA, 65 nt, Homo Sapiens
ccucuaauuugaacugguauuguuuacguuugauacaacauuaaggaauuugaugauuuucauuu

SEQ ID NO: 345562 - RNA, 65 nt, Homo Sapiens
aagcugcaaccuuucuguuuuauuuaaagaaagcccaacauuaaaggguuuucauugcaagcgug

SEQ ID NO: 345563 - RNA, 65 nt, Homo Sapiens
uuaaaagucaccccaacuguauaaagugagggauccaacauuacuugguuauagugggaauauaa

SEQ ID NO: 345564 - RNA, 65 nt, Homo Sapiens
cacaccaacgagacagaaaguuaacaccccacugucaacauuagauaauaauaauaauggcaaac

SEQ ID NO: 345565 - RNA, 65 nt, Homo Sapiens
ugauuuaaauaaaauugaaauucuucauaucaucacaacauuauucaugugguuucuaugcaaag

SEQ ID NO: 345566 - RNA, 65 nt, Homo Sapiens
uauguggacugcuuaaaucaguggcaauccuuaagcaacauuaucaaagaauaacagaaugcauc

SEQ ID NO: 345567 - RNA, 65 nt, Homo Sapiens
aaagagguggguucuguuuuguguuacugaaaaugcaacauuagcacaaugcaguauucucaauu

SEQ ID NO: 345568 - RNA, 65 nt, Homo Sapiens
guguucaugaagacuuaagaaaaaugucacuacugcaacauuaggaauguccugcacuuaauaga

SEQ ID NO: 345569 - RNA, 65 nt, Homo Sapiens
aagccccccaaaaauuaucuagccguuucgaauaucaacauuacccugguguauucacugcugua

SEQ ID NO: 345570 - RNA, 65 nt, Homo Sapiens
ugggaauuuucauaauaguucauacauuugucagccaacauuaaaagguaaccaacuccucaggu

SEQ ID NO: 345571 - RNA, 65 nt, Homo Sapiens
agaggaucagagaugggaaaggacuagcccaaggccaacauuaacaagcccucuaacaaaaacuu

SEQ ID NO: 345572 - RNA, 65 nt, Homo Sapiens
ucuguuugaauuaagaugggcuaagauggggcuugcaacauuaaacaugagcugagcauccauaa

SEQ ID NO: 345573 - RNA, 65 nt, Homo Sapiens
gaguggggggaucacaaagcggacggcagggaggucaacauuaacgcuggccaagagagaagacu

SEQ ID NO: 345574 - RNA, 65 nt, Homo Sapiens
uuugaacuauauccuuccuaauaaacugaaggacucaacauuacacauauuguuucaguguucaa

SEQ ID NO: 345575 - RNA, 65 nt, Homo Sapiens
gcuaagaggaacacuucaacauagaaaaaugacugcaacauuaaaccuuaacuccuuaguauuuc

SEQ ID NO: 345576 - RNA, 65 nt, Homo Sapiens
ccaagugcugugggcuuuucguguuuuugcaacugcaacauuaaacuaugggauaggaacuguca

SEQ ID NO: 345577 - RNA, 65 nt, Homo Sapiens
cuagaggggucuuguucaaaccaaaggcucaugagcaacauuaggccuugcguggaaugaaaacg

SEQ ID NO: 345578 - RNA, 65 nt, Homo Sapiens
caaauugguguuucugaaugacaucaacauucccccaacauuacuccauuacuaaagacagaaaa

SEQ ID NO: 345579 - RNA, 65 nt, Homo Sapiens
uauauaccagaguacuguaaaaucuagguuuuuuucaacauuagcaguaaauugagcacuguuua

SEQ ID NO: 345580 - RNA, 65 nt, Homo Sapiens
ugccuguuggaauuaauuuaagcuuaaguauauaucaacauuauuuuauugugcaauuaaaacaa

SEQ ID NO: 345581 - RNA, 65 nt, Homo Sapiens
aaagagguggacuuuacagauaauggagcagaagccaacauuaguaaaaggaaucccaacuucuu

SEQ ID NO: 345582 - RNA, 65 nt, Homo Sapiens
ugaaugaagccaauaggaaauaaaaaacaggcacacaacauuauuuggggaaaaacaccucuagu

SEQ ID NO: 345583 - RNA, 65 nt, Homo Sapiens
caaaauaagugucgaguuacccacauucgguugagcaacauuauauaugcuauaauuauaguauc

SEQ ID NO: 345584 - RNA, 65 nt, Homo Sapiens
auuuuaaaauaaaauaauugauuaccuggcacuagcaacauuagagaguaggcacucuuuaaucc

SEQ ID NO: 345585 - RNA, 65 nt, Homo Sapiens
agcugggaaggugucugagggccuuacccagaacacaacauuagcucuagguugaaagauaggca

SEQ ID NO: 345586 - RNA, 65 nt, Homo Sapiens
ugaugucauugagacuauauuuauauuugacuuggcaacauuaacauguccuaagacuuagugca

SEQ ID NO: 345587 - RNA, 65 nt, Homo Sapiens
aauaaauaaggaucacacuguauuagggguuauggcaacauuauugaauuuuuuauguacauaaa

SEQ ID NO: 345588 - RNA, 65 nt, Homo Sapiens
uccgaggucugcgagggcuucgacgaggagggccgcaacauuagcaagacccgcggguggcacag

SEQ ID NO: 345589 - RNA, 65 nt, Homo Sapiens
caggaacagauugggugucaguucaggauaaauaccaacauuaacagcagaaugaugcaaugaaa

SEQ ID NO: 345590 - RNA, 65 nt, Homo Sapiens
aaagagcacuucuguggcucaauguugauuugcgucaacauuauagagugcauuucuauaauaua

SEQ ID NO: 345591 - RNA, 65 nt, Homo Sapiens
ucuaauuaguucauuuccaaaaguaaguuuauuuccaacauuagcaaucaugcagccuauccaau

SEQ ID NO: 345592 - RNA, 65 nt, Homo Sapiens
ggaccuuuaaaaggaaguaagcauauccacuauaacaacauuaaaacccuccauuuguguuuauu

SEQ ID NO: 345593 - RNA, 65 nt, Homo Sapiens
guauuuuauucuacucugucggcuuugugucaucacaacauuaaaggagcagcggggcagugugg

SEQ ID NO: 345594 - RNA, 65 nt, Homo Sapiens
gagaaauuguaccuuaaguuugccaaagcccgagacaacauuaagauauccuuuaaacuaaauuu

SEQ ID NO: 345595 - RNA, 65 nt, Homo Sapiens
gcaguaugauaucaugcuuguuaaggggagcucuucaacauuaaggugcuagcuaaaagacaaau

SEQ ID NO: 345596 - RNA, 65 nt, Homo Sapiens
cccauggagaaacacuggcacauccugucccaugucaacauuauauaguccccacaacaaagaau

SEQ ID NO: 345597 - RNA, 65 nt, Homo Sapiens
auuaaaaauaagaaauuaagcagucagacaguuggcaacauuauaaaucccugauccuucaaggu

SEQ ID NO: 345598 - RNA, 65 nt, Homo Sapiens
guuucuuggggcagagaagguggagaguaaagacccaacauuacuaacaaugauacaguugcaug

SEQ ID NO: 345599 - RNA, 65 nt, Homo Sapiens
acuucaaagaaauugagccagcacuaucuguacuccaacauuaccggaucuggauuggggagguu

SEQ ID NO: 345600 - RNA, 65 nt, Homo Sapiens
gaaucaccaaaggagcuauggagagaauuaaaacucaacauuacuguuaacugugcguuaaauaa

SEQ ID NO: 345601 - RNA, 65 nt, Homo Sapiens
aaggacaguugcaaaaggcuucaaggaauuuaucucaacauuauucuuucuauguccuaacuaaa

SEQ ID NO: 345602 - RNA, 65 nt, Homo Sapiens
ccucagauaagaagaaaucaucucuacaauguagacaacauuauauuuuauagaauuuguuugaa

SEQ ID NO: 345603 - RNA, 65 nt, Homo Sapiens
ggcaaagccauggagaaaugucuccacagugagagcaacauuaaguggaucccaggagacaacag

SEQ ID NO: 345604 - RNA, 65 nt, Homo Sapiens
aauacuaaaaaauaaagacaauaaagcaagucuaucaacauuaaacacuaaugauacacagauag

SEQ ID NO: 345605 - RNA, 65 nt, Homo Sapiens
uccuugcacaaucaaauuaaugaacuuaacuuacacaacauuaaaauaaacuuaaaaggagauuu

SEQ ID NO: 345606 - RNA, 65 nt, Homo Sapiens
ccauuaaagcuaaccuauuuauguuauuuauagaacaacauuaauauguuucaguuacaacugua

SEQ ID NO: 345607 - RNA, 65 nt, Homo Sapiens
gccccugucucucuucuguaucuucauuccccuaucaacauuaccuuucugcuccugcuucucuc

SEQ ID NO: 345608 - RNA, 65 nt, Homo Sapiens
uuaagaccaguacugcaggacagauuccccauuugcaacauuagguaauuaaccuuguugaaucu

SEQ ID NO: 345609 - RNA, 65 nt, Homo Sapiens
cauaguuuaagucuuuuaucuuaaauggaacucaccaacauuauuuucugggaaauuguuauagc

SEQ ID NO: 345610 - RNA, 65 nt, Homo Sapiens
ugaauugagcaccucaagcauuuuaacucucaguccaacauuauuuccuguucagucaacaagua

SEQ ID NO: 345611 - RNA, 65 nt, Homo Sapiens
uccuaccucuguucucgcugaaaacucucggauggcaacauuaaggcucauucuuggccucgcag

SEQ ID NO: 345612 - RNA, 65 nt, Homo Sapiens
aguaacuuucaaccuugccaaguuuuuauagcuaucaacauuaggugucuuguuauguacaaacu

SEQ ID NO: 345613 - RNA, 65 nt, Homo Sapiens
uuucuuucuuaaggcaaggcuacuuuuuaaaccaucaacauuacucugcugcuucaaaaaguacu

SEQ ID NO: 345614 - RNA, 65 nt, Homo Sapiens
uuaaguaugagauacuugaugggggcuuuaucaugcaacauuaguuugcuuaccuuaagaauugc

SEQ ID NO: 345615 - RNA, 65 nt, Homo Sapiens
gguggaggaaaggaggaaaaagugcuuauuaugugcaacauuaugauuaaucugauuauacacca

SEQ ID NO: 345616 - RNA, 65 nt, Homo Sapiens
ccucuaauucuuuuccagugugccaacuccaaagucaacauuaaaaauguaaauggaccugugua

SEQ ID NO: 345617 - RNA, 65 nt, Homo Sapiens
acacuuacaguuaggauuugugguaagguaccucucaacauuaccaaaaucauuucuuuagaggg

SEQ ID NO: 345618 - RNA, 65 nt, Homo Sapiens
uaacaauuuuacgucaugucaaaaggugaaaggaacaacauuaauaaaaagaaggaaaaggaggu

SEQ ID NO: 345619 - RNA, 65 nt, Homo Sapiens
aauagauuugaaacauuuauuuaauguucaacaagcaacauuaaauuucuggaagugugaaaaug

SEQ ID NO: 345620 - RNA, 65 nt, Homo Sapiens
ccuuacuagaaccacaagaagugucucuucuuauucaacauuaauguauauguacauucuaaugu

SEQ ID NO: 345621 - RNA, 65 nt, Homo Sapiens
ugaaguaguucuucaguuaugaauucugugaauuucaacauuauuacuauaacuauaaaucucua

SEQ ID NO: 345622 - RNA, 65 nt, Homo Sapiens
aaccuguggagucacacguucaaaaacaaugacaacaacauuacuauggaauaauuccaacuuaa

SEQ ID NO: 345623 - RNA, 65 nt, Homo Sapiens
auuacuuuggauuuguaaucaagugauucuguaaccaacauuagacuuuuacugggggaguggga

SEQ ID NO: 345624 - RNA, 65 nt, Homo Sapiens
uuguggccucuuucuacaccuaauuuuuuuuuuaacaacauuaacgcacuugguuagcagauguu

SEQ ID NO: 345625 - RNA, 65 nt, Homo Sapiens
caauuuaaucacucuuggaauuaaauucacauauacaacauuauauuaacauguaaacaaaagug

SEQ ID NO: 345626 - RNA, 65 nt, Homo Sapiens
cugugugauuacagcauagggauauucauacuuuccaacauuaucuaccuuuaaaaaauaauuua

SEQ ID NO: 345627 - RNA, 65 nt, Homo Sapiens
ugagcauuuacuuuguauuuguuuuuaaaucacuucaacauuauuguaaauauaugaguauuuga

SEQ ID NO: 345628 - RNA, 65 nt, Homo Sapiens
uaaaaugaguuacuugaauggauuaacaauaauaacaacauuaagauaaauuaggcacaguaaga

SEQ ID NO: 345629 - RNA, 65 nt, Homo Sapiens
uuggagaucaguagugucaucuucauaaagcaagacaacauuaugacacuuuaaaacaguagcaa

SEQ ID NO: 345630 - RNA, 65 nt, Homo Sapiens
guuccuugcugucacagaugauagguucauguacacaacauuaauguuugauaaggaaagcauuu

SEQ ID NO: 345631 - RNA, 65 nt, Homo Sapiens
caugacucagaccauaagcuuuucaugccagaugucaacauuaagcugcaacauccuaaccacca

SEQ ID NO: 345632 - RNA, 65 nt, Homo Sapiens
gguggagacuaucagcccaagaugcuuuaagugcacaacauuacagggaaugccugagugccugg

SEQ ID NO: 345633 - RNA, 65 nt, Homo Sapiens
uuuuaaaaaucuuaaauccuaacugagagcagcaacaacauuauuuggguugucagugauuugug

SEQ ID NO: 345634 - RNA, 65 nt, Homo Sapiens
ccagagagaauuuuauguuuucacauauaguucaacaacauuaaucaguuuauaauucccaccuu

SEQ ID NO: 345635 - RNA, 65 nt, Homo Sapiens
aacaauggccacauuuaguuuauaagaacauaaaccaacauuauauaugguaacuacauagaugu

SEQ ID NO: 345636 - RNA, 65 nt, Homo Sapiens
caacuauagaagagaggcuaaacacaguggcaagacaacauuaccuucacuugggagagauggca

SEQ ID NO: 345637 - RNA, 65 nt, Homo Sapiens
acucaggaccccaagauacaucaggugggcgaugccaacauuaauuuuggcagauaugaggaugg

SEQ ID NO: 345638 - RNA, 65 nt, Homo Sapiens
ugaaguauagggauguauuuaauuuuacuaugcuccaacauuaaucaugacucuuuuguaaauua

SEQ ID NO: 345639 - RNA, 65 nt, Homo Sapiens
augaaguugaauuguuuuuaugugaacuuacauagcaacauuaaaugaacuuccagggauuuuau

SEQ ID NO: 345640 - RNA, 65 nt, Homo Sapiens
aagacauucuuuuguaccuucagaucuaugaacuacaacauuaugcgccccuuccuucuguuccc

SEQ ID NO: 345641 - RNA, 65 nt, Homo Sapiens
gaaaauggacuuuuuuuauuucauacuuuuuuguacaacauuaaauuauuuacuuucgguucugc

SEQ ID NO: 345642 - RNA, 65 nt, Homo Sapiens
uaaccaugaccugcuccuccauuuccauuuauucucaacauuaaauaguuuuaucuuguuguugc

SEQ ID NO: 345643 - RNA, 65 nt, Homo Sapiens
gaaaagcaguggcuccauugguguugacauacauccaacauuaaaagccacccccaaaugcccaa

SEQ ID NO: 345644 - RNA, 65 nt, Homo Sapiens
ucuagauguguacuuuugagggacaugagguuaggcaacauuacagcaacacacacuggggcuau

SEQ ID NO: 345645 - RNA, 65 nt, Homo Sapiens
cauuuucuacagcuugcugaguugucauuccuuugcaacauuaaaauacaugcugaacucauauu

SEQ ID NO: 345646 - RNA, 65 nt, Homo Sapiens
gauuuuuuuuucuguuugcauuuuuucacaauuuucaacauuagucaacugcuuaaugguugggg

SEQ ID NO: 345647 - RNA, 65 nt, Homo Sapiens
uuuccccaccaucuuuaaaucaaaguuguuuaaaacaacauuaauuuuaaaaaauacauaaaagc

SEQ ID NO: 345648 - RNA, 65 nt, Homo Sapiens
uugacugcuuaagucagccaguucagcauggauaccaacauuagcuuuucuucuugguuauauca

SEQ ID NO: 345649 - RNA, 65 nt, Homo Sapiens
acgaguuacagacaaacaucaccguaaaugacucacaacauuauaaacaguugugagaaaauauu

SEQ ID NO: 345650 - RNA, 65 nt, Homo Sapiens
gcugugauugacaguagcuguagguuaccagacggcaacauuagaaagugauuguaaauaacaug

SEQ ID NO: 345651 - RNA, 65 nt, Homo Sapiens
aaaucaauacuggauagaaaugcucacaccuuacucaacauuagagugcuaaaacccuaaacugg

SEQ ID NO: 345652 - RNA, 65 nt, Homo Sapiens
uaggauuuauucuucacaaucuuuauuuaaauuagcaacauuacuccucuuuguugaauuuuugu

SEQ ID NO: 345653 - RNA, 65 nt, Homo Sapiens
aagacacagcugagaguugauuuuggcaucucguacaacauuauuacuguuacaaauccuucuug

SEQ ID NO: 345654 - RNA, 65 nt, Homo Sapiens
cacaauaauaaugggagacuuaaacaccccacugucaacauuagaucaaugagacagaaaguuaa

SEQ ID NO: 345655 - RNA, 65 nt, Homo Sapiens
ccuucuuuccccacaugccccacuaaaccaucugacaacauuaaugaauaaaauggugaaaaugu

SEQ ID NO: 345656 - RNA, 65 nt, Homo Sapiens
auauuugacucuccguauuggagaaaauaaaauuacaacauuacgacauacuaaaaaaucaauau

SEQ ID NO: 345657 - RNA, 65 nt, Homo Sapiens
ggauuaauauuggauauuacuguuuuuauuaucaucaacauuauuauuaguggauuucuuaauag

SEQ ID NO: 345658 - RNA, 65 nt, Homo Sapiens
ggagagagauucuguuuccugaggcuuaauacacccaacauuauaacaaaggacuguagcaaggg

SEQ ID NO: 345659 - RNA, 65 nt, Homo Sapiens
uaaaccaaauccaucugcacaucaaaaagcuaauccaacauuaucaagcaggcuuuaguguuggg

SEQ ID NO: 345660 - RNA, 65 nt, Homo Sapiens
acugaaaauggaaauaaacuuauuuaugaaaaagucaacauuagauaguggagauuccaggugaa

SEQ ID NO: 345661 - RNA, 65 nt, Homo Sapiens
aaauauuuucacuccuuaaacuuuaaagcacaugacaacauuagacacagacauuucauacauau

SEQ ID NO: 345662 - RNA, 65 nt, Homo Sapiens
uaauguauagugugauuaaucucucacaauauacucaacauuauaccgauauguguaaagaucua

SEQ ID NO: 345663 - RNA, 65 nt, Homo Sapiens
cucuccuuccucagugugcuccugcugccuucccacaacauuaaaggagcccgcacccuaagcau

SEQ ID NO: 345664 - RNA, 65 nt, Homo Sapiens
ggcuuccuccuagaguguugagcacacacuuuucucaacauuauuguugagaaaccuuuagucac

SEQ ID NO: 345665 - RNA, 65 nt, Homo Sapiens
uaaaacuucuauaaaucccucaaauuggauguagacaacauuacucuguagucuuccaugcuuga

SEQ ID NO: 345666 - RNA, 65 nt, Homo Sapiens
aagauaauggaaaucacgacugacuuaggugcugucaacauuagcagucucucuuuguuuuaaug

SEQ ID NO: 345667 - RNA, 65 nt, Homo Sapiens
uucucuucuuccucagcuucaacuacauugcaagucaacauuauuccaaauuaucaguuaaucga

SEQ ID NO: 345668 - RNA, 65 nt, Homo Sapiens
aacugauacauagaaccaagggaaagauucuuugucaacauuaguugugucccuuuuugguuucu

SEQ ID NO: 345669 - RNA, 65 nt, Homo Sapiens
aaauuuaaaagcuuaaauauccuuuuaaaaaauaccaacauuauguauuaagugaaccucccgug

SEQ ID NO: 345670 - RNA, 65 nt, Homo Sapiens
cuugccuuugaauuagcuuucccuaggccaugagucaacauuaguaguuuauacauccaaauugg

SEQ ID NO: 345671 - RNA, 65 nt, Homo Sapiens
aaauacucgaggcauaaaugugguuauauucccaacaacauuaaaaaauuuauuuuuauuuuuug

SEQ ID NO: 345672 - RNA, 65 nt, Homo Sapiens
uaucagugcuguuuguaauuuuucacuuugagaaccaacauuaauuccauaugaaucaaguguuu

SEQ ID NO: 345673 - RNA, 65 nt, Homo Sapiens
uuaaauuuauaauuccauauuuauaauguuggccacaacauuaugauuauuccuugucuguacuu

SEQ ID NO: 345674 - RNA, 65 nt, Homo Sapiens
cuuuuuuauaauaugauucacuuaugccacagauucaacauuagaauauguuuuaucucuacugu

SEQ ID NO: 345675 - RNA, 65 nt, Homo Sapiens
agaaaauuaaaggcguuuuacucacauggcuauuucaacauuaguuuuuuuuguuuguuucuuuu

SEQ ID NO: 345676 - RNA, 65 nt, Homo Sapiens
uauauacaauauauauuuugugggcuuaauugaaacaacauuauuuuaaaaucaaaggggauaua

SEQ ID NO: 345677 - RNA, 65 nt, Homo Sapiens
aagcggauccaaagacccagggggaacuuggcauucaacauuaaaagaggagccuuucgauaucu

SEQ ID NO: 345678 - RNA, 65 nt, Homo Sapiens
agaagagauccaucauguagaacugaaacucuaugcaacauuaaauaguuagcccucacuagcca

SEQ ID NO: 345679 - RNA, 65 nt, Homo Sapiens
uaggaaacaaagaacuuuaagaauacuucugcauacaacauuaauucaggaaaauuuaguuuaca

SEQ ID NO: 345680 - RNA, 65 nt, Homo Sapiens
guuaacagauuuuccuccguuuccaaauugcuacccaacauuacuguucugucuacuaguaaaca

SEQ ID NO: 345681 - RNA, 65 nt, Homo Sapiens
acaaagguuuccucaguuuaaaggacggcuuuuaccaacauuagcccacugagaaccugcugagc

SEQ ID NO: 345682 - RNA, 65 nt, Homo Sapiens
auuuaauaugcuuuuguugaaggucaaguaaagcacaacauuauguuacggcugcaaaauggcua

SEQ ID NO: 345683 - RNA, 65 nt, Homo Sapiens
agaaaauuaaagguguuuuacucacauggauauuucaacauuaguuuuuuuuguuuguuucuuuu

SEQ ID NO: 345684 - RNA, 64 nt, Homo Sapiens; identical to SEQ ID NO: 257744

SEQ ID NO: 345685 - RNA, 64 nt, Homo Sapiens; identical to SEQ ID NO: 257745

SEQ ID NO: 345686 - RNA, 64 nt, Homo Sapiens; identical to SEQ ID NO: 257746

SEQ ID NO: 345687 - RNA, 64 nt, Homo Sapiens; identical to SEQ ID NO: 257747

SEQ ID NO: 345688 - RNA, 64 nt, Homo Sapiens; identical to SEQ ID NO: 257748

SEQ ID NO: 345689 - RNA, 64 nt, Homo Sapiens; identical to SEQ ID NO: 257749

SEQ ID NO: 345690 - RNA, 64 nt, Homo Sapiens; identical to SEQ ID NO: 257750

SEQ ID NO: 345691 - RNA, 64 nt, Homo Sapiens; identical to SEQ ID NO: 257751

SEQ ID NO: 345692 - RNA, 64 nt, Homo Sapiens; identical to SEQ ID NO: 257752

SEQ ID NO: 345693 - RNA, 64 nt, Homo Sapiens; identical to SEQ ID NO: 257753

SEQ ID NO: 345694 - RNA, 51 nt, Homo Sapiens; identical to SEQ ID NO: 257754

SEQ ID NO: 345695 - RNA, 64 nt, Homo Sapiens; identical to SEQ ID NO: 257755

SEQ ID NO: 345696 - RNA, 64 nt, Homo Sapiens
ccuguugucuucaaaugcuaaaaaaggagaauggaggguacaagacuagacaugacugaaaugg

SEQ ID NO: 345697 - RNA, 64 nt, Homo Sapiens
uagcuguaacccuuaaaaaugaaacgucaacucuaggguacauuugacauugaaagaauaguua

SEQ ID NO: 345698 - RNA, 64 nt, Homo Sapiens; identical to SEQ ID NO: 175895

SEQ ID NO: 345699 - RNA, 64 nt, Homo Sapiens; identical to SEQ ID NO: 175896

SEQ ID NO: 345700 - RNA, 64 nt, Homo Sapiens; identical to SEQ ID NO: 175897

SEQ ID NO: 345701 - RNA, 64 nt, Homo Sapiens; identical to SEQ ID NO: 175898

SEQ ID NO: 345702 - RNA, 64 nt, Homo Sapiens; identical to SEQ ID NO: 175899

SEQ ID NO: 345703 - RNA, 64 nt, Homo Sapiens; identical to SEQ ID NO: 175900

SEQ ID NO: 345704 - RNA, 64 nt, Homo Sapiens; identical to SEQ ID NO: 175901

SEQ ID NO: 345705 - RNA, 64 nt, Homo Sapiens; identical to SEQ ID NO: 175902

SEQ ID NO: 345706 - RNA, 64 nt, Homo Sapiens; identical to SEQ ID NO: 175903

SEQ ID NO: 345707 - RNA, 64 nt, Homo Sapiens; identical to SEQ ID NO: 175904

SEQ ID NO: 345708 - RNA, 64 nt, Homo Sapiens; identical to SEQ ID NO: 175905

SEQ ID NO: 345709 - RNA, 64 nt, Homo Sapiens; identical to SEQ ID NO: 175906

SEQ ID NO: 345710 - RNA, 64 nt, Homo Sapiens; identical to SEQ ID NO: 175907

SEQ ID NO: 345711 - RNA, 64 nt, Homo Sapiens; identical to SEQ ID NO: 175908

SEQ ID NO: 345712 - RNA, 64 nt, Homo Sapiens; identical to SEQ ID NO: 175909

SEQ ID NO: 345713 - RNA, 64 nt, Homo Sapiens; identical to SEQ ID NO: 175910

SEQ ID NO: 345714 - RNA, 64 nt, Homo Sapiens; identical to SEQ ID NO: 175911

SEQ ID NO: 345715 - RNA, 64 nt, Homo Sapiens; identical to SEQ ID NO: 175912

SEQ ID NO: 345716 - RNA, 64 nt, Homo Sapiens; identical to SEQ ID NO: 175913

SEQ ID NO: 345717 - RNA, 64 nt, Homo Sapiens; identical to SEQ ID NO: 175914

SEQ ID NO: 345718 - RNA, 64 nt, Homo Sapiens; identical to SEQ ID NO: 175915

SEQ ID NO: 345719 - RNA, 64 nt, Homo Sapiens; identical to SEQ ID NO: 175916

SEQ ID NO: 345720 - RNA, 64 nt, Homo Sapiens; identical to SEQ ID NO: 175917

SEQ ID NO: 345721 - RNA, 64 nt, Homo Sapiens; identical to SEQ ID NO: 175918

SEQ ID NO: 345722 - RNA, 64 nt, Homo Sapiens; identical to SEQ ID NO: 175919

SEQ ID NO: 345723 - RNA, 64 nt, Homo Sapiens; identical to SEQ ID NO: 175920

SEQ ID NO: 345724 - RNA, 64 nt, Homo Sapiens; identical to SEQ ID NO: 175921

SEQ ID NO: 345725 - RNA, 64 nt, Homo Sapiens; identical to SEQ ID NO: 175922

SEQ ID NO: 345726 - RNA, 64 nt, Homo Sapiens; identical to SEQ ID NO: 175923

SEQ ID NO: 345727 - RNA, 64 nt, Homo Sapiens; identical to SEQ ID NO: 175924

SEQ ID NO: 345728 - RNA, 64 nt, Homo Sapiens; identical to SEQ ID NO: 175925

SEQ ID NO: 345729 - RNA, 64 nt, Homo Sapiens; identical to SEQ ID NO: 175926

SEQ ID NO: 345730 - RNA, 64 nt, Homo Sapiens; identical to SEQ ID NO: 175927

SEQ ID NO: 345731 - RNA, 64 nt, Homo Sapiens; identical to SEQ ID NO: 175928

SEQ ID NO: 345732 - RNA, 64 nt, Homo Sapiens; identical to SEQ ID NO: 175929

SEQ ID NO: 345733 - RNA, 64 nt, Homo Sapiens; identical to SEQ ID NO: 175930

SEQ ID NO: 345734 - RNA, 64 nt, Homo Sapiens; identical to SEQ ID NO: 175931

SEQ ID NO: 345735 - RNA, 64 nt, Homo Sapiens; identical to SEQ ID NO: 175932

SEQ ID NO: 345736 - RNA, 64 nt, Homo Sapiens; identical to SEQ ID NO: 175933

SEQ ID NO: 345737 - RNA, 64 nt, Homo Sapiens; identical to SEQ ID NO: 175934

SEQ ID NO: 345738 - RNA, 64 nt, Homo Sapiens; identical to SEQ ID NO: 175935

SEQ ID NO: 345739 - RNA, 64 nt, Homo Sapiens; identical to SEQ ID NO: 175936

SEQ ID NO: 345740 - RNA, 64 nt, Homo Sapiens; identical to SEQ ID NO: 175937

SEQ ID NO: 345741 - RNA, 64 nt, Homo Sapiens; identical to SEQ ID NO: 175938

SEQ ID NO: 345742 - RNA, 64 nt, Homo Sapiens; identical to SEQ ID NO: 175939

SEQ ID NO: 345743 - RNA, 64 nt, Homo Sapiens; identical to SEQ ID NO: 175940

SEQ ID NO: 345744 - RNA, 64 nt, Homo Sapiens; identical to SEQ ID NO: 175941

SEQ ID NO: 345745 - RNA, 64 nt, Homo Sapiens; identical to SEQ ID NO: 175942

SEQ ID NO: 345746 - RNA, 64 nt, Homo Sapiens; identical to SEQ ID NO: 175943

SEQ ID NO: 345747 - RNA, 64 nt, Homo Sapiens; identical to SEQ ID NO: 175944

SEQ ID NO: 345748 - RNA, 64 nt, Homo Sapiens; identical to SEQ ID NO: 175945

SEQ ID NO: 345749 - RNA, 64 nt, Homo Sapiens; identical to SEQ ID NO: 175946

SEQ ID NO: 345750 - RNA, 64 nt, Homo Sapiens; identical to SEQ ID NO: 175947

SEQ ID NO: 345751 - RNA, 64 nt, Homo Sapiens; identical to SEQ ID NO: 175948

SEQ ID NO: 345752 - RNA, 64 nt, Homo Sapiens; identical to SEQ ID NO: 175949

SEQ ID NO: 345753 - RNA, 64 nt, Homo Sapiens; identical to SEQ ID NO: 175950

SEQ ID NO: 345754 - RNA, 64 nt, Homo Sapiens; identical to SEQ ID NO: 175951

SEQ ID NO: 345755 - RNA, 64 nt, Homo Sapiens; identical to SEQ ID NO: 175952

SEQ ID NO: 345756 - RNA, 64 nt, Homo Sapiens; identical to SEQ ID NO: 175953

SEQ ID NO: 345757 - RNA, 62 nt, Homo Sapiens; identical to SEQ ID NO: 175954

SEQ ID NO: 345758 - RNA, 64 nt, Homo Sapiens; identical to SEQ ID NO: 175955

SEQ ID NO: 345759 - RNA, 64 nt, Homo Sapiens; identical to SEQ ID NO: 175956

SEQ ID NO: 345760 - RNA, 64 nt, Homo Sapiens; identical to SEQ ID NO: 175957

SEQ ID NO: 345761 - RNA, 64 nt, Homo Sapiens; identical to SEQ ID NO: 175958

SEQ ID NO: 345762 - RNA, 64 nt, Homo Sapiens; identical to SEQ ID NO: 175959

SEQ ID NO: 345763 - RNA, 64 nt, Homo Sapiens; identical to SEQ ID NO: 175960

SEQ ID NO: 345764 - RNA, 64 nt, Homo Sapiens; identical to SEQ ID NO: 175961

SEQ ID NO: 345765 - RNA, 64 nt, Homo Sapiens; identical to SEQ ID NO: 175962

SEQ ID NO: 345766 - RNA, 64 nt, Homo Sapiens; identical to SEQ ID NO: 175963

SEQ ID NO: 345767 - RNA, 64 nt, Homo Sapiens; identical to SEQ ID NO: 175964

SEQ ID NO: 345768 - RNA, 64 nt, Homo Sapiens; identical to SEQ ID NO: 175965

SEQ ID NO: 345769 - RNA, 64 nt, Homo Sapiens; identical to SEQ ID NO: 175966

SEQ ID NO: 345770 - RNA, 64 nt, Homo Sapiens; identical to SEQ ID NO: 175967

SEQ ID NO: 345771 - RNA, 64 nt, Homo Sapiens; identical to SEQ ID NO: 175968

SEQ ID NO: 345772 - RNA, 64 nt, Homo Sapiens; identical to SEQ ID NO: 175969

SEQ ID NO: 345773 - RNA, 64 nt, Homo Sapiens; identical to SEQ ID NO: 175970

SEQ ID NO: 345774 - RNA, 64 nt, Homo Sapiens; identical to SEQ ID NO: 175971

SEQ ID NO: 345775 - RNA, 64 nt, Homo Sapiens; identical to SEQ ID NO: 175972

SEQ ID NO: 345776 - RNA, 64 nt, Homo Sapiens; identical to SEQ ID NO: 175973

SEQ ID NO: 345777 - RNA, 64 nt, Homo Sapiens; identical to SEQ ID NO: 175974

SEQ ID NO: 345778 - RNA, 64 nt, Homo Sapiens; identical to SEQ ID NO: 175975

SEQ ID NO: 345779 - RNA, 64 nt, Homo Sapiens; identical to SEQ ID NO: 175976

SEQ ID NO: 345780 - RNA, 64 nt, Homo Sapiens; identical to SEQ ID NO: 175977

SEQ ID NO: 345781 - RNA, 64 nt, Homo Sapiens; identical to SEQ ID NO: 175978

SEQ ID NO: 345782 - RNA, 64 nt, Homo Sapiens; identical to SEQ ID NO: 175979

SEQ ID NO: 345783 - RNA, 64 nt, Homo Sapiens; identical to SEQ ID NO: 175980

SEQ ID NO: 345784 - RNA, 64 nt, Homo Sapiens; identical to SEQ ID NO: 175981

SEQ ID NO: 345785 - RNA, 64 nt, Homo Sapiens; identical to SEQ ID NO: 175982

SEQ ID NO: 345786 - RNA, 64 nt, Homo Sapiens; identical to SEQ ID NO: 175983

SEQ ID NO: 345787 - RNA, 64 nt, Homo Sapiens; identical to SEQ ID NO: 175984

SEQ ID NO: 345788 - RNA, 64 nt, Homo Sapiens; identical to SEQ ID NO: 175985

SEQ ID NO: 345789 - RNA, 64 nt, Homo Sapiens; identical to SEQ ID NO: 175986

SEQ ID NO: 345790 - RNA, 64 nt, Homo Sapiens; identical to SEQ ID NO: 175987

SEQ ID NO: 345791 - RNA, 64 nt, Homo Sapiens; identical to SEQ ID NO: 175988

SEQ ID NO: 345792 - RNA, 64 nt, Homo Sapiens; identical to SEQ ID NO: 175989

SEQ ID NO: 345793 - RNA, 64 nt, Homo Sapiens; identical to SEQ ID NO: 175990

SEQ ID NO: 345794 - RNA, 64 nt, Homo Sapiens; identical to SEQ ID NO: 175991

SEQ ID NO: 345795 - RNA, 64 nt, Homo Sapiens; identical to SEQ ID NO: 175992

SEQ ID NO: 345796 - RNA, 64 nt, Homo Sapiens; identical to SEQ ID NO: 175993

SEQ ID NO: 345797 - RNA, 64 nt, Homo Sapiens; identical to SEQ ID NO: 175994

SEQ ID NO: 345798 - RNA, 64 nt, Homo Sapiens; identical to SEQ ID NO: 175995

SEQ ID NO: 345799 - RNA, 64 nt, Homo Sapiens; identical to SEQ ID NO: 175996

SEQ ID NO: 345800 - RNA, 64 nt, Homo Sapiens; identical to SEQ ID NO: 175997

SEQ ID NO: 345801 - RNA, 62 nt, Homo Sapiens; identical to SEQ ID NO: 175998

SEQ ID NO: 345802 - RNA, 64 nt, Homo Sapiens; identical to SEQ ID NO: 175999

SEQ ID NO: 345803 - RNA, 64 nt, Homo Sapiens; identical to SEQ ID NO: 176000

SEQ ID NO: 345804 - RNA, 64 nt, Homo Sapiens; identical to SEQ ID NO: 176001

SEQ ID NO: 345805 - RNA, 64 nt, Homo Sapiens; identical to SEQ ID NO: 176002

SEQ ID NO: 345806 - RNA, 64 nt, Homo Sapiens; identical to SEQ ID NO: 176003

SEQ ID NO: 345807 - RNA, 64 nt, Homo Sapiens; identical to SEQ ID NO: 176004

SEQ ID NO: 345808 - RNA, 64 nt, Homo Sapiens; identical to SEQ ID NO: 176005

SEQ ID NO: 345809 - RNA, 64 nt, Homo Sapiens; identical to SEQ ID NO: 176006

SEQ ID NO: 345810 - RNA, 64 nt, Homo Sapiens; identical to SEQ ID NO: 176007

SEQ ID NO: 345811 - RNA, 64 nt, Homo Sapiens; identical to SEQ ID NO: 176008

SEQ ID NO: 345812 - RNA, 64 nt, Homo Sapiens; identical to SEQ ID NO: 176009

SEQ ID NO: 345813 - RNA, 64 nt, Homo Sapiens; identical to SEQ ID NO: 176010

SEQ ID NO: 345814 - RNA, 64 nt, Homo Sapiens; identical to SEQ ID NO: 176011

SEQ ID NO: 345815 - RNA, 64 nt, Homo Sapiens; identical to SEQ ID NO: 176012

SEQ ID NO: 345816 - RNA, 64 nt, Homo Sapiens; identical to SEQ ID NO: 176013

SEQ ID NO: 345817 - RNA, 64 nt, Homo Sapiens; identical to SEQ ID NO: 176014

SEQ ID NO: 345818 - RNA, 64 nt, Homo Sapiens; identical to SEQ ID NO: 176015

SEQ ID NO: 345819 - RNA, 64 nt, Homo Sapiens; identical to SEQ ID NO: 176016

SEQ ID NO: 345820 - RNA, 64 nt, Homo Sapiens; identical to SEQ ID NO: 176017

SEQ ID NO: 345821 - RNA, 64 nt, Homo Sapiens; identical to SEQ ID NO: 176018

SEQ ID NO: 345822 - RNA, 64 nt, Homo Sapiens; identical to SEQ ID NO: 176019

SEQ ID NO: 345823 - RNA, 64 nt, Homo Sapiens; identical to SEQ ID NO: 176020

SEQ ID NO: 345824 - RNA, 64 nt, Homo Sapiens; identical to SEQ ID NO: 176021

SEQ ID NO: 345825 - RNA, 64 nt, Homo Sapiens; identical to SEQ ID NO: 176022

SEQ ID NO: 345826 - RNA, 64 nt, Homo Sapiens; identical to SEQ ID NO: 176023

SEQ ID NO: 345827 - RNA, 64 nt, Homo Sapiens; identical to SEQ ID NO: 176024

SEQ ID NO: 345828 - RNA, 64 nt, Homo Sapiens; identical to SEQ ID NO: 176025

SEQ ID NO: 345829 - RNA, 64 nt, Homo Sapiens; identical to SEQ ID NO: 176026

SEQ ID NO: 345830 - RNA, 64 nt, Homo Sapiens; identical to SEQ ID NO: 176027

SEQ ID NO: 345831 - RNA, 64 nt, Homo Sapiens; identical to SEQ ID NO: 176028

SEQ ID NO: 345832 - RNA, 64 nt, Homo Sapiens; identical to SEQ ID NO: 176029

SEQ ID NO: 345833 - RNA, 59 nt, Homo Sapiens; identical to SEQ ID NO: 176030

SEQ ID NO: 345834 - RNA, 56 nt, Homo Sapiens; identical to SEQ ID NO: 176031

SEQ ID NO: 345835 - RNA, 64 nt, Homo Sapiens; identical to SEQ ID NO: 176032

SEQ ID NO: 345836 - RNA, 64 nt, Homo Sapiens; identical to SEQ ID NO: 176033

SEQ ID NO: 345837 - RNA, 64 nt, Homo Sapiens; identical to SEQ ID NO: 176034

SEQ ID NO: 345838 - RNA, 64 nt, Homo Sapiens; identical to SEQ ID NO: 176035

SEQ ID NO: 345839 - RNA, 64 nt, Homo Sapiens; identical to SEQ ID NO: 176036

SEQ ID NO: 345840 - RNA, 64 nt, Homo Sapiens; identical to SEQ ID NO: 176037

SEQ ID NO: 345841 - RNA, 64 nt, Homo Sapiens; identical to SEQ ID NO: 176038

SEQ ID NO: 345842 - RNA, 64 nt, Homo Sapiens; identical to SEQ ID NO: 176039

SEQ ID NO: 345843 - RNA, 64 nt, Homo Sapiens; identical to SEQ ID NO: 176040

SEQ ID NO: 345844 - RNA, 64 nt, Homo Sapiens; identical to SEQ ID NO: 176041

SEQ ID NO: 345845 - RNA, 64 nt, Homo Sapiens; identical to SEQ ID NO: 176042

SEQ ID NO: 345846 - RNA, 64 nt, Homo Sapiens; identical to SEQ ID NO: 176043

SEQ ID NO: 345847 - RNA, 64 nt, Homo Sapiens; identical to SEQ ID NO: 176044

SEQ ID NO: 345848 - RNA, 64 nt, Homo Sapiens; identical to SEQ ID NO: 176045

SEQ ID NO: 345849 - RNA, 64 nt, Homo Sapiens; identical to SEQ ID NO: 176046

SEQ ID NO: 345850 - RNA, 64 nt, Homo Sapiens; identical to SEQ ID NO: 176047

SEQ ID NO: 345851 - RNA, 64 nt, Homo Sapiens; identical to SEQ ID NO: 176048

SEQ ID NO: 345852 - RNA, 64 nt, Homo Sapiens; identical to SEQ ID NO: 176049

SEQ ID NO: 345853 - RNA, 64 nt, Homo Sapiens; identical to SEQ ID NO: 176050

SEQ ID NO: 345854 - RNA, 64 nt, Homo Sapiens; identical to SEQ ID NO: 176051

SEQ ID NO: 345855 - RNA, 64 nt, Homo Sapiens; identical to SEQ ID NO: 176052

SEQ ID NO: 345856 - RNA, 64 nt, Homo Sapiens; identical to SEQ ID NO: 176053

SEQ ID NO: 345857 - RNA, 64 nt, Homo Sapiens; identical to SEQ ID NO: 176054

SEQ ID NO: 345858 - RNA, 64 nt, Homo Sapiens; identical to SEQ ID NO: 176055

SEQ ID NO: 345859 - RNA, 64 nt, Homo Sapiens; identical to SEQ ID NO: 176056

SEQ ID NO: 345860 - RNA, 64 nt, Homo Sapiens; identical to SEQ ID NO: 176057

SEQ ID NO: 345861 - RNA, 64 nt, Homo Sapiens; identical to SEQ ID NO: 176058

SEQ ID NO: 345862 - RNA, 64 nt, Homo Sapiens; identical to SEQ ID NO: 176059

SEQ ID NO: 345863 - RNA, 64 nt, Homo Sapiens; identical to SEQ ID NO: 176060

SEQ ID NO: 345864 - RNA, 64 nt, Homo Sapiens; identical to SEQ ID NO: 176061

SEQ ID NO: 345865 - RNA, 64 nt, Homo Sapiens; identical to SEQ ID NO: 176062

SEQ ID NO: 345866 - RNA, 64 nt, Homo Sapiens; identical to SEQ ID NO: 176063

SEQ ID NO: 345867 - RNA, 64 nt, Homo Sapiens; identical to SEQ ID NO: 176064

SEQ ID NO: 345868 - RNA, 64 nt, Homo Sapiens; identical to SEQ ID NO: 176065

SEQ ID NO: 345869 - RNA, 64 nt, Homo Sapiens; identical to SEQ ID NO: 176066

SEQ ID NO: 345870 - RNA, 64 nt, Homo Sapiens; identical to SEQ ID NO: 176067

SEQ ID NO: 345871 - RNA, 64 nt, Homo Sapiens; identical to SEQ ID NO: 176068

SEQ ID NO: 345872 - RNA, 64 nt, Homo Sapiens; identical to SEQ ID NO: 176069

SEQ ID NO: 345873 - RNA, 64 nt, Homo Sapiens; identical to SEQ ID NO: 176070

SEQ ID NO: 345874 - RNA, 64 nt, Homo Sapiens; identical to SEQ ID NO: 176071

SEQ ID NO: 345875 - RNA, 64 nt, Homo Sapiens; identical to SEQ ID NO: 176072

SEQ ID NO: 345876 - RNA, 64 nt, Homo Sapiens; identical to SEQ ID NO: 176073

SEQ ID NO: 345877 - RNA, 64 nt, Homo Sapiens; identical to SEQ ID NO: 176074

SEQ ID NO: 345878 - RNA, 64 nt, Homo Sapiens; identical to SEQ ID NO: 176075

SEQ ID NO: 345879 - RNA, 62 nt, Homo Sapiens
gugaaucaaucugaaauugagaaaagggcagguugaaucaagaacugguuuuaaaaucagug

SEQ ID NO: 345880 - RNA, 62 nt, Homo Sapiens
aauucccuuguuucaaaagauuaaacuuguguuugaaucaugcauggguaaauaauuuguca

SEQ ID NO: 345881 - RNA, 62 nt, Homo Sapiens
uagaaaugaaucuauauguuacauaaauaggauugaaucaaccauuauuuuguauuuuaaau

SEQ ID NO: 345882 - RNA, 62 nt, Homo Sapiens
uaugaauugaugauauacagguuuuaauucauuugaaucacucaaguaguaccaguuuuaag

SEQ ID NO: 345883 - RNA, 62 nt, Homo Sapiens
acucauugauuaaaauggaaagaaaggaaaacuugaaucaauaacuuaucauaaggaaaaau

SEQ ID NO: 345884 - RNA, 62 nt, Homo Sapiens
agacaccauggauuauauucuguuucuccccuuugaaucagcuggauacuaaaugacagccu

SEQ ID NO: 345885 - RNA, 62 nt, Homo Sapiens
ucaggugauacugcugcaguaaucauagcuguuugaaucaggaauaaucccaaucacauuuu

SEQ ID NO: 345886 - RNA, 62 nt, Homo Sapiens
gaaaggagauugguaaggaagugugauacauauugaaucaggugucaagguaccauuugugc

SEQ ID NO: 345887 - RNA, 62 nt, Homo Sapiens
gcucacacugcugaugauuucacuuucccaaauugaaucacuccagaauuuaaaccuauacu

SEQ ID NO: 345888 - RNA, 62 nt, Homo Sapiens
cuacaggccucacacacaaucaaccucuguauuugaaucagccaccaagcugcuguggccau

SEQ ID NO: 345889 - RNA, 62 nt, Homo Sapiens
aaauaaaagaauguggcuauaucaaaaauguauugaaucaucguuauguggugacuauuuga

SEQ ID NO: 345890 - RNA, 62 nt, Homo Sapiens
aauguauugaaucaucaaauuguggugacuauuugaaucaaauuaauaucgugccuagguua

SEQ ID NO: 345891 - RNA, 62 nt, Homo Sapiens
uugugaaugucccccucaaaauuuuuuuauuguugaaucauuuaaggaaaugggggugaaau

SEQ ID NO: 345892 - RNA, 62 nt, Homo Sapiens; identical to SEQ ID NO: 176089

SEQ ID NO: 345893 - RNA, 62 nt, Homo Sapiens
uggauagaaauauauuuuugcuaguucuaggcuugaaucaugggcuccuuggcuuuccuagc

SEQ ID NO: 345894 - RNA, 62 nt, Homo Sapiens
aauuuuuugcucaccgccauguuuaaaugggguugaaucauagcgagccauuugcucuugcc

SEQ ID NO: 345895 - RNA, 62 nt, Homo Sapiens
uuuucacucuugauaagcuuauaaaaucaugauugaaucagcuuuaaagcaucauaccauca

SEQ ID NO: 345896 - RNA, 62 nt, Homo Sapiens
aauuugcuugucaucacaaugaaguauguuuuuugaaucaucaauucuuucucauucuccau

SEQ ID NO: 345897 - RNA, 62 nt, Homo Sapiens
uuaaauguacagaaauaaaacugcagauuauauugaaucauauugauaagccauacaugaga

SEQ ID NO: 345898 - RNA, 62 nt, Homo Sapiens
gaacuagaaagaucugauuuaguucucuaccauugaaucaguaaacuucauguucaaguaga

SEQ ID NO: 345899 - RNA, 62 nt, Homo Sapiens
augaaaugcacucuucucgaugaggccucgauuugaaucaauggggugggccacaggaaaug

SEQ ID NO: 345900 - RNA, 62 nt, Homo Sapiens
gaccuuucuucccuucccuuggagguaucccuuugaaucaggccucucucuucucaucaguc

SEQ ID NO: 345901 - RNA, 64 nt, Homo Sapiens
agcacucuacuuaaguauucucuguguuuuaugaagagaaaaugaucugauuuucccuuauacu

SEQ ID NO: 345902 - RNA, 64 nt, Homo Sapiens
ucugggauauucuguggguuuuggcauauuagauagagaaaaugacagaucuagaugaagggag

SEQ ID NO: 345903 - RNA, 64 nt, Homo Sapiens
aagcccagaaaaacucucauuugcucaaagucacagagaaaauuaguggcaaagccaaaaagau

SEQ ID NO: 345904 - RNA, 64 nt, Homo Sapiens
auauauauuguauacuguauucuuaaaguaagcuagagaaaagaaaauguuacuuagaaaauca

SEQ ID NO: 345905 - RNA, 64 nt, Homo Sapiens
agaaaagaaaauguuacuuagaaaaucauaaggaagagaaaauauauuuacuguguuuaucaau

SEQ ID NO: 345906 - RNA, 64 nt, Homo Sapiens
ggcuggggccccuauaacaaaagacagauugacaagagaaaaacaaacauaaauuuauuagcgg

SEQ ID NO: 345907 - RNA, 64 nt, Homo Sapiens
acagaagcugcaaaagggaucuucgaaacugggcagagaaaaaauaaaguggaauauuaaguaa

SEQ ID NO: 345908 - RNA, 64 nt, Homo Sapiens
cagugucuuucugagguaaauuaaaacgaggguaagagaaaagccuuuagggaccagguagacu

SEQ ID NO: 345909 - RNA, 64 nt, Homo Sapiens
aagaaggggccugcaggaccccaagaauuacaucagagaaaaggcuugggcucuggagcuuucc

SEQ ID NO: 345910 - RNA, 64 nt, Homo Sapiens
cuguuaacuggaagaaaaaaggucuacccacccaagagaaaagagaagguuggaucuuggguuu

SEQ ID NO: 345911 - RNA, 64 nt, Homo Sapiens
uaggaguuucucaucuaugacaacucauaucuggagagaaaacccuuuuacucaacuaacuacu

SEQ ID NO: 345912 - RNA, 64 nt, Homo Sapiens
gugaaagugacucucacuaaaggggugugggagcagagaaaauuaaaugaauauguugaucauu

SEQ ID NO: 345913 - RNA, 64 nt, Homo Sapiens
uuuugaaaagaacaaaacauuaaugaauguaaugagagaaaaugauuuaaaguaaggccuuuag

SEQ ID NO: 345914 - RNA, 64 nt, Homo Sapiens
agaauucaguauguauggaggaaaaagccuuggaagagaaaaguaaacauuuuguuaaccuaug

SEQ ID NO: 345915 - RNA, 64 nt, Homo Sapiens
cccaaauuauacuugcacuagucacugauaaguuagagaaaacauccuagaaaacaggaugccu

SEQ ID NO: 345916 - RNA, 64 nt, Homo Sapiens
aaaaauagaagacauauaaaucacccccaaaaaaagagaaaaagguaugaauuugucacaugua

SEQ ID NO: 345917 - RNA, 64 nt, Homo Sapiens
gacacaaauauaaaauuaaaagauuugcaacauuagagaaaagaguuaaugucauuagugacaa

SEQ ID NO: 345918 - RNA, 64 nt, Homo Sapiens
aauaaauuuuaugaacuugucuaauauauguaacagagaaaaacaaacugaaggcagaauggaa

SEQ ID NO: 345919 - RNA, 64 nt, Homo Sapiens
auaaaacaaaaauagguaguacuuuaacauuaugagagaaaagcaaaucguauauaugagcuau

SEQ ID NO: 345920 - RNA, 64 nt, Homo Sapiens
cuuaauacacauuuguugaccgaaugccuagcauagagaaaauaauaucuauuauucuccuaaa

SEQ ID NO: 345921 - RNA, 64 nt, Homo Sapiens
aauguuuacuuucugcugugcauuuugugaggugagagaaaacugagggcguuggccaucucua

SEQ ID NO: 345922 - RNA, 64 nt, Homo Sapiens
ucugaagcucugaauaucaggacaugaugaaaaaagagaaaaagacacccagaaugagccagaa

SEQ ID NO: 345923 - RNA, 64 nt, Homo Sapiens
aucaucugaacagaagugcacaggcuacuuguacagagaaaaaauuaauacucaaaggaaaucu

SEQ ID NO: 345924 - RNA, 64 nt, Homo Sapiens
gacauucugcaccagcuaccucugccuccauggcagagaaaaggccauaagaacaguggaagag

SEQ ID NO: 345925 - RNA, 64 nt, Homo Sapiens
aagugacgaggaagguucuguuuugaguauagccagagaaaacaaggauggagaaaaaucuagg

SEQ ID NO: 345926 - RNA, 64 nt, Homo Sapiens
aagugaugagaaggauucuuuuucgaauauaaccagagaaaaaaaggauggagaaauaucuagg

SEQ ID NO: 345927 - RNA, 64 nt, Homo Sapiens
aagugacgaggaagauucuguuuuggguauagccagagaaaacaaggauggagaaaaaucuagg

SEQ ID NO: 345928 - RNA, 64 nt, Homo Sapiens
ugcccugaaccuguaagcaucaaauaagcaugagagagaaaaaaacaugauauauugcuuuacu

SEQ ID NO: 345929 - RNA, 64 nt, Homo Sapiens
ccggaguaggucccguguagcaugcgggugcuguagagaaaauucagugacguacauggcucug

SEQ ID NO: 345930 - RNA, 64 nt, Homo Sapiens
aguuaauaagcaaaauccugacuauuauguuguuagagaaaaaugcuuugcuuugucuggaaga

SEQ ID NO: 345931 - RNA, 64 nt, Homo Sapiens
uacuuuuuuccaauuuuagaaaaucaagcagguuagagaaaauagagaugaauuaggggacacu

SEQ ID NO: 345932 - RNA, 64 nt, Homo Sapiens
cacaaaggcuuaaaggcagugaaaauggccagccagagaaaagaucucaagaaccagaaauaaa

SEQ ID NO: 345933 - RNA, 64 nt, Homo Sapiens
ggagcuagacacaaugaaacaucagagccagcuaagagaaaagaaauauuuggaggauauugaa

SEQ ID NO: 345934 - RNA, 64 nt, Homo Sapiens
uauagcuuucccaugguagccugauaaggcugagagagaaaaauaugugcaguaucucauccuc

SEQ ID NO: 345935 - RNA, 64 nt, Homo Sapiens
ugaucacauggcaguugcaguaacuuguauggaaagagaaaaugcaaugagcccaguuacugca

SEQ ID NO: 345936 - RNA, 64 nt, Homo Sapiens
cacguguaaggugaugugcacauaucaagaagucagagaaaacacuuuccuggauaaaaaagaa

SEQ ID NO: 345937 - RNA, 64 nt, Homo Sapiens
guguucuccacuaauacugguuauccugugcuacagagaaaaucaaagcagucauaagcuccag

SEQ ID NO: 345938 - RNA, 64 nt, Homo Sapiens
cuacaguuuuauagauugcauguguugcuacccaagagaaaaugaauccagacuugggggucau

SEQ ID NO: 345939 - RNA, 64 nt, Homo Sapiens
cauuagugcucccacucauaugagcaauuacagcagagaaaauuauucagccguauugcacaga

SEQ ID NO: 345940 - RNA, 64 nt, Homo Sapiens
ugguggcagccacaaauucuacaagccaguccuaagagaaaaggugcagccaccagugggagag

SEQ ID NO: 345941 - RNA, 64 nt, Homo Sapiens
guuuuggcaugucagagccuauauagcaagauacagagaaaauuaguauuuuguggaauguacu

SEQ ID NO: 345942 - RNA, 64 nt, Homo Sapiens
guccuucaguuucucaguauaugugggccaagugagagaaaaguucuauuacccacuacaugac

SEQ ID NO: 345943 - RNA, 64 nt, Homo Sapiens
accaugcugcauacauucugaaaaagagagagagagagaaaaaguuccaguuccguucugagag

SEQ ID NO: 345944 - RNA, 64 nt, Homo Sapiens
agagagagagagaaaaagacccaguuccguucugagagaaaaaggagcaaacauguugcuguuu

SEQ ID NO: 345945 - RNA, 64 nt, Homo Sapiens
ggaucaaaucaaucugcaguauguguauggugcaagagaaaauuauagaguuguaauguuuuau

SEQ ID NO: 345946 - RNA, 64 nt, Homo Sapiens
aaaauuuuacaacaggaucaugcuugccuuuuucagagaaaaagccacacugugcaugcacccu

SEQ ID NO: 345947 - RNA, 64 nt, Homo Sapiens
gaagguuuauucuugucuuaauaauaugacacuuagagaaaaaguuagagaaaauguggaggaa

SEQ ID NO: 345948 - RNA, 64 nt, Homo Sapiens
uggaggaaauaauaugacacgaaagaagcagcuuagagaaaauggagguaggugaacauuccag

SEQ ID NO: 345949 - RNA, 64 nt, Homo Sapiens
ugagagaggggacuaauuauacaaaagacaugauagagaaaagaucagaaagaaaugucuuuau

SEQ ID NO: 345950 - RNA, 64 nt, Homo Sapiens
agcaguuuuauugcuuauaguuagaaggaugggaagagaaaagguaaagcagagagaacccagg

SEQ ID NO: 345951 - RNA, 64 nt, Homo Sapiens
aauguugcacaaggguugugucuggucugacuugagagaaaaggauaugcacugaaacaugugg

SEQ ID NO: 345952 - RNA, 64 nt, Homo Sapiens
gugaagagaugccuuuuggagauguaaucaguguagagaaaaccuuggcccuucuguaauagga

SEQ ID NO: 345953 - RNA, 64 nt, Homo Sapiens
cuccgaggaagagaagaaugagggaaaggagcaaagagaaaaacucccagaugguaaagacuga

SEQ ID NO: 345954 - RNA, 64 nt, Homo Sapiens
uaaagagacugguagcucaucauccuaccauaaaagagaaaaaaauucggaaagugaucagagc

SEQ ID NO: 345955 - RNA, 64 nt, Homo Sapiens
agauugaugacaagcaaguuacucaggaaucaaaagagaaaaaaguuucugaaaacaaugaaac

SEQ ID NO: 345956 - RNA, 64 nt, Homo Sapiens
ucuauguacuguaauagugugauuacuaugcucuagagaaaagucuaccccugcuaaggaguuc

SEQ ID NO: 345957 - RNA, 64 nt, Homo Sapiens
ccaaaagagaucacaauacucaaaagagagagagagagaaaaaagagagaucuugauccacaga

SEQ ID NO: 345958 - RNA, 64 nt, Homo Sapiens
aauauuaacacaaaaaaaugauuaaaacgaggagagagaaaaauagagcaagaaaagagaaaau

SEQ ID NO: 345959 - RNA, 64 nt, Homo Sapiens
uuaaaacgaggagagagaaaggaagagcaagaaaagagaaaauaaguuuaaacccaccauguau

SEQ ID NO: 345960 - RNA, 64 nt, Homo Sapiens
aggaagggaacuuauuucuugaaagacaaacgggagagaaaaagaaugagcaaacaaaaaaauc

SEQ ID NO: 345961 - RNA, 64 nt, Homo Sapiens
gacuuacaaaaacuugcagccaguuuguauguacagagaaaauguuuuucccuucaguagugag

SEQ ID NO: 345962 - RNA, 64 nt, Homo Sapiens
auacauuauaaaagcagaacaugaaaaacagaagagagaaaaauagcauuuagaaguuuuggau

SEQ ID NO: 345963 - RNA, 64 nt, Homo Sapiens
auaaagccagaaugagaaauuaccaucuucuacuagagaaaaccaagagaaaaauuuuuaugcu

SEQ ID NO: 345964 - RNA, 64 nt, Homo Sapiens
augagaaauuaccaucuucuacuagagaaaaccaagagaaaaauuuuuaugcuaggaugccuuu

SEQ ID NO: 345965 - RNA, 64 nt, Homo Sapiens
auguuauguuuuuggcaugaacaaaagaaacaagagagaaaaaaaucaaaauaauuaaaauaaa

SEQ ID NO: 345966 - RNA, 64 nt, Homo Sapiens
gagaaaaaaaucaaaauaauuaaaauaaauuguuagagaaaaguuacuuuaaaaauagcuauaa

SEQ ID NO: 345967 - RNA, 64 nt, Homo Sapiens
ggcucuuugaauguaugucaaacucaguuacuccagagaaaaaacugccuuucccuucaaagug

SEQ ID NO: 345968 - RNA, 50 nt, Homo Sapiens
auaacauccauaguguuuagagagaaaaaaauaaaccaauaaccuaccua

SEQ ID NO: 345969 - RNA, 64 nt, Homo Sapiens
ccuacuucuaggauugcaaaggagucuuccaacuagagaaaaauuguccacugacauuugggau

SEQ ID NO: 345970 - RNA, 64 nt, Homo Sapiens
uguuucguuggguauugcaguuucugaauaauaaagagaaaaggaacagauccauguuaggaca

SEQ ID NO: 345971 - RNA, 64 nt, Homo Sapiens
acuaugugguuucuguaagucugugccucuugauagagaaaaauauguuuacuguucagcaaau

SEQ ID NO: 345972 - RNA, 64 nt, Homo Sapiens
gaaaggcugcuuuagugccuuaacuaggucuccaagagaaaauaauuuguucuuccugauauga

SEQ ID NO: 345973 - RNA, 64 nt, Homo Sapiens
cuugguggugggauuuuuuuagagauuaguuuacagagaaaaggauuaaagcuggaaggggcua

SEQ ID NO: 345974 - RNA, 64 nt, Homo Sapiens
ccucacuuauuaacucucuuaguagcugucuccaagagaaaaaucuccaguucucccugaugac

SEQ ID NO: 345975 - RNA, 64 nt, Homo Sapiens
uccugacuaaaaaaaauucauuucuuauaacugcagagaaaauaguaucaugguguuuauuuuc

SEQ ID NO: 345976 - RNA, 64 nt, Homo Sapiens
aauuuuaaaaagaaagcuaauuaaaaaugcuuauagagaaaaaaaccucuuuuggguaugccuu

SEQ ID NO: 345977 - RNA, 64 nt, Homo Sapiens
auuuuuaaaauaauagauaauguuugauuaaaauagagaaaauacuuuuucuaaaaacuucaag

SEQ ID NO: 345978 - RNA, 64 nt, Homo Sapiens
gagcaccaaaaacuucauuagcuuauagacuaugagagaaaaguuuuuuuuuuugguauacuga

SEQ ID NO: 345979 - RNA, 64 nt, Homo Sapiens
uaaacagccaacuaggcaguuacucuugguuuacagagaaaaguuguauaucaugacuagcuuu

SEQ ID NO: 345980 - RNA, 64 nt, Homo Sapiens
aacuuuauguugcaggaaacuuccauauuuuaaaagagaaaaacuuguuuuauauaccaaugac

SEQ ID NO: 345981 - RNA, 64 nt, Homo Sapiens
uggaccuuuucccuugcuguagccccucaaagggagagaaaagcgauuaaugucaauguuaauc

SEQ ID NO: 345982 - RNA, 64 nt, Homo Sapiens
aggaaaagaaguugcaagacgccaagucuaaugaagagaaaaaagagauuucuacuucggagag

SEQ ID NO: 345983 - RNA, 64 nt, Homo Sapiens
ggguugaagagcaaagcagauuuaacuauagccuagagaaaagacagucuaucauauaaacauc

SEQ ID NO: 345984 - RNA, 64 nt, Homo Sapiens
uaauggcauuuuaaagguuaacauauaucuacagagagaaaaaucuuauuuuuugccacugcaa

SEQ ID NO: 345985 - RNA, 64 nt, Homo Sapiens
uauuauacacuauauuccuacaauaaaguaagcuagagaaaauguuauuuagaaaaucauaaga

SEQ ID NO: 345986 - RNA, 64 nt, Homo Sapiens
gcuagagaaaauguuauuuagaaaaucauaagaaagagaaaauauauuuacuauucauuaaaug

SEQ ID NO: 345987 - RNA, 64 nt, Homo Sapiens
auggcugcucaggaaggaagagcuguggaaugagagagaaaaccccaguccugcagugucugug

SEQ ID NO: 345988 - RNA, 64 nt, Homo Sapiens
ucucaucacaauuggagaccuccuuacaacagcuagagaaaacagaucugauuaauguuuccuu

SEQ ID NO: 345989 - RNA, 64 nt, Homo Sapiens
cucaagucuuagucgacauaaaagaauacacacuagagaaaaaccuuacaaaugugaagcaucu

SEQ ID NO: 345990 - RNA, 64 nt, Homo Sapiens
guuggccuauauuaaacaacaaggaauucauuucagagaaaagcccuauacguguagugaaugu

SEQ ID NO: 345991 - RNA, 64 nt, Homo Sapiens
acauuucaggcuuuacccaacaucgaaauaauggagagaaaauuguugauuauuuguuuaugaa

SEQ ID NO: 345992 - RNA, 64 nt, Homo Sapiens
aaagaacuguccgucccccuaaaggguaagcuagagagaaaaagcauuugggcuuauuuagaaa

SEQ ID NO: 345993 - RNA, 51 nt, Homo Sapiens
aacccagcgaaggcgccuucuagagaaaaacugugguucuccuccaguuga

SEQ ID NO: 345994 - RNA, 64 nt, Homo Sapiens
agaagcauaaucgugggcauccugugcugccauuagagaaaaaaccuuucucccagcuuugccg

SEQ ID NO: 345995 - RNA, 64 nt, Homo Sapiens
uucaucuucaucucggaauuucagucauaacucuagagaaaaacccaaauuauugcuucaacca

SEQ ID NO: 345996 - RNA, 64 nt, Homo Sapiens
uguuuguuuacauaagagaagcccugagaccucuagagaaaagaacuuaaguuuguaagacagu

SEQ ID NO: 345997 - RNA, 64 nt, Homo Sapiens
agaaaggacagagccagcggggagcucuugggucagagaaaaugccaaagcaaggagaucauuu

SEQ ID NO: 345998 - RNA, 64 nt, Homo Sapiens
aauuugggauacuaaaguagaauuauauuucuacagagaaaauguagcgcacccagagaaaauu

SEQ ID NO: 345999 - RNA, 64 nt, Homo Sapiens
aauuauauuucuacagagaauauuuagcgcacccagagaaaauuauugauuuguuaugguuaca

SEQ ID NO: 346000 - RNA, 64 nt, Homo Sapiens
uccccccacccgccaucugcgaaaggccuucugcagagaaaaugcacccaacccgagaugucag

SEQ ID NO: 346001 - RNA, 64 nt, Homo Sapiens
gaucuuuuaagggucccuuuauuuuguuuuacauagagaaaaacucuggguaucuuggcugaaa

SEQ ID NO: 346002 - RNA, 64 nt, Homo Sapiens
aucuugccuuauccaggaauaauugccccuuugcagagaaaaaaaaaaacuuaaaaaaagcaca

SEQ ID NO: 346003 - RNA, 64 nt, Homo Sapiens
cugcuagcuaggcaguaauaaacucuguuacagaagagaaaaagggccgggcacaguggcuuau

SEQ ID NO: 346004 - RNA, 64 nt, Homo Sapiens
ugcuguaaagccaugguagugguuccagugaauuagagaaaacccugcucuacaggaauagcau

SEQ ID NO: 346005 - RNA, 64 nt, Homo Sapiens
aagucucccucagaaaguacgcaguagaugaugaagagaaaaaaagaaugagaagcuugaaugg

SEQ ID NO: 346006 - RNA, 64 nt, Homo Sapiens
aucagguuuuaaacaggaaaacuuaugugaacugagagaaaaaaacaaaagaaaaugcacucua

SEQ ID NO: 346007 - RNA, 64 nt, Homo Sapiens
aacuuuguugccaaaagguuauuaagcuaaacuaagagaaaaauuaauaaaacuguucucagac

SEQ ID NO: 346008 - RNA, 64 nt, Homo Sapiens
uguuugcaauccaaauccagaacagcagaaucucagagaaaagcaaauacuguaagucucaauu

SEQ ID NO: 346009 - RNA, 64 nt, Homo Sapiens
ggaccuuuuuccaguuaaaauauacugacaaaccagagaaaaauauauaaauaaaggaaccuuu

SEQ ID NO: 346010 - RNA, 64 nt, Homo Sapiens
uaauucuagucagucauacaacuauaacuacuauagagaaaauaaaauuuuuuccuuuuuuuuu

SEQ ID NO: 346011 - RNA, 64 nt, Homo Sapiens
gggaugucaguuaauuaaggggugaugauuugcaagagaaaauuaguggagagucacauaggua

SEQ ID NO: 346012 - RNA, 64 nt, Homo Sapiens
aaucuauucuacaugaggaggcugagaaaggggaagagaaaaacaaaccaaauggaugauguua

SEQ ID NO: 346013 - RNA, 64 nt, Homo Sapiens
aaggaaacacgaaagaaaagucaggaagguagagagagaaaaagggagggaaggagaaagaaug

SEQ ID NO: 346014 - RNA, 64 nt, Homo Sapiens
ugaaaccuacaguugacaagagaauguacagcuaagagaaaagcuuaagaggccacacuauucg

SEQ ID NO: 346015 - RNA, 64 nt, Homo Sapiens
cgucaccuagcugcugagcagaaaccgcaccccgagagaaaaucccauccucuguuccaaggcc

SEQ ID NO: 346016 - RNA, 64 nt, Homo Sapiens
agaaauuuucuagcccaacucccuguuucaugaaagagaaaagaggcucagaaaaguuuagaga

SEQ ID NO: 346017 - RNA, 64 nt, Homo Sapiens
gucauauuuagaacaaagucaaguauaaauuuacagagaaaaaauucuaagacaguuggauguu

SEQ ID NO: 346018 - RNA, 64 nt, Homo Sapiens
uguuugagaaguuuuguuuugaggagaagcaugaagagaaaaccguuuggcugcccacaggcag

SEQ ID NO: 346019 - RNA, 64 nt, Homo Sapiens
gcaaagcaagguuguggccuuuauaaaggaaaagagagaaaaaguccacuauggugugugccuu

SEQ ID NO: 346020 - RNA, 64 nt, Homo Sapiens
acuugcccuuuuuccugggaguuacuucguugucagagaaaaacaagaucuugaaaagguaguu

SEQ ID NO: 346021 - RNA, 64 nt, Homo Sapiens
aagguaaaaacacuauuaccuuaggauaacaagaagagaaaauacauauaaaaacuuuaaugaa

SEQ ID NO: 346022 - RNA, 64 nt, Homo Sapiens
gauucauaaaaguuauaaaauauuagguaaauacagagaaaacaauaagccucugaaauaaguc

SEQ ID NO: 346023 - RNA, 64 nt, Homo Sapiens
cagaaaauagaaauacaaacaagguugguacaugagagaaaauguugaccuuuuacuuccuuuu

SEQ ID NO: 346024 - RNA, 64 nt, Homo Sapiens
ggaggcaaaaagcacuucuuacauggcggcagcaagagaaaaugagaaagaagcaaaaguggaa

SEQ ID NO: 346025 - RNA, 64 nt, Homo Sapiens
ggaggugaaaagcacuucguacauggugguggcaagagaaaaugaagaagaagcaaaaguggaa

SEQ ID NO: 346026 - RNA, 64 nt, Homo Sapiens
ugucuugcauaguuaagccggacauuuuucugucagagaaaaggcaucauuguccgcuccauua

SEQ ID NO: 346027 - RNA, 64 nt, Homo Sapiens
cuuuccaauuuauagaccaaaaaauuaacauccaagagaaaaguuauugucagauaccgcucuu

SEQ ID NO: 346028 - RNA, 64 nt, Homo Sapiens
cugaucccugucaguggaaauacacaagaaaaacagagaaaagcauuguccuuauagcauugca

SEQ ID NO: 346029 - RNA, 64 nt, Homo Sapiens
ccucaacuguguauuuugucacugugaaagagagagagaaaaaaccaggggcugguagacaaga

SEQ ID NO: 346030 - RNA, 64 nt, Homo Sapiens
aauuaauugcaguaaaaacaaaagaguaguggggagagaaaaacaauccaauacauauuuuucu

SEQ ID NO: 346031 - RNA, 64 nt, Homo Sapiens
cauauuuuucucucagaauagaaagaaaacacaaagagaaaauaugaacaauauaaagcacuua

SEQ ID NO: 346032 - RNA, 64 nt, Homo Sapiens
aggaucaucgccguugaaaugaaaagagagacagagagaaaaaaaaaaagagaacccacaugaa

SEQ ID NO: 346033 - RNA, 64 nt, Homo Sapiens
ugcauuuugaugaauuuuuucuagccauuuuuaaagagaaaacuaggaauugaguauuuugugu

SEQ ID NO: 346034 - RNA, 64 nt, Homo Sapiens
agcagguagcccaaaauagagaaagauuagauaaagagaaaauaaguauccaucagagacagua

SEQ ID NO: 346035 - RNA, 64 nt, Homo Sapiens
uauccaucagagacaguaucucuaggcuugggcaagagaaaaguccacagugauaagcaacucc

SEQ ID NO: 346036 - RNA, 64 nt, Homo Sapiens
auaagcaacuccaccuaaggcaugaauaugcggcagagaaaacagcaauagugaaugaaugcaa

SEQ ID NO: 346037 - RNA, 64 nt, Homo Sapiens
ccuguagcuugaaaggggaaagauuggagguaagagagaaaaugaaagaacaccucuggguccu

SEQ ID NO: 346038 - RNA, 64 nt, Homo Sapiens
gucuguaacugcugugcacugcuguaaacuuguuagagaaaaaaauaaccugcaugugggcucc

SEQ ID NO: 346039 - RNA, 64 nt, Homo Sapiens
guagccucagguuugaaucagucaccuagggguaagagaaaaaccacaacauaagaccugaaaa

SEQ ID NO: 346040 - RNA, 64 nt, Homo Sapiens
aaauuuuaggacuugaggacgugaacaacuugaaagagaaaauugauuccccuugaggaaagaa

SEQ ID NO: 346041 - RNA, 64 nt, Homo Sapiens
cuagagccugugcuaaagaaaaacccaaggaacaagagaaaaaagaguccuuugggauucuagg

SEQ ID NO: 346042 - RNA, 64 nt, Homo Sapiens
aaccaagauagauccauuugcuaauauuuaggcaagagaaaauauugaaacccauuaggcaugc

SEQ ID NO: 346043 - RNA, 64 nt, Homo Sapiens
uaaagggaaccugcaauaaucuugaaaaagaaaaagagaaaaauuuuaaaauccugcuauagga

SEQ ID NO: 346044 - RNA, 64 nt, Homo Sapiens
gaaaaauuuuaaaauccugcuauaggagaaaaaaagagaaaaaaauaaaaaucaaaaaaaaaaa

SEQ ID NO: 346045 - RNA, 64 nt, Homo Sapiens
ugauaaaacauaaagguacaguggucuaugaggaagagaaaagguaccugaggaugcagaagua

SEQ ID NO: 346046 - RNA, 64 nt, Homo Sapiens
uaccacaugggaaccguuuguccacacucauuccagagaaaaccgaguccucucaguugcacac

SEQ ID NO: 346047 - RNA, 64 nt, Homo Sapiens
cugacaggagaugggauuuuaaaugagcugcaagagagaaaaauuaacuuucaggauguauuuu

SEQ ID NO: 346048 - RNA, 64 nt, Homo Sapiens
aacuugccauauuuuacaagauuuggcaaaaacaagagaaaagaaaauucaaauaauuauaagc

SEQ ID NO: 346049 - RNA, 64 nt, Homo Sapiens
gauaaaguagaaaaagaaaaacacagucaaagaaagagaaaaaacucagcaguuugugccuccu

SEQ ID NO: 346050 - RNA, 64 nt, Homo Sapiens
ucauucagaaaucauggauuaaaguuauaaauaaagagaaaaacuuuccuacucuaauucaacu

SEQ ID NO: 346051 - RNA, 64 nt, Homo Sapiens
uaauuuuucuucaauacaaucauuuuaaugagucagagaaaaauaugugcuuaccacacugcca

SEQ ID NO: 346052 - RNA, 64 nt, Homo Sapiens
gaaauguuuucaguuuucuuaaggcauagggaauagagaaaaggcuaucaacuggagagcccac

SEQ ID NO: 346053 - RNA, 64 nt, Homo Sapiens
uaguccuucaaauacugcugcuuauaacugaugcagagaaaaauguucauagaugggaagcuuc

SEQ ID NO: 346054 - RNA, 64 nt, Homo Sapiens
cccaaaauagcugcccuuaaagaguuguuagcagagagaaaaauaacagugaaugugcuccugg

SEQ ID NO: 346055 - RNA, 64 nt, Homo Sapiens
aguauacacucagcaauaauuagaaaaaaaggagagagaaaagugauuuaaacaggguggauuc

SEQ ID NO: 346056 - RNA, 64 nt, Homo Sapiens
uuaugagaauaucaguugguauaaagagagagaaagagaaaaacauuucagcccuuagaugagg

SEQ ID NO: 346057 - RNA, 64 nt, Homo Sapiens
accccugagaaaugaacauugguaggagcauuuaagagaaaacuugcuuauuugcuaaugccua

SEQ ID NO: 346058 - RNA, 64 nt, Homo Sapiens
guuacuuucaaugugaggaaugaaugauaaauuaagagaaaaaaauaucaggaaggucaauaua

SEQ ID NO: 346059 - RNA, 64 nt, Homo Sapiens
aucuguaguuuagaguguaagaaguaauggguacagagaaaaaaaauuuaagaccaauauuuua

SEQ ID NO: 346060 - RNA, 64 nt, Homo Sapiens
agaguuaauugcaaugugauaguggguagaaaggagagaaaaacccacugaaggguucaaauac

SEQ ID NO: 346061 - RNA, 64 nt, Homo Sapiens
ugaugcuggcaaggagcgggacccaaagggaaaaagagaaaagcgcaaagaagggagagaaggu

SEQ ID NO: 346062 - RNA, 64 nt, Homo Sapiens
aacuuaagauuacuggccuuagcugaauauauccagagaaaauauaauuauguuuggaugcagc

SEQ ID NO: 346063 - RNA, 64 nt, Homo Sapiens
uaaaaaaaaaaaaguaagggacaaaaaaaaaaugagagaaaagcucuuuuuaaaaaaaauaaca

SEQ ID NO: 346064 - RNA, 64 nt, Homo Sapiens
caguaacaguuuacagaagcagugccaaaucacaagagaaaaaguuuuuccggcuuaagccuua

SEQ ID NO: 346065 - RNA, 64 nt, Homo Sapiens
aauauaacuuucuugagugcgaaaugaggaagagagagaaaaacaaaaggcagaauacuggcaa

SEQ ID NO: 346066 - RNA, 64 nt, Homo Sapiens
gcaacagauuuucagcguuggauacagguuuagaagagaaaagagacucaguuuuauugaggua

SEQ ID NO: 346067 - RNA, 64 nt, Homo Sapiens
cuaugccuguaauuuuuaaguaaauauagaaaauagagaaaaggaagcaugaauuauuuucaua

SEQ ID NO: 346068 - RNA, 64 nt, Homo Sapiens
aucacaaaaacaaacuuuuugaaaaaaaagaaaaagagaaaaaaaaugcauggauuccuuugaa

SEQ ID NO: 346069 - RNA, 64 nt, Homo Sapiens
gauggggaaaacaagcugugcacgaaggagagagagagaaaacucacacacacacacacacaca

SEQ ID NO: 346070 - RNA, 64 nt, Homo Sapiens
auaggccucuguucucauuuggcuccuuuuuuaaagagaaaagccggcugugcaucgcauucga

SEQ ID NO: 346071 - RNA, 64 nt, Homo Sapiens
cuucugugcccaggcuaaagggaaagaacaggaaagagaaaagcuccugaaguuugcugguuca

SEQ ID NO: 346072 - RNA, 64 nt, Homo Sapiens
cacuaacgguuccucuuagccugauauucugagcagagaaaaggauccacagucuguuccuguu

SEQ ID NO: 346073 - RNA, 64 nt, Homo Sapiens
aauggaaaguacccagaacugguucauaaaguuuagagaaaagguaauaauccuuauaaaauug

SEQ ID NO: 346074 - RNA, 64 nt, Homo Sapiens
uuuuuaaagaagccagcucagccguaauaacauuagagaaaaugaaguacagugagcacaauua

SEQ ID NO: 346075 - RNA, 64 nt, Homo Sapiens
gacuuacuggccagugauccuauucugguucuucagagaaaauauucuaaaugagguagaugaa

SEQ ID NO: 346076 - RNA, 64 nt, Homo Sapiens
auggaauaagcagaaacugcugauccccugugugagagaaaagaaaaaagguagaucugaaugc

SEQ ID NO: 346077 - RNA, 64 nt, Homo Sapiens
aaaaacagcauucuagaaauaaaaauucaaaugaagagaaaaagaagugugaggucuacuuuaa

SEQ ID NO: 346078 - RNA, 64 nt, Homo Sapiens
gaaaaaacaauguuagaaggauuugauuuauuucagagaaaauagaacgaauuuugcaaguuua

SEQ ID NO: 346079 - RNA, 64 nt, Homo Sapiens
cucaacaguacaaauuaacuugagaaaucuuuagagagaaaaaauauaguuacugaacugauuc

SEQ ID NO: 346080 - RNA, 64 nt, Homo Sapiens
auggugccguagggcugcuaggucugaccccucaagagaaaagcugcaucuuugagugcaguuu

SEQ ID NO: 346081 - RNA, 64 nt, Homo Sapiens
uaugaaaacacaaagcacaggucaggauccucugagagaaaaucaacauugcaccacguagggg

SEQ ID NO: 346082 - RNA, 64 nt, Homo Sapiens
augagggcaacaggagauguggggacguguuaggagagaaaaaaaaaaaaacaaaaauauauau

SEQ ID NO: 346083 - RNA, 64 nt, Homo Sapiens
aucaaccaacacaagaucaaaaaggaaaaggacgagagaaaaauuauuuuuaagauaauuaaac

SEQ ID NO: 346084 - RNA, 64 nt, Homo Sapiens
cacccugaccgugcugaacagacccccccacacgagagaaaauaaaggagcaauaaagucacga

SEQ ID NO: 346085 - RNA, 64 nt, Homo Sapiens
ccgcaagcagcugccugggggguguccaaggagcagagaaaacuacuagaugugaacuugaaga

SEQ ID NO: 346086 - RNA, 64 nt, Homo Sapiens
cuaaaugggaaugcaaagcuugagcugcucugcaagagaaaauaagcaggacagaggauuugcu

SEQ ID NO: 346087 - RNA, 64 nt, Homo Sapiens
ucauaaaugaaauauacuccgaguuucuugaagaagagaaaaucuucucagaaucaggucuaau

SEQ ID NO: 346088 - RNA, 64 nt, Homo Sapiens
aaaagucaugcuuuauuuuagugagggcaauuacagagaaaagaguaagcagaaauguccuucu

SEQ ID NO: 346089 - RNA, 64 nt, Homo Sapiens
ucauacgcauaauuggaucacuguguuuucacacagagaaaaaucacucgcccuucugagaggc

SEQ ID NO: 346090 - RNA, 64 nt, Homo Sapiens
cuuacaaaugucuaagguccccacugccugcuggagagaaaacacacuccuuugcuuagcccac

SEQ ID NO: 346091 - RNA, 64 nt, Homo Sapiens
gcuaaagggcauauguccucugcagauccacagcagagaaaaagucccgugcuugcuagucagg

SEQ ID NO: 346092 - RNA, 64 nt, Homo Sapiens
gggucugggcucugucagccgccaccucugggaaagagaaaagguuuggguccacugaacauca

SEQ ID NO: 346093 - RNA, 64 nt, Homo Sapiens
aucugucguggcugagcggggcgagcuguucuggagagaaaaccucacaccccagugucacagg

SEQ ID NO: 346094 - RNA, 64 nt, Homo Sapiens
cacaaauuccaaugucacaaggauggggggagagagagaaaaucccagggucuggugauggcag

SEQ ID NO: 346095 - RNA, 64 nt, Homo Sapiens
aaucacccaccacccccccaagagagacagagagagagaaaaaaaaaacagaaacccgagaaag

SEQ ID NO: 346096 - RNA, 59 nt, Homo Sapiens
gaaacccgagaaagagagagaaaccaaaaagagaaaacaucacagccggacucgccuaa

SEQ ID NO: 346097 - RNA, 64 nt, Homo Sapiens
agaugugggagaggacauauauguuuagagcaacagagaaaaaauaguauguuuuucugugugu

SEQ ID NO: 346098 - RNA, 64 nt, Homo Sapiens
cgugcauuguuuucaaaagauacuuauuggugagagagaaaaucuggacguaauaagucuuaug

SEQ ID NO: 346099 - RNA, 64 nt, Homo Sapiens
aaugaaugagaugacuaacgugauuaaccuccuuagagaaaauuuugaaugggguauuuacugu

SEQ ID NO: 346100 - RNA, 64 nt, Homo Sapiens
uuuugacuggaaauacacuggaaaaaccuuaugcagagaaaaguauuggugugaauugcuaagg

SEQ ID NO: 346101 - RNA, 64 nt, Homo Sapiens
cugggaucaguuauaauauauauuuuuuuuagaaagagaaaaugagcugagaguuuacaggcac

SEQ ID NO: 346102 - RNA, 64 nt, Homo Sapiens
acuuggggagagaucaguagcauuugaggaaguaagagaaaagaaucaugguaccucaggguuu

SEQ ID NO: 346103 - RNA, 64 nt, Homo Sapiens
ccaguuaguggugugcaaacuaaaaaaaagaaugagagaaaagcgaagagaccugccagaagau

SEQ ID NO: 346104 - RNA, 64 nt, Homo Sapiens
gggguuuuguuuccccaccugaaaaaaugaucagagagaaaaguucccucuuagaaucucuuau

SEQ ID NO: 346105 - RNA, 64 nt, Homo Sapiens
auauucuuuguuuagagguacuuguuuuuuauuaagagaaaaaccaguguaacguuuaugugac

SEQ ID NO: 346106 - RNA, 64 nt, Homo Sapiens
caagggcuccuccaggauugcaaaaaaaaaaggaagagaaaagaugaaccuuuaagcaaauaag

SEQ ID NO: 346107 - RNA, 64 nt, Homo Sapiens
cuuuccaacaccccugaaauucauagucaguagcagagaaaagcagaucccaauucaucccaca

SEQ ID NO: 346108 - RNA, 64 nt, Homo Sapiens
uugaaaacauccugaaaggaacucauacagcacaagagaaaacuacuaagcuugacaucuguga

SEQ ID NO: 346109 - RNA, 64 nt, Homo Sapiens
aaaccuacucaagaaaagacaacacaagaacuuaagagaaaaagcugaacaacacuaacaugag

SEQ ID NO: 346110 - RNA, 64 nt, Homo Sapiens
aaaccuguuacagaaaagacucaaggagaacauaagagaaaaggugagaaaagaacauaagaac

SEQ ID NO: 346111 - RNA, 64 nt, Homo Sapiens
aaaucuguugaagaaaggaccguaagcacaggaaagagaaaaaguacccuccgagaaagaagaa

SEQ ID NO: 346112 - RNA, 64 nt, Homo Sapiens
acaccuagaagaaggcaaagacagaaacaucagaagagaaaacggaccaucaagcaggucauaa

SEQ ID NO: 346113 - RNA, 64 nt, Homo Sapiens
accuggucucacugugguuggaguaagaugagcuagagaaaauaugauuucuuuuagaauaugg

SEQ ID NO: 346114 - RNA, 64 nt, Homo Sapiens
uccuuuucucuucacuguuucuagggguaaauugagagaaaagcaacuucauaaguaguauuaa

SEQ ID NO: 346115 - RNA, 64 nt, Homo Sapiens
gugagcucaaacaaaaacugcagacaaacaaaaaagagaaaagcuuuuauuuguguuuucaguu

SEQ ID NO: 346116 - RNA, 64 nt, Homo Sapiens
gacacacacacacagacacacacaaagaaucagcagagaaaacaaaauacaaguccuguucugu

SEQ ID NO: 346117 - RNA, 64 nt, Homo Sapiens; identical to SEQ ID NO: 53500

SEQ ID NO: 346118 - RNA, 64 nt, Homo Sapiens; identical to SEQ ID NO: 53501

SEQ ID NO: 346119 - RNA, 64 nt, Homo Sapiens; identical to SEQ ID NO: 53502

SEQ ID NO: 346120 - RNA, 64 nt, Homo Sapiens; identical to SEQ ID NO: 53503

SEQ ID NO: 346121 - RNA, 64 nt, Homo Sapiens; identical to SEQ ID NO: 53504

SEQ ID NO: 346122 - RNA, 64 nt, Homo Sapiens; identical to SEQ ID NO: 53505

SEQ ID NO: 346123 - RNA, 64 nt, Homo Sapiens; identical to SEQ ID NO: 53506

SEQ ID NO: 346124 - RNA, 64 nt, Homo Sapiens; identical to SEQ ID NO: 53507

SEQ ID NO: 346125 - RNA, 64 nt, Homo Sapiens; identical to SEQ ID NO: 53508

SEQ ID NO: 346126 - RNA, 64 nt, Homo Sapiens; identical to SEQ ID NO: 53509

SEQ ID NO: 346127 - RNA, 64 nt, Homo Sapiens; identical to SEQ ID NO: 53510

SEQ ID NO: 346128 - RNA, 64 nt, Homo Sapiens; identical to SEQ ID NO: 53511

SEQ ID NO: 346129 - RNA, 64 nt, Homo Sapiens; identical to SEQ ID NO: 53512

SEQ ID NO: 346130 - RNA, 64 nt, Homo Sapiens; identical to SEQ ID NO: 53513

SEQ ID NO: 346131 - RNA, 64 nt, Homo Sapiens; identical to SEQ ID NO: 53514

SEQ ID NO: 346132 - RNA, 64 nt, Homo Sapiens; identical to SEQ ID NO: 53515

SEQ ID NO: 346133 - RNA, 64 nt, Homo Sapiens; identical to SEQ ID NO: 53516

SEQ ID NO: 346134 - RNA, 64 nt, Homo Sapiens; identical to SEQ ID NO: 53517

SEQ ID NO: 346135 - RNA, 64 nt, Homo Sapiens; identical to SEQ ID NO: 53518

SEQ ID NO: 346136 - RNA, 64 nt, Homo Sapiens; identical to SEQ ID NO: 53519

SEQ ID NO: 346137 - RNA, 64 nt, Homo Sapiens; identical to SEQ ID NO: 53520

SEQ ID NO: 346138 - RNA, 54 nt, Homo Sapiens; identical to SEQ ID NO: 53521

SEQ ID NO: 346139 - RNA, 64 nt, Homo Sapiens; identical to SEQ ID NO: 53522

SEQ ID NO: 346140 - RNA, 64 nt, Homo Sapiens; identical to SEQ ID NO: 53523

SEQ ID NO: 346141 - RNA, 64 nt, Homo Sapiens; identical to SEQ ID NO: 53524

SEQ ID NO: 346142 - RNA, 64 nt, Homo Sapiens; identical to SEQ ID NO: 53525

SEQ ID NO: 346143 - RNA, 64 nt, Homo Sapiens; identical to SEQ ID NO: 53526

SEQ ID NO: 346144 - RNA, 64 nt, Homo Sapiens; identical to SEQ ID NO: 53527

SEQ ID NO: 346145 - RNA, 64 nt, Homo Sapiens; identical to SEQ ID NO: 53528

SEQ ID NO: 346146 - RNA, 64 nt, Homo Sapiens; identical to SEQ ID NO: 53529

SEQ ID NO: 346147 - RNA, 64 nt, Homo Sapiens; identical to SEQ ID NO: 53530

SEQ ID NO: 346148 - RNA, 64 nt, Homo Sapiens; identical to SEQ ID NO: 53531

SEQ ID NO: 346149 - RNA, 64 nt, Homo Sapiens; identical to SEQ ID NO: 53532

SEQ ID NO: 346150 - RNA, 64 nt, Homo Sapiens; identical to SEQ ID NO: 53533

SEQ ID NO: 346151 - RNA, 64 nt, Homo Sapiens; identical to SEQ ID NO: 53534

SEQ ID NO: 346152 - RNA, 64 nt, Homo Sapiens; identical to SEQ ID NO: 53535

SEQ ID NO: 346153 - RNA, 64 nt, Homo Sapiens; identical to SEQ ID NO: 53536

SEQ ID NO: 346154 - RNA, 64 nt, Homo Sapiens; identical to SEQ ID NO: 53537

SEQ ID NO: 346155 - RNA, 64 nt, Homo Sapiens; identical to SEQ ID NO: 53538

SEQ ID NO: 346156 - RNA, 64 nt, Homo Sapiens; identical to SEQ ID NO: 53539

SEQ ID NO: 346157 - RNA, 64 nt, Homo Sapiens; identical to SEQ ID NO: 53540

SEQ ID NO: 346158 - RNA, 64 nt, Homo Sapiens; identical to SEQ ID NO: 53541

SEQ ID NO: 346159 - RNA, 64 nt, Homo Sapiens; identical to SEQ ID NO: 53542

SEQ ID NO: 346160 - RNA, 64 nt, Homo Sapiens; identical to SEQ ID NO: 53543

SEQ ID NO: 346161 - RNA, 64 nt, Homo Sapiens
ggaaagacagauaauuucacugccccuuugagccaccacucacucuccuuauuacacaagcaca

SEQ ID NO: 346162 - RNA, 64 nt, Homo Sapiens
ugugucccauggcuggucagagcccugggucaaaaccacucagcccaggggaggggaugaggca

SEQ ID NO: 346163 - RNA, 64 nt, Homo Sapiens; identical to SEQ ID NO: 313188

SEQ ID NO: 346164 - RNA, 64 nt, Homo Sapiens; identical to SEQ ID NO: 313189

SEQ ID NO: 346165 - RNA, 64 nt, Homo Sapiens; identical to SEQ ID NO: 313190

SEQ ID NO: 346166 - RNA, 64 nt, Homo Sapiens; identical to SEQ ID NO: 313191

SEQ ID NO: 346167 - RNA, 64 nt, Homo Sapiens; identical to SEQ ID NO: 313192

SEQ ID NO: 346168 - RNA, 64 nt, Homo Sapiens; identical to SEQ ID NO: 313193

SEQ ID NO: 346169 - RNA, 64 nt, Homo Sapiens; identical to SEQ ID NO: 313194

SEQ ID NO: 346170 - RNA, 64 nt, Homo Sapiens; identical to SEQ ID NO: 313195

SEQ ID NO: 346171 - RNA, 64 nt, Homo Sapiens; identical to SEQ ID NO: 313196

SEQ ID NO: 346172 - RNA, 64 nt, Homo Sapiens; identical to SEQ ID NO: 313197

SEQ ID NO: 346173 - RNA, 64 nt, Homo Sapiens; identical to SEQ ID NO: 313198

SEQ ID NO: 346174 - RNA, 64 nt, Homo Sapiens; identical to SEQ ID NO: 313199

SEQ ID NO: 346175 - RNA, 64 nt, Homo Sapiens; identical to SEQ ID NO: 313200

SEQ ID NO: 346176 - RNA, 64 nt, Homo Sapiens; identical to SEQ ID NO: 313201

SEQ ID NO: 346177 - RNA, 64 nt, Homo Sapiens
auucaaaaacccuaaauuauucuagccaauuugucauaggcauaggcaaggaaagcuggccuug

SEQ ID NO: 346178 - RNA, 64 nt, Homo Sapiens
aaacccuaaauuauucuagccaauuugucauaggcauaggcaaggaaagcuggccuugcuaacu

SEQ ID NO: 346179 - RNA, 64 nt, Homo Sapiens
auagauggggauugguacguacagauuguauuggcauaggcauggagaagcaaacuuuuuugug

SEQ ID NO: 346180 - RNA, 64 nt, Homo Sapiens
uagaacuggaagaaacuuccagaugugaucugaucauaggcaauuuuuuaggaagcucugcaac

SEQ ID NO: 346181 - RNA, 64 nt, Homo Sapiens
uaucuaucuaucuaucuaucucuauuuauuuauguauuuagagaucaggucucacucuguugac

SEQ ID NO: 346182 - RNA, 64 nt, Homo Sapiens
cauaaaucaaaaguuaauguaauuguuaucccauuauuuagagcgaaauaaauguugaauauau

SEQ ID NO: 346183 - RNA, 64 nt, Homo Sapiens
ccugucuguguaaagauucaucuuuuauuguaaauauuuagacuuuaccacagaaauauuggaa

SEQ ID NO: 346184 - RNA, 64 nt, Homo Sapiens
auuuuugaggucaaagaaccaguuguucucuuuauauuuagaugaggaugauugaguccauaua

SEQ ID NO: 346185 - RNA, 64 nt, Homo Sapiens
aaagaaauucugacagaugacaucagaagacaccuauuuagaauguuacauuuaugaugggaau

SEQ ID NO: 346186 - RNA, 64 nt, Homo Sapiens
gggcauuguagaguauccuaaauauguuaucaaguauuuagaguucuauauuuuaaagauauau

SEQ ID NO: 346187 - RNA, 64 nt, Homo Sapiens
uauaccuguugagacugauucagaggagcaacccuauuuagaaauggauuuaucaucaccucaa

SEQ ID NO: 346188 - RNA, 64 nt, Homo Sapiens
acaggcgugagccaccgcgccuggccgaugguacuauuuagauauaacacuauguuuauuuacu

SEQ ID NO: 346189 - RNA, 64 nt, Homo Sapiens
uccaaacaagaauacuuccagauaacuguccuaauauuuagaugauucauugcuguuccuaggu

SEQ ID NO: 346190 - RNA, 64 nt, Homo Sapiens
uguuuucccguuuccuugaauuaggacccgguuuuauuuagacuaaugacuccuagaguaaacu

SEQ ID NO: 346191 - RNA, 64 nt, Homo Sapiens
accaaaggucauuacaaccuuuuauuuuuuuuuuuauuuagaugaucuuuuauuuuucuuuguu

SEQ ID NO: 346192 - RNA, 64 nt, Homo Sapiens
ggaaagaauuucauaugcaauaaauggugcuuuauauuuagauuuuuuuuucauugccaaaaac

SEQ ID NO: 346193 - RNA, 64 nt, Homo Sapiens
uccuguauucuuguucccgauuuucgucauuuuauauuuagaucuuaccacuuuuuuuuuuugu

SEQ ID NO: 346194 - RNA, 64 nt, Homo Sapiens
auuuuguauuaauuucugauauuccuguguucaauauuuagaaaaaaaaaugaggaauagcaaa

SEQ ID NO: 346195 - RNA, 64 nt, Homo Sapiens
cucuccugcuucuaacaugaaauuauucuugaaauauuuagagcauaauguguauuuuuuccuc

SEQ ID NO: 346196 - RNA, 64 nt, Homo Sapiens
ugguauaauucucuuaacuuaauaauuuuauaaguauuuagaaaguuaugguugcgcauaaauu

SEQ ID NO: 346197 - RNA, 64 nt, Homo Sapiens
aggauugcuuguaauguuugauucuaaacaggcuuauuuagaaauuccaugugcucuuaguucu

SEQ ID NO: 346198 - RNA, 64 nt, Homo Sapiens
cugaaauuuaugucaaaauauacagaguuugcgauauuuagauaauguggaaaauauuagaaac

SEQ ID NO: 346199 - RNA, 64 nt, Homo Sapiens
ugugguuucuuugaacccauaucaaauguaugacuauuuagaguguuuauaagagauaauggaa

SEQ ID NO: 346200 - RNA, 64 nt, Homo Sapiens
aucaagugauuuugaucuuuagugucaauauuuauauuuagauuaauuuuuauaaaugaaaaua

SEQ ID NO: 346201 - RNA, 64 nt, Homo Sapiens
auaagauuuccugccgcuuuuugacaaucuuguguauuuagaaaaauguauuacuugaaaacau

SEQ ID NO: 346202 - RNA, 64 nt, Homo Sapiens
uagaaaaguaagauuagugacauguguggguuuauauuuagauauuuaaggugcauuuucauag

SEQ ID NO: 346203 - RNA, 64 nt, Homo Sapiens
uagaguuccuauuuucagcuauuuagacuuugaauauuuagaacccucuccuuauuuuucuaau

SEQ ID NO: 346204 - RNA, 64 nt, Homo Sapiens
uugaauauuuagaacuagagccuuauuuuucuaauauuuagacucauuuugucauauccccucu

SEQ ID NO: 346205 - RNA, 64 nt, Homo Sapiens
ggacauggugcauuuuuuuuucuuuuauuuguuuuauuuagaacuuuuuuuauuuguuuuauuu

SEQ ID NO: 346206 - RNA, 64 nt, Homo Sapiens
uauuuguuuuauuuagaacuuuuuuuauuuguuuuauuuagaacuuuguguguucuuaaagugu

SEQ ID NO: 346207 - RNA, 64 nt, Homo Sapiens
ucucuagacucuaguggaaguuuguggaugacuauauuuagauucagaaaauaaaaacauccag

SEQ ID NO: 346208 - RNA, 64 nt, Homo Sapiens
gugccucaaaguuguaguacauaaucauuuuuaguauuuagauuucagcucaacucaagauuuc

SEQ ID NO: 346209 - RNA, 64 nt, Homo Sapiens
caggaauccucagagcaauugaaagcccauaauguauuuagaaacaagaccuaauagaaaauaa

SEQ ID NO: 346210 - RNA, 64 nt, Homo Sapiens
aacacacacacaccagauaauacuaguuucucuuuauuuagacaauccucuaguauaagugaau

SEQ ID NO: 346211 - RNA, 64 nt, Homo Sapiens
agaaacaaacgaaacuucuaaaagaagacccuucuauuuagaguuaucggaucugucguucugg

SEQ ID NO: 346212 - RNA, 64 nt, Homo Sapiens
ugguguaguagccagaauucugaaaaucgucauguauuuagacuacaauuucucauugauguug

SEQ ID NO: 346213 - RNA, 64 nt, Homo Sapiens
aauacuagcauacguuuuuccagcuaagucaguauauuuagagcccuaauuaggucauucagga

SEQ ID NO: 346214 - RNA, 64 nt, Homo Sapiens
gaggcuggagguggcagcuugauuuuguauaagcuauuuagaguguuagcuaugggaauaacuu

SEQ ID NO: 346215 - RNA, 64 nt, Homo Sapiens
accuacaugauacagugguguacauaaaaugcuuuauuuagaaauacuuuaaugcuuaaaauua

SEQ ID NO: 346216 - RNA, 64 nt, Homo Sapiens
cuaucuugaaaaucagauuuuaguuuuaucaguguauuuagacaccaauugauaaccaaucaca

SEQ ID NO: 346217 - RNA, 64 nt, Homo Sapiens
auuaagacaaauauacauucaaaaagggagauuuuauuuagacacacauuuucuuuucacccua

SEQ ID NO: 346218 - RNA, 64 nt, Homo Sapiens
uuauuuagacacacauuuucuuuucacccuaaucuauuuagauucauacuuauugagacgggaa

SEQ ID NO: 346219 - RNA, 64 nt, Homo Sapiens
acauagguuuuguguaauaauuauuuguaaauauuauuuagauuuguauuuagacaugauuuau

SEQ ID NO: 346220 - RNA, 64 nt, Homo Sapiens
uguaauaauuauuuguaaauauuauuuagauuuguauuuagacaugauuuauaucuaauauaga

SEQ ID NO: 346221 - RNA, 64 nt, Homo Sapiens
uugccaaauagcauucuuauucacuuuaugccgguauuuagaaaaaauaaauuauagcaaguau

SEQ ID NO: 346222 - RNA, 64 nt, Homo Sapiens
uuaauguauuaaaaagaaaauacaacaaaauguauauuuagacacgagcuuacauggcauaccu

SEQ ID NO: 346223 - RNA, 64 nt, Homo Sapiens
uuuggguagauucacugaggcuaugucaacaugauauuuagaccaacaggugaucaauguuugg

SEQ ID NO: 346224 - RNA, 64 nt, Homo Sapiens
caacaaugacuuauuuaaaaauuacccuuccugcuauuuagacaaaaacaacugaucagugguu

SEQ ID NO: 346225 - RNA, 64 nt, Homo Sapiens
augauuuuaaaagggaaugauaucucuaaauauuuauuuagagauuauuucauuuagaguucuc

SEQ ID NO: 346226 - RNA, 64 nt, Homo Sapiens
aggcagcuuaucuugagaggauuuccugcaugcuuauuuagaaguaugucaccaaccagacagu

SEQ ID NO: 346227 - RNA, 64 nt, Homo Sapiens
agccuucuaaaauaauugcauuccauggguuggguauuuagaaauguagguggcauuuagaaca

SEQ ID NO: 346228 - RNA, 64 nt, Homo Sapiens
cugggaaccuuuuuuacuuccccauauuuguuauuauuuagaaugguucauacgucugcuuugu

SEQ ID NO: 346229 - RNA, 64 nt, Homo Sapiens
uuccuuccaagcuuuuggaguuucucucguaucguauuuagaagauucugccuucccuaguagu

SEQ ID NO: 346230 - RNA, 64 nt, Homo Sapiens
aagaucuaacugugaaaacauacauaccuguacauauuuagauauaagcugcuauauguugaau

SEQ ID NO: 346231 - RNA, 64 nt, Homo Sapiens
cuuuuuuucucuuuuuacugcaacuuaauauuucuauuuagaacacagaaaaugaaaauauuua

SEQ ID NO: 346232 - RNA, 64 nt, Homo Sapiens
uuaauauuucuauuuagaacacagaaaaugaaaauauuuagaauaaguuguacauuugaugaca

SEQ ID NO: 346233 - RNA, 64 nt, Homo Sapiens
aauucacgaaaguacugcuccaccccaguugaguuauuuagaauuuuaucucaagugaaagcug

SEQ ID NO: 346234 - RNA, 64 nt, Homo Sapiens
augcuagggaugaaccugaaaauucuauuacguuuauuuagauuucaaaggcaaauauugauuc

SEQ ID NO: 346235 - RNA, 64 nt, Homo Sapiens
aaugaaguacuauuauugauaacuuauauauuuuuauuuagagcaaucccacaugcuuuucaca

SEQ ID NO: 346236 - RNA, 55 nt, Homo Sapiens
ccggccccccagagaaaugagcuccugcuggcaucuggagaacaccccugugccu

SEQ ID NO: 346237 - RNA, 64 nt, Homo Sapiens
gggccucaagcuggggugggaugaggaggcgcucugcuggcagugcugaggacggguacuccag

SEQ ID NO: 346238 - RNA, 64 nt, Homo Sapiens
guagagagggccagagaugcccgcgugguagggcugcuggcaggcacacuggguguagcccaac

SEQ ID NO: 346239 - RNA, 64 nt, Homo Sapiens
aggcacuggcccacuugcggaaccugacucaggcugcuggcaagcguagcuauguguuggcccu

SEQ ID NO: 346240 - RNA, 64 nt, Homo Sapiens
cucaaaggcagggcagagggaaucccacugaaauugcuggcauugagauccacauaccauucuc

SEQ ID NO: 346241 - RNA, 64 nt, Homo Sapiens
cucuucucguuggcucccucggacaguccuucccugcuggcaguaaucagcucuguccuuggcg

SEQ ID NO: 346242 - RNA, 64 nt, Homo Sapiens
ugggauuacuagaaaaccugacuaauggugucacugcuggcaauggugauaauggauuaauucc

SEQ ID NO: 346243 - RNA, 64 nt, Homo Sapiens
ucggauucccagaaaaccugacuaauggugccacugcuggcaauggugaugauggauuaauucc

SEQ ID NO: 346244 - RNA, 64 nt, Homo Sapiens
caaccucuuuacucuuagucaaguggaaugugcaugcuggcaucugaauguccauucgccaggc

SEQ ID NO: 346245 - RNA, 64 nt, Homo Sapiens
cugugcucucccugccuccccuagcccauaccucugcuggcaccuucuguaccaugccuucaga

SEQ ID NO: 346246 - RNA, 64 nt, Homo Sapiens
agcagaucauguauuucccggagacgugggaccuugcuggcaugucuccuucacaaucaggcgu

SEQ ID NO: 346247 - RNA, 64 nt, Homo Sapiens
cacagcccggcagaggggcacacucuggagaccuugcuggcagugcuagccaggaaacagagug

SEQ ID NO: 346248 - RNA, 64 nt, Homo Sapiens
ccucagguauuguaaccacugggccuuccaacuuugcuggcaagcucugguaaccucccugacu

SEQ ID NO: 346249 - RNA, 64 nt, Homo Sapiens
agcuucccuuuccacccuaccuagguucccuccuugcuggcauaaaggccaagcagugaaauga

SEQ ID NO: 346250 - RNA, 64 nt, Homo Sapiens
aagauggccgggcgugguggccuggucuaagaguugcuggcaagauagcugccauccgaggcuu

SEQ ID NO: 346251 - RNA, 64 nt, Homo Sapiens
acagagggugagccgcccauaaagacagccaugcugcuggcacuguuggccacagcaugggagg

SEQ ID NO: 346252 - RNA, 64 nt, Homo Sapiens
agccggcugccuaccaggggccuguccccuuuccugcuggcagggggcccaccaccuguccguc

SEQ ID NO: 346253 - RNA, 64 nt, Homo Sapiens
cagugcccucacagagacccugaugaugcgggacugcuggcaugacaguccugccgcagguaca

SEQ ID NO: 346254 - RNA, 64 nt, Homo Sapiens
auccacauccuuucgguggccugcuccuucaggcugcuggcagaucuaggggagacucugucuc

SEQ ID NO: 346255 - RNA, 64 nt, Homo Sapiens
auagacccacacaaggagccgagcagccauccccugcuggcacccugcuccauggggucuggga

SEQ ID NO: 346256 - RNA, 64 nt, Homo Sapiens
ugugcuuuugccaaacccagccagaacugugcucugcuggcagcgucagccguggccccaccua

SEQ ID NO: 346257 - RNA, 64 nt, Homo Sapiens
cggggccgaccccagcgaguagucacacggcugcugcuggcacaaucaaccgcuucugcuucca

SEQ ID NO: 346258 - RNA, 63 nt, Homo Sapiens
acuguggccaguugagcuaaucuguggccagggugcuggcaugguggcagcugcaaaugucca

SEQ ID NO: 346259 - RNA, 64 nt, Homo Sapiens
ucaggacguucauguggaugguuucaugucaucgugcuggcaacuuguccucccugccuuagag

SEQ ID NO: 346260 - RNA, 64 nt, Homo Sapiens
gccacaggugcccaagaagacacccccucuggccugcuggcaaucuggagccaacaccgccagc

SEQ ID NO: 346261 - RNA, 64 nt, Homo Sapiens
uugccaccccagguaucccuggcccaguuuugauugcuggcaucccaguguccugccccugcuu

SEQ ID NO: 346262 - RNA, 64 nt, Homo Sapiens
uguaagucccccaguugcucagaggagugugcugugcuggcaagcuggauuucugcccaagacc

SEQ ID NO: 346263 - RNA, 64 nt, Homo Sapiens
gaaugggaacaguggcugucacucuccguccugcugcuggcaagcuagggaggugggguagagc

SEQ ID NO: 346264 - RNA, 64 nt, Homo Sapiens
caccuucuggucucagcaagggaggagagucuguugcuggcauagcccuggaaggagcccccag

SEQ ID NO: 346265 - RNA, 64 nt, Homo Sapiens
cccacccuccuggaagagacccccguguucagagugcuggcagcccugcacguguccagggaca

SEQ ID NO: 346266 - RNA, 64 nt, Homo Sapiens
cacaucuuugaccacgucaucgggccagaaggcgugcuggcaggcaaggugaggccugccagag

SEQ ID NO: 346267 - RNA, 64 nt, Homo Sapiens
gcugcuuuaggaauucugcaaggguucuuggugaugcuggcagccauggccauggcagcgggug

SEQ ID NO: 346268 - RNA, 64 nt, Homo Sapiens
cuucaaauuacccaccugccucagccucccaaagugcuggcauuacaggcgcucgaggcuuucu

SEQ ID NO: 346269 - RNA, 64 nt, Homo Sapiens
acucgggacugaggcauccucuguucacaggacaugcuggcaucuacugggucagggcucugcu

SEQ ID NO: 346270 - RNA, 64 nt, Homo Sapiens
agcacguugaucugaacuuuaaaucaaucagugcugcuggcacaaugaaagguggaacugcacu

SEQ ID NO: 346271 - RNA, 64 nt, Homo Sapiens
uuuuguauguguuuuaucagaauuugcuggacuaugcuggcaaggacuuuguuuacgaucaaau

SEQ ID NO: 346272 - RNA, 64 nt, Homo Sapiens
ucugcacaacugagcagcucgccugaaugacaauguccaggaugucauucuuugcucaagaaag

SEQ ID NO: 346273 - RNA, 64 nt, Homo Sapiens
gcuuuguaccaaacagugaaugaaacuugaucuuguccaggaaacacaaggucacucugaggau

SEQ ID NO: 346274 - RNA, 64 nt, Homo Sapiens
guguuuagaguuggggacaaggaugacaccgaagguccaggaguccaggacagcaggugcuggc

SEQ ID NO: 346275 - RNA, 64 nt, Homo Sapiens
aguuggggacaaggaugacaccgaagguccaggaguccaggacagcaggugcuggccggugggg

SEQ ID NO: 346276 - RNA, 64 nt, Homo Sapiens
gcucgggcccugugaccacgccauugagggcagcguccaggagaaguggcugagcacguggaag

SEQ ID NO: 346277 - RNA, 64 nt, Homo Sapiens
aagcugcaggucugggggacgauggagcuaccguguccaggaugccucccucaggccagcgaga

SEQ ID NO: 346278 - RNA, 64 nt, Homo Sapiens
guggggcggagggguggggcaguuggguccuugaguccaggagcuucacugcugaggaguggcc

SEQ ID NO: 346279 - RNA, 64 nt, Homo Sapiens
cugugccuccucacccccagaggagccuggcuccguccaggagcacucugagcggccuccgucc

SEQ ID NO: 346280 - RNA, 59 nt, Homo Sapiens
cuggcuccguccaggagccugcggccuccguccaggagcggacgccgcagagacucuga

SEQ ID NO: 346281 - RNA, 55 nt, Homo Sapiens; identical to SEQ ID NO: 346236

SEQ ID NO: 346282 - RNA, 64 nt, Homo Sapiens; identical to SEQ ID NO: 346237

SEQ ID NO: 346283 - RNA, 64 nt, Homo Sapiens; identical to SEQ ID NO: 346238

SEQ ID NO: 346284 - RNA, 64 nt, Homo Sapiens; identical to SEQ ID NO: 346239

SEQ ID NO: 346285 - RNA, 64 nt, Homo Sapiens; identical to SEQ ID NO: 346240

SEQ ID NO: 346286 - RNA, 64 nt, Homo Sapiens; identical to SEQ ID NO: 346241

SEQ ID NO: 346287 - RNA, 64 nt, Homo Sapiens; identical to SEQ ID NO: 346242

SEQ ID NO: 346288 - RNA, 64 nt, Homo Sapiens; identical to SEQ ID NO: 346243

SEQ ID NO: 346289 - RNA, 64 nt, Homo Sapiens; identical to SEQ ID NO: 346244

SEQ ID NO: 346290 - RNA, 64 nt, Homo Sapiens; identical to SEQ ID NO: 346245

SEQ ID NO: 346291 - RNA, 64 nt, Homo Sapiens; identical to SEQ ID NO: 346246

SEQ ID NO: 346292 - RNA, 64 nt, Homo Sapiens; identical to SEQ ID NO: 346247

SEQ ID NO: 346293 - RNA, 64 nt, Homo Sapiens; identical to SEQ ID NO: 346248

SEQ ID NO: 346294 - RNA, 64 nt, Homo Sapiens; identical to SEQ ID NO: 346249

SEQ ID NO: 346295 - RNA, 64 nt, Homo Sapiens; identical to SEQ ID NO: 346250

SEQ ID NO: 346296 - RNA, 64 nt, Homo Sapiens; identical to SEQ ID NO: 346251

SEQ ID NO: 346297 - RNA, 64 nt, Homo Sapiens; identical to SEQ ID NO: 346252

SEQ ID NO: 346298 - RNA, 64 nt, Homo Sapiens; identical to SEQ ID NO: 346253

SEQ ID NO: 346299 - RNA, 64 nt, Homo Sapiens; identical to SEQ ID NO: 346254

SEQ ID NO: 346300 - RNA, 64 nt, Homo Sapiens; identical to SEQ ID NO: 346255

SEQ ID NO: 346301 - RNA, 64 nt, Homo Sapiens; identical to SEQ ID NO: 346256

SEQ ID NO: 346302 - RNA, 64 nt, Homo Sapiens; identical to SEQ ID NO: 346257

SEQ ID NO: 346303 - RNA, 63 nt, Homo Sapiens; identical to SEQ ID NO: 346258

SEQ ID NO: 346304 - RNA, 64 nt, Homo Sapiens; identical to SEQ ID NO: 346259

SEQ ID NO: 346305 - RNA, 64 nt, Homo Sapiens; identical to SEQ ID NO: 346260

SEQ ID NO: 346306 - RNA, 64 nt, Homo Sapiens; identical to SEQ ID NO: 346261

SEQ ID NO: 346307 - RNA, 64 nt, Homo Sapiens; identical to SEQ ID NO: 346262

SEQ ID NO: 346308 - RNA, 64 nt, Homo Sapiens; identical to SEQ ID NO: 346263

SEQ ID NO: 346309 - RNA, 64 nt, Homo Sapiens; identical to SEQ ID NO: 346264

SEQ ID NO: 346310 - RNA, 64 nt, Homo Sapiens; identical to SEQ ID NO: 346265

SEQ ID NO: 346311 - RNA, 64 nt, Homo Sapiens; identical to SEQ ID NO: 346266

SEQ ID NO: 346312 - RNA, 64 nt, Homo Sapiens; identical to SEQ ID NO: 346267

SEQ ID NO: 346313 - RNA, 64 nt, Homo Sapiens; identical to SEQ ID NO: 346268

SEQ ID NO: 346314 - RNA, 64 nt, Homo Sapiens; identical to SEQ ID NO: 346269

SEQ ID NO: 346315 - RNA, 64 nt, Homo Sapiens; identical to SEQ ID NO: 346270

SEQ ID NO: 346316 - RNA, 64 nt, Homo Sapiens; identical to SEQ ID NO: 346271

SEQ ID NO: 346317 - RNA, 64 nt, Homo Sapiens; identical to SEQ ID NO: 346272

SEQ ID NO: 346318 - RNA, 64 nt, Homo Sapiens; identical to SEQ ID NO: 346273

SEQ ID NO: 346319 - RNA, 64 nt, Homo Sapiens; identical to SEQ ID NO: 346274

SEQ ID NO: 346320 - RNA, 64 nt, Homo Sapiens; identical to SEQ ID NO: 346275

SEQ ID NO: 346321 - RNA, 64 nt, Homo Sapiens; identical to SEQ ID NO: 346276

SEQ ID NO: 346322 - RNA, 64 nt, Homo Sapiens; identical to SEQ ID NO: 346277

SEQ ID NO: 346323 - RNA, 64 nt, Homo Sapiens; identical to SEQ ID NO: 346278

SEQ ID NO: 346324 - RNA, 64 nt, Homo Sapiens; identical to SEQ ID NO: 346279

SEQ ID NO: 346325 - RNA, 59 nt, Homo Sapiens; identical to SEQ ID NO: 346280

SEQ ID NO: 346326 - RNA, 64 nt, Homo Sapiens; identical to SEQ ID NO: 24356

SEQ ID NO: 346327 - RNA, 64 nt, Homo Sapiens; identical to SEQ ID NO: 24357

SEQ ID NO: 346328 - RNA, 64 nt, Homo Sapiens; identical to SEQ ID NO: 24358

SEQ ID NO: 346329 - RNA, 64 nt, Homo Sapiens; identical to SEQ ID NO: 24359

SEQ ID NO: 346330 - RNA, 64 nt, Homo Sapiens; identical to SEQ ID NO: 24360

SEQ ID NO: 346331 - RNA, 64 nt, Homo Sapiens; identical to SEQ ID NO: 24361

SEQ ID NO: 346332 - RNA, 64 nt, Homo Sapiens; identical to SEQ ID NO: 24362

SEQ ID NO: 346333 - RNA, 64 nt, Homo Sapiens; identical to SEQ ID NO: 24363

SEQ ID NO: 346334 - RNA, 64 nt, Homo Sapiens; identical to SEQ ID NO: 24364

SEQ ID NO: 346335 - RNA, 64 nt, Homo Sapiens; identical to SEQ ID NO: 24365

SEQ ID NO: 346336 - RNA, 64 nt, Homo Sapiens; identical to SEQ ID NO: 24366

SEQ ID NO: 346337 - RNA, 64 nt, Homo Sapiens; identical to SEQ ID NO: 24367

SEQ ID NO: 346338 - RNA, 64 nt, Homo Sapiens; identical to SEQ ID NO: 24368

SEQ ID NO: 346339 - RNA, 64 nt, Homo Sapiens; identical to SEQ ID NO: 24369

SEQ ID NO: 346340 - RNA, 64 nt, Homo Sapiens; identical to SEQ ID NO: 24370

SEQ ID NO: 346341 - RNA, 64 nt, Homo Sapiens; identical to SEQ ID NO: 24371

SEQ ID NO: 346342 - RNA, 64 nt, Homo Sapiens
gacuuuaauaauuugcauuauacaaggauguauguacaaggacuagucgagccucaaugcuugc

SEQ ID NO: 346343 - RNA, 64 nt, Homo Sapiens
uauguacaaggacugacuuugccucaaugcuugcuacaaggauguuaaaggugcuguuagucga

SEQ ID NO: 346344 - RNA, 64 nt, Homo Sapiens
cauucaccuugccaucugucuugucauuguacuguacaaggaacagcccucagacguguucugc

SEQ ID NO: 346345 - RNA, 64 nt, Homo Sapiens
ugauugagguuuguaggagacugguucuucuacauacaaggauuugucuuaaguuugcacaaug

SEQ ID NO: 346346 - RNA, 64 nt, Homo Sapiens
uugauuuuguauucagaauuaaagccuguguagguacaaggacaucagcauuugcagcauucua

SEQ ID NO: 346347 - RNA, 64 nt, Homo Sapiens
acuugcagaaaugugauuuuaggucuuucacugauacaaggaaaauuauuuuucuuagcccaag

SEQ ID NO: 346348 - RNA, 64 nt, Homo Sapiens
ucaagcugacuguggagaaccugacuacucagaguacaaggagucuugcaggagggccgugagc

SEQ ID NO: 346349 - RNA, 64 nt, Homo Sapiens
acccagcauuugcgugaguauagcuauggaggacuacaaggauaaggccccgaguuagaaaaag

SEQ ID NO: 346350 - RNA, 64 nt, Homo Sapiens
aaggccaaagggaggccccuggguauuguccuccuacaaggaagauccucuuuguuuguucaaa

SEQ ID NO: 346351 - RNA, 64 nt, Homo Sapiens
auauugccccuugaugagagucaaacacccugccuacaaggagauguuuugaaauggagaggaa

SEQ ID NO: 346352 - RNA, 64 nt, Homo Sapiens; identical to SEQ ID NO: 225861

SEQ ID NO: 346353 - RNA, 64 nt, Homo Sapiens; identical to SEQ ID NO: 225862

SEQ ID NO: 346354 - RNA, 64 nt, Homo Sapiens; identical to SEQ ID NO: 225863

SEQ ID NO: 346355 - RNA, 64 nt, Homo Sapiens; identical to SEQ ID NO: 225864

SEQ ID NO: 346356 - RNA, 64 nt, Homo Sapiens; identical to SEQ ID NO: 225865

SEQ ID NO: 346357 - RNA, 64 nt, Homo Sapiens; identical to SEQ ID NO: 225866

SEQ ID NO: 346358 - RNA, 64 nt, Homo Sapiens; identical to SEQ ID NO: 225867

SEQ ID NO: 346359 - RNA, 64 nt, Homo Sapiens; identical to SEQ ID NO: 225868

SEQ ID NO: 346360 - RNA, 64 nt, Homo Sapiens; identical to SEQ ID NO: 225869

SEQ ID NO: 346361 - RNA, 64 nt, Homo Sapiens; identical to SEQ ID NO: 225870

SEQ ID NO: 346362 - RNA, 64 nt, Homo Sapiens; identical to SEQ ID NO: 225871

SEQ ID NO: 346363 - RNA, 64 nt, Homo Sapiens; identical to SEQ ID NO: 225872

SEQ ID NO: 346364 - RNA, 64 nt, Homo Sapiens; identical to SEQ ID NO: 225873

SEQ ID NO: 346365 - RNA, 64 nt, Homo Sapiens; identical to SEQ ID NO: 225874

SEQ ID NO: 346366 - RNA, 64 nt, Homo Sapiens; identical to SEQ ID NO: 225875

SEQ ID NO: 346367 - RNA, 64 nt, Homo Sapiens; identical to SEQ ID NO: 225876

SEQ ID NO: 346368 - RNA, 64 nt, Homo Sapiens; identical to SEQ ID NO: 225877

SEQ ID NO: 346369 - RNA, 64 nt, Homo Sapiens; identical to SEQ ID NO: 225878

SEQ ID NO: 346370 - RNA, 64 nt, Homo Sapiens; identical to SEQ ID NO: 225879

SEQ ID NO: 346371 - RNA, 64 nt, Homo Sapiens; identical to SEQ ID NO: 225880

SEQ ID NO: 346372 - RNA, 64 nt, Homo Sapiens; identical to SEQ ID NO: 225881

SEQ ID NO: 346373 - RNA, 64 nt, Homo Sapiens; identical to SEQ ID NO: 225882

SEQ ID NO: 346374 - RNA, 64 nt, Homo Sapiens; identical to SEQ ID NO: 225883

SEQ ID NO: 346375 - RNA, 64 nt, Homo Sapiens; identical to SEQ ID NO: 225884

SEQ ID NO: 346376 - RNA, 64 nt, Homo Sapiens; identical to SEQ ID NO: 225885

SEQ ID NO: 346377 - RNA, 64 nt, Homo Sapiens; identical to SEQ ID NO: 225886

SEQ ID NO: 346378 - RNA, 64 nt, Homo Sapiens; identical to SEQ ID NO: 225887

SEQ ID NO: 346379 - RNA, 64 nt, Homo Sapiens; identical to SEQ ID NO: 225888

SEQ ID NO: 346380 - RNA, 64 nt, Homo Sapiens; identical to SEQ ID NO: 225889

SEQ ID NO: 346381 - RNA, 64 nt, Homo Sapiens; identical to SEQ ID NO: 225890

SEQ ID NO: 346382 - RNA, 61 nt, Homo Sapiens; identical to SEQ ID NO: 225891

SEQ ID NO: 346383 - RNA, 64 nt, Homo Sapiens; identical to SEQ ID NO: 225892

SEQ ID NO: 346384 - RNA, 64 nt, Homo Sapiens; identical to SEQ ID NO: 225893

SEQ ID NO: 346385 - RNA, 64 nt, Homo Sapiens; identical to SEQ ID NO: 225894

SEQ ID NO: 346386 - RNA, 64 nt, Homo Sapiens; identical to SEQ ID NO: 225895

SEQ ID NO: 346387 - RNA, 64 nt, Homo Sapiens; identical to SEQ ID NO: 225896

SEQ ID NO: 346388 - RNA, 64 nt, Homo Sapiens; identical to SEQ ID NO: 225897

SEQ ID NO: 346389 - RNA, 64 nt, Homo Sapiens; identical to SEQ ID NO: 140340

SEQ ID NO: 346390 - RNA, 64 nt, Homo Sapiens; identical to SEQ ID NO: 140341

SEQ ID NO: 346391 - RNA, 64 nt, Homo Sapiens; identical to SEQ ID NO: 103765

SEQ ID NO: 346392 - RNA, 64 nt, Homo Sapiens; identical to SEQ ID NO: 103766

SEQ ID NO: 346393 - RNA, 53 nt, Homo Sapiens; identical to SEQ ID NO: 103767

SEQ ID NO: 346394 - RNA, 64 nt, Homo Sapiens; identical to SEQ ID NO: 103768

SEQ ID NO: 346395 - RNA, 64 nt, Homo Sapiens; identical to SEQ ID NO: 103769

SEQ ID NO: 346396 - RNA, 64 nt, Homo Sapiens; identical to SEQ ID NO: 103770

SEQ ID NO: 346397 - RNA, 53 nt, Homo Sapiens; identical to SEQ ID NO: 103771

SEQ ID NO: 346398 - RNA, 64 nt, Homo Sapiens; identical to SEQ ID NO: 103772

SEQ ID NO: 346399 - RNA, 64 nt, Homo Sapiens; identical to SEQ ID NO: 103773

SEQ ID NO: 346400 - RNA, 64 nt, Homo Sapiens; identical to SEQ ID NO: 103774

SEQ ID NO: 346401 - RNA, 64 nt, Homo Sapiens; identical to SEQ ID NO: 103775

SEQ ID NO: 346402 - RNA, 64 nt, Homo Sapiens; identical to SEQ ID NO: 103776

SEQ ID NO: 346403 - RNA, 64 nt, Homo Sapiens; identical to SEQ ID NO: 86375

SEQ ID NO: 346404 - RNA, 64 nt, Homo Sapiens; identical to SEQ ID NO: 86376

SEQ ID NO: 346405 - RNA, 64 nt, Homo Sapiens; identical to SEQ ID NO: 86377

SEQ ID NO: 346406 - RNA, 64 nt, Homo Sapiens; identical to SEQ ID NO: 86378

SEQ ID NO: 346407 - RNA, 64 nt, Homo Sapiens; identical to SEQ ID NO: 86379

SEQ ID NO: 346408 - RNA, 64 nt, Homo Sapiens; identical to SEQ ID NO: 86380

SEQ ID NO: 346409 - RNA, 64 nt, Homo Sapiens; identical to SEQ ID NO: 86381

SEQ ID NO: 346410 - RNA, 64 nt, Homo Sapiens; identical to SEQ ID NO: 86382

SEQ ID NO: 346411 - RNA, 64 nt, Homo Sapiens
gcccagcguuagggcuggaaugggcuuaggagagagggaccagcgcacaggggaagcccagccg

SEQ ID NO: 346412 - RNA, 64 nt, Homo Sapiens
aggggaccauucuguucaguaagacgcuguccucagggaccauuuguuuacauuuauguucugc

SEQ ID NO: 346413 - RNA, 64 nt, Homo Sapiens
ugugccaugcggcugccugcaccccagacaauaaagggaccaaaaccacccaacccccacccug

SEQ ID NO: 346414 - RNA, 64 nt, Homo Sapiens
cacuaggaucauuccacaccccugcaccugaccaagggaccaaugaggcagaggcuugccccaa

SEQ ID NO: 346415 - RNA, 64 nt, Homo Sapiens
uggaggaggccagcagcuagggcugugaggcuggagggaccagaaggaaagggcuucaggagga

SEQ ID NO: 346416 - RNA, 64 nt, Homo Sapiens
uucuggccaaucaaggcuugccagccgcuaggccagggaccaucagaggagaagcagccuccgc

SEQ ID NO: 346417 - RNA, 64 nt, Homo Sapiens
auuaacuuuuuggugcaucucagguuggcacuguagggaccaagccauaagcacuggggacugc

SEQ ID NO: 346418 - RNA, 64 nt, Homo Sapiens
cccugccucugcccaucagaaccgugacagucucagggaccaauggaaaggggguggagacagg

SEQ ID NO: 346419 - RNA, 64 nt, Homo Sapiens
accucccacucagacuggccccccaggauggcagagggaccagaaagcuggcagggaccaccag

SEQ ID NO: 346420 - RNA, 64 nt, Homo Sapiens
agccccaggauggcagagggucauggaagcuggcagggaccaccggccugacggguccggcuug

SEQ ID NO: 346421 - RNA, 64 nt, Homo Sapiens
uccugggauggcgauggggacucugccgcuguguagggaccagugggaugggcucuaccucucu

SEQ ID NO: 346422 - RNA, 64 nt, Homo Sapiens
augccaaguggacuuggagcugcacaaagucagcagggaccacuaaaucuccaagaccuggugu

SEQ ID NO: 346423 - RNA, 64 nt, Homo Sapiens
ggauggggccucuagacuugcaagggagaggaacagggaccaggcugccccacggucccugaag

SEQ ID NO: 346424 - RNA, 64 nt, Homo Sapiens
ucccucuacacuugaggaccacaguuggggguguagggaccacccagacccugguugaauuguu

SEQ ID NO: 346425 - RNA, 64 nt, Homo Sapiens
cugcugggauugggaaggagcccaugggaucuugagggaccaagcaagguucacggcgauucuc

SEQ ID NO: 346426 - RNA, 64 nt, Homo Sapiens
ggccuuagggauacagggggcuaccugggagaccagggaccacauggguccugaagcccucugu

SEQ ID NO: 346427 - RNA, 64 nt, Homo Sapiens
uaaggucuuucucuggaaauccagcaguagaggaagggaccacccaagaaaacuaaaaaccaag

SEQ ID NO: 346428 - RNA, 64 nt, Homo Sapiens
uggccuucaugaagaauagcaaacucaucccuguagggaccaggcagguaacauagacgaguga

SEQ ID NO: 346429 - RNA, 64 nt, Homo Sapiens; identical to SEQ ID NO: 95478

SEQ ID NO: 346430 - RNA, 64 nt, Homo Sapiens; identical to SEQ ID NO: 95479

SEQ ID NO: 346431 - RNA, 64 nt, Homo Sapiens; identical to SEQ ID NO: 95480

SEQ ID NO: 346432 - RNA, 64 nt, Homo Sapiens; identical to SEQ ID NO: 95481

SEQ ID NO: 346433 - RNA, 64 nt, Homo Sapiens; identical to SEQ ID NO: 95482

SEQ ID NO: 346434 - RNA, 64 nt, Homo Sapiens; identical to SEQ ID NO: 95483

SEQ ID NO: 346435 - RNA, 64 nt, Homo Sapiens; identical to SEQ ID NO: 95484

SEQ ID NO: 346436 - RNA, 64 nt, Homo Sapiens; identical to SEQ ID NO: 95485

SEQ ID NO: 346437 - RNA, 64 nt, Homo Sapiens; identical to SEQ ID NO: 95486

SEQ ID NO: 346438 - RNA, 64 nt, Homo Sapiens; identical to SEQ ID NO: 95487

SEQ ID NO: 346439 - RNA, 64 nt, Homo Sapiens; identical to SEQ ID NO: 95488

SEQ ID NO: 346440 - RNA, 64 nt, Homo Sapiens; identical to SEQ ID NO: 95489

SEQ ID NO: 346441 - RNA, 64 nt, Homo Sapiens; identical to SEQ ID NO: 95490

SEQ ID NO: 346442 - RNA, 64 nt, Homo Sapiens; identical to SEQ ID NO: 95491

SEQ ID NO: 346443 - RNA, 64 nt, Homo Sapiens; identical to SEQ ID NO: 95492

SEQ ID NO: 346444 - RNA, 64 nt, Homo Sapiens; identical to SEQ ID NO: 95493

SEQ ID NO: 346445 - RNA, 64 nt, Homo Sapiens; identical to SEQ ID NO: 95494

SEQ ID NO: 346446 - RNA, 64 nt, Homo Sapiens; identical to SEQ ID NO: 95495

SEQ ID NO: 346447 - RNA, 64 nt, Homo Sapiens; identical to SEQ ID NO: 95496

SEQ ID NO: 346448 - RNA, 64 nt, Homo Sapiens; identical to SEQ ID NO: 95497

SEQ ID NO: 346449 - RNA, 64 nt, Homo Sapiens; identical to SEQ ID NO: 95498

SEQ ID NO: 346450 - RNA, 64 nt, Homo Sapiens; identical to SEQ ID NO: 95499

SEQ ID NO: 346451 - RNA, 64 nt, Homo Sapiens; identical to SEQ ID NO: 95500

SEQ ID NO: 346452 - RNA, 64 nt, Homo Sapiens; identical to SEQ ID NO: 95501

SEQ ID NO: 346453 - RNA, 64 nt, Homo Sapiens; identical to SEQ ID NO: 95502

SEQ ID NO: 346454 - RNA, 64 nt, Homo Sapiens; identical to SEQ ID NO: 95503

SEQ ID NO: 346455 - RNA, 64 nt, Homo Sapiens; identical to SEQ ID NO: 95504

SEQ ID NO: 346456 - RNA, 64 nt, Homo Sapiens; identical to SEQ ID NO: 95505

SEQ ID NO: 346457 - RNA, 64 nt, Homo Sapiens; identical to SEQ ID NO: 95506

SEQ ID NO: 346458 - RNA, 64 nt, Homo Sapiens; identical to SEQ ID NO: 95507

SEQ ID NO: 346459 - RNA, 64 nt, Homo Sapiens; identical to SEQ ID NO: 95508

SEQ ID NO: 346460 - RNA, 64 nt, Homo Sapiens; identical to SEQ ID NO: 95509

SEQ ID NO: 346461 - RNA, 64 nt, Homo Sapiens; identical to SEQ ID NO: 95510

SEQ ID NO: 346462 - RNA, 64 nt, Homo Sapiens; identical to SEQ ID NO: 95511

SEQ ID NO: 346463 - RNA, 64 nt, Homo Sapiens; identical to SEQ ID NO: 95512

SEQ ID NO: 346464 - RNA, 64 nt, Homo Sapiens; identical to SEQ ID NO: 95513

SEQ ID NO: 346465 - RNA, 64 nt, Homo Sapiens; identical to SEQ ID NO: 95514

SEQ ID NO: 346466 - RNA, 64 nt, Homo Sapiens; identical to SEQ ID NO: 95515

SEQ ID NO: 346467 - RNA, 64 nt, Homo Sapiens; identical to SEQ ID NO: 95516

SEQ ID NO: 346468 - RNA, 64 nt, Homo Sapiens; identical to SEQ ID NO: 95517

SEQ ID NO: 346469 - RNA, 64 nt, Homo Sapiens; identical to SEQ ID NO: 95518

SEQ ID NO: 346470 - RNA, 64 nt, Homo Sapiens; identical to SEQ ID NO: 95519

SEQ ID NO: 346471 - RNA, 64 nt, Homo Sapiens; identical to SEQ ID NO: 95520

SEQ ID NO: 346472 - RNA, 64 nt, Homo Sapiens; identical to SEQ ID NO: 95521

SEQ ID NO: 346473 - RNA, 64 nt, Homo Sapiens; identical to SEQ ID NO: 95522

SEQ ID NO: 346474 - RNA, 64 nt, Homo Sapiens; identical to SEQ ID NO: 95523

SEQ ID NO: 346475 - RNA, 64 nt, Homo Sapiens; identical to SEQ ID NO: 95524

SEQ ID NO: 346476 - RNA, 64 nt, Homo Sapiens; identical to SEQ ID NO: 95525

SEQ ID NO: 346477 - RNA, 64 nt, Homo Sapiens
gcuucucuuuggcucccaaagagaaggacaguguugggaguaucugccguggcuucucuuuggc

SEQ ID NO: 346478 - RNA, 64 nt, Homo Sapiens
gcuucucuuuggcucccaaagagaaggacaguguugggaguaucugccggcgcuguccaggucc

SEQ ID NO: 346479 - RNA, 64 nt, Homo Sapiens
ggagcauuuuuacaccccuuaugguuuacacuguugggaguaaauuuaagaacgaauuauaauu

SEQ ID NO: 346480 - RNA, 64 nt, Homo Sapiens
aaaauagcuuaaaauuucucguaagugugauauaugggaguauuaaaacccaaauaaagguaga

SEQ ID NO: 346481 - RNA, 64 nt, Homo Sapiens
gcaaccugacgcgaugcucaaccccagcgucaggugggaguacucccuugguguuuuaccacag

SEQ ID NO: 346482 - RNA, 64 nt, Homo Sapiens
gcaaccugacacaaugcucaauccgugugugaggugggaguacuacccugguguuacacaacug

SEQ ID NO: 346483 - RNA, 64 nt, Homo Sapiens
gcaaccugacacgaugcucaaucccaaagucagaugggaguacucccuugguguuacacgaugg

SEQ ID NO: 346484 - RNA, 64 nt, Homo Sapiens
gcaaccugacaggaugcucaaucccaaagucaggugggaguacucccuugguguuauacaacgg

SEQ ID NO: 346485 - RNA, 64 nt, Homo Sapiens
aaucuaguaaaagaagaaaguuguacuuccuggcugggaguauuaggagaugggaguagagauu

SEQ ID NO: 346486 - RNA, 64 nt, Homo Sapiens
aaaguuguacuuccuggcugggaguauuaggagaugggaguagagauucacuuuuaaguucuug

SEQ ID NO: 346487 - RNA, 64 nt, Homo Sapiens
ccauguuggcugcugcuguugagauacugugcuuugggaguaaaaaaagaaaguuauuucuuug

SEQ ID NO: 346488 - RNA, 64 nt, Homo Sapiens
aaauaaaacaugugaagcaguauugauucuuuauugggaguacauuuuuuuaggucucuuaaac

SEQ ID NO: 346489 - RNA, 64 nt, Homo Sapiens
uucagagaauuuaggcaaacacuggccauggccgugggaguacugggaguaaaauaaaaauauc

SEQ ID NO: 346490 - RNA, 64 nt, Homo Sapiens
uuuaggcaaacacuggccauggccgugggaguacugggaguaaaauaaaaauaucgagguauag

SEQ ID NO: 346491 - RNA, 64 nt, Homo Sapiens; identical to SEQ ID NO: 179463

SEQ ID NO: 346492 - RNA, 64 nt, Homo Sapiens; identical to SEQ ID NO: 179464

SEQ ID NO: 346493 - RNA, 64 nt, Homo Sapiens; identical to SEQ ID NO: 179465

SEQ ID NO: 346494 - RNA, 64 nt, Homo Sapiens; identical to SEQ ID NO: 179466

SEQ ID NO: 346495 - RNA, 64 nt, Homo Sapiens; identical to SEQ ID NO: 179467

SEQ ID NO: 346496 - RNA, 64 nt, Homo Sapiens; identical to SEQ ID NO: 179468

SEQ ID NO: 346497 - RNA, 64 nt, Homo Sapiens; identical to SEQ ID NO: 179469

SEQ ID NO: 346498 - RNA, 64 nt, Homo Sapiens; identical to SEQ ID NO: 179470

SEQ ID NO: 346499 - RNA, 64 nt, Homo Sapiens; identical to SEQ ID NO: 179471

SEQ ID NO: 346500 - RNA, 64 nt, Homo Sapiens; identical to SEQ ID NO: 179472

SEQ ID NO: 346501 - RNA, 64 nt, Homo Sapiens; identical to SEQ ID NO: 179473

SEQ ID NO: 346502 - RNA, 64 nt, Homo Sapiens; identical to SEQ ID NO: 179474

SEQ ID NO: 346503 - RNA, 64 nt, Homo Sapiens; identical to SEQ ID NO: 179475

SEQ ID NO: 346504 - RNA, 64 nt, Homo Sapiens; identical to SEQ ID NO: 179476

SEQ ID NO: 346505 - RNA, 64 nt, Homo Sapiens; identical to SEQ ID NO: 179477

SEQ ID NO: 346506 - RNA, 64 nt, Homo Sapiens; identical to SEQ ID NO: 179478

SEQ ID NO: 346507 - RNA, 64 nt, Homo Sapiens; identical to SEQ ID NO: 179479

SEQ ID NO: 346508 - RNA, 64 nt, Homo Sapiens; identical to SEQ ID NO: 179480

SEQ ID NO: 346509 - RNA, 64 nt, Homo Sapiens; identical to SEQ ID NO: 179481

SEQ ID NO: 346510 - RNA, 64 nt, Homo Sapiens; identical to SEQ ID NO: 179482

SEQ ID NO: 346511 - RNA, 64 nt, Homo Sapiens; identical to SEQ ID NO: 179483

SEQ ID NO: 346512 - RNA, 64 nt, Homo Sapiens; identical to SEQ ID NO: 179484

SEQ ID NO: 346513 - RNA, 64 nt, Homo Sapiens
uuccugcuauugccuaaagcuacgucugaaacugaguagggaaaggcauacuuuuccagggacu

SEQ ID NO: 346514 - RNA, 64 nt, Homo Sapiens
ucaaagcuagucugaaagugaccuuacuuucggaaguagggaaguggaacuuugguaaaugacu

SEQ ID NO: 346515 - RNA, 64 nt, Homo Sapiens
uccaggagcggggacuucucaucagagggcuggcaguagggagucagugucacagacagcugcc

SEQ ID NO: 346516 - RNA, 64 nt, Homo Sapiens
agaagggcaccauccucucugccaaggcacguagaguagggagauccuucugucuuaagagaaa

SEQ ID NO: 346517 - RNA, 64 nt, Homo Sapiens
uccugaaauucuauuaacauuuccgcagaagaugaguagggagaugcugccuucccuuuugaga

SEQ ID NO: 346518 - RNA, 64 nt, Homo Sapiens
acaguaaaggguggaggugauauggcauucugaaaguagggagggacuaagucagucaucauac

SEQ ID NO: 346519 - RNA, 64 nt, Homo Sapiens; identical to SEQ ID NO: 264456

SEQ ID NO: 346520 - RNA, 64 nt, Homo Sapiens; identical to SEQ ID NO: 264457

SEQ ID NO: 346521 - RNA, 64 nt, Homo Sapiens; identical to SEQ ID NO: 264458

SEQ ID NO: 346522 - RNA, 64 nt, Homo Sapiens; identical to SEQ ID NO: 264459

SEQ ID NO: 346523 - RNA, 64 nt, Homo Sapiens; identical to SEQ ID NO: 264460

SEQ ID NO: 346524 - RNA, 64 nt, Homo Sapiens; identical to SEQ ID NO: 264461

SEQ ID NO: 346525 - RNA, 64 nt, Homo Sapiens; identical to SEQ ID NO: 264460

SEQ ID NO: 346526 - RNA, 64 nt, Homo Sapiens
cugugcaccaggcaguccauauuucauccuggucagucuagaguugacccuggagaaccauuuc

SEQ ID NO: 346527 - RNA, 64 nt, Homo Sapiens
cuucuaugaguaacgcccccccugaagagaagaaagucuagauucccccugaacaucaaauaug

SEQ ID NO: 346528 - RNA, 64 nt, Homo Sapiens
gccaagacaucugcccaaagugauggaacuagaaagucuagagcugguauucuagcccaaaucu

SEQ ID NO: 346529 - RNA, 64 nt, Homo Sapiens
ggauccuuaauuagagaugauuucuggaacauucagucuagaaagaaaacauuggaauugacug

SEQ ID NO: 346530 - RNA, 64 nt, Homo Sapiens
uuauuccucuuuccaaaacaaaagaaagguaaagagucuagaguugucccugagugaagucuag

SEQ ID NO: 346531 - RNA, 64 nt, Homo Sapiens
gaaagguaaagagucuagaguugucccugagugaagucuagaaacuuguuucuuuuaauuuuau

SEQ ID NO: 346532 - RNA, 64 nt, Homo Sapiens
ggguaacagucugcaucaucaguaagaaugcaaaagucuagaggcauuaacccccaaauucaaa

SEQ ID NO: 346533 - RNA, 64 nt, Homo Sapiens
auccuuaaaugucuaacaacgagguuccucuuggagucuagaacuugaaucagagaaaacuguu

SEQ ID NO: 346534 - RNA, 64 nt, Homo Sapiens
gcuggagccgaagagucaaagagcuaaaaaauuaagucuagaacauucuaugaggauaguauaa

SEQ ID NO: 346535 - RNA, 64 nt, Homo Sapiens
auucuaugaggauaguauaaauaaaaagaaauacagucuagacaugcugcaaggaaagaagauu

SEQ ID NO: 346536 - RNA, 64 nt, Homo Sapiens
aacauuccaagacucuagaguccaagguuuaaagagucuagauucaaagguucuagguuucaaa

SEQ ID NO: 346537 - RNA, 64 nt, Homo Sapiens
cuaagauucugauuuuaggagcuaaggcucuaugagucuagauguuuauucuucuagaguucag

SEQ ID NO: 346538 - RNA, 64 nt, Homo Sapiens
aggauucuaaaaugugauguucuaaggcucugagagucuagauucucuggcuguaaggcucuag

SEQ ID NO: 346539 - RNA, 64 nt, Homo Sapiens
uccagaggcccuaggcgggaugggcucgcugaaccucgaggaacuccaggacgaggaggacaug

SEQ ID NO: 346540 - RNA, 64 nt, Homo Sapiens
ggcccuccuggugcccacucccgccagccccugccucgaggacugauacugcagugacugccgu

SEQ ID NO: 346541 - RNA, 64 nt, Homo Sapiens
ccccuccuagcccugugguuaucccuagguggcucucgaggaguuaacuccaugagcccaggga

SEQ ID NO: 346542 - RNA, 64 nt, Homo Sapiens
accuguccacguggccagggcccaugcugccacccucgaggagauggaacccugugaugcaaaa

SEQ ID NO: 346543 - RNA, 64 nt, Homo Sapiens
accugcugguggggcacccaaguuccaugagaugcucgaggagcuccccugcgucuccuuguaa

SEQ ID NO: 346544 - RNA, 62 nt, Homo Sapiens
gccaucaggagcacuguuggccaucccuacaacucgaggauauuccagcuggagaggaauaa

SEQ ID NO: 346545 - RNA, 64 nt, Homo Sapiens
ucuccacagacuaacauugaagucuuccagaaaccucgaggagcugggcuagauacuucgagag

SEQ ID NO: 346546 - RNA, 64 nt, Homo Sapiens
uugguuuccaccuauuuaaagucagauuuauagacucgaggagacagaaacugaaucccacacc

SEQ ID NO: 346547 - RNA, 64 nt, Homo Sapiens
ccggaucaucagcacaauugucuguguacguguccucgaggaucauuaaaaacccaagcauuga

SEQ ID NO: 346548 - RNA, 64 nt, Homo Sapiens
uaaugaauuaaagaagagaaacugugcccagagccucgaggagguacuucuugauaccugggau

SEQ ID NO: 346549 - RNA, 64 nt, Homo Sapiens
aaaagauccagacccgggaaucaucuuguccugucucgaggaugcccagaagaagccgugaacu

SEQ ID NO: 346550 - RNA, 64 nt, Homo Sapiens
gaaugagccuucgacccugaaauccuuggggugccucgaggacgacuggccgaaaagccgcauu

SEQ ID NO: 346551 - RNA, 64 nt, Homo Sapiens
cugacuucuuaggcuaaaggccagguuguggaggcucgaggaagucaccugccccucccccauc

SEQ ID NO: 346552 - RNA, 64 nt, Homo Sapiens
cacacauugaccaagccagacccgguucacccagcucgaggaucccagguugaagaguggcccc

SEQ ID NO: 346553 - RNA, 64 nt, Homo Sapiens
ucuccucccucccacuucugcacccuuucaccaccucgaggagauuugcuccccauuagcgaau

SEQ ID NO: 346554 - RNA, 64 nt, Homo Sapiens
aaaggaauggauuucuuccaugauaacuacgugucucgaggaugaucugcucagagcucuucca

SEQ ID NO: 346555 - RNA, 64 nt, Homo Sapiens
cccagcagagccugcauugauaacagccuuaacccucgaggaauaccucaauaccucagacaag

SEQ ID NO: 346556 - RNA, 64 nt, Homo Sapiens
gcugacugugcgcuagacacugccaggcccgggccucgaggaggaaaagacaguagggaagaca

SEQ ID NO: 346557 - RNA, 64 nt, Homo Sapiens
agauacugagucuuccuuuccuuuucugacccuucucgaggacauuugcuuuccucacacuuuu

SEQ ID NO: 346558 - RNA, 64 nt, Homo Sapiens
aagguaggaaucccggcuccgcuauguuagcgcgcucgaggaaggauuuccaauuguuaauaac

SEQ ID NO: 346559 - RNA, 64 nt, Homo Sapiens
gcccuggagggaaucacaugggucacccaggagccucgaggaaaucuccagccauggucagaca

SEQ ID NO: 346560 - RNA, 64 nt, Homo Sapiens
caggacugaggauccucuccuccagaaaagcccccucgaggaaauaaauuagugcgguucucuu

SEQ ID NO: 346561 - RNA, 64 nt, Homo Sapiens
gggacuggccugucuguccacggaucaugggcuccucgaggacaguuaaaugccugucuccccg

SEQ ID NO: 346562 - RNA, 64 nt, Homo Sapiens
acuccacuagcgcccugggaugggagguggcccccucgaggaugcccguuccccccagguggcc

SEQ ID NO: 346563 - RNA, 64 nt, Homo Sapiens
uccuggaggguuugagcgucuucucuccucuuuccucgaggaacguuaaacacuaccuugauca

SEQ ID NO: 346564 - RNA, 64 nt, Homo Sapiens
aauaaagaucaugaaaaagacuggauccaagcgucucgaggauauugaaauugucacucgcuua

SEQ ID NO: 346565 - RNA, 64 nt, Homo Sapiens
cacauuuuccuccuuugugucucagcaccuuccucucgaggagcugacacccuggggugaggug

SEQ ID NO: 346566 - RNA, 64 nt, Homo Sapiens
ccaggacccaugagggggcugagagguuucuacacucgaggagcagggguccagagaggcaggc

SEQ ID NO: 346567 - RNA, 64 nt, Homo Sapiens
auuagucgauucucagauuacuaaggaugcaauccucgaggaaagccuccggcggcccaggauu

SEQ ID NO: 346568 - RNA, 62 nt, Homo Sapiens
ucggggcccuggggcugugagaccccgacccucucgaggaacccugccugagacgccuccau

SEQ ID NO: 346569 - RNA, 64 nt, Homo Sapiens
cucaguuuccucaucuguaacaucccagcuccaacucgaggagcgccagguccaugggggcugg

SEQ ID NO: 346570 - RNA, 64 nt, Homo Sapiens
aaaaaagaaaagauacgugccagcgagacuccgucucgaggaaagcacuccagccugggcaaca

SEQ ID NO: 346571 - RNA, 64 nt, Homo Sapiens
uuuuagacaaauacucauguguaugggcaaaaaacucgaggacuguauuugugacuaauuguau

SEQ ID NO: 346572 - RNA, 64 nt, Homo Sapiens
uuauuccugagacauggagucaguacucucgggacucgaggaaaacggugaugaaacugagguu

SEQ ID NO: 346573 - RNA, 64 nt, Homo Sapiens; identical to SEQ ID NO: 346571

SEQ ID NO: 346574 - RNA, 64 nt, Homo Sapiens
ugauuaugagaugugcauauugcuuugggaagagcucgaggaaggaaauaauucucuccuuugu

SEQ ID NO: 346575 - RNA, 64 nt, Homo Sapiens
cccagcuacuuggaaggcugaggugagaggaucacucgaggagauuggggcugccaugagccau

SEQ ID NO: 346576 - RNA, 64 nt, Homo Sapiens
ccucuucccacaccugucagcuucggaagcaucucucgaggacucuggucccaggaugucuccc

SEQ ID NO: 346577 - RNA, 64 nt, Homo Sapiens
caaggaagacgucguuaucuccccuccccacuuacucgaggagagaggugagggggggaugacu

SEQ ID NO: 346578 - RNA, 64 nt, Homo Sapiens
cagauugaaguaagagcaguucucuccguugccucucgaggaggaggugcgaaguccuggagua

SEQ ID NO: 346579 - RNA, 64 nt, Homo Sapiens
agggacagagcccucugugguggaacgaccccaccucgaggagcuuccugagcagguggcagaa

SEQ ID NO: 346580 - RNA, 64 nt, Homo Sapiens
acccgcugcagggaugcagggaagucagggcccccucgaggagcccucucccacacacauucca

SEQ ID NO: 346581 - RNA, 64 nt, Homo Sapiens
cuauuggcauaugauuccaaggugggaauaggaucucgaggagacuuuguaaaaugagggugga

SEQ ID NO: 346582 - RNA, 64 nt, Homo Sapiens
guaagguugccuuuccccuuggugccuucagggacucgaggaauguacuauccuguacugcagu

SEQ ID NO: 346583 - RNA, 64 nt, Homo Sapiens
gcgcugcaugacuugcugaacggcacagggaccccucgaggaacaagguugcacaccagcuuuc

SEQ ID NO: 346584 - RNA, 64 nt, Homo Sapiens
caacuaagaaaaaaagcacaaaguucucagagcucucgaggaaagugguuguccccguaccacc

SEQ ID NO: 346585 - RNA, 64 nt, Homo Sapiens
cacugacugagccacccucuccguaggguucuuucucgaggacucuacccuccucccccacguc

SEQ ID NO: 346586 - RNA, 64 nt, Homo Sapiens
ccugcgccccgccagcugcccgcagaggugcagccucgaggaaucugagggcgucggggcagcg

SEQ ID NO: 346587 - RNA, 64 nt, Homo Sapiens
aucagagcauucugugcccagggacaggacagaucucgaggacaccacaguccaccuguucccg

SEQ ID NO: 346588 - RNA, 64 nt, Homo Sapiens
cccgggccccaccugggcuuuggcugcuucauuccucgaggaugucccugagagguggugggaa

SEQ ID NO: 346589 - RNA, 64 nt, Homo Sapiens
caauuugccucugugugccucaccagaagcaggccucgaggaguauuauagcaauuuaagggcc

SEQ ID NO: 346590 - RNA, 64 nt, Homo Sapiens
uucaccacgaugauuuuccuggugucugcggaaacucgaggacagugaccaugccgaccacaaa

SEQ ID NO: 346591 - RNA, 64 nt, Homo Sapiens
caacggccucuagcacccagaaacagggaggguccucgaggaggacacaccagggucucagccu

SEQ ID NO: 346592 - RNA, 64 nt, Homo Sapiens
augcaccugggagcccccuggcuugcacugaacccucgaggaccugggcacggggucggaugga

SEQ ID NO: 346593 - RNA, 64 nt, Homo Sapiens
cacaccucugggaaaagauuacacuguauuaacucucgaggaguuuccucaccaauaaacagac

SEQ ID NO: 346594 - RNA, 64 nt, Homo Sapiens
ggcagcagcaaggcgcccaugccacacaccgucucucgaggaaacgcgguucagcgauucuuug

SEQ ID NO: 346595 - RNA, 64 nt, Homo Sapiens
guaguguucuuugcauuucuagggccagguggggcucgaggaacguuuagguucuagguagugg

SEQ ID NO: 346596 - RNA, 63 nt, Homo Sapiens
cccuacugcaugcagccaaauaaaaggugugcccagucuaaccugugcccugugguuucugga

SEQ ID NO: 346597 - RNA, 63 nt, Homo Sapiens
ucugccucccaggcucaagcaauccucccacuucagucuaaguagcugggacuacaggcacgu

SEQ ID NO: 346598 - RNA, 63 nt, Homo Sapiens
uucuaauguggggugcuauguaaauuagcaaagcagucuaacuagaauggauuuuacugaacc

SEQ ID NO: 346599 - RNA, 63 nt, Homo Sapiens
aaagcagucuaacuagaauggauuuuacugaaccagucuaacauuuacuuuccaagaaacauu

SEQ ID NO: 346600 - RNA, 63 nt, Homo Sapiens
gucugugccugaagcucaggaguguggaucagacagucuaaagauccuaaaaacuugccaacu

SEQ ID NO: 346601 - RNA, 63 nt, Homo Sapiens
acaacucaaaauacaccagcucauuuggcugcucagucuaacucuagaauggaugcuuuugaa

SEQ ID NO: 346602 - RNA, 63 nt, Homo Sapiens
gaacuggagcgaagugcacaccucaccauccuucagucuaaggaagaagggcaagcccuggga

SEQ ID NO: 346603 - RNA, 63 nt, Homo Sapiens
agucccauugccaaagcuuuuguuugauuuguccagucuaagagagcucuacagggucagcuu

SEQ ID NO: 346604 - RNA, 63 nt, Homo Sapiens
aacauaaugagacucagucuaggaguuugagaccagucuaagcugggaggaucgccugagccc

SEQ ID NO: 346605 - RNA, 63 nt, Homo Sapiens
ugucuuauuuuccaaaacacaaauuacaagccacagucuaauaugugcacugcuucugucuaa

SEQ ID NO: 346606 - RNA, 63 nt, Homo Sapiens
aacacuuugugaaacaaaucugcacugcaauaccagucuaaugaaugaacugcucccacgucc

SEQ ID NO: 346607 - RNA, 63 nt, Homo Sapiens
gaccuccuuugguaaagguguuguugcuguuuccagucuaaaggcaguuuuuaguugcuguaa

SEQ ID NO: 346608 - RNA, 63 nt, Homo Sapiens
ucucaugcuguugcugcuacugaaauuguaucucagucuaaggcuccaguuuuuguuuuugca

SEQ ID NO: 346609 - RNA, 63 nt, Homo Sapiens
gucuugugugugauuuuuuuuuaaguugaugugcagucuaauuguuguuucauaaaaguugga

SEQ ID NO: 346610 - RNA, 63 nt, Homo Sapiens
caaccuuucuauaguuaaugcagaguuaaugaacagucuaauauugacuuaucagaauaagcu

SEQ ID NO: 346611 - RNA, 63 nt, Homo Sapiens
ucauacgugaaauaaggugaaagugacagccuucagucuaauaaccuugaagugguuuuugaa

SEQ ID NO: 346612 - RNA, 63 nt, Homo Sapiens
gaaaguaucuugagauaucaguggaaagcuaaacagucuaaauuaacaugaaauacuucauuu

SEQ ID NO: 346613 - RNA, 63 nt, Homo Sapiens
cauugagcccaucacaacuguuuugacugcuggcagucuaaaacaguccacccaccccauggc

SEQ ID NO: 346614 - RNA, 63 nt, Homo Sapiens
uucaaauuucauuuuagaauaaguuaacuaaaucagucuaauaauuaaaauuuuaaaacuccu

SEQ ID NO: 346615 - RNA, 63 nt, Homo Sapiens
cagugucuaggaagauaacagccagucucaccccagucuaaucauggacccugauaauauugc

SEQ ID NO: 346616 - RNA, 63 nt, Homo Sapiens
aacuguuauaaacucuuugcuucugcuaagaagcagucuaaauauaaucaacguacagugagc

SEQ ID NO: 346617 - RNA, 63 nt, Homo Sapiens
caaaauuacuaaguauaaauuagucaaguuuaucagucuaaaaaacgaagggaugugcaacug

SEQ ID NO: 346618 - RNA, 63 nt, Homo Sapiens
ccagcagccuccaggugcuuucauuuucacuuccagucuaagccaguggcuccugccacugcc

SEQ ID NO: 346619 - RNA, 63 nt, Homo Sapiens
uucuuuuggcuccaacauuccuuuuagcuugaccagucuaauuuaaaauguguuuguuggagg

SEQ ID NO: 346620 - RNA, 63 nt, Homo Sapiens
aaagaagcuuuuuacuuaacguugucuuauuuccagucuaauuuuacgcuguagcagaaccag

SEQ ID NO: 346621 - RNA, 63 nt, Homo Sapiens
aggaggaaacaguuuuuuagacuggaaaaaagccagucuaaaggccucuggauacugggcucc

SEQ ID NO: 346622 - RNA, 63 nt, Homo Sapiens
cucuuuucaacaacagacguuuaugaacagcuacagucuaauucuagcagaaaucaaaaugcu

SEQ ID NO: 346623 - RNA, 63 nt, Homo Sapiens
uccaaaagaccaucaauaaaaauguuguguucacagucuaauucucuuucguaggccaguagc

SEQ ID NO: 346624 - RNA, 63 nt, Homo Sapiens
ugagagccugugacagguggcacaccucggcaacagucuaagaccaagacagcucaaaauauc

SEQ ID NO: 346625 - RNA, 63 nt, Homo Sapiens
cccaugaguacucaacuugcggcccacgugggacagucuaauaaaauaacugucugaggcuaa

SEQ ID NO: 346626 - RNA, 63 nt, Homo Sapiens
aaaauggguggggaugucguucauuuuuauagacagucuaaaccugcaaagaucauaauaaag

SEQ ID NO: 346627 - RNA, 63 nt, Homo Sapiens
uuuaaauuuuaaguuauuuuuuacagacuguaucagucuaauuacagcucucucgaagagauc

SEQ ID NO: 346628 - RNA, 63 nt, Homo Sapiens
uggccaugcuuuggaagggaagauaggaagaaucagucuaaacggugcuagacuuuagaagcc

SEQ ID NO: 346629 - RNA, 63 nt, Homo Sapiens
aaagucuuauuaaaacacuucauugaaaauauacagucuaaauuuauuauuuaaauuuuacua

SEQ ID NO: 346630 - RNA, 63 nt, Homo Sapiens
aaacugugccauuugaacagucacuuccaagcucagucuaaaugaaaccgaaacgugaccacg

SEQ ID NO: 346631 - RNA, 63 nt, Homo Sapiens
acuaaagucuuauuuuauguuuuagaacaguuacagucuaauugucuuggacauuuugggaag

SEQ ID NO: 346632 - RNA, 63 nt, Homo Sapiens
ggaaaagcaagucccugcagugagcacuagggacagucuaauuuggggauugcucaaccauca

SEQ ID NO: 346633 - RNA, 63 nt, Homo Sapiens
aaaaaaauauauuuuaggaggcugauuuaaugccagucuaaauccuuauguagaaaggacuuu

SEQ ID NO: 346634 - RNA, 63 nt, Homo Sapiens
cauacacaggagaaauuguagugaugaaaugugcagucuaagguuuaaucugaccaagaaauu

SEQ ID NO: 346635 - RNA, 63 nt, Homo Sapiens
ugauaucauguucuagaaauaccugcaacaugacagucuaaucaguagucuauuaaaacuugu

SEQ ID NO: 346636 - RNA, 63 nt, Homo Sapiens
acuucuucaccugaggaaaacuagaaugaaaugcagucuaaaauauuuugcacugaauuguaa

SEQ ID NO: 346637 - RNA, 63 nt, Homo Sapiens
acagacugcauguaguuggguauaauuuuuauccagucuaaaaauaucugucuuuuaauuggu

SEQ ID NO: 346638 - RNA, 63 nt, Homo Sapiens
ugcccuucugugggccauaaaucacacagauuucagucuaauccaauaaguaguagaaggagc

SEQ ID NO: 346639 - RNA, 63 nt, Homo Sapiens
cauuuuugcuuuuauucaacuuuaaaaguuuaacagucuaaaauaaacaggaaugcuuaaagc

SEQ ID NO: 346640 - RNA, 63 nt, Homo Sapiens
caucugauuuaauaugcauuuacaucugggauacagucuaacuuuucuuucccugcacuuugu

SEQ ID NO: 346641 - RNA, 63 nt, Homo Sapiens
agcuaauguggguuaccaaaugaacaacucugacagucuaaaguaaacuaaauuuuacuaagc

SEQ ID NO: 346642 - RNA, 63 nt, Homo Sapiens
uuugacugcugagaaguuucauguauuuuuuuacagucuaaauuucagaaaaguauguuuugc

SEQ ID NO: 346643 - RNA, 63 nt, Homo Sapiens
aaaaucacagaaaugaaccguuuugcagcugcgcagucuaaagggcaggccagugucuggaag

SEQ ID NO: 346644 - RNA, 63 nt, Homo Sapiens
ugcacacuccacuucacaugccguugacucucacagucuaagacuucagggccgggaccuuug

SEQ ID NO: 346645 - RNA, 63 nt, Homo Sapiens
ucccuucaacaugaaaauauauacccccccaugcagucuaaaaugcuucaguacuugugaaac

SEQ ID NO: 346646 - RNA, 63 nt, Homo Sapiens
uucaaaacuagaauuuguaaugcaaauggagcucagucuaauaaaaaagagguuuugguauua

SEQ ID NO: 346647 - RNA, 63 nt, Homo Sapiens
cuuuucauaguacaugaccugcauuccacaucucagucuaacaguuuaguagugauguaaaga

SEQ ID NO: 346648 - RNA, 63 nt, Homo Sapiens
uaagcuacuuuuagauuuggaaauugcuguuuacagucuaacaacauuaaaaugagagguaga

SEQ ID NO: 346649 - RNA, 63 nt, Homo Sapiens
gaauaucugcaugggauuugaccaggggaugcacagucuaaauguuggcuguucaucuuugaa

SEQ ID NO: 346650 - RNA, 63 nt, Homo Sapiens
uugguaugaccccucuaaggaguguagcaacuacagucuaaagcugguuuaauguuuuggcca

SEQ ID NO: 346651 - RNA, 63 nt, Homo Sapiens
auucagaaagaaaaagcuaccuguuagaauuuccagucuaaauggcacaggguaguuacggag

SEQ ID NO: 346652 - RNA, 63 nt, Homo Sapiens
cccaagguaugaagcagaugagggaccagcacucagucuaacauguaaacaucauacguaaua

SEQ ID NO: 346653 - RNA, 63 nt, Homo Sapiens
ucuuauuuuacaugauuucauuuauucaaaaaacagucuaauagguucaaucaauaaaaauau

SEQ ID NO: 346654 - RNA, 63 nt, Homo Sapiens
guaaauguuaacagcaggaguaacuguugcuggcagucuaagucuugagaccaaaauuuaagu

SEQ ID NO: 346655 - RNA, 63 nt, Homo Sapiens
cauaucccuucauugccauaaaauaucaucuaacagucuaaaaacugcuuucugcauuccguu

SEQ ID NO: 346656 - RNA, 63 nt, Homo Sapiens
uaucucugguacaucaaggggcaugauacaaaccagucuaaagacuguuuauaaaggagagag

SEQ ID NO: 346657 - RNA, 63 nt, Homo Sapiens
ucuuuuauaaguuauuaauuuuuaugguuuaaucagucuaauuguuuugacuguuauagaaac

SEQ ID NO: 346658 - RNA, 63 nt, Homo Sapiens
gaccacaccacacaugccuccaacacacacccacagucuaaacaucucuccuucucagugagc

SEQ ID NO: 346659 - RNA, 63 nt, Homo Sapiens
aauacagucaugcaucgcuuaacaacggggauacagucuaagaauugccuugucuggcaguuu

SEQ ID NO: 346660 - RNA, 63 nt, Homo Sapiens
gaggagcuugauuucuugguuggauaaguaccacagucuaaauuacccuucugggagccaaac

SEQ ID NO: 346661 - RNA, 63 nt, Homo Sapiens
ugaggcugggugcaguggcuaaccugcauuuaacagucuaauuucaucacugugaucuuuaaa

SEQ ID NO: 346662 - RNA, 63 nt, Homo Sapiens
agucauuaggucacucgggauuguuauaggcaucagucuaacaccaugcagccacuuuggguu

SEQ ID NO: 346663 - RNA, 63 nt, Homo Sapiens
auugauagaagaauaucgaugauuuuacuuuaacagucuaaaaucauaagacacuuagauuaa

SEQ ID NO: 346664 - RNA, 63 nt, Homo Sapiens
auuguaagcaaaaaguuauuuuuauauuauauacagucuaauuguucauccuaauuguuccug

SEQ ID NO: 346665 - RNA, 63 nt, Homo Sapiens
uccuauuacccaccuccuauuuuaaauauuuaucagucuaaacuugugcaguguaguaaacau

SEQ ID NO: 346666 - RNA, 63 nt, Homo Sapiens
agaaaagcugggauuacauauggugugcgguuacagucuaaauuuuuucauccuccuaugcau

SEQ ID NO: 346667 - RNA, 63 nt, Homo Sapiens
ugagcugauugugucagaggccuccuaccugcgcagucuaaacauagcuguggaucauuucca

SEQ ID NO: 346668 - RNA, 63 nt, Homo Sapiens
aagacaggauaaaugugauuguguguuggaggacagucuaaugucagccauucuaguuuuguu

SEQ ID NO: 346669 - RNA, 63 nt, Homo Sapiens
auacuauuaggugcauguauaugacugcaggaucagucuaacugguauuacacagggaaagcu

SEQ ID NO: 346670 - RNA, 63 nt, Homo Sapiens
cuucaaaaacuaaaaucauuuuuuuaaguauugcagucuaaaaaauuaaaguagauuauggcc

SEQ ID NO: 346671 - RNA, 63 nt, Homo Sapiens
ugcauuguagugucuuuuaacucuucuucaauucagucuaauaaaaaauaagacaaauccauu

SEQ ID NO: 346672 - RNA, 63 nt, Homo Sapiens
cuuucacauugcaccagauucuggcguagcucucagucuaaugggagcagagaaggacgggag

SEQ ID NO: 346673 - RNA, 63 nt, Homo Sapiens
agcugugguaggaaguaucaaucuucuguuguacagucuaauaccuuagagagccacaggaau

SEQ ID NO: 346674 - RNA, 63 nt, Homo Sapiens
auaauccuggacugugaugggaacagcccagugcagucuaaacuucaauuguguugaaacuac

SEQ ID NO: 346675 - RNA, 63 nt, Homo Sapiens
uaaugaaucucaaaauuuugaguaaauguaccucagucuaaucagacuuuuuaugaccuuuau

SEQ ID NO: 346676 - RNA, 63 nt, Homo Sapiens
aacaacuacagucuuugaaauauggaaaaucagcagucuaaaguuuguuuuaaauucuaaauu

SEQ ID NO: 346677 - RNA, 63 nt, Homo Sapiens
guaguauuaaucaguuuuaucuuuugaaaggcacagucuaaaucgaaacccuaaacucaaugc

SEQ ID NO: 346678 - RNA, 63 nt, Homo Sapiens
uuuuuuuuaacuauauugauucguuuacuagaacagucuaauuggggcauugaggaaaugaag

SEQ ID NO: 346679 - RNA, 63 nt, Homo Sapiens
gaagaaaauaaauaaaaggacuuuacgugaauacagucuaaguuucuucuuauuguaaauaca

SEQ ID NO: 346680 - RNA, 63 nt, Homo Sapiens
guuugccugcuguauuuauacuauguucuaggucagucuaacaugagacugaaauuuaguaca

SEQ ID NO: 346681 - RNA, 63 nt, Homo Sapiens
aggcccaccuccuccaccacccaguaaucugagcagucuaacgugggaugugauaacgagguu

SEQ ID NO: 346682 - RNA, 63 nt, Homo Sapiens
aauuccaaauucucacagaacuggaaauggacacagucuaacaugaacuacuagaaaauugug

SEQ ID NO: 346683 - RNA, 63 nt, Homo Sapiens
aauuaacucacccgguacuuaaagaaauggauacagucuaaaggaauagcuggauuuuuuaga

SEQ ID NO: 346684 - RNA, 63 nt, Homo Sapiens
aucagauuuguccuauaggagacaauauacugacagucuaaucguauuuaaaaaaagaaaaaa

SEQ ID NO: 346685 - RNA, 63 nt, Homo Sapiens
cuggauccuauaucuuagguaagacauauaacgcagucuaauuacauuucacuucaaggcuca

SEQ ID NO: 346686 - RNA, 63 nt, Homo Sapiens
uggaaaacacauuuggaaugagcuuccacacuucagucuaaaaucucacccaaacuuauggcu

SEQ ID NO: 346687 - RNA, 63 nt, Homo Sapiens
guccacagugcugugaucccgagggaaguccuccagucuaagucacagugcccugacagguga

SEQ ID NO: 346688 - RNA, 63 nt, Homo Sapiens
aauacauggucacaaccguggaucaaacaaggucagucuaaaguggcagguccuaggugugac

SEQ ID NO: 346689 - RNA, 63 nt, Homo Sapiens
guuagaaauaucccuuuauuacauuucuuucaucagucuaaaauuugcauuuaauggccucag

SEQ ID NO: 346690 - RNA, 63 nt, Homo Sapiens
agaguccgggagaaugcuggaguaauggcagagcagucuaaacgucaucacacucuccauguu

SEQ ID NO: 346691 - RNA, 63 nt, Homo Sapiens
guuuuuuaagcaaccuuugaauccagcucuagucagucuaagcaggcaaagguaacugaugac

SEQ ID NO: 346692 - RNA, 63 nt, Homo Sapiens
uagucagaauagcaguucuagagcacagguucucagucuaagcuauggaaaagcuccccuuau

SEQ ID NO: 346693 - RNA, 63 nt, Homo Sapiens
guaagaacaauccuuuuuuauuuuucuucuguacagucuaaagcuacagagaaaaaaaaaugc

SEQ ID NO: 346694 - RNA, 63 nt, Homo Sapiens
agaaaaacugaggucuuuuuuugucacuaucaacagucuaaaauaggggaagcauaaugguua

SEQ ID NO: 346695 - RNA, 63 nt, Homo Sapiens
cuauuccugggcugcaugauccacaguccuucccagucuaacaagagacagugacuguuccug

SEQ ID NO: 346696 - RNA, 63 nt, Homo Sapiens
aaugccccuaaauaguaaaagaaaaagggguaucagucuaaucucauggagaaaaacuacuug

SEQ ID NO: 346697 - RNA, 63 nt, Homo Sapiens
gggaaguccugggaggauccugagcugcuguugcagucuaacccacuaaucaguucuuagauu

SEQ ID NO: 346698 - RNA, 63 nt, Homo Sapiens
cuugcuagugaaucaagaaaacauccagguugacagucuaaaauggcuacugguauuuuaguu

SEQ ID NO: 346699 - RNA, 63 nt, Homo Sapiens
cagaaaugacccuccuuggaucaguuuucuuuccagucuaaucaucuuuggaacuaaaacuug

SEQ ID NO: 346700 - RNA, 63 nt, Homo Sapiens
agaacuccagaaagcuggagcccgccuagaacccagucuaauguccuuauggagcuggagcag

SEQ ID NO: 346701 - RNA, 63 nt, Homo Sapiens
ucugcuuaugccuaucuugacacuggggggccccagucuaagcaaccacuuguaccacuauac

SEQ ID NO: 346702 - RNA, 63 nt, Homo Sapiens
aaacaccagaacccuaucaaguggagacaagcucagucuaaucacucuaggaggguggccugg

SEQ ID NO: 346703 - RNA, 63 nt, Homo Sapiens
uuugaauuacauuuuuguaaugaauuuauuugacagucuaacucugaacugagaaaggagcuc

SEQ ID NO: 346704 - RNA, 63 nt, Homo Sapiens
aaugccaaguauccaaggcaccaaauuucagaacagucuaaucaauuuuuugacuaagcauaa

SEQ ID NO: 346705 - RNA, 63 nt, Homo Sapiens
aauaaaaaauaugagcaccacuuuucaggcccucagucuaaaacccugccucaguuggaaaac

SEQ ID NO: 346706 - RNA, 63 nt, Homo Sapiens
aacauauucaaggagcaagaaaugaacuuucagcagucuaaauuuucuaaauaaccaauaguu

SEQ ID NO: 346707 - RNA, 63 nt, Homo Sapiens
aaaugugauuuaaauuggacauuuucaucaaugcagucuaauguguagauaaauauuucaacc

SEQ ID NO: 346708 - RNA, 63 nt, Homo Sapiens
aauuaauauguuuuaaggagaaauaaaauaucacagucuaaaaauaauaaaaacauuuucuga

SEQ ID NO: 346709 - RNA, 63 nt, Homo Sapiens
ucuccucauggauauuuucagucucaauguugccagucuaauaguauaguaugugguugcuuu

SEQ ID NO: 346710 - RNA, 63 nt, Homo Sapiens
uuugcaugaugauccggauuuaauuugauaucacagucuaauuuuuauucauaagccaauuuu

SEQ ID NO: 346711 - RNA, 63 nt, Homo Sapiens
uuaccaugaagagauugcacuuauccuugagaacagucuaaauauaaaugaagauauuuuacc

SEQ ID NO: 346712 - RNA, 63 nt, Homo Sapiens
uuaccaugaagagauugcacuuauccuugagaacagucuaaugauacuuuuuuuacuuucaga

SEQ ID NO: 346713 - RNA, 63 nt, Homo Sapiens
cauagcaaccauaucugcuuugaagcuuagauacagucuaauuaaugcauuauucauauuucu

SEQ ID NO: 346714 - RNA, 63 nt, Homo Sapiens
cuuaaauaaaauuaugcuaaaguauugacaacacagucuaacuuauauauucccaaaaauguc

SEQ ID NO: 346715 - RNA, 63 nt, Homo Sapiens
agccagaacucauuuugugccaaagagaagcaucagucuaacaaguuuguucaaaaccugcag

SEQ ID NO: 346716 - RNA, 63 nt, Homo Sapiens
uccagcuugacaagauugagaggcccaugccaacagucuaaucuaagagauuagucuuucaaa

SEQ ID NO: 346717 - RNA, 63 nt, Homo Sapiens
gcugaaagucaaagucagugguuugcuaaugaucagucuaacagggcacuuggcccagaaguu

SEQ ID NO: 346718 - RNA, 63 nt, Homo Sapiens
gaaacaaaaccuauauguuaauuaaacaguuuacagucuaaagugaaauaaccaguuauacgu

SEQ ID NO: 346719 - RNA, 63 nt, Homo Sapiens
aagagguguuuuuauaauauaaggugaaauaaacagucuaaaguucaaugauuuuuuaugauc

SEQ ID NO: 346720 - RNA, 63 nt, Homo Sapiens
auccaucucuucuuaaguugauagugacuaugucagucuaaucucuuguuugccaagguuccu

SEQ ID NO: 346721 - RNA, 63 nt, Homo Sapiens
agggucugaacucacuccaaaagauaauaacugcagucuaauuuuucccaugguacuugcuag

SEQ ID NO: 346722 - RNA, 63 nt, Homo Sapiens
gcaaaucucuugcaagaacagcacaaggaaaaucagucuaauaagcugcucugccccuugugc

SEQ ID NO: 346723 - RNA, 63 nt, Homo Sapiens
ggcaagccauuuacagaaacccacucggcaccccagucuaacaccacaacuaauuucacccaa

SEQ ID NO: 346724 - RNA, 63 nt, Homo Sapiens
auaguucccuucuuuuuuggguaaugaagggagcagucuaaagaauuguaugcauguuugcau

SEQ ID NO: 346725 - RNA, 63 nt, Homo Sapiens
uuuuuuuuuaagggugagccaggucuagcccaacagucuaaacuauccagucaauaccgagug

SEQ ID NO: 346726 - RNA, 63 nt, Homo Sapiens
caucccuccaggggagccugggagcugcucucccagucuaagcauguagauaucaucguuugc

SEQ ID NO: 346727 - RNA, 63 nt, Homo Sapiens
gagaaagcugaggcccagaggggacacucgacccagucuaaagugggugccauucacggagga

SEQ ID NO: 346728 - RNA, 63 nt, Homo Sapiens
uucaaauuuaauauagagcaaccagugguugaacagucuaauugccucaaaguaaaugacaug

SEQ ID NO: 346729 - RNA, 63 nt, Homo Sapiens
uacugaaacuuuggaauauaacuccaaaccauucagucuaaaaucaacauucacauaguuuag

SEQ ID NO: 346730 - RNA, 63 nt, Homo Sapiens
aaaaaaucuggacaaucaaauuuuuccuccuugcagucuaauaauauuuuacuuuggugcuua

SEQ ID NO: 346731 - RNA, 63 nt, Homo Sapiens
uggcaggaucuaaaacagcagcauggccuuacccagucuaagccccaauugcacuggcccugg

SEQ ID NO: 346732 - RNA, 63 nt, Homo Sapiens
agguucacacuguaaagaguuugugaaagguuucagucuaacugggguuccuuagcuggaagc

SEQ ID NO: 346733 - RNA, 63 nt, Homo Sapiens
uuacccuuuauauuugcugaauaaacguucacacagucuaaaacgggugcuguaaauagucug

SEQ ID NO: 346734 - RNA, 63 nt, Homo Sapiens
ugggaaacugugguacagauccagcugacgucacagucuaagacggccaacagccagcccuug

SEQ ID NO: 346735 - RNA, 63 nt, Homo Sapiens
uugaaauauaauaugauuugucuagagccacagcagucuaauaaaguuacgcuuuucuguugu

SEQ ID NO: 346736 - RNA, 62 nt, Homo Sapiens
cgcaagguggccguuacugaucuuacuucauccagucuaauagguuuggagauuaaaccuuu

SEQ ID NO: 346737 - RNA, 63 nt, Homo Sapiens
cagagacgcauaacauccaauucugagaugaaacagucuaaaauaggaguaaagcaugcacua

SEQ ID NO: 346738 - RNA, 63 nt, Homo Sapiens
aaauccuagacagaacuuucuugagaaaaaaagcagucuaauaaaucuuccaauacagguaua

SEQ ID NO: 346739 - RNA, 63 nt, Homo Sapiens
agucuaaaggggccgggagauucuccaccaugucagucuaaagucucuaccacagcaaacaca

SEQ ID NO: 346740 - RNA, 63 nt, Homo Sapiens
guaaguaaaagaacagccaucuaaucuaaaugacagucuaagaaggguuaagaucuaaucucc

SEQ ID NO: 346741 - RNA, 63 nt, Homo Sapiens
ucuaaacaaugacuucauuuugucuaauucucccagucuaaaacuggcuauaaccccuguccc

SEQ ID NO: 346742 - RNA, 63 nt, Homo Sapiens
uggguggggacguccugccagacugacccugaucagucuaagacucagaggguuguucuccua

SEQ ID NO: 346743 - RNA, 63 nt, Homo Sapiens
ucauucacuucauuugauggguuuacucugccacagucuaauguagaaagcaauccagaugug

SEQ ID NO: 346744 - RNA, 63 nt, Homo Sapiens
ucaagaggcacuucuuuauuccucaguuaauugcagucuaauguuaugaagcugccccccacc

SEQ ID NO: 346745 - RNA, 63 nt, Homo Sapiens
uagugacaccucagucauauuaaaaauuaacagcagucuaaucuuuguuuucacacugauaca

SEQ ID NO: 346746 - RNA, 63 nt, Homo Sapiens
cucguauuugcuuugcugucccucuuugcaguucagucuaaguauuggugaaauggcccuuuc

SEQ ID NO: 346747 - RNA, 63 nt, Homo Sapiens
gagaugccgaugucagcacacuccuacgagaaucagucuaacaaaggcaaaaaaaaaaagcuu

SEQ ID NO: 346748 - RNA, 63 nt, Homo Sapiens
aauaaauauuucauaauuuaaugucauauuacucagucuaaacaugugcagguuuguuguuuc

SEQ ID NO: 346749 - RNA, 63 nt, Homo Sapiens
aauaaacaguuguaaaauaaauuaaaaagcauacagucuaaauauaauguuuucccauauauu

SEQ ID NO: 346750 - RNA, 63 nt, Homo Sapiens
gauccaccuuaacgaccgugcauaugaaaaccacagucuaaggaagugacugcagaaagcuca

SEQ ID NO: 346751 - RNA, 63 nt, Homo Sapiens
uacaaaugccuuacuuaugcuucacagguuagucagucuaagaauauuuauacaggaaaaaaa

SEQ ID NO: 346752 - RNA, 63 nt, Homo Sapiens
uuugcuucuuccuuaaagcauuugcaacagcuacagucuaaaauugcuucuuuaccaaggaua

SEQ ID NO: 346753 - RNA, 63 nt, Homo Sapiens
guguucucuuaagucuuuggaggaaaucuugagcagucuaagccuuuagagaaaauucauucu

SEQ ID NO: 346754 - RNA, 63 nt, Homo Sapiens
uuucuaagucaucaagauaaauccuuaagaauucagucuaaauuagcaaccaggaaggaaaaa

SEQ ID NO: 346755 - RNA, 63 nt, Homo Sapiens
cagaacagccaguuuuacugugauucagagccacagucuaacugagcaccuuuuaaaccccuc

SEQ ID NO: 346756 - RNA, 63 nt, Homo Sapiens
uguauaguagacuuugggaaacauacaagcuaccagucuaaugcacaugguaguguagggcca

SEQ ID NO: 346757 - RNA, 63 nt, Homo Sapiens
gcucccacucaucugggaguggggugugugcuacagucuaagguuuacuccagggccugacac

SEQ ID NO: 346758 - RNA, 63 nt, Homo Sapiens
gugacccguuaggagcucucaccguacauacuccagucuaauuuaaaucugaccacaguugca

SEQ ID NO: 346759 - RNA, 63 nt, Homo Sapiens
ucagaccagcauuugaaggaguacacugcaccacagucuaaauaaacuuguaccauguuacau

SEQ ID NO: 346760 - RNA, 63 nt, Homo Sapiens
cagagaaaguuggugcugcucauacuggucucacagucuaaguaagugucugugaugcuccca

SEQ ID NO: 346761 - RNA, 63 nt, Homo Sapiens
ucaggccauucucuuccccugugccuuucguggcagucuaaccuuucugggcccaguucccac

SEQ ID NO: 346762 - RNA, 63 nt, Homo Sapiens
uguugauaaaaugugacuuguguugguuugucccagucuaacgagauuggaguuuccauccca

SEQ ID NO: 346763 - RNA, 63 nt, Homo Sapiens
acugucaacaaaugauaccuuuggauauccauccuccucgacuuauaguacagugguguauag

SEQ ID NO: 346764 - RNA, 63 nt, Homo Sapiens
cccauuugucaccucgcacacuuauagcguuuccuccucgaaauucuaccaagacuggucaaa

SEQ ID NO: 346765 - RNA, 63 nt, Homo Sapiens
cuagugggggaucaagaaggaaagggcucuguccuccucgaccucaaguucuuggaaauggac

SEQ ID NO: 346766 - RNA, 63 nt, Homo Sapiens
ucacuguucaugcuggcgagaugugggcuucaacuccucgacagagcaagagauauuuugggc

SEQ ID NO: 346767 - RNA, 63 nt, Homo Sapiens
gcaggauugucuuuuuuuuuacuagacugugagcuccucgaggucaaccuaucuguuuccccc

SEQ ID NO: 346768 - RNA, 63 nt, Homo Sapiens
ugaaacaagucuauggcaaaggagugacuuuuucuccucgaauugaaacuuucaacaaucucu

SEQ ID NO: 346769 - RNA, 63 nt, Homo Sapiens
ugcuccucauggcugggcucggcuauauuuucucuccucgagugaacucuucuaaccuccuug

SEQ ID NO: 346770 - RNA, 63 nt, Homo Sapiens
ucaacuaacuauaucuugaaguuauauugaucucuccucgaaccuauaauugcacaaggucuu

SEQ ID NO: 346771 - RNA, 63 nt, Homo Sapiens
ugcugccagcggaggcgacagcagcguugggagcuccucgaugucagcuuuuugugcuggacu

SEQ ID NO: 346772 - RNA, 63 nt, Homo Sapiens
agaugccaaggccugugccagguucccugugcccuccucgaggugggcagccaucaccagcca

SEQ ID NO: 346773 - RNA, 63 nt, Homo Sapiens
aucaagaucuaucucucuucucaaggucagcaucuccucgacguuaaaguucuuuauuuuagg

SEQ ID NO: 346774 - RNA, 63 nt, Homo Sapiens
ccuucggagccucugagcucaauacugacccuccuccucgaugaggggcugcuccugcuugcc

SEQ ID NO: 346775 - RNA, 63 nt, Homo Sapiens
gcuuugauaaagguuagauuguauuuuaccaaccuccucgaugagagcugugauuuuugcaaa

SEQ ID NO: 346776 - RNA, 63 nt, Homo Sapiens
cgagcauaccccaugcccaccguggagcugcaacuccucgacagcacugaguuugauagucuc

SEQ ID NO: 346777 - RNA, 63 nt, Homo Sapiens
cacagucacacgaauaccugcaggguuauucuccuccucgaguaggaguugaguuguuugcuc

SEQ ID NO: 346778 - RNA, 63 nt, Homo Sapiens
cuggacuuuuuaugccugccauacccgcuaaugcuccucgaggugcaggagcagguugcugag

SEQ ID NO: 346779 - RNA, 63 nt, Homo Sapiens
aggcucccuccugucucuaagucaauuccaccccuccucgaagucccggcuuccaccccucuc

SEQ ID NO: 346780 - RNA, 63 nt, Homo Sapiens
acagggacuggccugucugucgcggaucaugggcuccucgaggucguuaaaugccugucuccc

SEQ ID NO: 346781 - RNA, 63 nt, Homo Sapiens
aguaaggaggaggagaaggggggcuccuucccucuccucgaaugacguuaugggcacaugccu

SEQ ID NO: 346782 - RNA, 63 nt, Homo Sapiens
ggagccgagcguccucgggcaccgcccucacaccuccucgagugcccugggaccacugggcca

SEQ ID NO: 346783 - RNA, 63 nt, Homo Sapiens
ggccacuggcccugcacccuuuaucucuuccugcuccucgauauggcuguaucauagcgauau

SEQ ID NO: 346784 - RNA, 63 nt, Homo Sapiens
cagccagagggaaagcgacccagacagcagccccuccucgacaggcccacccugcagcucagg

SEQ ID NO: 346785 - RNA, 63 nt, Homo Sapiens
ccuucagaaaaugguuuuaugcauauccaauaucuccucgaaaguguuuaggacauuugauuu

SEQ ID NO: 346786 - RNA, 63 nt, Homo Sapiens
augagggcugcagggccagugcugccccucggacuccucgagggguugggugcuaagcgcgag

SEQ ID NO: 346787 - RNA, 63 nt, Homo Sapiens
acgucacacacaguaagugucacaugcagcccucuccucgagcccaccagagcagccucucug

SEQ ID NO: 346788 - RNA, 63 nt, Homo Sapiens
uugcuuauauuaacaagaagacucacgcaauaacuccucgauaacucucagugaugguaucug

SEQ ID NO: 346789 - RNA, 63 nt, Homo Sapiens
uccauacaccacacaggcaugaugaucccaggucuccucgaccugcccauggaggaggcucuu

SEQ ID NO: 346790 - RNA, 63 nt, Homo Sapiens
ccucgcuccuuccugcccccccuccagugcccucuccucgaugaaggggccugccacccagcc

SEQ ID NO: 346791 - RNA, 63 nt, Homo Sapiens
ccugaagaaaaggcagugccaccccagggcagccuccucgacuagucagucaguggugccggg

SEQ ID NO: 346792 - RNA, 63 nt, Homo Sapiens
cugguuggcaaggugaaggcacuucuccuuccccuccucgaagacgggcugggucauaaggac

SEQ ID NO: 346793 - RNA, 63 nt, Homo Sapiens
gaucuuccccugacuccccaccgaggagagccucuccucgacccugcacgggcucugaggcca

SEQ ID NO: 346794 - RNA, 63 nt, Homo Sapiens
gcagggacuuuggucuauugaucagaaugaaagcuccucgaggguuuauuauguuuucucucc

SEQ ID NO: 346795 - RNA, 63 nt, Homo Sapiens
ccugcacagcuguggccgugcuccuccucugcccuccucgaggccaucuggcacuggccugga

SEQ ID NO: 346796 - RNA, 63 nt, Homo Sapiens
ucugagggaccaucuccccgacgcccaggcgagcuccucgaccuguuccuguggaggaugucu

SEQ ID NO: 346797 - RNA, 63 nt, Homo Sapiens
gaggcgcugcgcggacucgcccccaggaacgcucuccucgagcccucccccaaacagacucgc

SEQ ID NO: 346798 - RNA, 63 nt, Homo Sapiens
aaauccgaugugcuuccuucccuggcgcagucgcuccucgagccgcugccccccacccacccu

SEQ ID NO: 346799 - RNA, 63 nt, Homo Sapiens
cacauaauaucaguaccuugucuccccuuccuucuccucgaguuuuuacuaaaauuuuauaua

SEQ ID NO: 346800 - RNA, 63 nt, Homo Sapiens
gccaagaagguguuggaccauuccucccccgcccuccucgaguucgggaggugccaucggcac

SEQ ID NO: 346801 - RNA, 63 nt, Homo Sapiens
uggggacuuaguuagguagauuaauaucuggagcuccucgagggaccaaaucuccaacuuuuu

SEQ ID NO: 346802 - RNA, 63 nt, Homo Sapiens
ccaugugcugcggucacucacgucccacgucuccuccucgaagccauucggacugcugugccg

SEQ ID NO: 346803 - RNA, 63 nt, Homo Sapiens
uagcaaaagccgcauguccagccucuccaaugucuccucgaacagguagauggggcugaccug

SEQ ID NO: 346804 - RNA, 63 nt, Homo Sapiens
uucucugucuccucucucuccuccuuugaccuucuccucgaccagccaucaugacauuuacca

SEQ ID NO: 346805 - RNA, 63 nt, Homo Sapiens
auggccacgccagcugcggggacgcacuugggacuccucgagaggggacucgcggccgcgaug

SEQ ID NO: 346806 - RNA, 63 nt, Homo Sapiens
uagagacuugcuugggggcugcagaagugcccucuccucgaauccugccaguugcauucuucc

SEQ ID NO: 346807 - RNA, 63 nt, Homo Sapiens
uccuugcggucguaggugauucaccugcaggugcuccucgaugugcucccccagccgcaggcc

SEQ ID NO: 346808 - RNA, 63 nt, Homo Sapiens
ccacuccgguuccccgcaacuaaaguagaucaccuccucgaacgagcaugcgcagaggccagu

SEQ ID NO: 346809 - RNA, 63 nt, Homo Sapiens
gggagccuguccaccagcagcugugcuguuugucuccucgacaggugccuuuggccacaugug

SEQ ID NO: 346810 - RNA, 63 nt, Homo Sapiens
gcuuuaguggggaaaggaauguggauuacaaaucuccucgacuagcucuuguugcacuaaaaa

SEQ ID NO: 346811 - RNA, 63 nt, Homo Sapiens
ccccugugccuugucacgccagacuucccacggcuccucgagaucccaacacugccagcauuu

SEQ ID NO: 346812 - RNA, 63 nt, Homo Sapiens
gcccagggacucaugggacaccuuucccacagccuccucgauugcugugagcagaggccacuc

SEQ ID NO: 346813 - RNA, 63 nt, Homo Sapiens
aggggcucuggggacuucuccuucuaugaaagccuccucgagccaggugcuccugggcaccuu

SEQ ID NO: 346814 - RNA, 63 nt, Homo Sapiens
cacccagauuugaccguucauugguggggggugcuccucgaccacacccccauucuccaccug

SEQ ID NO: 346815 - RNA, 63 nt, Homo Sapiens
uuuccucggaaacacucuuguccacgcugccuccuccucgaguccguggccaugggaagaugu

SEQ ID NO: 346816 - RNA, 63 nt, Homo Sapiens
ccuuggggacguggcagaugucagccucugguucuccucgagugcuagcucaugcugcucuug

SEQ ID NO: 346817 - RNA, 63 nt, Homo Sapiens
uucuuuccuucaagugaagaugugacugacuaccuccucgaguugucaugaggaugaaagaau

SEQ ID NO: 346818 - RNA, 63 nt, Homo Sapiens
gccugccccucucugccuuuuccucgggugucccuccucgagccccuguggcauuggcuuggg

SEQ ID NO: 346819 - RNA, 63 nt, Homo Sapiens
uuacuccuccauauucuuucaacccacaugagucuccucgagaagugaggagaggcaguuugg

SEQ ID NO: 346820 - RNA, 63 nt, Homo Sapiens
ugcccagcucuccagggagcaggcucccagacgcuccucgaggggagccacugggacagggug

SEQ ID NO: 346821 - RNA, 63 nt, Homo Sapiens
uuccaaaagaugccgccuggccccggccggcgccuccucgaggcccugcagggcaucuagcag

SEQ ID NO: 346822 - RNA, 63 nt, Homo Sapiens
gcagggaccgugccuuauguacuagacugugagcuccucgaggguuccccauaugucuuccuu

SEQ ID NO: 346823 - RNA, 63 nt, Homo Sapiens
ccccuaagccacccccagagugagcugccgggccuccucgagguccugaccccagccaacagc

SEQ ID NO: 346824 - RNA, 63 nt, Homo Sapiens
gggccaggggcugugugacggcugccugaaguucuccucgaucccccggugagcuuccugcag

SEQ ID NO: 346825 - RNA, 63 nt, Homo Sapiens
cuugagaaggggacuugugaacucaaccacaaucuccucgagacauucauccagagaccaugu

SEQ ID NO: 346826 - RNA, 63 nt, Homo Sapiens
gugugggcccaaggcccccaacuuuugggaacucuccucgaaugccugggacagccacuggaa

SEQ ID NO: 346827 - RNA, 63 nt, Homo Sapiens
ccuuuggguuucagauuguugcagaacaugucucuccucgaguggcucaccuuucucuccuca

SEQ ID NO: 346828 - RNA, 63 nt, Homo Sapiens
cguacaguugagagccagggccuuucccguccccuccucgaccccuugguggggaccaagcag

SEQ ID NO: 346829 - RNA, 63 nt, Homo Sapiens
uuuaguuguccacggucaaucucucuuuccuuccuccucgaucggcuucccagaucccugagu

SEQ ID NO: 346830 - RNA, 63 nt, Homo Sapiens
ggcaugacuggcuucugaaaaauuccagcacaccuccucgaaccucauugucagcagagaggg

SEQ ID NO: 346831 - RNA, 63 nt, Homo Sapiens
ccccagccccugcugccccagccugugucuguucuccucgagggcuccagcauccucugcuuc

SEQ ID NO: 346832 - RNA, 63 nt, Homo Sapiens
uuuuaaauauucauguugagugugccuaauacucuccucgacaagucaugcuguuuuaugcag

SEQ ID NO: 346833 - RNA, 63 nt, Homo Sapiens
agcuuuuaaaaaauguguaccaaauuuaaaucucuccucgaucgucauuucuucauaagauag

SEQ ID NO: 346834 - RNA, 64 nt, Homo Sapiens
aacugucaacaaaugauaccuuuggauauccauccuccucgacuuauaguacagugguguauag

SEQ ID NO: 346835 - RNA, 64 nt, Homo Sapiens
ccccauuugucaccucgcacacuuauagcguuuccuccucgaaauucuaccaagacuggucaaa

SEQ ID NO: 346836 - RNA, 64 nt, Homo Sapiens
cuagugggggaucaagaaggcaaagggcucuguccuccucgaccgucaaguucuuggaaaugga

SEQ ID NO: 346837 - RNA, 64 nt, Homo Sapiens
ucacuguucaugcuggcgagcaugugggcuucaacuccucgacaggagcaagagauauuuuggg

SEQ ID NO: 346838 - RNA, 64 nt, Homo Sapiens
gcaggauugucuuuuuuuuucacuagacugugagcuccucgagggucaaccuaucuguuucccc

SEQ ID NO: 346839 - RNA, 64 nt, Homo Sapiens
ugaaacaagucuauggcaaauggagugacuuuuucuccucgaauuugaaacuuucaacaaucuc

SEQ ID NO: 346840 - RNA, 64 nt, Homo Sapiens
ugcuccucauggcugggcucgggcuauauuuucucuccucgaguggaacucuucuaaccuccuu

SEQ ID NO: 346841 - RNA, 64 nt, Homo Sapiens
ucaacuaacuauaucuugaauguuauauugaucucuccucgaacacuauaauugcacaaggucu

SEQ ID NO: 346842 - RNA, 64 nt, Homo Sapiens
cugcugccagcggaggcgacagcagcguugggagcuccucgaugucagcuuuuugugcuggacu

SEQ ID NO: 346843 - RNA, 64 nt, Homo Sapiens
gagaugccaaggccugugccagguucccugugcccuccucgaggugggcagccaucaccagcca

SEQ ID NO: 346844 - RNA, 64 nt, Homo Sapiens
aucaagaucuaucucucuucgucaaggucagcaucuccucgacgcuuaaaguucuuuauuuuag

SEQ ID NO: 346845 - RNA, 64 nt, Homo Sapiens
ccuucggagccucugagcuccaauacugacccuccuccucgauggaggggcugcuccugcuugc

SEQ ID NO: 346846 - RNA, 64 nt, Homo Sapiens
gcuuugauaaagguuagauuaguauuuuaccaaccuccucgaugcagagcugugauuuuugcaa

SEQ ID NO: 346847 - RNA, 64 nt, Homo Sapiens
acgagcauaccccaugcccaccguggagcugcaacuccucgacagcacugaguuugauagucuc

SEQ ID NO: 346848 - RNA, 64 nt, Homo Sapiens
cacagucacacgaauaccugccaggguuauucuccuccucgaguuaggaguugaguuguuugcu

SEQ ID NO: 346849 - RNA, 64 nt, Homo Sapiens
ucuggacuuuuuaugccugccauacccgcuaaugcuccucgaggugcaggagcagguugcugag

SEQ ID NO: 346850 - RNA, 64 nt, Homo Sapiens
gaggcucccuccugucucuaagucaauuccaccccuccucgaagucccggcuuccaccccucuc

SEQ ID NO: 346851 - RNA, 64 nt, Homo Sapiens
acagggacuggccugucuguccgcggaucaugggcuccucgagggucguuaaaugccugucucc

SEQ ID NO: 346852 - RNA, 64 nt, Homo Sapiens
uaguaaggaggaggagaaggggggcuccuucccucuccucgaaugacguuaugggcacaugccu

SEQ ID NO: 346853 - RNA, 64 nt, Homo Sapiens
aggagccgagcguccucgggcaccgcccucacaccuccucgagugcccugggaccacugggcca

SEQ ID NO: 346854 - RNA, 64 nt, Homo Sapiens
ggccacuggcccugcacccuuuuaucucuuccugcuccucgauaauggcuguaucauagcgaua

SEQ ID NO: 346855 - RNA, 64 nt, Homo Sapiens
acagccagagggaaagcgacccagacagcagccccuccucgacaggcccacccugcagcucagg

SEQ ID NO: 346856 - RNA, 64 nt, Homo Sapiens
ccuucagaaaaugguuuuauugcauauccaauaucuccucgaaauguguuuaggacauuugauu

SEQ ID NO: 346857 - RNA, 64 nt, Homo Sapiens
uaugagggcugcagggccagugcugccccucggacuccucgagggguugggugcuaagcgcgag

SEQ ID NO: 346858 - RNA, 64 nt, Homo Sapiens
acgucacacacaguaagugugcacaugcagcccucuccucgagcgccaccagagcagccucucu

SEQ ID NO: 346859 - RNA, 64 nt, Homo Sapiens
guugcuuauauuaacaagaagacucacgcaauaacuccucgauaacucucagugaugguaucug

SEQ ID NO: 346860 - RNA, 64 nt, Homo Sapiens
uccauacaccacacaggcauugaugaucccaggucuccucgacccugcccauggaggaggcucu

SEQ ID NO: 346861 - RNA, 64 nt, Homo Sapiens
ccucgcuccuuccugccccccccuccagugcccucuccucgaugcaaggggccugccacccagc

SEQ ID NO: 346862 - RNA, 64 nt, Homo Sapiens
ccugaagaaaaggcagugccgaccccagggcagccuccucgacugagucagucaguggugccgg

SEQ ID NO: 346863 - RNA, 64 nt, Homo Sapiens
cugguuggcaaggugaaggccacuucuccuuccccuccucgaagcacgggcugggucauaagga

SEQ ID NO: 346864 - RNA, 64 nt, Homo Sapiens
cgaucuuccccugacuccccaccgaggagagccucuccucgacccugcacgggcucugaggcca

SEQ ID NO: 346865 - RNA, 64 nt, Homo Sapiens
gcagggacuuuggucuauugcaucagaaugaaagcuccucgagguguuuauuauguuuucucuc

SEQ ID NO: 346866 - RNA, 64 nt, Homo Sapiens
ccugcacagcuguggccgugacuccuccucugcccuccucgagguccaucuggcacuggccugg

SEQ ID NO: 346867 - RNA, 64 nt, Homo Sapiens
ucugagggaccaucuccccguacgcccaggcgagcuccucgacccuguuccuguggaggauguc

SEQ ID NO: 346868 - RNA, 64 nt, Homo Sapiens
ugaggcgcugcgcggacucgcccccaggaacgcucuccucgagcccucccccaaacagacucgc

SEQ ID NO: 346869 - RNA, 64 nt, Homo Sapiens
aaaauccgaugugcuuccuucccuggcgcagucgcuccucgagccgcugccccccacccacccu

SEQ ID NO: 346870 - RNA, 64 nt, Homo Sapiens
cacauaauaucaguaccuugaucuccccuuccuucuccucgaguguuuuacuaaaauuuuauau

SEQ ID NO: 346871 - RNA, 64 nt, Homo Sapiens
gccaagaagguguuggaccacuuccucccccgcccuccucgaguaucgggaggugccaucggca

SEQ ID NO: 346872 - RNA, 64 nt, Homo Sapiens
cuggggacuuaguuagguagauuaauaucuggagcuccucgagggaccaaaucuccaacuuuuu

SEQ ID NO: 346873 - RNA, 64 nt, Homo Sapiens
ccaugugcugcggucacucagcgucccacgucuccuccucgaagcccauucggacugcugugcc

SEQ ID NO: 346874 - RNA, 64 nt, Homo Sapiens
uagcaaaagccgcauguccaggccucuccaaugucuccucgaaccagguagauggggcugaccu

SEQ ID NO: 346875 - RNA, 64 nt, Homo Sapiens
auucucugucuccucucucuccuccuuugaccuucuccucgaccagccaucaugacauuuacca

SEQ ID NO: 346876 - RNA, 64 nt, Homo Sapiens
cauggccacgccagcugcggggacgcacuugggacuccucgagaggggacucgcggccgcgaug

SEQ ID NO: 346877 - RNA, 64 nt, Homo Sapiens
cuagagacuugcuugggggcugcagaagugcccucuccucgaauccugccaguugcauucuucc

SEQ ID NO: 346878 - RNA, 64 nt, Homo Sapiens
uccuugcggucguaggugaucucaccugcaggugcuccucgaugcugcucccccagccgcaggc

SEQ ID NO: 346879 - RNA, 64 nt, Homo Sapiens
ccacuccgguuccccgcaacuuaaaguagaucaccuccucgaacggagcaugcgcagaggccag

SEQ ID NO: 346880 - RNA, 64 nt, Homo Sapiens
gggagccuguccaccagcaggcugugcuguuugucuccucgacaaggugccuuuggccacaugu

SEQ ID NO: 346881 - RNA, 64 nt, Homo Sapiens
gcuuuaguggggaaaggaauaguggauuacaaaucuccucgacugagcucuuguugcacuaaaa

SEQ ID NO: 346882 - RNA, 64 nt, Homo Sapiens
cccccugugccuugucacgccagacuucccacggcuccucgagaucccaacacugccagcauuu

SEQ ID NO: 346883 - RNA, 64 nt, Homo Sapiens
ggcccagggacucaugggacaccuuucccacagccuccucgauugcugugagcagaggccacuc

SEQ ID NO: 346884 - RNA, 64 nt, Homo Sapiens
aaggggcucuggggacuucuccuucuaugaaagccuccucgagccaggugcuccugggcaccuu

SEQ ID NO: 346885 - RNA, 64 nt, Homo Sapiens
cacccagauuugaccguucaguugguggggggugcuccucgaccaacacccccauucuccaccu

SEQ ID NO: 346886 - RNA, 64 nt, Homo Sapiens; identical to SEQ ID NO: 76484

SEQ ID NO: 346887 - RNA, 64 nt, Homo Sapiens; identical to SEQ ID NO: 76485

SEQ ID NO: 346888 - RNA, 64 nt, Homo Sapiens
auucuuuccuucaagugaagaugugacugacuaccuccucgaguugucaugaggaugaaagaau

SEQ ID NO: 346889 - RNA, 64 nt, Homo Sapiens
ugccugccccucucugccuuuuccucgggugucccuccucgagccccuguggcauuggcuuggg

SEQ ID NO: 346890 - RNA, 64 nt, Homo Sapiens
cuuacuccuccauauucuuucaacccacaugagucuccucgagaagugaggagaggcaguuugg

SEQ ID NO: 346891 - RNA, 64 nt, Homo Sapiens
ugcccagcucuccagggagcgaggcucccagacgcuccucgaggaggagccacugggacagggu

SEQ ID NO: 346892 - RNA, 64 nt, Homo Sapiens
uuccaaaagaugccgccugggccccggccggcgccuccucgaggucccugcagggcaucuagca

SEQ ID NO: 346893 - RNA, 64 nt, Homo Sapiens
gcagggaccgugccuuauguuacuagacugugagcuccucgagggguuccccauaugucuuccu

SEQ ID NO: 346894 - RNA, 64 nt, Homo Sapiens
ccccuaagccacccccagagcugagcugccgggccuccucgaggauccugaccccagccaacag

SEQ ID NO: 346895 - RNA, 64 nt, Homo Sapiens
agggccaggggcugugugacggcugccugaaguucuccucgaucccccggugagcuuccugcag

SEQ ID NO: 346896 - RNA, 64 nt, Homo Sapiens
acuugagaaggggacuugugaacucaaccacaaucuccucgagacauucauccagagaccaugu

SEQ ID NO: 346897 - RNA, 64 nt, Homo Sapiens
gugugggcccaaggcccccaaacuuuugggaacucuccucgaauugccugggacagccacugga

SEQ ID NO: 346898 - RNA, 64 nt, Homo Sapiens
ccuuuggguuucagauuguuagcagaacaugucucuccucgaguuggcucaccuuucucuccuc

SEQ ID NO: 346899 - RNA, 64 nt, Homo Sapiens
cguacaguugagagccaggggccuuucccguccccuccucgaccgccuugguggggaccaagca

SEQ ID NO: 346900 - RNA, 64 nt, Homo Sapiens
uuuaguuguccacggucaauucucucuuuccuuccuccucgaucaggcuucccagaucccugag

SEQ ID NO: 346901 - RNA, 64 nt, Homo Sapiens
aggcaugacuggcuucugaaaaauuccagcacaccuccucgaaccucauugucagcagagaggg

SEQ ID NO: 346902 - RNA, 64 nt, Homo Sapiens
cccccagccccugcugccccagccugugucuguucuccucgagggcuccagcauccucugcuuc

SEQ ID NO: 346903 - RNA, 64 nt, Homo Sapiens
cuuuuaaauauucauguugagugugccuaauacucuccucgacaagucaugcuguuuuaugcag

SEQ ID NO: 346904 - RNA, 64 nt, Homo Sapiens
agcuuuuaaaaaauguguacgcaaauuuaaaucucuccucgaucggucauuucuucauaagaua

SEQ ID NO: 346905 - RNA, 64 nt, Homo Sapiens; identical to SEQ ID NO: 182508

SEQ ID NO: 346906 - RNA, 64 nt, Homo Sapiens; identical to SEQ ID NO: 182509

SEQ ID NO: 346907 - RNA, 64 nt, Homo Sapiens; identical to SEQ ID NO: 182510

SEQ ID NO: 346908 - RNA, 64 nt, Homo Sapiens; identical to SEQ ID NO: 182511

SEQ ID NO: 346909 - RNA, 64 nt, Homo Sapiens; identical to SEQ ID NO: 182512

SEQ ID NO: 346910 - RNA, 64 nt, Homo Sapiens; identical to SEQ ID NO: 182513

SEQ ID NO: 346911 - RNA, 64 nt, Homo Sapiens; identical to SEQ ID NO: 182514

SEQ ID NO: 346912 - RNA, 64 nt, Homo Sapiens; identical to SEQ ID NO: 182515

SEQ ID NO: 346913 - RNA, 64 nt, Homo Sapiens; identical to SEQ ID NO: 182516

SEQ ID NO: 346914 - RNA, 64 nt, Homo Sapiens; identical to SEQ ID NO: 182517

SEQ ID NO: 346915 - RNA, 64 nt, Homo Sapiens; identical to SEQ ID NO: 182518

SEQ ID NO: 346916 - RNA, 64 nt, Homo Sapiens; identical to SEQ ID NO: 182519

SEQ ID NO: 346917 - RNA, 64 nt, Homo Sapiens; identical to SEQ ID NO: 182520

SEQ ID NO: 346918 - RNA, 64 nt, Homo Sapiens; identical to SEQ ID NO: 182521

SEQ ID NO: 346919 - RNA, 64 nt, Homo Sapiens; identical to SEQ ID NO: 182522

SEQ ID NO: 346920 - RNA, 64 nt, Homo Sapiens; identical to SEQ ID NO: 182523

SEQ ID NO: 346921 - RNA, 64 nt, Homo Sapiens; identical to SEQ ID NO: 182524

SEQ ID NO: 346922 - RNA, 64 nt, Homo Sapiens; identical to SEQ ID NO: 182525

SEQ ID NO: 346923 - RNA, 64 nt, Homo Sapiens; identical to SEQ ID NO: 182526

SEQ ID NO: 346924 - RNA, 64 nt, Homo Sapiens; identical to SEQ ID NO: 182527

SEQ ID NO: 346925 - RNA, 64 nt, Homo Sapiens; identical to SEQ ID NO: 182528

SEQ ID NO: 346926 - RNA, 64 nt, Homo Sapiens; identical to SEQ ID NO: 182529

SEQ ID NO: 346927 - RNA, 64 nt, Homo Sapiens; identical to SEQ ID NO: 182530

SEQ ID NO: 346928 - RNA, 64 nt, Homo Sapiens; identical to SEQ ID NO: 182531

SEQ ID NO: 346929 - RNA, 64 nt, Homo Sapiens; identical to SEQ ID NO: 182532

SEQ ID NO: 346930 - RNA, 64 nt, Homo Sapiens; identical to SEQ ID NO: 182533

SEQ ID NO: 346931 - RNA, 64 nt, Homo Sapiens; identical to SEQ ID NO: 182534

SEQ ID NO: 346932 - RNA, 64 nt, Homo Sapiens; identical to SEQ ID NO: 182535

SEQ ID NO: 346933 - RNA, 64 nt, Homo Sapiens; identical to SEQ ID NO: 298158

SEQ ID NO: 346934 - RNA, 64 nt, Homo Sapiens; identical to SEQ ID NO: 298159

SEQ ID NO: 346935 - RNA, 64 nt, Homo Sapiens; identical to SEQ ID NO: 298160

SEQ ID NO: 346936 - RNA, 64 nt, Homo Sapiens; identical to SEQ ID NO: 298161

SEQ ID NO: 346937 - RNA, 64 nt, Homo Sapiens; identical to SEQ ID NO: 298162

SEQ ID NO: 346938 - RNA, 64 nt, Homo Sapiens; identical to SEQ ID NO: 298163

SEQ ID NO: 346939 - RNA, 64 nt, Homo Sapiens; identical to SEQ ID NO: 298164

SEQ ID NO: 346940 - RNA, 64 nt, Homo Sapiens; identical to SEQ ID NO: 298165

SEQ ID NO: 346941 - RNA, 64 nt, Homo Sapiens; identical to SEQ ID NO: 298166

SEQ ID NO: 346942 - RNA, 64 nt, Homo Sapiens; identical to SEQ ID NO: 298167

SEQ ID NO: 346943 - RNA, 64 nt, Homo Sapiens; identical to SEQ ID NO: 298168

SEQ ID NO: 346944 - RNA, 64 nt, Homo Sapiens; identical to SEQ ID NO: 298169

SEQ ID NO: 346945 - RNA, 64 nt, Homo Sapiens; identical to SEQ ID NO: 298170

SEQ ID NO: 346946 - RNA, 64 nt, Homo Sapiens; identical to SEQ ID NO: 298171

SEQ ID NO: 346947 - RNA, 64 nt, Homo Sapiens; identical to SEQ ID NO: 298172

SEQ ID NO: 346948 - RNA, 64 nt, Homo Sapiens; identical to SEQ ID NO: 298173

SEQ ID NO: 346949 - RNA, 64 nt, Homo Sapiens; identical to SEQ ID NO: 298174

SEQ ID NO: 346950 - RNA, 64 nt, Homo Sapiens; identical to SEQ ID NO: 298175

SEQ ID NO: 346951 - RNA, 64 nt, Homo Sapiens; identical to SEQ ID NO: 298176

SEQ ID NO: 346952 - RNA, 64 nt, Homo Sapiens; identical to SEQ ID NO: 298177

SEQ ID NO: 346953 - RNA, 64 nt, Homo Sapiens; identical to SEQ ID NO: 298178

SEQ ID NO: 346954 - RNA, 64 nt, Homo Sapiens; identical to SEQ ID NO: 298179

SEQ ID NO: 346955 - RNA, 64 nt, Homo Sapiens; identical to SEQ ID NO: 298180

SEQ ID NO: 346956 - RNA, 64 nt, Homo Sapiens; identical to SEQ ID NO: 298181

SEQ ID NO: 346957 - RNA, 64 nt, Homo Sapiens; identical to SEQ ID NO: 298182

SEQ ID NO: 346958 - RNA, 64 nt, Homo Sapiens; identical to SEQ ID NO: 298183

SEQ ID NO: 346959 - RNA, 64 nt, Homo Sapiens; identical to SEQ ID NO: 298184

SEQ ID NO: 346960 - RNA, 64 nt, Homo Sapiens; identical to SEQ ID NO: 298185

SEQ ID NO: 346961 - RNA, 64 nt, Homo Sapiens; identical to SEQ ID NO: 298186

SEQ ID NO: 346962 - RNA, 64 nt, Homo Sapiens; identical to SEQ ID NO: 298187

SEQ ID NO: 346963 - RNA, 64 nt, Homo Sapiens; identical to SEQ ID NO: 298188

SEQ ID NO: 346964 - RNA, 64 nt, Homo Sapiens; identical to SEQ ID NO: 298189

SEQ ID NO: 346965 - RNA, 64 nt, Homo Sapiens; identical to SEQ ID NO: 298190

SEQ ID NO: 346966 - RNA, 64 nt, Homo Sapiens; identical to SEQ ID NO: 298191

SEQ ID NO: 346967 - RNA, 64 nt, Homo Sapiens; identical to SEQ ID NO: 298192

SEQ ID NO: 346968 - RNA, 64 nt, Homo Sapiens; identical to SEQ ID NO: 298193

SEQ ID NO: 346969 - RNA, 64 nt, Homo Sapiens; identical to SEQ ID NO: 298194

SEQ ID NO: 346970 - RNA, 64 nt, Homo Sapiens; identical to SEQ ID NO: 298195

SEQ ID NO: 346971 - RNA, 64 nt, Homo Sapiens; identical to SEQ ID NO: 298196

SEQ ID NO: 346972 - RNA, 64 nt, Homo Sapiens; identical to SEQ ID NO: 298197

SEQ ID NO: 346973 - RNA, 64 nt, Homo Sapiens; identical to SEQ ID NO: 298198

SEQ ID NO: 346974 - RNA, 64 nt, Homo Sapiens; identical to SEQ ID NO: 298199

SEQ ID NO: 346975 - RNA, 64 nt, Homo Sapiens; identical to SEQ ID NO: 298200

SEQ ID NO: 346976 - RNA, 64 nt, Homo Sapiens; identical to SEQ ID NO: 298201

SEQ ID NO: 346977 - RNA, 64 nt, Homo Sapiens; identical to SEQ ID NO: 298202

SEQ ID NO: 346978 - RNA, 64 nt, Homo Sapiens; identical to SEQ ID NO: 298203

SEQ ID NO: 346979 - RNA, 64 nt, Homo Sapiens; identical to SEQ ID NO: 298204

SEQ ID NO: 346980 - RNA, 64 nt, Homo Sapiens; identical to SEQ ID NO: 298205

SEQ ID NO: 346981 - RNA, 64 nt, Homo Sapiens; identical to SEQ ID NO: 298206

SEQ ID NO: 346982 - RNA, 64 nt, Homo Sapiens; identical to SEQ ID NO: 298207

SEQ ID NO: 346983 - RNA, 64 nt, Homo Sapiens; identical to SEQ ID NO: 298208

SEQ ID NO: 346984 - RNA, 64 nt, Homo Sapiens; identical to SEQ ID NO: 298209

SEQ ID NO: 346985 - RNA, 64 nt, Homo Sapiens; identical to SEQ ID NO: 298210

SEQ ID NO: 346986 - RNA, 64 nt, Homo Sapiens; identical to SEQ ID NO: 298211

SEQ ID NO: 346987 - RNA, 64 nt, Homo Sapiens; identical to SEQ ID NO: 298212

SEQ ID NO: 346988 - RNA, 64 nt, Homo Sapiens; identical to SEQ ID NO: 298213

SEQ ID NO: 346989 - RNA, 64 nt, Homo Sapiens; identical to SEQ ID NO: 298214

SEQ ID NO: 346990 - RNA, 64 nt, Homo Sapiens; identical to SEQ ID NO: 298215

SEQ ID NO: 346991 - RNA, 64 nt, Homo Sapiens; identical to SEQ ID NO: 298216

SEQ ID NO: 346992 - RNA, 64 nt, Homo Sapiens; identical to SEQ ID NO: 298217

SEQ ID NO: 346993 - RNA, 64 nt, Homo Sapiens; identical to SEQ ID NO: 298218

SEQ ID NO: 346994 - RNA, 64 nt, Homo Sapiens; identical to SEQ ID NO: 298219

SEQ ID NO: 346995 - RNA, 64 nt, Homo Sapiens; identical to SEQ ID NO: 298220

SEQ ID NO: 346996 - RNA, 64 nt, Homo Sapiens; identical to SEQ ID NO: 298221

SEQ ID NO: 346997 - RNA, 64 nt, Homo Sapiens; identical to SEQ ID NO: 298222

SEQ ID NO: 346998 - RNA, 64 nt, Homo Sapiens; identical to SEQ ID NO: 298223

SEQ ID NO: 346999 - RNA, 64 nt, Homo Sapiens; identical to SEQ ID NO: 298224

SEQ ID NO: 347000 - RNA, 64 nt, Homo Sapiens; identical to SEQ ID NO: 298225

SEQ ID NO: 347001 - RNA, 64 nt, Homo Sapiens; identical to SEQ ID NO: 298226

SEQ ID NO: 347002 - RNA, 64 nt, Homo Sapiens; identical to SEQ ID NO: 298227

SEQ ID NO: 347003 - RNA, 64 nt, Homo Sapiens; identical to SEQ ID NO: 298228

SEQ ID NO: 347004 - RNA, 64 nt, Homo Sapiens; identical to SEQ ID NO: 298229

SEQ ID NO: 347005 - RNA, 56 nt, Homo Sapiens; identical to SEQ ID NO: 298230

SEQ ID NO: 347006 - RNA, 64 nt, Homo Sapiens; identical to SEQ ID NO: 298231

SEQ ID NO: 347007 - RNA, 64 nt, Homo Sapiens; identical to SEQ ID NO: 298232

SEQ ID NO: 347008 - RNA, 64 nt, Homo Sapiens; identical to SEQ ID NO: 298233

SEQ ID NO: 347009 - RNA, 64 nt, Homo Sapiens; identical to SEQ ID NO: 298234

SEQ ID NO: 347010 - RNA, 64 nt, Homo Sapiens; identical to SEQ ID NO: 298235

SEQ ID NO: 347011 - RNA, 64 nt, Homo Sapiens; identical to SEQ ID NO: 298236

SEQ ID NO: 347012 - RNA, 64 nt, Homo Sapiens; identical to SEQ ID NO: 298237

SEQ ID NO: 347013 - RNA, 64 nt, Homo Sapiens; identical to SEQ ID NO: 298238

SEQ ID NO: 347014 - RNA, 63 nt, Homo Sapiens; identical to SEQ ID NO: 298239

SEQ ID NO: 347015 - RNA, 64 nt, Homo Sapiens; identical to SEQ ID NO: 298240

SEQ ID NO: 347016 - RNA, 64 nt, Homo Sapiens; identical to SEQ ID NO: 298241

SEQ ID NO: 347017 - RNA, 64 nt, Homo Sapiens; identical to SEQ ID NO: 298242

SEQ ID NO: 347018 - RNA, 64 nt, Homo Sapiens; identical to SEQ ID NO: 298243

SEQ ID NO: 347019 - RNA, 64 nt, Homo Sapiens; identical to SEQ ID NO: 298244

SEQ ID NO: 347020 - RNA, 64 nt, Homo Sapiens; identical to SEQ ID NO: 298245

SEQ ID NO: 347021 - RNA, 64 nt, Homo Sapiens; identical to SEQ ID NO: 298246

SEQ ID NO: 347022 - RNA, 64 nt, Homo Sapiens; identical to SEQ ID NO: 298247

SEQ ID NO: 347023 - RNA, 64 nt, Homo Sapiens; identical to SEQ ID NO: 298248

SEQ ID NO: 347024 - RNA, 64 nt, Homo Sapiens; identical to SEQ ID NO: 298249

SEQ ID NO: 347025 - RNA, 64 nt, Homo Sapiens; identical to SEQ ID NO: 182508

SEQ ID NO: 347026 - RNA, 64 nt, Homo Sapiens; identical to SEQ ID NO: 182509

SEQ ID NO: 347027 - RNA, 64 nt, Homo Sapiens; identical to SEQ ID NO: 182510

SEQ ID NO: 347028 - RNA, 64 nt, Homo Sapiens; identical to SEQ ID NO: 182511

SEQ ID NO: 347029 - RNA, 64 nt, Homo Sapiens; identical to SEQ ID NO: 182512

SEQ ID NO: 347030 - RNA, 64 nt, Homo Sapiens; identical to SEQ ID NO: 182513

SEQ ID NO: 347031 - RNA, 64 nt, Homo Sapiens; identical to SEQ ID NO: 182514

SEQ ID NO: 347032 - RNA, 64 nt, Homo Sapiens; identical to SEQ ID NO: 182515

SEQ ID NO: 347033 - RNA, 64 nt, Homo Sapiens; identical to SEQ ID NO: 182516

SEQ ID NO: 347034 - RNA, 64 nt, Homo Sapiens; identical to SEQ ID NO: 182517

SEQ ID NO: 347035 - RNA, 64 nt, Homo Sapiens; identical to SEQ ID NO: 182518

SEQ ID NO: 347036 - RNA, 64 nt, Homo Sapiens; identical to SEQ ID NO: 182519

SEQ ID NO: 347037 - RNA, 64 nt, Homo Sapiens; identical to SEQ ID NO: 182520

SEQ ID NO: 347038 - RNA, 64 nt, Homo Sapiens; identical to SEQ ID NO: 182521

SEQ ID NO: 347039 - RNA, 64 nt, Homo Sapiens; identical to SEQ ID NO: 182522

SEQ ID NO: 347040 - RNA, 64 nt, Homo Sapiens; identical to SEQ ID NO: 182523

SEQ ID NO: 347041 - RNA, 64 nt, Homo Sapiens; identical to SEQ ID NO: 182524

SEQ ID NO: 347042 - RNA, 64 nt, Homo Sapiens; identical to SEQ ID NO: 182525

SEQ ID NO: 347043 - RNA, 64 nt, Homo Sapiens; identical to SEQ ID NO: 182526

SEQ ID NO: 347044 - RNA, 64 nt, Homo Sapiens; identical to SEQ ID NO: 182527

SEQ ID NO: 347045 - RNA, 64 nt, Homo Sapiens; identical to SEQ ID NO: 182528

SEQ ID NO: 347046 - RNA, 64 nt, Homo Sapiens; identical to SEQ ID NO: 182529

SEQ ID NO: 347047 - RNA, 64 nt, Homo Sapiens; identical to SEQ ID NO: 182530

SEQ ID NO: 347048 - RNA, 64 nt, Homo Sapiens; identical to SEQ ID NO: 182531

SEQ ID NO: 347049 - RNA, 64 nt, Homo Sapiens; identical to SEQ ID NO: 182532

SEQ ID NO: 347050 - RNA, 64 nt, Homo Sapiens; identical to SEQ ID NO: 182533

SEQ ID NO: 347051 - RNA, 64 nt, Homo Sapiens; identical to SEQ ID NO: 182534

SEQ ID NO: 347052 - RNA, 64 nt, Homo Sapiens; identical to SEQ ID NO: 182535

SEQ ID NO: 347053 - RNA, 64 nt, Homo Sapiens; identical to SEQ ID NO: 298158

SEQ ID NO: 347054 - RNA, 64 nt, Homo Sapiens; identical to SEQ ID NO: 298159

SEQ ID NO: 347055 - RNA, 64 nt, Homo Sapiens; identical to SEQ ID NO: 298160

SEQ ID NO: 347056 - RNA, 64 nt, Homo Sapiens; identical to SEQ ID NO: 298161

SEQ ID NO: 347057 - RNA, 64 nt, Homo Sapiens; identical to SEQ ID NO: 298162

SEQ ID NO: 347058 - RNA, 64 nt, Homo Sapiens; identical to SEQ ID NO: 298163

SEQ ID NO: 347059 - RNA, 64 nt, Homo Sapiens; identical to SEQ ID NO: 298164

SEQ ID NO: 347060 - RNA, 64 nt, Homo Sapiens; identical to SEQ ID NO: 298165

SEQ ID NO: 347061 - RNA, 64 nt, Homo Sapiens; identical to SEQ ID NO: 298166

SEQ ID NO: 347062 - RNA, 64 nt, Homo Sapiens; identical to SEQ ID NO: 298167

SEQ ID NO: 347063 - RNA, 64 nt, Homo Sapiens; identical to SEQ ID NO: 298168

SEQ ID NO: 347064 - RNA, 64 nt, Homo Sapiens; identical to SEQ ID NO: 298169

SEQ ID NO: 347065 - RNA, 64 nt, Homo Sapiens; identical to SEQ ID NO: 298170

SEQ ID NO: 347066 - RNA, 64 nt, Homo Sapiens; identical to SEQ ID NO: 298171

SEQ ID NO: 347067 - RNA, 64 nt, Homo Sapiens; identical to SEQ ID NO: 298172

SEQ ID NO: 347068 - RNA, 64 nt, Homo Sapiens; identical to SEQ ID NO: 298173

SEQ ID NO: 347069 - RNA, 64 nt, Homo Sapiens; identical to SEQ ID NO: 298174

SEQ ID NO: 347070 - RNA, 64 nt, Homo Sapiens; identical to SEQ ID NO: 298175

SEQ ID NO: 347071 - RNA, 64 nt, Homo Sapiens; identical to SEQ ID NO: 298176

SEQ ID NO: 347072 - RNA, 64 nt, Homo Sapiens; identical to SEQ ID NO: 298177

SEQ ID NO: 347073 - RNA, 64 nt, Homo Sapiens; identical to SEQ ID NO: 298178

SEQ ID NO: 347074 - RNA, 64 nt, Homo Sapiens; identical to SEQ ID NO: 298179

SEQ ID NO: 347075 - RNA, 64 nt, Homo Sapiens; identical to SEQ ID NO: 298180

SEQ ID NO: 347076 - RNA, 64 nt, Homo Sapiens; identical to SEQ ID NO: 298181

SEQ ID NO: 347077 - RNA, 64 nt, Homo Sapiens; identical to SEQ ID NO: 298182

SEQ ID NO: 347078 - RNA, 64 nt, Homo Sapiens; identical to SEQ ID NO: 298183

SEQ ID NO: 347079 - RNA, 64 nt, Homo Sapiens; identical to SEQ ID NO: 298184

SEQ ID NO: 347080 - RNA, 64 nt, Homo Sapiens; identical to SEQ ID NO: 298185

SEQ ID NO: 347081 - RNA, 64 nt, Homo Sapiens; identical to SEQ ID NO: 298186

SEQ ID NO: 347082 - RNA, 64 nt, Homo Sapiens; identical to SEQ ID NO: 298187

SEQ ID NO: 347083 - RNA, 64 nt, Homo Sapiens; identical to SEQ ID NO: 298188

SEQ ID NO: 347084 - RNA, 64 nt, Homo Sapiens; identical to SEQ ID NO: 298189

SEQ ID NO: 347085 - RNA, 64 nt, Homo Sapiens; identical to SEQ ID NO: 298190

SEQ ID NO: 347086 - RNA, 64 nt, Homo Sapiens; identical to SEQ ID NO: 298191

SEQ ID NO: 347087 - RNA, 64 nt, Homo Sapiens; identical to SEQ ID NO: 298192

SEQ ID NO: 347088 - RNA, 64 nt, Homo Sapiens; identical to SEQ ID NO: 298193

SEQ ID NO: 347089 - RNA, 64 nt, Homo Sapiens; identical to SEQ ID NO: 298194

SEQ ID NO: 347090 - RNA, 64 nt, Homo Sapiens; identical to SEQ ID NO: 298195

SEQ ID NO: 347091 - RNA, 64 nt, Homo Sapiens; identical to SEQ ID NO: 298196

SEQ ID NO: 347092 - RNA, 64 nt, Homo Sapiens; identical to SEQ ID NO: 298197

SEQ ID NO: 347093 - RNA, 64 nt, Homo Sapiens; identical to SEQ ID NO: 298198

SEQ ID NO: 347094 - RNA, 64 nt, Homo Sapiens; identical to SEQ ID NO: 298199

SEQ ID NO: 347095 - RNA, 64 nt, Homo Sapiens; identical to SEQ ID NO: 298200

SEQ ID NO: 347096 - RNA, 64 nt, Homo Sapiens; identical to SEQ ID NO: 298201

SEQ ID NO: 347097 - RNA, 64 nt, Homo Sapiens; identical to SEQ ID NO: 298202

SEQ ID NO: 347098 - RNA, 64 nt, Homo Sapiens; identical to SEQ ID NO: 298203

SEQ ID NO: 347099 - RNA, 64 nt, Homo Sapiens; identical to SEQ ID NO: 298204

SEQ ID NO: 347100 - RNA, 64 nt, Homo Sapiens; identical to SEQ ID NO: 298205

SEQ ID NO: 347101 - RNA, 64 nt, Homo Sapiens; identical to SEQ ID NO: 298206

SEQ ID NO: 347102 - RNA, 64 nt, Homo Sapiens; identical to SEQ ID NO: 298207

SEQ ID NO: 347103 - RNA, 64 nt, Homo Sapiens; identical to SEQ ID NO: 298208

SEQ ID NO: 347104 - RNA, 64 nt, Homo Sapiens; identical to SEQ ID NO: 298209

SEQ ID NO: 347105 - RNA, 64 nt, Homo Sapiens; identical to SEQ ID NO: 298210

SEQ ID NO: 347106 - RNA, 64 nt, Homo Sapiens; identical to SEQ ID NO: 298211

SEQ ID NO: 347107 - RNA, 64 nt, Homo Sapiens; identical to SEQ ID NO: 298212

SEQ ID NO: 347108 - RNA, 64 nt, Homo Sapiens; identical to SEQ ID NO: 298213

SEQ ID NO: 347109 - RNA, 64 nt, Homo Sapiens; identical to SEQ ID NO: 298214

SEQ ID NO: 347110 - RNA, 64 nt, Homo Sapiens; identical to SEQ ID NO: 298215

SEQ ID NO: 347111 - RNA, 64 nt, Homo Sapiens; identical to SEQ ID NO: 298216

SEQ ID NO: 347112 - RNA, 64 nt, Homo Sapiens; identical to SEQ ID NO: 298217

SEQ ID NO: 347113 - RNA, 64 nt, Homo Sapiens; identical to SEQ ID NO: 298218

SEQ ID NO: 347114 - RNA, 64 nt, Homo Sapiens; identical to SEQ ID NO: 298219

SEQ ID NO: 347115 - RNA, 64 nt, Homo Sapiens; identical to SEQ ID NO: 298220

SEQ ID NO: 347116 - RNA, 64 nt, Homo Sapiens; identical to SEQ ID NO: 298221

SEQ ID NO: 347117 - RNA, 64 nt, Homo Sapiens; identical to SEQ ID NO: 298222

SEQ ID NO: 347118 - RNA, 64 nt, Homo Sapiens; identical to SEQ ID NO: 298223

SEQ ID NO: 347119 - RNA, 64 nt, Homo Sapiens; identical to SEQ ID NO: 298224

SEQ ID NO: 347120 - RNA, 64 nt, Homo Sapiens; identical to SEQ ID NO: 298225

SEQ ID NO: 347121 - RNA, 64 nt, Homo Sapiens; identical to SEQ ID NO: 298226

SEQ ID NO: 347122 - RNA, 64 nt, Homo Sapiens; identical to SEQ ID NO: 298227

SEQ ID NO: 347123 - RNA, 64 nt, Homo Sapiens; identical to SEQ ID NO: 298228

SEQ ID NO: 347124 - RNA, 64 nt, Homo Sapiens; identical to SEQ ID NO: 298229

SEQ ID NO: 347125 - RNA, 56 nt, Homo Sapiens; identical to SEQ ID NO: 298230

SEQ ID NO: 347126 - RNA, 64 nt, Homo Sapiens; identical to SEQ ID NO: 298231

SEQ ID NO: 347127 - RNA, 64 nt, Homo Sapiens; identical to SEQ ID NO: 298232

SEQ ID NO: 347128 - RNA, 64 nt, Homo Sapiens; identical to SEQ ID NO: 298233

SEQ ID NO: 347129 - RNA, 64 nt, Homo Sapiens; identical to SEQ ID NO: 298234

SEQ ID NO: 347130 - RNA, 64 nt, Homo Sapiens; identical to SEQ ID NO: 298235

SEQ ID NO: 347131 - RNA, 64 nt, Homo Sapiens; identical to SEQ ID NO: 298236

SEQ ID NO: 347132 - RNA, 64 nt, Homo Sapiens; identical to SEQ ID NO: 298237

SEQ ID NO: 347133 - RNA, 64 nt, Homo Sapiens; identical to SEQ ID NO: 298238

SEQ ID NO: 347134 - RNA, 63 nt, Homo Sapiens; identical to SEQ ID NO: 298239

SEQ ID NO: 347135 - RNA, 64 nt, Homo Sapiens; identical to SEQ ID NO: 298240

SEQ ID NO: 347136 - RNA, 64 nt, Homo Sapiens; identical to SEQ ID NO: 298241

SEQ ID NO: 347137 - RNA, 64 nt, Homo Sapiens; identical to SEQ ID NO: 298242

SEQ ID NO: 347138 - RNA, 64 nt, Homo Sapiens; identical to SEQ ID NO: 298243

SEQ ID NO: 347139 - RNA, 64 nt, Homo Sapiens; identical to SEQ ID NO: 298244

SEQ ID NO: 347140 - RNA, 64 nt, Homo Sapiens; identical to SEQ ID NO: 298245

SEQ ID NO: 347141 - RNA, 64 nt, Homo Sapiens; identical to SEQ ID NO: 298246

SEQ ID NO: 347142 - RNA, 64 nt, Homo Sapiens; identical to SEQ ID NO: 298247

SEQ ID NO: 347143 - RNA, 64 nt, Homo Sapiens; identical to SEQ ID NO: 298248

SEQ ID NO: 347144 - RNA, 64 nt, Homo Sapiens; identical to SEQ ID NO: 298249

SEQ ID NO: 347145 - RNA, 64 nt, Homo Sapiens; identical to SEQ ID NO: 182508

SEQ ID NO: 347146 - RNA, 64 nt, Homo Sapiens; identical to SEQ ID NO: 182509

SEQ ID NO: 347147 - RNA, 64 nt, Homo Sapiens; identical to SEQ ID NO: 182510

SEQ ID NO: 347148 - RNA, 64 nt, Homo Sapiens; identical to SEQ ID NO: 182511

SEQ ID NO: 347149 - RNA, 64 nt, Homo Sapiens; identical to SEQ ID NO: 182512

SEQ ID NO: 347150 - RNA, 64 nt, Homo Sapiens; identical to SEQ ID NO: 182513

SEQ ID NO: 347151 - RNA, 64 nt, Homo Sapiens; identical to SEQ ID NO: 182514

SEQ ID NO: 347152 - RNA, 64 nt, Homo Sapiens; identical to SEQ ID NO: 182515

SEQ ID NO: 347153 - RNA, 64 nt, Homo Sapiens; identical to SEQ ID NO: 182516

SEQ ID NO: 347154 - RNA, 64 nt, Homo Sapiens; identical to SEQ ID NO: 182517

SEQ ID NO: 347155 - RNA, 64 nt, Homo Sapiens; identical to SEQ ID NO: 182518

SEQ ID NO: 347156 - RNA, 64 nt, Homo Sapiens; identical to SEQ ID NO: 182519

SEQ ID NO: 347157 - RNA, 64 nt, Homo Sapiens; identical to SEQ ID NO: 182520

SEQ ID NO: 347158 - RNA, 64 nt, Homo Sapiens; identical to SEQ ID NO: 182521

SEQ ID NO: 347159 - RNA, 64 nt, Homo Sapiens; identical to SEQ ID NO: 182522

SEQ ID NO: 347160 - RNA, 64 nt, Homo Sapiens; identical to SEQ ID NO: 182523

SEQ ID NO: 347161 - RNA, 64 nt, Homo Sapiens; identical to SEQ ID NO: 182524

SEQ ID NO: 347162 - RNA, 64 nt, Homo Sapiens; identical to SEQ ID NO: 182525

SEQ ID NO: 347163 - RNA, 64 nt, Homo Sapiens; identical to SEQ ID NO: 182526

SEQ ID NO: 347164 - RNA, 64 nt, Homo Sapiens; identical to SEQ ID NO: 182527

SEQ ID NO: 347165 - RNA, 64 nt, Homo Sapiens; identical to SEQ ID NO: 182528

SEQ ID NO: 347166 - RNA, 64 nt, Homo Sapiens; identical to SEQ ID NO: 182529

SEQ ID NO: 347167 - RNA, 64 nt, Homo Sapiens; identical to SEQ ID NO: 182530

SEQ ID NO: 347168 - RNA, 64 nt, Homo Sapiens; identical to SEQ ID NO: 182531

SEQ ID NO: 347169 - RNA, 64 nt, Homo Sapiens; identical to SEQ ID NO: 182532

SEQ ID NO: 347170 - RNA, 64 nt, Homo Sapiens; identical to SEQ ID NO: 182533

SEQ ID NO: 347171 - RNA, 64 nt, Homo Sapiens; identical to SEQ ID NO: 182534

SEQ ID NO: 347172 - RNA, 64 nt, Homo Sapiens; identical to SEQ ID NO: 182535

SEQ ID NO: 347173 - RNA, 64 nt, Homo Sapiens; identical to SEQ ID NO: 298158

SEQ ID NO: 347174 - RNA, 64 nt, Homo Sapiens; identical to SEQ ID NO: 298159

SEQ ID NO: 347175 - RNA, 64 nt, Homo Sapiens; identical to SEQ ID NO: 298160

SEQ ID NO: 347176 - RNA, 64 nt, Homo Sapiens; identical to SEQ ID NO: 298161

SEQ ID NO: 347177 - RNA, 64 nt, Homo Sapiens; identical to SEQ ID NO: 298162

SEQ ID NO: 347178 - RNA, 64 nt, Homo Sapiens; identical to SEQ ID NO: 298163

SEQ ID NO: 347179 - RNA, 64 nt, Homo Sapiens; identical to SEQ ID NO: 298164

SEQ ID NO: 347180 - RNA, 64 nt, Homo Sapiens; identical to SEQ ID NO: 298165

SEQ ID NO: 347181 - RNA, 64 nt, Homo Sapiens; identical to SEQ ID NO: 298166

SEQ ID NO: 347182 - RNA, 64 nt, Homo Sapiens; identical to SEQ ID NO: 298167

SEQ ID NO: 347183 - RNA, 64 nt, Homo Sapiens; identical to SEQ ID NO: 298168

SEQ ID NO: 347184 - RNA, 64 nt, Homo Sapiens; identical to SEQ ID NO: 298169

SEQ ID NO: 347185 - RNA, 64 nt, Homo Sapiens; identical to SEQ ID NO: 298170

SEQ ID NO: 347186 - RNA, 64 nt, Homo Sapiens; identical to SEQ ID NO: 298171

SEQ ID NO: 347187 - RNA, 64 nt, Homo Sapiens; identical to SEQ ID NO: 298172

SEQ ID NO: 347188 - RNA, 64 nt, Homo Sapiens; identical to SEQ ID NO: 298173

SEQ ID NO: 347189 - RNA, 64 nt, Homo Sapiens; identical to SEQ ID NO: 298174

SEQ ID NO: 347190 - RNA, 64 nt, Homo Sapiens; identical to SEQ ID NO: 298175

SEQ ID NO: 347191 - RNA, 64 nt, Homo Sapiens; identical to SEQ ID NO: 298176

SEQ ID NO: 347192 - RNA, 64 nt, Homo Sapiens; identical to SEQ ID NO: 298177

SEQ ID NO: 347193 - RNA, 64 nt, Homo Sapiens; identical to SEQ ID NO: 298178

SEQ ID NO: 347194 - RNA, 64 nt, Homo Sapiens; identical to SEQ ID NO: 298179

SEQ ID NO: 347195 - RNA, 64 nt, Homo Sapiens; identical to SEQ ID NO: 298180

SEQ ID NO: 347196 - RNA, 64 nt, Homo Sapiens; identical to SEQ ID NO: 298181

SEQ ID NO: 347197 - RNA, 64 nt, Homo Sapiens; identical to SEQ ID NO: 298182

SEQ ID NO: 347198 - RNA, 64 nt, Homo Sapiens; identical to SEQ ID NO: 298183

SEQ ID NO: 347199 - RNA, 64 nt, Homo Sapiens; identical to SEQ ID NO: 298184

SEQ ID NO: 347200 - RNA, 64 nt, Homo Sapiens; identical to SEQ ID NO: 298185

SEQ ID NO: 347201 - RNA, 64 nt, Homo Sapiens; identical to SEQ ID NO: 298186

SEQ ID NO: 347202 - RNA, 64 nt, Homo Sapiens; identical to SEQ ID NO: 298187

SEQ ID NO: 347203 - RNA, 64 nt, Homo Sapiens; identical to SEQ ID NO: 298188

SEQ ID NO: 347204 - RNA, 64 nt, Homo Sapiens; identical to SEQ ID NO: 298189

SEQ ID NO: 347205 - RNA, 64 nt, Homo Sapiens; identical to SEQ ID NO: 298190

SEQ ID NO: 347206 - RNA, 64 nt, Homo Sapiens; identical to SEQ ID NO: 298191

SEQ ID NO: 347207 - RNA, 64 nt, Homo Sapiens; identical to SEQ ID NO: 298192

SEQ ID NO: 347208 - RNA, 64 nt, Homo Sapiens; identical to SEQ ID NO: 298193

SEQ ID NO: 347209 - RNA, 64 nt, Homo Sapiens; identical to SEQ ID NO: 298194

SEQ ID NO: 347210 - RNA, 64 nt, Homo Sapiens; identical to SEQ ID NO: 298195

SEQ ID NO: 347211 - RNA, 64 nt, Homo Sapiens; identical to SEQ ID NO: 298196

SEQ ID NO: 347212 - RNA, 64 nt, Homo Sapiens; identical to SEQ ID NO: 298197

SEQ ID NO: 347213 - RNA, 64 nt, Homo Sapiens; identical to SEQ ID NO: 298198

SEQ ID NO: 347214 - RNA, 64 nt, Homo Sapiens; identical to SEQ ID NO: 298199

SEQ ID NO: 347215 - RNA, 64 nt, Homo Sapiens; identical to SEQ ID NO: 298200

SEQ ID NO: 347216 - RNA, 64 nt, Homo Sapiens; identical to SEQ ID NO: 298201

SEQ ID NO: 347217 - RNA, 64 nt, Homo Sapiens; identical to SEQ ID NO: 298202

SEQ ID NO: 347218 - RNA, 64 nt, Homo Sapiens; identical to SEQ ID NO: 298203

SEQ ID NO: 347219 - RNA, 64 nt, Homo Sapiens; identical to SEQ ID NO: 298204

SEQ ID NO: 347220 - RNA, 64 nt, Homo Sapiens; identical to SEQ ID NO: 298205

SEQ ID NO: 347221 - RNA, 64 nt, Homo Sapiens; identical to SEQ ID NO: 298206

SEQ ID NO: 347222 - RNA, 64 nt, Homo Sapiens; identical to SEQ ID NO: 298207

SEQ ID NO: 347223 - RNA, 64 nt, Homo Sapiens; identical to SEQ ID NO: 298208

SEQ ID NO: 347224 - RNA, 64 nt, Homo Sapiens; identical to SEQ ID NO: 298209

SEQ ID NO: 347225 - RNA, 64 nt, Homo Sapiens; identical to SEQ ID NO: 298210

SEQ ID NO: 347226 - RNA, 64 nt, Homo Sapiens; identical to SEQ ID NO: 298211

SEQ ID NO: 347227 - RNA, 64 nt, Homo Sapiens; identical to SEQ ID NO: 298212

SEQ ID NO: 347228 - RNA, 64 nt, Homo Sapiens; identical to SEQ ID NO: 298213

SEQ ID NO: 347229 - RNA, 64 nt, Homo Sapiens; identical to SEQ ID NO: 298214

SEQ ID NO: 347230 - RNA, 64 nt, Homo Sapiens; identical to SEQ ID NO: 298215

SEQ ID NO: 347231 - RNA, 64 nt, Homo Sapiens; identical to SEQ ID NO: 298216

SEQ ID NO: 347232 - RNA, 64 nt, Homo Sapiens; identical to SEQ ID NO: 298217

SEQ ID NO: 347233 - RNA, 64 nt, Homo Sapiens; identical to SEQ ID NO: 298218

SEQ ID NO: 347234 - RNA, 64 nt, Homo Sapiens; identical to SEQ ID NO: 298219

SEQ ID NO: 347235 - RNA, 64 nt, Homo Sapiens; identical to SEQ ID NO: 298220

SEQ ID NO: 347236 - RNA, 64 nt, Homo Sapiens; identical to SEQ ID NO: 298221

SEQ ID NO: 347237 - RNA, 64 nt, Homo Sapiens; identical to SEQ ID NO: 298222

SEQ ID NO: 347238 - RNA, 64 nt, Homo Sapiens; identical to SEQ ID NO: 298223

SEQ ID NO: 347239 - RNA, 64 nt, Homo Sapiens; identical to SEQ ID NO: 298224

SEQ ID NO: 347240 - RNA, 64 nt, Homo Sapiens; identical to SEQ ID NO: 298225

SEQ ID NO: 347241 - RNA, 64 nt, Homo Sapiens; identical to SEQ ID NO: 298226

SEQ ID NO: 347242 - RNA, 64 nt, Homo Sapiens; identical to SEQ ID NO: 298227

SEQ ID NO: 347243 - RNA, 64 nt, Homo Sapiens; identical to SEQ ID NO: 298228

SEQ ID NO: 347244 - RNA, 64 nt, Homo Sapiens; identical to SEQ ID NO: 298229

SEQ ID NO: 347245 - RNA, 56 nt, Homo Sapiens; identical to SEQ ID NO: 298230

SEQ ID NO: 347246 - RNA, 64 nt, Homo Sapiens; identical to SEQ ID NO: 298231

SEQ ID NO: 347247 - RNA, 64 nt, Homo Sapiens; identical to SEQ ID NO: 298232

SEQ ID NO: 347248 - RNA, 64 nt, Homo Sapiens; identical to SEQ ID NO: 298233

SEQ ID NO: 347249 - RNA, 64 nt, Homo Sapiens; identical to SEQ ID NO: 298234

SEQ ID NO: 347250 - RNA, 64 nt, Homo Sapiens; identical to SEQ ID NO: 298235

SEQ ID NO: 347251 - RNA, 64 nt, Homo Sapiens; identical to SEQ ID NO: 298236

SEQ ID NO: 347252 - RNA, 64 nt, Homo Sapiens; identical to SEQ ID NO: 298237

SEQ ID NO: 347253 - RNA, 64 nt, Homo Sapiens; identical to SEQ ID NO: 298238

SEQ ID NO: 347254 - RNA, 63 nt, Homo Sapiens; identical to SEQ ID NO: 298239

SEQ ID NO: 347255 - RNA, 64 nt, Homo Sapiens; identical to SEQ ID NO: 298240

SEQ ID NO: 347256 - RNA, 64 nt, Homo Sapiens; identical to SEQ ID NO: 298241

SEQ ID NO: 347257 - RNA, 64 nt, Homo Sapiens; identical to SEQ ID NO: 298242

SEQ ID NO: 347258 - RNA, 64 nt, Homo Sapiens; identical to SEQ ID NO: 298243

SEQ ID NO: 347259 - RNA, 64 nt, Homo Sapiens; identical to SEQ ID NO: 298244

SEQ ID NO: 347260 - RNA, 64 nt, Homo Sapiens; identical to SEQ ID NO: 298245

SEQ ID NO: 347261 - RNA, 64 nt, Homo Sapiens; identical to SEQ ID NO: 298246

SEQ ID NO: 347262 - RNA, 64 nt, Homo Sapiens; identical to SEQ ID NO: 298247

SEQ ID NO: 347263 - RNA, 64 nt, Homo Sapiens; identical to SEQ ID NO: 298248

SEQ ID NO: 347264 - RNA, 64 nt, Homo Sapiens; identical to SEQ ID NO: 298249

SEQ ID NO: 347265 - RNA, 64 nt, Homo Sapiens; identical to SEQ ID NO: 182508

SEQ ID NO: 347266 - RNA, 64 nt, Homo Sapiens; identical to SEQ ID NO: 182509

SEQ ID NO: 347267 - RNA, 64 nt, Homo Sapiens; identical to SEQ ID NO: 182510

SEQ ID NO: 347268 - RNA, 64 nt, Homo Sapiens; identical to SEQ ID NO: 182511

SEQ ID NO: 347269 - RNA, 64 nt, Homo Sapiens; identical to SEQ ID NO: 182512

SEQ ID NO: 347270 - RNA, 64 nt, Homo Sapiens; identical to SEQ ID NO: 182513

SEQ ID NO: 347271 - RNA, 64 nt, Homo Sapiens; identical to SEQ ID NO: 182514

SEQ ID NO: 347272 - RNA, 64 nt, Homo Sapiens; identical to SEQ ID NO: 182515

SEQ ID NO: 347273 - RNA, 64 nt, Homo Sapiens; identical to SEQ ID NO: 182516

SEQ ID NO: 347274 - RNA, 64 nt, Homo Sapiens; identical to SEQ ID NO: 182517

SEQ ID NO: 347275 - RNA, 64 nt, Homo Sapiens; identical to SEQ ID NO: 182518

SEQ ID NO: 347276 - RNA, 64 nt, Homo Sapiens; identical to SEQ ID NO: 182519

SEQ ID NO: 347277 - RNA, 64 nt, Homo Sapiens; identical to SEQ ID NO: 182520

SEQ ID NO: 347278 - RNA, 64 nt, Homo Sapiens; identical to SEQ ID NO: 182521

SEQ ID NO: 347279 - RNA, 64 nt, Homo Sapiens; identical to SEQ ID NO: 182522

SEQ ID NO: 347280 - RNA, 64 nt, Homo Sapiens; identical to SEQ ID NO: 182523

SEQ ID NO: 347281 - RNA, 64 nt, Homo Sapiens; identical to SEQ ID NO: 182524

SEQ ID NO: 347282 - RNA, 64 nt, Homo Sapiens; identical to SEQ ID NO: 182525

SEQ ID NO: 347283 - RNA, 64 nt, Homo Sapiens; identical to SEQ ID NO: 182526

SEQ ID NO: 347284 - RNA, 64 nt, Homo Sapiens; identical to SEQ ID NO: 182527

SEQ ID NO: 347285 - RNA, 64 nt, Homo Sapiens; identical to SEQ ID NO: 182528

SEQ ID NO: 347286 - RNA, 64 nt, Homo Sapiens; identical to SEQ ID NO: 182529

SEQ ID NO: 347287 - RNA, 64 nt, Homo Sapiens; identical to SEQ ID NO: 182530

SEQ ID NO: 347288 - RNA, 64 nt, Homo Sapiens; identical to SEQ ID NO: 182531

SEQ ID NO: 347289 - RNA, 64 nt, Homo Sapiens; identical to SEQ ID NO: 182532

SEQ ID NO: 347290 - RNA, 64 nt, Homo Sapiens; identical to SEQ ID NO: 182533

SEQ ID NO: 347291 - RNA, 64 nt, Homo Sapiens; identical to SEQ ID NO: 182534

SEQ ID NO: 347292 - RNA, 64 nt, Homo Sapiens; identical to SEQ ID NO: 182535

SEQ ID NO: 347293 - RNA, 64 nt, Homo Sapiens; identical to SEQ ID NO: 298158

SEQ ID NO: 347294 - RNA, 64 nt, Homo Sapiens; identical to SEQ ID NO: 298159

SEQ ID NO: 347295 - RNA, 64 nt, Homo Sapiens; identical to SEQ ID NO: 298160

SEQ ID NO: 347296 - RNA, 64 nt, Homo Sapiens; identical to SEQ ID NO: 298161

SEQ ID NO: 347297 - RNA, 64 nt, Homo Sapiens; identical to SEQ ID NO: 298162

SEQ ID NO: 347298 - RNA, 64 nt, Homo Sapiens; identical to SEQ ID NO: 298163

SEQ ID NO: 347299 - RNA, 64 nt, Homo Sapiens; identical to SEQ ID NO: 298164

SEQ ID NO: 347300 - RNA, 64 nt, Homo Sapiens; identical to SEQ ID NO: 298165

SEQ ID NO: 347301 - RNA, 64 nt, Homo Sapiens; identical to SEQ ID NO: 298166

SEQ ID NO: 347302 - RNA, 64 nt, Homo Sapiens; identical to SEQ ID NO: 298167

SEQ ID NO: 347303 - RNA, 64 nt, Homo Sapiens; identical to SEQ ID NO: 298168

SEQ ID NO: 347304 - RNA, 64 nt, Homo Sapiens; identical to SEQ ID NO: 298169

SEQ ID NO: 347305 - RNA, 64 nt, Homo Sapiens; identical to SEQ ID NO: 298170

SEQ ID NO: 347306 - RNA, 64 nt, Homo Sapiens; identical to SEQ ID NO: 298171

SEQ ID NO: 347307 - RNA, 64 nt, Homo Sapiens; identical to SEQ ID NO: 298172

SEQ ID NO: 347308 - RNA, 64 nt, Homo Sapiens; identical to SEQ ID NO: 298173

SEQ ID NO: 347309 - RNA, 64 nt, Homo Sapiens; identical to SEQ ID NO: 298174

SEQ ID NO: 347310 - RNA, 64 nt, Homo Sapiens; identical to SEQ ID NO: 298175

SEQ ID NO: 347311 - RNA, 64 nt, Homo Sapiens; identical to SEQ ID NO: 298176

SEQ ID NO: 347312 - RNA, 64 nt, Homo Sapiens; identical to SEQ ID NO: 298177

SEQ ID NO: 347313 - RNA, 64 nt, Homo Sapiens; identical to SEQ ID NO: 298178

SEQ ID NO: 347314 - RNA, 64 nt, Homo Sapiens; identical to SEQ ID NO: 298179

SEQ ID NO: 347315 - RNA, 64 nt, Homo Sapiens; identical to SEQ ID NO: 298180

SEQ ID NO: 347316 - RNA, 64 nt, Homo Sapiens; identical to SEQ ID NO: 298181

SEQ ID NO: 347317 - RNA, 64 nt, Homo Sapiens; identical to SEQ ID NO: 298182

SEQ ID NO: 347318 - RNA, 64 nt, Homo Sapiens; identical to SEQ ID NO: 298183

SEQ ID NO: 347319 - RNA, 64 nt, Homo Sapiens; identical to SEQ ID NO: 298184

SEQ ID NO: 347320 - RNA, 64 nt, Homo Sapiens; identical to SEQ ID NO: 298185

SEQ ID NO: 347321 - RNA, 64 nt, Homo Sapiens; identical to SEQ ID NO: 298186

SEQ ID NO: 347322 - RNA, 64 nt, Homo Sapiens; identical to SEQ ID NO: 298187

SEQ ID NO: 347323 - RNA, 64 nt, Homo Sapiens; identical to SEQ ID NO: 298188

SEQ ID NO: 347324 - RNA, 64 nt, Homo Sapiens; identical to SEQ ID NO: 298189

SEQ ID NO: 347325 - RNA, 64 nt, Homo Sapiens; identical to SEQ ID NO: 298190

SEQ ID NO: 347326 - RNA, 64 nt, Homo Sapiens; identical to SEQ ID NO: 298191

SEQ ID NO: 347327 - RNA, 64 nt, Homo Sapiens; identical to SEQ ID NO: 298192

SEQ ID NO: 347328 - RNA, 64 nt, Homo Sapiens; identical to SEQ ID NO: 298193

SEQ ID NO: 347329 - RNA, 64 nt, Homo Sapiens; identical to SEQ ID NO: 298194

SEQ ID NO: 347330 - RNA, 64 nt, Homo Sapiens; identical to SEQ ID NO: 298195

SEQ ID NO: 347331 - RNA, 64 nt, Homo Sapiens; identical to SEQ ID NO: 298196

SEQ ID NO: 347332 - RNA, 64 nt, Homo Sapiens; identical to SEQ ID NO: 298197

SEQ ID NO: 347333 - RNA, 64 nt, Homo Sapiens; identical to SEQ ID NO: 298198

SEQ ID NO: 347334 - RNA, 64 nt, Homo Sapiens; identical to SEQ ID NO: 298199

SEQ ID NO: 347335 - RNA, 64 nt, Homo Sapiens; identical to SEQ ID NO: 298200

SEQ ID NO: 347336 - RNA, 64 nt, Homo Sapiens; identical to SEQ ID NO: 298201

SEQ ID NO: 347337 - RNA, 64 nt, Homo Sapiens; identical to SEQ ID NO: 298202

SEQ ID NO: 347338 - RNA, 64 nt, Homo Sapiens; identical to SEQ ID NO: 298203

SEQ ID NO: 347339 - RNA, 64 nt, Homo Sapiens; identical to SEQ ID NO: 298204

SEQ ID NO: 347340 - RNA, 64 nt, Homo Sapiens; identical to SEQ ID NO: 298205

SEQ ID NO: 347341 - RNA, 64 nt, Homo Sapiens; identical to SEQ ID NO: 298206

SEQ ID NO: 347342 - RNA, 64 nt, Homo Sapiens; identical to SEQ ID NO: 298207

SEQ ID NO: 347343 - RNA, 64 nt, Homo Sapiens; identical to SEQ ID NO: 298208

SEQ ID NO: 347344 - RNA, 64 nt, Homo Sapiens; identical to SEQ ID NO: 298209

SEQ ID NO: 347345 - RNA, 64 nt, Homo Sapiens; identical to SEQ ID NO: 298210

SEQ ID NO: 347346 - RNA, 64 nt, Homo Sapiens; identical to SEQ ID NO: 298211

SEQ ID NO: 347347 - RNA, 64 nt, Homo Sapiens; identical to SEQ ID NO: 298212

SEQ ID NO: 347348 - RNA, 64 nt, Homo Sapiens; identical to SEQ ID NO: 298213

SEQ ID NO: 347349 - RNA, 64 nt, Homo Sapiens; identical to SEQ ID NO: 298214

SEQ ID NO: 347350 - RNA, 64 nt, Homo Sapiens; identical to SEQ ID NO: 298215

SEQ ID NO: 347351 - RNA, 64 nt, Homo Sapiens; identical to SEQ ID NO: 298216

SEQ ID NO: 347352 - RNA, 64 nt, Homo Sapiens; identical to SEQ ID NO: 298217

SEQ ID NO: 347353 - RNA, 64 nt, Homo Sapiens; identical to SEQ ID NO: 298218

SEQ ID NO: 347354 - RNA, 64 nt, Homo Sapiens; identical to SEQ ID NO: 298219

SEQ ID NO: 347355 - RNA, 64 nt, Homo Sapiens; identical to SEQ ID NO: 298220

SEQ ID NO: 347356 - RNA, 64 nt, Homo Sapiens; identical to SEQ ID NO: 298221

SEQ ID NO: 347357 - RNA, 64 nt, Homo Sapiens; identical to SEQ ID NO: 298222

SEQ ID NO: 347358 - RNA, 64 nt, Homo Sapiens; identical to SEQ ID NO: 298223

SEQ ID NO: 347359 - RNA, 64 nt, Homo Sapiens; identical to SEQ ID NO: 298224

SEQ ID NO: 347360 - RNA, 64 nt, Homo Sapiens; identical to SEQ ID NO: 298225

SEQ ID NO: 347361 - RNA, 64 nt, Homo Sapiens; identical to SEQ ID NO: 298226

SEQ ID NO: 347362 - RNA, 64 nt, Homo Sapiens; identical to SEQ ID NO: 298227

SEQ ID NO: 347363 - RNA, 64 nt, Homo Sapiens; identical to SEQ ID NO: 298228

SEQ ID NO: 347364 - RNA, 64 nt, Homo Sapiens; identical to SEQ ID NO: 298229

SEQ ID NO: 347365 - RNA, 56 nt, Homo Sapiens; identical to SEQ ID NO: 298230

SEQ ID NO: 347366 - RNA, 64 nt, Homo Sapiens; identical to SEQ ID NO: 298231

SEQ ID NO: 347367 - RNA, 64 nt, Homo Sapiens; identical to SEQ ID NO: 298232

SEQ ID NO: 347368 - RNA, 64 nt, Homo Sapiens; identical to SEQ ID NO: 298233

SEQ ID NO: 347369 - RNA, 64 nt, Homo Sapiens; identical to SEQ ID NO: 298234

SEQ ID NO: 347370 - RNA, 64 nt, Homo Sapiens; identical to SEQ ID NO: 298235

SEQ ID NO: 347371 - RNA, 64 nt, Homo Sapiens; identical to SEQ ID NO: 298236

SEQ ID NO: 347372 - RNA, 64 nt, Homo Sapiens; identical to SEQ ID NO: 298237

SEQ ID NO: 347373 - RNA, 64 nt, Homo Sapiens; identical to SEQ ID NO: 298238

SEQ ID NO: 347374 - RNA, 63 nt, Homo Sapiens; identical to SEQ ID NO: 298239

SEQ ID NO: 347375 - RNA, 64 nt, Homo Sapiens; identical to SEQ ID NO: 298240

SEQ ID NO: 347376 - RNA, 64 nt, Homo Sapiens; identical to SEQ ID NO: 298241

SEQ ID NO: 347377 - RNA, 64 nt, Homo Sapiens; identical to SEQ ID NO: 298242

SEQ ID NO: 347378 - RNA, 64 nt, Homo Sapiens; identical to SEQ ID NO: 298243

SEQ ID NO: 347379 - RNA, 64 nt, Homo Sapiens; identical to SEQ ID NO: 298244

SEQ ID NO: 347380 - RNA, 64 nt, Homo Sapiens; identical to SEQ ID NO: 298245

SEQ ID NO: 347381 - RNA, 64 nt, Homo Sapiens; identical to SEQ ID NO: 298246

SEQ ID NO: 347382 - RNA, 64 nt, Homo Sapiens; identical to SEQ ID NO: 298247

SEQ ID NO: 347383 - RNA, 64 nt, Homo Sapiens; identical to SEQ ID NO: 298248

SEQ ID NO: 347384 - RNA, 64 nt, Homo Sapiens; identical to SEQ ID NO: 298249

SEQ ID NO: 347385 - RNA, 64 nt, Homo Sapiens; identical to SEQ ID NO: 182508

SEQ ID NO: 347386 - RNA, 64 nt, Homo Sapiens; identical to SEQ ID NO: 182509

SEQ ID NO: 347387 - RNA, 64 nt, Homo Sapiens; identical to SEQ ID NO: 182510

SEQ ID NO: 347388 - RNA, 64 nt, Homo Sapiens; identical to SEQ ID NO: 182511

SEQ ID NO: 347389 - RNA, 64 nt, Homo Sapiens; identical to SEQ ID NO: 182512

SEQ ID NO: 347390 - RNA, 64 nt, Homo Sapiens; identical to SEQ ID NO: 182513

SEQ ID NO: 347391 - RNA, 64 nt, Homo Sapiens; identical to SEQ ID NO: 182514

SEQ ID NO: 347392 - RNA, 64 nt, Homo Sapiens; identical to SEQ ID NO: 182515

SEQ ID NO: 347393 - RNA, 64 nt, Homo Sapiens; identical to SEQ ID NO: 182516

SEQ ID NO: 347394 - RNA, 64 nt, Homo Sapiens; identical to SEQ ID NO: 182517

SEQ ID NO: 347395 - RNA, 64 nt, Homo Sapiens; identical to SEQ ID NO: 182518

SEQ ID NO: 347396 - RNA, 64 nt, Homo Sapiens; identical to SEQ ID NO: 182519

SEQ ID NO: 347397 - RNA, 64 nt, Homo Sapiens; identical to SEQ ID NO: 182520

SEQ ID NO: 347398 - RNA, 64 nt, Homo Sapiens; identical to SEQ ID NO: 182521

SEQ ID NO: 347399 - RNA, 64 nt, Homo Sapiens; identical to SEQ ID NO: 182522

SEQ ID NO: 347400 - RNA, 64 nt, Homo Sapiens; identical to SEQ ID NO: 182523

SEQ ID NO: 347401 - RNA, 64 nt, Homo Sapiens; identical to SEQ ID NO: 182524

SEQ ID NO: 347402 - RNA, 64 nt, Homo Sapiens; identical to SEQ ID NO: 182525

SEQ ID NO: 347403 - RNA, 64 nt, Homo Sapiens; identical to SEQ ID NO: 182526

SEQ ID NO: 347404 - RNA, 64 nt, Homo Sapiens; identical to SEQ ID NO: 182527

SEQ ID NO: 347405 - RNA, 64 nt, Homo Sapiens; identical to SEQ ID NO: 182528

SEQ ID NO: 347406 - RNA, 64 nt, Homo Sapiens; identical to SEQ ID NO: 182529

SEQ ID NO: 347407 - RNA, 64 nt, Homo Sapiens; identical to SEQ ID NO: 182530

SEQ ID NO: 347408 - RNA, 64 nt, Homo Sapiens; identical to SEQ ID NO: 182531

SEQ ID NO: 347409 - RNA, 64 nt, Homo Sapiens; identical to SEQ ID NO: 182532

SEQ ID NO: 347410 - RNA, 64 nt, Homo Sapiens; identical to SEQ ID NO: 182533

SEQ ID NO: 347411 - RNA, 64 nt, Homo Sapiens; identical to SEQ ID NO: 182534

SEQ ID NO: 347412 - RNA, 64 nt, Homo Sapiens; identical to SEQ ID NO: 182535

SEQ ID NO: 347413 - RNA, 64 nt, Homo Sapiens; identical to SEQ ID NO: 298158

SEQ ID NO: 347414 - RNA, 64 nt, Homo Sapiens; identical to SEQ ID NO: 298159

SEQ ID NO: 347415 - RNA, 64 nt, Homo Sapiens; identical to SEQ ID NO: 298160

SEQ ID NO: 347416 - RNA, 64 nt, Homo Sapiens; identical to SEQ ID NO: 298161

SEQ ID NO: 347417 - RNA, 64 nt, Homo Sapiens; identical to SEQ ID NO: 298162

SEQ ID NO: 347418 - RNA, 64 nt, Homo Sapiens; identical to SEQ ID NO: 298163

SEQ ID NO: 347419 - RNA, 64 nt, Homo Sapiens; identical to SEQ ID NO: 298164

SEQ ID NO: 347420 - RNA, 64 nt, Homo Sapiens; identical to SEQ ID NO: 298165

SEQ ID NO: 347421 - RNA, 64 nt, Homo Sapiens; identical to SEQ ID NO: 298166

SEQ ID NO: 347422 - RNA, 64 nt, Homo Sapiens; identical to SEQ ID NO: 298167

SEQ ID NO: 347423 - RNA, 64 nt, Homo Sapiens; identical to SEQ ID NO: 298168

SEQ ID NO: 347424 - RNA, 64 nt, Homo Sapiens; identical to SEQ ID NO: 298169

SEQ ID NO: 347425 - RNA, 64 nt, Homo Sapiens; identical to SEQ ID NO: 298170

SEQ ID NO: 347426 - RNA, 64 nt, Homo Sapiens; identical to SEQ ID NO: 298171

SEQ ID NO: 347427 - RNA, 64 nt, Homo Sapiens; identical to SEQ ID NO: 298172

SEQ ID NO: 347428 - RNA, 64 nt, Homo Sapiens; identical to SEQ ID NO: 298173

SEQ ID NO: 347429 - RNA, 64 nt, Homo Sapiens; identical to SEQ ID NO: 298174

SEQ ID NO: 347430 - RNA, 64 nt, Homo Sapiens; identical to SEQ ID NO: 298175

SEQ ID NO: 347431 - RNA, 64 nt, Homo Sapiens; identical to SEQ ID NO: 298176

SEQ ID NO: 347432 - RNA, 64 nt, Homo Sapiens; identical to SEQ ID NO: 298177

SEQ ID NO: 347433 - RNA, 64 nt, Homo Sapiens; identical to SEQ ID NO: 298178

SEQ ID NO: 347434 - RNA, 64 nt, Homo Sapiens; identical to SEQ ID NO: 298179

SEQ ID NO: 347435 - RNA, 64 nt, Homo Sapiens; identical to SEQ ID NO: 298180

SEQ ID NO: 347436 - RNA, 64 nt, Homo Sapiens; identical to SEQ ID NO: 298181

SEQ ID NO: 347437 - RNA, 64 nt, Homo Sapiens; identical to SEQ ID NO: 298182

SEQ ID NO: 347438 - RNA, 64 nt, Homo Sapiens; identical to SEQ ID NO: 298183

SEQ ID NO: 347439 - RNA, 64 nt, Homo Sapiens; identical to SEQ ID NO: 298184

SEQ ID NO: 347440 - RNA, 64 nt, Homo Sapiens; identical to SEQ ID NO: 298185

SEQ ID NO: 347441 - RNA, 64 nt, Homo Sapiens; identical to SEQ ID NO: 298186

SEQ ID NO: 347442 - RNA, 64 nt, Homo Sapiens; identical to SEQ ID NO: 298187

SEQ ID NO: 347443 - RNA, 64 nt, Homo Sapiens; identical to SEQ ID NO: 298188

SEQ ID NO: 347444 - RNA, 64 nt, Homo Sapiens; identical to SEQ ID NO: 298189

SEQ ID NO: 347445 - RNA, 64 nt, Homo Sapiens; identical to SEQ ID NO: 298190

SEQ ID NO: 347446 - RNA, 64 nt, Homo Sapiens; identical to SEQ ID NO: 298191

SEQ ID NO: 347447 - RNA, 64 nt, Homo Sapiens; identical to SEQ ID NO: 298192

SEQ ID NO: 347448 - RNA, 64 nt, Homo Sapiens; identical to SEQ ID NO: 298193

SEQ ID NO: 347449 - RNA, 64 nt, Homo Sapiens; identical to SEQ ID NO: 298194

SEQ ID NO: 347450 - RNA, 64 nt, Homo Sapiens; identical to SEQ ID NO: 298195

SEQ ID NO: 347451 - RNA, 64 nt, Homo Sapiens; identical to SEQ ID NO: 298196

SEQ ID NO: 347452 - RNA, 64 nt, Homo Sapiens; identical to SEQ ID NO: 298197

SEQ ID NO: 347453 - RNA, 64 nt, Homo Sapiens; identical to SEQ ID NO: 298198

SEQ ID NO: 347454 - RNA, 64 nt, Homo Sapiens; identical to SEQ ID NO: 298199

SEQ ID NO: 347455 - RNA, 64 nt, Homo Sapiens; identical to SEQ ID NO: 298200

SEQ ID NO: 347456 - RNA, 64 nt, Homo Sapiens; identical to SEQ ID NO: 298201

SEQ ID NO: 347457 - RNA, 64 nt, Homo Sapiens; identical to SEQ ID NO: 298202

SEQ ID NO: 347458 - RNA, 64 nt, Homo Sapiens; identical to SEQ ID NO: 298203

SEQ ID NO: 347459 - RNA, 64 nt, Homo Sapiens; identical to SEQ ID NO: 298204

SEQ ID NO: 347460 - RNA, 64 nt, Homo Sapiens; identical to SEQ ID NO: 298205

SEQ ID NO: 347461 - RNA, 64 nt, Homo Sapiens; identical to SEQ ID NO: 298206

SEQ ID NO: 347462 - RNA, 64 nt, Homo Sapiens; identical to SEQ ID NO: 298207

SEQ ID NO: 347463 - RNA, 64 nt, Homo Sapiens; identical to SEQ ID NO: 298208

SEQ ID NO: 347464 - RNA, 64 nt, Homo Sapiens; identical to SEQ ID NO: 298209

SEQ ID NO: 347465 - RNA, 64 nt, Homo Sapiens; identical to SEQ ID NO: 298210

SEQ ID NO: 347466 - RNA, 64 nt, Homo Sapiens; identical to SEQ ID NO: 298211

SEQ ID NO: 347467 - RNA, 64 nt, Homo Sapiens; identical to SEQ ID NO: 298212

SEQ ID NO: 347468 - RNA, 64 nt, Homo Sapiens; identical to SEQ ID NO: 298213

SEQ ID NO: 347469 - RNA, 64 nt, Homo Sapiens; identical to SEQ ID NO: 298214

SEQ ID NO: 347470 - RNA, 64 nt, Homo Sapiens; identical to SEQ ID NO: 298215

SEQ ID NO: 347471 - RNA, 64 nt, Homo Sapiens; identical to SEQ ID NO: 298216

SEQ ID NO: 347472 - RNA, 64 nt, Homo Sapiens; identical to SEQ ID NO: 298217

SEQ ID NO: 347473 - RNA, 64 nt, Homo Sapiens; identical to SEQ ID NO: 298218

SEQ ID NO: 347474 - RNA, 64 nt, Homo Sapiens; identical to SEQ ID NO: 298219

SEQ ID NO: 347475 - RNA, 64 nt, Homo Sapiens; identical to SEQ ID NO: 298220

SEQ ID NO: 347476 - RNA, 64 nt, Homo Sapiens; identical to SEQ ID NO: 298221

SEQ ID NO: 347477 - RNA, 64 nt, Homo Sapiens; identical to SEQ ID NO: 298222

SEQ ID NO: 347478 - RNA, 64 nt, Homo Sapiens; identical to SEQ ID NO: 298223

SEQ ID NO: 347479 - RNA, 64 nt, Homo Sapiens; identical to SEQ ID NO: 298224

SEQ ID NO: 347480 - RNA, 64 nt, Homo Sapiens; identical to SEQ ID NO: 298225

SEQ ID NO: 347481 - RNA, 64 nt, Homo Sapiens; identical to SEQ ID NO: 298226

SEQ ID NO: 347482 - RNA, 64 nt, Homo Sapiens; identical to SEQ ID NO: 298227

SEQ ID NO: 347483 - RNA, 64 nt, Homo Sapiens; identical to SEQ ID NO: 298228

SEQ ID NO: 347484 - RNA, 64 nt, Homo Sapiens; identical to SEQ ID NO: 298229

SEQ ID NO: 347485 - RNA, 56 nt, Homo Sapiens; identical to SEQ ID NO: 298230

SEQ ID NO: 347486 - RNA, 64 nt, Homo Sapiens; identical to SEQ ID NO: 298231

SEQ ID NO: 347487 - RNA, 64 nt, Homo Sapiens; identical to SEQ ID NO: 298232

SEQ ID NO: 347488 - RNA, 64 nt, Homo Sapiens; identical to SEQ ID NO: 298233

SEQ ID NO: 347489 - RNA, 64 nt, Homo Sapiens; identical to SEQ ID NO: 298234

SEQ ID NO: 347490 - RNA, 64 nt, Homo Sapiens; identical to SEQ ID NO: 298235

SEQ ID NO: 347491 - RNA, 64 nt, Homo Sapiens; identical to SEQ ID NO: 298236

SEQ ID NO: 347492 - RNA, 64 nt, Homo Sapiens; identical to SEQ ID NO: 298237

SEQ ID NO: 347493 - RNA, 64 nt, Homo Sapiens; identical to SEQ ID NO: 298238

SEQ ID NO: 347494 - RNA, 63 nt, Homo Sapiens; identical to SEQ ID NO: 298239

SEQ ID NO: 347495 - RNA, 64 nt, Homo Sapiens; identical to SEQ ID NO: 298240

SEQ ID NO: 347496 - RNA, 64 nt, Homo Sapiens; identical to SEQ ID NO: 298241

SEQ ID NO: 347497 - RNA, 64 nt, Homo Sapiens; identical to SEQ ID NO: 298242

SEQ ID NO: 347498 - RNA, 64 nt, Homo Sapiens; identical to SEQ ID NO: 298243

SEQ ID NO: 347499 - RNA, 64 nt, Homo Sapiens; identical to SEQ ID NO: 298244

SEQ ID NO: 347500 - RNA, 64 nt, Homo Sapiens; identical to SEQ ID NO: 298245

SEQ ID NO: 347501 - RNA, 64 nt, Homo Sapiens; identical to SEQ ID NO: 298246

SEQ ID NO: 347502 - RNA, 64 nt, Homo Sapiens; identical to SEQ ID NO: 298247

SEQ ID NO: 347503 - RNA, 64 nt, Homo Sapiens; identical to SEQ ID NO: 298248

SEQ ID NO: 347504 - RNA, 64 nt, Homo Sapiens; identical to SEQ ID NO: 298249

SEQ ID NO: 347505 - RNA, 64 nt, Homo Sapiens; identical to SEQ ID NO: 182508

SEQ ID NO: 347506 - RNA, 64 nt, Homo Sapiens; identical to SEQ ID NO: 182509

SEQ ID NO: 347507 - RNA, 64 nt, Homo Sapiens; identical to SEQ ID NO: 182510

SEQ ID NO: 347508 - RNA, 64 nt, Homo Sapiens; identical to SEQ ID NO: 182511

SEQ ID NO: 347509 - RNA, 64 nt, Homo Sapiens; identical to SEQ ID NO: 182512

SEQ ID NO: 347510 - RNA, 64 nt, Homo Sapiens; identical to SEQ ID NO: 182513

SEQ ID NO: 347511 - RNA, 64 nt, Homo Sapiens; identical to SEQ ID NO: 182514

SEQ ID NO: 347512 - RNA, 64 nt, Homo Sapiens; identical to SEQ ID NO: 182515

SEQ ID NO: 347513 - RNA, 64 nt, Homo Sapiens; identical to SEQ ID NO: 182516

SEQ ID NO: 347514 - RNA, 64 nt, Homo Sapiens; identical to SEQ ID NO: 182517

SEQ ID NO: 347515 - RNA, 64 nt, Homo Sapiens; identical to SEQ ID NO: 182518

SEQ ID NO: 347516 - RNA, 64 nt, Homo Sapiens; identical to SEQ ID NO: 182519

SEQ ID NO: 347517 - RNA, 64 nt, Homo Sapiens; identical to SEQ ID NO: 182520

SEQ ID NO: 347518 - RNA, 64 nt, Homo Sapiens; identical to SEQ ID NO: 182521

SEQ ID NO: 347519 - RNA, 64 nt, Homo Sapiens; identical to SEQ ID NO: 182522

SEQ ID NO: 347520 - RNA, 64 nt, Homo Sapiens; identical to SEQ ID NO: 182523

SEQ ID NO: 347521 - RNA, 64 nt, Homo Sapiens; identical to SEQ ID NO: 182524

SEQ ID NO: 347522 - RNA, 64 nt, Homo Sapiens; identical to SEQ ID NO: 182525

SEQ ID NO: 347523 - RNA, 64 nt, Homo Sapiens; identical to SEQ ID NO: 182526

SEQ ID NO: 347524 - RNA, 64 nt, Homo Sapiens; identical to SEQ ID NO: 182527

SEQ ID NO: 347525 - RNA, 64 nt, Homo Sapiens; identical to SEQ ID NO: 182528

SEQ ID NO: 347526 - RNA, 64 nt, Homo Sapiens; identical to SEQ ID NO: 182529

SEQ ID NO: 347527 - RNA, 64 nt, Homo Sapiens; identical to SEQ ID NO: 182530

SEQ ID NO: 347528 - RNA, 64 nt, Homo Sapiens; identical to SEQ ID NO: 182531

SEQ ID NO: 347529 - RNA, 64 nt, Homo Sapiens; identical to SEQ ID NO: 182532

SEQ ID NO: 347530 - RNA, 64 nt, Homo Sapiens; identical to SEQ ID NO: 182533

SEQ ID NO: 347531 - RNA, 64 nt, Homo Sapiens; identical to SEQ ID NO: 182534

SEQ ID NO: 347532 - RNA, 64 nt, Homo Sapiens; identical to SEQ ID NO: 182535

SEQ ID NO: 347533 - RNA, 64 nt, Homo Sapiens; identical to SEQ ID NO: 298158

SEQ ID NO: 347534 - RNA, 64 nt, Homo Sapiens; identical to SEQ ID NO: 298159

SEQ ID NO: 347535 - RNA, 64 nt, Homo Sapiens; identical to SEQ ID NO: 298160

SEQ ID NO: 347536 - RNA, 64 nt, Homo Sapiens; identical to SEQ ID NO: 298161

SEQ ID NO: 347537 - RNA, 64 nt, Homo Sapiens; identical to SEQ ID NO: 298162

SEQ ID NO: 347538 - RNA, 64 nt, Homo Sapiens; identical to SEQ ID NO: 298163

SEQ ID NO: 347539 - RNA, 64 nt, Homo Sapiens; identical to SEQ ID NO: 298164

SEQ ID NO: 347540 - RNA, 64 nt, Homo Sapiens; identical to SEQ ID NO: 298165

SEQ ID NO: 347541 - RNA, 64 nt, Homo Sapiens; identical to SEQ ID NO: 298166

SEQ ID NO: 347542 - RNA, 64 nt, Homo Sapiens; identical to SEQ ID NO: 298167

SEQ ID NO: 347543 - RNA, 64 nt, Homo Sapiens; identical to SEQ ID NO: 298168

SEQ ID NO: 347544 - RNA, 64 nt, Homo Sapiens; identical to SEQ ID NO: 298169

SEQ ID NO: 347545 - RNA, 64 nt, Homo Sapiens; identical to SEQ ID NO: 298170

SEQ ID NO: 347546 - RNA, 64 nt, Homo Sapiens; identical to SEQ ID NO: 298171

SEQ ID NO: 347547 - RNA, 64 nt, Homo Sapiens; identical to SEQ ID NO: 298172

SEQ ID NO: 347548 - RNA, 64 nt, Homo Sapiens; identical to SEQ ID NO: 298173

SEQ ID NO: 347549 - RNA, 64 nt, Homo Sapiens; identical to SEQ ID NO: 298174

SEQ ID NO: 347550 - RNA, 64 nt, Homo Sapiens; identical to SEQ ID NO: 298175

SEQ ID NO: 347551 - RNA, 64 nt, Homo Sapiens; identical to SEQ ID NO: 298176

SEQ ID NO: 347552 - RNA, 64 nt, Homo Sapiens; identical to SEQ ID NO: 298177

SEQ ID NO: 347553 - RNA, 64 nt, Homo Sapiens; identical to SEQ ID NO: 298178

SEQ ID NO: 347554 - RNA, 64 nt, Homo Sapiens; identical to SEQ ID NO: 298179

SEQ ID NO: 347555 - RNA, 64 nt, Homo Sapiens; identical to SEQ ID NO: 298180

SEQ ID NO: 347556 - RNA, 64 nt, Homo Sapiens; identical to SEQ ID NO: 298181

SEQ ID NO: 347557 - RNA, 64 nt, Homo Sapiens; identical to SEQ ID NO: 298182

SEQ ID NO: 347558 - RNA, 64 nt, Homo Sapiens; identical to SEQ ID NO: 298183

SEQ ID NO: 347559 - RNA, 64 nt, Homo Sapiens; identical to SEQ ID NO: 298184

SEQ ID NO: 347560 - RNA, 64 nt, Homo Sapiens; identical to SEQ ID NO: 298185

SEQ ID NO: 347561 - RNA, 64 nt, Homo Sapiens; identical to SEQ ID NO: 298186

SEQ ID NO: 347562 - RNA, 64 nt, Homo Sapiens; identical to SEQ ID NO: 298187

SEQ ID NO: 347563 - RNA, 64 nt, Homo Sapiens; identical to SEQ ID NO: 298188

SEQ ID NO: 347564 - RNA, 64 nt, Homo Sapiens; identical to SEQ ID NO: 298189

SEQ ID NO: 347565 - RNA, 64 nt, Homo Sapiens; identical to SEQ ID NO: 298190

SEQ ID NO: 347566 - RNA, 64 nt, Homo Sapiens; identical to SEQ ID NO: 298191

SEQ ID NO: 347567 - RNA, 64 nt, Homo Sapiens; identical to SEQ ID NO: 298192

SEQ ID NO: 347568 - RNA, 64 nt, Homo Sapiens; identical to SEQ ID NO: 298193

SEQ ID NO: 347569 - RNA, 64 nt, Homo Sapiens; identical to SEQ ID NO: 298194

SEQ ID NO: 347570 - RNA, 64 nt, Homo Sapiens; identical to SEQ ID NO: 298195

SEQ ID NO: 347571 - RNA, 64 nt, Homo Sapiens; identical to SEQ ID NO: 298196

SEQ ID NO: 347572 - RNA, 64 nt, Homo Sapiens; identical to SEQ ID NO: 298197

SEQ ID NO: 347573 - RNA, 64 nt, Homo Sapiens; identical to SEQ ID NO: 298198

SEQ ID NO: 347574 - RNA, 64 nt, Homo Sapiens; identical to SEQ ID NO: 298199

SEQ ID NO: 347575 - RNA, 64 nt, Homo Sapiens; identical to SEQ ID NO: 298200

SEQ ID NO: 347576 - RNA, 64 nt, Homo Sapiens; identical to SEQ ID NO: 298201

SEQ ID NO: 347577 - RNA, 64 nt, Homo Sapiens; identical to SEQ ID NO: 298202

SEQ ID NO: 347578 - RNA, 64 nt, Homo Sapiens; identical to SEQ ID NO: 298203

SEQ ID NO: 347579 - RNA, 64 nt, Homo Sapiens; identical to SEQ ID NO: 298204

SEQ ID NO: 347580 - RNA, 64 nt, Homo Sapiens; identical to SEQ ID NO: 298205

SEQ ID NO: 347581 - RNA, 64 nt, Homo Sapiens; identical to SEQ ID NO: 298206

SEQ ID NO: 347582 - RNA, 64 nt, Homo Sapiens; identical to SEQ ID NO: 298207

SEQ ID NO: 347583 - RNA, 64 nt, Homo Sapiens; identical to SEQ ID NO: 298208

SEQ ID NO: 347584 - RNA, 64 nt, Homo Sapiens; identical to SEQ ID NO: 298209

SEQ ID NO: 347585 - RNA, 64 nt, Homo Sapiens; identical to SEQ ID NO: 298210

SEQ ID NO: 347586 - RNA, 64 nt, Homo Sapiens; identical to SEQ ID NO: 298211

SEQ ID NO: 347587 - RNA, 64 nt, Homo Sapiens; identical to SEQ ID NO: 298212

SEQ ID NO: 347588 - RNA, 64 nt, Homo Sapiens; identical to SEQ ID NO: 298213

SEQ ID NO: 347589 - RNA, 64 nt, Homo Sapiens; identical to SEQ ID NO: 298214

SEQ ID NO: 347590 - RNA, 64 nt, Homo Sapiens; identical to SEQ ID NO: 298215

SEQ ID NO: 347591 - RNA, 64 nt, Homo Sapiens; identical to SEQ ID NO: 298216

SEQ ID NO: 347592 - RNA, 64 nt, Homo Sapiens; identical to SEQ ID NO: 298217

SEQ ID NO: 347593 - RNA, 64 nt, Homo Sapiens; identical to SEQ ID NO: 298218

SEQ ID NO: 347594 - RNA, 64 nt, Homo Sapiens; identical to SEQ ID NO: 298219

SEQ ID NO: 347595 - RNA, 64 nt, Homo Sapiens; identical to SEQ ID NO: 298220

SEQ ID NO: 347596 - RNA, 64 nt, Homo Sapiens; identical to SEQ ID NO: 298221

SEQ ID NO: 347597 - RNA, 64 nt, Homo Sapiens; identical to SEQ ID NO: 298222

SEQ ID NO: 347598 - RNA, 64 nt, Homo Sapiens; identical to SEQ ID NO: 298223

SEQ ID NO: 347599 - RNA, 64 nt, Homo Sapiens; identical to SEQ ID NO: 298224

SEQ ID NO: 347600 - RNA, 64 nt, Homo Sapiens; identical to SEQ ID NO: 298225

SEQ ID NO: 347601 - RNA, 64 nt, Homo Sapiens; identical to SEQ ID NO: 298226

SEQ ID NO: 347602 - RNA, 64 nt, Homo Sapiens; identical to SEQ ID NO: 298227

SEQ ID NO: 347603 - RNA, 64 nt, Homo Sapiens; identical to SEQ ID NO: 298228

SEQ ID NO: 347604 - RNA, 64 nt, Homo Sapiens; identical to SEQ ID NO: 298229

SEQ ID NO: 347605 - RNA, 56 nt, Homo Sapiens; identical to SEQ ID NO: 298230

SEQ ID NO: 347606 - RNA, 64 nt, Homo Sapiens; identical to SEQ ID NO: 298231

SEQ ID NO: 347607 - RNA, 64 nt, Homo Sapiens; identical to SEQ ID NO: 298232

SEQ ID NO: 347608 - RNA, 64 nt, Homo Sapiens; identical to SEQ ID NO: 298233

SEQ ID NO: 347609 - RNA, 64 nt, Homo Sapiens; identical to SEQ ID NO: 298234

SEQ ID NO: 347610 - RNA, 64 nt, Homo Sapiens; identical to SEQ ID NO: 298235

SEQ ID NO: 347611 - RNA, 64 nt, Homo Sapiens; identical to SEQ ID NO: 298236

SEQ ID NO: 347612 - RNA, 64 nt, Homo Sapiens; identical to SEQ ID NO: 298237

SEQ ID NO: 347613 - RNA, 64 nt, Homo Sapiens; identical to SEQ ID NO: 298238

SEQ ID NO: 347614 - RNA, 63 nt, Homo Sapiens; identical to SEQ ID NO: 298239

SEQ ID NO: 347615 - RNA, 64 nt, Homo Sapiens; identical to SEQ ID NO: 298240

SEQ ID NO: 347616 - RNA, 64 nt, Homo Sapiens; identical to SEQ ID NO: 298241

SEQ ID NO: 347617 - RNA, 64 nt, Homo Sapiens; identical to SEQ ID NO: 298242

SEQ ID NO: 347618 - RNA, 64 nt, Homo Sapiens; identical to SEQ ID NO: 298243

SEQ ID NO: 347619 - RNA, 64 nt, Homo Sapiens; identical to SEQ ID NO: 298244

SEQ ID NO: 347620 - RNA, 64 nt, Homo Sapiens; identical to SEQ ID NO: 298245

SEQ ID NO: 347621 - RNA, 64 nt, Homo Sapiens; identical to SEQ ID NO: 298246

SEQ ID NO: 347622 - RNA, 64 nt, Homo Sapiens; identical to SEQ ID NO: 298247

SEQ ID NO: 347623 - RNA, 64 nt, Homo Sapiens; identical to SEQ ID NO: 298248

SEQ ID NO: 347624 - RNA, 64 nt, Homo Sapiens; identical to SEQ ID NO: 298249

SEQ ID NO: 347625 - RNA, 64 nt, Homo Sapiens; identical to SEQ ID NO: 182508

SEQ ID NO: 347626 - RNA, 64 nt, Homo Sapiens; identical to SEQ ID NO: 182509

SEQ ID NO: 347627 - RNA, 64 nt, Homo Sapiens; identical to SEQ ID NO: 182510

SEQ ID NO: 347628 - RNA, 64 nt, Homo Sapiens; identical to SEQ ID NO: 182511

SEQ ID NO: 347629 - RNA, 64 nt, Homo Sapiens; identical to SEQ ID NO: 182512

SEQ ID NO: 347630 - RNA, 64 nt, Homo Sapiens; identical to SEQ ID NO: 182513

SEQ ID NO: 347631 - RNA, 64 nt, Homo Sapiens; identical to SEQ ID NO: 182514

SEQ ID NO: 347632 - RNA, 64 nt, Homo Sapiens; identical to SEQ ID NO: 182515

SEQ ID NO: 347633 - RNA, 64 nt, Homo Sapiens; identical to SEQ ID NO: 182516

SEQ ID NO: 347634 - RNA, 64 nt, Homo Sapiens; identical to SEQ ID NO: 182517

SEQ ID NO: 347635 - RNA, 64 nt, Homo Sapiens; identical to SEQ ID NO: 182518

SEQ ID NO: 347636 - RNA, 64 nt, Homo Sapiens; identical to SEQ ID NO: 182519

SEQ ID NO: 347637 - RNA, 64 nt, Homo Sapiens; identical to SEQ ID NO: 182520

SEQ ID NO: 347638 - RNA, 64 nt, Homo Sapiens; identical to SEQ ID NO: 182521

SEQ ID NO: 347639 - RNA, 64 nt, Homo Sapiens; identical to SEQ ID NO: 182522

SEQ ID NO: 347640 - RNA, 64 nt, Homo Sapiens; identical to SEQ ID NO: 182523

SEQ ID NO: 347641 - RNA, 64 nt, Homo Sapiens; identical to SEQ ID NO: 182524

SEQ ID NO: 347642 - RNA, 64 nt, Homo Sapiens; identical to SEQ ID NO: 182525

SEQ ID NO: 347643 - RNA, 64 nt, Homo Sapiens; identical to SEQ ID NO: 182526

SEQ ID NO: 347644 - RNA, 64 nt, Homo Sapiens; identical to SEQ ID NO: 182527

SEQ ID NO: 347645 - RNA, 64 nt, Homo Sapiens; identical to SEQ ID NO: 182528

SEQ ID NO: 347646 - RNA, 64 nt, Homo Sapiens; identical to SEQ ID NO: 182529

SEQ ID NO: 347647 - RNA, 64 nt, Homo Sapiens; identical to SEQ ID NO: 182530

SEQ ID NO: 347648 - RNA, 64 nt, Homo Sapiens; identical to SEQ ID NO: 182531

SEQ ID NO: 347649 - RNA, 64 nt, Homo Sapiens; identical to SEQ ID NO: 182532

SEQ ID NO: 347650 - RNA, 64 nt, Homo Sapiens; identical to SEQ ID NO: 182533

SEQ ID NO: 347651 - RNA, 64 nt, Homo Sapiens; identical to SEQ ID NO: 182534

SEQ ID NO: 347652 - RNA, 64 nt, Homo Sapiens; identical to SEQ ID NO: 182535

SEQ ID NO: 347653 - RNA, 64 nt, Homo Sapiens; identical to SEQ ID NO: 327835

SEQ ID NO: 347654 - RNA, 64 nt, Homo Sapiens; identical to SEQ ID NO: 327836

SEQ ID NO: 347655 - RNA, 64 nt, Homo Sapiens; identical to SEQ ID NO: 327837

SEQ ID NO: 347656 - RNA, 64 nt, Homo Sapiens; identical to SEQ ID NO: 327838

SEQ ID NO: 347657 - RNA, 64 nt, Homo Sapiens; identical to SEQ ID NO: 327839

SEQ ID NO: 347658 - RNA, 64 nt, Homo Sapiens; identical to SEQ ID NO: 327840

SEQ ID NO: 347659 - RNA, 64 nt, Homo Sapiens; identical to SEQ ID NO: 327841

SEQ ID NO: 347660 - RNA, 64 nt, Homo Sapiens; identical to SEQ ID NO: 327842

SEQ ID NO: 347661 - RNA, 64 nt, Homo Sapiens; identical to SEQ ID NO: 327843

SEQ ID NO: 347662 - RNA, 64 nt, Homo Sapiens; identical to SEQ ID NO: 327844

SEQ ID NO: 347663 - RNA, 64 nt, Homo Sapiens; identical to SEQ ID NO: 327845

SEQ ID NO: 347664 - RNA, 64 nt, Homo Sapiens; identical to SEQ ID NO: 327846

SEQ ID NO: 347665 - RNA, 64 nt, Homo Sapiens; identical to SEQ ID NO: 327847

SEQ ID NO: 347666 - RNA, 64 nt, Homo Sapiens; identical to SEQ ID NO: 327848

SEQ ID NO: 347667 - RNA, 64 nt, Homo Sapiens; identical to SEQ ID NO: 327849

SEQ ID NO: 347668 - RNA, 64 nt, Homo Sapiens; identical to SEQ ID NO: 327850

SEQ ID NO: 347669 - RNA, 64 nt, Homo Sapiens; identical to SEQ ID NO: 327851

SEQ ID NO: 347670 - RNA, 64 nt, Homo Sapiens; identical to SEQ ID NO: 327852

SEQ ID NO: 347671 - RNA, 64 nt, Homo Sapiens; identical to SEQ ID NO: 182508

SEQ ID NO: 347672 - RNA, 64 nt, Homo Sapiens; identical to SEQ ID NO: 182509

SEQ ID NO: 347673 - RNA, 64 nt, Homo Sapiens; identical to SEQ ID NO: 182510

SEQ ID NO: 347674 - RNA, 64 nt, Homo Sapiens; identical to SEQ ID NO: 182511

SEQ ID NO: 347675 - RNA, 64 nt, Homo Sapiens; identical to SEQ ID NO: 182512

SEQ ID NO: 347676 - RNA, 64 nt, Homo Sapiens; identical to SEQ ID NO: 182513

SEQ ID NO: 347677 - RNA, 64 nt, Homo Sapiens; identical to SEQ ID NO: 182514

SEQ ID NO: 347678 - RNA, 64 nt, Homo Sapiens; identical to SEQ ID NO: 182515

SEQ ID NO: 347679 - RNA, 64 nt, Homo Sapiens; identical to SEQ ID NO: 182516

SEQ ID NO: 347680 - RNA, 64 nt, Homo Sapiens; identical to SEQ ID NO: 182517

SEQ ID NO: 347681 - RNA, 64 nt, Homo Sapiens; identical to SEQ ID NO: 182518

SEQ ID NO: 347682 - RNA, 64 nt, Homo Sapiens; identical to SEQ ID NO: 182519

SEQ ID NO: 347683 - RNA, 64 nt, Homo Sapiens; identical to SEQ ID NO: 182520

SEQ ID NO: 347684 - RNA, 64 nt, Homo Sapiens; identical to SEQ ID NO: 182521

SEQ ID NO: 347685 - RNA, 64 nt, Homo Sapiens; identical to SEQ ID NO: 182522

SEQ ID NO: 347686 - RNA, 64 nt, Homo Sapiens; identical to SEQ ID NO: 182523

SEQ ID NO: 347687 - RNA, 64 nt, Homo Sapiens; identical to SEQ ID NO: 182524

SEQ ID NO: 347688 - RNA, 64 nt, Homo Sapiens; identical to SEQ ID NO: 182525

SEQ ID NO: 347689 - RNA, 64 nt, Homo Sapiens; identical to SEQ ID NO: 182526

SEQ ID NO: 347690 - RNA, 64 nt, Homo Sapiens; identical to SEQ ID NO: 182527

SEQ ID NO: 347691 - RNA, 64 nt, Homo Sapiens; identical to SEQ ID NO: 182528

SEQ ID NO: 347692 - RNA, 64 nt, Homo Sapiens; identical to SEQ ID NO: 182529

SEQ ID NO: 347693 - RNA, 64 nt, Homo Sapiens; identical to SEQ ID NO: 182530

SEQ ID NO: 347694 - RNA, 64 nt, Homo Sapiens; identical to SEQ ID NO: 182531

SEQ ID NO: 347695 - RNA, 64 nt, Homo Sapiens; identical to SEQ ID NO: 182532

SEQ ID NO: 347696 - RNA, 64 nt, Homo Sapiens; identical to SEQ ID NO: 182533

SEQ ID NO: 347697 - RNA, 64 nt, Homo Sapiens; identical to SEQ ID NO: 182534

SEQ ID NO: 347698 - RNA, 64 nt, Homo Sapiens; identical to SEQ ID NO: 182535

SEQ ID NO: 347699 - RNA, 64 nt, Homo Sapiens; identical to SEQ ID NO: 327835

SEQ ID NO: 347700 - RNA, 64 nt, Homo Sapiens; identical to SEQ ID NO: 327836

SEQ ID NO: 347701 - RNA, 64 nt, Homo Sapiens; identical to SEQ ID NO: 327837

SEQ ID NO: 347702 - RNA, 64 nt, Homo Sapiens; identical to SEQ ID NO: 327838

SEQ ID NO: 347703 - RNA, 64 nt, Homo Sapiens; identical to SEQ ID NO: 327839

SEQ ID NO: 347704 - RNA, 64 nt, Homo Sapiens; identical to SEQ ID NO: 327840

SEQ ID NO: 347705 - RNA, 64 nt, Homo Sapiens; identical to SEQ ID NO: 327841

SEQ ID NO: 347706 - RNA, 64 nt, Homo Sapiens; identical to SEQ ID NO: 327842

SEQ ID NO: 347707 - RNA, 64 nt, Homo Sapiens; identical to SEQ ID NO: 327843

SEQ ID NO: 347708 - RNA, 64 nt, Homo Sapiens; identical to SEQ ID NO: 327844

SEQ ID NO: 347709 - RNA, 64 nt, Homo Sapiens; identical to SEQ ID NO: 327845

SEQ ID NO: 347710 - RNA, 64 nt, Homo Sapiens; identical to SEQ ID NO: 327846

SEQ ID NO: 347711 - RNA, 64 nt, Homo Sapiens; identical to SEQ ID NO: 327847

SEQ ID NO: 347712 - RNA, 64 nt, Homo Sapiens; identical to SEQ ID NO: 327848

SEQ ID NO: 347713 - RNA, 64 nt, Homo Sapiens; identical to SEQ ID NO: 327849

SEQ ID NO: 347714 - RNA, 64 nt, Homo Sapiens; identical to SEQ ID NO: 327850

SEQ ID NO: 347715 - RNA, 64 nt, Homo Sapiens; identical to SEQ ID NO: 327851

SEQ ID NO: 347716 - RNA, 64 nt, Homo Sapiens; identical to SEQ ID NO: 327852

SEQ ID NO: 347717 - RNA, 64 nt, Homo Sapiens; identical to SEQ ID NO: 182508

SEQ ID NO: 347718 - RNA, 64 nt, Homo Sapiens; identical to SEQ ID NO: 182509

SEQ ID NO: 347719 - RNA, 64 nt, Homo Sapiens; identical to SEQ ID NO: 182510

SEQ ID NO: 347720 - RNA, 64 nt, Homo Sapiens; identical to SEQ ID NO: 182511

SEQ ID NO: 347721 - RNA, 64 nt, Homo Sapiens; identical to SEQ ID NO: 182512

SEQ ID NO: 347722 - RNA, 64 nt, Homo Sapiens; identical to SEQ ID NO: 182513

SEQ ID NO: 347723 - RNA, 64 nt, Homo Sapiens; identical to SEQ ID NO: 182514

SEQ ID NO: 347724 - RNA, 64 nt, Homo Sapiens; identical to SEQ ID NO: 182515

SEQ ID NO: 347725 - RNA, 64 nt, Homo Sapiens; identical to SEQ ID NO: 182516

SEQ ID NO: 347726 - RNA, 64 nt, Homo Sapiens; identical to SEQ ID NO: 182517

SEQ ID NO: 347727 - RNA, 64 nt, Homo Sapiens; identical to SEQ ID NO: 182518

SEQ ID NO: 347728 - RNA, 64 nt, Homo Sapiens; identical to SEQ ID NO: 182519

SEQ ID NO: 347729 - RNA, 64 nt, Homo Sapiens; identical to SEQ ID NO: 182520

SEQ ID NO: 347730 - RNA, 64 nt, Homo Sapiens; identical to SEQ ID NO: 182521

SEQ ID NO: 347731 - RNA, 64 nt, Homo Sapiens; identical to SEQ ID NO: 182522

SEQ ID NO: 347732 - RNA, 64 nt, Homo Sapiens; identical to SEQ ID NO: 182523

SEQ ID NO: 347733 - RNA, 64 nt, Homo Sapiens; identical to SEQ ID NO: 182524

SEQ ID NO: 347734 - RNA, 64 nt, Homo Sapiens; identical to SEQ ID NO: 182525

SEQ ID NO: 347735 - RNA, 64 nt, Homo Sapiens; identical to SEQ ID NO: 182526

SEQ ID NO: 347736 - RNA, 64 nt, Homo Sapiens; identical to SEQ ID NO: 182527

SEQ ID NO: 347737 - RNA, 64 nt, Homo Sapiens; identical to SEQ ID NO: 182528

SEQ ID NO: 347738 - RNA, 64 nt, Homo Sapiens; identical to SEQ ID NO: 182529

SEQ ID NO: 347739 - RNA, 64 nt, Homo Sapiens; identical to SEQ ID NO: 182530

SEQ ID NO: 347740 - RNA, 64 nt, Homo Sapiens; identical to SEQ ID NO: 182531

SEQ ID NO: 347741 - RNA, 64 nt, Homo Sapiens; identical to SEQ ID NO: 182532

SEQ ID NO: 347742 - RNA, 64 nt, Homo Sapiens; identical to SEQ ID NO: 182533

SEQ ID NO: 347743 - RNA, 64 nt, Homo Sapiens; identical to SEQ ID NO: 182534

SEQ ID NO: 347744 - RNA, 64 nt, Homo Sapiens; identical to SEQ ID NO: 182535

SEQ ID NO: 347745 - RNA, 64 nt, Homo Sapiens; identical to SEQ ID NO: 327835

SEQ ID NO: 347746 - RNA, 64 nt, Homo Sapiens; identical to SEQ ID NO: 327836

SEQ ID NO: 347747 - RNA, 64 nt, Homo Sapiens; identical to SEQ ID NO: 327837

SEQ ID NO: 347748 - RNA, 64 nt, Homo Sapiens; identical to SEQ ID NO: 327838

SEQ ID NO: 347749 - RNA, 64 nt, Homo Sapiens; identical to SEQ ID NO: 327839

SEQ ID NO: 347750 - RNA, 64 nt, Homo Sapiens; identical to SEQ ID NO: 327840

SEQ ID NO: 347751 - RNA, 64 nt, Homo Sapiens; identical to SEQ ID NO: 327841

SEQ ID NO: 347752 - RNA, 64 nt, Homo Sapiens; identical to SEQ ID NO: 327842

SEQ ID NO: 347753 - RNA, 64 nt, Homo Sapiens; identical to SEQ ID NO: 327843

SEQ ID NO: 347754 - RNA, 64 nt, Homo Sapiens; identical to SEQ ID NO: 327844

SEQ ID NO: 347755 - RNA, 64 nt, Homo Sapiens; identical to SEQ ID NO: 327845

SEQ ID NO: 347756 - RNA, 64 nt, Homo Sapiens; identical to SEQ ID NO: 327846

SEQ ID NO: 347757 - RNA, 64 nt, Homo Sapiens; identical to SEQ ID NO: 327847

SEQ ID NO: 347758 - RNA, 64 nt, Homo Sapiens; identical to SEQ ID NO: 327848

SEQ ID NO: 347759 - RNA, 64 nt, Homo Sapiens; identical to SEQ ID NO: 327849

SEQ ID NO: 347760 - RNA, 64 nt, Homo Sapiens; identical to SEQ ID NO: 327850

SEQ ID NO: 347761 - RNA, 64 nt, Homo Sapiens; identical to SEQ ID NO: 327851

SEQ ID NO: 347762 - RNA, 64 nt, Homo Sapiens; identical to SEQ ID NO: 327852

SEQ ID NO: 347763 - RNA, 64 nt, Homo Sapiens; identical to SEQ ID NO: 182508

SEQ ID NO: 347764 - RNA, 64 nt, Homo Sapiens; identical to SEQ ID NO: 182509

SEQ ID NO: 347765 - RNA, 64 nt, Homo Sapiens; identical to SEQ ID NO: 182510

SEQ ID NO: 347766 - RNA, 64 nt, Homo Sapiens; identical to SEQ ID NO: 182511

SEQ ID NO: 347767 - RNA, 64 nt, Homo Sapiens; identical to SEQ ID NO: 182512

SEQ ID NO: 347768 - RNA, 64 nt, Homo Sapiens; identical to SEQ ID NO: 182513

SEQ ID NO: 347769 - RNA, 64 nt, Homo Sapiens; identical to SEQ ID NO: 182514

SEQ ID NO: 347770 - RNA, 64 nt, Homo Sapiens; identical to SEQ ID NO: 182515

SEQ ID NO: 347771 - RNA, 64 nt, Homo Sapiens; identical to SEQ ID NO: 182516

SEQ ID NO: 347772 - RNA, 64 nt, Homo Sapiens; identical to SEQ ID NO: 182517

SEQ ID NO: 347773 - RNA, 64 nt, Homo Sapiens; identical to SEQ ID NO: 182518

SEQ ID NO: 347774 - RNA, 64 nt, Homo Sapiens; identical to SEQ ID NO: 182519

SEQ ID NO: 347775 - RNA, 64 nt, Homo Sapiens; identical to SEQ ID NO: 182520

SEQ ID NO: 347776 - RNA, 64 nt, Homo Sapiens; identical to SEQ ID NO: 182521

SEQ ID NO: 347777 - RNA, 64 nt, Homo Sapiens; identical to SEQ ID NO: 182522

SEQ ID NO: 347778 - RNA, 64 nt, Homo Sapiens; identical to SEQ ID NO: 182523

SEQ ID NO: 347779 - RNA, 64 nt, Homo Sapiens; identical to SEQ ID NO: 182524

SEQ ID NO: 347780 - RNA, 64 nt, Homo Sapiens; identical to SEQ ID NO: 182525

SEQ ID NO: 347781 - RNA, 64 nt, Homo Sapiens; identical to SEQ ID NO: 182526

SEQ ID NO: 347782 - RNA, 64 nt, Homo Sapiens; identical to SEQ ID NO: 182527

SEQ ID NO: 347783 - RNA, 64 nt, Homo Sapiens; identical to SEQ ID NO: 182528

SEQ ID NO: 347784 - RNA, 64 nt, Homo Sapiens; identical to SEQ ID NO: 182529

SEQ ID NO: 347785 - RNA, 64 nt, Homo Sapiens; identical to SEQ ID NO: 182530

SEQ ID NO: 347786 - RNA, 64 nt, Homo Sapiens; identical to SEQ ID NO: 182531

SEQ ID NO: 347787 - RNA, 64 nt, Homo Sapiens; identical to SEQ ID NO: 182532

SEQ ID NO: 347788 - RNA, 64 nt, Homo Sapiens; identical to SEQ ID NO: 182533

SEQ ID NO: 347789 - RNA, 64 nt, Homo Sapiens; identical to SEQ ID NO: 182534

SEQ ID NO: 347790 - RNA, 64 nt, Homo Sapiens; identical to SEQ ID NO: 182535

SEQ ID NO: 347791 - RNA, 64 nt, Homo Sapiens; identical to SEQ ID NO: 327835

SEQ ID NO: 347792 - RNA, 64 nt, Homo Sapiens; identical to SEQ ID NO: 327836

SEQ ID NO: 347793 - RNA, 64 nt, Homo Sapiens; identical to SEQ ID NO: 327837

SEQ ID NO: 347794 - RNA, 64 nt, Homo Sapiens; identical to SEQ ID NO: 327838

SEQ ID NO: 347795 - RNA, 64 nt, Homo Sapiens; identical to SEQ ID NO: 327839

SEQ ID NO: 347796 - RNA, 64 nt, Homo Sapiens; identical to SEQ ID NO: 327840

SEQ ID NO: 347797 - RNA, 64 nt, Homo Sapiens; identical to SEQ ID NO: 327841

SEQ ID NO: 347798 - RNA, 64 nt, Homo Sapiens; identical to SEQ ID NO: 327842

SEQ ID NO: 347799 - RNA, 64 nt, Homo Sapiens; identical to SEQ ID NO: 327843

SEQ ID NO: 347800 - RNA, 64 nt, Homo Sapiens; identical to SEQ ID NO: 327844

SEQ ID NO: 347801 - RNA, 64 nt, Homo Sapiens; identical to SEQ ID NO: 327845

SEQ ID NO: 347802 - RNA, 64 nt, Homo Sapiens; identical to SEQ ID NO: 327846

SEQ ID NO: 347803 - RNA, 64 nt, Homo Sapiens; identical to SEQ ID NO: 327847

SEQ ID NO: 347804 - RNA, 64 nt, Homo Sapiens; identical to SEQ ID NO: 327848

SEQ ID NO: 347805 - RNA, 64 nt, Homo Sapiens; identical to SEQ ID NO: 327849

SEQ ID NO: 347806 - RNA, 64 nt, Homo Sapiens; identical to SEQ ID NO: 327850

SEQ ID NO: 347807 - RNA, 64 nt, Homo Sapiens; identical to SEQ ID NO: 327851

SEQ ID NO: 347808 - RNA, 64 nt, Homo Sapiens; identical to SEQ ID NO: 327852

SEQ ID NO: 347809 - RNA, 64 nt, Homo Sapiens; identical to SEQ ID NO: 182508

SEQ ID NO: 347810 - RNA, 64 nt, Homo Sapiens; identical to SEQ ID NO: 182509

SEQ ID NO: 347811 - RNA, 64 nt, Homo Sapiens; identical to SEQ ID NO: 182510

SEQ ID NO: 347812 - RNA, 64 nt, Homo Sapiens; identical to SEQ ID NO: 182511

SEQ ID NO: 347813 - RNA, 64 nt, Homo Sapiens; identical to SEQ ID NO: 182512

SEQ ID NO: 347814 - RNA, 64 nt, Homo Sapiens; identical to SEQ ID NO: 182513

SEQ ID NO: 347815 - RNA, 64 nt, Homo Sapiens; identical to SEQ ID NO: 182514

SEQ ID NO: 347816 - RNA, 64 nt, Homo Sapiens; identical to SEQ ID NO: 182515

SEQ ID NO: 347817 - RNA, 64 nt, Homo Sapiens; identical to SEQ ID NO: 182516

SEQ ID NO: 347818 - RNA, 64 nt, Homo Sapiens; identical to SEQ ID NO: 182517

SEQ ID NO: 347819 - RNA, 64 nt, Homo Sapiens; identical to SEQ ID NO: 182518

SEQ ID NO: 347820 - RNA, 64 nt, Homo Sapiens; identical to SEQ ID NO: 182519

SEQ ID NO: 347821 - RNA, 64 nt, Homo Sapiens; identical to SEQ ID NO: 182520

SEQ ID NO: 347822 - RNA, 64 nt, Homo Sapiens; identical to SEQ ID NO: 182521

SEQ ID NO: 347823 - RNA, 64 nt, Homo Sapiens; identical to SEQ ID NO: 182522

SEQ ID NO: 347824 - RNA, 64 nt, Homo Sapiens; identical to SEQ ID NO: 182523

SEQ ID NO: 347825 - RNA, 64 nt, Homo Sapiens; identical to SEQ ID NO: 182524

SEQ ID NO: 347826 - RNA, 64 nt, Homo Sapiens; identical to SEQ ID NO: 182525

SEQ ID NO: 347827 - RNA, 64 nt, Homo Sapiens; identical to SEQ ID NO: 182526

SEQ ID NO: 347828 - RNA, 64 nt, Homo Sapiens; identical to SEQ ID NO: 182527

SEQ ID NO: 347829 - RNA, 64 nt, Homo Sapiens; identical to SEQ ID NO: 182528

SEQ ID NO: 347830 - RNA, 64 nt, Homo Sapiens; identical to SEQ ID NO: 182529

SEQ ID NO: 347831 - RNA, 64 nt, Homo Sapiens; identical to SEQ ID NO: 182530

SEQ ID NO: 347832 - RNA, 64 nt, Homo Sapiens; identical to SEQ ID NO: 182531

SEQ ID NO: 347833 - RNA, 64 nt, Homo Sapiens; identical to SEQ ID NO: 182532

SEQ ID NO: 347834 - RNA, 64 nt, Homo Sapiens; identical to SEQ ID NO: 182533

SEQ ID NO: 347835 - RNA, 64 nt, Homo Sapiens; identical to SEQ ID NO: 182534

SEQ ID NO: 347836 - RNA, 64 nt, Homo Sapiens; identical to SEQ ID NO: 182535

SEQ ID NO: 347837 - RNA, 64 nt, Homo Sapiens; identical to SEQ ID NO: 327835

SEQ ID NO: 347838 - RNA, 64 nt, Homo Sapiens; identical to SEQ ID NO: 327836

SEQ ID NO: 347839 - RNA, 64 nt, Homo Sapiens; identical to SEQ ID NO: 327837

SEQ ID NO: 347840 - RNA, 64 nt, Homo Sapiens; identical to SEQ ID NO: 327838

SEQ ID NO: 347841 - RNA, 64 nt, Homo Sapiens; identical to SEQ ID NO: 327839

SEQ ID NO: 347842 - RNA, 64 nt, Homo Sapiens; identical to SEQ ID NO: 327840

SEQ ID NO: 347843 - RNA, 64 nt, Homo Sapiens; identical to SEQ ID NO: 327841

SEQ ID NO: 347844 - RNA, 64 nt, Homo Sapiens; identical to SEQ ID NO: 327842

SEQ ID NO: 347845 - RNA, 64 nt, Homo Sapiens; identical to SEQ ID NO: 327843

SEQ ID NO: 347846 - RNA, 64 nt, Homo Sapiens; identical to SEQ ID NO: 327844

SEQ ID NO: 347847 - RNA, 64 nt, Homo Sapiens; identical to SEQ ID NO: 327845

SEQ ID NO: 347848 - RNA, 64 nt, Homo Sapiens; identical to SEQ ID NO: 327846

SEQ ID NO: 347849 - RNA, 64 nt, Homo Sapiens; identical to SEQ ID NO: 327847

SEQ ID NO: 347850 - RNA, 64 nt, Homo Sapiens; identical to SEQ ID NO: 327848

SEQ ID NO: 347851 - RNA, 64 nt, Homo Sapiens; identical to SEQ ID NO: 327849

SEQ ID NO: 347852 - RNA, 64 nt, Homo Sapiens; identical to SEQ ID NO: 327850

SEQ ID NO: 347853 - RNA, 64 nt, Homo Sapiens; identical to SEQ ID NO: 327851

SEQ ID NO: 347854 - RNA, 64 nt, Homo Sapiens; identical to SEQ ID NO: 327852

SEQ ID NO: 347855 - RNA, 64 nt, Homo Sapiens
ggggcuggcccugguggaggucuaccucgaacuaaagaccuauuugggaaauaacagcagaacc

SEQ ID NO: 347856 - RNA, 64 nt, Homo Sapiens
gcucucccuucaccuccaggugaagaaguggaagaagaccuaagaggcggaacagaacugcauu

SEQ ID NO: 347857 - RNA, 64 nt, Homo Sapiens
aagccuuuuuuaagaaauaaugccuugaaaaacaaagaccuaaaaaguauaauaaguguuaauu

SEQ ID NO: 347858 - RNA, 64 nt, Homo Sapiens
ccauagagcacaguggaacgggggaaagccaaagaagaccuaggucuaggcacuaagggaguuu

SEQ ID NO: 347859 - RNA, 64 nt, Homo Sapiens
gauuuggaccuucuucuuaaaaaugaugcaauaaaagaccuauuaagaccuacuugugauauuu

SEQ ID NO: 347860 - RNA, 64 nt, Homo Sapiens
ugugauauuuaaaugaugcagccagaugacacuuaagaccuacuccuggcuacagaaagaagau

SEQ ID NO: 347861 - RNA, 64 nt, Homo Sapiens
aggcuuccaagugaucugcuccugaacaaguuugaagaccuauuguuucauagacccaagacca

SEQ ID NO: 347862 - RNA, 64 nt, Homo Sapiens
aagaccaaacgcaucuaaaggauccccagcccccaagaccuagccuuugucugcgauuuuggcu

SEQ ID NO: 347863 - RNA, 64 nt, Homo Sapiens
cuagacucagcugaaggaucuucaaagcaggaugaagaccuagacuuaccugaaggccuagacu

SEQ ID NO: 347864 - RNA, 64 nt, Homo Sapiens
cuagacucagcugaaggaucuucaaagcaggaugaagaccuagacuuaccugaaggaucuucaa

SEQ ID NO: 347865 - RNA, 64 nt, Homo Sapiens
cuagacuuaccugaaggaucuucaaagcagaaugaagaccuaggcuuaccugaaggaucuucaa

SEQ ID NO: 347866 - RNA, 64 nt, Homo Sapiens
cuaggcuuaccugaaggaucuucaaagcaggaugaagaccuagacuuaccugaaggaucuucac

SEQ ID NO: 347867 - RNA, 63 nt, Homo Sapiens
guagaauuaccugaaggaucuucacaggaggaugaagaccuagagaaaaagcgaucaucuagg

SEQ ID NO: 347868 - RNA, 64 nt, Homo Sapiens
cucaucugaaggaucuuugauucacaagaggaugaagaccuagacuaggguuaucugaaggauc

SEQ ID NO: 347869 - RNA, 64 nt, Homo Sapiens
guuaucugaaggaucuucacuucacaggaggaugaagaccuaggcuacaauuaccugaaggauc

SEQ ID NO: 347870 - RNA, 64 nt, Homo Sapiens
auuaccugaaggaucuucacuucaaagcaggaugaagaccuacacuagacucaucugcagaauc

SEQ ID NO: 347871 - RNA, 64 nt, Homo Sapiens
cucaucugcagaaucuucaacucacaggaggaugaagaccuagagaggaggaggacgaaggauc

SEQ ID NO: 347872 - RNA, 64 nt, Homo Sapiens; identical to SEQ ID NO: 165063

SEQ ID NO: 347873 - RNA, 64 nt, Homo Sapiens; identical to SEQ ID NO: 165064

SEQ ID NO: 347874 - RNA, 64 nt, Homo Sapiens; identical to SEQ ID NO: 165065

SEQ ID NO: 347875 - RNA, 64 nt, Homo Sapiens; identical to SEQ ID NO: 165066

SEQ ID NO: 347876 - RNA, 64 nt, Homo Sapiens; identical to SEQ ID NO: 165067

SEQ ID NO: 347877 - RNA, 64 nt, Homo Sapiens; identical to SEQ ID NO: 165068

SEQ ID NO: 347878 - RNA, 64 nt, Homo Sapiens; identical to SEQ ID NO: 165069

SEQ ID NO: 347879 - RNA, 64 nt, Homo Sapiens; identical to SEQ ID NO: 165070

SEQ ID NO: 347880 - RNA, 64 nt, Homo Sapiens; identical to SEQ ID NO: 165071

SEQ ID NO: 347881 - RNA, 64 nt, Homo Sapiens; identical to SEQ ID NO: 165072

SEQ ID NO: 347882 - RNA, 64 nt, Homo Sapiens; identical to SEQ ID NO: 165073

SEQ ID NO: 347883 - RNA, 64 nt, Homo Sapiens; identical to SEQ ID NO: 165074

SEQ ID NO: 347884 - RNA, 64 nt, Homo Sapiens; identical to SEQ ID NO: 165075

SEQ ID NO: 347885 - RNA, 64 nt, Homo Sapiens; identical to SEQ ID NO: 165076

SEQ ID NO: 347886 - RNA, 64 nt, Homo Sapiens; identical to SEQ ID NO: 165077

SEQ ID NO: 347887 - RNA, 64 nt, Homo Sapiens; identical to SEQ ID NO: 165078

SEQ ID NO: 347888 - RNA, 64 nt, Homo Sapiens; identical to SEQ ID NO: 165079

SEQ ID NO: 347889 - RNA, 64 nt, Homo Sapiens; identical to SEQ ID NO: 165080

SEQ ID NO: 347890 - RNA, 64 nt, Homo Sapiens; identical to SEQ ID NO: 165081

SEQ ID NO: 347891 - RNA, 64 nt, Homo Sapiens; identical to SEQ ID NO: 165082

SEQ ID NO: 347892 - RNA, 64 nt, Homo Sapiens; identical to SEQ ID NO: 165083

SEQ ID NO: 347893 - RNA, 64 nt, Homo Sapiens; identical to SEQ ID NO: 165084

SEQ ID NO: 347894 - RNA, 64 nt, Homo Sapiens; identical to SEQ ID NO: 165085

SEQ ID NO: 347895 - RNA, 64 nt, Homo Sapiens; identical to SEQ ID NO: 165086

SEQ ID NO: 347896 - RNA, 64 nt, Homo Sapiens; identical to SEQ ID NO: 165087

SEQ ID NO: 347897 - RNA, 64 nt, Homo Sapiens; identical to SEQ ID NO: 165088

SEQ ID NO: 347898 - RNA, 64 nt, Homo Sapiens; identical to SEQ ID NO: 165089

SEQ ID NO: 347899 - RNA, 64 nt, Homo Sapiens; identical to SEQ ID NO: 165090

SEQ ID NO: 347900 - RNA, 64 nt, Homo Sapiens; identical to SEQ ID NO: 165091

SEQ ID NO: 347901 - RNA, 64 nt, Homo Sapiens; identical to SEQ ID NO: 165092

SEQ ID NO: 347902 - RNA, 64 nt, Homo Sapiens; identical to SEQ ID NO: 165093

SEQ ID NO: 347903 - RNA, 64 nt, Homo Sapiens; identical to SEQ ID NO: 165094

SEQ ID NO: 347904 - RNA, 64 nt, Homo Sapiens; identical to SEQ ID NO: 165095

SEQ ID NO: 347905 - RNA, 64 nt, Homo Sapiens; identical to SEQ ID NO: 165096

SEQ ID NO: 347906 - RNA, 64 nt, Homo Sapiens; identical to SEQ ID NO: 165097

SEQ ID NO: 347907 - RNA, 64 nt, Homo Sapiens; identical to SEQ ID NO: 165098

SEQ ID NO: 347908 - RNA, 64 nt, Homo Sapiens; identical to SEQ ID NO: 165099

SEQ ID NO: 347909 - RNA, 64 nt, Homo Sapiens; identical to SEQ ID NO: 165100

SEQ ID NO: 347910 - RNA, 64 nt, Homo Sapiens; identical to SEQ ID NO: 165101

SEQ ID NO: 347911 - RNA, 64 nt, Homo Sapiens; identical to SEQ ID NO: 165102

SEQ ID NO: 347912 - RNA, 64 nt, Homo Sapiens; identical to SEQ ID NO: 165103

SEQ ID NO: 347913 - RNA, 64 nt, Homo Sapiens; identical to SEQ ID NO: 165104

SEQ ID NO: 347914 - RNA, 64 nt, Homo Sapiens; identical to SEQ ID NO: 165105

SEQ ID NO: 347915 - RNA, 64 nt, Homo Sapiens; identical to SEQ ID NO: 165106

SEQ ID NO: 347916 - RNA, 64 nt, Homo Sapiens
auucauaauugcauuauagaggaauguaguaugucauaaguacuuuguaaagauuugacauuca

SEQ ID NO: 347917 - RNA, 64 nt, Homo Sapiens
uacagcugugaagggcuaaaguuagaguugauuacauaaguaaguauuccccauauaaucuuuu

SEQ ID NO: 347918 - RNA, 64 nt, Homo Sapiens
cugggugacaaaaugagacauugucucuaaaauacauaaguaaauuuaaaaaaaaaagaauaau

SEQ ID NO: 347919 - RNA, 64 nt, Homo Sapiens
aaauugaaaaacuaguaagcaaauaaaugauaaacauaaguaaauuuaaacuguuguuuguaua

SEQ ID NO: 347920 - RNA, 64 nt, Homo Sapiens
gcuuuuagaauguaauauguuaauauguaacugccauaaguauaauuuuuauccuauccauaag

SEQ ID NO: 347921 - RNA, 64 nt, Homo Sapiens
auguaacugccauaaguauaauuuuuauccuauccauaaguaauagauucucagaaaucaggag

SEQ ID NO: 347922 - RNA, 64 nt, Homo Sapiens
ggaagguuucacuaaguaaagauauuugacuuuucauaaguagugaucuggaugaguuauacau

SEQ ID NO: 347923 - RNA, 64 nt, Homo Sapiens
ggaagguuucacuaaguaaagguauuugacuuuucauaaguagugaucuagaugaguuauaaau

SEQ ID NO: 347924 - RNA, 64 nt, Homo Sapiens
ccugcuaaaguuagcuuguagcuccauaguaagccauaaguauuguucuugcuguguaacagau

SEQ ID NO: 347925 - RNA, 64 nt, Homo Sapiens
uuuauuuauugagucaauuucuuuuuauaguugacauaaguaaauuuaguuauuuuucuuuuca

SEQ ID NO: 347926 - RNA, 64 nt, Homo Sapiens; identical to SEQ ID NO: 51595

SEQ ID NO: 347927 - RNA, 64 nt, Homo Sapiens; identical to SEQ ID NO: 51596

SEQ ID NO: 347928 - RNA, 64 nt, Homo Sapiens; identical to SEQ ID NO: 51597

SEQ ID NO: 347929 - RNA, 64 nt, Homo Sapiens; identical to SEQ ID NO: 51598

SEQ ID NO: 347930 - RNA, 64 nt, Homo Sapiens; identical to SEQ ID NO: 51599

SEQ ID NO: 347931 - RNA, 64 nt, Homo Sapiens; identical to SEQ ID NO: 51600

SEQ ID NO: 347932 - RNA, 64 nt, Homo Sapiens; identical to SEQ ID NO: 51601

SEQ ID NO: 347933 - RNA, 64 nt, Homo Sapiens; identical to SEQ ID NO: 51602

SEQ ID NO: 347934 - RNA, 64 nt, Homo Sapiens; identical to SEQ ID NO: 51603

SEQ ID NO: 347935 - RNA, 64 nt, Homo Sapiens; identical to SEQ ID NO: 51604

SEQ ID NO: 347936 - RNA, 64 nt, Homo Sapiens; identical to SEQ ID NO: 51605

SEQ ID NO: 347937 - RNA, 64 nt, Homo Sapiens; identical to SEQ ID NO: 51606

SEQ ID NO: 347938 - RNA, 64 nt, Homo Sapiens; identical to SEQ ID NO: 51607

SEQ ID NO: 347939 - RNA, 64 nt, Homo Sapiens; identical to SEQ ID NO: 51608

SEQ ID NO: 347940 - RNA, 64 nt, Homo Sapiens; identical to SEQ ID NO: 51609

SEQ ID NO: 347941 - RNA, 64 nt, Homo Sapiens; identical to SEQ ID NO: 51610

SEQ ID NO: 347942 - RNA, 64 nt, Homo Sapiens; identical to SEQ ID NO: 51611

SEQ ID NO: 347943 - RNA, 64 nt, Homo Sapiens; identical to SEQ ID NO: 51612

SEQ ID NO: 347944 - RNA, 64 nt, Homo Sapiens; identical to SEQ ID NO: 51613

SEQ ID NO: 347945 - RNA, 64 nt, Homo Sapiens; identical to SEQ ID NO: 51614

SEQ ID NO: 347946 - RNA, 64 nt, Homo Sapiens; identical to SEQ ID NO: 51615

SEQ ID NO: 347947 - RNA, 64 nt, Homo Sapiens; identical to SEQ ID NO: 51616

SEQ ID NO: 347948 - RNA, 64 nt, Homo Sapiens; identical to SEQ ID NO: 51617

SEQ ID NO: 347949 - RNA, 64 nt, Homo Sapiens; identical to SEQ ID NO: 51618

SEQ ID NO: 347950 - RNA, 64 nt, Homo Sapiens; identical to SEQ ID NO: 51619

SEQ ID NO: 347951 - RNA, 64 nt, Homo Sapiens; identical to SEQ ID NO: 51620

SEQ ID NO: 347952 - RNA, 64 nt, Homo Sapiens
acacugaccgacccuccuggggucugucaggaaaaaguagaagaaaagccacccccugcacccu

SEQ ID NO: 347953 - RNA, 64 nt, Homo Sapiens
ugugucaugccauccuuugggcccucugcuggaaaaguagaaucaagucucaaauaaugccuuu

SEQ ID NO: 347954 - RNA, 64 nt, Homo Sapiens
auauuugggauaagugaguguggauguccauuaaaaguagaaaaaauuaagauuuguuuucaag

SEQ ID NO: 347955 - RNA, 64 nt, Homo Sapiens
aauugaguauuuucugacauguuuuaaauaagugaaguagaagauaccuuucaguccugucugg

SEQ ID NO: 347956 - RNA, 64 nt, Homo Sapiens
cagugccaaggagaacuuggaugaauuaugcuuuaaguagaauuguacucaaauucucuacugu

SEQ ID NO: 347957 - RNA, 64 nt, Homo Sapiens
uuacauugucuagucuuguaaauucugaaauguuaaguagaagagauuuuuaaaggauuaauaa

SEQ ID NO: 347958 - RNA, 64 nt, Homo Sapiens
aaugccauaagucuagauuguaaaacauggagaaaaguagaaauuuuaaagugcaggcugcaau

SEQ ID NO: 347959 - RNA, 64 nt, Homo Sapiens
auaauauuucuccaauugggccaaaacuuuaaacaaguagaaagauuacccuaauggauugcaa

SEQ ID NO: 347960 - RNA, 64 nt, Homo Sapiens
caagaguucuuuuaaguuuuauggggaagaaauaaaguagaaccagaacacaugaaaggaauac

SEQ ID NO: 347961 - RNA, 64 nt, Homo Sapiens
acuuaaaaucaucuuucuuuacuauuuucccaacaaguagaaacgcuauuucuggauagagaug

SEQ ID NO: 347962 - RNA, 64 nt, Homo Sapiens
agaaggaugccacaguaguauguaaaacccaaacaaguagaacccaagcaaauaaaauuauuua

SEQ ID NO: 347963 - RNA, 64 nt, Homo Sapiens
uuuuguugugcugaguuugauuaguugcuuaaccaaguagaaagaaaagcacaucuuccugauc

SEQ ID NO: 347964 - RNA, 64 nt, Homo Sapiens
gacagggcauauuaguugauaugggauacuuuagaaguagaauugguaugacauuggauagaac

SEQ ID NO: 347965 - RNA, 64 nt, Homo Sapiens
ggugagauuguuuucuuuuuuuuuccuacuuauaaaguagaaaugagcuuauuuagaguccuag

SEQ ID NO: 347966 - RNA, 64 nt, Homo Sapiens
uuuccuuuuacaaucaaauucuacuaaaauguccaaguagaaugcuccuucccucuagcaauuu

SEQ ID NO: 347967 - RNA, 64 nt, Homo Sapiens
uacgccaggagcuccuuccccuucucuucuauccaaguagaaugcaguucuccuccugugcuau

SEQ ID NO: 347968 - RNA, 64 nt, Homo Sapiens
guaccuugcuuuagaguagauguuuggaaaagcuaaguagaaauuuuuuaaaauagaaguugua

SEQ ID NO: 347969 - RNA, 64 nt, Homo Sapiens
uuaggcuuuauaggugaaggacuuguuuugacuuaaguagaaguaauaugcucucauuucuuug

SEQ ID NO: 347970 - RNA, 64 nt, Homo Sapiens
uaaaauugaauaguacccaaaaguagauuaggugaaguagaacauugaaagaugggguugggua

SEQ ID NO: 347971 - RNA, 64 nt, Homo Sapiens
gguccucgaucaugguguuacgugauuggaugugaaguagaagacauuggaggugguuucuggc

SEQ ID NO: 347972 - RNA, 64 nt, Homo Sapiens
ccauacuauuagacuguguagugaugugacuuccaaguagaauuuaaucuccccauugagugug

SEQ ID NO: 347973 - RNA, 64 nt, Homo Sapiens
aguccuggguuuuugaaaaagugcuaaaacggacaaguagaauaaauguugcuguggaaugcca

SEQ ID NO: 347974 - RNA, 64 nt, Homo Sapiens
cugaaugagcaaaagcuggagcauuacucuugagaaguagaacaaggcacuucaguccuauuca

SEQ ID NO: 347975 - RNA, 64 nt, Homo Sapiens
aacagaaaaccaaauaccacauguucucacuuauaaguagaagcuaaacauugaguacacaugg

SEQ ID NO: 347976 - RNA, 64 nt, Homo Sapiens
aggcuggaggaugaguugggguugguagaaacggaaguagaaguuuuuuuaaugugccuuuugg

SEQ ID NO: 347977 - RNA, 64 nt, Homo Sapiens
ugggaugggcagugucugacccauuaauaccagcaaguagaagcguucccuuggggguguugag

SEQ ID NO: 347978 - RNA, 64 nt, Homo Sapiens
caaaagcuagggaaacagauuaucucuguacauaaaguagaaacuauuucuuagcaagauauuu

SEQ ID NO: 347979 - RNA, 64 nt, Homo Sapiens
cacuucaaaauaaaaaaacauuaaaaccaaucauaaguagaaccggcaagaugaaaugccagaa

SEQ ID NO: 347980 - RNA, 64 nt, Homo Sapiens
aaaggcggauugaggcugcugggucagccuugaucgcacagacagagcuugugccggauuuggc

SEQ ID NO: 347981 - RNA, 64 nt, Homo Sapiens
gauucugaaaauccuacccccaccccccaccagccgcacagauuguacuaccgcgagaggcauc

SEQ ID NO: 347982 - RNA, 64 nt, Homo Sapiens
ggccggcacgcgugacacggcacuucaggcuccacgcacagaaucucgcagauaguugggacua

SEQ ID NO: 347983 - RNA, 64 nt, Homo Sapiens
aagcugagagacccuggccucaaguuauuucaugcgcacagagggaagccaugugggguugcug

SEQ ID NO: 347984 - RNA, 64 nt, Homo Sapiens
ggaacugccaguguagagggaauucuaagcuggacgcacagaacagucucuccgugggaggaga

SEQ ID NO: 347985 - RNA, 64 nt, Homo Sapiens
ucuuuugucuucugugaagacaggaccuaugcaacgcacagacacuuuuggagaccguaaaaca

SEQ ID NO: 347986 - RNA, 64 nt, Homo Sapiens
uaaccguucccagguguacgcacgcgcgcgcgcgcgcacagacacacacacacacacacacaca

SEQ ID NO: 347987 - RNA, 64 nt, Homo Sapiens
auuuccuuccauuaagaauuacucagaguucuaacgcacagaauccugacuuccauguagcucc

SEQ ID NO: 347988 - RNA, 64 nt, Homo Sapiens
ggucucuuccugacccagacaucucagccugagacgcacagagauuuagaaaacagaaaucugc

SEQ ID NO: 347989 - RNA, 64 nt, Homo Sapiens
cgugugacccagaggcgagaacauacaccccagccgcacagaugugguacugcugugacgcggc

SEQ ID NO: 347990 - RNA, 64 nt, Homo Sapiens
gcccaguucucagggguuuuagcagcaggagaggcgcacagaagccccaaaagagagucaggag

SEQ ID NO: 347991 - RNA, 64 nt, Homo Sapiens
ugcccgccaggaucuguggcgagcuugagcugggcgcacagaggcugccagggagccgccaucc

SEQ ID NO: 347992 - RNA, 64 nt, Homo Sapiens
guuucauuucaccaauguguuaaacaauaaauuccgcacagaaaacauguggcuucacauuuau

SEQ ID NO: 347993 - RNA, 64 nt, Homo Sapiens
aggcccgccggaggagcgcguccccagccuuccgcgcacagagccgcaucccgccccgcccugc

SEQ ID NO: 347994 - RNA, 64 nt, Homo Sapiens
uucaaaggggcaccaguuuguagucccucuguuucgcacagaguacuaugacaaggaaacauca

SEQ ID NO: 347995 - RNA, 64 nt, Homo Sapiens
auguuuccuagaacaagaaccaccaaagccuguucgcacagaagggcgaccuugcagggacucg

SEQ ID NO: 347996 - RNA, 64 nt, Homo Sapiens
aguugugauaauagcauuuuuguaacuugccauccgcacagaaaauacgagaaaaucugcaugu

SEQ ID NO: 347997 - RNA, 64 nt, Homo Sapiens
ggccggggcacaauuugcacuccccucagcuagacgcacagacucagcaauaaaccuuugcauc

SEQ ID NO: 347998 - RNA, 64 nt, Homo Sapiens
caugcgcauccccacccacaggcggugcugucagcgcacagaccuaaaccugggucuucuccuu

SEQ ID NO: 347999 - RNA, 64 nt, Homo Sapiens
aaacugagcugggacuggaaccaugccauuccuucgcacagaugaggacccagagcaggccugu

SEQ ID NO: 348000 - RNA, 64 nt, Homo Sapiens
gggcacacagauaagcugcccaaaugcacgcacacgcacagagacaugccagaacauacaagga

SEQ ID NO: 348001 - RNA, 64 nt, Homo Sapiens
ugcauuaagaaacccccucauggaucugcauaaccgcacagacauugacaagcacgcacacaca

SEQ ID NO: 348002 - RNA, 64 nt, Homo Sapiens
ugauaaccaaauucugucacucaagacacagacacgcacagacccuguccuuugccucuauuaa

SEQ ID NO: 348003 - RNA, 64 nt, Homo Sapiens
auggcaggaugcgcugggacaccggucacaggaacgcacagaucagagguucugcacuccugga

SEQ ID NO: 348004 - RNA, 64 nt, Homo Sapiens
ucaugaacuuaggauguguuguacaguagugaaccgcacagauuccuuaagguuuuaauaccug

SEQ ID NO: 348005 - RNA, 64 nt, Homo Sapiens
acuucagaaaauacacaacagccccuucugcccccgcacagaaaugcugcagaguauauaaaac

SEQ ID NO: 348006 - RNA, 64 nt, Homo Sapiens
cgacagguggccccagcuuccucuccggagccugcgcacagagagucacgccccccacucuccu

SEQ ID NO: 348007 - RNA, 64 nt, Homo Sapiens
agccacagucuccagacucauggucaggcuccaccgcacagaaguaaggaacucagggggcacg

SEQ ID NO: 348008 - RNA, 64 nt, Homo Sapiens
guaacaggaugaaacaguuuucuagagggagccacgcacagaaugggcagcaucagagugccuu

SEQ ID NO: 348009 - RNA, 64 nt, Homo Sapiens
cggugcaccuaggucacacagcuacacacgcgcgcgcacagacaacucucgcucacgcucagac

SEQ ID NO: 348010 - RNA, 64 nt, Homo Sapiens
ugaacagaaacugaaacauucacauacacacacacgcacagaggacacacacacaugcacacaa

SEQ ID NO: 348011 - RNA, 64 nt, Homo Sapiens
gcaggagccuccuguuugcaucaaauaggaagaacgcacagaggcccuuguggcagcuuucucu

SEQ ID NO: 348012 - RNA, 64 nt, Homo Sapiens
ccgaggcgcauagagaccgaaggcgggaccgaggcgcacagagagagacgccacccggugcuug

SEQ ID NO: 348013 - RNA, 64 nt, Homo Sapiens
ccuggcucugacccccucucauugcagaccacaucgcacagaccagggcaagggguuccucugg

SEQ ID NO: 348014 - RNA, 64 nt, Homo Sapiens
uuaccuuuuuggccuccugauuacaaaaauaaaacgcacagaucagguauguuuuagauauagu

SEQ ID NO: 348015 - RNA, 64 nt, Homo Sapiens
gaagcaguucacugagucagcugguucccaagcucgcacagaaggugauaaguuacuaucaaau

SEQ ID NO: 348016 - RNA, 64 nt, Homo Sapiens
ugaaggagaucguaggguggaugccccugauggccgcacagaaggacuucuucugggaggcccu

SEQ ID NO: 348017 - RNA, 64 nt, Homo Sapiens
acacacacacacacaaaugugccacacccagacacgcacagaaucagacacuacaaacaccugc

SEQ ID NO: 348018 - RNA, 64 nt, Homo Sapiens
uccaguucuuaguguggcugcucugagagcaccacgcacagauuaaacaggcuuuccaccccug

SEQ ID NO: 348019 - RNA, 52 nt, Homo Sapiens
gcgucuucugccaccaagaggacgcacagacgggcaucagaaagcacuguga

SEQ ID NO: 348020 - RNA, 64 nt, Homo Sapiens
gugagaaaauucagaauaccaucuguuucauagccgcacagauuuuggacuuucacaaacauug

SEQ ID NO: 348021 - RNA, 64 nt, Homo Sapiens
cuccgugugacuuccguccagcuucucaggugcccgcacagagggcugggcagguguucuggca

SEQ ID NO: 348022 - RNA, 64 nt, Homo Sapiens
gaaggagccagcucccagccaagccucccgaacacgcacagaagggaccacgggcgaggacgug

SEQ ID NO: 348023 - RNA, 64 nt, Homo Sapiens
uuuguuuuaaauaaauaaacgggccuguacauagcgcacagaugcgcccaccucccugggagcc

SEQ ID NO: 348024 - RNA, 64 nt, Homo Sapiens
ggcccccaccacacaucccagcccaauccagguacgcacagacagguuuucacauaaaugcagc

SEQ ID NO: 348025 - RNA, 64 nt, Homo Sapiens
uguuugacuuuguuauaaaaucugggggaaugaacgcacagaucgguuuuuuucuacuugugug

SEQ ID NO: 348026 - RNA, 64 nt, Homo Sapiens
guuugugaucugagacccgcgguguggcugagagcgcacagagcgcacgugcacauaccucugc

SEQ ID NO: 348027 - RNA, 64 nt, Homo Sapiens
aauguuuaaagcacaguaaacuuuaaagcauugacgcacagacaaaucaccacauaguaugucc

SEQ ID NO: 348028 - RNA, 64 nt, Homo Sapiens
gagguggggagguggcgaggauggggacagaaagcgcacagaaucuuggaccaggucucucuuc

SEQ ID NO: 348029 - RNA, 64 nt, Homo Sapiens
gccaaugcccacggcuucauauggugguggaggccgcacagaagugcccacugugccuuucgag

SEQ ID NO: 348030 - RNA, 64 nt, Homo Sapiens
gggagguuuaguggugcauucaaacguggauuaucgcacagacuuccccacacacgccuaugca

SEQ ID NO: 348031 - RNA, 64 nt, Homo Sapiens
uccucgccugcagccucagaggggcaggcauccccgcacagacuugacuggcagggcggucacg

SEQ ID NO: 348032 - RNA, 64 nt, Homo Sapiens
gcagcggacuccggagcguccuuccugccugugacgcacagagaaguggcugcagguagcugga

SEQ ID NO: 348033 - RNA, 64 nt, Homo Sapiens
ggaugugaguugugugaauaaucuuucugucccucgcacagaagccaguaauuagcaucuaaug

SEQ ID NO: 348034 - RNA, 64 nt, Homo Sapiens
uuguacauaaaggcuucauccacgaaccauccagcgcacagaagcaagugcaaaaaugacacaa

SEQ ID NO: 348035 - RNA, 64 nt, Homo Sapiens
ccuucucugucccauugcuuucuccuuuccccgacgcacagaauaaacaugaagcucagcagua

SEQ ID NO: 348036 - RNA, 64 nt, Homo Sapiens
gugugccaggcacccccagauacaaaugcagccacgcacagacguaacacacaggugccaggcc

SEQ ID NO: 348037 - RNA, 64 nt, Homo Sapiens
aauugccugcgccacgcagcggggccggacaggccgcacagaccuacuguggcgggagggaggg

SEQ ID NO: 348038 - RNA, 64 nt, Homo Sapiens
uuaaacacugaagugccgaaguggcccgugccgccgcacagagaccccgacuuuaguuugggcu

SEQ ID NO: 348039 - RNA, 64 nt, Homo Sapiens
ugcacagguggcauuugcuuccaauuguagcuagcgcacagagcuuuggaagccugucauuaug

SEQ ID NO: 348040 - RNA, 64 nt, Homo Sapiens
gaagggggcagagagaguuaugaccccgagagggcgcacagaccaagcgugagcuccacgcggg

SEQ ID NO: 348041 - RNA, 64 nt, Homo Sapiens
ccugcagugggcacccuaggcguauguguauacacgcacagauauuuauuccuuucgcuuuuag

SEQ ID NO: 348042 - RNA, 64 nt, Homo Sapiens
aggaggugccguccaggugugcggcgagccgcugcgcacagaugucaggauuuccguuuggguc

SEQ ID NO: 348043 - RNA, 64 nt, Homo Sapiens
guuuugaggagaggcagugauuccccucccgccccgcacagagaccccgacucacugccagccg

SEQ ID NO: 348044 - RNA, 64 nt, Homo Sapiens
uuccagaggaggagggugacggccggucucaggccgcacagacgcugauuugacuuuucucgcc

SEQ ID NO: 348045 - RNA, 64 nt, Homo Sapiens
agauuaaagccaucucagugaagauaugcgugcacgcacagacagacagacacacacacacaca

SEQ ID NO: 348046 - RNA, 64 nt, Homo Sapiens
uucaggcaggcaggcccaggaugggcguuugcugcgcacagacacucagcaggggccucgcaga

SEQ ID NO: 348047 - RNA, 64 nt, Homo Sapiens
gggaaggaacaggacugcaaaaauccuucuccaccgcacagacugggaaccccuccuggccugg

SEQ ID NO: 348048 - RNA, 64 nt, Homo Sapiens
uuuugcuuuaugcuguagaacaugguaacaaauucgcacagagguccugaugguuucccguuuu

SEQ ID NO: 348049 - RNA, 64 nt, Homo Sapiens
aggcgugguccaggcauugugguggcccaggggccgcacagacgccgcccccagccggugcuca

SEQ ID NO: 348050 - RNA, 64 nt, Homo Sapiens
guuuguuuuuacuuuuaaagaaauguaaacagaucgcacagaguaaagaagaugaugauguaau

SEQ ID NO: 348051 - RNA, 64 nt, Homo Sapiens
gucaugcuucagugacauugggaggucuaccuaacgcacagaaaugaugcagucguggugaaca

SEQ ID NO: 348052 - RNA, 64 nt, Homo Sapiens
agagggcagaggggacaccuucauugccucuccucgcacagaaauggugggcucucucuggccc

SEQ ID NO: 348053 - RNA, 64 nt, Homo Sapiens
gcacugccugcgggugccagucugaaaaccagaccgcacagaggccuggggcugcugaugagcu

SEQ ID NO: 348054 - RNA, 64 nt, Homo Sapiens
uaggccuugcuugcugccuucuggauucuuggcccgcacagagcuggggcugagggauggacug

SEQ ID NO: 348055 - RNA, 64 nt, Homo Sapiens
acuucagggcuggaaaaguccugccucagcugcucgcacagauucacaaccagccacacagagc

SEQ ID NO: 348056 - RNA, 64 nt, Homo Sapiens
ccugaccauccucagaaucugcuggucuuguugccgcacagauugaagccccaggugccacuuu

SEQ ID NO: 348057 - RNA, 64 nt, Homo Sapiens; identical to SEQ ID NO: 283329

SEQ ID NO: 348058 - RNA, 64 nt, Homo Sapiens; identical to SEQ ID NO: 283330

SEQ ID NO: 348059 - RNA, 64 nt, Homo Sapiens; identical to SEQ ID NO: 283331

SEQ ID NO: 348060 - RNA, 64 nt, Homo Sapiens; identical to SEQ ID NO: 283332

SEQ ID NO: 348061 - RNA, 64 nt, Homo Sapiens; identical to SEQ ID NO: 247598

SEQ ID NO: 348062 - RNA, 64 nt, Homo Sapiens; identical to SEQ ID NO: 247599

SEQ ID NO: 348063 - RNA, 64 nt, Homo Sapiens; identical to SEQ ID NO: 247600

SEQ ID NO: 348064 - RNA, 64 nt, Homo Sapiens; identical to SEQ ID NO: 247601

SEQ ID NO: 348065 - RNA, 64 nt, Homo Sapiens; identical to SEQ ID NO: 247602

SEQ ID NO: 348066 - RNA, 64 nt, Homo Sapiens; identical to SEQ ID NO: 247603

SEQ ID NO: 348067 - RNA, 64 nt, Homo Sapiens; identical to SEQ ID NO: 247604

SEQ ID NO: 348068 - RNA, 64 nt, Homo Sapiens; identical to SEQ ID NO: 247605

SEQ ID NO: 348069 - RNA, 64 nt, Homo Sapiens; identical to SEQ ID NO: 247606

SEQ ID NO: 348070 - RNA, 64 nt, Homo Sapiens; identical to SEQ ID NO: 247607

SEQ ID NO: 348071 - RNA, 64 nt, Homo Sapiens; identical to SEQ ID NO: 247608

SEQ ID NO: 348072 - RNA, 64 nt, Homo Sapiens; identical to SEQ ID NO: 247609

SEQ ID NO: 348073 - RNA, 64 nt, Homo Sapiens; identical to SEQ ID NO: 247610

SEQ ID NO: 348074 - RNA, 64 nt, Homo Sapiens; identical to SEQ ID NO: 247611

SEQ ID NO: 348075 - RNA, 64 nt, Homo Sapiens; identical to SEQ ID NO: 247612

SEQ ID NO: 348076 - RNA, 64 nt, Homo Sapiens; identical to SEQ ID NO: 247613

SEQ ID NO: 348077 - RNA, 64 nt, Homo Sapiens
ucuacaucacuggcugcucuguucacacuuugcccuaugacauucaguuuauuacauuuagcuu

SEQ ID NO: 348078 - RNA, 64 nt, Homo Sapiens
aacaaugugugggauaauguuuuuaaguucaugucuaugacaugggcagcaggaacuuuaaauu

SEQ ID NO: 348079 - RNA, 64 nt, Homo Sapiens
uaaugaaccagcuacguauaauagcccuaaauugcuaugacaacugcuaugcauagcuugggca

SEQ ID NO: 348080 - RNA, 64 nt, Homo Sapiens
uuacuucaaacuguguacugaugguuggucauuucuaugacaaugaauuguuuaucaucuugac

SEQ ID NO: 348081 - RNA, 64 nt, Homo Sapiens
auggcacugcaggugagaaccccgcccauccgugcuaugacauggaggcacugaagcccgagga

SEQ ID NO: 348082 - RNA, 64 nt, Homo Sapiens
cauuuaauccaaacagggguucuuagucucagcacuaugacauuuugggcugacuacuuauuug

SEQ ID NO: 348083 - RNA, 64 nt, Homo Sapiens
cucaaauuuucuauugccagaaaauuuucaaacacuaugacacagaccaguccggcaccaucaa

SEQ ID NO: 348084 - RNA, 64 nt, Homo Sapiens
uccccuccacaggauuccaccucaacaaccagcucuaugacaucauuaccaugcgguacgcaga

SEQ ID NO: 348085 - RNA, 64 nt, Homo Sapiens
accgggacuuuuuuucuuuuuucuuuuuuuuuugcuaugacagaguaaugcuaacguaaggaca

SEQ ID NO: 348086 - RNA, 64 nt, Homo Sapiens
gguucuggucuccaaguaucguuaagcacaggugcuaugacagaaaaaguucugggguggaagu

SEQ ID NO: 348087 - RNA, 57 nt, Homo Sapiens
ccuauagaaggagccuggacucugaucccucuguacaggcuggauggaaggggcccu

SEQ ID NO: 348088 - RNA, 57 nt, Homo Sapiens
gagagaugugacaugguucuuggauuuccucuguagcagccuccuggacuuccugag

SEQ ID NO: 348089 - RNA, 57 nt, Homo Sapiens
gaaacuaaauaaaaauguuuuauuuaaccucuguaauguauggaugucauaaaaguc

SEQ ID NO: 348090 - RNA, 57 nt, Homo Sapiens
ccaacauccagugugauuuuaauccugccucuguagagagucauccagcaaugagag

SEQ ID NO: 348091 - RNA, 57 nt, Homo Sapiens
aaaaguaaugaucguaaagacacaaauccucuguaugccaucuugcauuggcacuga

SEQ ID NO: 348092 - RNA, 57 nt, Homo Sapiens
accaguccaucaccccucccaggccagccucuguaaguuggccacacuuggggagug

SEQ ID NO: 348093 - RNA, 57 nt, Homo Sapiens
cuuucugcugugucuucacaucacccuccucuguauaccuaaucugccucugccucu

SEQ ID NO: 348094 - RNA, 57 nt, Homo Sapiens
uccucuguucccacacuugggccucugccucuguaccugcagcucugcucucgggau

SEQ ID NO: 348095 - RNA, 64 nt, Homo Sapiens
gaccuaaauggacuauaguauauuggauguuaaauccauauaugauguauauuuuguaaaauug

SEQ ID NO: 348096 - RNA, 64 nt, Homo Sapiens
cgauacaugcaaauuuaauguaguaacucacuuuuccauauauuuugaauguauauuucuauuu

SEQ ID NO: 348097 - RNA, 64 nt, Homo Sapiens
caaacuucguuauuuuaucuugucauuuacaacauccauauaagcaacuagccauauaagcaaa

SEQ ID NO: 348098 - RNA, 64 nt, Homo Sapiens
cuacuaaugacuuaaguguacaucuguucuugucuccauauauucauguaagaugcacaacaaa

SEQ ID NO: 348099 - RNA, 64 nt, Homo Sapiens
uuuuuggaaguauuuggcauugcuaauugagcaguccauauaguacuacuuuuagaagaaacaa

SEQ ID NO: 348100 - RNA, 64 nt, Homo Sapiens
uuuuauuaauauuaauuuaaugcuauuagcaauuuccauauacuauauuguggaaaagacugaa

SEQ ID NO: 348101 - RNA, 64 nt, Homo Sapiens
accccaaaucuacuacuuuaucugcaaaaguuacuccauauacagaucaaaguucagaaaaugg

SEQ ID NO: 348102 - RNA, 64 nt, Homo Sapiens
cacacacacacacacacacaaucucaaacuuuauuccauauauaguaacaugaaaaagcaggga

SEQ ID NO: 348103 - RNA, 64 nt, Homo Sapiens
uagacuaguaaaucacagugguucaaaauauauauccauauauauauauauccauauauauauc

SEQ ID NO: 348104 - RNA, 64 nt, Homo Sapiens
agugguucaaaauauauauccauauauauauauauccauauauauaucucaugucaucacauua

SEQ ID NO: 348105 - RNA, 64 nt, Homo Sapiens
cuuuuaucugcucuuuuuaagacuguuugcauuuuccauauaucaaauugaauuagcaagaacc

SEQ ID NO: 348106 - RNA, 64 nt, Homo Sapiens
uauauauauauauauauauagaucgaauuauauauccauauauauucuucucagucccagcuca

SEQ ID NO: 348107 - RNA, 64 nt, Homo Sapiens
gugauaaaagauagaguauccuuaugguugaguuuccauauaaguggaccagacacagaaacaa

SEQ ID NO: 348108 - RNA, 64 nt, Homo Sapiens
auuccucuucagacaugaaagggaacauauauauuccauauauauguucaacucuucauagauu

SEQ ID NO: 348109 - RNA, 64 nt, Homo Sapiens
uauuccauauguauauguguuuccacauauguauuccauauauaauauaccauauauguauaua

SEQ ID NO: 348110 - RNA, 64 nt, Homo Sapiens
auauauguauauauuccacaauauauguauauauuccauauaccuguaugcauauauguauucc

SEQ ID NO: 348111 - RNA, 64 nt, Homo Sapiens
uauauauuccauauaccauaaugcauauauguauuccauauauguguauacauuccauguaugu

SEQ ID NO: 348112 - RNA, 64 nt, Homo Sapiens
uacauauauuccacauguguauggccaagguaguuccauauauaaagaauuucuuaacaaaaug

SEQ ID NO: 348113 - RNA, 64 nt, Homo Sapiens
uuuugguuaaauggguguuuaaucuuuugguuaguggguuaaacgggguaaguuagaguagggg

SEQ ID NO: 348114 - RNA, 64 nt, Homo Sapiens
acuccuauaauuuuugauugugagcucaccuauuuggguuaagcaugccaauuuaaagagacca

SEQ ID NO: 348115 - RNA, 64 nt, Homo Sapiens
acaccagcacuucugcuugcgucuuuaagaaaccuggguuaaagaguugguucuauugaagcca

SEQ ID NO: 348116 - RNA, 64 nt, Homo Sapiens
gaacuaacaguugucccuuuacuccuugcuugaguggguuaaaguagauaaaccucugcccucc

SEQ ID NO: 348117 - RNA, 64 nt, Homo Sapiens
cuuggaugacgucggcguugcccguccucuggcuuggguuaauuggcguugcuggguggcgaug

SEQ ID NO: 348118 - RNA, 64 nt, Homo Sapiens
cuucggugacacuggcguugcccauccucugccuuggguuaauuggcguugcuggguggcaaug

SEQ ID NO: 348119 - RNA, 64 nt, Homo Sapiens
cuucggugacacuggcguugcccguccucuggcuuggguuaauuggcauugcuggguggugaug

SEQ ID NO: 348120 - RNA, 64 nt, Homo Sapiens
cuucggugacacuggcauugcccguccucuggcuuggguuaauuaagaugaaggcauggcgaug

SEQ ID NO: 348121 - RNA, 64 nt, Homo Sapiens
uauuaaaaccuauccaguggcaaaguacuuuacuuggguuaauuuauagggcuuccuuugguau

SEQ ID NO: 348122 - RNA, 64 nt, Homo Sapiens
uuguaugaccaaaugaaucuuuucuaggucacauuggguuaaguuccagugguagaauuugagc

SEQ ID NO: 348123 - RNA, 64 nt, Homo Sapiens; identical to SEQ ID NO: 110383

SEQ ID NO: 348124 - RNA, 64 nt, Homo Sapiens; identical to SEQ ID NO: 110384

SEQ ID NO: 348125 - RNA, 64 nt, Homo Sapiens; identical to SEQ ID NO: 110385

SEQ ID NO: 348126 - RNA, 64 nt, Homo Sapiens; identical to SEQ ID NO: 110386

SEQ ID NO: 348127 - RNA, 64 nt, Homo Sapiens; identical to SEQ ID NO: 110387

SEQ ID NO: 348128 - RNA, 64 nt, Homo Sapiens; identical to SEQ ID NO: 110388

SEQ ID NO: 348129 - RNA, 64 nt, Homo Sapiens
acaaagaaguuuggaugaggugcaaauuugcagccuuuaccacuuaguguaguuuucuaaacgc

SEQ ID NO: 348130 - RNA, 64 nt, Homo Sapiens
ucuaugacuucuacauaacaaaauuguuacaaugcuuuaccaaaaaagauuuagaugccuuccu

SEQ ID NO: 348131 - RNA, 64 nt, Homo Sapiens
uaucuauagauucaguaucuacuacccauauuuacuuuaccaaauauauuucuccucacugcau

SEQ ID NO: 348132 - RNA, 64 nt, Homo Sapiens
acuaagaugguauuugcacauuuaagauauguuacuuuaccaauuuuuaaugguaaucaacucu

SEQ ID NO: 348133 - RNA, 64 nt, Homo Sapiens
auuaggaucucaccucuuuccuuugucucuguaccuuuaccaaccuuaccacuugguuggcucc

SEQ ID NO: 348134 - RNA, 64 nt, Homo Sapiens
uuuuccugguggcuuggcuucucuuucucuuacucuuuaccaaguauuaucucauauuuucucc

SEQ ID NO: 348135 - RNA, 64 nt, Homo Sapiens
uugaaugucgauggggcaagaacucagacuucuacuuuaccaaguaccacacacucuggaaugc

SEQ ID NO: 348136 - RNA, 64 nt, Homo Sapiens
uaauucucuaagcucaagaugcaucccauugccacuuuaccauucuauuucccaagggaaccau

SEQ ID NO: 348137 - RNA, 64 nt, Homo Sapiens
gaagccugaggcuucuguucaauuucauagacuccuuuaccauguaaaauuugucugauauuug

SEQ ID NO: 348138 - RNA, 64 nt, Homo Sapiens
augaguuagucaauuguaucagguuuuccaagaccuuuaccaguaaauuauguuucuguaugua

SEQ ID NO: 348139 - RNA, 64 nt, Homo Sapiens
uuugaaauaucauguuaaauuagaaugaauuuaucuuuaccaaaaaccauguugcguucaaaga

SEQ ID NO: 348140 - RNA, 64 nt, Homo Sapiens
aauauagagacaggacagaauguguucuuuucuccuuuaccaguccuauuuuucaaugggaaga

SEQ ID NO: 348141 - RNA, 64 nt, Homo Sapiens; identical to SEQ ID NO: 298975

SEQ ID NO: 348142 - RNA, 64 nt, Homo Sapiens; identical to SEQ ID NO: 298976

SEQ ID NO: 348143 - RNA, 64 nt, Homo Sapiens; identical to SEQ ID NO: 171676

SEQ ID NO: 348144 - RNA, 64 nt, Homo Sapiens; identical to SEQ ID NO: 171677

SEQ ID NO: 348145 - RNA, 64 nt, Homo Sapiens; identical to SEQ ID NO: 171678

SEQ ID NO: 348146 - RNA, 64 nt, Homo Sapiens; identical to SEQ ID NO: 171679

SEQ ID NO: 348147 - RNA, 64 nt, Homo Sapiens; identical to SEQ ID NO: 171680

SEQ ID NO: 348148 - RNA, 64 nt, Homo Sapiens; identical to SEQ ID NO: 171681

SEQ ID NO: 348149 - RNA, 64 nt, Homo Sapiens; identical to SEQ ID NO: 171682

SEQ ID NO: 348150 - RNA, 64 nt, Homo Sapiens; identical to SEQ ID NO: 171683

SEQ ID NO: 348151 - RNA, 64 nt, Homo Sapiens; identical to SEQ ID NO: 171684

SEQ ID NO: 348152 - RNA, 64 nt, Homo Sapiens; identical to SEQ ID NO: 171685

SEQ ID NO: 348153 - RNA, 64 nt, Homo Sapiens; identical to SEQ ID NO: 171686

SEQ ID NO: 348154 - RNA, 64 nt, Homo Sapiens; identical to SEQ ID NO: 171687

SEQ ID NO: 348155 - RNA, 64 nt, Homo Sapiens; identical to SEQ ID NO: 171688

SEQ ID NO: 348156 - RNA, 64 nt, Homo Sapiens; identical to SEQ ID NO: 171689

SEQ ID NO: 348157 - RNA, 64 nt, Homo Sapiens; identical to SEQ ID NO: 171690

SEQ ID NO: 348158 - RNA, 64 nt, Homo Sapiens; identical to SEQ ID NO: 171691

SEQ ID NO: 348159 - RNA, 64 nt, Homo Sapiens; identical to SEQ ID NO: 171692

SEQ ID NO: 348160 - RNA, 64 nt, Homo Sapiens; identical to SEQ ID NO: 171693

SEQ ID NO: 348161 - RNA, 64 nt, Homo Sapiens; identical to SEQ ID NO: 171694

SEQ ID NO: 348162 - RNA, 64 nt, Homo Sapiens; identical to SEQ ID NO: 171695

SEQ ID NO: 348163 - RNA, 64 nt, Homo Sapiens; identical to SEQ ID NO: 171696

SEQ ID NO: 348164 - RNA, 64 nt, Homo Sapiens; identical to SEQ ID NO: 171697

SEQ ID NO: 348165 - RNA, 64 nt, Homo Sapiens; identical to SEQ ID NO: 171698

SEQ ID NO: 348166 - RNA, 64 nt, Homo Sapiens; identical to SEQ ID NO: 171699

SEQ ID NO: 348167 - RNA, 64 nt, Homo Sapiens; identical to SEQ ID NO: 171700

SEQ ID NO: 348168 - RNA, 64 nt, Homo Sapiens; identical to SEQ ID NO: 171701

SEQ ID NO: 348169 - RNA, 64 nt, Homo Sapiens; identical to SEQ ID NO: 171702

SEQ ID NO: 348170 - RNA, 64 nt, Homo Sapiens; identical to SEQ ID NO: 171703

SEQ ID NO: 348171 - RNA, 64 nt, Homo Sapiens; identical to SEQ ID NO: 171704

SEQ ID NO: 348172 - RNA, 64 nt, Homo Sapiens; identical to SEQ ID NO: 171705

SEQ ID NO: 348173 - RNA, 64 nt, Homo Sapiens; identical to SEQ ID NO: 171706

SEQ ID NO: 348174 - RNA, 64 nt, Homo Sapiens; identical to SEQ ID NO: 171707

SEQ ID NO: 348175 - RNA, 61 nt, Homo Sapiens; identical to SEQ ID NO: 171708

SEQ ID NO: 348176 - RNA, 64 nt, Homo Sapiens; identical to SEQ ID NO: 171709

SEQ ID NO: 348177 - RNA, 64 nt, Homo Sapiens; identical to SEQ ID NO: 171710

SEQ ID NO: 348178 - RNA, 64 nt, Homo Sapiens; identical to SEQ ID NO: 171711

SEQ ID NO: 348179 - RNA, 64 nt, Homo Sapiens; identical to SEQ ID NO: 171712

SEQ ID NO: 348180 - RNA, 64 nt, Homo Sapiens; identical to SEQ ID NO: 171713

SEQ ID NO: 348181 - RNA, 64 nt, Homo Sapiens; identical to SEQ ID NO: 171714

SEQ ID NO: 348182 - RNA, 64 nt, Homo Sapiens; identical to SEQ ID NO: 171715

SEQ ID NO: 348183 - RNA, 64 nt, Homo Sapiens; identical to SEQ ID NO: 171716

SEQ ID NO: 348184 - RNA, 64 nt, Homo Sapiens; identical to SEQ ID NO: 171717

SEQ ID NO: 348185 - RNA, 64 nt, Homo Sapiens; identical to SEQ ID NO: 171718

SEQ ID NO: 348186 - RNA, 64 nt, Homo Sapiens; identical to SEQ ID NO: 171719

SEQ ID NO: 348187 - RNA, 64 nt, Homo Sapiens; identical to SEQ ID NO: 171720

SEQ ID NO: 348188 - RNA, 64 nt, Homo Sapiens; identical to SEQ ID NO: 171721

SEQ ID NO: 348189 - RNA, 64 nt, Homo Sapiens; identical to SEQ ID NO: 171722

SEQ ID NO: 348190 - RNA, 64 nt, Homo Sapiens; identical to SEQ ID NO: 171723

SEQ ID NO: 348191 - RNA, 64 nt, Homo Sapiens; identical to SEQ ID NO: 171724

SEQ ID NO: 348192 - RNA, 64 nt, Homo Sapiens; identical to SEQ ID NO: 171725

SEQ ID NO: 348193 - RNA, 64 nt, Homo Sapiens; identical to SEQ ID NO: 171726

SEQ ID NO: 348194 - RNA, 64 nt, Homo Sapiens; identical to SEQ ID NO: 171727

SEQ ID NO: 348195 - RNA, 64 nt, Homo Sapiens; identical to SEQ ID NO: 171728

SEQ ID NO: 348196 - RNA, 64 nt, Homo Sapiens; identical to SEQ ID NO: 171729

SEQ ID NO: 348197 - RNA, 64 nt, Homo Sapiens; identical to SEQ ID NO: 171730

SEQ ID NO: 348198 - RNA, 64 nt, Homo Sapiens; identical to SEQ ID NO: 171731

SEQ ID NO: 348199 - RNA, 64 nt, Homo Sapiens; identical to SEQ ID NO: 171732

SEQ ID NO: 348200 - RNA, 64 nt, Homo Sapiens; identical to SEQ ID NO: 171733

SEQ ID NO: 348201 - RNA, 64 nt, Homo Sapiens; identical to SEQ ID NO: 171734

SEQ ID NO: 348202 - RNA, 64 nt, Homo Sapiens; identical to SEQ ID NO: 171735

SEQ ID NO: 348203 - RNA, 64 nt, Homo Sapiens; identical to SEQ ID NO: 171736

SEQ ID NO: 348204 - RNA, 64 nt, Homo Sapiens; identical to SEQ ID NO: 171737

SEQ ID NO: 348205 - RNA, 64 nt, Homo Sapiens; identical to SEQ ID NO: 171738

SEQ ID NO: 348206 - RNA, 64 nt, Homo Sapiens; identical to SEQ ID NO: 171739

SEQ ID NO: 348207 - RNA, 64 nt, Homo Sapiens; identical to SEQ ID NO: 171740

SEQ ID NO: 348208 - RNA, 64 nt, Homo Sapiens; identical to SEQ ID NO: 171741

SEQ ID NO: 348209 - RNA, 64 nt, Homo Sapiens; identical to SEQ ID NO: 171742

SEQ ID NO: 348210 - RNA, 64 nt, Homo Sapiens; identical to SEQ ID NO: 171743

SEQ ID NO: 348211 - RNA, 64 nt, Homo Sapiens; identical to SEQ ID NO: 171744

SEQ ID NO: 348212 - RNA, 64 nt, Homo Sapiens; identical to SEQ ID NO: 171745

SEQ ID NO: 348213 - RNA, 64 nt, Homo Sapiens; identical to SEQ ID NO: 171746

SEQ ID NO: 348214 - RNA, 64 nt, Homo Sapiens; identical to SEQ ID NO: 171747

SEQ ID NO: 348215 - RNA, 64 nt, Homo Sapiens; identical to SEQ ID NO: 171748

SEQ ID NO: 348216 - RNA, 64 nt, Homo Sapiens; identical to SEQ ID NO: 171749

SEQ ID NO: 348217 - RNA, 64 nt, Homo Sapiens; identical to SEQ ID NO: 171750

SEQ ID NO: 348218 - RNA, 64 nt, Homo Sapiens; identical to SEQ ID NO: 171751

SEQ ID NO: 348219 - RNA, 64 nt, Homo Sapiens; identical to SEQ ID NO: 171752

SEQ ID NO: 348220 - RNA, 64 nt, Homo Sapiens; identical to SEQ ID NO: 171753

SEQ ID NO: 348221 - RNA, 64 nt, Homo Sapiens; identical to SEQ ID NO: 171754

SEQ ID NO: 348222 - RNA, 64 nt, Homo Sapiens; identical to SEQ ID NO: 171755

SEQ ID NO: 348223 - RNA, 64 nt, Homo Sapiens; identical to SEQ ID NO: 171756

SEQ ID NO: 348224 - RNA, 64 nt, Homo Sapiens; identical to SEQ ID NO: 171757

SEQ ID NO: 348225 - RNA, 64 nt, Homo Sapiens; identical to SEQ ID NO: 171758

SEQ ID NO: 348226 - RNA, 64 nt, Homo Sapiens; identical to SEQ ID NO: 171759

SEQ ID NO: 348227 - RNA, 64 nt, Homo Sapiens; identical to SEQ ID NO: 171760

SEQ ID NO: 348228 - RNA, 64 nt, Homo Sapiens; identical to SEQ ID NO: 171761

SEQ ID NO: 348229 - RNA, 64 nt, Homo Sapiens; identical to SEQ ID NO: 171762

SEQ ID NO: 348230 - RNA, 64 nt, Homo Sapiens; identical to SEQ ID NO: 171763

SEQ ID NO: 348231 - RNA, 64 nt, Homo Sapiens; identical to SEQ ID NO: 171764

SEQ ID NO: 348232 - RNA, 64 nt, Homo Sapiens; identical to SEQ ID NO: 171765

SEQ ID NO: 348233 - RNA, 64 nt, Homo Sapiens; identical to SEQ ID NO: 171766

SEQ ID NO: 348234 - RNA, 64 nt, Homo Sapiens; identical to SEQ ID NO: 171767

SEQ ID NO: 348235 - RNA, 64 nt, Homo Sapiens; identical to SEQ ID NO: 171768

SEQ ID NO: 348236 - RNA, 64 nt, Homo Sapiens; identical to SEQ ID NO: 171769

SEQ ID NO: 348237 - RNA, 64 nt, Homo Sapiens; identical to SEQ ID NO: 171770

SEQ ID NO: 348238 - RNA, 64 nt, Homo Sapiens; identical to SEQ ID NO: 171771

SEQ ID NO: 348239 - RNA, 64 nt, Homo Sapiens; identical to SEQ ID NO: 171772

SEQ ID NO: 348240 - RNA, 64 nt, Homo Sapiens; identical to SEQ ID NO: 171773

SEQ ID NO: 348241 - RNA, 64 nt, Homo Sapiens; identical to SEQ ID NO: 171774

SEQ ID NO: 348242 - RNA, 64 nt, Homo Sapiens; identical to SEQ ID NO: 171775

SEQ ID NO: 348243 - RNA, 64 nt, Homo Sapiens; identical to SEQ ID NO: 171776

SEQ ID NO: 348244 - RNA, 64 nt, Homo Sapiens; identical to SEQ ID NO: 171777

SEQ ID NO: 348245 - RNA, 64 nt, Homo Sapiens; identical to SEQ ID NO: 171778

SEQ ID NO: 348246 - RNA, 64 nt, Homo Sapiens; identical to SEQ ID NO: 171779

SEQ ID NO: 348247 - RNA, 64 nt, Homo Sapiens; identical to SEQ ID NO: 171780

SEQ ID NO: 348248 - RNA, 64 nt, Homo Sapiens; identical to SEQ ID NO: 171781

SEQ ID NO: 348249 - RNA, 64 nt, Homo Sapiens; identical to SEQ ID NO: 171782

SEQ ID NO: 348250 - RNA, 64 nt, Homo Sapiens; identical to SEQ ID NO: 171783

SEQ ID NO: 348251 - RNA, 64 nt, Homo Sapiens; identical to SEQ ID NO: 171784

SEQ ID NO: 348252 - RNA, 64 nt, Homo Sapiens; identical to SEQ ID NO: 171785

SEQ ID NO: 348253 - RNA, 64 nt, Homo Sapiens; identical to SEQ ID NO: 171786

SEQ ID NO: 348254 - RNA, 64 nt, Homo Sapiens; identical to SEQ ID NO: 171787

SEQ ID NO: 348255 - RNA, 64 nt, Homo Sapiens; identical to SEQ ID NO: 171788

SEQ ID NO: 348256 - RNA, 64 nt, Homo Sapiens; identical to SEQ ID NO: 171789

SEQ ID NO: 348257 - RNA, 64 nt, Homo Sapiens; identical to SEQ ID NO: 171790

SEQ ID NO: 348258 - RNA, 64 nt, Homo Sapiens; identical to SEQ ID NO: 171791

SEQ ID NO: 348259 - RNA, 64 nt, Homo Sapiens; identical to SEQ ID NO: 171792

SEQ ID NO: 348260 - RNA, 64 nt, Homo Sapiens; identical to SEQ ID NO: 171793

SEQ ID NO: 348261 - RNA, 64 nt, Homo Sapiens; identical to SEQ ID NO: 171794

SEQ ID NO: 348262 - RNA, 64 nt, Homo Sapiens; identical to SEQ ID NO: 171795

SEQ ID NO: 348263 - RNA, 64 nt, Homo Sapiens; identical to SEQ ID NO: 171796

SEQ ID NO: 348264 - RNA, 64 nt, Homo Sapiens; identical to SEQ ID NO: 171797

SEQ ID NO: 348265 - RNA, 64 nt, Homo Sapiens; identical to SEQ ID NO: 171798

SEQ ID NO: 348266 - RNA, 64 nt, Homo Sapiens; identical to SEQ ID NO: 171799

SEQ ID NO: 348267 - RNA, 64 nt, Homo Sapiens
uucuaaaaagauucuuauuugggggagugggcaaaauguugauuauuuucuaaugcuuuguagc

SEQ ID NO: 348268 - RNA, 64 nt, Homo Sapiens
uguaaauuucaguuacuggucauagaaggcuuucaauguugaguggccuuuuauuaacauguuu

SEQ ID NO: 348269 - RNA, 64 nt, Homo Sapiens
ccaaaggguuuguauucugcuaaaaggagaugccaauguugaaugaagucugaaacucuaguau

SEQ ID NO: 348270 - RNA, 64 nt, Homo Sapiens
aauaugaaaugggaccuaauaccaguaugugauaaauguugauguuuucuguguacaaacacau

SEQ ID NO: 348271 - RNA, 64 nt, Homo Sapiens
uaucccuuggggaaaguaaauguugaaguuacuuaauguugaucaaugccaucccugcugggaa

SEQ ID NO: 348272 - RNA, 64 nt, Homo Sapiens
uuacuuaauguugaucuaucccaucccugcugggaauguugaagguaaaauucugugagaaaug

SEQ ID NO: 348273 - RNA, 64 nt, Homo Sapiens
ucauuacuuuccuuuccuccuuuaaauaaccaugaauguugauuaugcuuagcuuuuaaggcau

SEQ ID NO: 348274 - RNA, 64 nt, Homo Sapiens
uuccaugacugaacaaagagcacaugucauuucuaauguugagugagagaaggugaucuauucc

SEQ ID NO: 348275 - RNA, 64 nt, Homo Sapiens
gcugaacuuaagauagcugucaaacucaaccagcaauguugagauuguuaagagguuuugguuc

SEQ ID NO: 348276 - RNA, 64 nt, Homo Sapiens
cagugcauccauuuucuuuaacauuuuuaagcugaauguugagaagguuugcagaaaguauuaa

SEQ ID NO: 348277 - RNA, 64 nt, Homo Sapiens
agaaacgaugcguaguuuucauuuacuaauuacaaauguugaggccuaauucugaaaguccuca

SEQ ID NO: 348278 - RNA, 64 nt, Homo Sapiens
auuuaggcgaaguaguuaagaaauggcccuuuugaauguugaagauaggaaagaaagccauaua

SEQ ID NO: 348279 - RNA, 64 nt, Homo Sapiens
uccuaguauaaaacugcaagaugauggcuuauuaaauguugacuacauuuuuaaucaauugugg

SEQ ID NO: 348280 - RNA, 64 nt, Homo Sapiens
uuuacugugaaaagguuuuuuuugguaaaauuuuaauguugauucaaaaaccauaauguuggaa

SEQ ID NO: 348281 - RNA, 64 nt, Homo Sapiens
gcugggagugaguugguaauaugagaugggaaggaauguugacuugcuaacauuccuuuaacaa

SEQ ID NO: 348282 - RNA, 64 nt, Homo Sapiens
uguuuaaauuuguuacagugacuuuuaaaggauuaauguugaaucacauugucagaauuuuuuc

SEQ ID NO: 348283 - RNA, 64 nt, Homo Sapiens
ugaaagcucucaggauaauuuuuuuugcaugauuaauguugaauauauucuuugugcaugugau

SEQ ID NO: 348284 - RNA, 64 nt, Homo Sapiens
auuguacauauguauuuaagcaggauaauaguuaaauguugaguggcuguaccuauaagaugua

SEQ ID NO: 348285 - RNA, 64 nt, Homo Sapiens
aagagcacgauuagaguccuggcagagacagaagaauguugaauuggcuuuuuauuccagucua

SEQ ID NO: 348286 - RNA, 64 nt, Homo Sapiens
ucgagccgaggcccuacuugcgcuggacaacuagaauguugaccccgaggugccggagagggag

SEQ ID NO: 348287 - RNA, 64 nt, Homo Sapiens
auaucauucgccucuauaacuacaguacuaagacaauguugaauacggaaagugccuuagacac

SEQ ID NO: 348288 - RNA, 64 nt, Homo Sapiens
ugccagugggugugacuccuaugccaucuuccugaauguugacauuauggagccuccagaacag

SEQ ID NO: 348289 - RNA, 64 nt, Homo Sapiens
acuucuuauggaggagaguguuuaacugaguuagaauguugaaacugacuugcugugacuuaug

SEQ ID NO: 348290 - RNA, 64 nt, Homo Sapiens
caguaaucaguuugcuaacauauuuaaagucuugaauguugaagaacucaugugauuuacccuu

SEQ ID NO: 348291 - RNA, 64 nt, Homo Sapiens
cuuuuaauacuauaguuucaccuguauucuaguaaauguugagacaccguuuugcuuuuaagua

SEQ ID NO: 348292 - RNA, 64 nt, Homo Sapiens
agcaagaucauuuacccaaggauagguguuugguaauguugaaggaguuagucuggcuucaugu

SEQ ID NO: 348293 - RNA, 63 nt, Homo Sapiens; identical to SEQ ID NO: 38974

SEQ ID NO: 348294 - RNA, 63 nt, Homo Sapiens; identical to SEQ ID NO: 38975

SEQ ID NO: 348295 - RNA, 64 nt, Homo Sapiens
cuuaaaagaaaguguccaguugucuucaggugcuuugccaaacuacugugagcaggugggccug

SEQ ID NO: 348296 - RNA, 64 nt, Homo Sapiens
auaagaaaacugucuuggaggcuucaucccauccuugccaaaaacugucagggaggcaaaaaag

SEQ ID NO: 348297 - RNA, 64 nt, Homo Sapiens
aagcaggaaggaggagugaauuuuauuaacauguuugccaaauguauugagauuuggccucuga

SEQ ID NO: 348298 - RNA, 64 nt, Homo Sapiens
cuuuaucauuguuuacuacuaguaaaaagcagcauugccaaauaaucccuaauuuuccacuaaa

SEQ ID NO: 348299 - RNA, 64 nt, Homo Sapiens
uucauuuuacuaaaaagauuccucguuauuguuguugccaaagagaaacaaaaaugauuuugcu

SEQ ID NO: 348300 - RNA, 64 nt, Homo Sapiens
ugggccaacuauuuaguaagcccggauagacuuauugccaaaaacaaaaaauagcuuucaaaag

SEQ ID NO: 348301 - RNA, 64 nt, Homo Sapiens
uuagaaagguggagcuguaaggaagggagggauuuugccaaaagacaaugacaacaucacaagg

SEQ ID NO: 348302 - RNA, 64 nt, Homo Sapiens
gcaucuaccuuaccuccuaacuaucccauaucgauugccaaagaguccugugaauuuuaaaaag

SEQ ID NO: 348303 - RNA, 64 nt, Homo Sapiens
ugcaaucuugggggugguuuuauuuauuucuuuuuugccaaauagaguguggauucauuucagg

SEQ ID NO: 348304 - RNA, 64 nt, Homo Sapiens
gaguagggcaauggaaauaccaaaccuucugacuuugccaaaaagcauacaagcaaccugguca

SEQ ID NO: 348305 - RNA, 64 nt, Homo Sapiens
gguaauucacuucaguuuaaugucuccuuugcucuugccaaaaaauagcacacuuuuccacauu

SEQ ID NO: 348306 - RNA, 64 nt, Homo Sapiens
ucgaacuuucaaaauauauuuucaguacacccaguugccaaaguuuugcugucucuuagagaaa

SEQ ID NO: 348307 - RNA, 64 nt, Homo Sapiens
aaaaggaaccuguuucuuagaagaaguaacauuuuugccaaaagaugacugggguuuuccguuu

SEQ ID NO: 348308 - RNA, 64 nt, Homo Sapiens
ccguuuguuaauauuaagcacaucagaacgugaauugccaaagucuucauuagaaggcagcauu

SEQ ID NO: 348309 - RNA, 64 nt, Homo Sapiens
cucaaacugacacaagaccuacagagaaaacccuuugccaaaucugcucucagcaaguggacag

SEQ ID NO: 348310 - RNA, 64 nt, Homo Sapiens
uuucaggaaagaaaucagcucagcucuccacucauugccaaaugucacuaaaggguuuaguuuu

SEQ ID NO: 348311 - RNA, 64 nt, Homo Sapiens
aucuaggaaauuaguuguauaguauucugaucaguugccaaagaucuauagcgagacauagaau

SEQ ID NO: 348312 - RNA, 64 nt, Homo Sapiens
aggaaauaagguuagaagcccgugagcuggucaguugccaaagguuucaucacuaguaugugug

SEQ ID NO: 348313 - RNA, 64 nt, Homo Sapiens
aaucggccaugguuugcauugucuuaagaaauaauugccaaaaaaaggacuuuugugcaauaug

SEQ ID NO: 348314 - RNA, 64 nt, Homo Sapiens
guuuguuuuauucaagacuccacaaaacaaugaauugccaaauuuaaguuuggagaaaauacca

SEQ ID NO: 348315 - RNA, 64 nt, Homo Sapiens
ccuccauggccaaguguuaauucuguaccaaaacuugccaaauugggucaguuccucacagugg

SEQ ID NO: 348316 - RNA, 64 nt, Homo Sapiens
agaggaaccacagaaagagaugcugccaagccacuugccaaagaaggucccuaguggguauauu

SEQ ID NO: 348317 - RNA, 64 nt, Homo Sapiens
auaucaauggugaugccgucauuuuuuuuuuuuuuugccaaacauuugauucuucuuuuuaaca

SEQ ID NO: 348318 - RNA, 64 nt, Homo Sapiens
ugguuuuaugcauugaugguuuuuuuuuucuuuuuugccaaauugacugucacgcggcagcuuc

SEQ ID NO: 348319 - RNA, 64 nt, Homo Sapiens
gaacccuccuccugucaauggggguguaguauuuuugccaaaauaucauguucaauuucaguag

SEQ ID NO: 348320 - RNA, 64 nt, Homo Sapiens
aaaacuuucaauggagauagggcuagaaauacuuuugccaaauagcauucuuauucacuuuaug

SEQ ID NO: 348321 - RNA, 64 nt, Homo Sapiens
aaaugcagucaucuuaauacuagucuauacauuuuugccaaauggcgcaaauauaccuccauuu

SEQ ID NO: 348322 - RNA, 64 nt, Homo Sapiens
uugaaacuacacacaaaaagguucucuaauuaucuugccaaauucuucuccaugucaguaucau

SEQ ID NO: 348323 - RNA, 64 nt, Homo Sapiens
aaaacaaaaaacuauguauuacaaaaugaaacauuugccaaaacauuggaccgaagucauuaaa

SEQ ID NO: 348324 - RNA, 64 nt, Homo Sapiens
agaaaaggcagguggugggcuuuuguuuuuguuuuugccaaaguauugucuugaggcuuccagg

SEQ ID NO: 348325 - RNA, 64 nt, Homo Sapiens
acucccugaggccucuccgcucagggcugcccuguugccaaacauucccaucagccagaggggg

SEQ ID NO: 348326 - RNA, 64 nt, Homo Sapiens
uucauuuuguaaugugguuuaacauccuuguuguuugccaaagaaauuucauuuggcugugaau

SEQ ID NO: 348327 - RNA, 64 nt, Homo Sapiens
aaacucuguuucugcaggggaugauauuggugaguugccaaagaagcaauacagcauaucugcu

SEQ ID NO: 348328 - RNA, 64 nt, Homo Sapiens
uugccauugugcuccugcauuuagcccaaaacaguugccaaacuguuuucuuucauacucauaa

SEQ ID NO: 348329 - RNA, 50 nt, Homo Sapiens
aagagaacugacuugcaagcuugccaaaucaugaaaauaguggaagguaa

SEQ ID NO: 348330 - RNA, 64 nt, Homo Sapiens
ucuacacauugggauuggaaaaaacuuguggauguugccaaagcaaagaaaauuucuacauauu

SEQ ID NO: 348331 - RNA, 64 nt, Homo Sapiens
uauugaaccugaauuuaagcaagauauacacaucuugccaaaaagccuccuaaugugcuacagu

SEQ ID NO: 348332 - RNA, 64 nt, Homo Sapiens
cuuacugcagauuaaguaaagccacugcauuguuuugccaaaaaucuggcaagaacaccucgga

SEQ ID NO: 348333 - RNA, 64 nt, Homo Sapiens
ugauaagaaaagcagccaacacaggugagggugguugccaaaggguccguuagaucuugauuuu

SEQ ID NO: 348334 - RNA, 64 nt, Homo Sapiens
caacagccaaaaaaaaaaaaugucuuaagaaugguugccaaaaaacacaguucuucuuucagcu

SEQ ID NO: 348335 - RNA, 64 nt, Homo Sapiens
uugcagcaaacaagugugcgacccuuuaaaucauuugccaaacaucugcaugaguugcuuuugu

SEQ ID NO: 348336 - RNA, 64 nt, Homo Sapiens
agccaagaugcucugcucacaccuguaauaggccauggcacaccaggggaucaauauuuugcac

SEQ ID NO: 348337 - RNA, 64 nt, Homo Sapiens
gggauaaacaagcaagauugaaaauaauauuuuuauggcacacuucccaucauagcacauguag

SEQ ID NO: 348338 - RNA, 64 nt, Homo Sapiens
agauaaauauggcuuugaaaauaaacuaaaauuuauggcacaaauauacauuauaauguaauau

SEQ ID NO: 348339 - RNA, 64 nt, Homo Sapiens
uaacaccuacugauauucacugccacagcagcccauggcacaaccuuaaggggauagacuagac

SEQ ID NO: 348340 - RNA, 64 nt, Homo Sapiens
acaccaaauauugguuaugaaauccuguggccacauggcacaaaaaccaugaugugaaacugac

SEQ ID NO: 348341 - RNA, 64 nt, Homo Sapiens
auggagaaaggacacacuggggucuuugguuuugauggcacacuuuugacaucaaccauuagua

SEQ ID NO: 348342 - RNA, 64 nt, Homo Sapiens
ggucccccagggcuuccucccacagcagcugugaauggcacagugaccuuccugcagcguggag

SEQ ID NO: 348343 - RNA, 64 nt, Homo Sapiens
gugaauggcacagugaccuuccugcagcguggagauggcacauccuugcugcuggggacuuggc

SEQ ID NO: 348344 - RNA, 64 nt, Homo Sapiens
agacauuuaagauugucagcaaacuugucccaaaauggcacaucaucauaauccauuuucucuu

SEQ ID NO: 348345 - RNA, 64 nt, Homo Sapiens
uuguuuuuauucuuacacgacuacaguacuucaaauggcacauagauaggcaggauauuacaua

SEQ ID NO: 348346 - RNA, 64 nt, Homo Sapiens
uuucagugucacagagacauucuuugauaaggaaauggcacaaacauaaagggaaaggcugcua

SEQ ID NO: 348347 - RNA, 64 nt, Homo Sapiens
ucaauauuaaagauagcugagaagcaccuuucaaauggcacagucccucuucaagaugucuaaa

SEQ ID NO: 348348 - RNA, 64 nt, Homo Sapiens
cacugcucacugcagccucgcaugcuggaguacaauggcacaaacagggucuugcuuugucacc

SEQ ID NO: 348349 - RNA, 64 nt, Homo Sapiens
ucaugcccuguaauccuagcccucgaagauggguauggcacaguaauucuacaugaccauaaaa

SEQ ID NO: 348350 - RNA, 64 nt, Homo Sapiens
ucucauuuuggaucucacuguugucuuuauaaaaauggcacauuuuacaaaguaguuuauucuu

SEQ ID NO: 348351 - RNA, 64 nt, Homo Sapiens
gaaaaggcagacacugguugggaccaaagucuccauggcacaugacugaagacugguggucgug

SEQ ID NO: 348352 - RNA, 64 nt, Homo Sapiens
cuuaguucauauaaucucgggauacacacacacacacacauauauauacacacacauacguaua

SEQ ID NO: 348353 - RNA, 64 nt, Homo Sapiens
ucgggauacacacacacacacacauauauauacacacacauacguauacacacacauacauaua

SEQ ID NO: 348354 - RNA, 64 nt, Homo Sapiens
cacacacauauauauacacacacauacguauacacacacauacauauauauaaauauaccugau

SEQ ID NO: 348355 - RNA, 64 nt, Homo Sapiens
aagaccaaacagaacaugagaauacacacacacacacacauauacacacacacacacuucacac

SEQ ID NO: 348356 - RNA, 64 nt, Homo Sapiens
acacacacacacacauauacacacacacacacuucacacauacacaccacucccaccaccguca

SEQ ID NO: 348357 - RNA, 64 nt, Homo Sapiens
aaucauauauaguccagucuucauuuuacauacacacacauauuuuacacacacacacauuuua

SEQ ID NO: 348358 - RNA, 64 nt, Homo Sapiens
acacacacacauuuuacacacacacacacacacacacacauauguuuuucuagucucuggcaug

SEQ ID NO: 348359 - RNA, 64 nt, Homo Sapiens
agagacaagccauuuacauacagauauucacagucacacauagaaacacccacauggacacaag

SEQ ID NO: 348360 - RNA, 64 nt, Homo Sapiens
cguuauacacaaggccagguaagcgcucauaauucacacauaauaaaacaucuagguuucauuc

SEQ ID NO: 348361 - RNA, 64 nt, Homo Sapiens
ugcuacccagagauuaauuuuaauuuuauauuuacacacauacgacuggugcuaaugucuaaua

SEQ ID NO: 348362 - RNA, 64 nt, Homo Sapiens
augaugaauuaaaaaaguuuaccacuuauuaaaacacacauagaauuccuauaaugggagcauc

SEQ ID NO: 348363 - RNA, 64 nt, Homo Sapiens
auauauauagauauauaaucuauaucuguauagacacacauauaaagaugaauauauauauaua

SEQ ID NO: 348364 - RNA, 64 nt, Homo Sapiens
ugaaaauacggaaggcuuugacauuuuguaaggccacacauaagccauagauuuuuuaaaaacu

SEQ ID NO: 348365 - RNA, 64 nt, Homo Sapiens
augguaaugccagucccaggucccaggugcucuccacacauagguuucuuuuaaauuauaucug

SEQ ID NO: 348366 - RNA, 64 nt, Homo Sapiens
gcaguagcagcagcagcagccacgcacauacacacacacauauacacaugcgugugcacccgcg

SEQ ID NO: 348367 - RNA, 64 nt, Homo Sapiens
uuauuauacugagauauauauauauacacacacacacacauauguguauauauguauauauaua

SEQ ID NO: 348368 - RNA, 64 nt, Homo Sapiens
uauaugugaguauauauacacacacacacacacacacacauauauauauauacacacacgcaca

SEQ ID NO: 348369 - RNA, 64 nt, Homo Sapiens
cacacacacacacauauauauauauacacacacgcacacauauauguugcugcagcauaaagaa

SEQ ID NO: 348370 - RNA, 64 nt, Homo Sapiens
ccauguucuucuaaaacauauacauauauacauacacacauacacauauucuucaggucucuaa

SEQ ID NO: 348371 - RNA, 64 nt, Homo Sapiens
cauaugcacacacgcauacacacaugcacgcacacacacauacacacaugcacgcacgcacgca

SEQ ID NO: 348372 - RNA, 64 nt, Homo Sapiens
cgcucuauuaacuuugccuauuucuaucuguggucacacauacauauuugguaucucuugcucc

SEQ ID NO: 348373 - RNA, 64 nt, Homo Sapiens
gaaggcuuuauaugucucauuugaaucaacuucucacacauacuugagugucaccaguggguaa

SEQ ID NO: 348374 - RNA, 64 nt, Homo Sapiens
cacugucaugcacucaacuacacucacagacccacacacauacacacacacacacauauacaca

SEQ ID NO: 348375 - RNA, 64 nt, Homo Sapiens
cacacacucacagacccacacacacacacacacacacacauauacacuuauaaaccucuguaca

SEQ ID NO: 348376 - RNA, 64 nt, Homo Sapiens
cugccacacaaacguauguaaauguauauacccacacacauacacacauaugucauauauuacu

SEQ ID NO: 348377 - RNA, 64 nt, Homo Sapiens
caaacguauguaaauguauauacccacacacauacacacauaugucauauauuacuagcauaug

SEQ ID NO: 348378 - RNA, 64 nt, Homo Sapiens
uguuucuguguuccucuuuuuauauauauauauacacacauauaauacauauguguguguauag

SEQ ID NO: 348379 - RNA, 64 nt, Homo Sapiens
uauguguguguauaguauauuguauauauauacacacacauacauauacauauauacauauaua

SEQ ID NO: 348380 - RNA, 64 nt, Homo Sapiens
uauauauauauaauucaaaguauauauacacacacacacauauaguuaaaauuauauauauaua

SEQ ID NO: 348381 - RNA, 64 nt, Homo Sapiens
gauagaauguauuauauauauauauauauacacacacacauauauauagcugaaucuuuggugu

SEQ ID NO: 348382 - RNA, 64 nt, Homo Sapiens
cuuucaaaaaaaaaaacaaaaaaaaaaccacacacacacauaaaaaacccaacaggucaaaaua

SEQ ID NO: 348383 - RNA, 64 nt, Homo Sapiens
auuuuuuaaagguauucauggugacucaggaauacacacauacacacacacacacacacacaca

SEQ ID NO: 348384 - RNA, 64 nt, Homo Sapiens
cacacauacacacacacacacacacacacacacacacacauacacacauauaauuugaaagagg

SEQ ID NO: 348385 - RNA, 64 nt, Homo Sapiens
cacacacacacacacacacacacacacacacauacacacauauaauuugaaagaggugaguaug

SEQ ID NO: 348386 - RNA, 64 nt, Homo Sapiens
uucccucccaggucugugucugauagcauacacacacacauauauauacacacacacacacaca

SEQ ID NO: 348387 - RNA, 64 nt, Homo Sapiens
uauacacacacacacacacacacacacacacacacacacauacauacacacacacauauauaua

SEQ ID NO: 348388 - RNA, 64 nt, Homo Sapiens
cacacacacacacacacacacacauacauacacacacacauauauauacacacacacacacaca

SEQ ID NO: 348389 - RNA, 64 nt, Homo Sapiens
caggaggccccugcggaggcagcguggaucugcccacacauaggcuacuggaauaguuuaaccc

SEQ ID NO: 348390 - RNA, 64 nt, Homo Sapiens
cuuauuuaacccuuuuguguucuagauuuacuuacacacauagccuagagcucaguuuuaguuu

SEQ ID NO: 348391 - RNA, 64 nt, Homo Sapiens
uauaauuuuuuuuuuuuuugcauauauauacauacacacauacauacauauauauauauauaua

SEQ ID NO: 348392 - RNA, 64 nt, Homo Sapiens
uacauacauauauauauauacacacacacacacacacacauacauccauauauacacacacaca

SEQ ID NO: 348393 - RNA, 64 nt, Homo Sapiens
uguauauaggauacacacucauauauguagaacacacacauagauauauauauggauggaugua

SEQ ID NO: 348394 - RNA, 64 nt, Homo Sapiens
uauauggauggauguaauaugcuagauauauacacacacauauagagagagaaguaccacugug

SEQ ID NO: 348395 - RNA, 64 nt, Homo Sapiens
auagugacugugccauaggaaagcagccccuccucacacauacaugugcacaugcacacacaug

SEQ ID NO: 348396 - RNA, 64 nt, Homo Sapiens
ugugcacaugcacacacaugcaugcacacacaugcacacauacacgcacaugcacacauacaca

SEQ ID NO: 348397 - RNA, 64 nt, Homo Sapiens
ugcaugcacacacaugcacacauacacgcacaugcacacauacacaugcaugcacacauacaca

SEQ ID NO: 348398 - RNA, 64 nt, Homo Sapiens
cacauacacgcacaugcacacauacacaugcaugcacacauacacaggcauacaugcaugcaca

SEQ ID NO: 348399 - RNA, 64 nt, Homo Sapiens
ugcaugcacacacacaugcacgcacacacacaugcacacauacacgugcacacauacacaggca

SEQ ID NO: 348400 - RNA, 64 nt, Homo Sapiens
caugcacgcacacacacaugcacacauacacgugcacacauacacaggcacacaugcaugcaca

SEQ ID NO: 348401 - RNA, 64 nt, Homo Sapiens
uacacgugcacacauacacaggcacacaugcaugcacacauacacaugcacacacacaugcaca

SEQ ID NO: 348402 - RNA, 64 nt, Homo Sapiens
caugcaugcacacauacacaugcacacacacaugcacacauauaugcacaggcacacacaugua

SEQ ID NO: 348403 - RNA, 64 nt, Homo Sapiens
aggcacacacauguacgcacacacacaugcacugcacacauauccaugcacacaaacacauaua

SEQ ID NO: 348404 - RNA, 64 nt, Homo Sapiens
aaccaagugguagacucacauucugaagucucaccacacauaauagcuuaagcauuuuuucaua

SEQ ID NO: 348405 - RNA, 64 nt, Homo Sapiens
guuuuaaaauaagaauguuacaaaaucuccaauccacacauauuuaucuuuugugccuagauug

SEQ ID NO: 348406 - RNA, 64 nt, Homo Sapiens
uaaaucuugcccugcaugaauauauacacacacacacacauacuugugugugugugugugugua

SEQ ID NO: 348407 - RNA, 64 nt, Homo Sapiens
gcacuucauagaaucaaagucacacacacacaugcacacauaccauauauauauauaauacaca

SEQ ID NO: 348408 - RNA, 64 nt, Homo Sapiens
agguugaaagagaguugaggaacuuggcacugcgcacacauacucagcuggggagguagcugag

SEQ ID NO: 348409 - RNA, 64 nt, Homo Sapiens
uuagaugugugcucccuguuguucauauguuaagcacacauacuuaugugaucgcacccggacu

SEQ ID NO: 348410 - RNA, 64 nt, Homo Sapiens
uugaaaacugauuggcacuuuacauauguauacacacacauaauuacaugcaugcacacauaca

SEQ ID NO: 348411 - RNA, 64 nt, Homo Sapiens
uacauauguauacacacacaaacauacaugcaugcacacauacagaaaaaauacacauaauaca

SEQ ID NO: 348412 - RNA, 64 nt, Homo Sapiens
gaaauuaagacguuucuuugcaaaacaaggaaaucacacauaugcacacauacauauuuauggu

SEQ ID NO: 348413 - RNA, 64 nt, Homo Sapiens
cguuucuuugcaaaacaaggaaaucacacauaugcacacauacauauuuaugguuacuaugauu

SEQ ID NO: 348414 - RNA, 64 nt, Homo Sapiens
gugggagucguuuuuuuuaaaauuuggugaguaacacacauauaggugauauccagcauguuug

SEQ ID NO: 348415 - RNA, 64 nt, Homo Sapiens
cuauaccccacuauauaaaaaacacgugugcauacacacauaccaaaaucuuacagaaccuuua

SEQ ID NO: 348416 - RNA, 64 nt, Homo Sapiens
cccaugaugugagcaaacacaacacacacacagacacacauacacacacacauacacaccccug

SEQ ID NO: 348417 - RNA, 64 nt, Homo Sapiens
caccccugaacacacacacaagacacacaacacacacacauacacacacccugaaaacacacac

SEQ ID NO: 348418 - RNA, 64 nt, Homo Sapiens
cacacacagagucuuuauugcagacacacauacacacacauacacuaggauuacaggcgugaga

SEQ ID NO: 348419 - RNA, 64 nt, Homo Sapiens
cacacauacacacacacagaaggcgugagacagacacacauacaagaaugagugcuaggauuac

SEQ ID NO: 348420 - RNA, 64 nt, Homo Sapiens
cucagcccuccacacacacucacccccacucccacacacauacacacacacacacacauacccc

SEQ ID NO: 348421 - RNA, 64 nt, Homo Sapiens
cucacccccacucccacacacauacacacacacacacacauaccccaucucccgagggcugacc

SEQ ID NO: 348422 - RNA, 64 nt, Homo Sapiens
uauauauauauauuuuuuuucacacacacacacacacacauauauauacacacacacacacaca

SEQ ID NO: 348423 - RNA, 64 nt, Homo Sapiens
uacauauacacacacacacacacacacacacacacacacauauauauauauauauauacacaca

SEQ ID NO: 348424 - RNA, 64 nt, Homo Sapiens
uguguguguguguauauguguuuauagagauacacacacauauauauguguguauauauauaca

SEQ ID NO: 348425 - RNA, 64 nt, Homo Sapiens
uacauauauauacacacacgcauuugcacagacacacacauauaucaauucucaugaguguauu

SEQ ID NO: 348426 - RNA, 64 nt, Homo Sapiens
ucaaaauuuuuacagguuugcucaucugccagagcacacauauaaauuugguauuucuuaacau

SEQ ID NO: 348427 - RNA, 64 nt, Homo Sapiens
gaggugaagauagagacauagagaggcugugaaacacacauacagcccuguuaggucuuuugaa

SEQ ID NO: 348428 - RNA, 64 nt, Homo Sapiens
caguugccuagaaaggaucaaauggaacauuugacacacauacucaaaaaaauguaacugacua

SEQ ID NO: 348429 - RNA, 64 nt, Homo Sapiens
auuaauaucuaacauaaaauuguuaauuuauacacacacauacacucauacauagagagagauu

SEQ ID NO: 348430 - RNA, 64 nt, Homo Sapiens
auauaugaauuuguguaacacacacagagacacacacacauacuacuuuaagggggugaggauc

SEQ ID NO: 348431 - RNA, 64 nt, Homo Sapiens
cuuugaauuuuacuuacauuuacacacacacgcacacacauauguauauacacauaucauuuua

SEQ ID NO: 348432 - RNA, 64 nt, Homo Sapiens
gcauaaaauacucagcagggcauauauauacucacacacauauauauagauauagauauacaca

SEQ ID NO: 348433 - RNA, 64 nt, Homo Sapiens
uauacucacacacauauagcuagauauagauauacacacauauauggauauagaucuacaucua

SEQ ID NO: 348434 - RNA, 64 nt, Homo Sapiens
ugcaguuuacugaaaaguagguuauagguugaagcacacauauuagcucaaagugacagaauau

SEQ ID NO: 348435 - RNA, 64 nt, Homo Sapiens
cauagacacacaaacacacacacacacacauacacacacauauagucucccuccucaacacaca

SEQ ID NO: 348436 - RNA, 64 nt, Homo Sapiens
cacacauauacauagacacaucaacacacacacacacacauacaccuccacacugucucccucc

SEQ ID NO: 348437 - RNA, 64 nt, Homo Sapiens; identical to SEQ ID NO: 211145

SEQ ID NO: 348438 - RNA, 64 nt, Homo Sapiens; identical to SEQ ID NO: 211146

SEQ ID NO: 348439 - RNA, 64 nt, Homo Sapiens; identical to SEQ ID NO: 211147

SEQ ID NO: 348440 - RNA, 64 nt, Homo Sapiens; identical to SEQ ID NO: 211148

SEQ ID NO: 348441 - RNA, 64 nt, Homo Sapiens; identical to SEQ ID NO: 211149

SEQ ID NO: 348442 - RNA, 64 nt, Homo Sapiens; identical to SEQ ID NO: 211150

SEQ ID NO: 348443 - RNA, 64 nt, Homo Sapiens; identical to SEQ ID NO: 211151

SEQ ID NO: 348444 - RNA, 64 nt, Homo Sapiens; identical to SEQ ID NO: 211152

SEQ ID NO: 348445 - RNA, 64 nt, Homo Sapiens
aagcauaggcucaggauuaauugaaagucaagaaggacagcagcggccgcuuuuuuaggccuag

SEQ ID NO: 348446 - RNA, 64 nt, Homo Sapiens
cagccugugcacaugggacaugugcugccaaaugggacagcacagccugguggggcuacugcag

SEQ ID NO: 348447 - RNA, 64 nt, Homo Sapiens
aggcccccacauacccugcaguuuucucuguccaggacagcagguaaaaaggaauccccagagc

SEQ ID NO: 348448 - RNA, 64 nt, Homo Sapiens
ccuguagggaguuuuccaggcagguccuuugccaggacagcaugguccugcccuguugucccgu

SEQ ID NO: 348449 - RNA, 64 nt, Homo Sapiens
acagcugcgcacacagcugcuugcucaggggccgggacagcacugggugcucaggcuggccaag

SEQ ID NO: 348450 - RNA, 64 nt, Homo Sapiens
caaggaucaagccgacuaccugugcugucuacugggacagcagucuccgagcuacuccguaccu

SEQ ID NO: 348451 - RNA, 64 nt, Homo Sapiens
ggggagggaaccauuuggcauggcagcccaggauggacagcagugguacuggcaguuuugggag

SEQ ID NO: 348452 - RNA, 64 nt, Homo Sapiens
ucauauguaaccauuugaaugacagaaagaugcaggacagcauugggguagcugcuaucuuuga

SEQ ID NO: 348453 - RNA, 64 nt, Homo Sapiens
uacauaguucacccuaauuuauacuuacucaucuggacagcaucuccucagauggugaauuaug

SEQ ID NO: 348454 - RNA, 64 nt, Homo Sapiens
uaguucauuggaugaggcugggugacauuucccaggacagcauggugaacauuaccaggcaugc

SEQ ID NO: 348455 - RNA, 64 nt, Homo Sapiens
agccuccaagcacagagccuuggaaagaggcucuggacagcagacaugccagauucugccucuc

SEQ ID NO: 348456 - RNA, 64 nt, Homo Sapiens
ccuucccacaugccugcgccagcugcuguucucaggacagcauccuauuuuugacuguagccac

SEQ ID NO: 348457 - RNA, 64 nt, Homo Sapiens
ccaaggaaacuguuaacuuauucauaguccuauuggacagcaggagcagcuccuacagugaacu

SEQ ID NO: 348458 - RNA, 64 nt, Homo Sapiens
cccagacccuuauuccagaugcugagagugaccaggacagcagcuccugaggcccaguggucuu

SEQ ID NO: 348459 - RNA, 64 nt, Homo Sapiens
cucgcagcagccucgggacaaaacaaugacucaaggacagcacuucucgcagaaggucuggaag

SEQ ID NO: 348460 - RNA, 64 nt, Homo Sapiens
gcagcagcuggacaggggcuacuggguuuggccuggacagcacugauuuguggauguggauggg

SEQ ID NO: 348461 - RNA, 64 nt, Homo Sapiens
gguggcauggacagggagucguccgcccuuuccgggacagcaaaucccaucucaguccagcaag

SEQ ID NO: 348462 - RNA, 64 nt, Homo Sapiens
gagaggaggaccuugugccugcccagagccugcaggacagcacgccuugaggucagaggccugg

SEQ ID NO: 348463 - RNA, 64 nt, Homo Sapiens
acaguugauauauuuguaacugguacaagaugaaggacagcagcuuuccaucccuaguucagag

SEQ ID NO: 348464 - RNA, 64 nt, Homo Sapiens
caugagguccgccuccugggcgagacccagcaguggacagcaugguccucacacccagcucccu

SEQ ID NO: 348465 - RNA, 64 nt, Homo Sapiens
uagaggaaucaaagccagcacuugugaauguuaaggacagcaggugcacuguugaaaacugcug

SEQ ID NO: 348466 - RNA, 64 nt, Homo Sapiens
cuuuccuguagcccauguuccugcuggacagcgaggacagcaggagaucaacacguacuggggc

SEQ ID NO: 348467 - RNA, 64 nt, Homo Sapiens
uauguuauuaucccaaugaaagaucaugcauuggggacagcagaaacaaaagcuuuuuuggaaa

SEQ ID NO: 348468 - RNA, 64 nt, Homo Sapiens
gcaugcacuucauacuagcaaucacagcacaggaggacagcauuaaauuuuauauagccaauuu

SEQ ID NO: 348469 - RNA, 64 nt, Homo Sapiens
ucuuuuugcuuacaguuuuaaauucugaacaauucucucuuauauguguauugcuaaucauuaa

SEQ ID NO: 348470 - RNA, 64 nt, Homo Sapiens
acauguuuaguauuaugucuuauuggugcauuuacucucuuaucauuauguaauguccuucuuu

SEQ ID NO: 348471 - RNA, 64 nt, Homo Sapiens
ucccugcgggccaggcacugcccuuuucaggaagcucucuuaaaauacccauugccccagaccu

SEQ ID NO: 348472 - RNA, 64 nt, Homo Sapiens
ggguggaaggaugggauggguuccagagguauuccucucuuaaaugcaagugccuagauuaggu

SEQ ID NO: 348473 - RNA, 64 nt, Homo Sapiens
cugucccuuuguagucagcuuucacucccaauagcucucuuaugagucgguacagaacaguucc

SEQ ID NO: 348474 - RNA, 64 nt, Homo Sapiens
uauucuugauucuagugacagagaaauaguguuccucucuuauaaagucucaguaguaucccua

SEQ ID NO: 348475 - RNA, 64 nt, Homo Sapiens
auuggaggauuugccauuguucucugucuuuuuucucucuuagauucucuuucucucuccuauc

SEQ ID NO: 348476 - RNA, 64 nt, Homo Sapiens
guucuuucauauggaauguaaaagcuacaauauucucucuuauuguuucuugacccuuuuguau

SEQ ID NO: 348477 - RNA, 64 nt, Homo Sapiens
acugcugacuugguuaugcacuccaaaaucaucucucucuuaggguuuaacuaaucucauuuaa

SEQ ID NO: 348478 - RNA, 64 nt, Homo Sapiens
gucuguuuuuagacuucaugaauucaguaucucccucucuuaaaauuuaauagguaaucaaggc

SEQ ID NO: 348479 - RNA, 64 nt, Homo Sapiens
uaaaugaacaaagcaaaggauacagagguauguucucucuuagaagcuaacuucccugagacug

SEQ ID NO: 348480 - RNA, 64 nt, Homo Sapiens
gagaugaaagauguauaauguagagaacugacuucucucuuaaaaaguacagagagccugugcu

SEQ ID NO: 348481 - RNA, 64 nt, Homo Sapiens; identical to SEQ ID NO: 311206

SEQ ID NO: 348482 - RNA, 64 nt, Homo Sapiens; identical to SEQ ID NO: 311207

SEQ ID NO: 348483 - RNA, 64 nt, Homo Sapiens; identical to SEQ ID NO: 311208

SEQ ID NO: 348484 - RNA, 64 nt, Homo Sapiens; identical to SEQ ID NO: 311209

SEQ ID NO: 348485 - RNA, 64 nt, Homo Sapiens; identical to SEQ ID NO: 311210

SEQ ID NO: 348486 - RNA, 64 nt, Homo Sapiens; identical to SEQ ID NO: 311211

SEQ ID NO: 348487 - RNA, 64 nt, Homo Sapiens; identical to SEQ ID NO: 311212

SEQ ID NO: 348488 - RNA, 64 nt, Homo Sapiens; identical to SEQ ID NO: 311213

SEQ ID NO: 348489 - RNA, 64 nt, Homo Sapiens; identical to SEQ ID NO: 311214

SEQ ID NO: 348490 - RNA, 64 nt, Homo Sapiens; identical to SEQ ID NO: 311215

SEQ ID NO: 348491 - RNA, 64 nt, Homo Sapiens; identical to SEQ ID NO: 311216

SEQ ID NO: 348492 - RNA, 64 nt, Homo Sapiens; identical to SEQ ID NO: 311217

SEQ ID NO: 348493 - RNA, 64 nt, Homo Sapiens
cauuuaccuuguauagaggauuguucauuccuuugggacuaaguuauaguuauggugagugugu

SEQ ID NO: 348494 - RNA, 64 nt, Homo Sapiens
uucaggcuccacgcacagaaucucgcagauaguugggacuaagcgggcucuaucgcucagggcg

SEQ ID NO: 348495 - RNA, 64 nt, Homo Sapiens
auuaagaauacuuaaaaugccugggauaguucuugggacuaacaacaugaucuucuuugaguua

SEQ ID NO: 348496 - RNA, 64 nt, Homo Sapiens
augagggugcucuugugacuuaauuuuuguucaagggacuaaauugcuuauguuuauucccugu

SEQ ID NO: 348497 - RNA, 64 nt, Homo Sapiens
caaacucaaggaacuguuggugcucagaacaggugggacuaaaagcuuuacaaguauuagugca

SEQ ID NO: 348498 - RNA, 64 nt, Homo Sapiens
gcccugcucugaacacgaaggacuagccuggcuugggacuaaaucuuuggucucuugcuugugg

SEQ ID NO: 348499 - RNA, 64 nt, Homo Sapiens
gagagaagcauguuauuacaacacacucuuuuaggggacuaagaacacacacacacacacacac

SEQ ID NO: 348500 - RNA, 64 nt, Homo Sapiens
caagcccugugguuugaaggugagcugugaggaugggacuaauugauaugcaccaguuuacaaa

SEQ ID NO: 348501 - RNA, 64 nt, Homo Sapiens
guuuuaagucuucauggauguucugcaugucauggggacuaaaacucacccaacagaucuuucc

SEQ ID NO: 348502 - RNA, 64 nt, Homo Sapiens
cuguuuguuauaagauuggaaacaauuuuugagagggacuaauuuaaacaaguccuccuuuagu

SEQ ID NO: 348503 - RNA, 64 nt, Homo Sapiens
ggagaagcuguuugucacucguuuuuaaagaaaugggacuaaugaauuagcuuccaggcagccu

SEQ ID NO: 348504 - RNA, 64 nt, Homo Sapiens
auuuuguuuaugaaaauggcaaaagaugagagaggggacuaauuauacaaaagacaugauagag

SEQ ID NO: 348505 - RNA, 64 nt, Homo Sapiens
acaggcuacuuucuguuuacucacugcuaucuuugggacuaaaccaaaacuccuuuauucaaaa

SEQ ID NO: 348506 - RNA, 64 nt, Homo Sapiens
guugcucuuggugggcuuggggacggaggagcuagggacuaacugauguguggguacuuggugg

SEQ ID NO: 348507 - RNA, 64 nt, Homo Sapiens
uggaaaaggucuguccauagggaacuuacccauggggacuaauaguguguuuuggggcauuugu

SEQ ID NO: 348508 - RNA, 64 nt, Homo Sapiens
gacuaggucccaggauccccuugucccuggaguagggacuaacuauagcacaaaguaauaugug

SEQ ID NO: 348509 - RNA, 64 nt, Homo Sapiens
cauuacccuuguuuuucucuuuggauacuguccugggacuaaguguagauuucugcuucaagca

SEQ ID NO: 348510 - RNA, 64 nt, Homo Sapiens
guaccagagaagggcuuggaauauuccagagacugggacuaaguagaugaaugagcaaaaccaa

SEQ ID NO: 348511 - RNA, 64 nt, Homo Sapiens
gcuuccagagaguggcuggaucugcagggaguuggggacuaaggcagcgacccugugacaccgg

SEQ ID NO: 348512 - RNA, 64 nt, Homo Sapiens
aagacagcuguuuagggucucggccaggugggcggggacuaacauggccuuguugcuggcaucc

SEQ ID NO: 348513 - RNA, 64 nt, Homo Sapiens
ucuuuggaaaagguuguauacuucuugaccgugugggacuaaugaaugcuucauaguggaaaua

SEQ ID NO: 348514 - RNA, 64 nt, Homo Sapiens
auaaaugaggaggacagcaggccccaagaaaguagggacuaaguaugucuuguucaaaauugua

SEQ ID NO: 348515 - RNA, 64 nt, Homo Sapiens
gcuuuuuuguaaguugaucguaucugaugucugugggacuaacuguaucacuuaauuuuuaccu

SEQ ID NO: 348516 - RNA, 64 nt, Homo Sapiens
uacuugauuuuaaccaaugagacuacaggcagaugggacuaaguguuuaugggacaauuaugua

SEQ ID NO: 348517 - RNA, 64 nt, Homo Sapiens
aacauagaauuuuauuagcagaaaauauaguagggggacuaagggaaccuucggaucuaugaaa

SEQ ID NO: 348518 - RNA, 64 nt, Homo Sapiens
cacuguacaaucugcuuaucauauccaagagacagggacuaaugcaaauugcagaaaaggcuca

SEQ ID NO: 348519 - RNA, 64 nt, Homo Sapiens
ucccauuccucuuuucugcuuugcuagcagaaaagggacuaacgcaauacggugauauccuuau

SEQ ID NO: 348520 - RNA, 64 nt, Homo Sapiens
uuauucucucauccgaagucucuagcucuagaaagggacuaaacgaaacagccaccgagaaggu

SEQ ID NO: 348521 - RNA, 64 nt, Homo Sapiens
uuugaacaauaauauacugguuugcuuuaaagaagggacuaaauaugacuuuaaagagacuuca

SEQ ID NO: 348522 - RNA, 64 nt, Homo Sapiens
cccaauggugugagucugacuuuggaaagaaaaagggacuaaagagaaauguaacaaacuuaca

SEQ ID NO: 348523 - RNA, 64 nt, Homo Sapiens
uuaugugacacugauacacacacaccccuuauaugggacuaauuuuacacuuuucuguguuaug

SEQ ID NO: 348524 - RNA, 64 nt, Homo Sapiens
aaagaagacacuauuuuagcuaaugggguuucuugggacuaaaaaauggcuuuguuuaaauuau

SEQ ID NO: 348525 - RNA, 64 nt, Homo Sapiens
gaaaccaagggggcugcugaggagaccuggugcagggacuaauccuggaucauuccuguauuaa

SEQ ID NO: 348526 - RNA, 64 nt, Homo Sapiens
gaaaguucuuuguuuggggaaguaaaauccuuaagggacuaaauuaaugcuugggugcauuaaa

SEQ ID NO: 348527 - RNA, 64 nt, Homo Sapiens
ucuacugcuuacacuuuagaauguuuauuuuauggggacuaagggauuaggagugugaacuaaa

SEQ ID NO: 348528 - RNA, 64 nt, Homo Sapiens
guuguacagaaauguguucaucaaaucuggucaagggacuaagcuccuagcugaccauucauuc

SEQ ID NO: 348529 - RNA, 64 nt, Homo Sapiens
ucaguacccuuggccugcacggacaggggacagugggacuaacucuggucccuccaacaugcau

SEQ ID NO: 348530 - RNA, 64 nt, Homo Sapiens
ugugaacaucccucagccccugcuguccccccuugggacuaaccacuaaccucacccccaaacu

SEQ ID NO: 348531 - RNA, 64 nt, Homo Sapiens
aagccagauuuauaguauuccaucuuuaauaugugggacuaacagcaguguagauuguuaccuu

SEQ ID NO: 348532 - RNA, 64 nt, Homo Sapiens
uagucccuggaggagggaguccggccccaggccagggacuaaggagcaaugaccauugugcaca

SEQ ID NO: 348533 - RNA, 64 nt, Homo Sapiens
uauaucacuauguauuuuaugaacagaauugacugggacuaauaucacaggaucaaucaucuca

SEQ ID NO: 348534 - RNA, 64 nt, Homo Sapiens
gcgugugccaccaugcccagccucccgaguagcugggacuaaagaagcaauucucuugccucag

SEQ ID NO: 348535 - RNA, 64 nt, Homo Sapiens
ucugcuguagcuagugagaguuccauuuccaccagggacuaaaaacccacgaucuucuuugggc

SEQ ID NO: 348536 - RNA, 64 nt, Homo Sapiens
acccaucucccuagucucagccuuacaacaccacgggacuaaggaagagcacuuccuugccucc

SEQ ID NO: 348537 - RNA, 64 nt, Homo Sapiens
ggaaagcaaagaagcugcuuuaaaaaauaaaaaggggacuaaaaauuuguuuuguauaaagagg

SEQ ID NO: 348538 - RNA, 64 nt, Homo Sapiens
uugccaacuaggcaggcacaaaucuugggucuuggggacuaacccaaugccugugaagcaguca

SEQ ID NO: 348539 - RNA, 64 nt, Homo Sapiens
aagcguuucucccaccuuagccuccugaguagcugggacuaaggcacacacacuguacuuggca

SEQ ID NO: 348540 - RNA, 64 nt, Homo Sapiens
caagaucuauauuuaaguuucuugauccuguugugggacuaauaggcuuuauuuuaauagugau

SEQ ID NO: 348541 - RNA, 64 nt, Homo Sapiens
gaggcuuauuguaacauauauaucaucguuuugagggacuaaugagguuguacagacuuauuua

SEQ ID NO: 348542 - RNA, 64 nt, Homo Sapiens
auucccacuagccagcggacccucuguggcugaugggacuaauucacucuugaagagcagacuc

SEQ ID NO: 348543 - RNA, 64 nt, Homo Sapiens
ugcggaaucuucuuacuaagacugccugaccuuugggacuaagcagaguuuuucaggagagaaa

SEQ ID NO: 348544 - RNA, 64 nt, Homo Sapiens
ccaggaacagggaccagcuccagaccgcgccccugggacuaaaggguggacuaggcccuacaca

SEQ ID NO: 348545 - RNA, 64 nt, Homo Sapiens
uuguacuugcacauuggagacugaaaggaaagaagggacuaaaugcuggggagguaaauuaaga

SEQ ID NO: 348546 - RNA, 64 nt, Homo Sapiens
gaggaguacccccagcccaagagaugaacaucuggggacuaauaucauagacccaucuggaggc

SEQ ID NO: 348547 - RNA, 64 nt, Homo Sapiens
aagcacaaagcaucuuccuuaaagcacaaagagagggacuaacugaugcugcaucuagaaaaca

SEQ ID NO: 348548 - RNA, 55 nt, Homo Sapiens
cacagggaucugcugcagccgggcugggacuaaguugcuggugcaggcccuguga

SEQ ID NO: 348549 - RNA, 64 nt, Homo Sapiens
ucacacggcuugugggcacuuuuauauuaucaaggggacuaaaguauaagugagagaaaugaag

SEQ ID NO: 348550 - RNA, 64 nt, Homo Sapiens
guucaagaauaaaacaaagccaggauucauacaugggacuaaaggcauucaggaggguaacacu

SEQ ID NO: 348551 - RNA, 64 nt, Homo Sapiens
ccacaucuguagcuucugaguacauccaauaauagggacuaaacgccucccucgaaucaagugc

SEQ ID NO: 348552 - RNA, 64 nt, Homo Sapiens
ugcuccggaaggguggagguagugagagagggaagggacuaacggaagcccagggagguugagc

SEQ ID NO: 348553 - RNA, 64 nt, Homo Sapiens
gauguucgccgguugugguugagcacaauaccuagggacuaaggccgcuccuguagaagguagg

SEQ ID NO: 348554 - RNA, 64 nt, Homo Sapiens
auuaccaagugccggacuagcaagugcuggagucgggacuaacccaggucccuugucccaaguu

SEQ ID NO: 348555 - RNA, 64 nt, Homo Sapiens
cccauccaucuucccuacccuuccugccaagccagggacuaagcagcccagaagcccaguaacu

SEQ ID NO: 348556 - RNA, 64 nt, Homo Sapiens
caguauagagacuugguuggcaucuucugcugcagggacuaaaaguauuugacuggggcacaug

SEQ ID NO: 348557 - RNA, 64 nt, Homo Sapiens
ucucuuuuucuagagaggaguugcuuaaaccaaugggacuaaaaccugaugggacaauaacgcc

SEQ ID NO: 348558 - RNA, 64 nt, Homo Sapiens
cacuggcgaggugcggccacuaagaccuugguaggggacuaauuugagaggaagggugggucug

SEQ ID NO: 348559 - RNA, 64 nt, Homo Sapiens
augugggcauguggagagggugaguacagugguggggacuaaaaucagcagcuugcccagcucu

SEQ ID NO: 348560 - RNA, 64 nt, Homo Sapiens
ggguggaggugauauggcauucugaaaguagggagggacuaagucagucaucauacuaaacaaa

SEQ ID NO: 348561 - RNA, 64 nt, Homo Sapiens
cuuaagucucagacugauuucuugcgggaggagggggacuaaacucaaccuaacacauuaaaug

SEQ ID NO: 348562 - RNA, 64 nt, Homo Sapiens
uuguaaaaaauuaguuuguuacauacagcuaaaagggacuaaaugcuauuggucuguccuuuug

SEQ ID NO: 348563 - RNA, 64 nt, Homo Sapiens
cagggaacuuccaaggaaggagccugagccacuggggacuaagugggcagaagaaacccuuggc

SEQ ID NO: 348564 - RNA, 64 nt, Homo Sapiens
gauuacauuuugaaaaggaaaucuagcaugugaggggacuaaguguucucagagugauguuuua

SEQ ID NO: 348565 - RNA, 64 nt, Homo Sapiens
gcagcuacaccaguaauggcacucuuccuaggacgggacuaaagaggacgccguccuuaaaacc

SEQ ID NO: 348566 - RNA, 64 nt, Homo Sapiens
uauugguagcagccuagagggccguggauacggugggacuaaugccucaaucacagaaaguaaa

SEQ ID NO: 348567 - RNA, 64 nt, Homo Sapiens
auuacugaaagcuaaauccucaaaaccuaguaaggggacuaaugauucauuaaaguaaauugau

SEQ ID NO: 348568 - RNA, 64 nt, Homo Sapiens
acauucuaaucuuaaaggaauaaagcacugaauugggacuaacauucugauagguugcacccuu

SEQ ID NO: 348569 - RNA, 64 nt, Homo Sapiens
acacuuggcagcugaagauguggauccagguucagggacuaaauuuuccuacagggagaugccu

SEQ ID NO: 348570 - RNA, 64 nt, Homo Sapiens
cuuggauaggguaggcugagggggcccuaagggagggacuaaggcuccaaggcaggucacuuuu

SEQ ID NO: 348571 - RNA, 64 nt, Homo Sapiens
uucuucggaggagguggacauuucggaagugguggggacuaagggaagaacucucuaguucccu

SEQ ID NO: 348572 - RNA, 64 nt, Homo Sapiens
caacaaauuucugcucaacugacucaucuuuugggggacuaauuuaauuugcugcugacagcca

SEQ ID NO: 348573 - RNA, 64 nt, Homo Sapiens
caacaaccuucagcucaacugacuugucuuuugagggacuaauuuacuuugcugcugacagcca

SEQ ID NO: 348574 - RNA, 64 nt, Homo Sapiens
caacaacuuucugcucaacugacuuaucuuuugggggacuaauuuaauuugcugcugacagcca

SEQ ID NO: 348575 - RNA, 64 nt, Homo Sapiens
auuuuugcaacagccuguucacuauauguguaaagggacuaaauuuuugcauuaaugaaguuug

SEQ ID NO: 348576 - RNA, 64 nt, Homo Sapiens
caugguuguuccaaagauaauuugaaaaccccaagggacuaauugugugagucagugugcagca

SEQ ID NO: 348577 - RNA, 64 nt, Homo Sapiens
ugggaagaacuggcuaauuuuuuuuguuuuaauagggacuaaugauuuugcucccuucccccca

SEQ ID NO: 348578 - RNA, 64 nt, Homo Sapiens
gguuaagcauuugguauuguuucauuuacaauuugggacuaagauggaaacacuuuuuuuauaa

SEQ ID NO: 348579 - RNA, 64 nt, Homo Sapiens
cccagaaauuugaaaagaaugcccaagguaaugugggacuaaaggguauuucuuccuccucaau

SEQ ID NO: 348580 - RNA, 64 nt, Homo Sapiens
guuccaacauaaucuuuaccacuugauuguagaagggacuaaauuuuauuaugguauaguuagg

SEQ ID NO: 348581 - RNA, 64 nt, Homo Sapiens
agguaaugauuuuccuagugccaccaaaauaaaggggacuaaauuuauucuucucauguuaaac

SEQ ID NO: 348582 - RNA, 64 nt, Homo Sapiens
accaagaucaagcagagaaaauaauuaauuucaugggacuaaaugaacuaaugaggauaauauu

SEQ ID NO: 348583 - RNA, 64 nt, Homo Sapiens
gauggcugggaaauggagaucacugaaguacacagggacuaaccaaggagaugagggggucgac

SEQ ID NO: 348584 - RNA, 64 nt, Homo Sapiens
uucugguugcucugaggguucggagcuucccucugggacuaaaggaguguccuuuacccuccca

SEQ ID NO: 348585 - RNA, 64 nt, Homo Sapiens
cccuucaucccuggcugccggucccauccuuggagggacuaagcugggggugggggacaugagu

SEQ ID NO: 348586 - RNA, 64 nt, Homo Sapiens
cgugaacucuguaauucuauucagucucccgucugggacuaaaagccuuccucagucucgagcc

SEQ ID NO: 348587 - RNA, 64 nt, Homo Sapiens
gcagaaucuaccucccaacuugugugugucaaaggggacuaacaugcugcccauucuccauuuc

SEQ ID NO: 348588 - RNA, 64 nt, Homo Sapiens
gaaaagacagcacugcaaauuuuguacaaaaaccgggacuaaaacaauggggaguaucauuguu

SEQ ID NO: 348589 - RNA, 64 nt, Homo Sapiens
agacuggccccgucugaaccuucucugggcacuggggacuaagguugcaggccuuagccucguc

SEQ ID NO: 348590 - RNA, 64 nt, Homo Sapiens
ggcaugugccuucugccaccugacuuuccgugaggggacuaaaauuuacuaauuguaguugcug

SEQ ID NO: 348591 - RNA, 64 nt, Homo Sapiens
caauuuucauagaccuaauuugcaaacucaaucggggacuaaaauuucccacugaaaauguuaa

SEQ ID NO: 348592 - RNA, 64 nt, Homo Sapiens
aagguuuauuuuaaaaaguguucagugagucccagggacuaauuauuugcuucuaaaaauuagu

SEQ ID NO: 348593 - RNA, 64 nt, Homo Sapiens
ucaugugccaccacacccagccccccaaguagcugggacuaaagaagcgacccuccugccucag

SEQ ID NO: 348594 - RNA, 64 nt, Homo Sapiens
aaaugggugucccccaccccguucccugggggcugggacuaaagcucccucugcccucugcucc

SEQ ID NO: 348595 - RNA, 64 nt, Homo Sapiens
uaauguccuaaagcauuuuguauagugugacccugggacuaacuggggugacucccuggccuag

SEQ ID NO: 348596 - RNA, 64 nt, Homo Sapiens
uuuuuuuuuuuuuuuuuuugguuaugaaaacuuagggacuaaaauuaauauaaaaauuggcaua

SEQ ID NO: 348597 - RNA, 64 nt, Homo Sapiens
uggugaugcgugucguaggugugcagcuauuugagggacuaagggauggagauauucugucaaa

SEQ ID NO: 348598 - RNA, 64 nt, Homo Sapiens
uaaaacgagggcaguagagaccauauagacgagauaaaggcagcgucuuuucacgcagaaagug

SEQ ID NO: 348599 - RNA, 64 nt, Homo Sapiens
gguuacucaugaugcuucugcggauuguaaaguguaaaggcacacuuuuaacagcaaccaauaa

SEQ ID NO: 348600 - RNA, 64 nt, Homo Sapiens
cuuuuuauggaugagcauaaaccuagucuuaguuuaaaggcaaacuaaaguugaggggaaauaa

SEQ ID NO: 348601 - RNA, 64 nt, Homo Sapiens
ccaguuauucacuuacagaugaaacuaaaacaaauaaaggcaagcuauuaucaguuugguaguu

SEQ ID NO: 348602 - RNA, 64 nt, Homo Sapiens
gaugugggacuacuuggucgugagauuuguagacuaaaggcaauggaaaaucaaguauaauccc

SEQ ID NO: 348603 - RNA, 64 nt, Homo Sapiens
gagaaacaagcagaauuccaguuuguaacacgguuaaaggcaauaauguuuacuuuuggacugg

SEQ ID NO: 348604 - RNA, 64 nt, Homo Sapiens
gcuuuauuuucaucucucaugaggauaagcucuuuaaaggcaaaucaagacgaagcuuauuucu

SEQ ID NO: 348605 - RNA, 64 nt, Homo Sapiens
uauuucgggcccuccucuucacucugggaaccuauaaaggcaggaucuaagaauguucuagggc

SEQ ID NO: 348606 - RNA, 64 nt, Homo Sapiens
guuacaaaauguucaguuuaaaguuauuaauuuguaaaggcaguuuaaaaauuauauguuuaua

SEQ ID NO: 348607 - RNA, 64 nt, Homo Sapiens
agacuuaaaguuguccucagucguuuguuguuuuuaaaggcaacaggaaagcacuaagaaacac

SEQ ID NO: 348608 - RNA, 64 nt, Homo Sapiens
cucucaggaagccagagguaacugugcauauaaguaaaggcaacuauuuucugcuaaaggagug

SEQ ID NO: 348609 - RNA, 64 nt, Homo Sapiens
cagaagggccacggaggcucuggggagugguugauaaaggcacacugccuaaggguggugaugg

SEQ ID NO: 348610 - RNA, 64 nt, Homo Sapiens
ggucacaucucuggaaaauagauguuacaguucuuaaaggcagugcuuuaaagugaaguucauu

SEQ ID NO: 348611 - RNA, 64 nt, Homo Sapiens
acauggcuuacagaauuaugaacaguggauagauuaaaggcauuuaauauuuguaauucauaau

SEQ ID NO: 348612 - RNA, 64 nt, Homo Sapiens
auucuccagccuuaaguaagggccaugauuaucuuaaaggcauugagguggugcugccccagug

SEQ ID NO: 348613 - RNA, 64 nt, Homo Sapiens
ucagauauccccaaggcugcaagaagagagauccuaaaggcaauugcaugauucuccaagacaa

SEQ ID NO: 348614 - RNA, 64 nt, Homo Sapiens
uccucagcgggucuccaguccccugacccagcucuaaaggcacuuaggacccagggaacauuuc

SEQ ID NO: 348615 - RNA, 64 nt, Homo Sapiens
ggcugagcucagagcucuggccuccugcucagacuaaaggcaccuccucuggccucacccaagc

SEQ ID NO: 348616 - RNA, 64 nt, Homo Sapiens
cgugagacuuucagugggcuccauccucauugguuaaaggcacaucaaacacagauaaggccug

SEQ ID NO: 348617 - RNA, 64 nt, Homo Sapiens
gauugacauuauugaaggaauuuuuuuuuuuuuuuaaaggcaaaaauuggcuagucuggcuuuu

SEQ ID NO: 348618 - RNA, 61 nt, Homo Sapiens
uaaaaaugaauaagcuaucaauauauaauuuaaguacaaguuuaggcugggcgugguggcu

SEQ ID NO: 348619 - RNA, 61 nt, Homo Sapiens
ccaucucaaaaaaagaaagaaagaaaaaagaaaguacaaguuuauaaaguauuauagugaa

SEQ ID NO: 348620 - RNA, 61 nt, Homo Sapiens
uuuucuuccucuuuaccucuuaaaacagcagaaguacaagaauacagcuguagggucauug

SEQ ID NO: 348621 - RNA, 61 nt, Homo Sapiens
aauuguuuuaaaucuauuuuguaaagauauaaaguacaauagaauuucuggaguacagauu

SEQ ID NO: 348622 - RNA, 61 nt, Homo Sapiens
gaaacauucauuauuuuauuaauauugcccuaaguacaacuaggcaagugauugccaccua

SEQ ID NO: 348623 - RNA, 61 nt, Homo Sapiens
gaggaaaccagcagauaguaaaccugguucaaaguacaauucaagaaacugaguauuuaug

SEQ ID NO: 348624 - RNA, 61 nt, Homo Sapiens
auuagccaggcgugguggcggucucuacuaaaaguacaaaagaccaacauggugaaacccu

SEQ ID NO: 348625 - RNA, 61 nt, Homo Sapiens
auauuucagucaguccagaguucuuuuguguaaguacaaccuugcuggaucugaaccagug

SEQ ID NO: 348626 - RNA, 61 nt, Homo Sapiens
uuuggaaugauaccugaagaguauugugacuaaguacaacuuuauuuaaauguuaacuguu

SEQ ID NO: 348627 - RNA, 61 nt, Homo Sapiens
aucccaucauuuggaaaaauaaaggcaucugaaguacaauauuacuuauagaaauaguuua

SEQ ID NO: 348628 - RNA, 61 nt, Homo Sapiens
aacuucuucccauagaauuagaaacaugugaaaguacaauaaacuucuuguucaaauuacc

SEQ ID NO: 348629 - RNA, 61 nt, Homo Sapiens
cgaguauuaggcaauuugcaaugguggcaugaaguacaauuaaauugaaaauuuaaauaac

SEQ ID NO: 348630 - RNA, 61 nt, Homo Sapiens
uaacuucaagaaaacaaaauuaaccuuccuuaaguacaauuuuaauucagccaaacauaaa

SEQ ID NO: 348631 - RNA, 61 nt, Homo Sapiens
auagaugaguauuuccaggacaacguucuaaaaguacaauuauuucuuauuggggagauua

SEQ ID NO: 348632 - RNA, 61 nt, Homo Sapiens
gggagauuacagguaguuuggcaaagcauugaaguacaaagguacauuuucaauuaaaaag

SEQ ID NO: 348633 - RNA, 64 nt, Homo Sapiens; identical to SEQ ID NO: 313493

SEQ ID NO: 348634 - RNA, 64 nt, Homo Sapiens; identical to SEQ ID NO: 313494

SEQ ID NO: 348635 - RNA, 64 nt, Homo Sapiens; identical to SEQ ID NO: 313495

SEQ ID NO: 348636 - RNA, 64 nt, Homo Sapiens; identical to SEQ ID NO: 313496

SEQ ID NO: 348637 - RNA, 64 nt, Homo Sapiens; identical to SEQ ID NO: 313497

SEQ ID NO: 348638 - RNA, 64 nt, Homo Sapiens; identical to SEQ ID NO: 313498

SEQ ID NO: 348639 - RNA, 64 nt, Homo Sapiens; identical to SEQ ID NO: 313499

SEQ ID NO: 348640 - RNA, 64 nt, Homo Sapiens; identical to SEQ ID NO: 313500

SEQ ID NO: 348641 - RNA, 64 nt, Homo Sapiens; identical to SEQ ID NO: 182371

SEQ ID NO: 348642 - RNA, 64 nt, Homo Sapiens; identical to SEQ ID NO: 182372

SEQ ID NO: 348643 - RNA, 64 nt, Homo Sapiens; identical to SEQ ID NO: 182373

SEQ ID NO: 348644 - RNA, 64 nt, Homo Sapiens; identical to SEQ ID NO: 182374

SEQ ID NO: 348645 - RNA, 64 nt, Homo Sapiens; identical to SEQ ID NO: 182375

SEQ ID NO: 348646 - RNA, 64 nt, Homo Sapiens; identical to SEQ ID NO: 182376

SEQ ID NO: 348647 - RNA, 64 nt, Homo Sapiens; identical to SEQ ID NO: 182377

SEQ ID NO: 348648 - RNA, 64 nt, Homo Sapiens; identical to SEQ ID NO: 182378

SEQ ID NO: 348649 - RNA, 64 nt, Homo Sapiens; identical to SEQ ID NO: 182379

SEQ ID NO: 348650 - RNA, 64 nt, Homo Sapiens; identical to SEQ ID NO: 182380

SEQ ID NO: 348651 - RNA, 64 nt, Homo Sapiens; identical to SEQ ID NO: 182381

SEQ ID NO: 348652 - RNA, 64 nt, Homo Sapiens; identical to SEQ ID NO: 182382

SEQ ID NO: 348653 - RNA, 64 nt, Homo Sapiens; identical to SEQ ID NO: 182383

SEQ ID NO: 348654 - RNA, 64 nt, Homo Sapiens; identical to SEQ ID NO: 182384

SEQ ID NO: 348655 - RNA, 64 nt, Homo Sapiens; identical to SEQ ID NO: 182385

SEQ ID NO: 348656 - RNA, 64 nt, Homo Sapiens; identical to SEQ ID NO: 182386

SEQ ID NO: 348657 - RNA, 64 nt, Homo Sapiens; identical to SEQ ID NO: 182387

SEQ ID NO: 348658 - RNA, 64 nt, Homo Sapiens; identical to SEQ ID NO: 182388

SEQ ID NO: 348659 - RNA, 64 nt, Homo Sapiens; identical to SEQ ID NO: 182389

SEQ ID NO: 348660 - RNA, 64 nt, Homo Sapiens; identical to SEQ ID NO: 182390

SEQ ID NO: 348661 - RNA, 64 nt, Homo Sapiens; identical to SEQ ID NO: 182391

SEQ ID NO: 348662 - RNA, 64 nt, Homo Sapiens; identical to SEQ ID NO: 182392

SEQ ID NO: 348663 - RNA, 64 nt, Homo Sapiens; identical to SEQ ID NO: 182393

SEQ ID NO: 348664 - RNA, 64 nt, Homo Sapiens; identical to SEQ ID NO: 182394

SEQ ID NO: 348665 - RNA, 64 nt, Homo Sapiens; identical to SEQ ID NO: 182395

SEQ ID NO: 348666 - RNA, 64 nt, Homo Sapiens; identical to SEQ ID NO: 182396

SEQ ID NO: 348667 - RNA, 64 nt, Homo Sapiens; identical to SEQ ID NO: 182397

SEQ ID NO: 348668 - RNA, 64 nt, Homo Sapiens; identical to SEQ ID NO: 182398

SEQ ID NO: 348669 - RNA, 64 nt, Homo Sapiens; identical to SEQ ID NO: 182399

SEQ ID NO: 348670 - RNA, 64 nt, Homo Sapiens; identical to SEQ ID NO: 182400

SEQ ID NO: 348671 - RNA, 64 nt, Homo Sapiens; identical to SEQ ID NO: 182401

SEQ ID NO: 348672 - RNA, 64 nt, Homo Sapiens; identical to SEQ ID NO: 182402

SEQ ID NO: 348673 - RNA, 64 nt, Homo Sapiens; identical to SEQ ID NO: 182403

SEQ ID NO: 348674 - RNA, 64 nt, Homo Sapiens; identical to SEQ ID NO: 182404

SEQ ID NO: 348675 - RNA, 64 nt, Homo Sapiens; identical to SEQ ID NO: 182405

SEQ ID NO: 348676 - RNA, 64 nt, Homo Sapiens; identical to SEQ ID NO: 182406

SEQ ID NO: 348677 - RNA, 64 nt, Homo Sapiens; identical to SEQ ID NO: 182407

SEQ ID NO: 348678 - RNA, 64 nt, Homo Sapiens; identical to SEQ ID NO: 182408

SEQ ID NO: 348679 - RNA, 64 nt, Homo Sapiens; identical to SEQ ID NO: 182409

SEQ ID NO: 348680 - RNA, 64 nt, Homo Sapiens; identical to SEQ ID NO: 182410

SEQ ID NO: 348681 - RNA, 64 nt, Homo Sapiens; identical to SEQ ID NO: 182411

SEQ ID NO: 348682 - RNA, 64 nt, Homo Sapiens; identical to SEQ ID NO: 182412

SEQ ID NO: 348683 - RNA, 64 nt, Homo Sapiens; identical to SEQ ID NO: 182413

SEQ ID NO: 348684 - RNA, 64 nt, Homo Sapiens; identical to SEQ ID NO: 182414

SEQ ID NO: 348685 - RNA, 64 nt, Homo Sapiens; identical to SEQ ID NO: 182415

SEQ ID NO: 348686 - RNA, 64 nt, Homo Sapiens; identical to SEQ ID NO: 182416

SEQ ID NO: 348687 - RNA, 64 nt, Homo Sapiens; identical to SEQ ID NO: 182417

SEQ ID NO: 348688 - RNA, 64 nt, Homo Sapiens; identical to SEQ ID NO: 182418

SEQ ID NO: 348689 - RNA, 64 nt, Homo Sapiens; identical to SEQ ID NO: 182419

SEQ ID NO: 348690 - RNA, 64 nt, Homo Sapiens; identical to SEQ ID NO: 182420

SEQ ID NO: 348691 - RNA, 64 nt, Homo Sapiens; identical to SEQ ID NO: 182421

SEQ ID NO: 348692 - RNA, 64 nt, Homo Sapiens; identical to SEQ ID NO: 182422

SEQ ID NO: 348693 - RNA, 64 nt, Homo Sapiens; identical to SEQ ID NO: 182423

SEQ ID NO: 348694 - RNA, 64 nt, Homo Sapiens; identical to SEQ ID NO: 182424

SEQ ID NO: 348695 - RNA, 64 nt, Homo Sapiens; identical to SEQ ID NO: 182425

SEQ ID NO: 348696 - RNA, 64 nt, Homo Sapiens; identical to SEQ ID NO: 182426

SEQ ID NO: 348697 - RNA, 64 nt, Homo Sapiens; identical to SEQ ID NO: 182427

SEQ ID NO: 348698 - RNA, 64 nt, Homo Sapiens; identical to SEQ ID NO: 182428

SEQ ID NO: 348699 - RNA, 64 nt, Homo Sapiens; identical to SEQ ID NO: 182429

SEQ ID NO: 348700 - RNA, 64 nt, Homo Sapiens
cauaggaccuaaccagugaagcuagaggcuacagccacuaaacuugcuucaggccaacgauagu

SEQ ID NO: 348701 - RNA, 64 nt, Homo Sapiens
uacucacaaguaaguaccuuaaugcuaaugagguccacuaaaaaggggaggaaggcagaccucc

SEQ ID NO: 348702 - RNA, 64 nt, Homo Sapiens
agauucuaaucugagugaguuacugagcuuugguccacuaaaacaagcugagcuuugguccacu

SEQ ID NO: 348703 - RNA, 64 nt, Homo Sapiens
agcuuugguccacuaaaacaagcugagcuuugguccacuaaaacaagaugaaaaauacaagagu

SEQ ID NO: 348704 - RNA, 64 nt, Homo Sapiens
gaauaaacauguuuguuuucagugcucacucaaaccacuaaaacagauggauagcuuugagguu

SEQ ID NO: 348705 - RNA, 64 nt, Homo Sapiens
gcaaguaagagcuaauucauucauuccaugugugccacuaaauaaagagauugagcaagugcca

SEQ ID NO: 348706 - RNA, 64 nt, Homo Sapiens
uaaucuguuauaugaacagaguacaacuuuuguuaguaccaaaaccauacaauugaugaauugu

SEQ ID NO: 348707 - RNA, 64 nt, Homo Sapiens
ugcauaccaguuauuauauacaauucaugacuuaaguaccaaaaacguugcuucuuguucuuca

SEQ ID NO: 348708 - RNA, 64 nt, Homo Sapiens
uguguggcauuuacaugguacccaggcuccacagaguaccaagauguugcccucugggaccaca

SEQ ID NO: 348709 - RNA, 64 nt, Homo Sapiens
aaacuaaacuuuuuuuugucucccguuauugaaaaguaccaaagcuucuuucuguuguguuuga

SEQ ID NO: 348710 - RNA, 64 nt, Homo Sapiens
ugccaggcaggcauucuuccuucagggagaggauggugagaauuaauugguucuuugcacuguu

SEQ ID NO: 348711 - RNA, 64 nt, Homo Sapiens
gugaccagagaugacgccauugcacuccagccugggugagaagagcgaaacuccgucucaaaaa

SEQ ID NO: 348712 - RNA, 64 nt, Homo Sapiens
ggggcauugagacuauaaagguggauuuuguggaggugagaaaauguacaguuaacucucccag

SEQ ID NO: 348713 - RNA, 64 nt, Homo Sapiens
cugccucuccccaaacauuagagucaaaagccugggugagaaucccagcugagugagaggguuu

SEQ ID NO: 348714 - RNA, 64 nt, Homo Sapiens
ugagaaagaaaugaugcugagggaagauaccuggggugagaagaacgggcgaaacaacugaugg

SEQ ID NO: 348715 - RNA, 64 nt, Homo Sapiens
gggcccccauaccaacugugaagcagccaggucuggugagaaauggcaauaggccgagcuuuag

SEQ ID NO: 348716 - RNA, 64 nt, Homo Sapiens
uccucuuuguggcaacagaucucagauauccuacggugagaagcuuaccauaagcuuggcaccu

SEQ ID NO: 348717 - RNA, 64 nt, Homo Sapiens
cuguuucuccuacuguucuguaaacuuauuaaugggugagaaucuaauuuuacucaucuugaug

SEQ ID NO: 348718 - RNA, 64 nt, Homo Sapiens
aguccaagugggguucccuguugccaguuagagaggugagaauguuuggacucuaacucaccga

SEQ ID NO: 348719 - RNA, 64 nt, Homo Sapiens
caggccucauccaccaggcaauagacaggagagaggugagaacuauuuuuagaaggaggaaaag

SEQ ID NO: 348720 - RNA, 64 nt, Homo Sapiens
guaauggaaaaugguguugaauagucauugauuuggugagaacauaaauaaucaaaacuguuuu

SEQ ID NO: 348721 - RNA, 64 nt, Homo Sapiens
caaagaaggggaaaaacugauggaaguuaagaggggugagaaaauuuccacuuuaauuucucag

SEQ ID NO: 348722 - RNA, 64 nt, Homo Sapiens
uauuccugaaaguagaacuguguuggaagauguaggugagaaaaaauucaaaaguaauuaauag

SEQ ID NO: 348723 - RNA, 64 nt, Homo Sapiens
guuuaauuccggucuucacauccuggaaaaauauggugagaaugacaagccaguuagcaaacag

SEQ ID NO: 348724 - RNA, 64 nt, Homo Sapiens
gucagauuuuccuauuuuaaggaccugccuccugggugagaaggggucuccaguggauaggaga

SEQ ID NO: 348725 - RNA, 64 nt, Homo Sapiens
aggaugaagggaggagagaggucugaaaucacauggugagaaggacucggaagugaaaggacuu

SEQ ID NO: 348726 - RNA, 64 nt, Homo Sapiens
gucaaaccucauucgacaccagagaauucauacgggugagaaacccuaugcauguacaguaugu

SEQ ID NO: 348727 - RNA, 64 nt, Homo Sapiens
cucauuacuuauuauacauaugagaagucauacuggugagaaacccuuugaauguaaugaaugu

SEQ ID NO: 348728 - RNA, 64 nt, Homo Sapiens
cuaaugaaagcccgauauguacagaauuuguacaggugagaagccucagcuauacuuuuucaua

SEQ ID NO: 348729 - RNA, 64 nt, Homo Sapiens
ccuaugaauguaaugaauguaaagaauuccuacuggugagaaacggcgcaucuuacucaacauc

SEQ ID NO: 348730 - RNA, 64 nt, Homo Sapiens
ccuuugaaugucaggaauguagagaauucacacuggugagaaacauuguucaacucuuaacacc

SEQ ID NO: 348731 - RNA, 64 nt, Homo Sapiens
ccuaugaguuuaaggaauguaaaauauucauacuggugagaaacagcccaucuuagucaacauc

SEQ ID NO: 348732 - RNA, 64 nt, Homo Sapiens; identical to SEQ ID NO: 22278

SEQ ID NO: 348733 - RNA, 64 nt, Homo Sapiens; identical to SEQ ID NO: 22279

SEQ ID NO: 348734 - RNA, 64 nt, Homo Sapiens; identical to SEQ ID NO: 22280

SEQ ID NO: 348735 - RNA, 64 nt, Homo Sapiens; identical to SEQ ID NO: 22281

SEQ ID NO: 348736 - RNA, 64 nt, Homo Sapiens; identical to SEQ ID NO: 22282

SEQ ID NO: 348737 - RNA, 64 nt, Homo Sapiens; identical to SEQ ID NO: 22283

SEQ ID NO: 348738 - RNA, 64 nt, Homo Sapiens; identical to SEQ ID NO: 22284

SEQ ID NO: 348739 - RNA, 64 nt, Homo Sapiens; identical to SEQ ID NO: 22285

SEQ ID NO: 348740 - RNA, 64 nt, Homo Sapiens; identical to SEQ ID NO: 22286

SEQ ID NO: 348741 - RNA, 64 nt, Homo Sapiens; identical to SEQ ID NO: 22287

SEQ ID NO: 348742 - RNA, 64 nt, Homo Sapiens; identical to SEQ ID NO: 22288

SEQ ID NO: 348743 - RNA, 64 nt, Homo Sapiens; identical to SEQ ID NO: 22289

SEQ ID NO: 348744 - RNA, 64 nt, Homo Sapiens; identical to SEQ ID NO: 22290

SEQ ID NO: 348745 - RNA, 64 nt, Homo Sapiens; identical to SEQ ID NO: 22291

SEQ ID NO: 348746 - RNA, 64 nt, Homo Sapiens; identical to SEQ ID NO: 22292

SEQ ID NO: 348747 - RNA, 64 nt, Homo Sapiens; identical to SEQ ID NO: 22293

SEQ ID NO: 348748 - RNA, 64 nt, Homo Sapiens
cuuucaugcaagaaggcccaguugccacagauuauacaaccauuacccaaaccacucugacagu

SEQ ID NO: 348749 - RNA, 64 nt, Homo Sapiens
cuuaauaaagucuucuaggcuguagggugguuccuacaaccacagccaugauugucuugugucu

SEQ ID NO: 348750 - RNA, 64 nt, Homo Sapiens
cucaggucgcucuaagcacaaacguggcucuuucuacaaccagaugcaaccgagggauuucccu

SEQ ID NO: 348751 - RNA, 64 nt, Homo Sapiens
cuguaggugugcacugucuauuuacauccguccuuacaaccauccuuguccuccuugguaccgu

SEQ ID NO: 348752 - RNA, 64 nt, Homo Sapiens
caccuccuuccucagcaggacugacucugggcucuacaaccagcuccuucacauaaaggguuua

SEQ ID NO: 348753 - RNA, 64 nt, Homo Sapiens
ugaugcaguuggguuccuccugguuuucuuuuguuacaaccacccuugccuguuuacauuaauu

SEQ ID NO: 348754 - RNA, 64 nt, Homo Sapiens; identical to SEQ ID NO: 346526

SEQ ID NO: 348755 - RNA, 64 nt, Homo Sapiens; identical to SEQ ID NO: 346527

SEQ ID NO: 348756 - RNA, 64 nt, Homo Sapiens; identical to SEQ ID NO: 346528

SEQ ID NO: 348757 - RNA, 64 nt, Homo Sapiens; identical to SEQ ID NO: 346529

SEQ ID NO: 348758 - RNA, 64 nt, Homo Sapiens; identical to SEQ ID NO: 346530

SEQ ID NO: 348759 - RNA, 64 nt, Homo Sapiens; identical to SEQ ID NO: 346531

SEQ ID NO: 348760 - RNA, 64 nt, Homo Sapiens; identical to SEQ ID NO: 346532

SEQ ID NO: 348761 - RNA, 64 nt, Homo Sapiens; identical to SEQ ID NO: 346533

SEQ ID NO: 348762 - RNA, 64 nt, Homo Sapiens; identical to SEQ ID NO: 346534

SEQ ID NO: 348763 - RNA, 64 nt, Homo Sapiens; identical to SEQ ID NO: 346535

SEQ ID NO: 348764 - RNA, 64 nt, Homo Sapiens; identical to SEQ ID NO: 346536

SEQ ID NO: 348765 - RNA, 64 nt, Homo Sapiens; identical to SEQ ID NO: 346537

SEQ ID NO: 348766 - RNA, 64 nt, Homo Sapiens; identical to SEQ ID NO: 346538

SEQ ID NO: 348767 - RNA, 64 nt, Homo Sapiens; identical to SEQ ID NO: 125569

SEQ ID NO: 348768 - RNA, 64 nt, Homo Sapiens; identical to SEQ ID NO: 125570

SEQ ID NO: 348769 - RNA, 64 nt, Homo Sapiens; identical to SEQ ID NO: 125571

SEQ ID NO: 348770 - RNA, 64 nt, Homo Sapiens; identical to SEQ ID NO: 125572

SEQ ID NO: 348771 - RNA, 64 nt, Homo Sapiens; identical to SEQ ID NO: 125573

SEQ ID NO: 348772 - RNA, 64 nt, Homo Sapiens; identical to SEQ ID NO: 125574

SEQ ID NO: 348773 - RNA, 64 nt, Homo Sapiens; identical to SEQ ID NO: 125575

SEQ ID NO: 348774 - RNA, 64 nt, Homo Sapiens; identical to SEQ ID NO: 125576

SEQ ID NO: 348775 - RNA, 64 nt, Homo Sapiens; identical to SEQ ID NO: 125577

SEQ ID NO: 348776 - RNA, 64 nt, Homo Sapiens; identical to SEQ ID NO: 125578

SEQ ID NO: 348777 - RNA, 64 nt, Homo Sapiens; identical to SEQ ID NO: 125579

SEQ ID NO: 348778 - RNA, 64 nt, Homo Sapiens; identical to SEQ ID NO: 125580

SEQ ID NO: 348779 - RNA, 64 nt, Homo Sapiens; identical to SEQ ID NO: 125581

SEQ ID NO: 348780 - RNA, 64 nt, Homo Sapiens; identical to SEQ ID NO: 125582

SEQ ID NO: 348781 - RNA, 64 nt, Homo Sapiens; identical to SEQ ID NO: 125583

SEQ ID NO: 348782 - RNA, 64 nt, Homo Sapiens; identical to SEQ ID NO: 125584

SEQ ID NO: 348783 - RNA, 64 nt, Homo Sapiens; identical to SEQ ID NO: 125585

SEQ ID NO: 348784 - RNA, 64 nt, Homo Sapiens; identical to SEQ ID NO: 125586

SEQ ID NO: 348785 - RNA, 64 nt, Homo Sapiens; identical to SEQ ID NO: 125587

SEQ ID NO: 348786 - RNA, 64 nt, Homo Sapiens; identical to SEQ ID NO: 125588

SEQ ID NO: 348787 - RNA, 64 nt, Homo Sapiens; identical to SEQ ID NO: 125589

SEQ ID NO: 348788 - RNA, 64 nt, Homo Sapiens; identical to SEQ ID NO: 125590

SEQ ID NO: 348789 - RNA, 64 nt, Homo Sapiens; identical to SEQ ID NO: 125591

SEQ ID NO: 348790 - RNA, 64 nt, Homo Sapiens; identical to SEQ ID NO: 125592

SEQ ID NO: 348791 - RNA, 64 nt, Homo Sapiens; identical to SEQ ID NO: 125593

SEQ ID NO: 348792 - RNA, 64 nt, Homo Sapiens; identical to SEQ ID NO: 125594

SEQ ID NO: 348793 - RNA, 64 nt, Homo Sapiens; identical to SEQ ID NO: 125595

SEQ ID NO: 348794 - RNA, 64 nt, Homo Sapiens; identical to SEQ ID NO: 125596

SEQ ID NO: 348795 - RNA, 64 nt, Homo Sapiens; identical to SEQ ID NO: 125597

SEQ ID NO: 348796 - RNA, 64 nt, Homo Sapiens; identical to SEQ ID NO: 125598

SEQ ID NO: 348797 - RNA, 64 nt, Homo Sapiens; identical to SEQ ID NO: 125599

SEQ ID NO: 348798 - RNA, 64 nt, Homo Sapiens; identical to SEQ ID NO: 125600

SEQ ID NO: 348799 - RNA, 64 nt, Homo Sapiens; identical to SEQ ID NO: 125601

SEQ ID NO: 348800 - RNA, 64 nt, Homo Sapiens; identical to SEQ ID NO: 125602

SEQ ID NO: 348801 - RNA, 64 nt, Homo Sapiens; identical to SEQ ID NO: 125603

SEQ ID NO: 348802 - RNA, 64 nt, Homo Sapiens; identical to SEQ ID NO: 125604

SEQ ID NO: 348803 - RNA, 64 nt, Homo Sapiens; identical to SEQ ID NO: 125605

SEQ ID NO: 348804 - RNA, 64 nt, Homo Sapiens; identical to SEQ ID NO: 125606

SEQ ID NO: 348805 - RNA, 64 nt, Homo Sapiens; identical to SEQ ID NO: 125607

SEQ ID NO: 348806 - RNA, 64 nt, Homo Sapiens; identical to SEQ ID NO: 125608

SEQ ID NO: 348807 - RNA, 64 nt, Homo Sapiens; identical to SEQ ID NO: 125609

SEQ ID NO: 348808 - RNA, 64 nt, Homo Sapiens; identical to SEQ ID NO: 125610

SEQ ID NO: 348809 - RNA, 64 nt, Homo Sapiens; identical to SEQ ID NO: 125611

SEQ ID NO: 348810 - RNA, 64 nt, Homo Sapiens; identical to SEQ ID NO: 125612

SEQ ID NO: 348811 - RNA, 64 nt, Homo Sapiens; identical to SEQ ID NO: 125613

SEQ ID NO: 348812 - RNA, 64 nt, Homo Sapiens; identical to SEQ ID NO: 125614

SEQ ID NO: 348813 - RNA, 64 nt, Homo Sapiens; identical to SEQ ID NO: 125615

SEQ ID NO: 348814 - RNA, 64 nt, Homo Sapiens; identical to SEQ ID NO: 125616

SEQ ID NO: 348815 - RNA, 64 nt, Homo Sapiens; identical to SEQ ID NO: 125617

SEQ ID NO: 348816 - RNA, 64 nt, Homo Sapiens; identical to SEQ ID NO: 125618

SEQ ID NO: 348817 - RNA, 64 nt, Homo Sapiens; identical to SEQ ID NO: 125619

SEQ ID NO: 348818 - RNA, 64 nt, Homo Sapiens; identical to SEQ ID NO: 125620

SEQ ID NO: 348819 - RNA, 64 nt, Homo Sapiens; identical to SEQ ID NO: 125621

SEQ ID NO: 348820 - RNA, 64 nt, Homo Sapiens; identical to SEQ ID NO: 125622

SEQ ID NO: 348821 - RNA, 64 nt, Homo Sapiens; identical to SEQ ID NO: 125623

SEQ ID NO: 348822 - RNA, 64 nt, Homo Sapiens; identical to SEQ ID NO: 125624

SEQ ID NO: 348823 - RNA, 64 nt, Homo Sapiens; identical to SEQ ID NO: 125625

SEQ ID NO: 348824 - RNA, 64 nt, Homo Sapiens; identical to SEQ ID NO: 125626

SEQ ID NO: 348825 - RNA, 64 nt, Homo Sapiens; identical to SEQ ID NO: 125627

SEQ ID NO: 348826 - RNA, 64 nt, Homo Sapiens; identical to SEQ ID NO: 125628

SEQ ID NO: 348827 - RNA, 64 nt, Homo Sapiens; identical to SEQ ID NO: 125629

SEQ ID NO: 348828 - RNA, 64 nt, Homo Sapiens; identical to SEQ ID NO: 125630

SEQ ID NO: 348829 - RNA, 64 nt, Homo Sapiens; identical to SEQ ID NO: 125631

SEQ ID NO: 348830 - RNA, 64 nt, Homo Sapiens; identical to SEQ ID NO: 125632

SEQ ID NO: 348831 - RNA, 64 nt, Homo Sapiens; identical to SEQ ID NO: 125633

SEQ ID NO: 348832 - RNA, 64 nt, Homo Sapiens; identical to SEQ ID NO: 125634

SEQ ID NO: 348833 - RNA, 64 nt, Homo Sapiens; identical to SEQ ID NO: 125635

SEQ ID NO: 348834 - RNA, 64 nt, Homo Sapiens; identical to SEQ ID NO: 125636

SEQ ID NO: 348835 - RNA, 64 nt, Homo Sapiens; identical to SEQ ID NO: 125637

SEQ ID NO: 348836 - RNA, 64 nt, Homo Sapiens; identical to SEQ ID NO: 125638

SEQ ID NO: 348837 - RNA, 64 nt, Homo Sapiens; identical to SEQ ID NO: 125639

SEQ ID NO: 348838 - RNA, 64 nt, Homo Sapiens; identical to SEQ ID NO: 125640

SEQ ID NO: 348839 - RNA, 64 nt, Homo Sapiens; identical to SEQ ID NO: 125641

SEQ ID NO: 348840 - RNA, 64 nt, Homo Sapiens; identical to SEQ ID NO: 125642

SEQ ID NO: 348841 - RNA, 64 nt, Homo Sapiens; identical to SEQ ID NO: 156518

SEQ ID NO: 348842 - RNA, 64 nt, Homo Sapiens; identical to SEQ ID NO: 156519

SEQ ID NO: 348843 - RNA, 64 nt, Homo Sapiens; identical to SEQ ID NO: 156520

SEQ ID NO: 348844 - RNA, 64 nt, Homo Sapiens; identical to SEQ ID NO: 156521

SEQ ID NO: 348845 - RNA, 64 nt, Homo Sapiens
caaggaccuuccaguccaggggaaugacugugcaagguaguaucuaagcaccugagaagcagua

SEQ ID NO: 348846 - RNA, 64 nt, Homo Sapiens
gcuuuaacucuaugcugacucagugagacacaguagguaguaugguuguggaccuauuuguuuu

SEQ ID NO: 348847 - RNA, 64 nt, Homo Sapiens
uuacauucauguucuaauuauagauuuuagaguuagguaguacagguaagggggaaauuguaaa

SEQ ID NO: 348848 - RNA, 64 nt, Homo Sapiens
gcuuuuuucuagcauguauaacuuuuuuaaauaaagguaguauuuaccauuaaaaaaauuuuag

SEQ ID NO: 348849 - RNA, 64 nt, Homo Sapiens
ugcuuuccuccagaaaguguguucccgucuagugagguaguauugaagccucggcuuucccucu

SEQ ID NO: 348850 - RNA, 64 nt, Homo Sapiens
uugugccagauacaaaugggcagagagaccccaaagguaguagaagccacaaguguuggagcug

SEQ ID NO: 348851 - RNA, 64 nt, Homo Sapiens
ugguccuaggguugccugaguccacaguggucacagguaguaccccauuuacccuugaccccag

SEQ ID NO: 348852 - RNA, 64 nt, Homo Sapiens
ccuuccuuccuccgcugggcugggagaucagggcagguaguaggaugacuuugagugauggcac

SEQ ID NO: 348853 - RNA, 64 nt, Homo Sapiens
cccugccccuguuacugugcggaaagaggccccaagguaguaaaggucagggagccccuggugu

SEQ ID NO: 348854 - RNA, 64 nt, Homo Sapiens
gccugaagucuugcaggacucagggagcugcuggagguaguagauccuccuuuuccaggcucag

SEQ ID NO: 348855 - RNA, 64 nt, Homo Sapiens
aguguguuaaaauguuccugguacauaguuuaccagguaguagaaaaagagcacaagaguaugc

SEQ ID NO: 348856 - RNA, 64 nt, Homo Sapiens
augacacauuuuguaaauaacauguuaaaauuagagguaguaaaauguucugaaguaccugaua

SEQ ID NO: 348857 - RNA, 64 nt, Homo Sapiens
aaaauucuugaagaguuuucauaugugggagcuaagguaguauuguaaaauuucaagucauccu

SEQ ID NO: 348858 - RNA, 64 nt, Homo Sapiens
auuacaacaucaauuaugaaauacugauaacgaaagguaguaaugaaauauauaugaugaaaag

SEQ ID NO: 348859 - RNA, 64 nt, Homo Sapiens
cuguugguggucuuccccacacgccccaauuuucagguaguacuaagaguaugugccaggaaac

SEQ ID NO: 348860 - RNA, 64 nt, Homo Sapiens
uugaagacagcaucauuaaagcauaaacagaauuagguaguauacaauuaccuggugagaaguu

SEQ ID NO: 348861 - RNA, 64 nt, Homo Sapiens
ggcggggguggugaccuuuagaggcuaaagggaaagguaguagguuucuuuauuuugcugggga

SEQ ID NO: 348862 - RNA, 64 nt, Homo Sapiens
aagguuaaaauuaaguuuuuaaaaaagucccuaaagguaguauuagauaugauuucugcuguuc

SEQ ID NO: 348863 - RNA, 64 nt, Homo Sapiens
uguaagagaguacugguuccuguuuguugcuaagagguaguaaaaauuaaauuuacauuugagu

SEQ ID NO: 348864 - RNA, 64 nt, Homo Sapiens
gaaauuuccauccacuuugguucagcggacaucaagguaguaauaauaauuuuuccuccacagg

SEQ ID NO: 348865 - RNA, 64 nt, Homo Sapiens
gguguguccuuucccagugcuuuucuuuuacaagagguaguagacuaguggaaauccccaaaug

SEQ ID NO: 348866 - RNA, 64 nt, Homo Sapiens
aagcaggauauggcaacggaacauccucaagcagagguaguaaaacaggaaagcagcauguccg

SEQ ID NO: 348867 - RNA, 64 nt, Homo Sapiens
uaauuaagagauuuaaauauuagaacgguauguaagguaguauaauuaccacuauuuuaaauaa

SEQ ID NO: 348868 - RNA, 64 nt, Homo Sapiens
aaacaccaucuauugagcaccuacauugugugccagguaguaaaauaggugcuuucauacacau

SEQ ID NO: 348869 - RNA, 64 nt, Homo Sapiens
ugccuuauguuugggcauguaacuccaaaauacuagguaguauaaggcuuucucaaucagugca

SEQ ID NO: 348870 - RNA, 64 nt, Homo Sapiens
ucgguuguuugaugugcaauauguuuuuguaugcagguaguaaauaaacuuugaucuuccauuu

SEQ ID NO: 348871 - RNA, 64 nt, Homo Sapiens
agcaaguuuauuuuuguuaaagagcacuugguggagguaguaggggcagggaaaggucagcaua

SEQ ID NO: 348872 - RNA, 64 nt, Homo Sapiens
cuguauucuagccagaauaauuuuagaucugaucagguaguagcuaaaauuagaaaaaaacaaa

SEQ ID NO: 348873 - RNA, 64 nt, Homo Sapiens
auuaagccacaacaauaauguauaaaccucauuuagguaguagucuuuaauucacuuuuaauag

SEQ ID NO: 348874 - RNA, 64 nt, Homo Sapiens
uuuccauagggccuccuuagucuucaaaugucuaagguaguaacauguacuaagcaguaagcua

SEQ ID NO: 348875 - RNA, 64 nt, Homo Sapiens
cuagugacagagaacaggguccagugccagcacaagguaguaaucuggggcagaauguuuacag

SEQ ID NO: 348876 - RNA, 64 nt, Homo Sapiens
gacuuaaugugcaugacuuguagaagccuucaguagguaguaaaaacaauuuucauguguaagg

SEQ ID NO: 348877 - RNA, 64 nt, Homo Sapiens
cuaaaaauagugcccaggcaaagaagggcagccaagguaguaacuuuuucuuuuuuuuuucuua

SEQ ID NO: 348878 - RNA, 64 nt, Homo Sapiens
uagucgucuuuccuacaacacacaagaaauagugagguaguaguuacaaaggaaauuucuaaag

SEQ ID NO: 348879 - RNA, 64 nt, Homo Sapiens
caagcuguuuguucaucuauauuuaguuuaaaauagguaguauuaucuuucuguacauagugua

SEQ ID NO: 348880 - RNA, 64 nt, Homo Sapiens
ugcuuuucaaagcauccuaacuugcuaagaugcuagguaguacgacccucuggauuuggaaggc

SEQ ID NO: 348881 - RNA, 64 nt, Homo Sapiens
aaaacugugagagcuagauguccuaugggcaauuagguaguauaauaaagguaaaugaagguac

SEQ ID NO: 348882 - RNA, 64 nt, Homo Sapiens
caaacacauuuuagugugauauuucauuuauuauagguaguauauuuuaauuuguuaguuuaaa

SEQ ID NO: 348883 - RNA, 64 nt, Homo Sapiens
aucuuauacaaaugagccucugcuuguucuacaaagguaguagaaucaaucucgaccuauauaa

SEQ ID NO: 348884 - RNA, 64 nt, Homo Sapiens
caccagcugccucuuugcugcguaguaguggaagagguaguaaggcuuuucugucagucugaag

SEQ ID NO: 348885 - RNA, 64 nt, Homo Sapiens
uuaaacagggaaaguuuaauagaagacagaaacaagguaguaauuguguuagucuguaucaauc

SEQ ID NO: 348886 - RNA, 64 nt, Homo Sapiens
aaauccuacuaauaaaaauaaaaaaguguacaaaagguaguauauguaaaaauuuuguucuuca

SEQ ID NO: 348887 - RNA, 64 nt, Homo Sapiens
uauaauugacuuauucugaacagugucucuccuaagguaguaaacuggauaaaaacaguugugu

SEQ ID NO: 348888 - RNA, 64 nt, Homo Sapiens
gugcacugauuugaccauugcaguguauaaaacuagguaguauugccugacaagacauuuuuuu

SEQ ID NO: 348889 - RNA, 64 nt, Homo Sapiens
guauguuggaguuauaaagaaauacacuaaggagagguaguaaaugugaaccuuguugcagugu

SEQ ID NO: 348890 - RNA, 64 nt, Homo Sapiens
uaaagaggagcgaagggauuauguggguugggacagguaguaccaguuaaggaagggggugagg

SEQ ID NO: 348891 - RNA, 64 nt, Homo Sapiens
ucucuuucaacugagugcaaaugauggucauucaagguaguaggaauaucaugggcauuucucu

SEQ ID NO: 348892 - RNA, 64 nt, Homo Sapiens
auccuuaaugaaaccaguggccugaaauaaaguuagguaguaaaaaaucguagacguaacuccc

SEQ ID NO: 348893 - RNA, 64 nt, Homo Sapiens
uauaagucuuaggaaagacuaucgaugaaucaguagguaguauuucugacucaacucacuggcu

SEQ ID NO: 348894 - RNA, 64 nt, Homo Sapiens
uuaguaaaauuuugcaauucugacaucuucucacagguaguauguuucuguuuaauucccaaag

SEQ ID NO: 348895 - RNA, 64 nt, Homo Sapiens
uagaacacucuggcuccuggcacauuagaauaaaagguaguaaucagcuuucagggccaugguu

SEQ ID NO: 348896 - RNA, 64 nt, Homo Sapiens
cuccugcugcuucucccaacagcccacuguuaggagguaguagaccccagccucaaggcucuga

SEQ ID NO: 348897 - RNA, 64 nt, Homo Sapiens
guaguuaagauaugccugcuaucuuuaacuuuggagguaguaucaaaauuuuacuucuuugguu

SEQ ID NO: 348898 - RNA, 64 nt, Homo Sapiens
acugaagccaaaccugccuguccaaaauaucucuagguaguacacacaguucacucuagcuucu

SEQ ID NO: 348899 - RNA, 64 nt, Homo Sapiens
gaaugacaguagcauuaugaguaguguggaauucagguaguaaauaugaaacuaggguuugaaa

SEQ ID NO: 348900 - RNA, 64 nt, Homo Sapiens
aaaagcuguaauuuccagagagaccauuaggaacagguaguaucuauuuuucuccauuauuuau

SEQ ID NO: 348901 - RNA, 64 nt, Homo Sapiens
ugacuguuuugggaaggaagaguaccucuuaucgagguaguauaaaacacauagggucuuguuu

SEQ ID NO: 348902 - RNA, 64 nt, Homo Sapiens
uuagucuugccugucaaaaaguccaacauuucauagguaguaggggccacauauuacauucagu

SEQ ID NO: 348903 - RNA, 64 nt, Homo Sapiens
aauacagauaguucuguuugucuaggauauuccgagguaguaaggcagugaauuaauaacuccu

SEQ ID NO: 348904 - RNA, 64 nt, Homo Sapiens
acugcuggauucuucuuccuaagguggcuuuguuagguaguaaaaaaaauugggaggcuuuuca

SEQ ID NO: 348905 - RNA, 64 nt, Homo Sapiens
guauaaguaauuuuuugguuuguuaauugugauuagguaguaaaaauacaauuuguuauguuua

SEQ ID NO: 348906 - RNA, 64 nt, Homo Sapiens
uaggugcaguguguggaagcuaagcauggaagagagguaguaggcucaccuuucuaaacccagu

SEQ ID NO: 348907 - RNA, 64 nt, Homo Sapiens
aacaaaauuacuggaagcaguauuguaaguaaugagguaguauuaaucaguuuuaucuuuugaa

SEQ ID NO: 348908 - RNA, 64 nt, Homo Sapiens
cagcucgauucaguuuuagcuaaauuuauaguuuagguaguauguuacauuugaauuuuugucu

SEQ ID NO: 348909 - RNA, 64 nt, Homo Sapiens
aguaagauuugcugaugagaggaagaucauucgaagguaguauuaaaucagaaaugauugcauu

SEQ ID NO: 348910 - RNA, 64 nt, Homo Sapiens
aaucuuuuucaaauuuaauguauauguguauauaagguaguauucagugaauacuugagaaaug

SEQ ID NO: 348911 - RNA, 64 nt, Homo Sapiens
auuguaucuuacuaggagaucacccauuuacuguagguaguauucucuuccuacuauauuucau

SEQ ID NO: 348912 - RNA, 64 nt, Homo Sapiens
augacuugggcucauauccacaauacuugguauaagguaguagauuguuggggguggggaggga

SEQ ID NO: 348913 - RNA, 64 nt, Homo Sapiens
aaaguuuuccucaaggagcagcugggggcagaauagguaguauuuaagcaaauacuuaagucca

SEQ ID NO: 348914 - RNA, 64 nt, Homo Sapiens
auuucuuuggaaaggugucuuuacacguuaauagagguaguacaauuuuuuuuugguugguggu

SEQ ID NO: 348915 - RNA, 64 nt, Homo Sapiens
uaggguacugagagccuagcagacuuaaaggacaagguaguaaauguuuuaucacucaaaaauc

SEQ ID NO: 348916 - RNA, 64 nt, Homo Sapiens
uacuuguguuccacaguuauggccauauacacagagguaguauaugaugaagagaagauuacag

SEQ ID NO: 348917 - RNA, 64 nt, Homo Sapiens
aacacauuaugaaguuauuaaauuuaagggacagagguaguauaguuagauauacuuucucuua

SEQ ID NO: 348918 - RNA, 64 nt, Homo Sapiens
agggaacauuacuucugcuucaaaugcuuuauuaagguaguaaaaaucauuuguaucaaagggg

SEQ ID NO: 348919 - RNA, 64 nt, Homo Sapiens
uuuuauaucccauuuauagaacugcaacaugaugagguaguaccacugaucucguuuuuucuuc

SEQ ID NO: 348920 - RNA, 64 nt, Homo Sapiens
cugaaagugcauuauuauggaagaauguauuugcagguaguaauagcauuaaaaaauauacucg

SEQ ID NO: 348921 - RNA, 64 nt, Homo Sapiens
uucuuuccaccacaaauuaaucacuauguuuauaagguaguaucagaauuuuuuuaggauucac

SEQ ID NO: 348922 - RNA, 64 nt, Homo Sapiens
agaaaugaggaaaaagagguugcuuuauuuuaaaagguaguauacagcugcuggccacauuucc

SEQ ID NO: 348923 - RNA, 64 nt, Homo Sapiens
guaacuaaaggggaauauaugaggauuaauucugagguaguauagggaugauuacuuuuuuaag

SEQ ID NO: 348924 - RNA, 64 nt, Homo Sapiens
uuguguaugcccaauaauuuguuaucauuuccuuagguaguaaccuauuuuuguucugguuugg

SEQ ID NO: 348925 - RNA, 64 nt, Homo Sapiens
aaaccaaggcuaagggacuggucuaaagucucacagguaguauaugguggagccaacacuugaa

SEQ ID NO: 348926 - RNA, 64 nt, Homo Sapiens
auuuguaauuccuuccucucccuuguucccaaguagguaguaguaaguaugugccacaggcuga

SEQ ID NO: 348927 - RNA, 64 nt, Homo Sapiens
gaggacagaaaacagaacaggagagaaauaugugagguaguaagagaggaaggguggagaagga

SEQ ID NO: 348928 - RNA, 64 nt, Homo Sapiens
uucaaugugaauccaaagcucacauacuguacacagguaguauuuauuuuccaauuuccuuucu

SEQ ID NO: 348929 - RNA, 64 nt, Homo Sapiens
gcagcagcuucgugcucucaguuuugagaaaagcagguaguagaccagccucaggaacuaacaa

SEQ ID NO: 348930 - RNA, 64 nt, Homo Sapiens
uagaacuggauugccauuuugcucuuugucaaauagguaguagugcuaacaacacccugcugaa

SEQ ID NO: 348931 - RNA, 64 nt, Homo Sapiens
ugagaaauguguucucuugagcauguuaguuuaaagguaguaggggaaaaccacauuuccagaa

SEQ ID NO: 348932 - RNA, 64 nt, Homo Sapiens
uucuacucugacuacuuuccugcuuuuaacucuaagguaguauugaaaugagaagccccaagcu

SEQ ID NO: 348933 - RNA, 64 nt, Homo Sapiens
agauacuccauacaacacaaacauacacucaggaagguaguacacccaauaaaugaacaaaugu

SEQ ID NO: 348934 - RNA, 64 nt, Homo Sapiens
guaugaagucauagauaauaguacaugucaccuuagguaguaggaagaauuacaauuucuuuaa

SEQ ID NO: 348935 - RNA, 64 nt, Homo Sapiens
aucauaugaucuaauauuguauugauggaaguauagguaguauaguagugauuguucuucaagc

SEQ ID NO: 348936 - RNA, 64 nt, Homo Sapiens
cuaguuacuacuuuuaaguauguaaauacuagaaagguaguacuagugacaucaucacguguau

SEQ ID NO: 348937 - RNA, 64 nt, Homo Sapiens
uuuuagagugcacugagugcgacuaagagugugaagguaguacuguauuuuaauccuauuacuu

SEQ ID NO: 348938 - RNA, 64 nt, Homo Sapiens
agaugugccagaguccuuccuccccuccaaggacagguaguaggugccagccuaggggagcuuc

SEQ ID NO: 348939 - RNA, 64 nt, Homo Sapiens
uucuaaauggauaaauuauucuaggcuucuuaauagguaguaauuuguucaaaagcgguuuuag

SEQ ID NO: 348940 - RNA, 64 nt, Homo Sapiens
auucucacugaaucaugagagaauguguauuuguagguaguacucuaaauagaucucauugaua

SEQ ID NO: 348941 - RNA, 64 nt, Homo Sapiens
cugccuguauuucccagugauuuacucuaggguaagguaguacacauuugguucagaaauuaau

SEQ ID NO: 348942 - RNA, 64 nt, Homo Sapiens
ucagucguguugcuuacgguuucuuuguuacuuuagguaguagaaucucagcacuuuguuucau

SEQ ID NO: 348943 - RNA, 64 nt, Homo Sapiens
cugaauguacucauuauaauaugauaucugacaaagguaguacagcguuucugagucauuuggg

SEQ ID NO: 348944 - RNA, 64 nt, Homo Sapiens
caguaaaaaguuucuuacuuuauuuuauuauauuagguaguaaaaaauguaggguuauuuacca

SEQ ID NO: 348945 - RNA, 64 nt, Homo Sapiens
ucguuaucguuauuguacugucacuuuguucuugagguaguagucaaggaucaggaggggcaga

SEQ ID NO: 348946 - RNA, 64 nt, Homo Sapiens
uggcgucugcucugguggcuuaagugagcagaacagguaguauuacaccaccggcccccucccc

SEQ ID NO: 348947 - RNA, 64 nt, Homo Sapiens
aucucagcacuuuguuucauuucuuuguuacuuuagguaguagaucagucguguugcuuacggu

SEQ ID NO: 348948 - RNA, 64 nt, Homo Sapiens
cucuugagaccucucccugauucagccccugugcagguaguaacccugacuuucccccuguacc

SEQ ID NO: 348949 - RNA, 64 nt, Homo Sapiens
caguguggauaagcaggacaagugacuaaggggcagguaguauagacaaccaaggcggcuacua

SEQ ID NO: 348950 - RNA, 64 nt, Homo Sapiens
uaauuuguucaauguauaacgagauuuaauuauaagguaguaccuuaaaggauucuuuccaagc

SEQ ID NO: 348951 - RNA, 64 nt, Homo Sapiens
acaaugaaaauuguucuaagaaacucuuuucuccagguaguagggcguucuuagcuuuuuugac

SEQ ID NO: 348952 - RNA, 64 nt, Homo Sapiens
acuuggauuuccaguuuguuuacagaguagucuuagguaguagcaaaagagccaaagaagagau

SEQ ID NO: 348953 - RNA, 64 nt, Homo Sapiens
aaaaguccucacuguagaucgucugguuuugguuagguaguaaugagcugcgagaucugugcaa

SEQ ID NO: 348954 - RNA, 64 nt, Homo Sapiens
ucauugccagauuccauuacccuuucuuccucauagguaguaauuaccaauguaacuaagcauu

SEQ ID NO: 348955 - RNA, 64 nt, Homo Sapiens
gaagcuguuuuaauuccccuguugaaugugaaaaagguaguaguauuccugggucuuuaugaug

SEQ ID NO: 348956 - RNA, 64 nt, Homo Sapiens
guuucugcccuuaccccucaguaguggggcugcgagguaguagacaggaugcccaguuaaguuu

SEQ ID NO: 348957 - RNA, 64 nt, Homo Sapiens
gcguagaaucugaacacacugaggccaccuagcaagguaguaacuagucuaaccugugcuaaca

SEQ ID NO: 348958 - RNA, 64 nt, Homo Sapiens
uaccaguguaacuaagcauuacuuucuuccucauagguaguaauuaauugucagauuccacuac

SEQ ID NO: 348959 - RNA, 64 nt, Homo Sapiens
aguaggcauagucauuuucuggauccuuuuucaaagguaguaucauauucaauguauuuuuuau

SEQ ID NO: 348960 - RNA, 64 nt, Homo Sapiens
aaaccccacacgagggcucucaccuccuucuccuagguaguauuuauuuucagcaccuguuuga

SEQ ID NO: 348961 - RNA, 64 nt, Homo Sapiens
gauuuuagcauauuaaugcguuuaauuuguuauaagguaguacuaucuugcuuuguguaucuca

SEQ ID NO: 348962 - RNA, 64 nt, Homo Sapiens
ugucauucuucaaucagauagcucuaagcuucagagguaguaacgaagugcccaugauugcagg

SEQ ID NO: 348963 - RNA, 64 nt, Homo Sapiens
gaaagcacauugugucaaugauuguggcauauacagguaguaaaaauucauauuugauagagaa

SEQ ID NO: 348964 - RNA, 64 nt, Homo Sapiens
uguaguuggaagaacuacuaaaaaauuuauuuuaagguaguacacuuuuuauuucauucuuuua

SEQ ID NO: 348965 - RNA, 64 nt, Homo Sapiens
auuccuuuuaaauuuuuuccagaaugucugaagaagguaguaauauccucaugcauuuuccuca

SEQ ID NO: 348966 - RNA, 64 nt, Homo Sapiens
gagacgugaagccagcuggauagcagcuacagaaagguaguaguccgucuacucacuguaguag

SEQ ID NO: 348967 - RNA, 64 nt, Homo Sapiens
agggcuuuaucaaaaaguacaauaauaaauccucagguaguacugggaauggaaggcuuugcca

SEQ ID NO: 348968 - RNA, 64 nt, Homo Sapiens
aaguaguauuggaaugauguuccuauguuaugucagguaguaguugaugacagguaacgaaacu

SEQ ID NO: 348969 - RNA, 64 nt, Homo Sapiens
auucaguguaguuaaggccauuauuuaaaauuucagguaguaaugaaaauucgauuaggaaacu

SEQ ID NO: 348970 - RNA, 64 nt, Homo Sapiens
gacaacuguuccugcuucuaaggggaccaacagaagguaguauuagaaagguauguugucuaac

SEQ ID NO: 348971 - RNA, 64 nt, Homo Sapiens
auaauccaagcaaaaguuaaugguggcuucaacuagguaguagcaauaagggugauaagaagug

SEQ ID NO: 348972 - RNA, 64 nt, Homo Sapiens
uauaaguacaaauuugggaacauacaaaucuuuuagguaguagaguuuaacguguauaagcuaa

SEQ ID NO: 348973 - RNA, 64 nt, Homo Sapiens
aaaauaaauaaggaaaagcuaaaccaagucacuuagguaguacccccucucuuagggacaguca

SEQ ID NO: 348974 - RNA, 64 nt, Homo Sapiens
uccaguggcuagagguggggcuuaguugcacaaaagguaguaugcuuggaaauccucuguuuag

SEQ ID NO: 348975 - RNA, 64 nt, Homo Sapiens
cccagcuggggaaaugggagugaacagggcaggcagguaguaggccugccucauggcaccagag

SEQ ID NO: 348976 - RNA, 64 nt, Homo Sapiens
uuucuuuuuauauuucuaugacguaagggaaauaagguaguacuguguuuuucauauuauuucc

SEQ ID NO: 348977 - RNA, 64 nt, Homo Sapiens
ucuuggaaacuuccauuaaguguguagauugagcagguaguaauugcaugcaguuuguacauua

SEQ ID NO: 348978 - RNA, 64 nt, Homo Sapiens
gacagaggcacaugcugaggccugcugguggaggagguaguaccuuugaagaugcuguugacca

SEQ ID NO: 348979 - RNA, 64 nt, Homo Sapiens
aguguuaucucuuaccuuaaaaaacucagccaacagguaguauugguaaaaacaaacaaacaaa

SEQ ID NO: 348980 - RNA, 64 nt, Homo Sapiens
agcccaaucuugggcuguuagauuguucuugcugagguaguaaccaguucauguauuuacuggu

SEQ ID NO: 348981 - RNA, 64 nt, Homo Sapiens; identical to SEQ ID NO: 156540

SEQ ID NO: 348982 - RNA, 64 nt, Homo Sapiens; identical to SEQ ID NO: 156541

SEQ ID NO: 348983 - RNA, 64 nt, Homo Sapiens; identical to SEQ ID NO: 156542

SEQ ID NO: 348984 - RNA, 64 nt, Homo Sapiens; identical to SEQ ID NO: 156543

SEQ ID NO: 348985 - RNA, 64 nt, Homo Sapiens; identical to SEQ ID NO: 156544

SEQ ID NO: 348986 - RNA, 64 nt, Homo Sapiens; identical to SEQ ID NO: 156545

SEQ ID NO: 348987 - RNA, 64 nt, Homo Sapiens; identical to SEQ ID NO: 156546

SEQ ID NO: 348988 - RNA, 64 nt, Homo Sapiens; identical to SEQ ID NO: 156547

SEQ ID NO: 348989 - RNA, 64 nt, Homo Sapiens; identical to SEQ ID NO: 156548

SEQ ID NO: 348990 - RNA, 64 nt, Homo Sapiens; identical to SEQ ID NO: 156549

SEQ ID NO: 348991 - RNA, 64 nt, Homo Sapiens; identical to SEQ ID NO: 156550

SEQ ID NO: 348992 - RNA, 64 nt, Homo Sapiens; identical to SEQ ID NO: 156551

SEQ ID NO: 348993 - RNA, 64 nt, Homo Sapiens; identical to SEQ ID NO: 156552

SEQ ID NO: 348994 - RNA, 64 nt, Homo Sapiens; identical to SEQ ID NO: 156553

SEQ ID NO: 348995 - RNA, 64 nt, Homo Sapiens; identical to SEQ ID NO: 156554

SEQ ID NO: 348996 - RNA, 64 nt, Homo Sapiens
aggacuucacuacguugauugcuagguggccuaguuuguguaaauauaauguauuggucuuucu

SEQ ID NO: 348997 - RNA, 64 nt, Homo Sapiens
auguaacuccauguuuacugcuaaaaaccaaagcuuuguguaaaaucuugaauuuauggggcgg

SEQ ID NO: 348998 - RNA, 64 nt, Homo Sapiens
uuucugggaggucucuccuuugugugucuguauguuuguguacacacacgugcccaucugcugu

SEQ ID NO: 348999 - RNA, 64 nt, Homo Sapiens
augagggggaggagaaucuuuaucagaaacugguuuuguguaguaaacuuucuuuugugguuuu

SEQ ID NO: 349000 - RNA, 64 nt, Homo Sapiens
acuuuauaguuuacaaagcauauuuuacuuugcauuuguguaguugcuagaaauaugguuaaug

SEQ ID NO: 349001 - RNA, 64 nt, Homo Sapiens
aaaaccuucuauuuugggcucuacauaaaucguauuuguguaugaauuauguuaaaagaaaucu

SEQ ID NO: 349002 - RNA, 64 nt, Homo Sapiens
aauuuguuauaaguucacauuuauaaaauaauauuuuguguauaguagaacuuaauauacagga

SEQ ID NO: 349003 - RNA, 64 nt, Homo Sapiens
acuuaauauacaggauuauauuccuuaagugaaauuuguguagauaaaugauugguuuguaaca

SEQ ID NO: 349004 - RNA, 64 nt, Homo Sapiens
guggcgauugaaugcugccccuaucugcaauguuuuuguguagacagauguguugacguaagcu

SEQ ID NO: 349005 - RNA, 64 nt, Homo Sapiens
caguaugcacguuaacagcguguauuuaaugauuuuuguguaucucgauguacagucucaauuu

SEQ ID NO: 349006 - RNA, 64 nt, Homo Sapiens
uacuuuuuauaauuagagugauaaaugacaccgguuuguguauuauguaauacugauaaugaca

SEQ ID NO: 349007 - RNA, 64 nt, Homo Sapiens
ucuuauguggauuaccaauuagucacuugaagguuuuguguauauuuuauuuauugaacaaugu

SEQ ID NO: 349008 - RNA, 64 nt, Homo Sapiens
guuagacauuuucucauuuugaaauauuuguguguuuguguaugugcucugugccauggcuggu

SEQ ID NO: 349009 - RNA, 64 nt, Homo Sapiens
aauuauucuuuguaagcgggacauuuagaauauauuuguguacauauuauauguauguauauuu

SEQ ID NO: 349010 - RNA, 64 nt, Homo Sapiens
caaaaauaacacaauaacaggagacuuccauaaguuuguguauuauguuagucuaugaaaacgu

SEQ ID NO: 349011 - RNA, 64 nt, Homo Sapiens
caaaauaagauacugucucagcuagggcuugucauuuguguauuuaguguuaagauaggaaugc

SEQ ID NO: 349012 - RNA, 64 nt, Homo Sapiens
cauacuccuuuuaaaacaauauuuauguccuauguuuguguauagacaugacucuacuagggca

SEQ ID NO: 349013 - RNA, 64 nt, Homo Sapiens
guauagacaugacucuacuagggcauaauuagaguuuguguauuauuuuuccagguuuggggau

SEQ ID NO: 349014 - RNA, 64 nt, Homo Sapiens
uaucugccauuugcaucaugacuccaggcucuguuuuguguauugcuucuugagcuaugucucu

SEQ ID NO: 349015 - RNA, 64 nt, Homo Sapiens
uacuguauauuuauugugccagccagugagccacuuuguguauuagaaaccccgaagucuuccc

SEQ ID NO: 349016 - RNA, 64 nt, Homo Sapiens
uacuuguaaacacggauuuucugaacccugacuuuuuguguacaauuuccuggcaaacggccuc

SEQ ID NO: 349017 - RNA, 64 nt, Homo Sapiens
gugaugugucuguaucuuuacacugucauagccuuuuguguauaucucuucugauucugcugcu

SEQ ID NO: 349018 - RNA, 64 nt, Homo Sapiens
uuuagcucuaaccucaucaaaccaaaggcacagauuuguguacaauauacccauugaauguaua

SEQ ID NO: 349019 - RNA, 64 nt, Homo Sapiens
acuuuucaugggaaauauauuucacaccauugccuuuguguagagaaauauuucuuuuccugug

SEQ ID NO: 349020 - RNA, 64 nt, Homo Sapiens
augccuuuuugcaauucugaauaugauucuaguauuuguguagauguauuugguacuuuuuccc

SEQ ID NO: 349021 - RNA, 64 nt, Homo Sapiens
cagaaggaucaagaauucuaccaucccuugggucuuuguguauaaacaauguuaaauaaaggua

SEQ ID NO: 349022 - RNA, 64 nt, Homo Sapiens
aaaugugcauagaguuuguaagcuugggaaagauuuuguguaggacccucaaguguuuuuuccg

SEQ ID NO: 349023 - RNA, 64 nt, Homo Sapiens
cacauucuuaccuuugguagugggguaggugacauuuguguaucccuaccucaacaaagcaggg

SEQ ID NO: 349024 - RNA, 64 nt, Homo Sapiens
aucuuggcauuuguauugauguuccuguggauguuuuguguaguaaaaaaaaaagaugaaaaaa

SEQ ID NO: 349025 - RNA, 64 nt, Homo Sapiens
auucaaaaaaaaaaaagauguuauguaggaaauguuuguguacauuucucuguuguauguugga

SEQ ID NO: 349026 - RNA, 64 nt, Homo Sapiens
uuaacagccaccuauagaaguucuggaauauaacuuuguguaaagcgacagcggggcuuccuga

SEQ ID NO: 349027 - RNA, 64 nt, Homo Sapiens
aaaaaauggaauggucuuuuauuuuaguaugcacuuuguguaggcugaagaugauuauugugaa

SEQ ID NO: 349028 - RNA, 64 nt, Homo Sapiens
uugugauuuguucauguuauauuaaaacuugagauuuguguauuuauguagagucuguauugac

SEQ ID NO: 349029 - RNA, 64 nt, Homo Sapiens
cuugaauaaauauagccugcuuucccuagaugcauuuguguaggaaguauauacauuucccuau

SEQ ID NO: 349030 - RNA, 64 nt, Homo Sapiens
ggccuuacauguggauauuaacauugguuauuuauuuguguaaugacaaaccauuugaauuuua

SEQ ID NO: 349031 - RNA, 64 nt, Homo Sapiens
auuuaccuggaggacucguacaagaugcuucccauuuguguaauuugaaauauacuuaaaaauu

SEQ ID NO: 349032 - RNA, 64 nt, Homo Sapiens
uucccagucauugcugcaauuaucuugucuguucuuuguguaauauguucugugugagccucug

SEQ ID NO: 349033 - RNA, 64 nt, Homo Sapiens
uuucuaaaggcaguuucuguuguuuuaauuaguauuuguguaguucaaaccaggaaggauuuga

SEQ ID NO: 349034 - RNA, 64 nt, Homo Sapiens
agaguaacuucacauaaaagcagauaccuuuaaguuuguguagacuucugaauaagaugauaga

SEQ ID NO: 349035 - RNA, 64 nt, Homo Sapiens
aaucuaguagagcagacuuucuaacauaccuaguuuuguguauuggcuuugcuggaguaugaua

SEQ ID NO: 349036 - RNA, 64 nt, Homo Sapiens
ucguggcucucggccuucucagagaaauaaaugcuuuguguaacaucugugcacaccauccauu

SEQ ID NO: 349037 - RNA, 64 nt, Homo Sapiens
cccagaggcugaucugcaaaucaagcuacauguauuuguguauaagacccuguguucaggacug

SEQ ID NO: 349038 - RNA, 64 nt, Homo Sapiens
agagagaugaugaaaguaggcagggcuguguuccuuuguguagccuguauauauuuuccauaug

SEQ ID NO: 349039 - RNA, 64 nt, Homo Sapiens
aagagcaaccaaguaaagucaugaauuuucuaauuuuguguauauggaauauauuuuuaaauag

SEQ ID NO: 349040 - RNA, 64 nt, Homo Sapiens
cacuauuuguuggagaguuaaauggucucuucccuuuguguaucuuaccuaguguuuacuccug

SEQ ID NO: 349041 - RNA, 64 nt, Homo Sapiens
aaauuuuucuuuucuuucuuucuuuuuuuuuuuuuuuguguagaaaaauaggugcaauaaugau

SEQ ID NO: 349042 - RNA, 64 nt, Homo Sapiens
ugcuauuuccuucaaaugaaugauuuuuacuaauuuuguguacuuuuauugugucgauguagaa

SEQ ID NO: 349043 - RNA, 64 nt, Homo Sapiens
agauacaugaaauauuaaagaaaauguguaacuuuuuguguaaauacaucuugucuuguuuuca

SEQ ID NO: 349044 - RNA, 64 nt, Homo Sapiens
uucuucauguguuuuugucucuagccuauguguauuuguguagaauaaugugggauaccugaau

SEQ ID NO: 349045 - RNA, 64 nt, Homo Sapiens
cugaaaucuagcugcugaaugcacaguuacucacuuuguguaauaaagaaauuuuaagaauuug

SEQ ID NO: 349046 - RNA, 64 nt, Homo Sapiens
uaguguaacuauuuuguacauugcuuauuguauauuuguguaugaucuuaccaugaagguuguu

SEQ ID NO: 349047 - RNA, 64 nt, Homo Sapiens
ucacuauuagccagcuaaguuggaacauaauucuuuuguguagcuuaggucuuccuugcaauac

SEQ ID NO: 349048 - RNA, 64 nt, Homo Sapiens
aauguucuuuaaaaguuuaaggaacuuccugaauuuuguguauuaaaaauaaaguccuuuuaag

SEQ ID NO: 349049 - RNA, 64 nt, Homo Sapiens
ugagauuuauuaacagugcuucuggaacuugauuuuuguguaucuguaauuaaaugcuuugccc

SEQ ID NO: 349050 - RNA, 64 nt, Homo Sapiens
aauuggagagaacuauguuuaauuaaaagagcgguuuguguagaauuguucaucuaauuaaaua

SEQ ID NO: 349051 - RNA, 64 nt, Homo Sapiens
uuaacaauagauaugaaauaaaccauucacugauuuuguguaauuccauugguguagcuuuaca

SEQ ID NO: 349052 - RNA, 64 nt, Homo Sapiens
auuguguuuuuaaaauaguuuagaguaaaacuauuuuguguacaaccuugaagucacaguguuu

SEQ ID NO: 349053 - RNA, 64 nt, Homo Sapiens
gagguccuaaucaagaaacuuuauuuuaucaauauuuguguaguaggacuuucuuucuauagaa

SEQ ID NO: 349054 - RNA, 64 nt, Homo Sapiens
aucagaguacuggaauacggucuaaccaggugucccuggucaccuucaaacccucagguuugcc

SEQ ID NO: 349055 - RNA, 64 nt, Homo Sapiens
cuuaaaauaaccugcaucucuagugacagugugcccuggucaucaacacucaaggggaaaccug

SEQ ID NO: 349056 - RNA, 64 nt, Homo Sapiens
cccacagucccuggcaggcggcuggaaggccaggccuggucaucugucaagcaggguggacuuc

SEQ ID NO: 349057 - RNA, 64 nt, Homo Sapiens
aaguggguggaucacuugaggaguucaagaccagccuggucaacaugucaaaacccuguaccua

SEQ ID NO: 349058 - RNA, 64 nt, Homo Sapiens
ccgcugcuuccagguauggggcauccuacuccuaccuggucaacguuuuccuaguauacccacu

SEQ ID NO: 349059 - RNA, 64 nt, Homo Sapiens
ggcucacucuuucccccaaacugggcucugucuuccuggucauagcaacuggacuauagcaggg

SEQ ID NO: 349060 - RNA, 64 nt, Homo Sapiens
aagaguaaaacuucaucucaucauugcacuccagccuggucaacugcagugagccaagaucacg

SEQ ID NO: 349061 - RNA, 64 nt, Homo Sapiens
ucugguucgauugaccaggacagggagcaaguggccuggucacugaggcccacagccacccagg

SEQ ID NO: 349062 - RNA, 64 nt, Homo Sapiens
augugaugugaucagaugcuacaucuaagcuuuaccuggucaccuuggauaaugugggaaaaug

SEQ ID NO: 349063 - RNA, 64 nt, Homo Sapiens
uuugauucuuaaccccauggcuauaguugccagcccuggucaguccagagcuacaacaugccau

SEQ ID NO: 349064 - RNA, 64 nt, Homo Sapiens
gcaucugccaucugcuuuucccauugccaugcguccuggucaagcuccccucacucuguuuccu

SEQ ID NO: 349065 - RNA, 64 nt, Homo Sapiens
caugcguccuggucaagcuccccucacucuguuuccuggucagcauguacuccccucauccgau

SEQ ID NO: 349066 - RNA, 64 nt, Homo Sapiens
guuaacacaugggaacaccaaaauauucaauaagccuggucaauucuauaguuaucuuuuuugu

SEQ ID NO: 349067 - RNA, 64 nt, Homo Sapiens
cuaagcuagcaugcucagggugcaccguauguccccuggucaugugaugcuauguguuaccuug

SEQ ID NO: 349068 - RNA, 64 nt, Homo Sapiens
auguacuccccucauccgaucccucacucuguuuccuggucagccaugcguccuggucaggcuu

SEQ ID NO: 349069 - RNA, 64 nt, Homo Sapiens
cuucccucacucuguuuccuccauugccaugcguccuggucagggcaucucccaucugcuuuuc

SEQ ID NO: 349070 - RNA, 64 nt, Homo Sapiens; identical to SEQ ID NO: 115714

SEQ ID NO: 349071 - RNA, 64 nt, Homo Sapiens; identical to SEQ ID NO: 115715

SEQ ID NO: 349072 - RNA, 64 nt, Homo Sapiens; identical to SEQ ID NO: 115716

SEQ ID NO: 349073 - RNA, 64 nt, Homo Sapiens; identical to SEQ ID NO: 115717

SEQ ID NO: 349074 - RNA, 64 nt, Homo Sapiens; identical to SEQ ID NO: 115718

SEQ ID NO: 349075 - RNA, 64 nt, Homo Sapiens; identical to SEQ ID NO: 115719

SEQ ID NO: 349076 - RNA, 64 nt, Homo Sapiens; identical to SEQ ID NO: 115720

SEQ ID NO: 349077 - RNA, 64 nt, Homo Sapiens; identical to SEQ ID NO: 115721

SEQ ID NO: 349078 - RNA, 64 nt, Homo Sapiens; identical to SEQ ID NO: 115722

SEQ ID NO: 349079 - RNA, 64 nt, Homo Sapiens; identical to SEQ ID NO: 115723

SEQ ID NO: 349080 - RNA, 64 nt, Homo Sapiens; identical to SEQ ID NO: 115724

SEQ ID NO: 349081 - RNA, 64 nt, Homo Sapiens; identical to SEQ ID NO: 115725

SEQ ID NO: 349082 - RNA, 64 nt, Homo Sapiens; identical to SEQ ID NO: 115726

SEQ ID NO: 349083 - RNA, 64 nt, Homo Sapiens; identical to SEQ ID NO: 115727

SEQ ID NO: 349084 - RNA, 64 nt, Homo Sapiens; identical to SEQ ID NO: 115728

SEQ ID NO: 349085 - RNA, 64 nt, Homo Sapiens; identical to SEQ ID NO: 115729

SEQ ID NO: 349086 - RNA, 64 nt, Homo Sapiens; identical to SEQ ID NO: 115730

SEQ ID NO: 349087 - RNA, 64 nt, Homo Sapiens; identical to SEQ ID NO: 115731

SEQ ID NO: 349088 - RNA, 64 nt, Homo Sapiens; identical to SEQ ID NO: 115732

SEQ ID NO: 349089 - RNA, 64 nt, Homo Sapiens; identical to SEQ ID NO: 115733

SEQ ID NO: 349090 - RNA, 64 nt, Homo Sapiens; identical to SEQ ID NO: 115734

SEQ ID NO: 349091 - RNA, 64 nt, Homo Sapiens; identical to SEQ ID NO: 115735

SEQ ID NO: 349092 - RNA, 64 nt, Homo Sapiens; identical to SEQ ID NO: 115736

SEQ ID NO: 349093 - RNA, 64 nt, Homo Sapiens; identical to SEQ ID NO: 115737

SEQ ID NO: 349094 - RNA, 64 nt, Homo Sapiens; identical to SEQ ID NO: 115738

SEQ ID NO: 349095 - RNA, 64 nt, Homo Sapiens; identical to SEQ ID NO: 115739

SEQ ID NO: 349096 - RNA, 64 nt, Homo Sapiens
aagcaacucucaguauuuuggauuauucaaguguaugugguaaaaaugcagaugauugcugcuu

SEQ ID NO: 349097 - RNA, 64 nt, Homo Sapiens
ccuuuggaaauaaaaaguuaaauguuuacauuucaugugguauuucaggucuucagguucugau

SEQ ID NO: 349098 - RNA, 64 nt, Homo Sapiens
cucuacuaaauguaucuguaguuaggggaaggcuaugugguaaguguggacgucuuuggaauuu

SEQ ID NO: 349099 - RNA, 64 nt, Homo Sapiens
ugaaaaucauggcaugaauugcaucaguuguucaaugugguagauggccaaugccuggcugcag

SEQ ID NO: 349100 - RNA, 64 nt, Homo Sapiens
uuuauacuggagcaaaaccuuggaaauucaaagaaugugguaaaacuuacaauccucaaaacuu

SEQ ID NO: 349101 - RNA, 64 nt, Homo Sapiens
uucauacuggagagaaaccccacaaauaugaagaaugugguaaugcuuuuaaccaauucucaaa

SEQ ID NO: 349102 - RNA, 64 nt, Homo Sapiens
cucacacuggagagaaacccuauaaaugcaugccaugugguaaagccuucaaucuuuccaguuc

SEQ ID NO: 349103 - RNA, 64 nt, Homo Sapiens
cucacacugcagagaaacccuaugaaugcaagcaaugugguaaagccuucaguaguuccaguuc

SEQ ID NO: 349104 - RNA, 64 nt, Homo Sapiens; identical to SEQ ID NO: 122412

SEQ ID NO: 349105 - RNA, 64 nt, Homo Sapiens; identical to SEQ ID NO: 122413

SEQ ID NO: 349106 - RNA, 64 nt, Homo Sapiens; identical to SEQ ID NO: 122453

SEQ ID NO: 349107 - RNA, 64 nt, Homo Sapiens; identical to SEQ ID NO: 122454

SEQ ID NO: 349108 - RNA, 64 nt, Homo Sapiens; identical to SEQ ID NO: 122460

SEQ ID NO: 349109 - RNA, 64 nt, Homo Sapiens; identical to SEQ ID NO: 122461

SEQ ID NO: 349110 - RNA, 64 nt, Homo Sapiens; identical to SEQ ID NO: 122467

SEQ ID NO: 349111 - RNA, 64 nt, Homo Sapiens; identical to SEQ ID NO: 122468

SEQ ID NO: 349112 - RNA, 64 nt, Homo Sapiens; identical to SEQ ID NO: 122481

SEQ ID NO: 349113 - RNA, 64 nt, Homo Sapiens; identical to SEQ ID NO: 122482

SEQ ID NO: 349114 - RNA, 64 nt, Homo Sapiens; identical to SEQ ID NO: 122498

SEQ ID NO: 349115 - RNA, 64 nt, Homo Sapiens; identical to SEQ ID NO: 122499

SEQ ID NO: 349116 - RNA, 64 nt, Homo Sapiens; identical to SEQ ID NO: 122513

SEQ ID NO: 349117 - RNA, 64 nt, Homo Sapiens; identical to SEQ ID NO: 122514

SEQ ID NO: 349118 - RNA, 64 nt, Homo Sapiens; identical to SEQ ID NO: 122517

SEQ ID NO: 349119 - RNA, 64 nt, Homo Sapiens; identical to SEQ ID NO: 122518

SEQ ID NO: 349120 - RNA, 64 nt, Homo Sapiens; identical to SEQ ID NO: 122606

SEQ ID NO: 349121 - RNA, 64 nt, Homo Sapiens; identical to SEQ ID NO: 122607

SEQ ID NO: 349122 - RNA, 64 nt, Homo Sapiens; identical to SEQ ID NO: 122654

SEQ ID NO: 349123 - RNA, 64 nt, Homo Sapiens; identical to SEQ ID NO: 122655

SEQ ID NO: 349124 - RNA, 64 nt, Homo Sapiens; identical to SEQ ID NO: 122669

SEQ ID NO: 349125 - RNA, 64 nt, Homo Sapiens; identical to SEQ ID NO: 122670

SEQ ID NO: 349126 - RNA, 64 nt, Homo Sapiens; identical to SEQ ID NO: 122677

SEQ ID NO: 349127 - RNA, 64 nt, Homo Sapiens; identical to SEQ ID NO: 122678

SEQ ID NO: 349128 - RNA, 64 nt, Homo Sapiens; identical to SEQ ID NO: 122684

SEQ ID NO: 349129 - RNA, 64 nt, Homo Sapiens; identical to SEQ ID NO: 122685

SEQ ID NO: 349130 - RNA, 64 nt, Homo Sapiens; identical to SEQ ID NO: 122691

SEQ ID NO: 349131 - RNA, 64 nt, Homo Sapiens; identical to SEQ ID NO: 122692

SEQ ID NO: 349132 - RNA, 64 nt, Homo Sapiens; identical to SEQ ID NO: 122693

SEQ ID NO: 349133 - RNA, 64 nt, Homo Sapiens; identical to SEQ ID NO: 122709

SEQ ID NO: 349134 - RNA, 64 nt, Homo Sapiens; identical to SEQ ID NO: 122710

SEQ ID NO: 349135 - RNA, 64 nt, Homo Sapiens; identical to SEQ ID NO: 122711

SEQ ID NO: 349136 - RNA, 64 nt, Homo Sapiens; identical to SEQ ID NO: 122718

SEQ ID NO: 349137 - RNA, 64 nt, Homo Sapiens; identical to SEQ ID NO: 122719

SEQ ID NO: 349138 - RNA, 64 nt, Homo Sapiens; identical to SEQ ID NO: 122734

SEQ ID NO: 349139 - RNA, 64 nt, Homo Sapiens; identical to SEQ ID NO: 122735

SEQ ID NO: 349140 - RNA, 64 nt, Homo Sapiens; identical to SEQ ID NO: 122742

SEQ ID NO: 349141 - RNA, 64 nt, Homo Sapiens; identical to SEQ ID NO: 122743

SEQ ID NO: 349142 - RNA, 64 nt, Homo Sapiens; identical to SEQ ID NO: 122744

SEQ ID NO: 349143 - RNA, 64 nt, Homo Sapiens; identical to SEQ ID NO: 122746

SEQ ID NO: 349144 - RNA, 64 nt, Homo Sapiens; identical to SEQ ID NO: 122747

SEQ ID NO: 349145 - RNA, 64 nt, Homo Sapiens; identical to SEQ ID NO: 122749

SEQ ID NO: 349146 - RNA, 64 nt, Homo Sapiens; identical to SEQ ID NO: 122750

SEQ ID NO: 349147 - RNA, 64 nt, Homo Sapiens; identical to SEQ ID NO: 122801

SEQ ID NO: 349148 - RNA, 64 nt, Homo Sapiens; identical to SEQ ID NO: 122802

SEQ ID NO: 349149 - RNA, 64 nt, Homo Sapiens; identical to SEQ ID NO: 122837

SEQ ID NO: 349150 - RNA, 64 nt, Homo Sapiens; identical to SEQ ID NO: 122838

SEQ ID NO: 349151 - RNA, 64 nt, Homo Sapiens; identical to SEQ ID NO: 122842

SEQ ID NO: 349152 - RNA, 64 nt, Homo Sapiens; identical to SEQ ID NO: 122843

SEQ ID NO: 349153 - RNA, 64 nt, Homo Sapiens; identical to SEQ ID NO: 122853

SEQ ID NO: 349154 - RNA, 64 nt, Homo Sapiens; identical to SEQ ID NO: 122854

SEQ ID NO: 349155 - RNA, 64 nt, Homo Sapiens; identical to SEQ ID NO: 122861

SEQ ID NO: 349156 - RNA, 64 nt, Homo Sapiens; identical to SEQ ID NO: 122862

SEQ ID NO: 349157 - RNA, 64 nt, Homo Sapiens; identical to SEQ ID NO: 122909

SEQ ID NO: 349158 - RNA, 64 nt, Homo Sapiens; identical to SEQ ID NO: 122910

SEQ ID NO: 349159 - RNA, 64 nt, Homo Sapiens; identical to SEQ ID NO: 122911

SEQ ID NO: 349160 - RNA, 64 nt, Homo Sapiens; identical to SEQ ID NO: 122931

SEQ ID NO: 349161 - RNA, 64 nt, Homo Sapiens; identical to SEQ ID NO: 122932

SEQ ID NO: 349162 - RNA, 64 nt, Homo Sapiens; identical to SEQ ID NO: 122949

SEQ ID NO: 349163 - RNA, 64 nt, Homo Sapiens; identical to SEQ ID NO: 122950

SEQ ID NO: 349164 - RNA, 64 nt, Homo Sapiens; identical to SEQ ID NO: 122967

SEQ ID NO: 349165 - RNA, 64 nt, Homo Sapiens; identical to SEQ ID NO: 122968

SEQ ID NO: 349166 - RNA, 64 nt, Homo Sapiens; identical to SEQ ID NO: 122972

SEQ ID NO: 349167 - RNA, 64 nt, Homo Sapiens; identical to SEQ ID NO: 122973

SEQ ID NO: 349168 - RNA, 64 nt, Homo Sapiens; identical to SEQ ID NO: 122977

SEQ ID NO: 349169 - RNA, 64 nt, Homo Sapiens; identical to SEQ ID NO: 122978

SEQ ID NO: 349170 - RNA, 64 nt, Homo Sapiens
gcauguuuauauccccaauuauccuaggcauuguccuaggcauucuuuauugagcaucuucuac

SEQ ID NO: 349171 - RNA, 64 nt, Homo Sapiens
guccuaggcauugcauguuuagcaucuucuacauccuaggcauuaaugauaacuaucuuuauug

SEQ ID NO: 349172 - RNA, 64 nt, Homo Sapiens
gcugagcccccugcagcucccaucuccagcuauuccuaggcaaagagccucauggcuaaggcag

SEQ ID NO: 349173 - RNA, 64 nt, Homo Sapiens
augcuauuaauuuccauccuuuagcaggcugggcccuaggcaggaagcuggcuucugggagagg

SEQ ID NO: 349174 - RNA, 64 nt, Homo Sapiens; identical to SEQ ID NO: 159255

SEQ ID NO: 349175 - RNA, 64 nt, Homo Sapiens; identical to SEQ ID NO: 159256

SEQ ID NO: 349176 - RNA, 64 nt, Homo Sapiens; identical to SEQ ID NO: 159257

SEQ ID NO: 349177 - RNA, 64 nt, Homo Sapiens; identical to SEQ ID NO: 159258

SEQ ID NO: 349178 - RNA, 64 nt, Homo Sapiens; identical to SEQ ID NO: 159259

SEQ ID NO: 349179 - RNA, 64 nt, Homo Sapiens; identical to SEQ ID NO: 159260

SEQ ID NO: 349180 - RNA, 63 nt, Homo Sapiens; identical to SEQ ID NO: 38974

SEQ ID NO: 349181 - RNA, 63 nt, Homo Sapiens; identical to SEQ ID NO: 38975

SEQ ID NO: 349182 - RNA, 64 nt, Homo Sapiens
auuggugaccuuuuguaagacauuaguuugagguacuaccuauguacuugaaaauaauaaagug

SEQ ID NO: 349183 - RNA, 64 nt, Homo Sapiens
gaugacaguaauucuguugucuaccauuaaugcuacuaccuacuccauaauugccuauuuagcu

SEQ ID NO: 349184 - RNA, 64 nt, Homo Sapiens
cugacgacuggaauagauauaaaguccuguuuaaacuaccuaaccuuggcugugggccgauaau

SEQ ID NO: 349185 - RNA, 64 nt, Homo Sapiens
uaaggauacagcuuauaaguugcuaucaauuuucacuaccuaagcagaauuuuucucuaauuua

SEQ ID NO: 349186 - RNA, 64 nt, Homo Sapiens
uacuacucuacccccugccuagccucaucauuugacuaccuauguguuauugguagacacccuc

SEQ ID NO: 349187 - RNA, 64 nt, Homo Sapiens
agaagaguaaaucagacugaaaauaaaaaaucugacuaccuaucaauguaccuggcacguuuga

SEQ ID NO: 349188 - RNA, 64 nt, Homo Sapiens
gcccaagaaaaccaacuaagcugguggauuucuuacuaccuaacgaagguuuuggcugggguuc

SEQ ID NO: 349189 - RNA, 64 nt, Homo Sapiens
guucaaaaaauaaagaaauguagaauccugggcaacuaccuaugugaggccuuucagagcucag

SEQ ID NO: 349190 - RNA, 64 nt, Homo Sapiens
caauguauguaauuuguuucuuuuuucauagguuacuaccuauaaauuuuuaccuaaucuccac

SEQ ID NO: 349191 - RNA, 64 nt, Homo Sapiens
aaauacuaagaaaaauuuguuaagaaaaaauaaaacuaccuacgguuuggauccugacucaaau

SEQ ID NO: 349192 - RNA, 64 nt, Homo Sapiens
agaacuaauagacacaggaggcagcccugaagaaacuaccuagguacugugaagugaaguuggc

SEQ ID NO: 349193 - RNA, 64 nt, Homo Sapiens
aaaaaaguacuucugugacaaaagguuuaaauauacuaccuaagggugguaauaauuauaacug

SEQ ID NO: 349194 - RNA, 64 nt, Homo Sapiens
ucaugcaaugaaagcauuuuauagucauuuuuaaacuaccuauccaaaaaaaaaagaaaaaaga

SEQ ID NO: 349195 - RNA, 64 nt, Homo Sapiens
guuuaauuaucggcacuuguuuuuuguuuaauauacuaccuauaacauaauugcuaaaaacuca

SEQ ID NO: 349196 - RNA, 64 nt, Homo Sapiens
cacacacacacacacacacacaaauauugcuuggacuaccuauaaauggacuugcuucuugugu

SEQ ID NO: 349197 - RNA, 64 nt, Homo Sapiens
ccccuggucuccuccccguagccacucucugcccacuaccuaugcuucuagaaagccccucacc

SEQ ID NO: 349198 - RNA, 64 nt, Homo Sapiens
ucuuugguguugguuguaacaaaauuugauuugaacuaccuauaaaugaaaagucgggguuuau

SEQ ID NO: 349199 - RNA, 64 nt, Homo Sapiens
cuuuacucuugagugucuccaacaauugggcaaaacuaccuaggaaaaucacauuucagaauaa

SEQ ID NO: 349200 - RNA, 64 nt, Homo Sapiens
ucuaaacuuugccauauugacuaugugcaugcauacuaccuauuuaagaagacuuuuuguugua

SEQ ID NO: 349201 - RNA, 64 nt, Homo Sapiens
ccacaguucuggaaggaucugcagaugauggagaacuaccuaggcuucaucuuuucaacauaug

SEQ ID NO: 349202 - RNA, 64 nt, Homo Sapiens
ugggguuggaagugugacuucuuacacauaaagcacuaccuaaguaauucucucucuguuuugu

SEQ ID NO: 349203 - RNA, 64 nt, Homo Sapiens
aucuuaguuccagaauuuagucuuccuuuggaauacuaccuaauucccuuccuuaucauagugg

SEQ ID NO: 349204 - RNA, 64 nt, Homo Sapiens
uccuucugacuagaaguauguauaauaaaacaauacuaccuaguuaaacauuuacuuucucuuu

SEQ ID NO: 349205 - RNA, 64 nt, Homo Sapiens
auacauaaacauauacaauaaagaaauuuaagucacuaccuaguacagaagcacaaguaaauaa

SEQ ID NO: 349206 - RNA, 64 nt, Homo Sapiens
ugaagagaguaucauuuauauggcuccugugggaacuaccuagacccaacaucccaggcugugg

SEQ ID NO: 349207 - RNA, 64 nt, Homo Sapiens
ggacauauagauuauucguauuauaguuuguagaacuaccuaguucagaaucuugacugccagu

SEQ ID NO: 349208 - RNA, 64 nt, Homo Sapiens
uuuggaagaugcagaagcaauaauaaaguacuugacuaccuacugguguaaucucaaugcaagc

SEQ ID NO: 349209 - RNA, 64 nt, Homo Sapiens
gaagaaauuaauggaauauggugugcuaauuaucacuaccuauaacaugaggaauauaacauug

SEQ ID NO: 349210 - RNA, 64 nt, Homo Sapiens
acugagcgcuguuuuuaaauaauuggauugacuuacuaccuaacaagucauuaauuuauacuga

SEQ ID NO: 349211 - RNA, 64 nt, Homo Sapiens
uaaaugcaucaaaaaauauaaaguagagaauuaaacuaccuaaacuuguauuagaacauaauaa

SEQ ID NO: 349212 - RNA, 64 nt, Homo Sapiens
aaagauucuaaggccuaguauucaaguuucagcaacuaccuacaacuucaaaguauuauucaac

SEQ ID NO: 349213 - RNA, 64 nt, Homo Sapiens
acaaauauuucugauaagacuaggaaauaaaacaacuaccuaauuaaaauuguaagcaauagaa

SEQ ID NO: 349214 - RNA, 64 nt, Homo Sapiens
aggucugagugcaugugugcauuaaaaacauuucacuaccuauucucucauggacuucucaucc

SEQ ID NO: 349215 - RNA, 64 nt, Homo Sapiens
cauccuuugaguaguaaaggauaaaagcauauauacuaccuauauguaugugcuguaugugggc

SEQ ID NO: 349216 - RNA, 64 nt, Homo Sapiens
ucagacaagagaucugccauuucaugcccuugugacuaccuaucauuggcccugcaauaaaauc

SEQ ID NO: 349217 - RNA, 64 nt, Homo Sapiens
cuuuuaugcauggcaccucugaauggaccuugaaacuaccuagguaaaaucaugaggaauggaa

SEQ ID NO: 349218 - RNA, 64 nt, Homo Sapiens
cacugacuuaguaaauaguaccaaaccacuaaaaacuaccuaaagcaugcacacacacagaacc

SEQ ID NO: 349219 - RNA, 64 nt, Homo Sapiens
aaaucuugaagagagguaauaaauauaaauacauacuaccuaaauuucucgugaucagaagcca

SEQ ID NO: 349220 - RNA, 64 nt, Homo Sapiens
augccuguugugcucagguguuuuauguauuuaaacuaccuacccuuucccuguguuggaaagu

SEQ ID NO: 349221 - RNA, 64 nt, Homo Sapiens
ggguuuuuuauacuccccaauuuagcauaucuagacuaccuauuugaaaggaacccuaucaacu

SEQ ID NO: 349222 - RNA, 64 nt, Homo Sapiens
gccugccucucuacuguucccccuuuucuaacacacuaccuagaaaagccauucaguacuggcu

SEQ ID NO: 349223 - RNA, 64 nt, Homo Sapiens
gggagcugacaauucguggguccgcaaaaucuuaacuaccuaauagccuacuauugaccauaaa

SEQ ID NO: 349224 - RNA, 64 nt, Homo Sapiens
aauuauaacauuagaagccucacuauggucgaauacuaccuacguauugcugaauauaauguga

SEQ ID NO: 349225 - RNA, 64 nt, Homo Sapiens
cugacuuucuguccacugcaauggaucccuagggacuaccuaauugauagauucccagagcugg

SEQ ID NO: 349226 - RNA, 64 nt, Homo Sapiens
auaggauaaauuucaagcuauuuucuaaugaaaaacuaccuauacagaaguuaacacaaugguu

SEQ ID NO: 349227 - RNA, 53 nt, Homo Sapiens
auuaugaaagaagacguuaauaaacuaccuaacauuauuuauucagcuucauu

SEQ ID NO: 349228 - RNA, 64 nt, Homo Sapiens
acucugaccacuuaaaaaaaaaucuaaaaauugaacuaccuauaguagucuguguuuaaaguga

SEQ ID NO: 349229 - RNA, 64 nt, Homo Sapiens
guacauuguuuauauagccaaguguauaugcuuuacuaccuaacaauuauucuagccuagguga

SEQ ID NO: 349230 - RNA, 64 nt, Homo Sapiens
gucaacucuggccaggaacuaagaaaaucacaucacuaccuagaaauauuuagaaaaacauccc

SEQ ID NO: 349231 - RNA, 64 nt, Homo Sapiens
uuccuuguguaauuaaugcuauauuuuuauucaaacuaccuauaauagcuccaagcuguuaaag

SEQ ID NO: 349232 - RNA, 64 nt, Homo Sapiens
guuuaugcuuaauuuuaauuaugugcagaagguuacuaccuaggggaaauucggagcuauacau

SEQ ID NO: 349233 - RNA, 64 nt, Homo Sapiens
ugugauuuuugcugguuacuuuucaauauuggugacuaccuaaauaaauuauauaucagaaaac

SEQ ID NO: 349234 - RNA, 64 nt, Homo Sapiens
gcuugccaguuccugguucuguguccuuggacaaacuaccuaaccuuucugagccuccuauacc

SEQ ID NO: 349235 - RNA, 64 nt, Homo Sapiens
cuggauucgugacaacaugccaccaagguuaccaacuaccuagaaaggaugucccgggugugua

SEQ ID NO: 349236 - RNA, 64 nt, Homo Sapiens
gaaaauugagaaacuauauauucaguugggaugcacuaccuagcuaaauaugcuuuaguuuuaa

SEQ ID NO: 349237 - RNA, 64 nt, Homo Sapiens
guguuucccugccucucaauucgcugaaaaaggaacuaccuauccuuacauuucaccuacuaau

SEQ ID NO: 349238 - RNA, 64 nt, Homo Sapiens
cuauuuagggaagcuuuuccaagccacaaucuuaacuaccuacccaaaggauuugcauuacccc

SEQ ID NO: 349239 - RNA, 64 nt, Homo Sapiens
aaguuuggaugaaagugcaagauguggaacaucaacuaccuauuuuccuuggguuuuuccacuc

SEQ ID NO: 349240 - RNA, 64 nt, Homo Sapiens
aggcagagcugagggcccuguggaguccagcucuacuaccuacguuugcaccgccugcccuccc

SEQ ID NO: 349241 - RNA, 64 nt, Homo Sapiens
uuacuauaaaggaaauguuagaaguaaaacaccaacuaccuaccaccaacaugaaaguaccacu

SEQ ID NO: 349242 - RNA, 64 nt, Homo Sapiens
uuuucuggucauucuugacuaacaaauaugagagacuaccuacuaguaaaaaguggacaugcua

SEQ ID NO: 349243 - RNA, 64 nt, Homo Sapiens
auaaauaaaauuagugaaaauauucugagugaaaacuaccuaauaaaccugaaaaaugaauuga

SEQ ID NO: 349244 - RNA, 64 nt, Homo Sapiens
aagugcugugaggcucaaauauggggauaauagcacuaccuaccuucucagugccaucuauaaa

SEQ ID NO: 349245 - RNA, 64 nt, Homo Sapiens
auaaaacacuauuaauauuuuaaucucuaauccuacuaccuagacaaaaauaagaaaauuaaaa

SEQ ID NO: 349246 - RNA, 64 nt, Homo Sapiens
ggggcuugauagcugugguccccucuccccucugacuaccuaaaaucaauaccuaaauacagaa

SEQ ID NO: 349247 - RNA, 64 nt, Homo Sapiens
auaaaauagaauuacuacaauucugcaauuucauacuaccuaaaaaagacuagauuugaaaaug

SEQ ID NO: 349248 - RNA, 64 nt, Homo Sapiens
uauuauauauguguaugcauuuuacuggcucaaaacuaccuacuucuuucucaggcaucaaaag

SEQ ID NO: 349249 - RNA, 59 nt, Homo Sapiens
augauaccacacaugguuaauuggaaaauacuaccuacugguuugggagauguauauag

SEQ ID NO: 349250 - RNA, 64 nt, Homo Sapiens
cucaguguagaggacauuccugucauccaugccaacuaccuaacucguuaucagagcugauaga

SEQ ID NO: 349251 - RNA, 64 nt, Homo Sapiens
caggaguggaacugguagagggugcacuaauuucacuaccuaucacuugucuuuugguggacau

SEQ ID NO: 349252 - RNA, 64 nt, Homo Sapiens
aagaaugcugucacaccuuuccauccaagaaacuacuaccuaucgccauuucaauuuugcagca

SEQ ID NO: 349253 - RNA, 64 nt, Homo Sapiens
uggaugggcaagaguguacuucuuggcuccauuuacuaccuacugcucaguagucaucucugua

SEQ ID NO: 349254 - RNA, 64 nt, Homo Sapiens
cgguucucuuguuggugccaguauuacauugaagacuaccuaugauagaggcaauguugcuuug

SEQ ID NO: 349255 - RNA, 64 nt, Homo Sapiens
uugacugcccacccacagaaaagcaaaauaaccaacuaccuacucaauuguguguuuguaauug

SEQ ID NO: 349256 - RNA, 64 nt, Homo Sapiens
aaucacgaaaauaauaauaauaaaucuuuaacauacuaccuaaagggaaccugcaauaaucuug

SEQ ID NO: 349257 - RNA, 64 nt, Homo Sapiens
aaaagaaagaaagaaaccuccagcguauuuuaucacuaccuauagaaagaaauccugcuuugag

SEQ ID NO: 349258 - RNA, 64 nt, Homo Sapiens
agaagacacgcuuuuuguggaaugaggaaaauguacuaccuagaaaauggccagauuuucagug

SEQ ID NO: 349259 - RNA, 64 nt, Homo Sapiens
cauucaugcggauacuaguauuuauagaugucugacuaccuaacuuaauuuuuguuuuugaacu

SEQ ID NO: 349260 - RNA, 64 nt, Homo Sapiens
cucaguuugucuuuuaaaaaacagcugaaucuuuacuaccuauuuaguucuccuuguuaaagaa

SEQ ID NO: 349261 - RNA, 64 nt, Homo Sapiens
ugguuuaugaccacuuagauaaucuuuuaauaaaacuaccuaucgaaggaguguucuuagggua

SEQ ID NO: 349262 - RNA, 64 nt, Homo Sapiens
uuuuuuaaauagcuagguuuacccaugaaugugcacuaccuacacccccgaaaaccuugaucuu

SEQ ID NO: 349263 - RNA, 64 nt, Homo Sapiens
ggaauauuuuugaggccugguaggguguuuguggacuaccuaaugagaucccagccccuaugag

SEQ ID NO: 349264 - RNA, 64 nt, Homo Sapiens
acuuguguugugaacguuugguauaaagcacuuuacuaccuaccuguguauauaguauuuccuu

SEQ ID NO: 349265 - RNA, 64 nt, Homo Sapiens
guguguauucucuugacggguuccaaccuaagaaacuaccuaccauuuccuucagggacagauu

SEQ ID NO: 349266 - RNA, 64 nt, Homo Sapiens
uagcaaucauuuuggaucacuggacuuucaguggacuaccuaaaacaggggacagcuuuuggaa

SEQ ID NO: 349267 - RNA, 64 nt, Homo Sapiens
ugugugauugugggaaauuagaugcuagcgugccacuaccuacugucccauagaacagaaaugg

SEQ ID NO: 349268 - RNA, 64 nt, Homo Sapiens
uggguaaguugaaaagguaaucuagcauuuuuuuacuaccuauaugcaaauuagcuuuuuaucu

SEQ ID NO: 349269 - RNA, 64 nt, Homo Sapiens
agaaucuaagcuauagcagguucugaaagaaacuacuaccuaggaccugcacagcucauuuucc

SEQ ID NO: 349270 - RNA, 64 nt, Homo Sapiens
uccccagcuuaccgguuagucagacucuuggaugacuaccuagauaacaaauuucuucucccuc

SEQ ID NO: 349271 - RNA, 64 nt, Homo Sapiens
ucaugugguugguugaugauuaaaaugaggacauacuaccuaccagacucaguuucuuccucug

SEQ ID NO: 349272 - RNA, 64 nt, Homo Sapiens
acguuuuuuauuuuugugcuaaauuguaguucaaacuaccuaaacuguuauauaauucaguuuu

SEQ ID NO: 349273 - RNA, 64 nt, Homo Sapiens
agucagcauacccugagugauggcucaggggcgcacuaccuauuuugucaccagagcugacuca

SEQ ID NO: 349274 - RNA, 64 nt, Homo Sapiens
uucuccuuauccuugccagcacuuguauugccagacuaccuaauuuuugccagucucaugggua

SEQ ID NO: 349275 - RNA, 64 nt, Homo Sapiens
ucuugguuuucuucauccaugaaauccaaguaauacuaccuaauuguuacuguggagauuaagu

SEQ ID NO: 349276 - RNA, 64 nt, Homo Sapiens
aucaccccaaggacaacggcacaaguagagagaaacuaccuaccucacuucaaauuauguuugg

SEQ ID NO: 349277 - RNA, 64 nt, Homo Sapiens
aucaccccaaggacaacggcagaaguagagagaaacuaccuaccucacuucaaauuauguuugg

SEQ ID NO: 349278 - RNA, 64 nt, Homo Sapiens
uuugugagucuccgugacccugcccccacccugcacuaccuauucacguuuacacagggugggc

SEQ ID NO: 349279 - RNA, 64 nt, Homo Sapiens
gaaagccagcaaagaaugaaggccaucuuuuccuacuaccuagaauaaucaugggacugccggu

SEQ ID NO: 349280 - RNA, 64 nt, Homo Sapiens
ggucggagcauggaaggagggugaggaucaaaaaacuaccuaucugguacuaugcuuuuuaucu

SEQ ID NO: 349281 - RNA, 64 nt, Homo Sapiens
ugauguuaauggguuaucucaaauuuuaaguuaaacuaccuaaaauaaauaccaaagauaaugc

SEQ ID NO: 349282 - RNA, 64 nt, Homo Sapiens
agaucccgcgucagcggauugcugcuucaccuacacuaccuacaaccuuaccaccccucagagu

SEQ ID NO: 349283 - RNA, 64 nt, Homo Sapiens
aguaagaagaggagccucaguggaaggagcacauacuaccuagacacccccuccccaaagccac

SEQ ID NO: 349284 - RNA, 64 nt, Homo Sapiens
ggaaagucugucagguuuggaacacugaaaaaauacuaccuauaaggagaaauuuugguuuuuc

SEQ ID NO: 349285 - RNA, 64 nt, Homo Sapiens
ggaauaugugcuggaaaaauugcaacaacacuuuacuaccuaacggauagcauuuguaaauacu

SEQ ID NO: 349286 - RNA, 64 nt, Homo Sapiens
gccugugaaaauacauuucacaucuuugcaaaugacuaccuauacaaggaucaaaaauuguggc

SEQ ID NO: 349287 - RNA, 64 nt, Homo Sapiens
aagaacauccguguacccaguacccugacuaccgacuaccuacaacccgucccugccccauccu

SEQ ID NO: 349288 - RNA, 64 nt, Homo Sapiens
gucuaccuugaguuaaaucccaccucugccaucuacuaccuaagugaccuugggaaggucagaa

SEQ ID NO: 349289 - RNA, 64 nt, Homo Sapiens
aucuccauccucugggcaccuugcacugcccuacacuaccuaccggucccagagcuggagcuuc

SEQ ID NO: 349290 - RNA, 64 nt, Homo Sapiens
aggaugucuaaauguuuguuagaauaauguacguacuaccuaaacccguuuacagaaugcuaca

SEQ ID NO: 349291 - RNA, 64 nt, Homo Sapiens
auuguggaaaaggugauucuguagauguugcccuacuaccuaccgagagcaagaaaaagaugau

SEQ ID NO: 349292 - RNA, 64 nt, Homo Sapiens
gcacuuuaagucagugacagugauagggaaggcuacuaccuagggucacuggcaucucacuuua

SEQ ID NO: 349293 - RNA, 64 nt, Homo Sapiens
aucuccccucuugucuguggaagauaucacaugaacuaccuaauuuucaagcauggaucuccau

SEQ ID NO: 349294 - RNA, 64 nt, Homo Sapiens
uaaaauuugcacaugugauugugaagaaauuuguacuaccuaaaagucccagugcaugucucug

SEQ ID NO: 349295 - RNA, 64 nt, Homo Sapiens
ugcucaaaucuaugggaacaaaagucaagguaucacuaccuagaaguaaugauauacaguuuuc

SEQ ID NO: 349296 - RNA, 64 nt, Homo Sapiens
uguagugugaccuacauuuacauggucccuagagacuaccuaguucggccuugugucagcaggu

SEQ ID NO: 349297 - RNA, 64 nt, Homo Sapiens
acaaguuaaauuuacaagucaaaaacaaaccacuacuaccuagcuggcagaguuuugguuuaag

SEQ ID NO: 349298 - RNA, 64 nt, Homo Sapiens
ggaaaauuaauucuaaacugagaaaaauguuccuacuaccuauugcugauacugucuuugcaua

SEQ ID NO: 349299 - RNA, 64 nt, Homo Sapiens; identical to SEQ ID NO: 349298

SEQ ID NO: 349300 - RNA, 64 nt, Homo Sapiens
gcuuugugugcacaaaauugcuuuuuccaccucggaaaugcagcuuucccuagggggaggccua

SEQ ID NO: 349301 - RNA, 64 nt, Homo Sapiens
aauuuuagugacaccuuaugccauuucaagaggagaaaugcaggcuggcagagcaauuuccaga

SEQ ID NO: 349302 - RNA, 64 nt, Homo Sapiens
uccaccagggagggagacacugauagaacaaagcgaaaugcaggcgauuucagcuucauuccuc

SEQ ID NO: 349303 - RNA, 64 nt, Homo Sapiens
gaaacucccgagguccagaggacagugcaaggaggaaaugcagggagcccugcaaggcagaaau

SEQ ID NO: 349304 - RNA, 64 nt, Homo Sapiens
uugaaguaguuugaugauuuuguuuuaaaaagaagaaaugcauacuacaaauaauugcccccuu

SEQ ID NO: 349305 - RNA, 64 nt, Homo Sapiens
uggaggcuaaguauugcuuuuaugccauuucugggaaaugcaucgucuaggccuuugaauggca

SEQ ID NO: 349306 - RNA, 64 nt, Homo Sapiens
aaaccucgagacaugguuuugggcaaagccauuagaaaugcauaacucuggguaucucuccuau

SEQ ID NO: 349307 - RNA, 64 nt, Homo Sapiens
cagggcaugagcaacugagguaauaaaaccagaggaaaugcauaaaguauuuucuuaauuugaa

SEQ ID NO: 349308 - RNA, 64 nt, Homo Sapiens
aaucuucuauucuuaauauuguuauguuaauuaagaaaugcauaaguuuauauuuagcuaaacu

SEQ ID NO: 349309 - RNA, 64 nt, Homo Sapiens
agaaaggcuuguuuugguugauaaccagugcugugaaaugcagauuauaaggaaaacaaauaua

SEQ ID NO: 349310 - RNA, 64 nt, Homo Sapiens
ugaaaagggaguuucguaagcaaaauagaggacagaaaugcaguucaugaacuugcugguuggu

SEQ ID NO: 349311 - RNA, 64 nt, Homo Sapiens
cugcuguccuggugacuugucccucuucuuaguggaaaugcauuugagauggugacagggcugg

SEQ ID NO: 349312 - RNA, 64 nt, Homo Sapiens
aaagaaccaucagcaucacccgggaacuuuuuuagaaaugcaaaaucucuacugcuuuggaucc

SEQ ID NO: 349313 - RNA, 64 nt, Homo Sapiens
uuuggauccugggucaaaaaaaagaaaaaaaaaagaaaugcaaaacuuuaggcccugccccaga

SEQ ID NO: 349314 - RNA, 64 nt, Homo Sapiens
augaagauguggaaaccaaugaaaaguacauuuagaaaugcaggcuuuuuaguagaaagaagcu

SEQ ID NO: 349315 - RNA, 64 nt, Homo Sapiens
ccccagagcaguccucaacacuaugucagugcuggaaaugcagccacuggcagaucuggccccc

SEQ ID NO: 349316 - RNA, 64 nt, Homo Sapiens
ugacagcagugaaacuccuccucacuggaaagaggaaaugcagagauuaagagcauauagacca

SEQ ID NO: 349317 - RNA, 64 nt, Homo Sapiens
uccccagcaaaaguagaggagacuuccccucuaggaaaugcacggcuugauaccccagauauaa

SEQ ID NO: 349318 - RNA, 64 nt, Homo Sapiens
gucuaaaauggacgaaucuaugucugacugcauugaaaugcaauaggugcaaaagcccacauau

SEQ ID NO: 349319 - RNA, 64 nt, Homo Sapiens
ucaaaaucacaaugagauucuauuauucauuagggaaaugcaagcaugaaaaaauacucaacau

SEQ ID NO: 349320 - RNA, 64 nt, Homo Sapiens
ggacccagaauauccaaauaccaaaauucauaaagaaaugcaagcagaaauugauaagcuaguc

SEQ ID NO: 349321 - RNA, 64 nt, Homo Sapiens
ucaaaaccacaaugagauauuaacuauucauacagaaaugcaaaauuuuuaaaaugcucaacau

SEQ ID NO: 349322 - RNA, 64 nt, Homo Sapiens
ugguaauaaaaaguauaaauucacuaaauuuagagaaaugcacaaaauauaaaauaguaaaauu

SEQ ID NO: 349323 - RNA, 64 nt, Homo Sapiens
ggcgacacuggagucuucuucuuagacaaugccugaaaugcaaaccacauaaaugcaggaagaa

SEQ ID NO: 349324 - RNA, 64 nt, Homo Sapiens
gaacucugggugccgagagaaggugcacagguuggaaaugcacugcugggugguugcacaggcc

SEQ ID NO: 349325 - RNA, 64 nt, Homo Sapiens
uuuggagaacuuaauuaacgugagauuggcaauugaaaugcaggugcaguuuucuguuaauguc

SEQ ID NO: 349326 - RNA, 64 nt, Homo Sapiens
gauuucguauucuaguagucaauguauuuucagugaaaugcaaaaauauucccguuaucuuuga

SEQ ID NO: 349327 - RNA, 64 nt, Homo Sapiens
ugauccauggcaggaguaaaaggaguugaugguagaaaugcauauauaaaaauacugcaaaacc

SEQ ID NO: 349328 - RNA, 64 nt, Homo Sapiens
uuuggugauguugcacuuucaaaaugaauccugggaaaugcacguaaauuuucaugagaauucu

SEQ ID NO: 349329 - RNA, 64 nt, Homo Sapiens
ucagaauaucagaaucuucuuagaaauaaacuaggaaaugcagauguuuuuaacuacucagacu

SEQ ID NO: 349330 - RNA, 64 nt, Homo Sapiens
cuaaacuaucagucauuuacauccucucaugaaugaaaugcaguguagggagaggagauggcag

SEQ ID NO: 349331 - RNA, 64 nt, Homo Sapiens
accacuauguauauauguuuaauaucugucuuuugaaaugcagaaauaguuuaaauguuucuuu

SEQ ID NO: 349332 - RNA, 64 nt, Homo Sapiens
uguuaaaguaauauuuuauuaucuacauaaaacagaaaugcacaauaccuucauaguuuguucu

SEQ ID NO: 349333 - RNA, 64 nt, Homo Sapiens
cuaccugcccgguuccuuuccugaggacccggcagaaaugcagaaccauccauggacugugauu

SEQ ID NO: 349334 - RNA, 64 nt, Homo Sapiens
auauuugcucuagaagaaaaaaaaaaaaggaggggaaaugcauuuuccccagagauaaaggcug

SEQ ID NO: 349335 - RNA, 64 nt, Homo Sapiens
ugcaucccaggaacuugguuaguggaucauguuggaaaugcaacuuuauagaaugugaagaccc

SEQ ID NO: 349336 - RNA, 64 nt, Homo Sapiens
gaggacugagaauacuuugggaaaaggcauuugggaaaugcaaaaucucuuuuugaucaaacaa

SEQ ID NO: 349337 - RNA, 64 nt, Homo Sapiens
uaaaccuggguuuuguucauauuuucuccagacagaaaugcaaagaucaaacugugcaaauauu

SEQ ID NO: 349338 - RNA, 64 nt, Homo Sapiens
ugacuuucucucaacugcaguuuucuuaaucuuugaaaugcaaauaauguuuaucucagaagac

SEQ ID NO: 349339 - RNA, 64 nt, Homo Sapiens
cauagaacugagugcugagaauccaggauggaaagaaaugcagaacuaucauagucacauacau

SEQ ID NO: 349340 - RNA, 64 nt, Homo Sapiens
uguacuugaagguuuuauauuuaaaaguauuuuugaaaugcaauguguccccucucaccuuauu

SEQ ID NO: 349341 - RNA, 64 nt, Homo Sapiens
accuugucaugacaaaagaguuaggagaggcccagaaaugcaucgaaacaccagauagaagauc

SEQ ID NO: 349342 - RNA, 64 nt, Homo Sapiens
gggagccugugaaagcacaacacccacuucugcugaaaugcauuagaaguaggcuaaggcagac

SEQ ID NO: 349343 - RNA, 64 nt, Homo Sapiens
uuuuucugaacuucaaagauaaccauaguucaucgaaaugcagcacuaugugcuuuuuuuuuuu

SEQ ID NO: 349344 - RNA, 64 nt, Homo Sapiens
gacuuauacuaagacaauuuauuacuuuguuacagaaaugcaguuuggauuagcugugccuuuc

SEQ ID NO: 349345 - RNA, 64 nt, Homo Sapiens
acauguugaaauuuuaaaaauuaauguuaauauggaaaugcauuuagagaagcccaguaguuuu

SEQ ID NO: 349346 - RNA, 64 nt, Homo Sapiens
uccuaaaguuucuucaaguauuuuuuaagguggagaaaugcaggaauuguauaaccagaauugu

SEQ ID NO: 349347 - RNA, 64 nt, Homo Sapiens
aacgucaaaagcaaggcagguaauguuaauagaggaaaugcagcgcauucagaccaaccaucau

SEQ ID NO: 349348 - RNA, 64 nt, Homo Sapiens
ccagcuuccugcgucuaccaacccauggcaccuagaaaugcaugucacugcuucagcagugaag

SEQ ID NO: 349349 - RNA, 64 nt, Homo Sapiens
ccuuaacuuacugaacugaacaucagugcuuuuagaaaugcagguugcagguuuuguguuuuau

SEQ ID NO: 349350 - RNA, 64 nt, Homo Sapiens
guaaggugacuuuauugugugggaaacauucugagaaaugcauuucacaugucacuuaaugaua

SEQ ID NO: 349351 - RNA, 64 nt, Homo Sapiens
ggaaaaauggguucaagcuuuccuauuagccauggaaaugcaaaguuuagcagaagcaagcaau

SEQ ID NO: 349352 - RNA, 64 nt, Homo Sapiens
aguaguaagauuuuaaucaaacacgaccagguccgaaaugcaggucaugagugugaaauucuca

SEQ ID NO: 349353 - RNA, 64 nt, Homo Sapiens
gaugcuggugugccuggagccccauguguucuaagaaaugcagcggcccugaggcugaaaugug

SEQ ID NO: 349354 - RNA, 64 nt, Homo Sapiens
caaaggugcagucggaaaagaaaggaauuuguaggaaaugcagccagacuuguucuuuuuacau

SEQ ID NO: 349355 - RNA, 64 nt, Homo Sapiens
ggggaggccgagcauaaccacacuuacggacacagaaaugcacaacacagaaaugcacagggga

SEQ ID NO: 349356 - RNA, 64 nt, Homo Sapiens
ggggacacuuacggacacaggucuuguggacacagaaaugcacaugucuacaggguuuauagua

SEQ ID NO: 349357 - RNA, 58 nt, Homo Sapiens
gccacaccugugcuacacuucagcugcucuucugaauuugugcccucagauguguuga

SEQ ID NO: 349358 - RNA, 58 nt, Homo Sapiens
aucagagauuaaauauuguucaaagugccuucugaagcccuaaggcccuucaagaucu

SEQ ID NO: 349359 - RNA, 58 nt, Homo Sapiens
caaaauuccucauaaggcaugaaugauacuucugaaauuauaugaugcugagucugug

SEQ ID NO: 349360 - RNA, 58 nt, Homo Sapiens
uauggucacacuauauacuaauucucuucuucugaaauuauccuuuuaaauuaugcua

SEQ ID NO: 349361 - RNA, 58 nt, Homo Sapiens
uccauuauagcaauguuagugccaccaccuucugaacacaguggggagggcugugaag

SEQ ID NO: 349362 - RNA, 58 nt, Homo Sapiens
ggcuggcauauuaacaccugccuucuggcuucugaaagugagauuuguauaugggcug

SEQ ID NO: 349363 - RNA, 58 nt, Homo Sapiens
auauuuugagauagguuuaguaaaugugcuucugaaauauuagcuagaauaugaccau

SEQ ID NO: 349364 - RNA, 58 nt, Homo Sapiens
caucaaaguagaagagccccaaaauauucuucugaacuauaguuuucucaaccauuua

SEQ ID NO: 349365 - RNA, 58 nt, Homo Sapiens
cacuacccuggucccugauugcaaggagcuucugaagcaagggugaauccuucccaca

SEQ ID NO: 349366 - RNA, 58 nt, Homo Sapiens
agcagcccaaccaauccccaauccuuuucuucugaaacugagcaggaaggguaaggaa

SEQ ID NO: 349367 - RNA, 58 nt, Homo Sapiens
ucugguuccugcccagugacaccuuucccuucugaaagcccuuggcguugccuauggc

SEQ ID NO: 349368 - RNA, 58 nt, Homo Sapiens
cucuagggagaagccgguuccugugcuccuucugaaggaaaucaaggugucagcagag

SEQ ID NO: 349369 - RNA, 58 nt, Homo Sapiens
gaagcuuuuuuuuuuaaaaaauguauugcuucugaacuuuuuucugccacugcucccu

SEQ ID NO: 349370 - RNA, 58 nt, Homo Sapiens
guucaaacauaauaccaucuuuuugcuucuucugaacuuuagaucuccauaacacaug

SEQ ID NO: 349371 - RNA, 58 nt, Homo Sapiens
aaaaaauguugcuuuuuaaagcaagacccuucugaaaugaauucagaaaaccacuuaa

SEQ ID NO: 349372 - RNA, 58 nt, Homo Sapiens
aagacaugucaauauucuuuuaguuauucuucugaacuaaaagcaaaucaacacuuua

SEQ ID NO: 349373 - RNA, 58 nt, Homo Sapiens
gugacccccaaguccuauccuuauuugccuucugaaauuguagcuucuucugaaagaa

SEQ ID NO: 349374 - RNA, 58 nt, Homo Sapiens
aauuauuugccuucugaaauuguagcuucuucugaaaguacccauagaaaacuugaca

SEQ ID NO: 349375 - RNA, 58 nt, Homo Sapiens
uagaaacaaucuauaguuauaaggaccucuucugaagcaacauuuuaauacagauuga

SEQ ID NO: 349376 - RNA, 58 nt, Homo Sapiens
cuuagaauggccucuuuguaaucagugacuucugaaucuauuuggaauuuuaaguucu

SEQ ID NO: 349377 - RNA, 58 nt, Homo Sapiens
ucaccaaacugaggccagagcugggagucuucugaaccccaagaaauacuuuuuauug

SEQ ID NO: 349378 - RNA, 58 nt, Homo Sapiens
cucaaaugaguggaggccuccccugaaucuucugaaaucccucccuaagcuccagggu

SEQ ID NO: 349379 - RNA, 58 nt, Homo Sapiens
aagagcucaaaagcagaaauggccaggccuucugaaaacuuaaguccagaauugucac

SEQ ID NO: 349380 - RNA, 58 nt, Homo Sapiens
uggccuccuuggauucuucugacuuuggcuucugaaaggaaggccuagauccagcccu

SEQ ID NO: 349381 - RNA, 58 nt, Homo Sapiens
aaaggcgcuucauguccaguguguggcccuucugaaacuuauggucaucucucccacu

SEQ ID NO: 349382 - RNA, 58 nt, Homo Sapiens
uggagccugaauacauuuucaagucucucuucugaaccaauuuugucuccugcuugga

SEQ ID NO: 349383 - RNA, 58 nt, Homo Sapiens
uggaaaggggaaguuggcaguagaggaacuucugaacugucuucuuuucauuuuugau

SEQ ID NO: 349384 - RNA, 58 nt, Homo Sapiens
uuuagaugauaaggcuacaauucagaaucuucugaaccaucuauguaaugaaugggga

SEQ ID NO: 349385 - RNA, 58 nt, Homo Sapiens
uuagaacaaacccuuuuugaucuuaaugcuucugaaaacuaggucugacucuggggau

SEQ ID NO: 349386 - RNA, 58 nt, Homo Sapiens
uaucaguguuuugccguuaaaaaaauaacuucugaauuaauaaacauauuuuuuuuac

SEQ ID NO: 349387 - RNA, 58 nt, Homo Sapiens
guagauaacugcuuuuugaccugcuuuucuucugaaauauauauaaccgugauugucu

SEQ ID NO: 349388 - RNA, 58 nt, Homo Sapiens
gggcuguuacuuuuaaagucaaaauuuucuucugaaggcucauuuugguauuugaucu

SEQ ID NO: 349389 - RNA, 58 nt, Homo Sapiens
caaagccauucuuaagagucgugagguccuucugaauguaaaacuggagcccaggaga

SEQ ID NO: 349390 - RNA, 58 nt, Homo Sapiens
uuacaucaguuuuauuuuaauuaauauacuucugaaguucucucccaaaucacuaagu

SEQ ID NO: 349391 - RNA, 58 nt, Homo Sapiens
agccacaaauuuaugaaacagggauagccuucugaaaagaguagaaaacuaugaaugu

SEQ ID NO: 349392 - RNA, 58 nt, Homo Sapiens
ucagugaggaaaucucuuccaauuucugcuucugaaugauucaauguugggagcaaua

SEQ ID NO: 349393 - RNA, 58 nt, Homo Sapiens
aguugagggaaggagcuguauuguggcacuucugaauuccccguuuuguuccauauug

SEQ ID NO: 349394 - RNA, 58 nt, Homo Sapiens
aauggggcccuguagcugcagaacgcuccuucugaagaaggggacgauggaauaccca

SEQ ID NO: 349395 - RNA, 58 nt, Homo Sapiens
gaugacuuaaugucgaauauaggcuucucuucugaaauaaaccuuuccuacuucaaac

SEQ ID NO: 349396 - RNA, 64 nt, Homo Sapiens; identical to SEQ ID NO: 47016

SEQ ID NO: 349397 - RNA, 64 nt, Homo Sapiens; identical to SEQ ID NO: 47017

SEQ ID NO: 349398 - RNA, 64 nt, Homo Sapiens; identical to SEQ ID NO: 47018

SEQ ID NO: 349399 - RNA, 64 nt, Homo Sapiens; identical to SEQ ID NO: 47019

SEQ ID NO: 349400 - RNA, 64 nt, Homo Sapiens; identical to SEQ ID NO: 47020

SEQ ID NO: 349401 - RNA, 64 nt, Homo Sapiens; identical to SEQ ID NO: 47021

SEQ ID NO: 349402 - RNA, 64 nt, Homo Sapiens; identical to SEQ ID NO: 47022

SEQ ID NO: 349403 - RNA, 64 nt, Homo Sapiens; identical to SEQ ID NO: 47023

SEQ ID NO: 349404 - RNA, 64 nt, Homo Sapiens; identical to SEQ ID NO: 47024

SEQ ID NO: 349405 - RNA, 64 nt, Homo Sapiens; identical to SEQ ID NO: 47025

SEQ ID NO: 349406 - RNA, 64 nt, Homo Sapiens; identical to SEQ ID NO: 47026

SEQ ID NO: 349407 - RNA, 64 nt, Homo Sapiens; identical to SEQ ID NO: 47027

SEQ ID NO: 349408 - RNA, 64 nt, Homo Sapiens; identical to SEQ ID NO: 47028

SEQ ID NO: 349409 - RNA, 64 nt, Homo Sapiens; identical to SEQ ID NO: 47029

SEQ ID NO: 349410 - RNA, 64 nt, Homo Sapiens; identical to SEQ ID NO: 47030

SEQ ID NO: 349411 - RNA, 64 nt, Homo Sapiens; identical to SEQ ID NO: 47031

SEQ ID NO: 349412 - RNA, 64 nt, Homo Sapiens; identical to SEQ ID NO: 47032

SEQ ID NO: 349413 - RNA, 64 nt, Homo Sapiens; identical to SEQ ID NO: 47033

SEQ ID NO: 349414 - RNA, 64 nt, Homo Sapiens; identical to SEQ ID NO: 47034

SEQ ID NO: 349415 - RNA, 64 nt, Homo Sapiens; identical to SEQ ID NO: 47035

SEQ ID NO: 349416 - RNA, 64 nt, Homo Sapiens; identical to SEQ ID NO: 47036

SEQ ID NO: 349417 - RNA, 64 nt, Homo Sapiens; identical to SEQ ID NO: 47037

SEQ ID NO: 349418 - RNA, 64 nt, Homo Sapiens; identical to SEQ ID NO: 47038

SEQ ID NO: 349419 - RNA, 64 nt, Homo Sapiens; identical to SEQ ID NO: 47039

SEQ ID NO: 349420 - RNA, 64 nt, Homo Sapiens; identical to SEQ ID NO: 47040

SEQ ID NO: 349421 - RNA, 64 nt, Homo Sapiens; identical to SEQ ID NO: 47041

SEQ ID NO: 349422 - RNA, 64 nt, Homo Sapiens; identical to SEQ ID NO: 47042

SEQ ID NO: 349423 - RNA, 64 nt, Homo Sapiens; identical to SEQ ID NO: 47043

SEQ ID NO: 349424 - RNA, 64 nt, Homo Sapiens; identical to SEQ ID NO: 47044

SEQ ID NO: 349425 - RNA, 64 nt, Homo Sapiens; identical to SEQ ID NO: 47045

SEQ ID NO: 349426 - RNA, 64 nt, Homo Sapiens; identical to SEQ ID NO: 47046

SEQ ID NO: 349427 - RNA, 64 nt, Homo Sapiens; identical to SEQ ID NO: 47047

SEQ ID NO: 349428 - RNA, 64 nt, Homo Sapiens; identical to SEQ ID NO: 47048

SEQ ID NO: 349429 - RNA, 64 nt, Homo Sapiens; identical to SEQ ID NO: 47049

SEQ ID NO: 349430 - RNA, 64 nt, Homo Sapiens; identical to SEQ ID NO: 47050

SEQ ID NO: 349431 - RNA, 64 nt, Homo Sapiens; identical to SEQ ID NO: 47051

SEQ ID NO: 349432 - RNA, 64 nt, Homo Sapiens; identical to SEQ ID NO: 47052

SEQ ID NO: 349433 - RNA, 64 nt, Homo Sapiens; identical to SEQ ID NO: 47053

SEQ ID NO: 349434 - RNA, 64 nt, Homo Sapiens; identical to SEQ ID NO: 47054

SEQ ID NO: 349435 - RNA, 51 nt, Homo Sapiens; identical to SEQ ID NO: 47055

SEQ ID NO: 349436 - RNA, 64 nt, Homo Sapiens; identical to SEQ ID NO: 47056

SEQ ID NO: 349437 - RNA, 64 nt, Homo Sapiens; identical to SEQ ID NO: 47057

SEQ ID NO: 349438 - RNA, 64 nt, Homo Sapiens; identical to SEQ ID NO: 47058

SEQ ID NO: 349439 - RNA, 64 nt, Homo Sapiens; identical to SEQ ID NO: 47059

SEQ ID NO: 349440 - RNA, 64 nt, Homo Sapiens; identical to SEQ ID NO: 47060

SEQ ID NO: 349441 - RNA, 64 nt, Homo Sapiens; identical to SEQ ID NO: 47061

SEQ ID NO: 349442 - RNA, 64 nt, Homo Sapiens; identical to SEQ ID NO: 47062

SEQ ID NO: 349443 - RNA, 64 nt, Homo Sapiens; identical to SEQ ID NO: 47063

SEQ ID NO: 349444 - RNA, 64 nt, Homo Sapiens; identical to SEQ ID NO: 47064

SEQ ID NO: 349445 - RNA, 64 nt, Homo Sapiens; identical to SEQ ID NO: 47065

SEQ ID NO: 349446 - RNA, 64 nt, Homo Sapiens; identical to SEQ ID NO: 47066

SEQ ID NO: 349447 - RNA, 64 nt, Homo Sapiens; identical to SEQ ID NO: 47067

SEQ ID NO: 349448 - RNA, 64 nt, Homo Sapiens; identical to SEQ ID NO: 47068

SEQ ID NO: 349449 - RNA, 64 nt, Homo Sapiens; identical to SEQ ID NO: 47069

SEQ ID NO: 349450 - RNA, 64 nt, Homo Sapiens; identical to SEQ ID NO: 47070

SEQ ID NO: 349451 - RNA, 64 nt, Homo Sapiens; identical to SEQ ID NO: 47071

SEQ ID NO: 349452 - RNA, 64 nt, Homo Sapiens; identical to SEQ ID NO: 47072

SEQ ID NO: 349453 - RNA, 64 nt, Homo Sapiens; identical to SEQ ID NO: 47073

SEQ ID NO: 349454 - RNA, 64 nt, Homo Sapiens; identical to SEQ ID NO: 47074

SEQ ID NO: 349455 - RNA, 64 nt, Homo Sapiens; identical to SEQ ID NO: 47075

SEQ ID NO: 349456 - RNA, 64 nt, Homo Sapiens; identical to SEQ ID NO: 47076

SEQ ID NO: 349457 - RNA, 64 nt, Homo Sapiens; identical to SEQ ID NO: 47077

SEQ ID NO: 349458 - RNA, 64 nt, Homo Sapiens; identical to SEQ ID NO: 47078

SEQ ID NO: 349459 - RNA, 64 nt, Homo Sapiens; identical to SEQ ID NO: 47079

SEQ ID NO: 349460 - RNA, 64 nt, Homo Sapiens; identical to SEQ ID NO: 47080

SEQ ID NO: 349461 - RNA, 64 nt, Homo Sapiens; identical to SEQ ID NO: 47081

SEQ ID NO: 349462 - RNA, 64 nt, Homo Sapiens; identical to SEQ ID NO: 47082

SEQ ID NO: 349463 - RNA, 64 nt, Homo Sapiens; identical to SEQ ID NO: 47083

SEQ ID NO: 349464 - RNA, 64 nt, Homo Sapiens; identical to SEQ ID NO: 334556

SEQ ID NO: 349465 - RNA, 64 nt, Homo Sapiens; identical to SEQ ID NO: 334557

SEQ ID NO: 349466 - RNA, 64 nt, Homo Sapiens
uccauccuacuucccucaauugaaucagguaacacuaacggaucaaggcagggccagagggugg

SEQ ID NO: 349467 - RNA, 64 nt, Homo Sapiens
uugcuucuuccuuugaauucucuaaaauaggcagcuaacggauuauauacuucaggguuuggcu

SEQ ID NO: 349468 - RNA, 64 nt, Homo Sapiens
acgguggaaacccgaggauguguggguuucccagcuaacggacaagcuccccugccacacccag

SEQ ID NO: 349469 - RNA, 64 nt, Homo Sapiens
cugcuuuuugacauuaaaagcaccaauggauaaacuaacggaaauccucaucuguugugauaua

SEQ ID NO: 349470 - RNA, 64 nt, Homo Sapiens
gaaaaacuaagagaaugaaaacccaugaagguaacuaacggaagaaaaacaauaauuuggaaaa

SEQ ID NO: 349471 - RNA, 64 nt, Homo Sapiens
uuuuuuuuuuuuuuuuuuucauccugugguuuuucuaacggacuuucaggaauuuuguaaucuc

SEQ ID NO: 349472 - RNA, 64 nt, Homo Sapiens
ggccaggcuccgcguggacggacuucaggguccccuaacggaaaguguuggcggggcggucgca

SEQ ID NO: 349473 - RNA, 64 nt, Homo Sapiens
gauuuguuauguuuaggaucuacacgaagaaaugcuaacggaagacaggaaguaggaacaugca

SEQ ID NO: 349474 - RNA, 64 nt, Homo Sapiens
acauccaaagaccaucagucuacugaggagaaagcuaacggaacaaaaagucucccucagaaag

SEQ ID NO: 349475 - RNA, 64 nt, Homo Sapiens
gcaggucaggaaagccaggacccuccaccugucccuaacggacgcucugauggcaagacuuggc

SEQ ID NO: 349476 - RNA, 64 nt, Homo Sapiens
ugucacuuccuagaaggggaagggaacucugggucuaacggaguccacuccugggcccacugug

SEQ ID NO: 349477 - RNA, 64 nt, Homo Sapiens
gcacgauuaaaauccaguuguauauaauggacagcuaacggaacaauauaaucaccacaaugca

SEQ ID NO: 349478 - RNA, 64 nt, Homo Sapiens
uuuguucagcgacugaauaucacgaacagugccccuaacggagaugaccuguguguucccagca

SEQ ID NO: 349479 - RNA, 64 nt, Homo Sapiens
augugcuggaaaaauugcaacaacacuuuacuaccuaacggauagcauuuguaaauacucuagg

SEQ ID NO: 349480 - RNA, 64 nt, Homo Sapiens
aauaaauuauuugugauuuuaaacuguaucaacucuaacggaagguguacuuuguugcuauuua

SEQ ID NO: 349481 - RNA, 64 nt, Homo Sapiens
cuuugacaggacuggauuuuguaccuaaguuaggcuaacggagaucacuuguaagucaccgcca

SEQ ID NO: 349482 - RNA, 55 nt, Homo Sapiens
gugagcuugugccccugccugcuggcuaacggauaauuucuccaaacacaauuag

SEQ ID NO: 349483 - RNA, 64 nt, Homo Sapiens
uuguguggaguccuggcuggcugaagccagggggcuaacggaugaugccucauccagagcuccu

SEQ ID NO: 349484 - RNA, 64 nt, Homo Sapiens
uuuuuuuuuuuuuuaaagaaaaguucuuaaaacacuaacggaaacccauggaguuuguccuuug

SEQ ID NO: 349485 - RNA, 64 nt, Homo Sapiens
ggcacuugcucuucugcauguacccacuugugaugggguacagaugcgguaggagugccgccuc

SEQ ID NO: 349486 - RNA, 64 nt, Homo Sapiens
guucaguuuuccucucuguucagaaagcuggagugggguacagagaaugagccggcuggucccc

SEQ ID NO: 349487 - RNA, 64 nt, Homo Sapiens
gaugggucacacugggucugcagcaggcgacacggggguacaccgaacuucagaaucucacuua

SEQ ID NO: 349488 - RNA, 64 nt, Homo Sapiens
ugacccagcuggccucggccucaaccccaggcuagggguacacccugggggugccgcuccucac

SEQ ID NO: 349489 - RNA, 64 nt, Homo Sapiens
ggauacugggggugccgcuccuccugggcaacuugggguacacagagcccaaggcccccucggc

SEQ ID NO: 349490 - RNA, 64 nt, Homo Sapiens
cccucucuuccaaccgagaagaaccaccacccgagggguacagcuguggugcgcccuggauuga

SEQ ID NO: 349491 - RNA, 64 nt, Homo Sapiens
cuccagaugaucgaggugccuucgagaaugacaugggguacaaaacugcuccuacuuccugugg

SEQ ID NO: 349492 - RNA, 64 nt, Homo Sapiens; identical to SEQ ID NO: 209887

SEQ ID NO: 349493 - RNA, 64 nt, Homo Sapiens; identical to SEQ ID NO: 209888

SEQ ID NO: 349494 - RNA, 64 nt, Homo Sapiens; identical to SEQ ID NO: 209889

SEQ ID NO: 349495 - RNA, 64 nt, Homo Sapiens; identical to SEQ ID NO: 209890

SEQ ID NO: 349496 - RNA, 64 nt, Homo Sapiens; identical to SEQ ID NO: 209891

SEQ ID NO: 349497 - RNA, 64 nt, Homo Sapiens; identical to SEQ ID NO: 209892

SEQ ID NO: 349498 - RNA, 64 nt, Homo Sapiens; identical to SEQ ID NO: 209893

SEQ ID NO: 349499 - RNA, 64 nt, Homo Sapiens; identical to SEQ ID NO: 209894

SEQ ID NO: 349500 - RNA, 64 nt, Homo Sapiens; identical to SEQ ID NO: 209895

SEQ ID NO: 349501 - RNA, 64 nt, Homo Sapiens; identical to SEQ ID NO: 209896

SEQ ID NO: 349502 - RNA, 64 nt, Homo Sapiens; identical to SEQ ID NO: 209897

SEQ ID NO: 349503 - RNA, 64 nt, Homo Sapiens; identical to SEQ ID NO: 209898

SEQ ID NO: 349504 - RNA, 64 nt, Homo Sapiens; identical to SEQ ID NO: 209899

SEQ ID NO: 349505 - RNA, 64 nt, Homo Sapiens; identical to SEQ ID NO: 209900

SEQ ID NO: 349506 - RNA, 64 nt, Homo Sapiens; identical to SEQ ID NO: 209901

SEQ ID NO: 349507 - RNA, 64 nt, Homo Sapiens; identical to SEQ ID NO: 209902

SEQ ID NO: 349508 - RNA, 64 nt, Homo Sapiens; identical to SEQ ID NO: 209903

SEQ ID NO: 349509 - RNA, 64 nt, Homo Sapiens; identical to SEQ ID NO: 209904

SEQ ID NO: 349510 - RNA, 64 nt, Homo Sapiens; identical to SEQ ID NO: 209905

SEQ ID NO: 349511 - RNA, 64 nt, Homo Sapiens; identical to SEQ ID NO: 209906

SEQ ID NO: 349512 - RNA, 64 nt, Homo Sapiens; identical to SEQ ID NO: 209907

SEQ ID NO: 349513 - RNA, 64 nt, Homo Sapiens; identical to SEQ ID NO: 209908

SEQ ID NO: 349514 - RNA, 64 nt, Homo Sapiens; identical to SEQ ID NO: 209909

SEQ ID NO: 349515 - RNA, 64 nt, Homo Sapiens; identical to SEQ ID NO: 209910

SEQ ID NO: 349516 - RNA, 64 nt, Homo Sapiens; identical to SEQ ID NO: 209911

SEQ ID NO: 349517 - RNA, 64 nt, Homo Sapiens; identical to SEQ ID NO: 209912

SEQ ID NO: 349518 - RNA, 64 nt, Homo Sapiens; identical to SEQ ID NO: 209913

SEQ ID NO: 349519 - RNA, 64 nt, Homo Sapiens; identical to SEQ ID NO: 209914

SEQ ID NO: 349520 - RNA, 64 nt, Homo Sapiens; identical to SEQ ID NO: 209915

SEQ ID NO: 349521 - RNA, 64 nt, Homo Sapiens; identical to SEQ ID NO: 209916

SEQ ID NO: 349522 - RNA, 64 nt, Homo Sapiens; identical to SEQ ID NO: 225055

SEQ ID NO: 349523 - RNA, 64 nt, Homo Sapiens; identical to SEQ ID NO: 225056

SEQ ID NO: 349524 - RNA, 64 nt, Homo Sapiens; identical to SEQ ID NO: 225057

SEQ ID NO: 349525 - RNA, 64 nt, Homo Sapiens; identical to SEQ ID NO: 225058

SEQ ID NO: 349526 - RNA, 64 nt, Homo Sapiens; identical to SEQ ID NO: 225059

SEQ ID NO: 349527 - RNA, 64 nt, Homo Sapiens; identical to SEQ ID NO: 225060

SEQ ID NO: 349528 - RNA, 64 nt, Homo Sapiens; identical to SEQ ID NO: 225061

SEQ ID NO: 349529 - RNA, 64 nt, Homo Sapiens; identical to SEQ ID NO: 225062

SEQ ID NO: 349530 - RNA, 64 nt, Homo Sapiens; identical to SEQ ID NO: 225063

SEQ ID NO: 349531 - RNA, 64 nt, Homo Sapiens; identical to SEQ ID NO: 225064

SEQ ID NO: 349532 - RNA, 64 nt, Homo Sapiens; identical to SEQ ID NO: 225065

SEQ ID NO: 349533 - RNA, 64 nt, Homo Sapiens; identical to SEQ ID NO: 225066

SEQ ID NO: 349534 - RNA, 64 nt, Homo Sapiens; identical to SEQ ID NO: 225067

SEQ ID NO: 349535 - RNA, 64 nt, Homo Sapiens; identical to SEQ ID NO: 225068

SEQ ID NO: 349536 - RNA, 64 nt, Homo Sapiens; identical to SEQ ID NO: 225069

SEQ ID NO: 349537 - RNA, 64 nt, Homo Sapiens; identical to SEQ ID NO: 225070

SEQ ID NO: 349538 - RNA, 64 nt, Homo Sapiens; identical to SEQ ID NO: 225071

SEQ ID NO: 349539 - RNA, 64 nt, Homo Sapiens; identical to SEQ ID NO: 225072

SEQ ID NO: 349540 - RNA, 64 nt, Homo Sapiens; identical to SEQ ID NO: 225073

SEQ ID NO: 349541 - RNA, 64 nt, Homo Sapiens; identical to SEQ ID NO: 225074

SEQ ID NO: 349542 - RNA, 64 nt, Homo Sapiens; identical to SEQ ID NO: 225075

SEQ ID NO: 349543 - RNA, 64 nt, Homo Sapiens; identical to SEQ ID NO: 225076

SEQ ID NO: 349544 - RNA, 64 nt, Homo Sapiens; identical to SEQ ID NO: 225077

SEQ ID NO: 349545 - RNA, 64 nt, Homo Sapiens; identical to SEQ ID NO: 225078

SEQ ID NO: 349546 - RNA, 64 nt, Homo Sapiens; identical to SEQ ID NO: 209887

SEQ ID NO: 349547 - RNA, 64 nt, Homo Sapiens; identical to SEQ ID NO: 209888

SEQ ID NO: 349548 - RNA, 64 nt, Homo Sapiens; identical to SEQ ID NO: 209889

SEQ ID NO: 349549 - RNA, 64 nt, Homo Sapiens; identical to SEQ ID NO: 209890

SEQ ID NO: 349550 - RNA, 64 nt, Homo Sapiens; identical to SEQ ID NO: 209891

SEQ ID NO: 349551 - RNA, 64 nt, Homo Sapiens; identical to SEQ ID NO: 209892

SEQ ID NO: 349552 - RNA, 64 nt, Homo Sapiens; identical to SEQ ID NO: 209893

SEQ ID NO: 349553 - RNA, 64 nt, Homo Sapiens; identical to SEQ ID NO: 209894

SEQ ID NO: 349554 - RNA, 64 nt, Homo Sapiens; identical to SEQ ID NO: 209895

SEQ ID NO: 349555 - RNA, 64 nt, Homo Sapiens; identical to SEQ ID NO: 209896

SEQ ID NO: 349556 - RNA, 64 nt, Homo Sapiens; identical to SEQ ID NO: 209897

SEQ ID NO: 349557 - RNA, 64 nt, Homo Sapiens; identical to SEQ ID NO: 209898

SEQ ID NO: 349558 - RNA, 64 nt, Homo Sapiens; identical to SEQ ID NO: 209899

SEQ ID NO: 349559 - RNA, 64 nt, Homo Sapiens; identical to SEQ ID NO: 209900

SEQ ID NO: 349560 - RNA, 64 nt, Homo Sapiens; identical to SEQ ID NO: 209901

SEQ ID NO: 349561 - RNA, 64 nt, Homo Sapiens; identical to SEQ ID NO: 209902

SEQ ID NO: 349562 - RNA, 64 nt, Homo Sapiens; identical to SEQ ID NO: 209903

SEQ ID NO: 349563 - RNA, 64 nt, Homo Sapiens; identical to SEQ ID NO: 209904

SEQ ID NO: 349564 - RNA, 64 nt, Homo Sapiens; identical to SEQ ID NO: 209905

SEQ ID NO: 349565 - RNA, 64 nt, Homo Sapiens; identical to SEQ ID NO: 209906

SEQ ID NO: 349566 - RNA, 64 nt, Homo Sapiens; identical to SEQ ID NO: 209907

SEQ ID NO: 349567 - RNA, 64 nt, Homo Sapiens; identical to SEQ ID NO: 209908

SEQ ID NO: 349568 - RNA, 64 nt, Homo Sapiens; identical to SEQ ID NO: 209909

SEQ ID NO: 349569 - RNA, 64 nt, Homo Sapiens; identical to SEQ ID NO: 209910

SEQ ID NO: 349570 - RNA, 64 nt, Homo Sapiens; identical to SEQ ID NO: 209911

SEQ ID NO: 349571 - RNA, 64 nt, Homo Sapiens; identical to SEQ ID NO: 209912

SEQ ID NO: 349572 - RNA, 64 nt, Homo Sapiens; identical to SEQ ID NO: 209913

SEQ ID NO: 349573 - RNA, 64 nt, Homo Sapiens; identical to SEQ ID NO: 209914

SEQ ID NO: 349574 - RNA, 64 nt, Homo Sapiens; identical to SEQ ID NO: 209915

SEQ ID NO: 349575 - RNA, 64 nt, Homo Sapiens; identical to SEQ ID NO: 209916

SEQ ID NO: 349576 - RNA, 64 nt, Homo Sapiens; identical to SEQ ID NO: 225055

SEQ ID NO: 349577 - RNA, 64 nt, Homo Sapiens; identical to SEQ ID NO: 225056

SEQ ID NO: 349578 - RNA, 64 nt, Homo Sapiens; identical to SEQ ID NO: 225057

SEQ ID NO: 349579 - RNA, 64 nt, Homo Sapiens; identical to SEQ ID NO: 225058

SEQ ID NO: 349580 - RNA, 64 nt, Homo Sapiens; identical to SEQ ID NO: 225059

SEQ ID NO: 349581 - RNA, 64 nt, Homo Sapiens; identical to SEQ ID NO: 225060

SEQ ID NO: 349582 - RNA, 64 nt, Homo Sapiens; identical to SEQ ID NO: 225061

SEQ ID NO: 349583 - RNA, 64 nt, Homo Sapiens; identical to SEQ ID NO: 225062

SEQ ID NO: 349584 - RNA, 64 nt, Homo Sapiens; identical to SEQ ID NO: 225063

SEQ ID NO: 349585 - RNA, 64 nt, Homo Sapiens; identical to SEQ ID NO: 225064

SEQ ID NO: 349586 - RNA, 64 nt, Homo Sapiens; identical to SEQ ID NO: 225065

SEQ ID NO: 349587 - RNA, 64 nt, Homo Sapiens; identical to SEQ ID NO: 225066

SEQ ID NO: 349588 - RNA, 64 nt, Homo Sapiens; identical to SEQ ID NO: 225067

SEQ ID NO: 349589 - RNA, 64 nt, Homo Sapiens; identical to SEQ ID NO: 225068

SEQ ID NO: 349590 - RNA, 64 nt, Homo Sapiens; identical to SEQ ID NO: 225069

SEQ ID NO: 349591 - RNA, 64 nt, Homo Sapiens; identical to SEQ ID NO: 225070

SEQ ID NO: 349592 - RNA, 64 nt, Homo Sapiens; identical to SEQ ID NO: 225071

SEQ ID NO: 349593 - RNA, 64 nt, Homo Sapiens; identical to SEQ ID NO: 225072

SEQ ID NO: 349594 - RNA, 64 nt, Homo Sapiens; identical to SEQ ID NO: 225073

SEQ ID NO: 349595 - RNA, 64 nt, Homo Sapiens; identical to SEQ ID NO: 225074

SEQ ID NO: 349596 - RNA, 64 nt, Homo Sapiens; identical to SEQ ID NO: 225075

SEQ ID NO: 349597 - RNA, 64 nt, Homo Sapiens; identical to SEQ ID NO: 225076

SEQ ID NO: 349598 - RNA, 64 nt, Homo Sapiens; identical to SEQ ID NO: 225077

SEQ ID NO: 349599 - RNA, 64 nt, Homo Sapiens; identical to SEQ ID NO: 225078

SEQ ID NO: 349600 - RNA, 64 nt, Homo Sapiens; identical to SEQ ID NO: 209887

SEQ ID NO: 349601 - RNA, 64 nt, Homo Sapiens; identical to SEQ ID NO: 209888

SEQ ID NO: 349602 - RNA, 64 nt, Homo Sapiens; identical to SEQ ID NO: 209889

SEQ ID NO: 349603 - RNA, 64 nt, Homo Sapiens; identical to SEQ ID NO: 209890

SEQ ID NO: 349604 - RNA, 64 nt, Homo Sapiens; identical to SEQ ID NO: 209891

SEQ ID NO: 349605 - RNA, 64 nt, Homo Sapiens; identical to SEQ ID NO: 209892

SEQ ID NO: 349606 - RNA, 64 nt, Homo Sapiens; identical to SEQ ID NO: 209893

SEQ ID NO: 349607 - RNA, 64 nt, Homo Sapiens; identical to SEQ ID NO: 209894

SEQ ID NO: 349608 - RNA, 64 nt, Homo Sapiens; identical to SEQ ID NO: 209895

SEQ ID NO: 349609 - RNA, 64 nt, Homo Sapiens; identical to SEQ ID NO: 209896

SEQ ID NO: 349610 - RNA, 64 nt, Homo Sapiens; identical to SEQ ID NO: 209897

SEQ ID NO: 349611 - RNA, 64 nt, Homo Sapiens; identical to SEQ ID NO: 209898

SEQ ID NO: 349612 - RNA, 64 nt, Homo Sapiens; identical to SEQ ID NO: 209899

SEQ ID NO: 349613 - RNA, 64 nt, Homo Sapiens; identical to SEQ ID NO: 209900

SEQ ID NO: 349614 - RNA, 64 nt, Homo Sapiens; identical to SEQ ID NO: 209901

SEQ ID NO: 349615 - RNA, 64 nt, Homo Sapiens; identical to SEQ ID NO: 209902

SEQ ID NO: 349616 - RNA, 64 nt, Homo Sapiens; identical to SEQ ID NO: 209903

SEQ ID NO: 349617 - RNA, 64 nt, Homo Sapiens; identical to SEQ ID NO: 209904

SEQ ID NO: 349618 - RNA, 64 nt, Homo Sapiens; identical to SEQ ID NO: 209905

SEQ ID NO: 349619 - RNA, 64 nt, Homo Sapiens; identical to SEQ ID NO: 209906

SEQ ID NO: 349620 - RNA, 64 nt, Homo Sapiens; identical to SEQ ID NO: 209907

SEQ ID NO: 349621 - RNA, 64 nt, Homo Sapiens; identical to SEQ ID NO: 209908

SEQ ID NO: 349622 - RNA, 64 nt, Homo Sapiens; identical to SEQ ID NO: 209909

SEQ ID NO: 349623 - RNA, 64 nt, Homo Sapiens; identical to SEQ ID NO: 209910

SEQ ID NO: 349624 - RNA, 64 nt, Homo Sapiens; identical to SEQ ID NO: 209911

SEQ ID NO: 349625 - RNA, 64 nt, Homo Sapiens; identical to SEQ ID NO: 209912

SEQ ID NO: 349626 - RNA, 64 nt, Homo Sapiens; identical to SEQ ID NO: 209913

SEQ ID NO: 349627 - RNA, 64 nt, Homo Sapiens; identical to SEQ ID NO: 209914

SEQ ID NO: 349628 - RNA, 64 nt, Homo Sapiens; identical to SEQ ID NO: 209915

SEQ ID NO: 349629 - RNA, 64 nt, Homo Sapiens; identical to SEQ ID NO: 209916

SEQ ID NO: 349630 - RNA, 64 nt, Homo Sapiens; identical to SEQ ID NO: 225055

SEQ ID NO: 349631 - RNA, 64 nt, Homo Sapiens; identical to SEQ ID NO: 225056

SEQ ID NO: 349632 - RNA, 64 nt, Homo Sapiens; identical to SEQ ID NO: 225057

SEQ ID NO: 349633 - RNA, 64 nt, Homo Sapiens; identical to SEQ ID NO: 225058

SEQ ID NO: 349634 - RNA, 64 nt, Homo Sapiens; identical to SEQ ID NO: 225059

SEQ ID NO: 349635 - RNA, 64 nt, Homo Sapiens; identical to SEQ ID NO: 225060

SEQ ID NO: 349636 - RNA, 64 nt, Homo Sapiens; identical to SEQ ID NO: 225061

SEQ ID NO: 349637 - RNA, 64 nt, Homo Sapiens; identical to SEQ ID NO: 225062

SEQ ID NO: 349638 - RNA, 64 nt, Homo Sapiens; identical to SEQ ID NO: 225063

SEQ ID NO: 349639 - RNA, 64 nt, Homo Sapiens; identical to SEQ ID NO: 225064

SEQ ID NO: 349640 - RNA, 64 nt, Homo Sapiens; identical to SEQ ID NO: 225065

SEQ ID NO: 349641 - RNA, 64 nt, Homo Sapiens; identical to SEQ ID NO: 225066

SEQ ID NO: 349642 - RNA, 64 nt, Homo Sapiens; identical to SEQ ID NO: 225067

SEQ ID NO: 349643 - RNA, 64 nt, Homo Sapiens; identical to SEQ ID NO: 225068

SEQ ID NO: 349644 - RNA, 64 nt, Homo Sapiens; identical to SEQ ID NO: 225069

SEQ ID NO: 349645 - RNA, 64 nt, Homo Sapiens; identical to SEQ ID NO: 225070

SEQ ID NO: 349646 - RNA, 64 nt, Homo Sapiens; identical to SEQ ID NO: 225071

SEQ ID NO: 349647 - RNA, 64 nt, Homo Sapiens; identical to SEQ ID NO: 225072

SEQ ID NO: 349648 - RNA, 64 nt, Homo Sapiens; identical to SEQ ID NO: 225073

SEQ ID NO: 349649 - RNA, 64 nt, Homo Sapiens; identical to SEQ ID NO: 225074

SEQ ID NO: 349650 - RNA, 64 nt, Homo Sapiens; identical to SEQ ID NO: 225075

SEQ ID NO: 349651 - RNA, 64 nt, Homo Sapiens; identical to SEQ ID NO: 225076

SEQ ID NO: 349652 - RNA, 64 nt, Homo Sapiens; identical to SEQ ID NO: 225077

SEQ ID NO: 349653 - RNA, 64 nt, Homo Sapiens; identical to SEQ ID NO: 225078

SEQ ID NO: 349654 - RNA, 64 nt, Homo Sapiens; identical to SEQ ID NO: 209887

SEQ ID NO: 349655 - RNA, 64 nt, Homo Sapiens; identical to SEQ ID NO: 209888

SEQ ID NO: 349656 - RNA, 64 nt, Homo Sapiens; identical to SEQ ID NO: 209889

SEQ ID NO: 349657 - RNA, 64 nt, Homo Sapiens; identical to SEQ ID NO: 209890

SEQ ID NO: 349658 - RNA, 64 nt, Homo Sapiens; identical to SEQ ID NO: 209891

SEQ ID NO: 349659 - RNA, 64 nt, Homo Sapiens; identical to SEQ ID NO: 209892

SEQ ID NO: 349660 - RNA, 64 nt, Homo Sapiens; identical to SEQ ID NO: 209893

SEQ ID NO: 349661 - RNA, 64 nt, Homo Sapiens; identical to SEQ ID NO: 209894

SEQ ID NO: 349662 - RNA, 64 nt, Homo Sapiens; identical to SEQ ID NO: 209895

SEQ ID NO: 349663 - RNA, 64 nt, Homo Sapiens; identical to SEQ ID NO: 209896

SEQ ID NO: 349664 - RNA, 64 nt, Homo Sapiens; identical to SEQ ID NO: 209897

SEQ ID NO: 349665 - RNA, 64 nt, Homo Sapiens; identical to SEQ ID NO: 209898

SEQ ID NO: 349666 - RNA, 64 nt, Homo Sapiens; identical to SEQ ID NO: 209899

SEQ ID NO: 349667 - RNA, 64 nt, Homo Sapiens; identical to SEQ ID NO: 209900

SEQ ID NO: 349668 - RNA, 64 nt, Homo Sapiens; identical to SEQ ID NO: 209901

SEQ ID NO: 349669 - RNA, 64 nt, Homo Sapiens; identical to SEQ ID NO: 209902

SEQ ID NO: 349670 - RNA, 64 nt, Homo Sapiens; identical to SEQ ID NO: 209903

SEQ ID NO: 349671 - RNA, 64 nt, Homo Sapiens; identical to SEQ ID NO: 209904

SEQ ID NO: 349672 - RNA, 64 nt, Homo Sapiens; identical to SEQ ID NO: 209905

SEQ ID NO: 349673 - RNA, 64 nt, Homo Sapiens; identical to SEQ ID NO: 209906

SEQ ID NO: 349674 - RNA, 64 nt, Homo Sapiens; identical to SEQ ID NO: 209907

SEQ ID NO: 349675 - RNA, 64 nt, Homo Sapiens; identical to SEQ ID NO: 209908

SEQ ID NO: 349676 - RNA, 64 nt, Homo Sapiens; identical to SEQ ID NO: 209909

SEQ ID NO: 349677 - RNA, 64 nt, Homo Sapiens; identical to SEQ ID NO: 209910

SEQ ID NO: 349678 - RNA, 64 nt, Homo Sapiens; identical to SEQ ID NO: 209911

SEQ ID NO: 349679 - RNA, 64 nt, Homo Sapiens; identical to SEQ ID NO: 209912

SEQ ID NO: 349680 - RNA, 64 nt, Homo Sapiens; identical to SEQ ID NO: 209913

SEQ ID NO: 349681 - RNA, 64 nt, Homo Sapiens; identical to SEQ ID NO: 209914

SEQ ID NO: 349682 - RNA, 64 nt, Homo Sapiens; identical to SEQ ID NO: 209915

SEQ ID NO: 349683 - RNA, 64 nt, Homo Sapiens; identical to SEQ ID NO: 209916

SEQ ID NO: 349684 - RNA, 64 nt, Homo Sapiens; identical to SEQ ID NO: 225055

SEQ ID NO: 349685 - RNA, 64 nt, Homo Sapiens; identical to SEQ ID NO: 225056

SEQ ID NO: 349686 - RNA, 64 nt, Homo Sapiens; identical to SEQ ID NO: 225057

SEQ ID NO: 349687 - RNA, 64 nt, Homo Sapiens; identical to SEQ ID NO: 225058

SEQ ID NO: 349688 - RNA, 64 nt, Homo Sapiens; identical to SEQ ID NO: 225059

SEQ ID NO: 349689 - RNA, 64 nt, Homo Sapiens; identical to SEQ ID NO: 225060

SEQ ID NO: 349690 - RNA, 64 nt, Homo Sapiens; identical to SEQ ID NO: 225061

SEQ ID NO: 349691 - RNA, 64 nt, Homo Sapiens; identical to SEQ ID NO: 225062

SEQ ID NO: 349692 - RNA, 64 nt, Homo Sapiens; identical to SEQ ID NO: 225063

SEQ ID NO: 349693 - RNA, 64 nt, Homo Sapiens; identical to SEQ ID NO: 225064

SEQ ID NO: 349694 - RNA, 64 nt, Homo Sapiens; identical to SEQ ID NO: 225065

SEQ ID NO: 349695 - RNA, 64 nt, Homo Sapiens; identical to SEQ ID NO: 225066

SEQ ID NO: 349696 - RNA, 64 nt, Homo Sapiens; identical to SEQ ID NO: 225067

SEQ ID NO: 349697 - RNA, 64 nt, Homo Sapiens; identical to SEQ ID NO: 225068

SEQ ID NO: 349698 - RNA, 64 nt, Homo Sapiens; identical to SEQ ID NO: 225069

SEQ ID NO: 349699 - RNA, 64 nt, Homo Sapiens; identical to SEQ ID NO: 225070

SEQ ID NO: 349700 - RNA, 64 nt, Homo Sapiens; identical to SEQ ID NO: 225071

SEQ ID NO: 349701 - RNA, 64 nt, Homo Sapiens; identical to SEQ ID NO: 225072

SEQ ID NO: 349702 - RNA, 64 nt, Homo Sapiens; identical to SEQ ID NO: 225073

SEQ ID NO: 349703 - RNA, 64 nt, Homo Sapiens; identical to SEQ ID NO: 225074

SEQ ID NO: 349704 - RNA, 64 nt, Homo Sapiens; identical to SEQ ID NO: 225075

SEQ ID NO: 349705 - RNA, 64 nt, Homo Sapiens; identical to SEQ ID NO: 225076

SEQ ID NO: 349706 - RNA, 64 nt, Homo Sapiens; identical to SEQ ID NO: 225077

SEQ ID NO: 349707 - RNA, 64 nt, Homo Sapiens; identical to SEQ ID NO: 225078

SEQ ID NO: 349708 - RNA, 64 nt, Homo Sapiens; identical to SEQ ID NO: 209887

SEQ ID NO: 349709 - RNA, 64 nt, Homo Sapiens; identical to SEQ ID NO: 209888

SEQ ID NO: 349710 - RNA, 64 nt, Homo Sapiens; identical to SEQ ID NO: 209889

SEQ ID NO: 349711 - RNA, 64 nt, Homo Sapiens; identical to SEQ ID NO: 209890

SEQ ID NO: 349712 - RNA, 64 nt, Homo Sapiens; identical to SEQ ID NO: 209891

SEQ ID NO: 349713 - RNA, 64 nt, Homo Sapiens; identical to SEQ ID NO: 209892

SEQ ID NO: 349714 - RNA, 64 nt, Homo Sapiens; identical to SEQ ID NO: 209893

SEQ ID NO: 349715 - RNA, 64 nt, Homo Sapiens; identical to SEQ ID NO: 209894

SEQ ID NO: 349716 - RNA, 64 nt, Homo Sapiens; identical to SEQ ID NO: 209895

SEQ ID NO: 349717 - RNA, 64 nt, Homo Sapiens; identical to SEQ ID NO: 209896

SEQ ID NO: 349718 - RNA, 64 nt, Homo Sapiens; identical to SEQ ID NO: 209897

SEQ ID NO: 349719 - RNA, 64 nt, Homo Sapiens; identical to SEQ ID NO: 209898

SEQ ID NO: 349720 - RNA, 64 nt, Homo Sapiens; identical to SEQ ID NO: 209899

SEQ ID NO: 349721 - RNA, 64 nt, Homo Sapiens; identical to SEQ ID NO: 209900

SEQ ID NO: 349722 - RNA, 64 nt, Homo Sapiens; identical to SEQ ID NO: 209901

SEQ ID NO: 349723 - RNA, 64 nt, Homo Sapiens; identical to SEQ ID NO: 209902

SEQ ID NO: 349724 - RNA, 64 nt, Homo Sapiens; identical to SEQ ID NO: 209903

SEQ ID NO: 349725 - RNA, 64 nt, Homo Sapiens; identical to SEQ ID NO: 209904

SEQ ID NO: 349726 - RNA, 64 nt, Homo Sapiens; identical to SEQ ID NO: 209905

SEQ ID NO: 349727 - RNA, 64 nt, Homo Sapiens; identical to SEQ ID NO: 209906

SEQ ID NO: 349728 - RNA, 64 nt, Homo Sapiens; identical to SEQ ID NO: 209907

SEQ ID NO: 349729 - RNA, 64 nt, Homo Sapiens; identical to SEQ ID NO: 209908

SEQ ID NO: 349730 - RNA, 64 nt, Homo Sapiens; identical to SEQ ID NO: 209909

SEQ ID NO: 349731 - RNA, 64 nt, Homo Sapiens; identical to SEQ ID NO: 209910

SEQ ID NO: 349732 - RNA, 64 nt, Homo Sapiens; identical to SEQ ID NO: 209911

SEQ ID NO: 349733 - RNA, 64 nt, Homo Sapiens; identical to SEQ ID NO: 209912

SEQ ID NO: 349734 - RNA, 64 nt, Homo Sapiens; identical to SEQ ID NO: 209913

SEQ ID NO: 349735 - RNA, 64 nt, Homo Sapiens; identical to SEQ ID NO: 209914

SEQ ID NO: 349736 - RNA, 64 nt, Homo Sapiens; identical to SEQ ID NO: 209915

SEQ ID NO: 349737 - RNA, 64 nt, Homo Sapiens; identical to SEQ ID NO: 209916

SEQ ID NO: 349738 - RNA, 64 nt, Homo Sapiens; identical to SEQ ID NO: 225055

SEQ ID NO: 349739 - RNA, 64 nt, Homo Sapiens; identical to SEQ ID NO: 225056

SEQ ID NO: 349740 - RNA, 64 nt, Homo Sapiens; identical to SEQ ID NO: 225057

SEQ ID NO: 349741 - RNA, 64 nt, Homo Sapiens; identical to SEQ ID NO: 225058

SEQ ID NO: 349742 - RNA, 64 nt, Homo Sapiens; identical to SEQ ID NO: 225059

SEQ ID NO: 349743 - RNA, 64 nt, Homo Sapiens; identical to SEQ ID NO: 225060

SEQ ID NO: 349744 - RNA, 64 nt, Homo Sapiens; identical to SEQ ID NO: 225061

SEQ ID NO: 349745 - RNA, 64 nt, Homo Sapiens; identical to SEQ ID NO: 225062

SEQ ID NO: 349746 - RNA, 64 nt, Homo Sapiens; identical to SEQ ID NO: 225063

SEQ ID NO: 349747 - RNA, 64 nt, Homo Sapiens; identical to SEQ ID NO: 225064

SEQ ID NO: 349748 - RNA, 64 nt, Homo Sapiens; identical to SEQ ID NO: 225065

SEQ ID NO: 349749 - RNA, 64 nt, Homo Sapiens; identical to SEQ ID NO: 225066

SEQ ID NO: 349750 - RNA, 64 nt, Homo Sapiens; identical to SEQ ID NO: 225067

SEQ ID NO: 349751 - RNA, 64 nt, Homo Sapiens; identical to SEQ ID NO: 225068

SEQ ID NO: 349752 - RNA, 64 nt, Homo Sapiens; identical to SEQ ID NO: 225069

SEQ ID NO: 349753 - RNA, 64 nt, Homo Sapiens; identical to SEQ ID NO: 225070

SEQ ID NO: 349754 - RNA, 64 nt, Homo Sapiens; identical to SEQ ID NO: 225071

SEQ ID NO: 349755 - RNA, 64 nt, Homo Sapiens; identical to SEQ ID NO: 225072

SEQ ID NO: 349756 - RNA, 64 nt, Homo Sapiens; identical to SEQ ID NO: 225073

SEQ ID NO: 349757 - RNA, 64 nt, Homo Sapiens; identical to SEQ ID NO: 225074

SEQ ID NO: 349758 - RNA, 64 nt, Homo Sapiens; identical to SEQ ID NO: 225075

SEQ ID NO: 349759 - RNA, 64 nt, Homo Sapiens; identical to SEQ ID NO: 225076

SEQ ID NO: 349760 - RNA, 64 nt, Homo Sapiens; identical to SEQ ID NO: 225077

SEQ ID NO: 349761 - RNA, 64 nt, Homo Sapiens; identical to SEQ ID NO: 225078

SEQ ID NO: 349762 - RNA, 64 nt, Homo Sapiens; identical to SEQ ID NO: 117299

SEQ ID NO: 349763 - RNA, 64 nt, Homo Sapiens; identical to SEQ ID NO: 117300

SEQ ID NO: 349764 - RNA, 64 nt, Homo Sapiens; identical to SEQ ID NO: 117301

SEQ ID NO: 349765 - RNA, 64 nt, Homo Sapiens; identical to SEQ ID NO: 117302

SEQ ID NO: 349766 - RNA, 64 nt, Homo Sapiens; identical to SEQ ID NO: 117303

SEQ ID NO: 349767 - RNA, 64 nt, Homo Sapiens; identical to SEQ ID NO: 117304

SEQ ID NO: 349768 - RNA, 64 nt, Homo Sapiens; identical to SEQ ID NO: 117305

SEQ ID NO: 349769 - RNA, 64 nt, Homo Sapiens; identical to SEQ ID NO: 117306

SEQ ID NO: 349770 - RNA, 64 nt, Homo Sapiens; identical to SEQ ID NO: 117307

SEQ ID NO: 349771 - RNA, 64 nt, Homo Sapiens; identical to SEQ ID NO: 117308

SEQ ID NO: 349772 - RNA, 64 nt, Homo Sapiens; identical to SEQ ID NO: 117309

SEQ ID NO: 349773 - RNA, 64 nt, Homo Sapiens; identical to SEQ ID NO: 117310

SEQ ID NO: 349774 - RNA, 64 nt, Homo Sapiens; identical to SEQ ID NO: 117311

SEQ ID NO: 349775 - RNA, 64 nt, Homo Sapiens; identical to SEQ ID NO: 117312

SEQ ID NO: 349776 - RNA, 64 nt, Homo Sapiens; identical to SEQ ID NO: 117313

SEQ ID NO: 349777 - RNA, 64 nt, Homo Sapiens; identical to SEQ ID NO: 117314

SEQ ID NO: 349778 - RNA, 64 nt, Homo Sapiens; identical to SEQ ID NO: 117315

SEQ ID NO: 349779 - RNA, 64 nt, Homo Sapiens; identical to SEQ ID NO: 117316

SEQ ID NO: 349780 - RNA, 64 nt, Homo Sapiens; identical to SEQ ID NO: 117317

SEQ ID NO: 349781 - RNA, 64 nt, Homo Sapiens; identical to SEQ ID NO: 117318

SEQ ID NO: 349782 - RNA, 64 nt, Homo Sapiens; identical to SEQ ID NO: 117319

SEQ ID NO: 349783 - RNA, 64 nt, Homo Sapiens; identical to SEQ ID NO: 117320

SEQ ID NO: 349784 - RNA, 64 nt, Homo Sapiens; identical to SEQ ID NO: 117321

SEQ ID NO: 349785 - RNA, 64 nt, Homo Sapiens; identical to SEQ ID NO: 117322

SEQ ID NO: 349786 - RNA, 64 nt, Homo Sapiens; identical to SEQ ID NO: 117323

SEQ ID NO: 349787 - RNA, 64 nt, Homo Sapiens; identical to SEQ ID NO: 117324

SEQ ID NO: 349788 - RNA, 64 nt, Homo Sapiens; identical to SEQ ID NO: 117325

SEQ ID NO: 349789 - RNA, 64 nt, Homo Sapiens; identical to SEQ ID NO: 117326

SEQ ID NO: 349790 - RNA, 64 nt, Homo Sapiens; identical to SEQ ID NO: 117327

SEQ ID NO: 349791 - RNA, 64 nt, Homo Sapiens; identical to SEQ ID NO: 117328

SEQ ID NO: 349792 - RNA, 64 nt, Homo Sapiens; identical to SEQ ID NO: 174092

SEQ ID NO: 349793 - RNA, 64 nt, Homo Sapiens; identical to SEQ ID NO: 174093

SEQ ID NO: 349794 - RNA, 64 nt, Homo Sapiens; identical to SEQ ID NO: 174095

SEQ ID NO: 349795 - RNA, 64 nt, Homo Sapiens; identical to SEQ ID NO: 174096

SEQ ID NO: 349796 - RNA, 64 nt, Homo Sapiens; identical to SEQ ID NO: 174127

SEQ ID NO: 349797 - RNA, 64 nt, Homo Sapiens; identical to SEQ ID NO: 174128

SEQ ID NO: 349798 - RNA, 64 nt, Homo Sapiens; identical to SEQ ID NO: 174147

SEQ ID NO: 349799 - RNA, 64 nt, Homo Sapiens; identical to SEQ ID NO: 174148

SEQ ID NO: 349800 - RNA, 64 nt, Homo Sapiens; identical to SEQ ID NO: 174171

SEQ ID NO: 349801 - RNA, 64 nt, Homo Sapiens; identical to SEQ ID NO: 174172

SEQ ID NO: 349802 - RNA, 64 nt, Homo Sapiens; identical to SEQ ID NO: 174194

SEQ ID NO: 349803 - RNA, 64 nt, Homo Sapiens; identical to SEQ ID NO: 174195

SEQ ID NO: 349804 - RNA, 64 nt, Homo Sapiens; identical to SEQ ID NO: 174204

SEQ ID NO: 349805 - RNA, 64 nt, Homo Sapiens; identical to SEQ ID NO: 174205

SEQ ID NO: 349806 - RNA, 64 nt, Homo Sapiens; identical to SEQ ID NO: 174212

SEQ ID NO: 349807 - RNA, 64 nt, Homo Sapiens; identical to SEQ ID NO: 174213

SEQ ID NO: 349808 - RNA, 64 nt, Homo Sapiens; identical to SEQ ID NO: 174220

SEQ ID NO: 349809 - RNA, 64 nt, Homo Sapiens; identical to SEQ ID NO: 174221

SEQ ID NO: 349810 - RNA, 64 nt, Homo Sapiens; identical to SEQ ID NO: 174227

SEQ ID NO: 349811 - RNA, 64 nt, Homo Sapiens; identical to SEQ ID NO: 174228

SEQ ID NO: 349812 - RNA, 64 nt, Homo Sapiens; identical to SEQ ID NO: 174230

SEQ ID NO: 349813 - RNA, 64 nt, Homo Sapiens; identical to SEQ ID NO: 174231

SEQ ID NO: 349814 - RNA, 64 nt, Homo Sapiens; identical to SEQ ID NO: 174233

SEQ ID NO: 349815 - RNA, 51 nt, Homo Sapiens; identical to SEQ ID NO: 173793

SEQ ID NO: 349816 - RNA, 64 nt, Homo Sapiens; identical to SEQ ID NO: 174312

SEQ ID NO: 349817 - RNA, 64 nt, Homo Sapiens; identical to SEQ ID NO: 174313

SEQ ID NO: 349818 - RNA, 57 nt, Homo Sapiens; identical to SEQ ID NO: 173883

SEQ ID NO: 349819 - RNA, 64 nt, Homo Sapiens; identical to SEQ ID NO: 174325

SEQ ID NO: 349820 - RNA, 64 nt, Homo Sapiens; identical to SEQ ID NO: 174358

SEQ ID NO: 349821 - RNA, 64 nt, Homo Sapiens; identical to SEQ ID NO: 174359

SEQ ID NO: 349822 - RNA, 64 nt, Homo Sapiens; identical to SEQ ID NO: 174369

SEQ ID NO: 349823 - RNA, 64 nt, Homo Sapiens; identical to SEQ ID NO: 174370

SEQ ID NO: 349824 - RNA, 64 nt, Homo Sapiens; identical to SEQ ID NO: 174388

SEQ ID NO: 349825 - RNA, 64 nt, Homo Sapiens; identical to SEQ ID NO: 174389

SEQ ID NO: 349826 - RNA, 64 nt, Homo Sapiens; identical to SEQ ID NO: 174405

SEQ ID NO: 349827 - RNA, 64 nt, Homo Sapiens; identical to SEQ ID NO: 174406

SEQ ID NO: 349828 - RNA, 64 nt, Homo Sapiens; identical to SEQ ID NO: 174416

SEQ ID NO: 349829 - RNA, 64 nt, Homo Sapiens; identical to SEQ ID NO: 174417

SEQ ID NO: 349830 - RNA, 64 nt, Homo Sapiens; identical to SEQ ID NO: 174427

SEQ ID NO: 349831 - RNA, 64 nt, Homo Sapiens; identical to SEQ ID NO: 174428

SEQ ID NO: 349832 - RNA, 64 nt, Homo Sapiens; identical to SEQ ID NO: 174434

SEQ ID NO: 349833 - RNA, 64 nt, Homo Sapiens; identical to SEQ ID NO: 174435

SEQ ID NO: 349834 - RNA, 64 nt, Homo Sapiens; identical to SEQ ID NO: 174516

SEQ ID NO: 349835 - RNA, 64 nt, Homo Sapiens; identical to SEQ ID NO: 174517

SEQ ID NO: 349836 - RNA, 63 nt, Homo Sapiens
ccucuggggaagggguucccucccuccugaagaugaacacacaauacacggaagagcgccagc

SEQ ID NO: 349837 - RNA, 63 nt, Homo Sapiens
gagccaccuggcagggcucacacuccugggcucugaacacacacgccagcuccucucugaagc

SEQ ID NO: 349838 - RNA, 63 nt, Homo Sapiens
gucauuuccccagaaaagcuguguucccuaugcugaacacaccauacacauucucaucuggaa

SEQ ID NO: 349839 - RNA, 63 nt, Homo Sapiens
ccaaaucaaaauaaaagaaauaugaucagagcuugaacacaggcuuauuuuuaaaauaaaaau

SEQ ID NO: 349840 - RNA, 63 nt, Homo Sapiens
auucaaguuaaaugacguguaugauauauaagcugaacacauuuucuauagcccuuaauuuag

SEQ ID NO: 349841 - RNA, 63 nt, Homo Sapiens
cugaccacauacaucauagggugcuaaaguugaugaacacauuaauccguuaaguaaaaugga

SEQ ID NO: 349842 - RNA, 63 nt, Homo Sapiens
ggacucagcgccccuggacccccaaaugcugcaugaacacauuuucaggggagccugugcccc

SEQ ID NO: 349843 - RNA, 63 nt, Homo Sapiens
gaaacuucaaauucagcuauaggauaguaccaaugaacacauccagcugaucccaaaagcugu

SEQ ID NO: 349844 - RNA, 63 nt, Homo Sapiens
agagaccagcagcccaagggcuccagacacaccugaacacaucgugaugaugacguccucuca

SEQ ID NO: 349845 - RNA, 63 nt, Homo Sapiens
ucagucagguuaaaacaacggacaauaaaagaaugaacacauuccucgugugugauucacucu

SEQ ID NO: 349846 - RNA, 63 nt, Homo Sapiens
cagcuugcuauuuuuauaacauggugauugaguugaacacaaucaaaguacaguaguaacuga

SEQ ID NO: 349847 - RNA, 63 nt, Homo Sapiens
agcugcuugggaggcugaggcaggagaaucacuugaacacaggaggcagagguugcagugagc

SEQ ID NO: 349848 - RNA, 63 nt, Homo Sapiens
cacagucuuccuuccucuucaagcguuucauguugaacacagcucucuccgcucccuugugau

SEQ ID NO: 349849 - RNA, 63 nt, Homo Sapiens
uuaaaauaguuaagaauccaagucgagaacacuugaacacacagaagggagaccccgccuagc

SEQ ID NO: 349850 - RNA, 63 nt, Homo Sapiens
uuuucuuucuuaguccaguuguguugacacauaugaacacagacaaagugcuaugcggaggaa

SEQ ID NO: 349851 - RNA, 63 nt, Homo Sapiens
cuguuguuuaagcauuuuuuuaaggugaacaaaugaacacaauguaucuaccuuugaacuguu

SEQ ID NO: 349852 - RNA, 63 nt, Homo Sapiens
aggugugaacugaccucuaaccagccgcucaucugaacacagaagacggcaguguucagaauu

SEQ ID NO: 349853 - RNA, 63 nt, Homo Sapiens
gaaggucugguacauauugggucauggaggugcugaacacagggcucagaaaacagaaauacu

SEQ ID NO: 349854 - RNA, 63 nt, Homo Sapiens
ugaccccuuucccgcgcacuggaguggucugaaugaacacagcaccuucugguucuaaaacgg

SEQ ID NO: 349855 - RNA, 63 nt, Homo Sapiens
uacagucauucuuugaaggugcaguucaggauaugaacacagggcauggagcuauuccuuggu

SEQ ID NO: 349856 - RNA, 63 nt, Homo Sapiens
augccaggccaggaacugggcagcccagcagugugaacacacaucaggcccaauauucucaga

SEQ ID NO: 349857 - RNA, 63 nt, Homo Sapiens
uuguucaggaacaaacacuaguucauguucuagugaacacagcgaugugcaauugguuuaagu

SEQ ID NO: 349858 - RNA, 63 nt, Homo Sapiens
uucauugguauauuauuuaaguuuuuucauuuaugaacacauugucugauuuuauuuuucaaa

SEQ ID NO: 349859 - RNA, 63 nt, Homo Sapiens
gguggaauuucugaagggaaagcugaauacgaaugaacacaguuauguccuuauuuuucuuuc

SEQ ID NO: 349860 - RNA, 63 nt, Homo Sapiens
ggguguuuguuaucagaaaauaugaaagcaaauugaacacauccaauucaggaaagacuuaaa

SEQ ID NO: 349861 - RNA, 63 nt, Homo Sapiens
aaucuuuuuuggucaguguagcuuuguuguaucugaacacaugguuaguaaguuagaaagcua

SEQ ID NO: 349862 - RNA, 63 nt, Homo Sapiens
ucucuccuuuccuuuugucuccaugggggucuuugaacacacccuugggggaugggcucuucg

SEQ ID NO: 349863 - RNA, 63 nt, Homo Sapiens
cagccacaggcaccagcuggcuucuugucacacugaacacaucagacugggcucugaccuagg

SEQ ID NO: 349864 - RNA, 63 nt, Homo Sapiens
ucauaaagauuucucuuuuauacaaaaucaaucugaacacaauccaugaauauauuauguuua

SEQ ID NO: 349865 - RNA, 63 nt, Homo Sapiens
caagggagcuugcuugcagaaauugauuuaaagugaacacacacauucagugaguuaaacacg

SEQ ID NO: 349866 - RNA, 63 nt, Homo Sapiens
ccuucagccaccaugccuuucaacucaguggccugaacacacaauggccuuagcugucccaca

SEQ ID NO: 349867 - RNA, 63 nt, Homo Sapiens
agaacgauacaauccugaaaucuuggaauugucugaacacaguacauaaucggaggugcagaa

SEQ ID NO: 349868 - RNA, 63 nt, Homo Sapiens
guaugggcacggcuaugcuauauauugcuuuagugaacacagaaugaugguuuugguaguauc

SEQ ID NO: 349869 - RNA, 63 nt, Homo Sapiens
gguaaauaaaacauaguccaaugcuggcauccaugaacacacccauauacugauguaaaaauc

SEQ ID NO: 349870 - RNA, 63 nt, Homo Sapiens
uugaguauuuaggaaauggguuacguggcaaaaugaacacaucgugaagauaagaaaugaucu

SEQ ID NO: 349871 - RNA, 63 nt, Homo Sapiens
gccuggacucccugcuccguuuccgucgcugcuugaacacagucuuugaagacccugcggagg

SEQ ID NO: 349872 - RNA, 63 nt, Homo Sapiens
ugcugcacguggcaucugauuaccuguggucacugaacacacgaauaacuuggauagcaaauc

SEQ ID NO: 349873 - RNA, 63 nt, Homo Sapiens
uuccauuauagcaauguuagugccaccaccuucugaacacaguggggagggcugugaaggcuc

SEQ ID NO: 349874 - RNA, 63 nt, Homo Sapiens
uaaggacauauuuugauaaaguauuauuuguaaugaacacaagccucucuugaguagaagucu

SEQ ID NO: 349875 - RNA, 63 nt, Homo Sapiens
gaugaugguaaauaagaacacagaagcuguagcugaacacaggcuggcuggugggcuuccuag

SEQ ID NO: 349876 - RNA, 63 nt, Homo Sapiens
uuuaggcuuuucauaagaugaaacaugccacagugaacacacucguguacauaucaagagaag

SEQ ID NO: 349877 - RNA, 63 nt, Homo Sapiens
uauucgggagcuucuuagagggaugagguucuuugaacacagugaaaauuuaaauuaguaacu

SEQ ID NO: 349878 - RNA, 63 nt, Homo Sapiens
cagccaguuaucaguagauacaauaucuuuaaaugaacacacgaguguaugucucacaauaua

SEQ ID NO: 349879 - RNA, 63 nt, Homo Sapiens
gaaagauccauuuuaggucuuuuucaagaauagugaacacauuuuuuaacaaaauaaguugua

SEQ ID NO: 349880 - RNA, 63 nt, Homo Sapiens
cuuuauuagugaaguaugcacuaaucaauacuuugaacacaaagccuguguuacugauuuggc

SEQ ID NO: 349881 - RNA, 63 nt, Homo Sapiens
ugaacuuuaugugcuacgauuuaacugcagccuugaacacacacaaaaauauucuuaagggcu

SEQ ID NO: 349882 - RNA, 63 nt, Homo Sapiens
uucucugucuauucacacauauguacaaauacaugaacacagccugucugugcucagacauag

SEQ ID NO: 349883 - RNA, 63 nt, Homo Sapiens
uugcucugucaccuaggcuagaguggaguggcaugaacacaacgcacugcagccucuaccucc

SEQ ID NO: 349884 - RNA, 63 nt, Homo Sapiens
uauaaagagcaagcauagauggaaagugcauauugaacacaucugugcauuugagaaggcagg

SEQ ID NO: 349885 - RNA, 63 nt, Homo Sapiens
uuacuauaccuaccauuuauucagcuggauugcugaacacaguucuggauucauagaauuaag

SEQ ID NO: 349886 - RNA, 63 nt, Homo Sapiens
agcuguucugaauuuauccacaguaauauagucugaacacaaauaguuuacuuaacuuauccu

SEQ ID NO: 349887 - RNA, 63 nt, Homo Sapiens
accgccuccuuuuuccuuuaaucuuauuuuugaugaacacauauauaggagaacaucuauccu

SEQ ID NO: 349888 - RNA, 63 nt, Homo Sapiens
gggaugguguccacauucauguucugcgguucuugaacacacggaugccucugggccaccugu

SEQ ID NO: 349889 - RNA, 63 nt, Homo Sapiens
cuuguuaaugucagucugugucuggaugaaggcugaacacaggcuccugauuucccuggaggu

SEQ ID NO: 349890 - RNA, 63 nt, Homo Sapiens
cucauugaggagcauuuuuugcugaaaaaaaauugaacacaauaagggaaaaguugcaagaau

SEQ ID NO: 349891 - RNA, 63 nt, Homo Sapiens
gucucauacuaaccaagaaguuuugcucucagaugaacacaauugcugugaugcuaguguuga

SEQ ID NO: 349892 - RNA, 63 nt, Homo Sapiens
ugacuacauuuuccaaaacuuuaauaauuugcaugaacacagaaaaauuaaaaauauguaaaa

SEQ ID NO: 349893 - RNA, 63 nt, Homo Sapiens
agcuugcccuguuaaaagauugaaacugagaugugaacacaucuccuagugaaagaggcagcu

SEQ ID NO: 349894 - RNA, 63 nt, Homo Sapiens
cuuucugguucuaguaauccucuuguaaaacagugaacacacguuuguagcaccgcucagcug

SEQ ID NO: 349895 - RNA, 63 nt, Homo Sapiens
ugcuuacuuguggauacuaugaacaaaaaacagugaacacaagacuggguguauucuagugug

SEQ ID NO: 349896 - RNA, 63 nt, Homo Sapiens
uuucuauuuucucuugaaucuugaguuuaauggugaacacauuguuacuucuaaaaauuagua

SEQ ID NO: 349897 - RNA, 63 nt, Homo Sapiens
ucacccccacauaccaacucaacuuuuuuccugugaacacauaaauauauuuuuauagaaaaa

SEQ ID NO: 349898 - RNA, 63 nt, Homo Sapiens
aaagaaaaaauccagaacauaagaacuauauuaugaacacaugauuugaaccuguugugguaa

SEQ ID NO: 349899 - RNA, 63 nt, Homo Sapiens
acagugggaucuguuuuuugugagguucauuucugaacacauuaggcauaugagcagauuucc

SEQ ID NO: 349900 - RNA, 63 nt, Homo Sapiens
ugguguaaaaggaugggucugguuugcagagcuugaacacagucucacccagacuccaggcug

SEQ ID NO: 349901 - RNA, 63 nt, Homo Sapiens
agcuggugacauggaacuguuuucugguccacaugaacacaggcuccauccaggcccagcucc

SEQ ID NO: 349902 - RNA, 63 nt, Homo Sapiens
ggcuucagccuuugugcaguacucucgaugcccugaacacacaccuucccuuugcccaggcgg

SEQ ID NO: 349903 - RNA, 63 nt, Homo Sapiens
ccggccacaucauucugugucucugcauccauuugaacacauuauuaagcaccgauaauaggu

SEQ ID NO: 349904 - RNA, 63 nt, Homo Sapiens
acuuaccuccaguagaaacacugcauuuuucugugaacacauccacuucacaagccuuguuuc

SEQ ID NO: 349905 - RNA, 63 nt, Homo Sapiens
gcagacuauuaggaaugauucagugcauuuaacugaacacagagcuaguucuaggugagugag

SEQ ID NO: 349906 - RNA, 63 nt, Homo Sapiens
gguuggauuuucuauguuggcugauuaccauauugaacacauggcauuuguagcauucuuuaa

SEQ ID NO: 349907 - RNA, 63 nt, Homo Sapiens
ucuauaauaucuuccugugauuuauguagaaaaugaacacaccccuuuuccauuuaagacccu

SEQ ID NO: 349908 - RNA, 63 nt, Homo Sapiens
ggaaugucuguggggugacugaaguucagccguugaacacauaggggccggugaugguaugcu

SEQ ID NO: 349909 - RNA, 63 nt, Homo Sapiens
ugacucaggggaguacaaucuuauucugaccaaugaacacagcuuggugucagaugcuggaau

SEQ ID NO: 349910 - RNA, 63 nt, Homo Sapiens
guacaauaguacaaaaaccacaguaucuauauuugaacacacuuaaaauuuugcagaggucuu

SEQ ID NO: 349911 - RNA, 63 nt, Homo Sapiens
gugcaaaaugaauucuuuuuucauuucccuuugugaacacaaacugcaggguuugauggagcc

SEQ ID NO: 349912 - RNA, 63 nt, Homo Sapiens
cacacacacacacacacagggucccucccuugcugaacacacaugcuugcaggaggccaaacu

SEQ ID NO: 349913 - RNA, 63 nt, Homo Sapiens
caugacacacaaaacuggcucccagccugcacaugaacacauuggacuaaaugaaaaguuguu

SEQ ID NO: 349914 - RNA, 63 nt, Homo Sapiens
aaugcuauacuagacagauaaauuaccauuuguugaacacauuuuugagguggucuuaguagu

SEQ ID NO: 349915 - RNA, 63 nt, Homo Sapiens
ucauguauuacuugacacagacucauucguuuaugaacacaucguuuguauggcucuggaaua

SEQ ID NO: 349916 - RNA, 63 nt, Homo Sapiens
agccucugaaaagguagcucaucaaacauugguugaacacauccuaggcccuacuccaguuaa

SEQ ID NO: 349917 - RNA, 63 nt, Homo Sapiens
uuaauuauuucaaaauguuuaaugcauggaaugugaacacaagcagggcuuaaccugcuagaa

SEQ ID NO: 349918 - RNA, 63 nt, Homo Sapiens
cacauuuuuuaaaaugaaacucaauuaagaauuugaacacaacuguuuaccccaaaacaagug

SEQ ID NO: 349919 - RNA, 63 nt, Homo Sapiens
uaaaauugaagagccuuuucauguauuaaauaaugaacacaaauuauauaauuaaaauaauug

SEQ ID NO: 349920 - RNA, 63 nt, Homo Sapiens
uucuguuuaugauccauauugauauuuaugacaugaacacagaauaguaccuuacauuugcua

SEQ ID NO: 349921 - RNA, 63 nt, Homo Sapiens
uuauuuuuaccauaucagcacaugacaaggccaugaacacauggcucuaaaauaauuuagugu

SEQ ID NO: 349922 - RNA, 63 nt, Homo Sapiens
auagguacauaagugaaagaagucucaguucagugaacacaaaacuuauuuaaagaugcuuua

SEQ ID NO: 349923 - RNA, 63 nt, Homo Sapiens
aauuaguaauaaguuuugacuaggucuaaagaaugaacacauuguaaacaguugccacaguag

SEQ ID NO: 349924 - RNA, 63 nt, Homo Sapiens
ccaguuuacaggaaagaugcguguggagugugcugaacacacaagauucuaacauauugccau

SEQ ID NO: 349925 - RNA, 63 nt, Homo Sapiens
cacguuauaguccaugguccagugcuuuaagaaugaacacaauggcaccauuggucucugggu

SEQ ID NO: 349926 - RNA, 63 nt, Homo Sapiens
ugcugaagaggcaagagacaacaaugguuuacaugaacacagcgaacaacaacaacaauaaca

SEQ ID NO: 349927 - RNA, 63 nt, Homo Sapiens
ggcuggcugcucugggcagccuggagcauugggugaacacacagcaggccacgauggucugcu

SEQ ID NO: 349928 - RNA, 63 nt, Homo Sapiens
acauuaacaacuccacucaucacacauuguauuugaacacaaauacugagcuuccuuauguuu

SEQ ID NO: 349929 - RNA, 63 nt, Homo Sapiens
uuucaacuuaaggucugcaucauguaacuccauugaacacauuuauacuuaauuuucuaaaac

SEQ ID NO: 349930 - RNA, 63 nt, Homo Sapiens
cucaguaauucucuuuagagcuggccccagcagugaacacaaaacauagcccugcaaagagau

SEQ ID NO: 349931 - RNA, 63 nt, Homo Sapiens
cucugcucuucugcccucgaugccacauggcggugaacacaucugaagccacuauguuuccug

SEQ ID NO: 349932 - RNA, 63 nt, Homo Sapiens
ccuggcucugauuuuuuacuggcugugugacuuugaacacaucucuuagucccucuuaggagu

SEQ ID NO: 349933 - RNA, 63 nt, Homo Sapiens
agccuuugcuuuccucuggccccggccccacccugaacacagcucauacacagaaucaggacc

SEQ ID NO: 349934 - RNA, 63 nt, Homo Sapiens
aaaugcuuuuuacucugguguauuauagaauaaugaacacauuuuuauauauguuaaagccug

SEQ ID NO: 349935 - RNA, 63 nt, Homo Sapiens
ucucagguucuuuccaugcagacuccucagaucugaacacaguuuagugcuuuacaugcugug

SEQ ID NO: 349936 - RNA, 63 nt, Homo Sapiens
uacuuugcuucuuuuauguuuguaaucuguaaaugaacacauggcagaaaauaaccccugauu

SEQ ID NO: 349937 - RNA, 63 nt, Homo Sapiens
uuuugguggauguaaauaaccccauucuuugcuugaacacaguauuuucccaauagcacuuuc

SEQ ID NO: 349938 - RNA, 63 nt, Homo Sapiens
caaagaaacuuaaaguaaugcccaauuauuaaaugaacacaagagcugagaugucacauucgu

SEQ ID NO: 349939 - RNA, 63 nt, Homo Sapiens
cucguuuuaggcaaucaagauucuggagagucuugaacacagaauaacgauugugaccauuau

SEQ ID NO: 349940 - RNA, 63 nt, Homo Sapiens
gacaaguauaaaaccuccuuuauggguuuguugugaacacagugcagggcacauuuauaauaa

SEQ ID NO: 349941 - RNA, 63 nt, Homo Sapiens
cugaucgcacacaugcuuuguuuggauauggagugaacacaauuauguaccaaauuuaacuug

SEQ ID NO: 349942 - RNA, 63 nt, Homo Sapiens
aaugcuguuuuaauuuuguugcuugcaaguuacugaacacaauuguaaaaccagugcauuuca

SEQ ID NO: 349943 - RNA, 63 nt, Homo Sapiens
cuugguaaagaacaucaaaauguuugccuuucgugaacacauuagacuaucuugaaggugggc

SEQ ID NO: 349944 - RNA, 63 nt, Homo Sapiens
ugaaaaauugugccugauuacuuagcauauaacugaacacaguuaaacuuuguaaugcacauu

SEQ ID NO: 349945 - RNA, 63 nt, Homo Sapiens
uuucuguuaaagaaguuagacacacacaacuugugaacacacacacagaggcacaugugcaug

SEQ ID NO: 349946 - RNA, 63 nt, Homo Sapiens
ucugucugccccacacuucucaaagcuaguaacugaacacaggagccucaacacaauuuugga

SEQ ID NO: 349947 - RNA, 63 nt, Homo Sapiens
auacacugucaaacuuuacagaacuguugauuuugaacacaacgaucuuuagauucuuguuua

SEQ ID NO: 349948 - RNA, 63 nt, Homo Sapiens
ugauaccucaauugacaauccaagagaggcaggugaacacacauagcaaccaaagaaauaggg

SEQ ID NO: 349949 - RNA, 63 nt, Homo Sapiens
aggacguguguaaauauguaauuaagucaugugugaacacauaauuggaaaugucaucuaacc

SEQ ID NO: 349950 - RNA, 63 nt, Homo Sapiens
cuaauugucuaacauuuguucacccagccuguuugaacacauuaaugauuccguccuaacacc

SEQ ID NO: 349951 - RNA, 52 nt, Homo Sapiens
cucguugccucugauuuucuacugaacacauuaugccaaguugauaucuuga

SEQ ID NO: 349952 - RNA, 63 nt, Homo Sapiens
ucuuugguuaauaguaaaugcuuaucuggaaugugaacacaacugaaugcuuuuccacguaga

SEQ ID NO: 349953 - RNA, 63 nt, Homo Sapiens
uuuaaaucuuucugaaucucugcucagugaucaugaacacaauuccaagugcuggcaccuacu

SEQ ID NO: 349954 - RNA, 63 nt, Homo Sapiens
gguuuuauccuuuccuuuaagaaccccuccccaugaacacaagcaaacacuuaggacugaacu

SEQ ID NO: 349955 - RNA, 63 nt, Homo Sapiens
aaagcaauuacuacaaauggaugacacauuuaaugaacacaauuuuauuuuuuuucuguaacu

SEQ ID NO: 349956 - RNA, 63 nt, Homo Sapiens
aaaaaaaaaaagaauucuguuccccucauaucaugaacacaguaacugauagguaaaaagacu

SEQ ID NO: 349957 - RNA, 63 nt, Homo Sapiens
aaagguagaauggacaagugacacuguggacaaugaacacaugggccgccgcucauccaaaug

SEQ ID NO: 349958 - RNA, 63 nt, Homo Sapiens
augaagcuggaagcacugcuguguccgcuuucaugaacacagccugggaccagggcauauuaa

SEQ ID NO: 349959 - RNA, 63 nt, Homo Sapiens; identical to SEQ ID NO: 349958

SEQ ID NO: 349960 - RNA, 63 nt, Homo Sapiens
auuguuuaagguuuccucaaacugugauuuuucugaacacaauaaacuauuuugaugaucuug

SEQ ID NO: 349961 - RNA, 63 nt, Homo Sapiens
caccucucuucagccccuagugcuauucuguguugaacacaauugauacuucaggugcuuuug

SEQ ID NO: 349962 - RNA, 63 nt, Homo Sapiens
ugaauguuuccaaaucuauuuuaucugacgucaugaacacacaggcaaugauuuuaugacaac

SEQ ID NO: 349963 - RNA, 63 nt, Homo Sapiens
uuguggguuuugugccuuauaaauggaaauguaugaacacaauauaugcucauguagaauuuu

SEQ ID NO: 349964 - RNA, 63 nt, Homo Sapiens
ccgucugaacucaaguagucauucauauaaauuugaacacaccugcugugccuagacaagugu

SEQ ID NO: 349965 - RNA, 63 nt, Homo Sapiens
uuuccgaaaacugguuucuaguaaagccuugaaugaacacacacacacacacacacacacaca

SEQ ID NO: 349966 - RNA, 63 nt, Homo Sapiens
guucucauuauacucuuauuuuaaauuuauauuugaacacagucaaaucugaauggaaauaca

SEQ ID NO: 349967 - RNA, 63 nt, Homo Sapiens
gcauugaauucuuccuuuaaaaauguaacuuucugaacacauuuuucucuuuauuaacgauuu

SEQ ID NO: 349968 - RNA, 63 nt, Homo Sapiens
gucucugcuguggcaaagauagagaggugagagugaacacauuuggagcagagaucacauuuc

SEQ ID NO: 349969 - RNA, 63 nt, Homo Sapiens
aggcaacaucauaaguaggaucgggaaguuccaugaacacacaauguucuuauguucacugug

SEQ ID NO: 349970 - RNA, 63 nt, Homo Sapiens
uaaaauugauuuacugucugcuaguauguucugugaacacaaaggagcgacugucgagaucgc

SEQ ID NO: 349971 - RNA, 63 nt, Homo Sapiens
ccugacccuagaguccacacuggaguuggaguuugaacacaggucccaagguggucguagugg

SEQ ID NO: 349972 - RNA, 63 nt, Homo Sapiens
ccugguuguaauguccauuuaccagcacaggacugaacacaucuuccuacauuccaggccaga

SEQ ID NO: 349973 - RNA, 63 nt, Homo Sapiens
ggaaggcagaggguuuacuaagagcugcgaacgugaacacagugugccagaugccccagugcc

SEQ ID NO: 349974 - RNA, 63 nt, Homo Sapiens
auguguauuuagaauauuuguuugccaucaucuugaacacaaaguacuguacaguuaaucuua

SEQ ID NO: 349975 - RNA, 63 nt, Homo Sapiens
caguggagagguuaaucuaggguuuaggaggucugaacacacacuugcccuaagcuaccugag

SEQ ID NO: 349976 - RNA, 63 nt, Homo Sapiens
aaaucuauauugaaaacugaaguuugcauacagugaacacauagaaauguguauuuuggcuac

SEQ ID NO: 349977 - RNA, 63 nt, Homo Sapiens
acagaacuauguuuugacuuggauaauguggcuugaacacauuuucugagcaguuaaccucua

SEQ ID NO: 349978 - RNA, 63 nt, Homo Sapiens
ugguauauugcuuuaccaaaaaugauuaccaagugaacacacuuauacauguguugcuuagug

SEQ ID NO: 349979 - RNA, 63 nt, Homo Sapiens
acaucguagggugacugauucaucuguuuaauuugaacacacucuaauuauuuuaacuguaua

SEQ ID NO: 349980 - RNA, 63 nt, Homo Sapiens
acuggaaaggguauccacagaaauguaaaauuuugaacacaacuauaauaaauuuaaaaucua

SEQ ID NO: 349981 - RNA, 63 nt, Homo Sapiens
uugauagggcuuauuucacaguacagaaauacaugaacacauugucucaguauagaucaguug

SEQ ID NO: 349982 - RNA, 63 nt, Homo Sapiens
uugcuauucccaucccacccaauucauucucucugaacacacaagguuguucaaaguuuaagc

SEQ ID NO: 349983 - RNA, 63 nt, Homo Sapiens
ugcagauagcuggacuucuacgagaacguccucugaacacacauugguuucacuccugagaua

SEQ ID NO: 349984 - RNA, 63 nt, Homo Sapiens
cccuccuucccacuggccagcaccugaacccagugaacacaggcauuagugguccaggguccu

SEQ ID NO: 349985 - RNA, 63 nt, Homo Sapiens
aagaauuuuaauuuguaaagaauugagccacauugaacacaauugaaugagauucagaauaaa

SEQ ID NO: 349986 - RNA, 63 nt, Homo Sapiens
agcgagacccugucucuuaaaaaacgaugaugaugaacacagaggacggggcacugugcuggg

SEQ ID NO: 349987 - RNA, 63 nt, Homo Sapiens
uucgugauuaaaaugcuccuaaucaagauuguuugaacacauguauuuauaaaacagagcuag

SEQ ID NO: 349988 - RNA, 63 nt, Homo Sapiens
uugaugcccaauugguuagguaugaaaguaauaugaacacauuaauguugaauuuuacagaca

SEQ ID NO: 349989 - RNA, 63 nt, Homo Sapiens
guagccagcagggaccuaaacuuuggcaaaaagugaacacaauucaaauacgaaugaaggaag

SEQ ID NO: 349990 - RNA, 63 nt, Homo Sapiens
auauguguguuuacacauaugucugcaugcaugugaacacacacacacacacacacacaccag

SEQ ID NO: 349991 - RNA, 63 nt, Homo Sapiens
cugaagaaauccugggaauuacaucugcacuccugaacacaccguagaaaggucauccaaaga

SEQ ID NO: 349992 - RNA, 63 nt, Homo Sapiens
gauuagguuaugguuuaauguguggaagcauagugaacacacuagugugagaagacuggcuag

SEQ ID NO: 349993 - RNA, 63 nt, Homo Sapiens
gugaauaucauuuccauuuccgagaugccaagaugaacacaauaaauauuggauucauuuuau

SEQ ID NO: 349994 - RNA, 63 nt, Homo Sapiens
ucguuuuuucauuugaauugauggacuuugguuugaacacaauagaguuuccaucccaacaug

SEQ ID NO: 349995 - RNA, 63 nt, Homo Sapiens
gcagcuagaggcuccuccucccccauaagccagugaacacagacccuccguccugcugaaaac

SEQ ID NO: 349996 - RNA, 63 nt, Homo Sapiens
aaaauucauacuggagagaaccucaaaacucauugaacacaaguggcaaagcuucuaccugau

SEQ ID NO: 349997 - RNA, 63 nt, Homo Sapiens
gucaccuccacuccccauuccaagagagaggcaugaacacacacagguauaauggugagagag

SEQ ID NO: 349998 - RNA, 63 nt, Homo Sapiens
cuagauauuugaggauauuaaaucagaaaaauuugaacacagaucuaaaaucaauuauuaggc

SEQ ID NO: 349999 - RNA, 63 nt, Homo Sapiens
caugagggaggguuggagucacaggugaacaggugaacacaaacauuucacagauaaacugua

SEQ ID NO: 350000 - RNA, 63 nt, Homo Sapiens
ugucugagcuagaauuauuccuacauuacuuuaugaacacaggucucauuauugcagagaaca

SEQ ID NO: 350001 - RNA, 63 nt, Homo Sapiens
uauguuuugaggcagcauggguaugacuuuuacugaacacaguauacccacuguguagccugu

SEQ ID NO: 350002 - RNA, 63 nt, Homo Sapiens
cauaagaacuggucuucuacgcuagggagggcaugaacacaaaccaguuguuacccuagcaag

SEQ ID NO: 350003 - RNA, 63 nt, Homo Sapiens
cuaacugugcaaaauuaucuguggcugguuucuugaacacauuaaaucuaauccgguuacauu

SEQ ID NO: 350004 - RNA, 63 nt, Homo Sapiens
gcugggaacccgacugugaaaguaugugauaucugaacacauacuagaaagcucugcaugugu

SEQ ID NO: 350005 - RNA, 63 nt, Homo Sapiens
cacaccuccaguuuuugcucuuuuguguuguacugaacacaauauuuguguuuuuauuauuua

SEQ ID NO: 350006 - RNA, 63 nt, Homo Sapiens
ugcuggugaaacguauaaucacauccaauuauuugaacacaugcaaaauaauuuuuuaaauua

SEQ ID NO: 350007 - RNA, 63 nt, Homo Sapiens
cuaagcauuaacuuaauaaucacauuuaagacuugaacacaugcuacccuuuugucaucuucu

SEQ ID NO: 350008 - RNA, 63 nt, Homo Sapiens
guuccagaguacuuaaacacgcacgauuuccucugaacacagggcucugauugaucuauucuu

SEQ ID NO: 350009 - RNA, 63 nt, Homo Sapiens
aguccccuagaaaaacaacuaaaaacauucauuugaacacagucuaaugacauuuugcagauu

SEQ ID NO: 350010 - RNA, 63 nt, Homo Sapiens
gaaauaugugcccaaaguucuugagaaucagacugaacacagugcugguguugaauagggccu

SEQ ID NO: 350011 - RNA, 63 nt, Homo Sapiens
uuucaaugguaagauacuuauaaaaucuuaggcugaacacauaacuuuuguucugcugguggg

SEQ ID NO: 350012 - RNA, 63 nt, Homo Sapiens
cacgcagggagaaggcagccggagauggccacaugaacacagacaugacugguguccuucuaa

SEQ ID NO: 350013 - RNA, 63 nt, Homo Sapiens
ugcugcuaggcuggagcacacacuggccauuacugaacacagccauauuagggaaagcaaaaa

SEQ ID NO: 350014 - RNA, 63 nt, Homo Sapiens
caacagugucaguuuaggaaauuauuacuacuuugaacacaaacugaaauugcaacuuugccu

SEQ ID NO: 350015 - RNA, 63 nt, Homo Sapiens
cagaaaaggaaaugacacuugagauccuuggaaugaacacagcuucuaaagugugcauauacu

SEQ ID NO: 350016 - RNA, 63 nt, Homo Sapiens
uugcuuuuucacuguuuccuauuaaucuucagcugaacacaagcaaaccuucucaggaggugu

SEQ ID NO: 350017 - RNA, 63 nt, Homo Sapiens
guuugggucaagauccugguucuuauggguccaugaacacacuugugaccuuaguacuugguc

SEQ ID NO: 350018 - RNA, 63 nt, Homo Sapiens
aacugguuuuguucugaauaguacagauugaugugaacacaaagcauuuuguguaaggagaac

SEQ ID NO: 350019 - RNA, 63 nt, Homo Sapiens
caugaaaguugcuugacagcucuaauuacgaauugaacacauuaaacaccuggugaaauuauc

SEQ ID NO: 350020 - RNA, 63 nt, Homo Sapiens
uacuuauuuuuaaguaucuugacagaagcaauuugaacacagugucccgucauuucuagaaac

SEQ ID NO: 350021 - RNA, 63 nt, Homo Sapiens
ggcucuauggaagaaaugccgaaaaaaacaguuugaacacaaaaaaggaaaaaaagaaaaaag

SEQ ID NO: 350022 - RNA, 63 nt, Homo Sapiens
uuuaaaauaagcuauaaucaauuuucaagagugugaacacaaauuccuguguaauuuggguag

SEQ ID NO: 350023 - RNA, 63 nt, Homo Sapiens
acgucagaucaaagaaaacauuuuagaagcuugugaacacauggacuuuaauuuuggcaaaca

SEQ ID NO: 350024 - RNA, 63 nt, Homo Sapiens
uacacauaucaauuucuuaacucaagauuuaagugaacacauuagacuucauccuuagguuuu

SEQ ID NO: 350025 - RNA, 63 nt, Homo Sapiens
gaagauauuuccuucaggugauagacacacacaugaacacacuuccccuacacauacaugcac

SEQ ID NO: 350026 - RNA, 63 nt, Homo Sapiens
cauuuuguggaguauauaguaagugacuaagacugaacacauauuuacgucuuaagagcagau

SEQ ID NO: 350027 - RNA, 63 nt, Homo Sapiens
cuugaucaaaauuauuuguaauccugcuuucuuugaacacauaguuagagaaaaagccuuuuu

SEQ ID NO: 350028 - RNA, 63 nt, Homo Sapiens
uagcccuuucccagccuuuuugguuuuuuuaauugaacacauuucaucuaaguaaagcucagu

SEQ ID NO: 350029 - RNA, 63 nt, Homo Sapiens
caagaaaggaaaacuacagaucaauauuuccauugaacacagaugcagaaauccucaaaauau

SEQ ID NO: 350030 - RNA, 63 nt, Homo Sapiens
auccugccucagcccgccaagguagccaucccaugaacacacuguguccuggugcucucugcc

SEQ ID NO: 350031 - RNA, 63 nt, Homo Sapiens
gagaccugggauuugagauaccacaaacccugcugaacacagugucuguucagcaaacuaacc

SEQ ID NO: 350032 - RNA, 63 nt, Homo Sapiens
auugagauuugaccugaaaaacaaugaaacacaugaacacacuuccgauuuucuccucgcuga

SEQ ID NO: 350033 - RNA, 63 nt, Homo Sapiens
cucauuugauccuaauuuuccccguauucuacuugaacacauuaaaaauacucugcugccuau

SEQ ID NO: 350034 - RNA, 63 nt, Homo Sapiens
auuuuaauggcuuuuuugaaaguuccuuuuucaugaacacacccgagaaaucuuaaauagaca

SEQ ID NO: 350035 - RNA, 63 nt, Homo Sapiens
auuuccuggucuacugguacucaguaccaacaaugaacacauuuccacacuaaauuaaguggg

SEQ ID NO: 350036 - RNA, 63 nt, Homo Sapiens
uacuuuuguaaucagaaaauaaauuuuuucuaaugaacacauauacuuauucauucuguacuu

SEQ ID NO: 350037 - RNA, 63 nt, Homo Sapiens
uauuuuaaggcaguuaaauuaauuaaauagaggugaacacaauuuguaauacgugugcauaaa

SEQ ID NO: 350038 - RNA, 63 nt, Homo Sapiens
ugcagaaauccuuaaaauguucaauauuuccagugaacacagacaagaaaggaaaacuacaga

SEQ ID NO: 350039 - RNA, 63 nt, Homo Sapiens
ggggagacgugcuuuuuuggcaccacaucacagugaacacacuuguuaaauguggaucuuuua

SEQ ID NO: 350040 - RNA, 63 nt, Homo Sapiens
gugugcagauggggaggggggcugggacugguuugaacacaggaagccaauaacaugacagga

SEQ ID NO: 350041 - RNA, 63 nt, Homo Sapiens
uccaaaaacuaauuuagaguaggcucucuuacuugaacacaaaugcauauccuauuuccaggc

SEQ ID NO: 350042 - RNA, 63 nt, Homo Sapiens
uaacauuuuaauguuuaugcucauaaaacuuagugaacacacuguguuaugccagcucaaauc

SEQ ID NO: 350043 - RNA, 63 nt, Homo Sapiens
ucaggauucguauuuuuaaagauuuaguuaauaugaacacagcacagauuuguuagaagaaaa

SEQ ID NO: 350044 - RNA, 63 nt, Homo Sapiens
cucaccaucuauacacccuguauguccagcuuuugaacacaagggaaccaugcuucucuuaga

SEQ ID NO: 350045 - RNA, 63 nt, Homo Sapiens
agcucacacagcuaacaaguagcacacugaguuugaacacagaucauucuccuuguaaaagcc

SEQ ID NO: 350046 - RNA, 63 nt, Homo Sapiens
cagagggaagaugauaauauauaaauaauauaaugaacacacccuuaguuucucauaagcauu

SEQ ID NO: 350047 - RNA, 63 nt, Homo Sapiens
aaguaaauucuaguuuguaguucucauuuguaaugaacacauuaacgacuagauuaaaauauu

SEQ ID NO: 350048 - RNA, 63 nt, Homo Sapiens
acuuuucuaaauguagugccuuuaaaggaaaaaugaacacagggaagugacuuugcuacaaau

SEQ ID NO: 350049 - RNA, 63 nt, Homo Sapiens
cagagaagauuguauaguuggggcuggucuuggugaacacacauuauuaccccacacaucccc

SEQ ID NO: 350050 - RNA, 63 nt, Homo Sapiens
gguucugcugaggaaauggguaugaaugugccuugaacacaaagcucugucaauaagugauac

SEQ ID NO: 350051 - RNA, 63 nt, Homo Sapiens
agccucccuaagaccuccugucacuggcuucagugaacacagacacugcagagccugggagca

SEQ ID NO: 350052 - RNA, 63 nt, Homo Sapiens
acagcuucgcucuuucucuuacggacauuagugugaacacaggcaccugucaccuuguaaaac

SEQ ID NO: 350053 - RNA, 63 nt, Homo Sapiens
gaguuggaaucacuguuuagaaaguguuuucucugaacacauucuguaaacacagacaggguc

SEQ ID NO: 350054 - RNA, 63 nt, Homo Sapiens
gccucggaucagccuugagacggccccaccucgugaacacaaacguuaggaaacagugagcuc

SEQ ID NO: 350055 - RNA, 63 nt, Homo Sapiens
cauaauauauauaaccaguggcauuuuguacuuugaacacacaucaauguuaacaucauugcu

SEQ ID NO: 350056 - RNA, 63 nt, Homo Sapiens
gugucacaucaugacacucgugcugugaacaagugaacacauuguucugaaauauuuuaccac

SEQ ID NO: 350057 - RNA, 63 nt, Homo Sapiens
cacagacacacauacacccaacauacacaccccugaacacacacacagacacacaacacacac

SEQ ID NO: 350058 - RNA, 63 nt, Homo Sapiens
gccaguccguuucuaggcuuguuuguauuucugugaacacacaacuagcacauaccgcguggu

SEQ ID NO: 350059 - RNA, 63 nt, Homo Sapiens
uguaugauacuaaagacggugguggcucacuacugaacacauguccuguggcaggaggcuuug

SEQ ID NO: 350060 - RNA, 63 nt, Homo Sapiens
aaauuuagcaauuuaaaaucaacagcucuagaaugaacacauauuuuucuugauuaggucugg

SEQ ID NO: 350061 - RNA, 63 nt, Homo Sapiens
ugugcuauauuguccuuguccucuuuggaaucgugaacacaggaagaguugccucugaguuag

SEQ ID NO: 350062 - RNA, 63 nt, Homo Sapiens
gaagcuaauuagcaaguuuuugucuugugugucugaacacacauuacuacaguguauuucacu

SEQ ID NO: 350063 - RNA, 63 nt, Homo Sapiens
ugguugcugagucucagccugccugcaaugcaaugaacacaagagcaaccaaacuuacuacua

SEQ ID NO: 350064 - RNA, 63 nt, Homo Sapiens
agcuugucaaugauuucaaaagaagaaucuuaaugaacacacaaggggagaaacccuaaaaag

SEQ ID NO: 350065 - RNA, 63 nt, Homo Sapiens
ggcaacagaggcaaacuguugcuuaggaaaacaugaacacaggaggaggcgugggaaacucug

SEQ ID NO: 350066 - RNA, 63 nt, Homo Sapiens
ugaggaggcuggagaaagggaaguggaaggcagugaacacacucagcagcccccugcccgacc

SEQ ID NO: 350067 - RNA, 63 nt, Homo Sapiens
uuuccuacauucugaaaagcaaacaugaaaaacugaacacaguuuuuacagauauacaauaug

SEQ ID NO: 350068 - RNA, 63 nt, Homo Sapiens
acugaucuaugcuguguuugcuuauucuuuaguugaacacacuaugaagaauuccagguguac

SEQ ID NO: 350069 - RNA, 63 nt, Homo Sapiens
agcaaguucuauuuguucauugcuugccagagaugaacacagaauguucuguuucauuuuaca

SEQ ID NO: 350070 - RNA, 63 nt, Homo Sapiens
aguuauuaauaucauaaguuauuauuaauauuuugaacacagguggaugugaaggauuuucau

SEQ ID NO: 350071 - RNA, 63 nt, Homo Sapiens
uuguaaagccacuggcaucugauuaucuccauuugaacacacagcacagaacaaucauuuaaa

SEQ ID NO: 350072 - RNA, 63 nt, Homo Sapiens
ucauuuaggacuguuuuuagacccuccuagccuugaacacacacauguacacacacacacaca

SEQ ID NO: 350073 - RNA, 63 nt, Homo Sapiens
guguuggaucggagguuccguggaagugacaacugaacacacucugaugggacaauacccugu

SEQ ID NO: 350074 - RNA, 63 nt, Homo Sapiens
uguucaaggccagccugggcagggaggauggcuugaacacaggagcugcuugggagguugagg

SEQ ID NO: 350075 - RNA, 63 nt, Homo Sapiens
uggcccacuccccccaucaggccaccuccuuccugaacacauuaccuacugagcgacccagca

SEQ ID NO: 350076 - RNA, 62 nt, Homo Sapiens
acagucaggccuggucucccaacuuguacccagugaacacacguaugugaagaugcuugguc

SEQ ID NO: 350077 - RNA, 63 nt, Homo Sapiens
uaagauuugagggauauaagcuucuagacauauugaacacauugcuagcuagaccacagauau

SEQ ID NO: 350078 - RNA, 63 nt, Homo Sapiens
guuuguagugcuauccauucaggucuuggaaugugaacacauuuuucugagaaguuaguguua

SEQ ID NO: 350079 - RNA, 63 nt, Homo Sapiens
acucaggaauugguggcuuaucuuucuaugaacugaacacaaaugcuuuuaguuguaugaguc

SEQ ID NO: 350080 - RNA, 63 nt, Homo Sapiens
guguauaaauucuuuaccaaugucaagaagcugugaacacaugacaacacugauaauuauacc

SEQ ID NO: 350081 - RNA, 63 nt, Homo Sapiens
gccauaugaauaauuucacaaauauacaaaacaugaacacagucauaguuucuuuuguacuug

SEQ ID NO: 350082 - RNA, 63 nt, Homo Sapiens
agcuagcaaaagaaguaacacccuugaaagucaugaacacaucaguuauuuauuuuuuaauaa

SEQ ID NO: 350083 - RNA, 63 nt, Homo Sapiens
aacaugauucuguuugugcaaaaucgggacaagugaacacauuaacaaaaucuuucaaaaaaa

SEQ ID NO: 350084 - RNA, 63 nt, Homo Sapiens
ugaucgaguguuggcucugaagcagaugaguagugaacacaggagaaacuuaacccaagguca

SEQ ID NO: 350085 - RNA, 63 nt, Homo Sapiens
uuuguaaauagugccuuuaugugucuuuaauugugaacacauauuccccaacccacugguugg

SEQ ID NO: 350086 - RNA, 63 nt, Homo Sapiens
cuugaucuuuucuuuagauugaaagucugucucugaacacaauuauuuguaaaaguuaguagu

SEQ ID NO: 350087 - RNA, 63 nt, Homo Sapiens
ggcaauuucucuggguucccaaagaaugacauuugaacacaguauuuugaaacagcucuaguu

SEQ ID NO: 350088 - RNA, 63 nt, Homo Sapiens
agaaagguuuuuguugcuagucuggaaaacuggugaacacacuguuuauuaugacaaguuuuc

SEQ ID NO: 350089 - RNA, 63 nt, Homo Sapiens
auuuaaaacaaacaagcaagcagacacacacagugaacacauuugauuaauuguguuguuuca

SEQ ID NO: 350090 - RNA, 63 nt, Homo Sapiens
uugaaguagaggguaaaucagcgguaagaacagugaacacagugguugggauaaaauaaggug

SEQ ID NO: 350091 - RNA, 63 nt, Homo Sapiens
gcucugccuucauugcuggagacaguagaggcaugaacacacauggaugcacacacacacacg

SEQ ID NO: 350092 - RNA, 63 nt, Homo Sapiens
gcauaaauuugccugguucaaaggagaugauguugaacacacuggaaucugugccguauugau

SEQ ID NO: 350093 - RNA, 63 nt, Homo Sapiens
aauaagugaauaagauaaaacauacuuauccucugaacacauaauuuuuuguccuuuauucaa

SEQ ID NO: 350094 - RNA, 63 nt, Homo Sapiens
ugaauuuuuucuaaaaagaaaguggggaguauuugaacacagugaagugauauggugaaggga

SEQ ID NO: 350095 - RNA, 63 nt, Homo Sapiens
uuuucucaacauuguagcagguguucauauuaaugaacacauuuaaaucaucucuguagacau

SEQ ID NO: 350096 - RNA, 63 nt, Homo Sapiens
uuuaauauuuuuuuuucugacaucaaauaauucugaacacaaacaucagcacaaagaagcaau

SEQ ID NO: 350097 - RNA, 63 nt, Homo Sapiens
cgcucccuggaagcuggaagcauucggccuuggugaacacacacagcuuaccuagucuuguag

SEQ ID NO: 350098 - RNA, 63 nt, Homo Sapiens
gcccguguuugucacuuacaaaaauguuuacuaugaacacacagaaauaaaaaauaggcuaaa

SEQ ID NO: 350099 - RNA, 63 nt, Homo Sapiens
auuauauaagcaaaaugaaaagagaaacuuaaaugaacacagcucuuuaacaugguucaggua

SEQ ID NO: 350100 - RNA, 63 nt, Homo Sapiens
uugcguuaggaugcucugaucugacauuugacaugaacacaaaguugcuagaugcucuuguug

SEQ ID NO: 350101 - RNA, 63 nt, Homo Sapiens
ugugauaucugauggcuugaacuugcccacaguugaacacaagugcugucauugcauuucuuc

SEQ ID NO: 350102 - RNA, 63 nt, Homo Sapiens
cauucucccuugauuccacuuguguggagggauugaacacaggcaaagaggugcugcuuugcu

SEQ ID NO: 350103 - RNA, 63 nt, Homo Sapiens
aaucuguuguuuguuuccuauaagaugcuuugcugaacacauagcaaaauucaugugacggau

SEQ ID NO: 350104 - RNA, 63 nt, Homo Sapiens
ccccacaacuuuaaacauugacgauuccuucucugaacacaggcagcuuucuagaaguuuccc

SEQ ID NO: 350105 - RNA, 63 nt, Homo Sapiens
cauaugaugguaaagcagaagauuguacuugcaugaacacaaucuuaggaggacaguuuuaau

SEQ ID NO: 350106 - RNA, 63 nt, Homo Sapiens
auguaacaaugcaaauaaauuuuaucaagacucugaacacaaguuguaagccguggcuauagu

SEQ ID NO: 350107 - RNA, 63 nt, Homo Sapiens
uaccagagauguuuuagaaauugcauauaucauugaacacacacaguaccugaccaguauuag

SEQ ID NO: 350108 - RNA, 63 nt, Homo Sapiens
uucucuccaccuggcucccacucccaugcagcaugaacacaauaagucaccuccauucucuac

SEQ ID NO: 350109 - RNA, 63 nt, Homo Sapiens
gaucucuuuccuaaacugacuucugagaaauucugaacacauaucuacauauuuuuuauuuuu

SEQ ID NO: 350110 - RNA, 63 nt, Homo Sapiens
aacaccacgacgucuacgauuggaaaccaaccgugaacacaucagcaauauuuaaagaugcuu

SEQ ID NO: 350111 - RNA, 63 nt, Homo Sapiens
gaggcacuggcgaucccaguccuugcagcacccugaacacagcucagaccagugaggggugau

SEQ ID NO: 350112 - RNA, 63 nt, Homo Sapiens
cccaguagucaccaaggcagguagugugauaaaugaacacaccacucugaggcuaauuaccua

SEQ ID NO: 350113 - RNA, 63 nt, Homo Sapiens
gauuccuacuuuauguaauggggucgaaaucuuugaacacauuauuuauaaaaaccuguuuaa

SEQ ID NO: 350114 - RNA, 63 nt, Homo Sapiens
ugggggaggagggagcgugaagguagugacuccugaacacacccagguggaaccaucuuuggg

SEQ ID NO: 350115 - RNA, 63 nt, Homo Sapiens
cuagugccaaagguucaauucaguguauauaacugaacacacucauccauuugugcuuuuguu

SEQ ID NO: 350116 - RNA, 63 nt, Homo Sapiens
gaugacuauauauaaaauuauauucacuacuuuugaacacauucugcuaugaauuauuuauau

SEQ ID NO: 350117 - RNA, 63 nt, Homo Sapiens
uuucaagagcagacaucuugagcaguacaaugaugaacacacguauuuuucccaauugcccug

SEQ ID NO: 350118 - RNA, 63 nt, Homo Sapiens
gccuccucaucuucuuccugucacaagacauccugaacacauuguggcuucaggccucgggaa

SEQ ID NO: 350119 - RNA, 63 nt, Homo Sapiens
cacaguuugauuaaaacauuaggaaaccugaaaugaacacaguguauugacaauucuucaugu

SEQ ID NO: 350120 - RNA, 63 nt, Homo Sapiens
cacugugguaggauaacaguucuuagggauacuugaacacaaauuaaucauccuuaauccuua

SEQ ID NO: 350121 - RNA, 63 nt, Homo Sapiens
uaaacugaggcucagauaagauaccuuccacuaugaacacagacccaguauucagaugugucu

SEQ ID NO: 350122 - RNA, 63 nt, Homo Sapiens
ugcuugucggaacgcuuucuggguaugcauguaugaacacacaagugcauugcccuuuguugg

SEQ ID NO: 350123 - RNA, 63 nt, Homo Sapiens
ccucagugagaugcaggcauuugacaucuucccugaacacauugauguuuuucccggccagug

SEQ ID NO: 350124 - RNA, 63 nt, Homo Sapiens
uucuugcugaacauuauguacaguguuugccuuugaacacaucuuucugaacaagaaggugau

SEQ ID NO: 350125 - RNA, 63 nt, Homo Sapiens
ggcagagugcgcucacgcgagggcuggcugugaugaacacaucucucuuuuauuuuuauguuu

SEQ ID NO: 350126 - RNA, 63 nt, Homo Sapiens
uguuggcuuuguauugaucucuccagucauuuuugaacacauccaauagaaacauuggcagca

SEQ ID NO: 350127 - RNA, 63 nt, Homo Sapiens
uagauauuauaagcgaugaugguucuguugcuaugaacacagcagucggucccugucauuguc

SEQ ID NO: 350128 - RNA, 63 nt, Homo Sapiens
ucaauaagaguuguauauuuaauauauuugcagugaacacagaauacuuuaugcauauuacug

SEQ ID NO: 350129 - RNA, 63 nt, Homo Sapiens
uuugaugaugucuacagaaaaugcuggcugagcugaacacauuugcccaauuccaggugugca

SEQ ID NO: 350130 - RNA, 63 nt, Homo Sapiens
gcaaccugcggaaggagguucucccagcccaucugaacacaaccagagguggcaggagaauuu

SEQ ID NO: 350131 - RNA, 63 nt, Homo Sapiens
uuugcacaagguguguguaguaaguuaaauuguugaacacaaaaauguugcugcuugaggcau

SEQ ID NO: 350132 - RNA, 63 nt, Homo Sapiens
aauuauuuaaguguacguguauuauuaaacugaugaacacauccccagaggccaacauucaau

SEQ ID NO: 350133 - RNA, 63 nt, Homo Sapiens
ccucuuucuugugccuuguucuggccuguuuccugaacacagaucaccugcuccaugugggga

SEQ ID NO: 350134 - RNA, 63 nt, Homo Sapiens
gccuguucuaguccuggcggaagcauuucugucugaacacaaauucauuucacugggauuuug

SEQ ID NO: 350135 - RNA, 63 nt, Homo Sapiens
uuugagcugaagucuuucuuuuuucuuuuccauugaacacagcuuaccuguguucuaucaugu

SEQ ID NO: 350136 - RNA, 63 nt, Homo Sapiens
acagggagauggacaaccacuucccugggggcuugaacacagacauccucuacugccauaccu

SEQ ID NO: 350137 - RNA, 63 nt, Homo Sapiens
ccugugugugugugugugugauguauacauacgugaacacaugagcucuggccuuguguguau

SEQ ID NO: 350138 - RNA, 63 nt, Homo Sapiens
uugucagugaugauguaaacugaugagaauaggugaacacaccuggaauccaucaguguuacg

SEQ ID NO: 350139 - RNA, 63 nt, Homo Sapiens
uuugcccaugacauugccuaaagcacaguuuuaugaacacaauaaucuaucauaagcagaccu

SEQ ID NO: 350140 - RNA, 63 nt, Homo Sapiens
ccggcuccaucuugguucuagccgccaccugcaugaacacaguggcccggcuuaacgcacuaa

SEQ ID NO: 350141 - RNA, 63 nt, Homo Sapiens
ucauuuggacuaaaaaaagaaagcagaaauccaugaacacauugcuucucggccuuuuggcua

SEQ ID NO: 350142 - RNA, 63 nt, Homo Sapiens
aagagaccuacuugcacauucuuaaccuguauuugaacacaaaauaucuauacuucaugcucc

SEQ ID NO: 350143 - RNA, 63 nt, Homo Sapiens
uaacuggaagaaauuguauugcugcguagaaucugaacacacugaggccaccuagcaagguag

SEQ ID NO: 350144 - RNA, 63 nt, Homo Sapiens
uaaaccacagucuguaaucccaggagaauugcuugaacacaggaggcagagguugcagcgagc

SEQ ID NO: 350145 - RNA, 63 nt, Homo Sapiens
ucccucaguccuuuauuguccauuccaauacauugaacacauuuccuuuacccuccacacacu

SEQ ID NO: 350146 - RNA, 63 nt, Homo Sapiens
gcacccgugucuuacgauggacagugauaaaggugaacacacagagacagacuauucucuaag

SEQ ID NO: 350147 - RNA, 63 nt, Homo Sapiens
ucugccuuaauuuuugaaaagcugcuaacuacaugaacacaaauguguauuuuuguugcagug

SEQ ID NO: 350148 - RNA, 63 nt, Homo Sapiens
ccagcccggggacuguccuggguggagggcaggugaacacaagcugcugccggggacuguccu

SEQ ID NO: 350149 - RNA, 63 nt, Homo Sapiens
ugcugccggggacuguccuggguggacggcaggugaacacaagcggcugccgcauguagccac

SEQ ID NO: 350150 - RNA, 63 nt, Homo Sapiens
uggugacuugggguggacgccucugccuucacuugaacacaaaugugcuuccuauaaaaucau

SEQ ID NO: 350151 - RNA, 63 nt, Homo Sapiens
uuacucuagaggcaucaccuucucugcacccagugaacacauuagaggggcaccuuuucaugg

SEQ ID NO: 350152 - RNA, 63 nt, Homo Sapiens
gaacagguacauauauuaaacuccagcaguauuugaacacaugagcaccugcuacuauugcua

SEQ ID NO: 350153 - RNA, 63 nt, Homo Sapiens
acauauacauuaucuauacugugguuauuaaagugaacacagcuuagaguaguuacuuaugaa

SEQ ID NO: 350154 - RNA, 60 nt, Homo Sapiens
acuuccuuauuacguccuuuaucucugcugugaacacaccgugccuccucuugcugcuaa

SEQ ID NO: 350155 - RNA, 63 nt, Homo Sapiens
ccaaaacaugauugaagccucagaaaacugcagugaacacaugcugcuccuuaauagugcaga

SEQ ID NO: 350156 - RNA, 63 nt, Homo Sapiens
ggcugccagucuccugguccacaccugcccaggugaacacagccagugggggugacugggugc

SEQ ID NO: 350157 - RNA, 63 nt, Homo Sapiens
ggccaaauaaaguugaaauuuucacaaucgaauugaacacauuaguucuucaggcauuucuau

SEQ ID NO: 350158 - RNA, 63 nt, Homo Sapiens
cagcacaguuucgacaugucccucuaguuauguugaacacagcggaagaaaaugccaaagaua

SEQ ID NO: 350159 - RNA, 63 nt, Homo Sapiens
ugcuacucuuaggcugcauaguuuaugagaaaaugaacacaugcauuuauggauccaguauca

SEQ ID NO: 350160 - RNA, 63 nt, Homo Sapiens
uucugagaugugacgagacuuuugaaaaaauggugaacacacucuuggagagguaaauaguaa

SEQ ID NO: 350161 - RNA, 63 nt, Homo Sapiens
uuuuuuagccuguugcuucagagagacacaaagugaacacacuggugugaaugucgcucucug

SEQ ID NO: 350162 - RNA, 63 nt, Homo Sapiens
uguuauuuacuucaaaagacgauauauaaguagugaacacacaugugcuuuuucauauuuugu

SEQ ID NO: 350163 - RNA, 63 nt, Homo Sapiens
caauacagucugauuuagaauuaacguauuaacugaacacagaccacaaacuucaguuguugg

SEQ ID NO: 350164 - RNA, 63 nt, Homo Sapiens
agacugcaacaagaaccaaagcuuucugaggggugaacacagaaaagucagauggauucuuuu

SEQ ID NO: 350165 - RNA, 63 nt, Homo Sapiens
ugaguauuugaagugaauuugcuguuuuuuaaaugaacacaguuuagucucgugcauauaguu

SEQ ID NO: 350166 - RNA, 63 nt, Homo Sapiens
uaggaaaaccacgaugauccuguuuuaauguagugaacacagugggacguuucaagcaguaca

SEQ ID NO: 350167 - RNA, 63 nt, Homo Sapiens
uguguuuugaagaaguagcaaaaaaugauuccgugaacacagaaaauuugauuuuguuauuag

SEQ ID NO: 350168 - RNA, 63 nt, Homo Sapiens
agaggguuuuuuuaaaauuuuuuuuucucuuaaugaacacauuuucuaaaugaauuuuuuuug

SEQ ID NO: 350169 - RNA, 63 nt, Homo Sapiens
cacacccaccccguucggccccgccccccgcacugaacacacccgcccucaaccccgcacccu

SEQ ID NO: 350170 - RNA, 63 nt, Homo Sapiens
ugagacagaaaguuaacaaggauauccaggaauugaacacagcucugcaccaagcggaccuaa

SEQ ID NO: 350171 - RNA, 63 nt, Homo Sapiens
aagaugcugauguacaauugucgugcauuugugugaacacauugcguucccaguccaugccau

SEQ ID NO: 350172 - RNA, 63 nt, Homo Sapiens
caggacaaguuggcgaccuuacuccuccaaaacugaacacaaggggagggaaagaucauuaca

SEQ ID NO: 350173 - RNA, 63 nt, Homo Sapiens
ggguggagaaaaggcguuggucgcagugauuggugaacacagcgggggugggugguagcgcug

SEQ ID NO: 350174 - RNA, 63 nt, Homo Sapiens
ugcacaugcacacaccccacacgcauacacacaugaacacaugcacaugugcacacacaagua

SEQ ID NO: 350175 - RNA, 63 nt, Homo Sapiens
gcuccgaggaaaaaguuucuucuuuugugggcaugaacacagugggcuucaguagguucaggu

SEQ ID NO: 350176 - RNA, 63 nt, Homo Sapiens
uggagaugacaacugaguggggaaaacagaccgugaacacaaaacaucaaguuccacacacgc

SEQ ID NO: 350177 - RNA, 63 nt, Homo Sapiens
cuucagaaaaacucuagggaugcacugcaugugugaacacaugauaaaaaagucaugcuuuau

SEQ ID NO: 350178 - RNA, 63 nt, Homo Sapiens
gccugcuaggacaacucaacauugauagcccuuugaacacacaugcuaccaagcucugggaaa

SEQ ID NO: 350179 - RNA, 63 nt, Homo Sapiens
ugugcuugggaugacgggugggggacugccuggugaacacagauggagucggguccuggcagu

SEQ ID NO: 350180 - RNA, 63 nt, Homo Sapiens
ugaauucacaguggagaagaucucaggucuuaaugaacacauaaauguggaagcaacuuugua

SEQ ID NO: 350181 - RNA, 63 nt, Homo Sapiens
ugagaacuaaaugugcuuccaugaugcugagcgugaacacaucggaagcaaggaugcaacaag

SEQ ID NO: 350182 - RNA, 63 nt, Homo Sapiens
gagucauguacuggucuauauacccaagaaacaugaacacaggaacuacuauauauaugcauc

SEQ ID NO: 350183 - RNA, 63 nt, Homo Sapiens
uuccugauaacuuuaagaucugacgaguacucuugaacacaagaagauuuauggaaaauacuc

SEQ ID NO: 350184 - RNA, 63 nt, Homo Sapiens
gauauugccuguguguuugccucccaauagaaaugaacacagaucuccaucuugcauacaggg

SEQ ID NO: 350185 - RNA, 63 nt, Homo Sapiens; identical to SEQ ID NO: 350184

SEQ ID NO: 350186 - RNA, 63 nt, Homo Sapiens
gucccucaugcuaccuuuuucacauaaaacuaaugaacacaaaauucguguaaccacugcaac

SEQ ID NO: 350187 - RNA, 63 nt, Homo Sapiens
gauggugaggcugcagugagcaggagaaugguuugaacacaggagcaacuuaggagccugagg

SEQ ID NO: 350188 - RNA, 63 nt, Homo Sapiens
uucaggaugacagacugcaaaggcaaugucaagugaacacaaaguaagcugaaacuaauaauu

SEQ ID NO: 350189 - RNA, 63 nt, Homo Sapiens
gccgggcacuaaacacccgccugccugccagggugaacacacagccagcuuaucccucuuaag

SEQ ID NO: 350190 - RNA, 63 nt, Homo Sapiens
cacaaagcaucaaaagacucacucacaaacuucugaacacaaacuccauggaugaaagcuguu

SEQ ID NO: 350191 - RNA, 63 nt, Homo Sapiens
caucuuugcaggaaccaggaguccugagcacacugaacacaccucagagggaggauccuuguu

SEQ ID NO: 350192 - RNA, 63 nt, Homo Sapiens
aaggaguaugcagggagcugggcuuccagaaaaugaacacagcaguucugcagaggacgggag

SEQ ID NO: 350193 - RNA, 63 nt, Homo Sapiens
uagacuaagauuuguuuuccaggaggcucaaucugaacacacagaaugucagagcuggaaggg

SEQ ID NO: 350194 - RNA, 63 nt, Homo Sapiens
augaauacuaaagucagaagcaguguuucauuuugaacacauuuuggauuauuaagcugacua

SEQ ID NO: 350195 - RNA, 63 nt, Homo Sapiens
uaccaaaacugcauuuugguuuguauaguguaaugaacacaaagaaaacauggaaacuuagac

SEQ ID NO: 350196 - RNA, 63 nt, Homo Sapiens
ucuauauuuuaguauuuuuuuaguggagaugccugaacacaaugguuacugcugcgauugaug

SEQ ID NO: 350197 - RNA, 63 nt, Homo Sapiens
ggaauggcugaguuuaacuuuucuagaccucacugaacacacugucaggguggagaucugggu

SEQ ID NO: 350198 - RNA, 63 nt, Homo Sapiens
cgaacuucgaaggccacacacuacacacccacaugaacacauuuuccauguccgauucacacg

SEQ ID NO: 350199 - RNA, 63 nt, Homo Sapiens
auuucaccaaacuauuaaucaaaagucacuuauugaacacauugauaaagcaucauguucccu

SEQ ID NO: 350200 - RNA, 63 nt, Homo Sapiens
uuuuaugacgugcaggcaaauuaucauuuucugugaacacagcucagauuuuggcuggaaugg

SEQ ID NO: 350201 - RNA, 63 nt, Homo Sapiens
ccugcugauggaagauaaacugcacacuuucccugaacacacuguauaaacucuuuuuaguuc

SEQ ID NO: 350202 - RNA, 63 nt, Homo Sapiens
guuuaagaaaaaggaauaauuaauggcugugacugaacacacgcggcccugacggugguaucc

SEQ ID NO: 350203 - RNA, 61 nt, Homo Sapiens
uggaagucaguguaacaugacaacgccagggugaacacacgccacuucccagcuaggagug

SEQ ID NO: 350204 - RNA, 63 nt, Homo Sapiens
uuuggaaagcagugugcauaucuugaggggugaugaacacaagcaaaccaaguugcaccuggc

SEQ ID NO: 350205 - RNA, 63 nt, Homo Sapiens
caaugacugcgcagaguggacggccagguaggaugaacacaggggaaauauugagagagaagu

SEQ ID NO: 350206 - RNA, 63 nt, Homo Sapiens
ugggcugugccuggaaggcgagccuugauugucugaacacauaaagcaaacuguccagaaggg

SEQ ID NO: 350207 - RNA, 63 nt, Homo Sapiens
uggacccugguaaagaaaagccucagcucauagugaacacagcagaccuagaaauguagcagc

SEQ ID NO: 350208 - RNA, 63 nt, Homo Sapiens
aagucagcugccggggagaaacuugcuccuaaaugaacacauaaguuuagaucgcaaugagga

SEQ ID NO: 350209 - RNA, 63 nt, Homo Sapiens
accuaaaugaagaaaccaugccuggaggggccgugaacacagaacccucaagacaaggaugac

SEQ ID NO: 350210 - RNA, 63 nt, Homo Sapiens
ucugcccagagauguggagcagaagcugggcccugaacacacggggccaugucuggacgagca

SEQ ID NO: 350211 - RNA, 63 nt, Homo Sapiens
gccugggugccagggaaaggagagccaggggucugaacacaggcaaaggguguuucugugaug

SEQ ID NO: 350212 - RNA, 63 nt, Homo Sapiens
gagggccuaaccgagaucagaagacugggcccaugaacacagacuggggggaggcagccagcc

SEQ ID NO: 350213 - RNA, 63 nt, Homo Sapiens
uguguguguuuugguuaaucaauauauaacauuugaacacaauauuguuaaauugacucuuca

SEQ ID NO: 350214 - RNA, 63 nt, Homo Sapiens
cuccuucugcucaaggcugauguuuguaacuuaugaacacacgugaaguguugaguccaaaag

SEQ ID NO: 350215 - RNA, 63 nt, Homo Sapiens
uuacuuuguugaaaaagaaaaagaaauuaaauuugaacacagugaaagcugcaaguaugccag

SEQ ID NO: 350216 - RNA, 63 nt, Homo Sapiens
aguguucugcguggguggugauggggguucaccugaacacagaguguauuuucuuauugaggc

SEQ ID NO: 350217 - RNA, 63 nt, Homo Sapiens
gugucuggcagaugaguaugucaaggauugagaugaacacauaagucuuggaaauuaaauaaa

SEQ ID NO: 350218 - RNA, 63 nt, Homo Sapiens
gccuccuucucccucccacccaccucaagcaguugaacacagccaguuauucuuccauuauua

SEQ ID NO: 350219 - RNA, 63 nt, Homo Sapiens
uauugcaagacuccucccacaauuauucuaaucugaacacaguuaucaggauuacaaaaugug

SEQ ID NO: 350220 - RNA, 63 nt, Homo Sapiens
guuuguauauuuucugugacuugaaauaaacuuugaacacaauuuuaguacacugcaaauuga

SEQ ID NO: 350221 - RNA, 63 nt, Homo Sapiens
auagacuaagaauaagaagcaucauacuauaacugaacacaauguguauucauaguauacuga

SEQ ID NO: 350222 - RNA, 63 nt, Homo Sapiens
uauugaaacacucaaaaauaccacuucucaguaugaacacaauugcuaagagccuaauuuggu

SEQ ID NO: 350223 - RNA, 63 nt, Homo Sapiens
acagucugagcagccaacccauuucaacaaaauugaacacaggacucuucugcucagcagcau

SEQ ID NO: 350224 - RNA, 63 nt, Homo Sapiens
caaauaguaggcaagauggcacagggcaugaaaugaacacaaauuaugcuaagaauuuuuuau

SEQ ID NO: 350225 - RNA, 63 nt, Homo Sapiens
uguaacauuuaccugguaucuuuauuguuaguaugaacacaaccugugccacgucauccauag

SEQ ID NO: 350226 - RNA, 63 nt, Homo Sapiens
aaugaagacuuuauuuucagaauugauaccuuaugaacacauuauauacaucuuguguauaaa

SEQ ID NO: 350227 - RNA, 63 nt, Homo Sapiens
gauuggggagggaccagagcgcuuccacccucaugaacacagguaccuucaaggcggaucugg

SEQ ID NO: 350228 - RNA, 63 nt, Homo Sapiens
uagguggaaugcaucugagaucuauggaguucgugaacacaucucaugguuuauauuucuuau

SEQ ID NO: 350229 - RNA, 63 nt, Homo Sapiens
gcucauaaggucuuuucaguaauuguggugguuugaacacauuccuuaauuuccuuauuuaua

SEQ ID NO: 350230 - RNA, 63 nt, Homo Sapiens
ucuuuuuaaaaaaaggagacaacaaacaaaagcugaacacauuuuccugucaagcaaucaaga

SEQ ID NO: 350231 - RNA, 63 nt, Homo Sapiens
uauuuuuucaaugcaagaugaagugaacauaacugaacacaaguaggcuuuaaugaccuuaca

SEQ ID NO: 350232 - RNA, 63 nt, Homo Sapiens
uugcuugcauuuaguaagacuuguguguagccaugaacacagcuauaugcagacuuccauggu

SEQ ID NO: 350233 - RNA, 63 nt, Homo Sapiens
uccuugaaaaauguugguggaaagccacuguuuugaacacauuacaaauccacaucuuuugua

SEQ ID NO: 350234 - RNA, 63 nt, Homo Sapiens
aaccugauuugaaagcuaacaauuuugauagucugaacacaagcauuucacuucuccaagaag

SEQ ID NO: 350235 - RNA, 63 nt, Homo Sapiens; identical to SEQ ID NO: 350234

SEQ ID NO: 350236 - RNA, 63 nt, Homo Sapiens
gcucaaaauccacugacgaucauucuccuaaacugaacacaugacuagaauugguggugagau

SEQ ID NO: 350237 - RNA, 62 nt, Homo Sapiens
ugccuaacacaaaucugugauaacaacaggcugugccuuauuuugauaauuuucugauuccc

SEQ ID NO: 350238 - RNA, 62 nt, Homo Sapiens
agacuuggguuuucucuuuggugguuucuaaagugccuuaucugcaaacaacuucuuuucuc

SEQ ID NO: 350239 - RNA, 62 nt, Homo Sapiens
ccccaggggacccugcccacuuccuggacuucgugccuuacugagucucuaagacuuuuucu

SEQ ID NO: 350240 - RNA, 62 nt, Homo Sapiens
uuuuuuuuuuccuuucaacuuaguugacauacgugccuuaaaaaggaaaacuaguguugcua

SEQ ID NO: 350241 - RNA, 62 nt, Homo Sapiens
uccuucccuuucuuccuccuucccuuauuguagugccuuauaugauaauguagugguuaaua

SEQ ID NO: 350242 - RNA, 62 nt, Homo Sapiens
uuugccauuccuaccuugcauuuuuccugucagugccuuagccaaggcaaggagauaaggau

SEQ ID NO: 350243 - RNA, 62 nt, Homo Sapiens
uucaucuuccaacucaaacucuuaaaacccaagugccuuagcaaauucuguuuuucuaggcc

SEQ ID NO: 350244 - RNA, 62 nt, Homo Sapiens
ucauugcacuuucccaccucuauaccuugccugugccuuaguguccucuuuuuuccaguuca

SEQ ID NO: 350245 - RNA, 62 nt, Homo Sapiens
ucuacuguccucauugacuuguuugaaccuuagugccuuacccuguccucuucccaguucuc

SEQ ID NO: 350246 - RNA, 62 nt, Homo Sapiens
ugaguucuaaaaggcaugcccacaucucuuucgugccuuaaggauagugagaugcacacuua

SEQ ID NO: 350247 - RNA, 62 nt, Homo Sapiens
ucaaaaacagagcccauucuuaagaucacuuggugccuuaaagacacgcauuccaaagugga

SEQ ID NO: 350248 - RNA, 62 nt, Homo Sapiens
ugugcagaaguuagaagggucuggcgggggcagugccuuacacaugcuugauucccacgcua

SEQ ID NO: 350249 - RNA, 62 nt, Homo Sapiens
uuuuagagagguguuauacagggcgauuuuuggugccuuacuuuuaucuuaauuuuugccaa

SEQ ID NO: 350250 - RNA, 62 nt, Homo Sapiens
augcagccuuuuaccuaagaaauuuucugucagugccuuaucuuaugaagaaacagaaccuc

SEQ ID NO: 350251 - RNA, 62 nt, Homo Sapiens
gcaaggccuucucuccagacuaucguaaccuggugccuuaccaaguugugcuuuucuguuuu

SEQ ID NO: 350252 - RNA, 62 nt, Homo Sapiens
ucacugccuuaagggggcugauggcgccaccugugccuuacauccagguucaggcaucacua

SEQ ID NO: 350253 - RNA, 55 nt, Homo Sapiens; identical to SEQ ID NO: 174536

SEQ ID NO: 350254 - RNA, 62 nt, Homo Sapiens
ucuugaugauccucaaggaaauacaaccuagggugccuuaaaaauaacaacaacaaaaaacc

SEQ ID NO: 350255 - RNA, 62 nt, Homo Sapiens
auugccauggacaccaguugcgaagggaaauagugccuuacuauauguggguugagcuaugc

SEQ ID NO: 350256 - RNA, 62 nt, Homo Sapiens
guggccucucacucccaccaucucuggucagugugccuuaggcagccuccucccuccaugcc

SEQ ID NO: 350257 - RNA, 62 nt, Homo Sapiens
ugaaagcaacauguaucccuugaaaaguguuagugccuuaggugcgcuggaagcauaucccg

SEQ ID NO: 350258 - RNA, 62 nt, Homo Sapiens
cacuucagcuaugagccaaaugaggccuaucugugccuuagugcagggagccaggaggcacc

SEQ ID NO: 350259 - RNA, 62 nt, Homo Sapiens
aauccuaagcucagagaaaguaguuaauuucagugccuuacaaccacuccccaccccagcug

SEQ ID NO: 350260 - RNA, 62 nt, Homo Sapiens
aucauugugucucuuuuaucccuaugcuaagggugccuuagaaaaugucuauuuugaaauuc

SEQ ID NO: 350261 - RNA, 62 nt, Homo Sapiens
uuuuagucuuuagaacucuaagauuauaauaugugccuuaagagcuuuuaauagugucauaa

SEQ ID NO: 350262 - RNA, 62 nt, Homo Sapiens
uugcacuggaguucaagugcauuaaaaacaaagugccuuaucauucuaaagagacugauaga

SEQ ID NO: 350263 - RNA, 62 nt, Homo Sapiens
uugguuaugaguaaaaauuacaggcucuauuugugccuuagcaaaagaccacuuuuaccacu

SEQ ID NO: 350264 - RNA, 62 nt, Homo Sapiens
gucccaucugugggccucauagagccaggguugugccuuauuccuuugacucccugaccucc

SEQ ID NO: 350265 - RNA, 62 nt, Homo Sapiens
aaaaauaaugaucucugucuuaagaaguuauugugccuuaugaaucugaugucaaauagcac

SEQ ID NO: 350266 - RNA, 62 nt, Homo Sapiens
cagagucaggagaccccaaggaugccucuucugugccuuaagccacuccacuuuccuccaca

SEQ ID NO: 350267 - RNA, 62 nt, Homo Sapiens
cauauuacuauauauuuuccaaaguuugccaugugccuuaaauuucuugcaauuuaaugcca

SEQ ID NO: 350268 - RNA, 62 nt, Homo Sapiens
uuauaccaaagauuacuaaugauuuuuuugaugugccuuaaaucagauauuugagaauaggg

SEQ ID NO: 350269 - RNA, 58 nt, Homo Sapiens; identical to SEQ ID NO: 174552

SEQ ID NO: 350270 - RNA, 62 nt, Homo Sapiens
uuuguaccaaaacaguccuucaacuuugcacugugccuuaaguaauuacuaacaaaagguac

SEQ ID NO: 350271 - RNA, 62 nt, Homo Sapiens
cuugaauauguaaaugggauuaauuuuguccugugccuuauguggaaaggaacuucuuuggu

SEQ ID NO: 350272 - RNA, 62 nt, Homo Sapiens
uacgugcauguuuuccguacuuucagaauagagugccuuagcuaggccagaggcucguauug

SEQ ID NO: 350273 - RNA, 62 nt, Homo Sapiens
uuacauuucuuuauacaaauaaugugcuuucagugccuuaguuacagcucccuuucuguuuc

SEQ ID NO: 350274 - RNA, 62 nt, Homo Sapiens
gguacagucaggggaaaauagaucuaggcagagugccuuagucagggaccacgggcgcugaa

SEQ ID NO: 350275 - RNA, 62 nt, Homo Sapiens
ugugggugugaaaaugccuacaaaggguuuuagugccuuagaaguccuaagaagcccaaucu

SEQ ID NO: 350276 - RNA, 62 nt, Homo Sapiens
gcacaguaucagaggagccuguuaaccucucugugccuuaguuucuuagcccaugaaagaga

SEQ ID NO: 350277 - RNA, 62 nt, Homo Sapiens
uuuuuucuucaguuaacaaaaucauaaauauggugccuuauaacaugaaaggaaaauuaguu

SEQ ID NO: 350278 - RNA, 62 nt, Homo Sapiens
cauugcuuauguaguauuuuucuuuuggaaaugugccuuauguuaaacacuauguacuuuua

SEQ ID NO: 350279 - RNA, 62 nt, Homo Sapiens
ggccccagcagcccuauggugaccgccacacugugccuuaaugucugccgggggcccaggcu

SEQ ID NO: 350280 - RNA, 62 nt, Homo Sapiens
cuucucccgacccccagagcagggcagggcccgugccuuagagggagaaggagccgugcgcc

SEQ ID NO: 350281 - RNA, 62 nt, Homo Sapiens
caguguguacuugugugugucccgcccuagcugugccuuagucaaggggccuucugcccgcc

SEQ ID NO: 350282 - RNA, 62 nt, Homo Sapiens
gguauucucagaacauuuuauauuugcauucagugccuuacuauaauucauauuucaggugg

SEQ ID NO: 350283 - RNA, 62 nt, Homo Sapiens
uugugauuuaaaagaaaucauuuaauccaauggugccuuacuaguaaaagccaggagaaaug

SEQ ID NO: 350284 - RNA, 62 nt, Homo Sapiens
uaaaagggcauucuuaggacuuccaaacaugagugccuuauuauuuaguaguuacauccuau

SEQ ID NO: 350285 - RNA, 62 nt, Homo Sapiens
ccauuucucuguguaauacaggcuuuagauuagugccuuauauugguuuugguuuggggcac

SEQ ID NO: 350286 - RNA, 62 nt, Homo Sapiens
guggaggcugcuggaccuggucagagacugaugugccuuagcggcaaugguuagagcuuuuc

SEQ ID NO: 350287 - RNA, 62 nt, Homo Sapiens
aucccuucuacuucacuccucaggggagugaagugccuuaagaaacaaagcccuguccuaau

SEQ ID NO: 350288 - RNA, 62 nt, Homo Sapiens
caagugaagaguuugccuguacucuuaucugggugccuuaaggagagagauuguguucuucc

SEQ ID NO: 350289 - RNA, 62 nt, Homo Sapiens
aaguggcauaaagcauauccauucagaaugaagugccuuaaauauagcaguagucuuuuuug

SEQ ID NO: 350290 - RNA, 62 nt, Homo Sapiens
gaaggguugaagagugacaagcauugguaacagugccuuagaacugugucaguuagucugau

SEQ ID NO: 350291 - RNA, 62 nt, Homo Sapiens
cacugucuuuaauacccccagcccaggagcucgugccuuacaugcugggcccacauucugcc

SEQ ID NO: 350292 - RNA, 62 nt, Homo Sapiens
agaagaaaaguauuuaaaagaaauaccagugagugccuuaaaguuggagaaguaacugccca

SEQ ID NO: 350293 - RNA, 62 nt, Homo Sapiens
gcuucauaugaggaggauguacaguacagcaugugccuuaauaggucagggagugcuggcuc

SEQ ID NO: 350294 - RNA, 62 nt, Homo Sapiens
gcagguguguacaucucucaacccuucucccugugccuuagaucuuggucuccccuguggaa

SEQ ID NO: 350295 - RNA, 62 nt, Homo Sapiens
gcauggcuggaauuuauagagaaauaguucuggugccuuaacuuaauuuuggaggggguggg

SEQ ID NO: 350296 - RNA, 62 nt, Homo Sapiens
cucccaaguagcugggauuacaagugauucuugugccuuagccaaccucugccuucuggauu

SEQ ID NO: 350297 - RNA, 62 nt, Homo Sapiens
cuucuccacucugcacccuauggcaguuacccgugccuuagugucggcacuuugccacugug

SEQ ID NO: 350298 - RNA, 62 nt, Homo Sapiens
ccgaagccaggggaagaagcagaggagcaagggugccuuagaccagcaguccacuaucugcc

SEQ ID NO: 350299 - RNA, 62 nt, Homo Sapiens
cuguuuuuucugauauggucuucccaagaguggugccuuacuuuacugcaagcuaccuuaau

SEQ ID NO: 350300 - RNA, 62 nt, Homo Sapiens
aaugcuuuagaaucugaacuuuccagaacaccgugccuuagaccaacagaagcacauuuguc

SEQ ID NO: 350301 - RNA, 62 nt, Homo Sapiens
cuuugcuuuuagucaaaccaaauucauagcaggugccuuauuucuguuuuaugguugugcua

SEQ ID NO: 350302 - RNA, 62 nt, Homo Sapiens
agcgugacaguucagcucucgugaaaugcucugugccuuagaauauaaauguauguuggugu

SEQ ID NO: 350303 - RNA, 62 nt, Homo Sapiens
gaugaucaugguucagaauaaauguauuugaagugccuuaaaacuuaaauuuaguggucaga

SEQ ID NO: 350304 - RNA, 62 nt, Homo Sapiens
ugacuaacuuaaaaaaauagauuguaauugaugugccuuaauuugcauaaaucauaaaugua

SEQ ID NO: 350305 - RNA, 62 nt, Homo Sapiens
uuucacuggauaauguguguagauuuuuacaugugccuuauuugacaaugcuuaugucuugu

SEQ ID NO: 350306 - RNA, 62 nt, Homo Sapiens
gaaaaaauggagugauguuguaaucuaaacaagugccuuauguuuauugcuaagaacuggug

SEQ ID NO: 350307 - RNA, 62 nt, Homo Sapiens
uucauuuguugguacauauuacacaaaacauugugccuuaaaaugagucauacaucuuuuaa

SEQ ID NO: 350308 - RNA, 62 nt, Homo Sapiens
cugaucucucgugauugauaagaaccuuuugagugccuuacacaaugguuuucuuguguguu

SEQ ID NO: 350309 - RNA, 62 nt, Homo Sapiens
gcuguuaauucauuucccccggacuagagacugugccuuauauauaggaguucaccuucuua

SEQ ID NO: 350310 - RNA, 62 nt, Homo Sapiens
ggaaguuucugacuggaaaacucuaucacagugugccuuaugucacagaauccuuccaagug

SEQ ID NO: 350311 - RNA, 62 nt, Homo Sapiens
cuuacuaaauuuaaaucuuuaaggcugcuuuagugccuuacgggucuccaagagaaaauaga

SEQ ID NO: 350312 - RNA, 62 nt, Homo Sapiens
auauguauucuauaaugauuuuuugagacuuagugccuuaaaaguauaacaggugccuucac

SEQ ID NO: 350313 - RNA, 62 nt, Homo Sapiens
ucacuuaacauagacuugaaucaauauuaauugugccuuauuuucccuuucccuaaaucaaa

SEQ ID NO: 350314 - RNA, 62 nt, Homo Sapiens
auaacauggaacuuacacaaaaggcuuuucaugugccuuacuuuuuuaaaaaggaguuuauu

SEQ ID NO: 350315 - RNA, 62 nt, Homo Sapiens
caguuuaggaugcaauuacgaguguaaacugugugccuuauuuacacuuuauugucucccgc

SEQ ID NO: 350316 - RNA, 62 nt, Homo Sapiens
uuguuaaugguucuuacagaguaucuuuaaaagugccuuaggggaacccugucccuccuaac

SEQ ID NO: 350317 - RNA, 62 nt, Homo Sapiens
uuguggaaccaacacuaaucaagcagccggaagugccuuaacgaggaaccacgcugccacca

SEQ ID NO: 350318 - RNA, 62 nt, Homo Sapiens
uuuaaccaauauuuucuucuggucccagggcugugccuuaacaaacauagcugcaggucuuu

SEQ ID NO: 350319 - RNA, 62 nt, Homo Sapiens
ugagaauuucuaaaugauuucuaauucugugggugccuuaagaauugaguauuguggguccc

SEQ ID NO: 350320 - RNA, 62 nt, Homo Sapiens
ccuugaguuguguacacuugacauguaaauuugugccuuacacugugaauagccuguuuucc

SEQ ID NO: 350321 - RNA, 62 nt, Homo Sapiens
aggaagaugaauuuuuaaaaucuccaucaaacgugccuuaaagcuaaagcauuuugacagga

SEQ ID NO: 350322 - RNA, 62 nt, Homo Sapiens
ugcgcgggaggccacagcccgugccgauuccagugccuuaacuacuuaccggaucccuccau

SEQ ID NO: 350323 - RNA, 62 nt, Homo Sapiens
ggacgaugagacuuugaaacuaucucaugccagugccuuauuacccaggaagauuuuaaagg

SEQ ID NO: 350324 - RNA, 62 nt, Homo Sapiens
uuguaucuagaucuuugcucuguguuucaguugugccuuacccucuguaagauacugauucu

SEQ ID NO: 350325 - RNA, 62 nt, Homo Sapiens
acaggguuccugagcucacugaaaagacuauugugccuuaggaaaagcauuugcuguguuuc

SEQ ID NO: 350326 - RNA, 62 nt, Homo Sapiens
uugacaguauauuugaaacuguaaauauguuugugccuuaaaaggagagaagaaaguguaga

SEQ ID NO: 350327 - RNA, 62 nt, Homo Sapiens
uuuucuuccuuuuugugagauuuguggguuuugugccuuauaaauggaaauguaugaacaca

SEQ ID NO: 350328 - RNA, 62 nt, Homo Sapiens
uggaguguggggaagcugcugucucccaggaagugccuuacucaucccgcaaccagucagcg

SEQ ID NO: 350329 - RNA, 62 nt, Homo Sapiens
aaaguauuuguuuuuauuuguaccauccacuugugccuuacuguauccugugucauguccaa

SEQ ID NO: 350330 - RNA, 62 nt, Homo Sapiens
uuuggcaaacagaauguucauacugauguguugugccuuaaagacaagacagcauuugugug

SEQ ID NO: 350331 - RNA, 62 nt, Homo Sapiens
gcaaacaaggaaaggaaaggaaagaagaaaaggugccuuaguccuuuguugcacuuccauuu

SEQ ID NO: 350332 - RNA, 62 nt, Homo Sapiens
gggcacuguacuuggaucuucccggcgugugugugccuuacacaggggugaacuguucacug

SEQ ID NO: 350333 - RNA, 62 nt, Homo Sapiens
ccccugcggaggagcgcucccgucucccacaggugccuuaccgcguucccucccgcugcuuu

SEQ ID NO: 350334 - RNA, 62 nt, Homo Sapiens
caugacauauugugguuaauuuuaaaacuacugugccuuaacguguuucuuaaacuuuugua

SEQ ID NO: 350335 - RNA, 62 nt, Homo Sapiens
ccagguuccugggcuucugcugccaacucaaagugccuuagcacuucccgugcagacucaga

SEQ ID NO: 350336 - RNA, 62 nt, Homo Sapiens
ggauuuggccuguccucaagcuguuuuacuccgugccuuacucacacauagccccccaucag

SEQ ID NO: 350337 - RNA, 62 nt, Homo Sapiens
uguuuaaaaucucuggcuucuaauguuuucaagugccuuaauugcacauuuguacauauacu

SEQ ID NO: 350338 - RNA, 62 nt, Homo Sapiens
agacagugaaagguaagcucauauaaagaacagugccuuagaagcaucuuaugucauugaga

SEQ ID NO: 350339 - RNA, 62 nt, Homo Sapiens
cagcccagcaggccaggcagacacaccccgcugugccuuaggaaggugugagaccggcuucc

SEQ ID NO: 350340 - RNA, 62 nt, Homo Sapiens
uuuaguuguuucuagacuauaaauguugcuaugugccuuauguugaaaaaauuuaaaaguaa

SEQ ID NO: 350341 - RNA, 62 nt, Homo Sapiens
aagauaauucauacuggagaaaacucccagaagugccuuauugcacaggaaagcauuuauac

SEQ ID NO: 350342 - RNA, 62 nt, Homo Sapiens
ggcauuuccucuauucuguuacgucauuaacagugccuuacugugcaaggcaccaaaggaca

SEQ ID NO: 350343 - RNA, 62 nt, Homo Sapiens
acgagugaccacaguuuaauuccaggccaagugugccuuagccuucccaaacaguaacucac

SEQ ID NO: 350344 - RNA, 62 nt, Homo Sapiens
aauguuguggccaagccacaagucagagaagggugccuuaaaugggaauaaaaauuugugca

SEQ ID NO: 350345 - RNA, 62 nt, Homo Sapiens
guaggaagguguuuccaaguuauccugauccugugccuuaaaagcucguacauguggguucu

SEQ ID NO: 350346 - RNA, 62 nt, Homo Sapiens
agaaguccuuuaucugugcucucugcccgccagugccuuacaauuugcaaacguguauagcc

SEQ ID NO: 350347 - RNA, 62 nt, Homo Sapiens
caguaaggaucuugcccucccugcaacaccgagugccuuagacagcugcugccugagaacug

SEQ ID NO: 350348 - RNA, 62 nt, Homo Sapiens
ugaucagagauuuacaacuguucauuauaguggugccuuaggcaaucuuuccaaaguaaauu

SEQ ID NO: 350349 - RNA, 62 nt, Homo Sapiens
uuaaaggauaguaauuauucuuguuuauaacagugccuuaagguaugauguauuucugaugg

SEQ ID NO: 350350 - RNA, 62 nt, Homo Sapiens
ggaaauacuuuggcuuuuucauauaccuaguggugccuuaucauaauagcacuguuacauga

SEQ ID NO: 350351 - RNA, 62 nt, Homo Sapiens
ugguguguguguguguguguuauaauccaguggugccuuacaggcauuuguccccuccaugc

SEQ ID NO: 350352 - RNA, 62 nt, Homo Sapiens
aaguauuccaaguuuacuccacgcgaacucaggugccuuaaacauaggaagagaucugccag

SEQ ID NO: 350353 - RNA, 62 nt, Homo Sapiens
uugguuaaaaaaaaaaaaaaaaauuucugguagugccuuagcggccagaaucauuauccuug

SEQ ID NO: 350354 - RNA, 62 nt, Homo Sapiens
ugaguuuucgguauaaauauaauucaugugccgugccuuauccaugaggcagcacgugcaca

SEQ ID NO: 350355 - RNA, 62 nt, Homo Sapiens
aaauaugggaaugucuaacucuagacuccauugugccuuacuuggaaauuaaaaaaaaaaaa

SEQ ID NO: 350356 - RNA, 62 nt, Homo Sapiens
acuuugguccucuauguauuuaaauguuugaagugccuuagacucuugccauauuuucaaaa

SEQ ID NO: 350357 - RNA, 62 nt, Homo Sapiens
auguuacuuuuaguuuuaaaaugaaaucuuaggugccuuagggguuuuuuuuuuuuuuaagu

SEQ ID NO: 350358 - RNA, 62 nt, Homo Sapiens
auagccuaagugcuauaucgaucgucccggaugugccuuaagaaccgugaccucaucagucg

SEQ ID NO: 350359 - RNA, 62 nt, Homo Sapiens
uggaaccuggacacccucagcucuccugcuuugugccuuaucuacaggagcaucgcccauug

SEQ ID NO: 350360 - RNA, 62 nt, Homo Sapiens
gcuagagcuucuguauuuucaaagacugccacgugccuuaggaauacuguuuuaucuccaua

SEQ ID NO: 350361 - RNA, 62 nt, Homo Sapiens
cuggauguccagcaccugagcguggaugcaccgugccuuaucaaagccagcaccacuuugcc

SEQ ID NO: 350362 - RNA, 62 nt, Homo Sapiens
cuccauuacucucccugcccuucucuguuggggugccuuauccugagccaccuccucucccc

SEQ ID NO: 350363 - RNA, 62 nt, Homo Sapiens
cuggcucugcccuucuuacugcaaaccaugcugugccuuagggcccuucucauagcuguucc

SEQ ID NO: 350364 - RNA, 62 nt, Homo Sapiens
agaaaucagacaaaugcccugacuuuuccaaagugccuuaaaucuuucuguccgcagauccu

SEQ ID NO: 350365 - RNA, 62 nt, Homo Sapiens
ugcacagagguacugcccccuucaacguaagugugccuuaauggugagcagccacugugcag

SEQ ID NO: 350366 - RNA, 62 nt, Homo Sapiens
cauguuguucccuuugcucgcgucacacugcugugccuuagucacagccccagcccugcccc

SEQ ID NO: 350367 - RNA, 62 nt, Homo Sapiens
ugguuuucauaguuuaaguguugaaugauacugugccuuaauugcucuucugucuauaaauu

SEQ ID NO: 350368 - RNA, 62 nt, Homo Sapiens
augugcuuaagauacaauagauuucuuauuaugugccuuauuaauuacuguguauuuacuua

SEQ ID NO: 350369 - RNA, 62 nt, Homo Sapiens
gaugagaguacuaacuggaauucacacuucaugugccuuacuugaaauuuggggcccaaaau

SEQ ID NO: 350370 - RNA, 62 nt, Homo Sapiens
uccagagagucuuuuuuuuuuccaggucauaugugccuuacccuuacaccacaaccagcuuc

SEQ ID NO: 350371 - RNA, 62 nt, Homo Sapiens
gcaggucucuugugcccugucuaggcugugaggugccuuagggauuccucaaguaccauuug

SEQ ID NO: 350372 - RNA, 62 nt, Homo Sapiens
ggcagagaagcgaggcggauccccccuugcuugugccuuaaagagccacugagggauguuuu

SEQ ID NO: 350373 - RNA, 62 nt, Homo Sapiens
cuccaucucaugucccucccaucgcucgcugugugccuuaaaggccagcaccucccuccucc

SEQ ID NO: 350374 - RNA, 62 nt, Homo Sapiens
cagugguagauuuaugauucacauccgaaagugugccuuaguuaucaauuuaacauuucucu

SEQ ID NO: 350375 - RNA, 62 nt, Homo Sapiens
ggguaauucauugacuuguuuuaguauuuugugugccuuagauuuccguuuuaagacaugua

SEQ ID NO: 350376 - RNA, 62 nt, Homo Sapiens
gcuuuggggggugugcugacaacuuagcucaggugccuuacaucuuuucuaaucacaguguu

SEQ ID NO: 350377 - RNA, 62 nt, Homo Sapiens
aaaaaaaaauaauaaauaaauuucuacgucaugugccuuaguuugcauuuuguaccucaaua

SEQ ID NO: 350378 - RNA, 62 nt, Homo Sapiens
ggguacuggggucuggucuuacgucgggguuagugccuuagacuuuccagccagugucucug

SEQ ID NO: 350379 - RNA, 62 nt, Homo Sapiens
uaaaacauuucucgaucacuugguaucuuuuugugccuuauccagccuaguguuaacauucu

SEQ ID NO: 350380 - RNA, 62 nt, Homo Sapiens
agacuggaaguuuaaaaaugugauuaaauacugugccuuagggggugguaauauuggcauuc

SEQ ID NO: 350381 - RNA, 62 nt, Homo Sapiens
ccugaaugucuguagccaaaaauuugugguaugugccuuaaaucagugacagggcuucuugu

SEQ ID NO: 350382 - RNA, 62 nt, Homo Sapiens
ccuccccugggccgcugaggccccgcgcaccugugccuuaaucuucccuccccugugcugcc

SEQ ID NO: 350383 - RNA, 62 nt, Homo Sapiens
cccccuacacuucaguugagggaaaagcucaagugccuuaggcccguggaccacagucuugg

SEQ ID NO: 350384 - RNA, 62 nt, Homo Sapiens
gacuucugccacagugacaauggaauuguguugugccuuacuucagagguggucucuucuuu

SEQ ID NO: 350385 - RNA, 62 nt, Homo Sapiens
uuuugguugaaauugaacauacucuagugaaugugccuuaaaaaucaagacacuaguucaga

SEQ ID NO: 350386 - RNA, 62 nt, Homo Sapiens
cuucagcuucuuacguuuucugagcauccauugugccuuaacauuuucugcuuguccuuugg

SEQ ID NO: 350387 - RNA, 62 nt, Homo Sapiens
auuuggagaccagcuaugccugcccucugugggugccuuagcauugcgggaggguggugcuu

SEQ ID NO: 350388 - RNA, 62 nt, Homo Sapiens
gacuaauucuggcaccccuuuccgccucagcugugccuuaagaguugugccuuggugccuug

SEQ ID NO: 350389 - RNA, 62 nt, Homo Sapiens
aacucaaugagaaucaugguucaauuauuugggugccuuaaagucuuaauauaucuuaggcu

SEQ ID NO: 350390 - RNA, 62 nt, Homo Sapiens
ggcccccuacaaggggccccagcccugaaugugugccuuaaaggugcugguucacucugccc

SEQ ID NO: 350391 - RNA, 62 nt, Homo Sapiens
auacaggacaaauaggcucuguccucuuccuugugccuuaacgaaccccuuuaucccaggaa

SEQ ID NO: 350392 - RNA, 62 nt, Homo Sapiens
ccugaauccuagcccuuaccuggggcuagaaugugccuuaguguuugcacagcccuugugug

SEQ ID NO: 350393 - RNA, 62 nt, Homo Sapiens
cuaugagaccauucagaauauauuugugcgaagugccuuaugagccugaagagcuuauuacu

SEQ ID NO: 350394 - RNA, 62 nt, Homo Sapiens
cacugcccccacccucagccugaccgcaaaaggugccuuacagcgauggaguguggcugggc

SEQ ID NO: 350395 - RNA, 62 nt, Homo Sapiens
gaagcucucaaaauauuuuauuuuggaugcaggugccuuaauccagcuguauuauuuugauc

SEQ ID NO: 350396 - RNA, 62 nt, Homo Sapiens
auggauuguguuuuagauucuagaauaaugaugugccuuacauuuuuuccugucuugggaga

SEQ ID NO: 350397 - RNA, 62 nt, Homo Sapiens
cccuuuccuaaucuggcuuuuacauuuauuuugugccuuaaagauuaacuacaaagauaaac

SEQ ID NO: 350398 - RNA, 62 nt, Homo Sapiens
ugcuuucguaucuccucaggcaaaaguggagggugccuuaugggcccuccucauagguuguc

SEQ ID NO: 350399 - RNA, 62 nt, Homo Sapiens
augcacacuauucuguaacagaaagcccuauugugccuuaccugugugcuuuugugggcacc

SEQ ID NO: 350400 - RNA, 62 nt, Homo Sapiens
uccauuucuuuuuucccaaacccucaaacagagugccuuaaaaaauuguuuuaucaggauaa

SEQ ID NO: 350401 - RNA, 62 nt, Homo Sapiens
aauaggaggguggcaagaacaguucuauccuggugccuuacgaauaaaaaacuggauucugg

SEQ ID NO: 350402 - RNA, 62 nt, Homo Sapiens
gccacugaacaucccuucucugcuccacaggagugccuuagacagccugacucuccacaaac

SEQ ID NO: 350403 - RNA, 62 nt, Homo Sapiens
gaucuuuguaucccccauggacugagggucuugugccuuauaggcugucaggcgacuacaag

SEQ ID NO: 350404 - RNA, 62 nt, Homo Sapiens
uccugcccaggagagccagccucccccugccagugccuuaccaagcaccugccgaccucguc

SEQ ID NO: 350405 - RNA, 62 nt, Homo Sapiens
cuagagggucggggaggagggccuccccggaagugccuuaacuaacaggaccccaaggaccu

SEQ ID NO: 350406 - RNA, 62 nt, Homo Sapiens
gaccuaaauauccacucaguuggaggagaacugugccuuacugaagaugggagauuccuaag

SEQ ID NO: 350407 - RNA, 62 nt, Homo Sapiens
uuugugugccaauuaaugccgauuaaguacucgugccuuauaugcuaaggggggagggugag

SEQ ID NO: 350408 - RNA, 62 nt, Homo Sapiens
acaaguucuuugcaugcuuuuauuuuaauaaagugccuuauauaaagggauguaagcacuuu

SEQ ID NO: 350409 - RNA, 62 nt, Homo Sapiens
gcagcgugucuccuggcacgggagcuugguaagugccuuacucuucuuucccucuauccaaa

SEQ ID NO: 350410 - RNA, 62 nt, Homo Sapiens
cucuguuacacuuuuuggaaacaaaguuaccagugccuuaaaguuuuaaucucuaacagugg

SEQ ID NO: 350411 - RNA, 62 nt, Homo Sapiens
augaaguuguuggaagcuauaauaugcaagaugugccuuacaguuucaguguuguauauaua

SEQ ID NO: 350412 - RNA, 62 nt, Homo Sapiens
auagcuugggaugagaugugcuucuaagcaaagugccuuagguuccugccuaauuuuuauau

SEQ ID NO: 350413 - RNA, 62 nt, Homo Sapiens
ugagugugucaucaaucagaccuuguaaauaagugccuuacggauucuguuuuaaguccaua

SEQ ID NO: 350414 - RNA, 62 nt, Homo Sapiens
agacuacagagucaaagcuccuaucagguuuugugccuuaagggccaccaguuaaaugccgu

SEQ ID NO: 350415 - RNA, 62 nt, Homo Sapiens
ggaauuugcguaacuaacacgaaaaccguaaagugccuuauauguaccucacuguccaauau

SEQ ID NO: 350416 - RNA, 62 nt, Homo Sapiens
gccccuauggcgccccugcugggccacugauugugccuuauaaccugccuuugccuggggga

SEQ ID NO: 350417 - RNA, 62 nt, Homo Sapiens
auuuuagucucugugaagccuuuacucucuaggugccuuauaauguuucagggcucaacuuu

SEQ ID NO: 350418 - RNA, 62 nt, Homo Sapiens
aguggcagaggugagggucaaagggagucacagugccuuagauggcgguacccacccagccc

SEQ ID NO: 350419 - RNA, 62 nt, Homo Sapiens
caaagagaaacucuauacaguaugguuuuacugugccuuacagcaaccaauuauauacucaa

SEQ ID NO: 350420 - RNA, 62 nt, Homo Sapiens
cagacuuuuuaguccaaaauacacugagacaugugccuuaaauguguguguuuuuaauauuc

SEQ ID NO: 350421 - RNA, 62 nt, Homo Sapiens
cgacacuuugucgacacugaaauaucgauuaagugccuuaaaaccucuuuagacauagcuau

SEQ ID NO: 350422 - RNA, 62 nt, Homo Sapiens
uuggaggagggguaugaaguaucuuugacauggugccuuaggaaugacuuggguuuaacaag

SEQ ID NO: 350423 - RNA, 62 nt, Homo Sapiens
ggcuguauagcaaaguguuuuaauccacgguugugccuuauuguuccauuaaaauuguaucu

SEQ ID NO: 350424 - RNA, 62 nt, Homo Sapiens
gugaacagaaguccuuaagcagaggaauuggugugccuuaaagauacaaucugggauaguuu

SEQ ID NO: 350425 - RNA, 62 nt, Homo Sapiens
ugaugacucaaguguagacugaaguugagguagugccuuaugccauuaugucauauguugaa

SEQ ID NO: 350426 - RNA, 62 nt, Homo Sapiens
cacaugugaguuuaccugaaucugugcauuuugugccuuauucaugagaaugauagaaguac

SEQ ID NO: 350427 - RNA, 62 nt, Homo Sapiens
aacaguaugguacugcuucugugacaaauaucgugccuuaacaauguggcuguccuuuucca

SEQ ID NO: 350428 - RNA, 62 nt, Homo Sapiens
cauuguuuuuaaaacuguuuuauaucuuaagagugccuuauuaaaguauagauguaugucuu

SEQ ID NO: 350429 - RNA, 62 nt, Homo Sapiens
caaccuuagccuauuauaguucagagccaaaagugccuuauaugagaguuaggagaaauauu

SEQ ID NO: 350430 - RNA, 62 nt, Homo Sapiens
gugaaucaagguagugccacgauaagcugcuggugccuuagugugaugcuaaaguaauggug

SEQ ID NO: 350431 - RNA, 62 nt, Homo Sapiens
guaacuuguucuguaccuccuaccucaacuaugugccuuaugucugggccuggugugggggc

SEQ ID NO: 350432 - RNA, 62 nt, Homo Sapiens
ugguggugguugugcccagccacuuuccgugggugccuuaugcucgccugccuucugagcug

SEQ ID NO: 350433 - RNA, 62 nt, Homo Sapiens
aaaaccaaauuguggcuauuugcuaucaaacugugccuuauuuguucuuaauuccuagcauc

SEQ ID NO: 350434 - RNA, 62 nt, Homo Sapiens
guccuucuuaacagacucaaaucaccagccaugugccuuagucccgugucuaugacgcaaag

SEQ ID NO: 350435 - RNA, 62 nt, Homo Sapiens
aaauuuguuuucauuuagaucucagaucaaaugugccuuaauuuauaccagaaaguuaaauu

SEQ ID NO: 350436 - RNA, 62 nt, Homo Sapiens
ucaugagaguggagcccucaugaaugggaucagugccuuaugaaaggcccuagagagauacc

SEQ ID NO: 350437 - RNA, 62 nt, Homo Sapiens
guacaugcucggaggccugggguguggugacugugccuuacuugcagggaggcccuucccaa

SEQ ID NO: 350438 - RNA, 62 nt, Homo Sapiens
aucgccccuggacagaguucuccuucaccacugugccuuagacacuugggggaccaaucaug

SEQ ID NO: 350439 - RNA, 62 nt, Homo Sapiens
ucacuguuucagcugaguccuccccauuuucugugccuuaucacuugguacccauggccacc

SEQ ID NO: 350440 - RNA, 62 nt, Homo Sapiens
uucuaggaucagaauuaguugaaagcuucagcgugccuuaguuuucaaaugauuggaucuuu

SEQ ID NO: 350441 - RNA, 62 nt, Homo Sapiens
cucaugggcugccuaggagcugugucacccuugugccuuagcacugagcccucguggccacc

SEQ ID NO: 350442 - RNA, 62 nt, Homo Sapiens
cucucggcggccucaccuggccucacugcuucgugccuuagcucgggggucgggggagaacc

SEQ ID NO: 350443 - RNA, 62 nt, Homo Sapiens
agugagaggcuguggggcagcggcucuguccugugccuuaccagcccuggggaggggggcau

SEQ ID NO: 350444 - RNA, 62 nt, Homo Sapiens
ugcuagucuguaagcuccuuaagaguaggguugugccuuauucaacugcauacauagcuccu

SEQ ID NO: 350445 - RNA, 62 nt, Homo Sapiens
cuuauucaacugcauacauagcuccuagcacagugccuuauucgguaggcaucuaagcacau

SEQ ID NO: 350446 - RNA, 62 nt, Homo Sapiens
uacaggacauagcucucuccugcuaccagucugugccuuagaggucuguuaggccugccaaa

SEQ ID NO: 350447 - RNA, 62 nt, Homo Sapiens
cugggggcaccuuaagauuuugcaccuguaaagugccuuacaggguaacugugcugaaugcu

SEQ ID NO: 350448 - RNA, 62 nt, Homo Sapiens
cagcugagcugcgcuggcucugggcagggagugugccuuaaugggaagcacacgggcuuugg

SEQ ID NO: 350449 - RNA, 62 nt, Homo Sapiens
cagaagagcccuuaugaccccugggccgcgcugugccuuagugucuacuugcaggacccuuc

SEQ ID NO: 350450 - RNA, 62 nt, Homo Sapiens
acaaagacaagaaaaaucagggcauuuugugagugccuuaagaucaaacuaacaagaucuga

SEQ ID NO: 350451 - RNA, 62 nt, Homo Sapiens
uaaaacacaccucucugcuguuccagagucuugugccuuaaaaauaaauacaaagcccauuc

SEQ ID NO: 350452 - RNA, 62 nt, Homo Sapiens
uaacugcccuuccuucccuugcugcgauuccugugccuuaugccugccuucagcuggugcuu

SEQ ID NO: 350453 - RNA, 62 nt, Homo Sapiens
cacuacaguacuaagacaauacauuacggaaagugccuuagaguugguaguuaagcaaacug

SEQ ID NO: 350454 - RNA, 62 nt, Homo Sapiens
cauuaaaauuucuuuguuaccagccucucacugugccuuauguugaggaugcuuaaugauuc

SEQ ID NO: 350455 - RNA, 62 nt, Homo Sapiens
ucgaagggaccagaagugcuuuacugacucuggugccuuauccccacagaacaacgggaacg

SEQ ID NO: 350456 - RNA, 62 nt, Homo Sapiens
gggaaauagccuggggugucucgguuucuucagugccuuacauccgguccugagagcuugca

SEQ ID NO: 350457 - RNA, 62 nt, Homo Sapiens
agggcugggauacuucugauuuguuucugugggugccuuauccugcuguuucagaggcuagg

SEQ ID NO: 350458 - RNA, 62 nt, Homo Sapiens
aacgaaaaccugugcuuguggauuuguucucagugccuuagcacccuucacugaguucucug

SEQ ID NO: 350459 - RNA, 62 nt, Homo Sapiens
gcauauuucaacuguucuucauaaauguuuaugugccuuaaaagacuuuauguuaaaggauu

SEQ ID NO: 350460 - RNA, 62 nt, Homo Sapiens
ccuucuggcaccccugggguucaauacuggaagugccuuauuuaaccagaccaucagggcau

SEQ ID NO: 350461 - RNA, 62 nt, Homo Sapiens
uuuauucauugaaacacgguugaccugaacucgugccuuaggaauuaaugcccccuuaugga

SEQ ID NO: 350462 - RNA, 62 nt, Homo Sapiens
auccuccuccagccuccuccagcccccaggcagugccuuaccuguggugcccagaaaagugc

SEQ ID NO: 350463 - RNA, 62 nt, Homo Sapiens
ggugggcgccccgaccacgacuuggcuuccuugugccuuaaaaaaccugccuuccugcagcc

SEQ ID NO: 350464 - RNA, 62 nt, Homo Sapiens
uggccuuuuaugagaggggacccgucaaaucugugccuuauggagggguccggcagcggcca

SEQ ID NO: 350465 - RNA, 62 nt, Homo Sapiens
ugcccagucuggccugcgcucccgccgcccuggugccuuagcccccggcacaggauggggca

SEQ ID NO: 350466 - RNA, 62 nt, Homo Sapiens
agugcgcccucccucccucccaucuggggguagugccuuaugcuggguguuggagcagagug

SEQ ID NO: 350467 - RNA, 62 nt, Homo Sapiens
ggugugacuuggccccucuggcuugucuuucugugccuuacuccuccuccugcgucucccgu

SEQ ID NO: 350468 - RNA, 62 nt, Homo Sapiens
aacuccucaccaggagagccaaagacaggguugugccuuaccccaggagccaccccuguacc

SEQ ID NO: 350469 - RNA, 62 nt, Homo Sapiens
cggacuggggccuccccaccucccucucggcugugccuuacggagccccgauccaggccucc

SEQ ID NO: 350470 - RNA, 62 nt, Homo Sapiens
caggucagcugcuuggggcucccaggcugggugugccuuagccacaggcagggcugucaaua

SEQ ID NO: 350471 - RNA, 62 nt, Homo Sapiens
cacccccagcuggcccuccacccccaccucaagugccuuauucucacagcaagccccuuagu

SEQ ID NO: 350472 - RNA, 62 nt, Homo Sapiens
ccauugccaaagcaugccugcccacccucgcugugccuuagucaguguguacgugugugugu

SEQ ID NO: 350473 - RNA, 62 nt, Homo Sapiens
ccugucuagagaccccaccucacccacaccgugugccuuacucaagagggggaugucagccu

SEQ ID NO: 350474 - RNA, 62 nt, Homo Sapiens
cuaagccucccauccuguguucuacuguaaaugugccuuagcgccucggauuuccuggcccc

SEQ ID NO: 350475 - RNA, 62 nt, Homo Sapiens
cgcucugugacacagucuacgaccuugauugugugccuuaaccauccccuuccuagcuguau

SEQ ID NO: 350476 - RNA, 62 nt, Homo Sapiens
gaacccgccgcgugcccagggacacaaaagacgugccuuaaggagccgcagcugcaaacucu

SEQ ID NO: 350477 - RNA, 62 nt, Homo Sapiens
gacauguuccugcugcagaucauaagugaucugugccuuaacuccugaaccacaaaccauag

SEQ ID NO: 350478 - RNA, 62 nt, Homo Sapiens
uaagucggggguggcaaggggggacgcgggcugugccuuacuccuuccgggccgggcggaag

SEQ ID NO: 350479 - RNA, 62 nt, Homo Sapiens
ucugugugugaucaguuucuagggcagggaccgugccuuaugacuagacugugagcuccucg

SEQ ID NO: 350480 - RNA, 62 nt, Homo Sapiens
gggcccucguccacccaaggccaccuccacaggugccuuaaacagcucccgccccucgcccc

SEQ ID NO: 350481 - RNA, 62 nt, Homo Sapiens
uauacuuauuuauuucaggauggggggcaucugugccuuauugacaguccuuccgugaggcc

SEQ ID NO: 350482 - RNA, 62 nt, Homo Sapiens
ucccgucagaagaaucagcaggacagaucguagugccuuauuccauuguccuccccuggcca

SEQ ID NO: 350483 - RNA, 62 nt, Homo Sapiens
acugccuaaagucacagcacagauacugcccagugccuuaagaggagacaugaucucuacca

SEQ ID NO: 350484 - RNA, 62 nt, Homo Sapiens
aagaccuacuugacgucauguggacagugcacgugccuuacgcuacaucuuguuuucuagga

SEQ ID NO: 350485 - RNA, 62 nt, Homo Sapiens
uugcucaugggauguugcaaagaacacaaagugugccuuagacauucucaagucaucagcgu

SEQ ID NO: 350486 - RNA, 62 nt, Homo Sapiens
ugucagauggcguggucugcagggggagcucugugccuuaguggcucuuggcaggacacuga

SEQ ID NO: 350487 - RNA, 62 nt, Homo Sapiens
gggaagcccagugaggcauugcugcccugcuugugccuuagucccacagcaggcuguaccag

SEQ ID NO: 350488 - RNA, 62 nt, Homo Sapiens
ccuugggcugggggagggggugcagccaccuggugccuuagucuguguccgggccggccugc

SEQ ID NO: 350489 - RNA, 62 nt, Homo Sapiens
uuggauccucuagaaacuaaggcccaaggacagugccuuaguuaaaacccuuuuuaggcaag

SEQ ID NO: 350490 - RNA, 62 nt, Homo Sapiens
cucccuauucagaaagcuccuacucagcaggugugccuuaacuacacaagaaauauuuguuu

SEQ ID NO: 350491 - RNA, 62 nt, Homo Sapiens
gaagaagcagugacacucccgacgcgucucuagugccuuacuaacguaucuuuccuuuaugu

SEQ ID NO: 350492 - RNA, 62 nt, Homo Sapiens
aaggauugucuaauuucaauugugcaagacaugugccuuauaauuauuuuuagcuuaaaauu

SEQ ID NO: 350493 - RNA, 62 nt, Homo Sapiens
uuuagaaguguguucuuuaaagaggaauucgugugccuuagaauaaucuuacucugugaaau

SEQ ID NO: 350494 - RNA, 62 nt, Homo Sapiens
cccacacuugacugggcugugagcacagaggagugccuuauccucuaccauaucuuagcuca

SEQ ID NO: 350495 - RNA, 62 nt, Homo Sapiens
uuuuaaccaguuuccaauaaauaaagcuuggagugccuuaauacuguaaccucaaggaaacc

SEQ ID NO: 350496 - RNA, 62 nt, Homo Sapiens
ggccgcucuccagcucaccacagugucuccacgugccuuaccccuucuccuucaggccaagu

SEQ ID NO: 350497 - RNA, 62 nt, Homo Sapiens
cagcuuugaagaaacuaggauaagccauucaagugccuuacaacuuuuccaggugguguuaa

SEQ ID NO: 350498 - RNA, 62 nt, Homo Sapiens
uuacugaaugaauaggguuugcucauuuguuugugccuuacuuuugaauaaagugaacagag

SEQ ID NO: 350499 - RNA, 62 nt, Homo Sapiens
ccacagccgaagaauccguggcagaacacacagugccuuaugccagccaugagcgccuuccu

SEQ ID NO: 350500 - RNA, 62 nt, Homo Sapiens
auguguugcagcugucaccauauauaauaaaagugccuuagcucccacccuacccccuuuuu

SEQ ID NO: 350501 - RNA, 62 nt, Homo Sapiens
aggugaguggucuuucgaagugaauuauacaugugccuuaccccagaguccucacaccugaa

SEQ ID NO: 350502 - RNA, 62 nt, Homo Sapiens
uuccuaccuagcuccuuguuggugagcuucuugugccuuaauccugugacccagccccuuac

SEQ ID NO: 350503 - RNA, 62 nt, Homo Sapiens
agggaaacaguugaaacuguuuaaaaauagaugugccuuauuuauugcaggcuuucuuuccc

SEQ ID NO: 350504 - RNA, 62 nt, Homo Sapiens
guauuucuuuguuauacauuuaaagauuuaaagugccuuaucaaauaauauucaugaagagu

SEQ ID NO: 350505 - RNA, 62 nt, Homo Sapiens
guguuugaaaaagaagggggggagaauuccaggugccuuaauauaaaguuugaagcuucauc

SEQ ID NO: 350506 - RNA, 62 nt, Homo Sapiens
cuaaucauguuuucgucacaugcugaguaaaagugccuuacaauguaaaaauuguacaguac

SEQ ID NO: 350507 - RNA, 62 nt, Homo Sapiens
cucucuuguggaauugcauucaaaccagaacagugccuuagaauggaugugcccaacugcuc

SEQ ID NO: 350508 - RNA, 62 nt, Homo Sapiens
aggcccggcuguggcuccaccuccagcucuccgugccuuaagggaaaagcgggacagcuccc

SEQ ID NO: 350509 - RNA, 62 nt, Homo Sapiens
uccagugcccgcccuguggggccaaggcggccgugccuuacuacucugugucuucugccucc

SEQ ID NO: 350510 - RNA, 62 nt, Homo Sapiens
uagacucuucauuuacuuuucuuucauaugaagugccuuaaguugugaaaauuuugaauuag

SEQ ID NO: 350511 - RNA, 62 nt, Homo Sapiens
aagcaauccucugucaaaauagaagauguguagugccuuaacauaguuaaucauuuaaccaa

SEQ ID NO: 350512 - RNA, 62 nt, Homo Sapiens
aaggcaccaugaccaccuggugugaccucucugugccuuacugaggcaccuuucuagagauu

SEQ ID NO: 350513 - RNA, 64 nt, Homo Sapiens; identical to SEQ ID NO: 219184

SEQ ID NO: 350514 - RNA, 64 nt, Homo Sapiens; identical to SEQ ID NO: 219185

SEQ ID NO: 350515 - RNA, 64 nt, Homo Sapiens; identical to SEQ ID NO: 219186

SEQ ID NO: 350516 - RNA, 64 nt, Homo Sapiens; identical to SEQ ID NO: 219187

SEQ ID NO: 350517 - RNA, 64 nt, Homo Sapiens; identical to SEQ ID NO: 219188

SEQ ID NO: 350518 - RNA, 64 nt, Homo Sapiens; identical to SEQ ID NO: 219189

SEQ ID NO: 350519 - RNA, 64 nt, Homo Sapiens; identical to SEQ ID NO: 219190

SEQ ID NO: 350520 - RNA, 64 nt, Homo Sapiens; identical to SEQ ID NO: 219191

SEQ ID NO: 350521 - RNA, 64 nt, Homo Sapiens; identical to SEQ ID NO: 219192

SEQ ID NO: 350522 - RNA, 64 nt, Homo Sapiens; identical to SEQ ID NO: 219193

SEQ ID NO: 350523 - RNA, 64 nt, Homo Sapiens; identical to SEQ ID NO: 219194

SEQ ID NO: 350524 - RNA, 64 nt, Homo Sapiens; identical to SEQ ID NO: 219195

SEQ ID NO: 350525 - RNA, 64 nt, Homo Sapiens; identical to SEQ ID NO: 219196

SEQ ID NO: 350526 - RNA, 64 nt, Homo Sapiens; identical to SEQ ID NO: 219197

SEQ ID NO: 350527 - RNA, 64 nt, Homo Sapiens; identical to SEQ ID NO: 219198

SEQ ID NO: 350528 - RNA, 64 nt, Homo Sapiens; identical to SEQ ID NO: 219199

SEQ ID NO: 350529 - RNA, 64 nt, Homo Sapiens; identical to SEQ ID NO: 219200

SEQ ID NO: 350530 - RNA, 64 nt, Homo Sapiens; identical to SEQ ID NO: 219201

SEQ ID NO: 350531 - RNA, 64 nt, Homo Sapiens; identical to SEQ ID NO: 219202

SEQ ID NO: 350532 - RNA, 64 nt, Homo Sapiens; identical to SEQ ID NO: 219203

SEQ ID NO: 350533 - RNA, 64 nt, Homo Sapiens; identical to SEQ ID NO: 219204

SEQ ID NO: 350534 - RNA, 64 nt, Homo Sapiens; identical to SEQ ID NO: 219205

SEQ ID NO: 350535 - RNA, 64 nt, Homo Sapiens; identical to SEQ ID NO: 219206

SEQ ID NO: 350536 - RNA, 64 nt, Homo Sapiens; identical to SEQ ID NO: 219207

SEQ ID NO: 350537 - RNA, 64 nt, Homo Sapiens; identical to SEQ ID NO: 219208

SEQ ID NO: 350538 - RNA, 64 nt, Homo Sapiens; identical to SEQ ID NO: 219209

SEQ ID NO: 350539 - RNA, 64 nt, Homo Sapiens; identical to SEQ ID NO: 219210

SEQ ID NO: 350540 - RNA, 64 nt, Homo Sapiens; identical to SEQ ID NO: 219211

SEQ ID NO: 350541 - RNA, 64 nt, Homo Sapiens; identical to SEQ ID NO: 219212

SEQ ID NO: 350542 - RNA, 64 nt, Homo Sapiens; identical to SEQ ID NO: 219213

SEQ ID NO: 350543 - RNA, 58 nt, Homo Sapiens
cugcguguggccacuccucagcauccuccccacccaccaugguucauuccgacuuuuc

SEQ ID NO: 350544 - RNA, 58 nt, Homo Sapiens
acguggccuucagaggaauccacagguccccacccaagaucccucaauuauaugggga

SEQ ID NO: 350545 - RNA, 58 nt, Homo Sapiens
cacugguuaggaaggauguucaaacggucccacccaagccugucaccucugcucaucc

SEQ ID NO: 350546 - RNA, 58 nt, Homo Sapiens
ccuaccaagcucgagcuggcccuugacccccacccacccccacccuugcuggcagggg

SEQ ID NO: 350547 - RNA, 58 nt, Homo Sapiens
ccccauggagcagccagcguuagaugcccccacccaccuguacucuggagagacugug

SEQ ID NO: 350548 - RNA, 58 nt, Homo Sapiens
ggcaaaauaaucuaaaaagacuaaccugcccacccacuccuuauauugcugugagauu

SEQ ID NO: 350549 - RNA, 58 nt, Homo Sapiens
aggccauccccucuucuaccuccugcaacccacccauccuauuagccucccacauuca

SEQ ID NO: 350550 - RNA, 58 nt, Homo Sapiens
gggcuucuccugagguaaugauuacccccccacccacagcugagucugugaggcccca

SEQ ID NO: 350551 - RNA, 58 nt, Homo Sapiens
cacaacacugggacaauucacacacccacccacccacagcagggugcucacacacccc

SEQ ID NO: 350552 - RNA, 58 nt, Homo Sapiens
cacacacaacacugggacaacccccacacccacccacccaucgcagggugcucacaca

SEQ ID NO: 350553 - RNA, 58 nt, Homo Sapiens
acggcugugaugagguggcccaaacucccccacccaggauccaccggcugcacaggca

SEQ ID NO: 350554 - RNA, 58 nt, Homo Sapiens
cccacaggucgauuuggucugggcccuccccacccacaagaggccuagggagguuuua

SEQ ID NO: 350555 - RNA, 58 nt, Homo Sapiens
cccgugauggcuccuuggggucugccugcccacccacaugagcccgcgaguauggcag

SEQ ID NO: 350556 - RNA, 58 nt, Homo Sapiens
uagguuagcggagcuuuuuccucuuuuccccacccaucuccccaauauugcccauuau

SEQ ID NO: 350557 - RNA, 58 nt, Homo Sapiens
uagggcagaggggucaggauaucucccacccacccagcgcccacuagcagcccccagc

SEQ ID NO: 350558 - RNA, 58 nt, Homo Sapiens
cagcuagggcagaggggucacagcaucucccacccaccgggggcccacuagcagcccc

SEQ ID NO: 350559 - RNA, 58 nt, Homo Sapiens
uuaaaaaagauaccuuauccuauuccuccccacccacccauguuuuuaaacuaauuua

SEQ ID NO: 350560 - RNA, 58 nt, Homo Sapiens
aaaagauaccuuauccuauuccuccccacccacccauguuuuuaaacuaauuuauaua

SEQ ID NO: 350561 - RNA, 58 nt, Homo Sapiens
ccgcuguuccgcugcagccccgcccugccccacccacccagugccuugcugaagccca

SEQ ID NO: 350562 - RNA, 58 nt, Homo Sapiens
uguuccgcugcagccccgcccugccccacccacccagugccuugcugaagcccauagc

SEQ ID NO: 350563 - RNA, 58 nt, Homo Sapiens
ccauucacccucaccucuccccuucccacccacccaguuuucuuuuauuucagugcug

SEQ ID NO: 350564 - RNA, 58 nt, Homo Sapiens
caguccauucacccucaccugcugccuucccacccaccgccuuuucuuuuauuucagu

SEQ ID NO: 350565 - RNA, 58 nt, Homo Sapiens
ccuucgacgcgacgccuacggcggcguucccacccacauccuccuggccuucugacgg

SEQ ID NO: 350566 - RNA, 58 nt, Homo Sapiens
ugcgcccucggcucggucuccuucccuucccacccagccccgucucccggccgccccu

SEQ ID NO: 350567 - RNA, 58 nt, Homo Sapiens
cucugacgagaggcuuuuccccaccagacccacccacguggccugagcagggggccug

SEQ ID NO: 350568 - RNA, 58 nt, Homo Sapiens
acucuggccaaaaauggcucccaagucucccacccagagagucugggucucacuggcc

SEQ ID NO: 350569 - RNA, 58 nt, Homo Sapiens
cccaaagccaccggcaugugagaguaugcccacccagccuguggccuuuuaacauuca

SEQ ID NO: 350570 - RNA, 58 nt, Homo Sapiens
gaggcagugagacugcaggugggcugggcccacccagggagcugaugccccuucuccc

SEQ ID NO: 350571 - RNA, 58 nt, Homo Sapiens
uguucuuccuuccuagaagccccugucgcccacccagcugguccuguggaugggaucc

SEQ ID NO: 350572 - RNA, 50 nt, Homo Sapiens; identical to SEQ ID NO: 56468

SEQ ID NO: 350573 - RNA, 58 nt, Homo Sapiens
cuucuaccacucuuaaauuuacucccuccccacccagaacccagaugggguggagggg

SEQ ID NO: 350574 - RNA, 58 nt, Homo Sapiens
ccuccccccccgccccucugcuucccuccccacccaccaccucaaggguagggaguug

SEQ ID NO: 350575 - RNA, 58 nt, Homo Sapiens
cuggcaggccugcugugugccaaaaacucccacccaaggucccucaggggauauuuca

SEQ ID NO: 350576 - RNA, 58 nt, Homo Sapiens
uaugacccccucccccaggacaccaccucccacccacagaccuucccuuuagcuguug

SEQ ID NO: 350577 - RNA, 58 nt, Homo Sapiens
gaagcccccucucccugguccucuccuacccacccauguccucucagaaccccagccu

SEQ ID NO: 350578 - RNA, 58 nt, Homo Sapiens
uagaggacagaaaaaugugaagagacgccccacccacccucagccagcccucuccagu

SEQ ID NO: 350579 - RNA, 58 nt, Homo Sapiens
ccccugcagcccugcugcacgacaugaccccacccagccauaguacaguucuucagug

SEQ ID NO: 350580 - RNA, 58 nt, Homo Sapiens
gggcccugaagcagggccaacacaccuacccacccaguucuguccccaucuuccuccc

SEQ ID NO: 350581 - RNA, 58 nt, Homo Sapiens
agacugaggggcagaggcacacacaggccccacccagccagcuggaggcuggagggag

SEQ ID NO: 350582 - RNA, 58 nt, Homo Sapiens
ccuucucaguccagcuggaguguggcuucccacccaaagaauuggagaaauggagcuc

SEQ ID NO: 350583 - RNA, 58 nt, Homo Sapiens
gcagugcccuccucgccugugcagcccgcccacccacaggcucaccccuccugccggc

SEQ ID NO: 350584 - RNA, 58 nt, Homo Sapiens
ccgccuucuuggugccaaacccccuucccccacccagagacugggcagcugugucugg

SEQ ID NO: 350585 - RNA, 58 nt, Homo Sapiens
cugguugggagcagccccuggcccauugcccacccacccaucucacuaugcaauucga

SEQ ID NO: 350586 - RNA, 58 nt, Homo Sapiens
uugggagcagccccuggcccauugcccacccacccaucucacuaugcaauucgaguuc

SEQ ID NO: 350587 - RNA, 58 nt, Homo Sapiens
uuucuuuuuauggccccaggcuccuucccccacccagcauucucugaauuuauuuccu

SEQ ID NO: 350588 - RNA, 58 nt, Homo Sapiens
uuuuuucuuugguugcuuuuagucuccccccacccaccuuggggcuacgcgccaggag

SEQ ID NO: 350589 - RNA, 58 nt, Homo Sapiens
uccaucacccauccaauaaaauaguacucccacccacuccauauaucccuccuuuacc

SEQ ID NO: 350590 - RNA, 58 nt, Homo Sapiens
uaucccuccuuuaccauaguugguggcucccacccauagggggaugggggacuuuugu

SEQ ID NO: 350591 - RNA, 58 nt, Homo Sapiens
cccagucuccccgagucacagugccgaucccacccacccaccguagggugcacagcaa

SEQ ID NO: 350592 - RNA, 58 nt, Homo Sapiens
gucuccccgagucacagugccgaucccacccacccaccguagggugcacagcaaggca

SEQ ID NO: 350593 - RNA, 58 nt, Homo Sapiens
auguccuggcucacuccgcacccccccacccacccaggccuccccacuggagggcaag

SEQ ID NO: 350594 - RNA, 58 nt, Homo Sapiens
caggauguccuggcucacuccaagcccccccacccacccuuuccuccccacuggaggg

SEQ ID NO: 350595 - RNA, 58 nt, Homo Sapiens
acacuggacuuuucuagagaugcacccacccacccaccuggcuuacuauuucauugug

SEQ ID NO: 350596 - RNA, 58 nt, Homo Sapiens
caccacacuggacuuuucuaugugugcacccacccaccgguguggcuuacuauuucau

SEQ ID NO: 350597 - RNA, 58 nt, Homo Sapiens
agguagcugugauacaaaccccaggacacccacccacccaaagagccaaagaauaguu

SEQ ID NO: 350598 - RNA, 58 nt, Homo Sapiens
agcugugauacaaaccccaggacacccacccacccaaagagccaaagaauaguuccug

SEQ ID NO: 350599 - RNA, 58 nt, Homo Sapiens
gguggcccucccaggcugguauccuagccccacccagagaacguuugguacaaucgac

SEQ ID NO: 350600 - RNA, 58 nt, Homo Sapiens
gagaacguuugguacaaucguucccucucccacccaaguuugcuccaggcaucacuga

SEQ ID NO: 350601 - RNA, 58 nt, Homo Sapiens
ccaggcauguggcagggguucagaaagccccacccagggugcccugagccagggucuc

SEQ ID NO: 350602 - RNA, 58 nt, Homo Sapiens
aacccucagggcaaagccagucgccuuccccacccacccccagacgccuggcugcuga

SEQ ID NO: 350603 - RNA, 58 nt, Homo Sapiens
uuccuuccucuucccucuuccuaccagccccacccacccugcagcaccuuaguccaua

SEQ ID NO: 350604 - RNA, 58 nt, Homo Sapiens
ccaggauguuaggguccccuggcccugccccacccacucccaccuagaggagaccaug

SEQ ID NO: 350605 - RNA, 58 nt, Homo Sapiens
ccuugggcuggggccugcggaggggaagcccacccacaaugcauggaguauuauuuuu

SEQ ID NO: 350606 - RNA, 58 nt, Homo Sapiens
guccuggccccugugaugcucccccauccccacccacuucuacauccauccacacccc

SEQ ID NO: 350607 - RNA, 58 nt, Homo Sapiens
guccugcccacagcgcccuguaccugcucccacccagcccuuggugugcccacccagc

SEQ ID NO: 350608 - RNA, 58 nt, Homo Sapiens
uaccugcucccacccagcccuuggugugcccacccagccuccucuccagcaccuugcu

SEQ ID NO: 350609 - RNA, 58 nt, Homo Sapiens
agccaagaagaucaagucucagcaccggcccacccaaagauucuggcccaacuccauc

SEQ ID NO: 350610 - RNA, 58 nt, Homo Sapiens
ucccugaggauagauggcacccauggcccccacccacggaaggacuugaguuguuuac

SEQ ID NO: 350611 - RNA, 58 nt, Homo Sapiens
agccugcggggaugcccaucccacacaccccacccagcuguucuaacccugcuaucca

SEQ ID NO: 350612 - RNA, 58 nt, Homo Sapiens
cuccacuguccacccuaacacauacccucccacccaccuuccagacccccuugguugg

SEQ ID NO: 350613 - RNA, 58 nt, Homo Sapiens
uuaauugugcuuagagcccacucacccacccacccaguugcaucugaauaggccuacc

SEQ ID NO: 350614 - RNA, 58 nt, Homo Sapiens
caguuuaauugugcuuagaguacccucacccacccaccgccuugcaucugaauaggcc

SEQ ID NO: 350615 - RNA, 58 nt, Homo Sapiens
caugacucuaaguguguugucccccagccccacccacugcagcuccccaaggcccugc

SEQ ID NO: 350616 - RNA, 58 nt, Homo Sapiens
cccucagguggcacaucuggggccagugcccacccagccugcuucuugccuaccacuu

SEQ ID NO: 350617 - RNA, 58 nt, Homo Sapiens
ccacaggccagccuacucuuccucuccucccacccacggccgagugcccucuccgucc

SEQ ID NO: 350618 - RNA, 58 nt, Homo Sapiens
cacagccacugccucccccuugucugugcccacccaggucagggccauguaccagauc

SEQ ID NO: 350619 - RNA, 58 nt, Homo Sapiens
cuuccccaacccuggauaccaguagcuucccacccaguccaaaccugcaccauccauc

SEQ ID NO: 350620 - RNA, 58 nt, Homo Sapiens
ucaucuguaggauuugggcugccccaggcccacccagggggcucugaauguauuuugu

SEQ ID NO: 350621 - RNA, 58 nt, Homo Sapiens
agcccccuuuguuacuuaggugggaaaccccacccaaacuccuccucuugaacuuggg

SEQ ID NO: 350622 - RNA, 58 nt, Homo Sapiens
ugcggcuaagucucuuuuuccugguuuccccacccaacugguacugccucugaacacu

SEQ ID NO: 350623 - RNA, 58 nt, Homo Sapiens
uuccccuuagagugcugugagaacuccucccacccaaccagaccucucccacccacaa

SEQ ID NO: 350624 - RNA, 58 nt, Homo Sapiens
agaacuccucccacccaacuagaccucucccacccacaaucggcuuccucaggggcac

SEQ ID NO: 350625 - RNA, 58 nt, Homo Sapiens
ucucaccaguggccugcccucucgcucccccacccagcccacccauugaagucuccuu

SEQ ID NO: 350626 - RNA, 58 nt, Homo Sapiens
uggccugcccucucgcucccccacccagcccacccauugaagucuccuugggccacca

SEQ ID NO: 350627 - RNA, 58 nt, Homo Sapiens
ugcaggcccaggcaggcccagccucugccccacccaucaguggaguccagauggcagg

SEQ ID NO: 350628 - RNA, 58 nt, Homo Sapiens
cucccgaccccauccaccuauccaccaccccacccaccuuugcagggaauaccucguu

SEQ ID NO: 350629 - RNA, 58 nt, Homo Sapiens
ccagaugguacagccuguugaccuaugacccacccagguauacaaaccuagaugggac

SEQ ID NO: 350630 - RNA, 58 nt, Homo Sapiens
acauuuuaauaguaaauagacccccacccccacccaagcugacaaguugacucuucga

SEQ ID NO: 350631 - RNA, 58 nt, Homo Sapiens
cugcuccccacacggacuccaggcgguccccacccacagaagcagaccuucagcucag

SEQ ID NO: 350632 - RNA, 58 nt, Homo Sapiens
ggguggcccuggaggccccugaccccaccccacccacagagcacgagggccccgucag

SEQ ID NO: 350633 - RNA, 58 nt, Homo Sapiens
ugucucauuguggcugccuagggacccccccacccacgccucccucagcaccaagacc

SEQ ID NO: 350634 - RNA, 58 nt, Homo Sapiens
cacccccucccggggcagcaauagcuuccccacccaggcccccacaccagaccccaac

SEQ ID NO: 350635 - RNA, 58 nt, Homo Sapiens
ccugagaguuauaggaagugcccacugacccacccacccaccuacaccccccgccaca

SEQ ID NO: 350636 - RNA, 58 nt, Homo Sapiens
agaguuauaggaagugcccacugacccacccacccaccuacaccccccgccacacaca

SEQ ID NO: 350637 - RNA, 58 nt, Homo Sapiens
gcaguauccauaacccccugcccacguccccacccacgggggagacggagagauauaa

SEQ ID NO: 350638 - RNA, 58 nt, Homo Sapiens
ggccuggagggcacuuccuccacagucccccacccaccuccugcggcucagccuugca

SEQ ID NO: 350639 - RNA, 58 nt, Homo Sapiens
ggagaacagcaagaucuagggcaccagccccacccacuggcuguuucuccguccucuc

SEQ ID NO: 350640 - RNA, 58 nt, Homo Sapiens
aaaagagcuaaccccuucccacacuccacccacccaccuacauuuccucugugaaauc

SEQ ID NO: 350641 - RNA, 58 nt, Homo Sapiens
caaaagcagaaguggaccaccaucagcucccacccacccagcgauuuuuccuuggagg

SEQ ID NO: 350642 - RNA, 58 nt, Homo Sapiens
agcagaaguggaccaccaucagcucccacccacccagcgauuuuuccuuggaggucag

SEQ ID NO: 350643 - RNA, 58 nt, Homo Sapiens
ucuucaccuccuuggcgcugccaccugccccacccaguuucuggaaaaaguugaugcu

SEQ ID NO: 350644 - RNA, 58 nt, Homo Sapiens
gcugagccuccuugucuauccuuccucccccacccaccauuguaaaguuuaugucacc

SEQ ID NO: 350645 - RNA, 58 nt, Homo Sapiens
agcgggucaggccuucagaacacugccacccacccaguuuuauaaucccgcucccucu

SEQ ID NO: 350646 - RNA, 58 nt, Homo Sapiens
uuauaaucccgcucccucuccaggcaaccccacccaccagccuaggccugcuccucca

SEQ ID NO: 350647 - RNA, 58 nt, Homo Sapiens
caguggucgagcacugccccgagaccagcccacccagccugggccugcaggagaggcu

SEQ ID NO: 350648 - RNA, 58 nt, Homo Sapiens
cuccagaagcuggaaccauuaccccacccccacccagcucuaucccacacccaccccc

SEQ ID NO: 350649 - RNA, 58 nt, Homo Sapiens
cuuggagcuggaugccugugcugagucacccacccagcucccugggggcgauuagcug

SEQ ID NO: 350650 - RNA, 58 nt, Homo Sapiens
gccuuuccuuggcccucacuucuaugggcccacccaguaggccacugcugggacaggg

SEQ ID NO: 350651 - RNA, 58 nt, Homo Sapiens
cguaccagaaauaaaggcuuaccagucccccacccagcccggcagaggacgggaggag

SEQ ID NO: 350652 - RNA, 58 nt, Homo Sapiens
agcaggcccccaacccccagagugccggcccacccaccgcacgcggcccucuccuguc

SEQ ID NO: 350653 - RNA, 58 nt, Homo Sapiens
aggguggggcgggcugggguuggagggucccacccaccacccugcugugcuugggaac

SEQ ID NO: 350654 - RNA, 58 nt, Homo Sapiens
uuugaggcuagacggggaggggccaggacccacccacugcuccugggggaugaggucc

SEQ ID NO: 350655 - RNA, 58 nt, Homo Sapiens
aagcggagaccagggugcaggcuccgcccccacccaaggccgggcccagccagaggag

SEQ ID NO: 350656 - RNA, 58 nt, Homo Sapiens
caggucugagcagggagcaacucaggcccccacccaagccugcgucagcggaacuuga

SEQ ID NO: 350657 - RNA, 58 nt, Homo Sapiens
aagugacucagccugguuggagaacugccccacccaguaucuucugugccaugguucc

SEQ ID NO: 350658 - RNA, 58 nt, Homo Sapiens
caaauaaguacgauaacauagucauagucccacccaacaugaugcaguuaucuugcau

SEQ ID NO: 350659 - RNA, 58 nt, Homo Sapiens
cacaggccccacuugcuaagacccccaucccacccaacuaacuccagcccccacccac

SEQ ID NO: 350660 - RNA, 58 nt, Homo Sapiens
cccccaucccacccaaccaccuccagcccccacccacaaaagaggggcucacgcuuaa

SEQ ID NO: 350661 - RNA, 58 nt, Homo Sapiens
ucuguagagucccagaaacaccuacccacccacccaccugcgaacucacagugacugu

SEQ ID NO: 350662 - RNA, 58 nt, Homo Sapiens; identical to SEQ ID NO: 56558

SEQ ID NO: 350663 - RNA, 58 nt, Homo Sapiens
gcgcagucuccaccucggccccugcauucccacccagcuggcugugccgggcagccau

SEQ ID NO: 350664 - RNA, 58 nt, Homo Sapiens
gcagcaccagccccggccacgagugcgucccacccaacgggcccacaggcagggguau

SEQ ID NO: 350665 - RNA, 58 nt, Homo Sapiens
cccagaaguggggagagacuuugggccucccacccaguggggcuuggccuggcuucug

SEQ ID NO: 350666 - RNA, 58 nt, Homo Sapiens
ccagcgaaucugccugggcugcuccugucccacccacccucacugagauccauguaag

SEQ ID NO: 350667 - RNA, 58 nt, Homo Sapiens
aggggucccagcccgucuaccuccccaucccacccaggcccccagcuccccgcggggg

SEQ ID NO: 350668 - RNA, 58 nt, Homo Sapiens
uucaucaccacucgggggcaccgggccgcccacccacucccaaaauccgucaguauuc

SEQ ID NO: 350669 - RNA, 58 nt, Homo Sapiens
ucagggccuggguauccagcgagcccuccccacccacccacgguccucaccuggagcu

SEQ ID NO: 350670 - RNA, 58 nt, Homo Sapiens
ggccuggguauccagcgagcccuccccacccacccacgguccucaccuggagcugugg

SEQ ID NO: 350671 - RNA, 58 nt, Homo Sapiens
cuggacuuggccccaugggagucgcucucccacccagcccuugcggcccuggcucuga

SEQ ID NO: 350672 - RNA, 58 nt, Homo Sapiens
ucugggcucccaggcagggaaucccacucccacccaugggcccuccugcuccaccccc

SEQ ID NO: 350673 - RNA, 58 nt, Homo Sapiens
cugagaugacaguggcugaccgcacagccccacccacugccucagaauccaggagaua

SEQ ID NO: 350674 - RNA, 58 nt, Homo Sapiens
accugccuggagaggaacgguuccugcccccacccaccagggccugcccggccuccug

SEQ ID NO: 350675 - RNA, 58 nt, Homo Sapiens
ccaggucggcuuguuucucacacaggcacccacccacagcccuccucccauccacaca

SEQ ID NO: 350676 - RNA, 58 nt, Homo Sapiens
ccauccuacccagggaccccccuggcaccccacccacucaccagaaagcaccaaagcc

SEQ ID NO: 350677 - RNA, 58 nt, Homo Sapiens
gcugagucugugaggccccauuuacccccccacccacaggcuucuccugagguaauga

SEQ ID NO: 350678 - RNA, 58 nt, Homo Sapiens
cuauuagccucccacauucuuccugcaacccacccaucaggccauccccucuucuacc

SEQ ID NO: 350679 - RNA, 58 nt, Homo Sapiens
cacgaccugcucaccaccuaugccguuacccacccacagguguccuacugccagggca

SEQ ID NO: 350680 - RNA, 58 nt, Homo Sapiens
uccaggagggacccucugguccagcugccccacccagcugcccuuaucagcuccaagu

SEQ ID NO: 350681 - RNA, 58 nt, Homo Sapiens
gggguaaauccugaggcuuuggugcucccccacccacccauucccgcccuuugcagca

SEQ ID NO: 350682 - RNA, 58 nt, Homo Sapiens
uaaauccugaggcuuuggugcucccccacccacccauucccgcccuuugcagcagccc

SEQ ID NO: 350683 - RNA, 58 nt, Homo Sapiens
cuguagugacccacgcguccagcagacgcccacccaccgcuagccguuguuccugugc

SEQ ID NO: 350684 - RNA, 58 nt, Homo Sapiens
guuccugugcaaaguagugugcuaugcacccacccagguggccgccucugggcccaag

SEQ ID NO: 350685 - RNA, 58 nt, Homo Sapiens
ucuucauuuggaggaaucaccucuguuccccacccaguagaaucuaggccaccccaac

SEQ ID NO: 350686 - RNA, 58 nt, Homo Sapiens
aaaggaggaccagucaggaugggacuuucccacccaggucaggccucaccccuccccu

SEQ ID NO: 350687 - RNA, 64 nt, Homo Sapiens
ccaacaguccuaaacugucaacagaggacuuucugugauucauaacuuucugugauucauacca

SEQ ID NO: 350688 - RNA, 64 nt, Homo Sapiens
ccaacagaggacuuucugugaaacgguacuuucugugauucauacuuuucuuuucacuguauau

SEQ ID NO: 350689 - RNA, 64 nt, Homo Sapiens
gguaugaagaauuuuuugauugcagugaggacuugugauucacuguuggauuuguuaugucugu

SEQ ID NO: 350690 - RNA, 64 nt, Homo Sapiens
uucugauaaaauauuugucuaauacucacaacaugugauucauuagaaggaaacagauauuuua

SEQ ID NO: 350691 - RNA, 64 nt, Homo Sapiens
agucuuucaaggcuugagacuaauauaggccauugugauucaggaagaaacccaagguuggagg

SEQ ID NO: 350692 - RNA, 64 nt, Homo Sapiens
caggugguuuuaaaguuaacagggguuugucauggugauucacuacucaguuuaucagcucaag

SEQ ID NO: 350693 - RNA, 64 nt, Homo Sapiens
aaaugugugaaaccaaaaugaucacugccuacuugugauucaaaucuucagaguuuuccuaguu

SEQ ID NO: 350694 - RNA, 64 nt, Homo Sapiens
gauagaguggagguaaauuaagagccuccaggcugugauucaccauuugagacauuauacauaa

SEQ ID NO: 350695 - RNA, 64 nt, Homo Sapiens
auuuaaaaacacuguaauccauaggugcugaauugugauucacagccuuauuaguuauaacaug

SEQ ID NO: 350696 - RNA, 64 nt, Homo Sapiens
uaggacuucuuucaucaauuuggccuacaauagugugauucaugaacagcugcuguaacuaguc

SEQ ID NO: 350697 - RNA, 63 nt, Homo Sapiens
guauauaggcuuuugacaaaucauggauuugggcaaacugaauauuuuacaauugugaaaacc

SEQ ID NO: 350698 - RNA, 63 nt, Homo Sapiens
auguguuacaagaaaaauaugcauuaaauuauacaaacugaaaaaaggcaaacauaggucugg

SEQ ID NO: 350699 - RNA, 63 nt, Homo Sapiens
ggaagggcugcuaucaaaccuaccuuuuuugagcaaacugagacuaaacuucucucuuuucaa

SEQ ID NO: 350700 - RNA, 63 nt, Homo Sapiens
uuuucuaaacagaaauuauuuucuauuaauuugcaaacugaugauuucacuuuuuuuuacuuu

SEQ ID NO: 350701 - RNA, 63 nt, Homo Sapiens
gaauacuagauaggagagacaguacaagcugggcaaacugacaccauuagaagcaaaauuaaa

SEQ ID NO: 350702 - RNA, 63 nt, Homo Sapiens
acaauuaaaauucugacaguaguaccagccguccaaacugaucuggauugugagaaaguacca

SEQ ID NO: 350703 - RNA, 63 nt, Homo Sapiens
aagcaggccgggcauggugggagcuuaaagauccaaacugagacuuucaugcuucugggguug

SEQ ID NO: 350704 - RNA, 63 nt, Homo Sapiens
ugguugaaugauagcauuucgccccgggggcagcaaacugacaagaaagguuugguuugaaau

SEQ ID NO: 350705 - RNA, 63 nt, Homo Sapiens
acauguuaaggcuauaguuuuucuucccaggaucaaacugaaacuucauucagggcauauuuu

SEQ ID NO: 350706 - RNA, 63 nt, Homo Sapiens
caauuuaacaauccugacaugagauaaacaagacaaacugaguaagauuuagaagauauuuug

SEQ ID NO: 350707 - RNA, 61 nt, Homo Sapiens
aaaaaaaaaaacaaaaaaagcaagugacacgcacaaacugacauguguuugguuucugauu

SEQ ID NO: 350708 - RNA, 63 nt, Homo Sapiens
auaagaaaacaaaaaucaaaguaaagaaacugacaaacugaaagcuagaaaaaaauaauggua

SEQ ID NO: 350709 - RNA, 63 nt, Homo Sapiens
aaaauuaaaagaagaggaagaaagagaaauaaucaaacugaccaugaaguaagcagcacuuaa

SEQ ID NO: 350710 - RNA, 63 nt, Homo Sapiens
aucagucaugugaaguauuugucuaaaacagagcaaacugaagaccaaauuauucuccuguug

SEQ ID NO: 350711 - RNA, 63 nt, Homo Sapiens
agcacucagagggacuuaugccucacccaccuccaaacugacuuuuuaaguacccccuuuccu

SEQ ID NO: 350712 - RNA, 63 nt, Homo Sapiens
uucuaggcagacaguugucuaucuugaaagaaacaaacugacagggaaguccagaugcggguu

SEQ ID NO: 350713 - RNA, 64 nt, Homo Sapiens
cuuguaacccagcacuuuggaguggccaggagcgguagcucauaauacauuagaaauggacaaa

SEQ ID NO: 350714 - RNA, 64 nt, Homo Sapiens
aaggaauagagggaggagugauucuacgggggcaguagcucaacuuuggguauaaaggaggggg

SEQ ID NO: 350715 - RNA, 64 nt, Homo Sapiens
cauuuaaaaaauauauaaauaugacuguuguacuguagcucaguuuagacaaccacugaacuag

SEQ ID NO: 350716 - RNA, 64 nt, Homo Sapiens
gguguggggaaacguuccccugaucgcugguaaaguagcucaguagccuauuccaucacaauca

SEQ ID NO: 350717 - RNA, 64 nt, Homo Sapiens
cagaauuugagaaccuuggaccacuccugucccuguagcucagucaucaaagcagaagucuggc

SEQ ID NO: 350718 - RNA, 64 nt, Homo Sapiens
guuugcuaguaucuuggguguauucucuguaaguguagcucaaauaggucaucaugaaagguua

SEQ ID NO: 350719 - RNA, 64 nt, Homo Sapiens
uaaaagggaaaaguagauccgauaacuuaaaaacguagcucaucccuuaccauccaaggggcac

SEQ ID NO: 350720 - RNA, 64 nt, Homo Sapiens
ucugcaguuuguagcagaaugguauuuuccucaaguagcucauaauacugccaaaucucaaaag

SEQ ID NO: 350721 - RNA, 64 nt, Homo Sapiens
cacuagcaaggaugauaaacacuugugcacugaaagcuaacagggagagguuacacaauauuuu

SEQ ID NO: 350722 - RNA, 64 nt, Homo Sapiens
auguuuuccaacauauccuaaaaacugugauauaagcuaacauauaauuugccuuacgucaaaa

SEQ ID NO: 350723 - RNA, 64 nt, Homo Sapiens
aagccauccguagaaaguacuuuguccuccaaaaagcuaacauacgguuuugaagcagcauuga

SEQ ID NO: 350724 - RNA, 64 nt, Homo Sapiens
uuuuuuguuguaauaguuaaagaggcuuagaacaagcuaacaggcaauagaaauauguauauca

SEQ ID NO: 350725 - RNA, 64 nt, Homo Sapiens
gcaggacaugcugaagccaaagccaauaacacacagcuaacacacagcucccauaaccgcugau

SEQ ID NO: 350726 - RNA, 64 nt, Homo Sapiens
aggcaaugccauccucaaacacugcaggcaucacagcuaacaauugugaagucgucuuaacuca

SEQ ID NO: 350727 - RNA, 64 nt, Homo Sapiens
aucucccagugugcuauaguuuucuaccuagaguaccaguaaaccuuaguggacaauggaguca

SEQ ID NO: 350728 - RNA, 64 nt, Homo Sapiens
aauugauugguaucuuugauuucuuauauauuucaccaguaagaacucuugugacuccuggaag

SEQ ID NO: 350729 - RNA, 64 nt, Homo Sapiens
cucccucaaagaagaaaaagccccagagggcucaccuuccaaguggucaccagcggccccaugu

SEQ ID NO: 350730 - RNA, 55 nt, Homo Sapiens
cuuuagagggugaguccagcucucuccuuccaaguagagacaaagagcccuuuag

SEQ ID NO: 350731 - RNA, 64 nt, Homo Sapiens
cuuacggagcuucuccucagaagugguaccaucgccuuccaaagucagcacucuacacucuuga

SEQ ID NO: 350732 - RNA, 64 nt, Homo Sapiens
ucacuuuacauccucagguauuguaaccacugggccuuccaacuuugcuggcaagcucugguaa

SEQ ID NO: 350733 - RNA, 64 nt, Homo Sapiens
acuuuuauuugcaacauuuacaguccuucaaaauccuuccaaagaauucuuauacacauugggg

SEQ ID NO: 350734 - RNA, 64 nt, Homo Sapiens
uacuugagccuuuaauggacuuauuucuucaaauccuuccaaaaauuauuauaagcauugaaau

SEQ ID NO: 350735 - RNA, 64 nt, Homo Sapiens
cauuugccccgcaacccuggcuucccucagaggaccuuccaauccccaaggcacccugugccug

SEQ ID NO: 350736 - RNA, 64 nt, Homo Sapiens
ccccccuccaccuucgccacgcuccuccucugagccuuccaaguuugccccaacuagacuguga

SEQ ID NO: 350737 - RNA, 64 nt, Homo Sapiens
gaccuggaagagaacuuugagaacaauaucuucuccuuccaaguaugugacguaguccugaacc

SEQ ID NO: 350738 - RNA, 64 nt, Homo Sapiens
cagcgccuuucccucaaguccuuucugauucugcccuuccaacgcaucacccgccucaaacugc

SEQ ID NO: 350739 - RNA, 64 nt, Homo Sapiens
aaagugccgggaccaaaugguaauaauaauaaaaccuuccaaaaagacuccaucucaauaaaau

SEQ ID NO: 350740 - RNA, 64 nt, Homo Sapiens
ccaggcgcgguggcuaaaaagcaguaauuaauaaccuuccaagauaucuauuaaauaaauugaa

SEQ ID NO: 350741 - RNA, 64 nt, Homo Sapiens
cuacagcccuggcagcccauggcaacucaaagugccuuccaaaccaaacugccccucaugaggu

SEQ ID NO: 350742 - RNA, 64 nt, Homo Sapiens
auguuccaugcaugucccugcuuccaaagccugaccuuccaaagcuugcuuccuuccuccuggc

SEQ ID NO: 350743 - RNA, 64 nt, Homo Sapiens
agugucugaucaucucucuuggaaguuuucugaaccuuccaagcucuguggugaggacaaacca

SEQ ID NO: 350744 - RNA, 64 nt, Homo Sapiens
aguguuuuccaccucauucucccagauugagcucccuuccaaaggaucguuccucucauugcac

SEQ ID NO: 350745 - RNA, 64 nt, Homo Sapiens
aaacuccugggcucaagugauccacccaccuuggccuuccaaaguggugggauuaugggcagga

SEQ ID NO: 350746 - RNA, 64 nt, Homo Sapiens
gccuccagaccucggugcccacagccuugaggauccuuccaauaaaggugucaagagcucagcc

SEQ ID NO: 350747 - RNA, 64 nt, Homo Sapiens; identical to SEQ ID NO: 57592

SEQ ID NO: 350748 - RNA, 64 nt, Homo Sapiens; identical to SEQ ID NO: 57593

SEQ ID NO: 350749 - RNA, 64 nt, Homo Sapiens; identical to SEQ ID NO: 57594

SEQ ID NO: 350750 - RNA, 64 nt, Homo Sapiens; identical to SEQ ID NO: 57595

SEQ ID NO: 350751 - RNA, 64 nt, Homo Sapiens; identical to SEQ ID NO: 57596

SEQ ID NO: 350752 - RNA, 64 nt, Homo Sapiens; identical to SEQ ID NO: 57597

SEQ ID NO: 350753 - RNA, 64 nt, Homo Sapiens; identical to SEQ ID NO: 57598

SEQ ID NO: 350754 - RNA, 64 nt, Homo Sapiens; identical to SEQ ID NO: 57599

SEQ ID NO: 350755 - RNA, 64 nt, Homo Sapiens; identical to SEQ ID NO: 57600

SEQ ID NO: 350756 - RNA, 64 nt, Homo Sapiens; identical to SEQ ID NO: 57601

SEQ ID NO: 350757 - RNA, 64 nt, Homo Sapiens; identical to SEQ ID NO: 57602

SEQ ID NO: 350758 - RNA, 64 nt, Homo Sapiens
aaaaguuuaaaauccgauaaggaauaucugggacaggguuuagaucaugacucuacacagauac

SEQ ID NO: 350759 - RNA, 64 nt, Homo Sapiens
cagcugguuugggcucaaauugucccuggagacuaggguuuauguuaggguauugauagauuag

SEQ ID NO: 350760 - RNA, 64 nt, Homo Sapiens
uuuuguauagaaucacaguucacauaagguuugcaggguuuauauacuuuuaucugucagguag

SEQ ID NO: 350761 - RNA, 64 nt, Homo Sapiens
uguggcgcagugaugcauggggccaagcacuauaaggguuuagcucuggguuaacgcuuuucag

SEQ ID NO: 350762 - RNA, 64 nt, Homo Sapiens
cuguaaauuuacauacguugucuagaaguaccauaggguuuaaaaaccugggcuggcauugguc

SEQ ID NO: 350763 - RNA, 64 nt, Homo Sapiens
acuguguuucacuuacaaguuuuaaaaaaaugacaggguuuaauggagcgugcauaaaaaugua

SEQ ID NO: 350764 - RNA, 64 nt, Homo Sapiens
cuggcccagcacauccugucgcuagucucccccgaggguuuagggcaagcugcuuuaucccugc

SEQ ID NO: 350765 - RNA, 64 nt, Homo Sapiens
ccacuuugcagaggauggaggugggcaccccauaaggguuuaggccaccugcccuccaccagga

SEQ ID NO: 350766 - RNA, 64 nt, Homo Sapiens; identical to SEQ ID NO: 265198

SEQ ID NO: 350767 - RNA, 64 nt, Homo Sapiens; identical to SEQ ID NO: 265199

SEQ ID NO: 350768 - RNA, 64 nt, Homo Sapiens; identical to SEQ ID NO: 265200

SEQ ID NO: 350769 - RNA, 64 nt, Homo Sapiens; identical to SEQ ID NO: 265201

SEQ ID NO: 350770 - RNA, 64 nt, Homo Sapiens; identical to SEQ ID NO: 265202

SEQ ID NO: 350771 - RNA, 64 nt, Homo Sapiens; identical to SEQ ID NO: 265203

SEQ ID NO: 350772 - RNA, 64 nt, Homo Sapiens; identical to SEQ ID NO: 265204

SEQ ID NO: 350773 - RNA, 64 nt, Homo Sapiens; identical to SEQ ID NO: 265205

SEQ ID NO: 350774 - RNA, 64 nt, Homo Sapiens; identical to SEQ ID NO: 286991

SEQ ID NO: 350775 - RNA, 64 nt, Homo Sapiens; identical to SEQ ID NO: 286992

SEQ ID NO: 350776 - RNA, 64 nt, Homo Sapiens; identical to SEQ ID NO: 286993

SEQ ID NO: 350777 - RNA, 64 nt, Homo Sapiens; identical to SEQ ID NO: 286994

SEQ ID NO: 350778 - RNA, 64 nt, Homo Sapiens; identical to SEQ ID NO: 286995

SEQ ID NO: 350779 - RNA, 64 nt, Homo Sapiens; identical to SEQ ID NO: 286996

SEQ ID NO: 350780 - RNA, 64 nt, Homo Sapiens; identical to SEQ ID NO: 286997

SEQ ID NO: 350781 - RNA, 64 nt, Homo Sapiens; identical to SEQ ID NO: 286998

SEQ ID NO: 350782 - RNA, 64 nt, Homo Sapiens; identical to SEQ ID NO: 286999

SEQ ID NO: 350783 - RNA, 64 nt, Homo Sapiens; identical to SEQ ID NO: 287000

SEQ ID NO: 350784 - RNA, 64 nt, Homo Sapiens; identical to SEQ ID NO: 287001

SEQ ID NO: 350785 - RNA, 64 nt, Homo Sapiens; identical to SEQ ID NO: 287002

SEQ ID NO: 350786 - RNA, 64 nt, Homo Sapiens; identical to SEQ ID NO: 287003

SEQ ID NO: 350787 - RNA, 64 nt, Homo Sapiens; identical to SEQ ID NO: 287004

SEQ ID NO: 350788 - RNA, 64 nt, Homo Sapiens; identical to SEQ ID NO: 287005

SEQ ID NO: 350789 - RNA, 64 nt, Homo Sapiens; identical to SEQ ID NO: 287006

SEQ ID NO: 350790 - RNA, 64 nt, Homo Sapiens; identical to SEQ ID NO: 287007

SEQ ID NO: 350791 - RNA, 64 nt, Homo Sapiens; identical to SEQ ID NO: 287008

SEQ ID NO: 350792 - RNA, 64 nt, Homo Sapiens; identical to SEQ ID NO: 287009

SEQ ID NO: 350793 - RNA, 64 nt, Homo Sapiens; identical to SEQ ID NO: 287010

SEQ ID NO: 350794 - RNA, 64 nt, Homo Sapiens; identical to SEQ ID NO: 287011

SEQ ID NO: 350795 - RNA, 64 nt, Homo Sapiens; identical to SEQ ID NO: 287012

SEQ ID NO: 350796 - RNA, 64 nt, Homo Sapiens; identical to SEQ ID NO: 287013

SEQ ID NO: 350797 - RNA, 64 nt, Homo Sapiens; identical to SEQ ID NO: 287014

SEQ ID NO: 350798 - RNA, 64 nt, Homo Sapiens; identical to SEQ ID NO: 287015

SEQ ID NO: 350799 - RNA, 64 nt, Homo Sapiens; identical to SEQ ID NO: 287016

SEQ ID NO: 350800 - RNA, 64 nt, Homo Sapiens; identical to SEQ ID NO: 287017

SEQ ID NO: 350801 - RNA, 64 nt, Homo Sapiens; identical to SEQ ID NO: 287018

SEQ ID NO: 350802 - RNA, 64 nt, Homo Sapiens; identical to SEQ ID NO: 287019

SEQ ID NO: 350803 - RNA, 64 nt, Homo Sapiens; identical to SEQ ID NO: 287020

SEQ ID NO: 350804 - RNA, 64 nt, Homo Sapiens; identical to SEQ ID NO: 287021

SEQ ID NO: 350805 - RNA, 64 nt, Homo Sapiens; identical to SEQ ID NO: 287022

SEQ ID NO: 350806 - RNA, 64 nt, Homo Sapiens; identical to SEQ ID NO: 287023

SEQ ID NO: 350807 - RNA, 64 nt, Homo Sapiens; identical to SEQ ID NO: 287024

SEQ ID NO: 350808 - RNA, 64 nt, Homo Sapiens; identical to SEQ ID NO: 287025

SEQ ID NO: 350809 - RNA, 64 nt, Homo Sapiens; identical to SEQ ID NO: 287026

SEQ ID NO: 350810 - RNA, 64 nt, Homo Sapiens; identical to SEQ ID NO: 287027

SEQ ID NO: 350811 - RNA, 64 nt, Homo Sapiens; identical to SEQ ID NO: 287028

SEQ ID NO: 350812 - RNA, 64 nt, Homo Sapiens; identical to SEQ ID NO: 287029

SEQ ID NO: 350813 - RNA, 64 nt, Homo Sapiens; identical to SEQ ID NO: 287030

SEQ ID NO: 350814 - RNA, 64 nt, Homo Sapiens; identical to SEQ ID NO: 287031

SEQ ID NO: 350815 - RNA, 64 nt, Homo Sapiens; identical to SEQ ID NO: 287032

SEQ ID NO: 350816 - RNA, 64 nt, Homo Sapiens; identical to SEQ ID NO: 287033

SEQ ID NO: 350817 - RNA, 64 nt, Homo Sapiens; identical to SEQ ID NO: 287034

SEQ ID NO: 350818 - RNA, 64 nt, Homo Sapiens; identical to SEQ ID NO: 287035

SEQ ID NO: 350819 - RNA, 64 nt, Homo Sapiens; identical to SEQ ID NO: 287036

SEQ ID NO: 350820 - RNA, 64 nt, Homo Sapiens; identical to SEQ ID NO: 287037

SEQ ID NO: 350821 - RNA, 64 nt, Homo Sapiens; identical to SEQ ID NO: 287038

SEQ ID NO: 350822 - RNA, 64 nt, Homo Sapiens; identical to SEQ ID NO: 287039

SEQ ID NO: 350823 - RNA, 64 nt, Homo Sapiens; identical to SEQ ID NO: 287040

SEQ ID NO: 350824 - RNA, 64 nt, Homo Sapiens; identical to SEQ ID NO: 287041

SEQ ID NO: 350825 - RNA, 64 nt, Homo Sapiens; identical to SEQ ID NO: 287042

SEQ ID NO: 350826 - RNA, 64 nt, Homo Sapiens; identical to SEQ ID NO: 287043

SEQ ID NO: 350827 - RNA, 64 nt, Homo Sapiens; identical to SEQ ID NO: 287044

SEQ ID NO: 350828 - RNA, 64 nt, Homo Sapiens; identical to SEQ ID NO: 287045

SEQ ID NO: 350829 - RNA, 64 nt, Homo Sapiens; identical to SEQ ID NO: 287046

SEQ ID NO: 350830 - RNA, 64 nt, Homo Sapiens; identical to SEQ ID NO: 287047

SEQ ID NO: 350831 - RNA, 64 nt, Homo Sapiens; identical to SEQ ID NO: 287048

SEQ ID NO: 350832 - RNA, 64 nt, Homo Sapiens; identical to SEQ ID NO: 287049

SEQ ID NO: 350833 - RNA, 64 nt, Homo Sapiens; identical to SEQ ID NO: 287050

SEQ ID NO: 350834 - RNA, 64 nt, Homo Sapiens; identical to SEQ ID NO: 287051

SEQ ID NO: 350835 - RNA, 64 nt, Homo Sapiens; identical to SEQ ID NO: 287052

SEQ ID NO: 350836 - RNA, 64 nt, Homo Sapiens; identical to SEQ ID NO: 287053

SEQ ID NO: 350837 - RNA, 64 nt, Homo Sapiens; identical to SEQ ID NO: 287054

SEQ ID NO: 350838 - RNA, 64 nt, Homo Sapiens; identical to SEQ ID NO: 287055

SEQ ID NO: 350839 - RNA, 64 nt, Homo Sapiens; identical to SEQ ID NO: 287056

SEQ ID NO: 350840 - RNA, 64 nt, Homo Sapiens; identical to SEQ ID NO: 287057

SEQ ID NO: 350841 - RNA, 64 nt, Homo Sapiens; identical to SEQ ID NO: 287058

SEQ ID NO: 350842 - RNA, 64 nt, Homo Sapiens; identical to SEQ ID NO: 287059

SEQ ID NO: 350843 - RNA, 64 nt, Homo Sapiens; identical to SEQ ID NO: 287060

SEQ ID NO: 350844 - RNA, 64 nt, Homo Sapiens; identical to SEQ ID NO: 287061

SEQ ID NO: 350845 - RNA, 64 nt, Homo Sapiens; identical to SEQ ID NO: 287062

SEQ ID NO: 350846 - RNA, 64 nt, Homo Sapiens; identical to SEQ ID NO: 287063

SEQ ID NO: 350847 - RNA, 64 nt, Homo Sapiens; identical to SEQ ID NO: 287064

SEQ ID NO: 350848 - RNA, 64 nt, Homo Sapiens; identical to SEQ ID NO: 287065

SEQ ID NO: 350849 - RNA, 64 nt, Homo Sapiens; identical to SEQ ID NO: 287066

SEQ ID NO: 350850 - RNA, 64 nt, Homo Sapiens; identical to SEQ ID NO: 287067

SEQ ID NO: 350851 - RNA, 64 nt, Homo Sapiens; identical to SEQ ID NO: 287068

SEQ ID NO: 350852 - RNA, 64 nt, Homo Sapiens; identical to SEQ ID NO: 287069

SEQ ID NO: 350853 - RNA, 64 nt, Homo Sapiens; identical to SEQ ID NO: 287070

SEQ ID NO: 350854 - RNA, 64 nt, Homo Sapiens; identical to SEQ ID NO: 287071

SEQ ID NO: 350855 - RNA, 64 nt, Homo Sapiens; identical to SEQ ID NO: 287072

SEQ ID NO: 350856 - RNA, 64 nt, Homo Sapiens; identical to SEQ ID NO: 287073

SEQ ID NO: 350857 - RNA, 64 nt, Homo Sapiens; identical to SEQ ID NO: 287074

SEQ ID NO: 350858 - RNA, 64 nt, Homo Sapiens; identical to SEQ ID NO: 287075

SEQ ID NO: 350859 - RNA, 55 nt, Homo Sapiens; identical to SEQ ID NO: 287076

SEQ ID NO: 350860 - RNA, 64 nt, Homo Sapiens; identical to SEQ ID NO: 287077

SEQ ID NO: 350861 - RNA, 64 nt, Homo Sapiens; identical to SEQ ID NO: 287078

SEQ ID NO: 350862 - RNA, 64 nt, Homo Sapiens; identical to SEQ ID NO: 287079

SEQ ID NO: 350863 - RNA, 64 nt, Homo Sapiens; identical to SEQ ID NO: 287080

SEQ ID NO: 350864 - RNA, 64 nt, Homo Sapiens; identical to SEQ ID NO: 287081

SEQ ID NO: 350865 - RNA, 64 nt, Homo Sapiens; identical to SEQ ID NO: 287082

SEQ ID NO: 350866 - RNA, 64 nt, Homo Sapiens; identical to SEQ ID NO: 287083

SEQ ID NO: 350867 - RNA, 64 nt, Homo Sapiens; identical to SEQ ID NO: 287084

SEQ ID NO: 350868 - RNA, 64 nt, Homo Sapiens; identical to SEQ ID NO: 287085

SEQ ID NO: 350869 - RNA, 64 nt, Homo Sapiens; identical to SEQ ID NO: 287086

SEQ ID NO: 350870 - RNA, 64 nt, Homo Sapiens; identical to SEQ ID NO: 287087

SEQ ID NO: 350871 - RNA, 64 nt, Homo Sapiens; identical to SEQ ID NO: 287088

SEQ ID NO: 350872 - RNA, 64 nt, Homo Sapiens; identical to SEQ ID NO: 287089

SEQ ID NO: 350873 - RNA, 64 nt, Homo Sapiens; identical to SEQ ID NO: 287090

SEQ ID NO: 350874 - RNA, 64 nt, Homo Sapiens; identical to SEQ ID NO: 287091

SEQ ID NO: 350875 - RNA, 64 nt, Homo Sapiens; identical to SEQ ID NO: 287092

SEQ ID NO: 350876 - RNA, 64 nt, Homo Sapiens; identical to SEQ ID NO: 287093

SEQ ID NO: 350877 - RNA, 64 nt, Homo Sapiens; identical to SEQ ID NO: 287094

SEQ ID NO: 350878 - RNA, 64 nt, Homo Sapiens; identical to SEQ ID NO: 287095

SEQ ID NO: 350879 - RNA, 64 nt, Homo Sapiens; identical to SEQ ID NO: 287096

SEQ ID NO: 350880 - RNA, 64 nt, Homo Sapiens; identical to SEQ ID NO: 287097

SEQ ID NO: 350881 - RNA, 64 nt, Homo Sapiens; identical to SEQ ID NO: 287098

SEQ ID NO: 350882 - RNA, 64 nt, Homo Sapiens; identical to SEQ ID NO: 287099

SEQ ID NO: 350883 - RNA, 64 nt, Homo Sapiens; identical to SEQ ID NO: 287100

SEQ ID NO: 350884 - RNA, 64 nt, Homo Sapiens; identical to SEQ ID NO: 287101

SEQ ID NO: 350885 - RNA, 64 nt, Homo Sapiens; identical to SEQ ID NO: 287102

SEQ ID NO: 350886 - RNA, 64 nt, Homo Sapiens; identical to SEQ ID NO: 287103

SEQ ID NO: 350887 - RNA, 64 nt, Homo Sapiens; identical to SEQ ID NO: 287104

SEQ ID NO: 350888 - RNA, 64 nt, Homo Sapiens; identical to SEQ ID NO: 287105

SEQ ID NO: 350889 - RNA, 64 nt, Homo Sapiens; identical to SEQ ID NO: 287106

SEQ ID NO: 350890 - RNA, 64 nt, Homo Sapiens; identical to SEQ ID NO: 287107

SEQ ID NO: 350891 - RNA, 64 nt, Homo Sapiens; identical to SEQ ID NO: 287108

SEQ ID NO: 350892 - RNA, 64 nt, Homo Sapiens; identical to SEQ ID NO: 287109

SEQ ID NO: 350893 - RNA, 64 nt, Homo Sapiens; identical to SEQ ID NO: 287110

SEQ ID NO: 350894 - RNA, 64 nt, Homo Sapiens; identical to SEQ ID NO: 287111

SEQ ID NO: 350895 - RNA, 64 nt, Homo Sapiens; identical to SEQ ID NO: 287112

SEQ ID NO: 350896 - RNA, 64 nt, Homo Sapiens; identical to SEQ ID NO: 287113

SEQ ID NO: 350897 - RNA, 64 nt, Homo Sapiens; identical to SEQ ID NO: 287114

SEQ ID NO: 350898 - RNA, 64 nt, Homo Sapiens; identical to SEQ ID NO: 287115

SEQ ID NO: 350899 - RNA, 64 nt, Homo Sapiens; identical to SEQ ID NO: 287116

SEQ ID NO: 350900 - RNA, 64 nt, Homo Sapiens; identical to SEQ ID NO: 287117

SEQ ID NO: 350901 - RNA, 64 nt, Homo Sapiens; identical to SEQ ID NO: 287118

SEQ ID NO: 350902 - RNA, 52 nt, Homo Sapiens; identical to SEQ ID NO: 287119

SEQ ID NO: 350903 - RNA, 64 nt, Homo Sapiens; identical to SEQ ID NO: 287120

SEQ ID NO: 350904 - RNA, 64 nt, Homo Sapiens; identical to SEQ ID NO: 287121

SEQ ID NO: 350905 - RNA, 64 nt, Homo Sapiens; identical to SEQ ID NO: 287122

SEQ ID NO: 350906 - RNA, 55 nt, Homo Sapiens; identical to SEQ ID NO: 287123

SEQ ID NO: 350907 - RNA, 64 nt, Homo Sapiens; identical to SEQ ID NO: 287124

SEQ ID NO: 350908 - RNA, 64 nt, Homo Sapiens; identical to SEQ ID NO: 287125

SEQ ID NO: 350909 - RNA, 64 nt, Homo Sapiens; identical to SEQ ID NO: 287126

SEQ ID NO: 350910 - RNA, 64 nt, Homo Sapiens; identical to SEQ ID NO: 287127

SEQ ID NO: 350911 - RNA, 64 nt, Homo Sapiens; identical to SEQ ID NO: 287128

SEQ ID NO: 350912 - RNA, 64 nt, Homo Sapiens; identical to SEQ ID NO: 287129

SEQ ID NO: 350913 - RNA, 64 nt, Homo Sapiens; identical to SEQ ID NO: 287130

SEQ ID NO: 350914 - RNA, 64 nt, Homo Sapiens; identical to SEQ ID NO: 287131

SEQ ID NO: 350915 - RNA, 64 nt, Homo Sapiens; identical to SEQ ID NO: 287132

SEQ ID NO: 350916 - RNA, 64 nt, Homo Sapiens; identical to SEQ ID NO: 287133

SEQ ID NO: 350917 - RNA, 64 nt, Homo Sapiens; identical to SEQ ID NO: 287134

SEQ ID NO: 350918 - RNA, 64 nt, Homo Sapiens; identical to SEQ ID NO: 287135

SEQ ID NO: 350919 - RNA, 64 nt, Homo Sapiens; identical to SEQ ID NO: 287136

SEQ ID NO: 350920 - RNA, 64 nt, Homo Sapiens; identical to SEQ ID NO: 287137

SEQ ID NO: 350921 - RNA, 64 nt, Homo Sapiens; identical to SEQ ID NO: 287138

SEQ ID NO: 350922 - RNA, 64 nt, Homo Sapiens; identical to SEQ ID NO: 287139

SEQ ID NO: 350923 - RNA, 64 nt, Homo Sapiens; identical to SEQ ID NO: 287140

SEQ ID NO: 350924 - RNA, 64 nt, Homo Sapiens; identical to SEQ ID NO: 287141

SEQ ID NO: 350925 - RNA, 64 nt, Homo Sapiens; identical to SEQ ID NO: 287142

SEQ ID NO: 350926 - RNA, 64 nt, Homo Sapiens; identical to SEQ ID NO: 287143

SEQ ID NO: 350927 - RNA, 64 nt, Homo Sapiens; identical to SEQ ID NO: 287144

SEQ ID NO: 350928 - RNA, 64 nt, Homo Sapiens; identical to SEQ ID NO: 287145

SEQ ID NO: 350929 - RNA, 64 nt, Homo Sapiens; identical to SEQ ID NO: 287146

SEQ ID NO: 350930 - RNA, 64 nt, Homo Sapiens; identical to SEQ ID NO: 287147

SEQ ID NO: 350931 - RNA, 64 nt, Homo Sapiens; identical to SEQ ID NO: 287148

SEQ ID NO: 350932 - RNA, 64 nt, Homo Sapiens; identical to SEQ ID NO: 287149

SEQ ID NO: 350933 - RNA, 64 nt, Homo Sapiens; identical to SEQ ID NO: 287150

SEQ ID NO: 350934 - RNA, 64 nt, Homo Sapiens; identical to SEQ ID NO: 287151

SEQ ID NO: 350935 - RNA, 64 nt, Homo Sapiens; identical to SEQ ID NO: 287152

SEQ ID NO: 350936 - RNA, 64 nt, Homo Sapiens; identical to SEQ ID NO: 287153

SEQ ID NO: 350937 - RNA, 64 nt, Homo Sapiens; identical to SEQ ID NO: 287154

SEQ ID NO: 350938 - RNA, 64 nt, Homo Sapiens; identical to SEQ ID NO: 287155

SEQ ID NO: 350939 - RNA, 64 nt, Homo Sapiens; identical to SEQ ID NO: 287156

SEQ ID NO: 350940 - RNA, 64 nt, Homo Sapiens; identical to SEQ ID NO: 287157

SEQ ID NO: 350941 - RNA, 64 nt, Homo Sapiens; identical to SEQ ID NO: 287158

SEQ ID NO: 350942 - RNA, 64 nt, Homo Sapiens; identical to SEQ ID NO: 287159

SEQ ID NO: 350943 - RNA, 64 nt, Homo Sapiens; identical to SEQ ID NO: 287160

SEQ ID NO: 350944 - RNA, 64 nt, Homo Sapiens; identical to SEQ ID NO: 287161

SEQ ID NO: 350945 - RNA, 64 nt, Homo Sapiens; identical to SEQ ID NO: 287162

SEQ ID NO: 350946 - RNA, 64 nt, Homo Sapiens; identical to SEQ ID NO: 287163

SEQ ID NO: 350947 - RNA, 64 nt, Homo Sapiens; identical to SEQ ID NO: 287164

SEQ ID NO: 350948 - RNA, 64 nt, Homo Sapiens; identical to SEQ ID NO: 287165

SEQ ID NO: 350949 - RNA, 64 nt, Homo Sapiens; identical to SEQ ID NO: 287166

SEQ ID NO: 350950 - RNA, 64 nt, Homo Sapiens; identical to SEQ ID NO: 287167

SEQ ID NO: 350951 - RNA, 64 nt, Homo Sapiens; identical to SEQ ID NO: 287168

SEQ ID NO: 350952 - RNA, 64 nt, Homo Sapiens; identical to SEQ ID NO: 287169

SEQ ID NO: 350953 - RNA, 64 nt, Homo Sapiens; identical to SEQ ID NO: 287170

SEQ ID NO: 350954 - RNA, 64 nt, Homo Sapiens; identical to SEQ ID NO: 287171

SEQ ID NO: 350955 - RNA, 64 nt, Homo Sapiens; identical to SEQ ID NO: 287172

SEQ ID NO: 350956 - RNA, 64 nt, Homo Sapiens; identical to SEQ ID NO: 287173

SEQ ID NO: 350957 - RNA, 64 nt, Homo Sapiens; identical to SEQ ID NO: 287174

SEQ ID NO: 350958 - RNA, 64 nt, Homo Sapiens; identical to SEQ ID NO: 287175

SEQ ID NO: 350959 - RNA, 64 nt, Homo Sapiens; identical to SEQ ID NO: 287176

SEQ ID NO: 350960 - RNA, 64 nt, Homo Sapiens; identical to SEQ ID NO: 167924

SEQ ID NO: 350961 - RNA, 64 nt, Homo Sapiens; identical to SEQ ID NO: 167925

SEQ ID NO: 350962 - RNA, 64 nt, Homo Sapiens; identical to SEQ ID NO: 167926

SEQ ID NO: 350963 - RNA, 64 nt, Homo Sapiens; identical to SEQ ID NO: 167927

SEQ ID NO: 350964 - RNA, 64 nt, Homo Sapiens; identical to SEQ ID NO: 167928

SEQ ID NO: 350965 - RNA, 64 nt, Homo Sapiens; identical to SEQ ID NO: 167929

SEQ ID NO: 350966 - RNA, 64 nt, Homo Sapiens; identical to SEQ ID NO: 167930

SEQ ID NO: 350967 - RNA, 64 nt, Homo Sapiens; identical to SEQ ID NO: 167931

SEQ ID NO: 350968 - RNA, 64 nt, Homo Sapiens; identical to SEQ ID NO: 167932

SEQ ID NO: 350969 - RNA, 64 nt, Homo Sapiens; identical to SEQ ID NO: 167933

SEQ ID NO: 350970 - RNA, 64 nt, Homo Sapiens; identical to SEQ ID NO: 167934

SEQ ID NO: 350971 - RNA, 64 nt, Homo Sapiens; identical to SEQ ID NO: 167935

SEQ ID NO: 350972 - RNA, 64 nt, Homo Sapiens; identical to SEQ ID NO: 167936

SEQ ID NO: 350973 - RNA, 64 nt, Homo Sapiens; identical to SEQ ID NO: 167937

SEQ ID NO: 350974 - RNA, 64 nt, Homo Sapiens; identical to SEQ ID NO: 167938

SEQ ID NO: 350975 - RNA, 64 nt, Homo Sapiens; identical to SEQ ID NO: 167939

SEQ ID NO: 350976 - RNA, 64 nt, Homo Sapiens; identical to SEQ ID NO: 167940

SEQ ID NO: 350977 - RNA, 64 nt, Homo Sapiens; identical to SEQ ID NO: 167941

SEQ ID NO: 350978 - RNA, 64 nt, Homo Sapiens; identical to SEQ ID NO: 167942

SEQ ID NO: 350979 - RNA, 64 nt, Homo Sapiens; identical to SEQ ID NO: 167942

SEQ ID NO: 350980 - RNA, 64 nt, Homo Sapiens; identical to SEQ ID NO: 167944

SEQ ID NO: 350981 - RNA, 64 nt, Homo Sapiens; identical to SEQ ID NO: 167945

SEQ ID NO: 350982 - RNA, 64 nt, Homo Sapiens; identical to SEQ ID NO: 167946

SEQ ID NO: 350983 - RNA, 64 nt, Homo Sapiens; identical to SEQ ID NO: 167947

SEQ ID NO: 350984 - RNA, 64 nt, Homo Sapiens; identical to SEQ ID NO: 167948

SEQ ID NO: 350985 - RNA, 64 nt, Homo Sapiens; identical to SEQ ID NO: 167949

SEQ ID NO: 350986 - RNA, 64 nt, Homo Sapiens; identical to SEQ ID NO: 221951

SEQ ID NO: 350987 - RNA, 64 nt, Homo Sapiens; identical to SEQ ID NO: 221952

SEQ ID NO: 350988 - RNA, 64 nt, Homo Sapiens; identical to SEQ ID NO: 221953

SEQ ID NO: 350989 - RNA, 64 nt, Homo Sapiens; identical to SEQ ID NO: 221954

SEQ ID NO: 350990 - RNA, 64 nt, Homo Sapiens; identical to SEQ ID NO: 221955

SEQ ID NO: 350991 - RNA, 64 nt, Homo Sapiens; identical to SEQ ID NO: 221956

SEQ ID NO: 350992 - RNA, 64 nt, Homo Sapiens; identical to SEQ ID NO: 221957

SEQ ID NO: 350993 - RNA, 64 nt, Homo Sapiens; identical to SEQ ID NO: 221958

SEQ ID NO: 350994 - RNA, 64 nt, Homo Sapiens; identical to SEQ ID NO: 221959

SEQ ID NO: 350995 - RNA, 64 nt, Homo Sapiens; identical to SEQ ID NO: 221960

SEQ ID NO: 350996 - RNA, 64 nt, Homo Sapiens; identical to SEQ ID NO: 221961

SEQ ID NO: 350997 - RNA, 64 nt, Homo Sapiens; identical to SEQ ID NO: 221962

SEQ ID NO: 350998 - RNA, 64 nt, Homo Sapiens; identical to SEQ ID NO: 221963

SEQ ID NO: 350999 - RNA, 64 nt, Homo Sapiens; identical to SEQ ID NO: 221964

SEQ ID NO: 351000 - RNA, 64 nt, Homo Sapiens; identical to SEQ ID NO: 221965

SEQ ID NO: 351001 - RNA, 64 nt, Homo Sapiens; identical to SEQ ID NO: 221966

SEQ ID NO: 351002 - RNA, 64 nt, Homo Sapiens; identical to SEQ ID NO: 221967

SEQ ID NO: 351003 - RNA, 64 nt, Homo Sapiens; identical to SEQ ID NO: 221968

SEQ ID NO: 351004 - RNA, 64 nt, Homo Sapiens; identical to SEQ ID NO: 221969

SEQ ID NO: 351005 - RNA, 64 nt, Homo Sapiens; identical to SEQ ID NO: 221970

SEQ ID NO: 351006 - RNA, 64 nt, Homo Sapiens; identical to SEQ ID NO: 221971

SEQ ID NO: 351007 - RNA, 64 nt, Homo Sapiens; identical to SEQ ID NO: 221972

SEQ ID NO: 351008 - RNA, 64 nt, Homo Sapiens; identical to SEQ ID NO: 221973

SEQ ID NO: 351009 - RNA, 64 nt, Homo Sapiens; identical to SEQ ID NO: 221974

SEQ ID NO: 351010 - RNA, 64 nt, Homo Sapiens; identical to SEQ ID NO: 221975

SEQ ID NO: 351011 - RNA, 64 nt, Homo Sapiens; identical to SEQ ID NO: 221976

SEQ ID NO: 351012 - RNA, 64 nt, Homo Sapiens; identical to SEQ ID NO: 221977

SEQ ID NO: 351013 - RNA, 64 nt, Homo Sapiens; identical to SEQ ID NO: 221978

SEQ ID NO: 351014 - RNA, 64 nt, Homo Sapiens; identical to SEQ ID NO: 221979

SEQ ID NO: 351015 - RNA, 64 nt, Homo Sapiens; identical to SEQ ID NO: 221980

SEQ ID NO: 351016 - RNA, 64 nt, Homo Sapiens; identical to SEQ ID NO: 221981

SEQ ID NO: 351017 - RNA, 64 nt, Homo Sapiens; identical to SEQ ID NO: 221982

SEQ ID NO: 351018 - RNA, 64 nt, Homo Sapiens; identical to SEQ ID NO: 221983

SEQ ID NO: 351019 - RNA, 64 nt, Homo Sapiens; identical to SEQ ID NO: 221984

SEQ ID NO: 351020 - RNA, 64 nt, Homo Sapiens; identical to SEQ ID NO: 221985

SEQ ID NO: 351021 - RNA, 64 nt, Homo Sapiens; identical to SEQ ID NO: 221986

SEQ ID NO: 351022 - RNA, 64 nt, Homo Sapiens; identical to SEQ ID NO: 221987

SEQ ID NO: 351023 - RNA, 64 nt, Homo Sapiens; identical to SEQ ID NO: 221988

SEQ ID NO: 351024 - RNA, 64 nt, Homo Sapiens; identical to SEQ ID NO: 221989

SEQ ID NO: 351025 - RNA, 64 nt, Homo Sapiens; identical to SEQ ID NO: 221990

SEQ ID NO: 351026 - RNA, 64 nt, Homo Sapiens; identical to SEQ ID NO: 221991

SEQ ID NO: 351027 - RNA, 64 nt, Homo Sapiens; identical to SEQ ID NO: 221992

SEQ ID NO: 351028 - RNA, 64 nt, Homo Sapiens; identical to SEQ ID NO: 221993

SEQ ID NO: 351029 - RNA, 64 nt, Homo Sapiens; identical to SEQ ID NO: 221994

SEQ ID NO: 351030 - RNA, 64 nt, Homo Sapiens; identical to SEQ ID NO: 221995

SEQ ID NO: 351031 - RNA, 64 nt, Homo Sapiens; identical to SEQ ID NO: 221996

SEQ ID NO: 351032 - RNA, 64 nt, Homo Sapiens; identical to SEQ ID NO: 221997

SEQ ID NO: 351033 - RNA, 64 nt, Homo Sapiens; identical to SEQ ID NO: 221998

SEQ ID NO: 351034 - RNA, 64 nt, Homo Sapiens; identical to SEQ ID NO: 221999

SEQ ID NO: 351035 - RNA, 64 nt, Homo Sapiens; identical to SEQ ID NO: 222000

SEQ ID NO: 351036 - RNA, 64 nt, Homo Sapiens; identical to SEQ ID NO: 222001

SEQ ID NO: 351037 - RNA, 64 nt, Homo Sapiens; identical to SEQ ID NO: 222002

SEQ ID NO: 351038 - RNA, 64 nt, Homo Sapiens; identical to SEQ ID NO: 222003

SEQ ID NO: 351039 - RNA, 64 nt, Homo Sapiens; identical to SEQ ID NO: 222004

SEQ ID NO: 351040 - RNA, 64 nt, Homo Sapiens; identical to SEQ ID NO: 222005

SEQ ID NO: 351041 - RNA, 64 nt, Homo Sapiens; identical to SEQ ID NO: 222006

SEQ ID NO: 351042 - RNA, 64 nt, Homo Sapiens; identical to SEQ ID NO: 222007

SEQ ID NO: 351043 - RNA, 64 nt, Homo Sapiens
ggaggagugcaguggugugaucucagcucacugcaaccuccaccucccagguucaagcaauucu

SEQ ID NO: 351044 - RNA, 64 nt, Homo Sapiens
gcuggaacgcaguggugacaucucggcucacugcaaccuccaccucccagguucaagugauucu

SEQ ID NO: 351045 - RNA, 64 nt, Homo Sapiens
uccuggguucaagugauucuucucagcucacugcaaccuccaccgcuggaaugcagugaugcca

SEQ ID NO: 351046 - RNA, 64 nt, Homo Sapiens
uuauuuuccagugguguagauuugcacggcucuaaaccuccaugcauuuuuaaaaaaguuuuau

SEQ ID NO: 351047 - RNA, 64 nt, Homo Sapiens
uuuggaugugcuuguuccuggccuccaaggcaauaaccuccauguccuuuucccuguauuuacu

SEQ ID NO: 351048 - RNA, 64 nt, Homo Sapiens
agcacgccaacuucaggcaguguuuucuacugcaaaccuccacauccuggaaucaaucacacug

SEQ ID NO: 351049 - RNA, 64 nt, Homo Sapiens
agguggaauauaguucugucagggcuuuuacguaaaccuccacuuguacaugcaauuuggacag

SEQ ID NO: 351050 - RNA, 64 nt, Homo Sapiens
guguuucugucagcagaauguacauguuguacaaaaccuccagguuccuuaagcuuuuugcugu

SEQ ID NO: 351051 - RNA, 64 nt, Homo Sapiens
gcuggagugcaguggcgugaucucggcucacuacaaccuccaccucccagccaccugccuuggc

SEQ ID NO: 351052 - RNA, 64 nt, Homo Sapiens
ugcuuuuuccucuuaggguuucuuugcagaaagaaaccuccagcaagggaagagaggugugugu

SEQ ID NO: 351053 - RNA, 64 nt, Homo Sapiens
cacugugcccagcaggguggacugugcagccuggaaccuccagugcaggagucaggagccaggg

SEQ ID NO: 351054 - RNA, 64 nt, Homo Sapiens
cacugcgcccggcaggagucaccaugcagcccgaaaccuccagugggucuccugugagccgggg

SEQ ID NO: 351055 - RNA, 64 nt, Homo Sapiens
agcuaguggagggguguguacuuggguaccccccaaccuccaggggagggggguggcacagcag

SEQ ID NO: 351056 - RNA, 50 nt, Homo Sapiens
cugcaccccucccuucuccaaaccuccaacgguggaaugggguuucauaa

SEQ ID NO: 351057 - RNA, 64 nt, Homo Sapiens
ucccagguucaagcaauuauucuaggcucacugcaaccuccaccgcugaacugcagugguguga

SEQ ID NO: 351058 - RNA, 64 nt, Homo Sapiens
gacccucugaccccaucgaccccugcaugaaaauaaccuccaaggcaugcacaccucugaagac

SEQ ID NO: 351059 - RNA, 64 nt, Homo Sapiens
gcuggagugcaguggugcgaccuuggcucacugcaaccuccaucuccggggcucaagcgcuucu

SEQ ID NO: 351060 - RNA, 64 nt, Homo Sapiens
gcuggaguucaguggugcgaccucggcuuacugcaaccuccaccucccggguucaagugauucu

SEQ ID NO: 351061 - RNA, 64 nt, Homo Sapiens
gcuggagugcaguggcgugaucucggcucacugcaaccuccacccccggggaucaagcaacucu

SEQ ID NO: 351062 - RNA, 64 nt, Homo Sapiens
guucgaguucaguggugccaucucuguccacugcaaccuccacauccuggguucaagugauucu

SEQ ID NO: 351063 - RNA, 64 nt, Homo Sapiens
uccuggguucaagcaauucuucuuggcucacugcaaccuccaccgcuggagugcaguggcacag

SEQ ID NO: 351064 - RNA, 64 nt, Homo Sapiens
ucccggguucaagcaauucuucuuggcucacugcaaccuccaccgcuguagugcaguggcacga

SEQ ID NO: 351065 - RNA, 59 nt, Homo Sapiens
ggcgcccaauggggggucccugagacuugcauguaaaacuagucuagaugucuucuuuu

SEQ ID NO: 351066 - RNA, 59 nt, Homo Sapiens
uuuuuguaaguuuuauuuuuguaauugugcauguaaagcaucauugaaucaauggaucu

SEQ ID NO: 351067 - RNA, 59 nt, Homo Sapiens
uuaaguaaaaacaacaaauaaacucuguacauguaaaacgugagaaauuguccugcccu

SEQ ID NO: 351068 - RNA, 59 nt, Homo Sapiens
aaauuuuaaguaccuaggggagaaagagccauguaaauaucuguaauaaacuuguagca

SEQ ID NO: 351069 - RNA, 59 nt, Homo Sapiens
guuguaauaauugcuagguugaaguucaacauguaaaaaaagggggcauggauuuacau

SEQ ID NO: 351070 - RNA, 59 nt, Homo Sapiens
uccuaagcgcauaguuuuugguccugccucauguaaaauaguuaaugauuaucauuuac

SEQ ID NO: 351071 - RNA, 59 nt, Homo Sapiens
ucacaaacauuaacggcaguaggcaccaccauguaaaagugagcucagacgucucuaaa

SEQ ID NO: 351072 - RNA, 59 nt, Homo Sapiens
uauuuaaaucucuacacagauucaccaggcauguaaacucaucugcagaaaauguaaac

SEQ ID NO: 351073 - RNA, 59 nt, Homo Sapiens
gguuaucaaguguuucugcaugguaaugucauguaaaugcugauauugauuucacuggu

SEQ ID NO: 351074 - RNA, 59 nt, Homo Sapiens
cuauuaaguuucaucuauugugugcuauacauguaaaaacugucucuuugaacuauuga

SEQ ID NO: 351075 - RNA, 59 nt, Homo Sapiens
gguggugcugauuauuauaguacauauaccauguaaacucucaaacucuauuuagcugu

SEQ ID NO: 351076 - RNA, 59 nt, Homo Sapiens
gaguuugagaccauggcuguuacagggaucauguaaacuugcuguuuuuguuuuuuccu

SEQ ID NO: 351077 - RNA, 59 nt, Homo Sapiens
gcuuauguuacagguuacgugagaacaaucauguaaaucuauaugauuucagaaauguu

SEQ ID NO: 351078 - RNA, 59 nt, Homo Sapiens
auacaaaaagaaauguaaaugaccuuuaacauguaaagaugcucaccuuguucagaaga

SEQ ID NO: 351079 - RNA, 59 nt, Homo Sapiens
gcuucauugccuucucugauugccuuuugcauguaaaacuaugugucuggagucuuuug

SEQ ID NO: 351080 - RNA, 59 nt, Homo Sapiens
acaaacuucuuuaucacauguaucuucuacauguaaaacauuucugaugauuuuuuaac

SEQ ID NO: 351081 - RNA, 59 nt, Homo Sapiens
uauuuaugacagugaacauucugauuuuacauguaaaacaagaaaaguugaagaagaua

SEQ ID NO: 351082 - RNA, 59 nt, Homo Sapiens
aucuaagauaggcaauaguguauaaauaucauguaaaugugauggauuucuuaaucaua

SEQ ID NO: 351083 - RNA, 59 nt, Homo Sapiens
uaggaagguaaaggagcaggcuccgguaccauguaaacccgggcucaccaggcugcugg

SEQ ID NO: 351084 - RNA, 59 nt, Homo Sapiens
uuuagauuucuaaaacagguucuuaguuacauguaaaauaaacccacauagcacuuugc

SEQ ID NO: 351085 - RNA, 59 nt, Homo Sapiens
uggcagccagccucuucuagcgguggccucauguaaacgcuuagcuggacuuagaucuu

SEQ ID NO: 351086 - RNA, 59 nt, Homo Sapiens
aauggggacacucuguucaguaguaaaugcauguaaacaaagacuuuagggggaaagaa

SEQ ID NO: 351087 - RNA, 59 nt, Homo Sapiens
gccucuuuuugauacuggagucguauaggcauguaaacaaucucuuuuccacuccauug

SEQ ID NO: 351088 - RNA, 59 nt, Homo Sapiens
uguacauauguagucuaguaaaauauuaccauguaaauaaaugaaaaucauauuucaga

SEQ ID NO: 351089 - RNA, 59 nt, Homo Sapiens
aauccuaacauuuaaguguaauaaagcaucauguaaagaauaaggauguaaugauuuag

SEQ ID NO: 351090 - RNA, 59 nt, Homo Sapiens
uugcuuuauuacuuucauuuauacaaaaacauguaaauaaaggaaauauuuuuguucuu

SEQ ID NO: 351091 - RNA, 59 nt, Homo Sapiens
aggaguguuuuaaagaaugcacuaagucacauguaaauuagugacaccaagggaaguug

SEQ ID NO: 351092 - RNA, 59 nt, Homo Sapiens
gaaacuguugcuccauuggaaaauccaaucauguaaaauuuuaaaauuuguaaauuucu

SEQ ID NO: 351093 - RNA, 59 nt, Homo Sapiens
agucaucugguagauuuuuagaaacucaccauguaaaagaagauuuuaaauucacaaua

SEQ ID NO: 351094 - RNA, 59 nt, Homo Sapiens
cuauaucagcaaaagggucuggcugguaacauguaaaauauuccagaauuuguuuauau

SEQ ID NO: 351095 - RNA, 59 nt, Homo Sapiens
caggagaccugcucugggccccacccagucauguaaagggcccuggcagauugggguau

SEQ ID NO: 351096 - RNA, 59 nt, Homo Sapiens
accaagaaauaaugucugcguuagaaauacauguaaaauuuuuuuuaaaguaauauuuu

SEQ ID NO: 351097 - RNA, 59 nt, Homo Sapiens
gcuuuguacagacagguaaaucaauguagcauguaaaaguguuaauggugcuuuaagug

SEQ ID NO: 351098 - RNA, 59 nt, Homo Sapiens
uuaguucuggccacaguguagauauaaaacauguaaagcgauuguugagauaaauaagu

SEQ ID NO: 351099 - RNA, 59 nt, Homo Sapiens
aaucuaaagaugguuugcuucacaaauaucauguaaacuugaauaguugguuuccaaug

SEQ ID NO: 351100 - RNA, 59 nt, Homo Sapiens
uuuuauuuucaaaugaaugagcgcggccucauguaaacaccacuuucagcuggacacag

SEQ ID NO: 351101 - RNA, 59 nt, Homo Sapiens
uaagucuggacuuaagaguucaaaugugccauguaaaagaaauguuuauagccaaauaa

SEQ ID NO: 351102 - RNA, 59 nt, Homo Sapiens
ccacagaaccgugaguugauaagcagaagcauguaaagcguuuccugaggccuccccag

SEQ ID NO: 351103 - RNA, 59 nt, Homo Sapiens
ggaaaucaguucucacugagcccgguuuccauguaaaaucucuguuguggugggcauag

SEQ ID NO: 351104 - RNA, 59 nt, Homo Sapiens
gcauguaagauccacaaaaugagacaaugcauguaaauccaugcucauguucuaaacau

SEQ ID NO: 351105 - RNA, 59 nt, Homo Sapiens
guuuggaaaaaggacaacgaaaggcuuuucauguaaagauaagaucuuuagcuaucucu

SEQ ID NO: 351106 - RNA, 59 nt, Homo Sapiens
cuacuguguugugguuuuuaaacauuaaacauguaaaguuauauacgaaauaucugcuu

SEQ ID NO: 351107 - RNA, 59 nt, Homo Sapiens
aaagaaauugauagguguaaaugagagaccauguaaaauauguaaauucuaguaccuga

SEQ ID NO: 351108 - RNA, 59 nt, Homo Sapiens
acucugaaaccugaugcaacaguggaauccauguaaaacucucugugcaucuaaauacu

SEQ ID NO: 351109 - RNA, 59 nt, Homo Sapiens
gugaucaaaaaagaagaguuaaaacaacacauguaaaugccuuuugauauuucauggga

SEQ ID NO: 351110 - RNA, 59 nt, Homo Sapiens
ucccauugaggaaucuuaaauuucauagacauguaaagcugaaguaacucuaaagagca

SEQ ID NO: 351111 - RNA, 59 nt, Homo Sapiens
uuuaauuuuuugaauaugauaccuugucacauguaaauuagauacuuaaauauuaaauu

SEQ ID NO: 351112 - RNA, 59 nt, Homo Sapiens
auguuuuaaauguacaguuuggggcaagucauguaaauacuguugguggucuuccccac

SEQ ID NO: 351113 - RNA, 59 nt, Homo Sapiens
auuuagaugugaaaccucuacagagcuaucauguaaaaacuacauaaggugguugugcu

SEQ ID NO: 351114 - RNA, 59 nt, Homo Sapiens
uucuuaaacccgugcauauucuggugaaacauguaaaauacuuuaaguaaaauugaaca

SEQ ID NO: 351115 - RNA, 59 nt, Homo Sapiens
auagcagccucucaaguccauugaggccucauguaaaauucccauuuuucaucuuuaca

SEQ ID NO: 351116 - RNA, 59 nt, Homo Sapiens
auggcuuguuauauaaaauuacauuuuuacauguaaaaauaaacuaaacaaaucuaaug

SEQ ID NO: 351117 - RNA, 59 nt, Homo Sapiens
gaccuuauaagugacauuuaaugucauagcauguaaaggguuuuuuuuguaauaaaaau

SEQ ID NO: 351118 - RNA, 59 nt, Homo Sapiens
cauuccacugaaguucugaaaucuuucgucauguaaauaauuuccauauuucucuuuua

SEQ ID NO: 351119 - RNA, 59 nt, Homo Sapiens
ugucacauuuuguuuaacauuuacaaaaucauguaaauaaauuugugacaaguuugcac

SEQ ID NO: 351120 - RNA, 59 nt, Homo Sapiens
uugucaagcugugaaagaaaguuuuuguacauguaaacagacaugaugcuucuugcugg

SEQ ID NO: 351121 - RNA, 59 nt, Homo Sapiens
acacuaacacuaaccauagucuugggccacauguaaaacgaccgcauuggaagaauuuu

SEQ ID NO: 351122 - RNA, 59 nt, Homo Sapiens
agcuuugcaaaauuuuccagaaacaccuucauguaaaccaauugucugaaauugggaca

SEQ ID NO: 351123 - RNA, 59 nt, Homo Sapiens
uucacaguuaaagacugaauugcuuccaucauguaaaaguaugacauugaguccuucac

SEQ ID NO: 351124 - RNA, 59 nt, Homo Sapiens
augucuuucuuuuuuaaauacuacacauacauguaaaauacauucuuccugauuauuuu

SEQ ID NO: 351125 - RNA, 59 nt, Homo Sapiens
auuguguuaauuauuuuacuucaguauugcauguaaauauucaaaaagugccaaauuug

SEQ ID NO: 351126 - RNA, 59 nt, Homo Sapiens
caaguugguacaaaucaauauuggucuuccauguaaauauucuuuuaggucagccuuug

SEQ ID NO: 351127 - RNA, 59 nt, Homo Sapiens
aacagaauuuugucuucuuuacaauaaaccauguaaaugagacaauuuuaauguuuaca

SEQ ID NO: 351128 - RNA, 59 nt, Homo Sapiens
aacaacacacgcauacagaacuuguuucccauguaaauauucacaggauuguaauuagu

SEQ ID NO: 351129 - RNA, 59 nt, Homo Sapiens
accaguaaaguguaacauauaaaagccaucauguaaauuaccaugucucccagggccuu

SEQ ID NO: 351130 - RNA, 59 nt, Homo Sapiens
gcaguccagaauaagugcuguagcuauugcauguaaaauuuaauucauaauuagaacaa

SEQ ID NO: 351131 - RNA, 59 nt, Homo Sapiens
auuaucuccuuuauagccuggaauaugaucauguaaauguuuggugaccaucuguuuga

SEQ ID NO: 351132 - RNA, 59 nt, Homo Sapiens
ggaauccucucuauacaagugcagacuuacauguaaaccuucagcugugguuauuuaaa

SEQ ID NO: 351133 - RNA, 59 nt, Homo Sapiens
aacuaucuuuguuaucacuaucuuuuuuccauguaaaucgauuaacauauuguaaaugu

SEQ ID NO: 351134 - RNA, 59 nt, Homo Sapiens
ggguugugguuuggggucaggauagauagcauguaaauuauauguggauaacaaagaua

SEQ ID NO: 351135 - RNA, 59 nt, Homo Sapiens
agguuacucaaguuguacuaacuuuuugucauguaaaaagaggacaauuuauauaacuc

SEQ ID NO: 351136 - RNA, 59 nt, Homo Sapiens
cauuucggcuaccauuugcuauaacuuagcauguaaacuuuuuaaagggaaaaguaaau

SEQ ID NO: 351137 - RNA, 59 nt, Homo Sapiens
guuaacauuauccuauuuccacuuuucaucauguaaaaauuagaaauugcaaauaguua

SEQ ID NO: 351138 - RNA, 59 nt, Homo Sapiens
gugcaguaaauauuuacuauaaugucuuucauguaaaaacaacaacaauguguuguaaa

SEQ ID NO: 351139 - RNA, 59 nt, Homo Sapiens
ggcaauggaauuuucuauaaacauuuucucauguaaacaugcugccaccuuuucuucuu

SEQ ID NO: 351140 - RNA, 59 nt, Homo Sapiens
aaaaaagugaauugccaagauacuggugucauguaaauucccacuuuacauaaaaaccc

SEQ ID NO: 351141 - RNA, 59 nt, Homo Sapiens
uuuauugaaagauuucaucugucguguuucauguaaaugagaacagauuauuugcauga

SEQ ID NO: 351142 - RNA, 59 nt, Homo Sapiens
cagugguuagcuauucgcacguuauuugccauguaaaugaaaacgucuuuauuuaucaa

SEQ ID NO: 351143 - RNA, 59 nt, Homo Sapiens
uauaaucaauuagaaguaaugaauggaugcauguaaaauggaugugauuuuuuuucaag

SEQ ID NO: 351144 - RNA, 59 nt, Homo Sapiens
uugcuaaagaccaguucuuuaagcuaagacauguaaaaaaucccaaauggcaguaccuc

SEQ ID NO: 351145 - RNA, 59 nt, Homo Sapiens
aucuauaucuauauauuuuuaaucaucuacauguaaaugaagcaauagaauucuaacau

SEQ ID NO: 351146 - RNA, 59 nt, Homo Sapiens
gaagaaagcuacuaacuuagcuguauucucauguaaauauuuuuuaaauaauuaagcaa

SEQ ID NO: 351147 - RNA, 59 nt, Homo Sapiens
gcuguuacgaauuuacagcagcauuuguacauguaaaauuaaaggcuauuuucuggucu

SEQ ID NO: 351148 - RNA, 59 nt, Homo Sapiens
uaggguaaguaaauauagccaccuguuaacauguaaauaagcauaauuuguuccaaaga

SEQ ID NO: 351149 - RNA, 59 nt, Homo Sapiens
acauggauuuucaucuuucugcauuauuucauguaaauuuucuacacauuuguauacaa

SEQ ID NO: 351150 - RNA, 59 nt, Homo Sapiens
uuuuaaauuguuagcuuccuuaaguauaucauguaaagaaaugucuuaauuuuugaaaa

SEQ ID NO: 351151 - RNA, 59 nt, Homo Sapiens
uauuuaaaaaaagauggcagucaucuagacauguaaaaugccaagaaugucuuagaauu

SEQ ID NO: 351152 - RNA, 59 nt, Homo Sapiens
uuuuuaaguauuuaucauuuuauaguacacauguaaagaauauaugagccuuguaugga

SEQ ID NO: 351153 - RNA, 59 nt, Homo Sapiens
ccaacaucugggucugugucucugauuuccauguaaauguugcaaaaagaguuuuccaa

SEQ ID NO: 351154 - RNA, 59 nt, Homo Sapiens
ucugauuguacaugauaguaaguguaagccauguaaaaaguaaauaaugucugggcaca

SEQ ID NO: 351155 - RNA, 59 nt, Homo Sapiens
auuaagagcacaaacuuuuuuuuguaaaacauguaaaaaaaaaaacugggauuaauuuu

SEQ ID NO: 351156 - RNA, 59 nt, Homo Sapiens
auauaauuccuaguuuccauauuuauccgcauguaaagggccgguuuauccauguuaca

SEQ ID NO: 351157 - RNA, 59 nt, Homo Sapiens
cauuuuuuuuuguagagggugauauauaccauguaaaugaacaaagacauuuuaaauuu

SEQ ID NO: 351158 - RNA, 59 nt, Homo Sapiens
guguauuuuccauauauguaaaacauacacauguaaaauauauguggccauaaauuagg

SEQ ID NO: 351159 - RNA, 59 nt, Homo Sapiens
cacuggucacauuuucaucaagcagucaacauguaaauuucuguuguaaagacaccuua

SEQ ID NO: 351160 - RNA, 59 nt, Homo Sapiens
uaccuauacuuaucuccucauaauaucuucauguaaagaaccaucuguuucuuauugga

SEQ ID NO: 351161 - RNA, 59 nt, Homo Sapiens
gguuuaccuguuacauuuucaaguuaauucauguaaaaaaugauagugauuuugaugua

SEQ ID NO: 351162 - RNA, 59 nt, Homo Sapiens
uguuuauaucuuuugcugugcaaaagaaacauguaaaauguuguucaguuguauauaca

SEQ ID NO: 351163 - RNA, 59 nt, Homo Sapiens
aagaguucucuuauguauuagauacuaaucauguaaaguuccaugugugaaccuugagu

SEQ ID NO: 351164 - RNA, 59 nt, Homo Sapiens
gauuuggggaacggcagaaauauuuaaaacauguaaaagaucgaucauauucuaaaggc

SEQ ID NO: 351165 - RNA, 59 nt, Homo Sapiens
cauuuuaguguuucugguuuauucuuucacauguaaacaugacguaaaucaacgugaug

SEQ ID NO: 351166 - RNA, 59 nt, Homo Sapiens
uucuaaagcaggcugccuugauuuguuaucauguaaauaaaguucuccugcaagguuua

SEQ ID NO: 351167 - RNA, 59 nt, Homo Sapiens
aaaauuaaaaaaaaaaaacagaagauuuucauguaaaauugggauguauggagaggaug

SEQ ID NO: 351168 - RNA, 59 nt, Homo Sapiens
cugccuauugcuaaaauucuaggcuuagucauguaaaaaaggacacauuuuuuaucucu

SEQ ID NO: 351169 - RNA, 59 nt, Homo Sapiens
cuccuguacaagcgaacacguuauacagccauguaaauccgcggcgccccuagccaucu

SEQ ID NO: 351170 - RNA, 59 nt, Homo Sapiens
aguggauccaucuugcuuuuauuucuuuccauguaaagucugggguuugcugcagagcu

SEQ ID NO: 351171 - RNA, 59 nt, Homo Sapiens
auugaagugucuaacaaaugauugaaaaccauguaaaaugaaauuuugguacaguguac

SEQ ID NO: 351172 - RNA, 59 nt, Homo Sapiens
aguuaguguauuagagaagucagagaugucauguaaaaauuucuuccauuaacugcuuc

SEQ ID NO: 351173 - RNA, 59 nt, Homo Sapiens
caccaaauaaauauuacauuaugaccucacauguaaauuucuguaucuuucuuuuguaa

SEQ ID NO: 351174 - RNA, 59 nt, Homo Sapiens
aaagauguugaaucuuguugugucauaaacauguaaauauguguaugaccauuaaugua

SEQ ID NO: 351175 - RNA, 59 nt, Homo Sapiens
auuccuaaagcacaagaaaaagcagaucacauguaaaucaaguauaaaauuaagauaua

SEQ ID NO: 351176 - RNA, 59 nt, Homo Sapiens
aucuaaaaauucuugcaauguuaugcagacauguaaaaaaagcaaaguacacccauuau

SEQ ID NO: 351177 - RNA, 59 nt, Homo Sapiens
ccuauuucucuaagaccauugaaaagccucauguaaaacuccuugaggcuguugcugag

SEQ ID NO: 351178 - RNA, 59 nt, Homo Sapiens
acaaaguauguuucaguuuagcucuuuugcauguaaagcaggaggauuuucuuuagaau

SEQ ID NO: 351179 - RNA, 59 nt, Homo Sapiens
acccaagggaauguuggugagaagaggagcauguaaauuaaucccuuuuugcagugaca

SEQ ID NO: 351180 - RNA, 59 nt, Homo Sapiens
cccauccuucccuucauucaucgaaaaugcauguaaauguuuggucuacaacacaguga

SEQ ID NO: 351181 - RNA, 59 nt, Homo Sapiens
accaaaguaauuuuucugaagaauauugacauguaaaagagagaaagaaccucuuuccu

SEQ ID NO: 351182 - RNA, 59 nt, Homo Sapiens
aaauuuaguuuuuguucuuauuccauauucauguaaacauauuuugauuauuguauuua

SEQ ID NO: 351183 - RNA, 59 nt, Homo Sapiens
gagaauuuauaccagagagaaacccuacacauguaaagaauguggcaaagccuucaaua

SEQ ID NO: 351184 - RNA, 59 nt, Homo Sapiens
auacguuuaauguaauaagaacaagggaacauguaaacuaacauaaccaauugucaguu

SEQ ID NO: 351185 - RNA, 59 nt, Homo Sapiens
ugccuauaucaugaaguacauuaauuucucauguaaaaaaaauagcucuaaaauuuguu

SEQ ID NO: 351186 - RNA, 59 nt, Homo Sapiens
uucaggcccuauaaugugucaggcacugacauguaaaauuuuuuuaauuaaaaaagagc

SEQ ID NO: 351187 - RNA, 59 nt, Homo Sapiens
aaguuugagauuugugauaacuuuguagucauguaaaacuuaagugcuucaugccucuc

SEQ ID NO: 351188 - RNA, 59 nt, Homo Sapiens
cauauuuauguauauguaccauguuguuacauguaaacaaacuucaauuugaagugcag

SEQ ID NO: 351189 - RNA, 59 nt, Homo Sapiens
gugcuuugugguaucugaacaauucauaacauguaaauaaugugggaaaauaguauugu

SEQ ID NO: 351190 - RNA, 59 nt, Homo Sapiens
guucuuuuucacaaguucaaucuguuuuucauguaaauuuuguaugaaaaaucaauguc

SEQ ID NO: 351191 - RNA, 59 nt, Homo Sapiens
uaauuuuaaaguggcuuaguacugccagucauguaaauugauucugcugagggucuuau

SEQ ID NO: 351192 - RNA, 59 nt, Homo Sapiens
aggccuaagaaagguggcaaugaacugugcauguaaauuuuaaauggguacuuugugca

SEQ ID NO: 351193 - RNA, 59 nt, Homo Sapiens
aaaagaacuauuuaaaacucuugaaaacucauguaaauaaaaaucauagggugaaaauu

SEQ ID NO: 351194 - RNA, 59 nt, Homo Sapiens
ugcuguaaaugauaauguguuuaauuuaccauguaaaaugaacauuuuaaaacaaucag

SEQ ID NO: 351195 - RNA, 59 nt, Homo Sapiens
aauucacagucaauaaaguccagaaguuacauguaaaugauuugcacagagugaaaugu

SEQ ID NO: 351196 - RNA, 59 nt, Homo Sapiens
cacaguggcuccguguguuauccuccacacauguaaaggccauuugcauauuaauaugu

SEQ ID NO: 351197 - RNA, 59 nt, Homo Sapiens
uccaaaauguugaucuuccaccugacacccauguaaauguucuguaguucauccuuaau

SEQ ID NO: 351198 - RNA, 53 nt, Homo Sapiens
ucgcuucuucaagugaaugacuucauguaaaugacggaauggugccauuguaa

SEQ ID NO: 351199 - RNA, 59 nt, Homo Sapiens
cuuuuugguuaagaccucacuuugaaugccauguaaagguuuuuuguuuuuguuuuugu

SEQ ID NO: 351200 - RNA, 59 nt, Homo Sapiens
uuucaacucuguaugaaaauaaauuauuccauguaaacauacaggucuuucuguaggga

SEQ ID NO: 351201 - RNA, 59 nt, Homo Sapiens
uauuuaccaacaucuauuguucuguguuccauguaaauuauuauuucucuggauaucuu

SEQ ID NO: 351202 - RNA, 59 nt, Homo Sapiens
gggaauauauggggggagugauaagaaaacauguaaagguugauuaaacuguaugucuu

SEQ ID NO: 351203 - RNA, 59 nt, Homo Sapiens
cauaacuauccucaucaugugauaauaugcauguaaauauauaaaucaaauacacaugu

SEQ ID NO: 351204 - RNA, 59 nt, Homo Sapiens
uuuuguucuucaaaaaaguguaguaaacacauguaaaaaaauaugauauuuaaauaaca

SEQ ID NO: 351205 - RNA, 59 nt, Homo Sapiens
aagauaucuuugcuuuaagauuauucucgcauguaaacacaggguauuauuauagaaua

SEQ ID NO: 351206 - RNA, 59 nt, Homo Sapiens
ccaugaaaguaaaagacuacugucauuagcauguaaaacaaagaaagauauacaugacu

SEQ ID NO: 351207 - RNA, 59 nt, Homo Sapiens
caaaauuuuguuuaaaacucagaauauaacauguaaaaucccaucugcuagaagcccau

SEQ ID NO: 351208 - RNA, 59 nt, Homo Sapiens
uuuaugagggggcccuucacuaaaaaguacauguaaaaguacauuugaugacaauagcu

SEQ ID NO: 351209 - RNA, 59 nt, Homo Sapiens
uguagaagugaguuuguaaauauucuacacauguaaaauauguaaaacuauggguuauu

SEQ ID NO: 351210 - RNA, 59 nt, Homo Sapiens
aaaagagguuuuucuuaaauaauaaagaucauguaaaaguaacaaaugugugaaauuua

SEQ ID NO: 351211 - RNA, 59 nt, Homo Sapiens
cuguacuacaaucaacuuuauuuugaaaucauguaaaauaagauauuagacuguuuuuu

SEQ ID NO: 351212 - RNA, 59 nt, Homo Sapiens
ggugggaaauuuagcugacuagggacaaacauguaaaccuauuuuccuaugaaaaaaau

SEQ ID NO: 351213 - RNA, 59 nt, Homo Sapiens
uccuacuaaaugaaagugcacuacugccucauguaaagacucuugcacgcagagccuuu

SEQ ID NO: 351214 - RNA, 59 nt, Homo Sapiens
uuaaagaaaaaugcaaucaggauuuuaaacauguaaauacaaauuuuguauaacuuuug

SEQ ID NO: 351215 - RNA, 59 nt, Homo Sapiens
uuaaaaugcucaauuucagcaccgauggccauguaaauaagaugauuuaauguugauuu

SEQ ID NO: 351216 - RNA, 59 nt, Homo Sapiens
uuuuguucugaaagugauauuauauuguacauguaaaauuaauuuaaauauuuuuucaa

SEQ ID NO: 351217 - RNA, 59 nt, Homo Sapiens
agcagaugagggaccagcacucagucuaacauguaaacaucauacguaauaaagguugu

SEQ ID NO: 351218 - RNA, 59 nt, Homo Sapiens
cacuuaaaguuuuuuauauaugaauauuacauguaaagcuguuaaaauacauaacuuca

SEQ ID NO: 351219 - RNA, 59 nt, Homo Sapiens
gcugcuucugugugauuucuuccaaaauacauguaaaaucuuguacacaucuuagcugc

SEQ ID NO: 351220 - RNA, 59 nt, Homo Sapiens
uacugccuacuuuaccuaguucaccuuaacauguaaauccacaggguagauuucuuucu

SEQ ID NO: 351221 - RNA, 59 nt, Homo Sapiens
aagagagaguggcuuugucaguauaaaaccauguaaagucaucaucaagucaucuggau

SEQ ID NO: 351222 - RNA, 59 nt, Homo Sapiens
uacugcuuccucacaagucucccacaggccauguaaaggguauuuuuuuguggcuugcu

SEQ ID NO: 351223 - RNA, 59 nt, Homo Sapiens
uggcuuucuggagucugccacauuaauaccauguaaagccaaucagccccuaccacgag

SEQ ID NO: 351224 - RNA, 59 nt, Homo Sapiens
gguagcaaguaaugauuacacagauguugcauguaaauuaaaucaaaugucaguccuag

SEQ ID NO: 351225 - RNA, 59 nt, Homo Sapiens
uauuguauuauuacacuuguuuugcuucccauguaaaucauauaaaaugucccuuggau

SEQ ID NO: 351226 - RNA, 59 nt, Homo Sapiens
aauguuuuccuguagucauauguagagggcauguaaauauauguuuuguaaauccauuu

SEQ ID NO: 351227 - RNA, 59 nt, Homo Sapiens
aaaucccgccgcaacuguuuuuguacguacauguaaaacauuucaaggcuaauaccuac

SEQ ID NO: 351228 - RNA, 59 nt, Homo Sapiens
guucuguuaauaacccacugguaaauaugcauguaaauauguguacaaaaggauugcuu

SEQ ID NO: 351229 - RNA, 59 nt, Homo Sapiens
uuuaugguacagauaguuauuuuucguggcauguaaauuuuuaaaauuauaaauuaaug

SEQ ID NO: 351230 - RNA, 59 nt, Homo Sapiens
aaggaagcuaagcaguggguaaaugcuuacauguaaagacccuuuuaaaaccuagauau

SEQ ID NO: 351231 - RNA, 59 nt, Homo Sapiens
aggacaauuuaaaaauuuuaaguauauuacauguaaaacuacauuacauguauauuaca

SEQ ID NO: 351232 - RNA, 59 nt, Homo Sapiens
gacaaaaggaaacauuugcccguuauuuacauguaaauagugucauguugcagguucaa

SEQ ID NO: 351233 - RNA, 59 nt, Homo Sapiens
auuaaaacaauauugaugcugccucacagcauguaaauaagcuuuggucccacagccuu

SEQ ID NO: 351234 - RNA, 59 nt, Homo Sapiens
ugugccuuacaccuugaguuuguuuuccacauguaaauugguuacaucugugaauagcc

SEQ ID NO: 351235 - RNA, 59 nt, Homo Sapiens
auaauuuaacuuuuaacauucacuacuugcauguaaagacauguggagaaaauuauuca

SEQ ID NO: 351236 - RNA, 59 nt, Homo Sapiens
aaaacuaaaaauaagucgcccagacgcuucauguaaauaaaguuuacauuuuuguacug

SEQ ID NO: 351237 - RNA, 59 nt, Homo Sapiens
acagcacgucuguuccaaggccuuaccuccauguaaagauuagacccaucuuaauuaag

SEQ ID NO: 351238 - RNA, 59 nt, Homo Sapiens
gagguaggaugaauugaucauuucagcugcauguaaaaguaugucccuagccugucauu

SEQ ID NO: 351239 - RNA, 59 nt, Homo Sapiens
ccuuuaauaagucauugaaauacugaugccauguaaaggcauucaucucuaacauauga

SEQ ID NO: 351240 - RNA, 59 nt, Homo Sapiens
ucuuguacaaaaaauggaaucuaaagcuacauguaaaguaaggggcuugagcaugaccc

SEQ ID NO: 351241 - RNA, 59 nt, Homo Sapiens
uuuuaaaguuaugaacucaguuaauauggcauguaaagcuauauaaaugaagaacauuu

SEQ ID NO: 351242 - RNA, 59 nt, Homo Sapiens
caauaacuggaagaaaaugaugugaauuucauguaaaugaccagaggaaagauggauaa

SEQ ID NO: 351243 - RNA, 59 nt, Homo Sapiens
uaccgauuagaucuauccauuguagaauucauguaaauagaauacuguaguauguacuu

SEQ ID NO: 351244 - RNA, 56 nt, Homo Sapiens
ccagccucuacacccagugaaugccccauguaaaaacaugaugauaaaacagcaaa

SEQ ID NO: 351245 - RNA, 59 nt, Homo Sapiens
ucauucuucacaaaagaauaguagaggaucauguaaaccugagccuaacucuuguucca

SEQ ID NO: 351246 - RNA, 59 nt, Homo Sapiens
aaguauaagugaaugauauuuuucuuuuacauguaaacaaugaaguuauuucaaaguua

SEQ ID NO: 351247 - RNA, 59 nt, Homo Sapiens
gagcaccauugcugguuccauuuagcuuacauguaaauguaauuauuuaaaacacacac

SEQ ID NO: 351248 - RNA, 59 nt, Homo Sapiens
auggugccuaagagagcuauauauauacacauguaaaguccauuguuuuuauuguccug

SEQ ID NO: 351249 - RNA, 59 nt, Homo Sapiens
cuuucaauaacaguaauguauaauaaaaccauguaaaguuuuguuguauuuugauucga

SEQ ID NO: 351250 - RNA, 59 nt, Homo Sapiens
uuuauaaccacuuaaauugugagccaagccauguaaaagaucuacuuuuucuaagggca

SEQ ID NO: 351251 - RNA, 59 nt, Homo Sapiens
gugaucuuuauuuauaguaaauuauguuucauguaaaugauauauuuuuggugaaaugc

SEQ ID NO: 351252 - RNA, 59 nt, Homo Sapiens
guacccuugggucgcacgggccuggcuggcauguaaacggucaguugcacugccuagug

SEQ ID NO: 351253 - RNA, 59 nt, Homo Sapiens
aaccuagagauuuuaaaucaugaauugaacauguaaaauuccaguaaaauguaaaaacg

SEQ ID NO: 351254 - RNA, 59 nt, Homo Sapiens
gaauaaauggaagcauuaauuguuuugaacauguaaauauaaaucugucagccacuaca

SEQ ID NO: 351255 - RNA, 59 nt, Homo Sapiens
aaaaaaaaaaaaaaaaaggaaagaacugucauguaaacauaccaacauguuuaaaccug

SEQ ID NO: 351256 - RNA, 59 nt, Homo Sapiens
gccccucugaggauuugggccuuuuauuucauguaaacucuccuguuaaaaaaauugua

SEQ ID NO: 351257 - RNA, 59 nt, Homo Sapiens
ccaacugguccauacccauugggaucaagcauguaaacagccaguacaccaaggcugua

SEQ ID NO: 351258 - RNA, 59 nt, Homo Sapiens
ugcuuagaacaggaccuaggaggaacugacauguaaaagugguuguucuaagaauuaaa

SEQ ID NO: 351259 - RNA, 59 nt, Homo Sapiens
aaagaucgcaggaauguggaugcuccaagcauguaaagaucuggauccagaaggccuua

SEQ ID NO: 351260 - RNA, 59 nt, Homo Sapiens
gacuguacuaggccuacuggagcuaucuucauguaaauucauugccguggcaucuuaaa

SEQ ID NO: 351261 - RNA, 59 nt, Homo Sapiens
gggaaauuaguauaugauguuuaaagcugcauguaaaaggugccauuguuuggacaaua

SEQ ID NO: 351262 - RNA, 59 nt, Homo Sapiens
gccauuuauauuuuagaaaaguucuuuugcauguaaacuugaggucauccagcuggugu

SEQ ID NO: 351263 - RNA, 59 nt, Homo Sapiens
uuaccuuuuguuauugagcauugucuacacauguaaaacuugcuuuguauuaaaccucu

SEQ ID NO: 351264 - RNA, 59 nt, Homo Sapiens
aguuauuacaaauauuuuauggcaccacacauguaaaacuucagauauauuauuuuaaa

SEQ ID NO: 351265 - RNA, 59 nt, Homo Sapiens
uggcaaaaaaaauuuuuuacaaagcuuaacauguaaaaugcaugauuuuuuuggucuua

SEQ ID NO: 351266 - RNA, 59 nt, Homo Sapiens
uguacaagugcaucacugguauuccaccccauguaaauaaucuaaaaauaugggaaaac

SEQ ID NO: 351267 - RNA, 59 nt, Homo Sapiens
uuucuguauuuuuuauauguuuuuguauacauguaaauaucugaaaucuguuuuaauau

SEQ ID NO: 351268 - RNA, 59 nt, Homo Sapiens
aagguguucuuagaauucgcagcagucgacauguaaauggcaagugacugcuuucaagc

SEQ ID NO: 351269 - RNA, 59 nt, Homo Sapiens
uacauaauaaaauuccaggcacaacuuaacauguaaauggaaaacgugggccggugaaa

SEQ ID NO: 351270 - RNA, 59 nt, Homo Sapiens
aguuacaaaaauaaacgaacuaaucggaacauguaaaacgacauaagcuaccgauuaac

SEQ ID NO: 351271 - RNA, 59 nt, Homo Sapiens
cucuuugcugaaauugaauugcacuuauacauguaaauugucaacauguaauuuggaau

SEQ ID NO: 351272 - RNA, 59 nt, Homo Sapiens
augauugacucauucauaguaaauaugggcauguaaacuaauaaauaugcacuggauac

SEQ ID NO: 351273 - RNA, 59 nt, Homo Sapiens
gcaaaaggggaagaaaggaauugcgaauacauguaaaaugucaccagacauuuguauua

SEQ ID NO: 351274 - RNA, 59 nt, Homo Sapiens
aauauggaaaagccauuuauaucugcucacauguaaaaacaucaguucauacuuaauaa

SEQ ID NO: 351275 - RNA, 59 nt, Homo Sapiens
ucuaaaacuacuagaucucaucccauucccauguaaauuaccacagaccgcaguaccgg

SEQ ID NO: 351276 - RNA, 59 nt, Homo Sapiens
gaagaggaauauaaaugcucuagaguuaacauguaaaauauauacguacugagguuugu

SEQ ID NO: 351277 - RNA, 59 nt, Homo Sapiens
ccugugcuauuaaauauaucagggcagugcauguaaaucauccugauauauuuaauaua

SEQ ID NO: 351278 - RNA, 59 nt, Homo Sapiens
aaucugucuagaauccugcuuuacaggaucauguaaaugcucaaagauguaauguaguu

SEQ ID NO: 351279 - RNA, 59 nt, Homo Sapiens
cacaaaauuucacucucuaaaagcaacagcauguaaacuagaaugaaagaaggaaauua

SEQ ID NO: 351280 - RNA, 59 nt, Homo Sapiens
gaaagagacgaggggugaucugugagucccauguaaacuuuguacauuggaauauuuau

SEQ ID NO: 351281 - RNA, 59 nt, Homo Sapiens
gcugggagggcggagaauucagguuccagcauguaaagaggugacccagcaucugaguu

SEQ ID NO: 351282 - RNA, 59 nt, Homo Sapiens
aaauaagucagcgaaaaaaauuauguaaacauguaaagaaguauguggacucuguuccu

SEQ ID NO: 351283 - RNA, 59 nt, Homo Sapiens
ccuuguagauagcuugagcuuugaccuugcauguaaaaaaguccucuggauugagauac

SEQ ID NO: 351284 - RNA, 59 nt, Homo Sapiens
gaaccaaacucacaauauuaagccugcuacauguaaaaauuguaauuuaacaauaaaua

SEQ ID NO: 351285 - RNA, 59 nt, Homo Sapiens
guugagcuaagcaagccccgauuuauugucauguaaauauuuauguuuugaguuuugga

SEQ ID NO: 351286 - RNA, 59 nt, Homo Sapiens
cuuguauuuaccaaagauuuacauuuuuacauguaaauauuuacugaaauuugagcuaa

SEQ ID NO: 351287 - RNA, 59 nt, Homo Sapiens
aguguagauagaggaauuaauauuuuagccauguaaauacaaaagacuuuuuucaaugu

SEQ ID NO: 351288 - RNA, 59 nt, Homo Sapiens
ugaaaguucaggggucuauuguauucucacauguaaauuuagaaaguuaagauguaaau

SEQ ID NO: 351289 - RNA, 59 nt, Homo Sapiens
augagugcuaaaguaagcuugcauuuaaccauguaaaaggugaucucaaauuaggaaau

SEQ ID NO: 351290 - RNA, 59 nt, Homo Sapiens
gaacuguuuccuguauaaagaccaaacuacauguaaaguaauaagcuuuuuccagccaa

SEQ ID NO: 351291 - RNA, 59 nt, Homo Sapiens
uuaaauuauaauauugcugcaaauuuguccauguaaagcaaaaucauuuuuucaaagaa

SEQ ID NO: 351292 - RNA, 59 nt, Homo Sapiens
ggauauauaauuugccaaagaauuuuaaacauguaaaauauucuucgaguucaaagcac

SEQ ID NO: 351293 - RNA, 59 nt, Homo Sapiens
uucuaccaauuugcuguauauaaaauuaucauguaaaugcuuucugucuguggauucug

SEQ ID NO: 351294 - RNA, 59 nt, Homo Sapiens
augccgcuauuacaacuuacuaauagucucauguaaaaugacuuaauauuauccuuuuc

SEQ ID NO: 351295 - RNA, 59 nt, Homo Sapiens
aguuucccauuucccuuucuauuuuucaucauguaaacaagagucaaucucuuaauuau

SEQ ID NO: 351296 - RNA, 59 nt, Homo Sapiens
caccugcaccguuucugagcaccgauugacauguaaaugugcaaaccucugagccugga

SEQ ID NO: 351297 - RNA, 59 nt, Homo Sapiens
uaagcacguagagaugauucuuuugacaucauguaaaccaucacuuaaugaaccacgug

SEQ ID NO: 351298 - RNA, 59 nt, Homo Sapiens
gacuauuuuuuauaaucuuuauacuaugccauguaaauauguuuauauaucacugaggu

SEQ ID NO: 351299 - RNA, 59 nt, Homo Sapiens
cagaagauaagccauguuucuguauuguacauguaaagaaaaauaaaacuguuuaugau

SEQ ID NO: 351300 - RNA, 59 nt, Homo Sapiens
gaaagggcucccucaucagagacgugcgacauguaaaccaaauuaaacuauggugucca

SEQ ID NO: 351301 - RNA, 59 nt, Homo Sapiens
aguuuuuuuuauuugaguccaguauaauucauguaaauguuaacaauuagaauaauacu

SEQ ID NO: 351302 - RNA, 59 nt, Homo Sapiens
auuuugggugccauuaaauagggaaaaaacauguaaaaaauguaaaauggagaccaauu

SEQ ID NO: 351303 - RNA, 59 nt, Homo Sapiens
aucuaaucuuaaaacauuugaauucuaaacauguaaaaugugacagccugcaauuuugu

SEQ ID NO: 351304 - RNA, 59 nt, Homo Sapiens
auguuuacauuuacuaaggugugcugggucauguaaaauauuagacacuaauauuuuca

SEQ ID NO: 351305 - RNA, 59 nt, Homo Sapiens
auuccuucaacagacugcuauauauucaccauguaaacugcagccaccuuuagugauac

SEQ ID NO: 351306 - RNA, 59 nt, Homo Sapiens
uucacaguucauaaaagaugugaccacuacauguaaaaauagcauucuacuugaucuua

SEQ ID NO: 351307 - RNA, 59 nt, Homo Sapiens
cauuaaguuuugcauaucuuuuguuaugccauguaaauucccuuuuucguaugauuaaa

SEQ ID NO: 351308 - RNA, 59 nt, Homo Sapiens
gcaugacauacuuuugcuuucaguaguuucauguaaagaaaaaaacuugaaaauaguaa

SEQ ID NO: 351309 - RNA, 59 nt, Homo Sapiens
auuuuuuaaaguuaauaauauaaaguggccauguaaaauauuuuauuuuccaggcuaaa

SEQ ID NO: 351310 - RNA, 59 nt, Homo Sapiens
uaacuuuucuuaugaaaaauacauauuugcauguaaacaaugauuucaaaauacuugaa

SEQ ID NO: 351311 - RNA, 59 nt, Homo Sapiens
uguuguacggugucuagaauuaaagaauacauguaaacuuucaugguauuuagccuuuc

SEQ ID NO: 351312 - RNA, 59 nt, Homo Sapiens
uguugggaccuucugagccuucuacuuaucauguaaauguauuggcacagugcuuacau

SEQ ID NO: 351313 - RNA, 59 nt, Homo Sapiens
ccucacaagcaaaugcuaaggggaacauacauguaaaaagccagcaaacuaucuucaaa

SEQ ID NO: 351314 - RNA, 59 nt, Homo Sapiens
caaccugggcagaaaaaaaaaaaaaaagacauguaaaauuuuguuauuuccagucugua

SEQ ID NO: 351315 - RNA, 59 nt, Homo Sapiens
auuuguggcaauuuuauguucuuuuuggccauguaaacuucauuuuauuuuugacguca

SEQ ID NO: 351316 - RNA, 59 nt, Homo Sapiens
uauagcuuagaauauucuuacaaaguccacauguaaauugcugcaucccagguguguag

SEQ ID NO: 351317 - RNA, 59 nt, Homo Sapiens
uacccagcuucucagacuuguuuugauaccauguaaaccuuuuggcugcagauguuaaa

SEQ ID NO: 351318 - RNA, 59 nt, Homo Sapiens
gauauaaucuucuuuaacaacacugcuuucauguaaaauaacuguuuaagcaaaaaaug

SEQ ID NO: 351319 - RNA, 59 nt, Homo Sapiens
guauaagauuuuaauguaaucaccucuuacauguaaagguguucuagguuuaugaauuu

SEQ ID NO: 351320 - RNA, 59 nt, Homo Sapiens
agucuugguucugaaacuucacagcuuuucauguaaauuacuuuucaacuacuuucucu

SEQ ID NO: 351321 - RNA, 59 nt, Homo Sapiens
agaaaaaaagagugaaaaaggguuaauuucauguaaaacgguagccagaugauaaauau

SEQ ID NO: 351322 - RNA, 59 nt, Homo Sapiens
acuggucacaaaugaacugacuucuuuuucauguaaaccggcagagauuauaucccuau

SEQ ID NO: 351323 - RNA, 59 nt, Homo Sapiens
aacauucacugguuccagggacauuuugccauguaaacuauuaaacacaucugcaggac

SEQ ID NO: 351324 - RNA, 59 nt, Homo Sapiens
auugccaaaaagugaaauaauguguaguucauguaaauaauacauuauauuucuauuuu

SEQ ID NO: 351325 - RNA, 59 nt, Homo Sapiens
cagaauugaugguuguauaagaacuagcucauguaaaaauaaaauaacauuauuacauu

SEQ ID NO: 351326 - RNA, 59 nt, Homo Sapiens
aaucagaacccagggcaacaaugccauuucauguaaacauuuucucucucaccauguuu

SEQ ID NO: 351327 - RNA, 59 nt, Homo Sapiens
aagaacaauagauguugcuuuucccgugucauguaaauuuguugcacuuuuuugggcug

SEQ ID NO: 351328 - RNA, 59 nt, Homo Sapiens
ucuaugaaaugaguggaccauuaaccuuacauguaaagauuauguuaguaauuaagaaa

SEQ ID NO: 351329 - RNA, 59 nt, Homo Sapiens
auuuauggucuauauaccaauuuaaauggcauguaaaccugccuguuucuucuccucuu

SEQ ID NO: 351330 - RNA, 59 nt, Homo Sapiens
guaaaauuagcucuuucaaaucuucuugucauguaaaaugaagcuagucuguuuuaaaa

SEQ ID NO: 351331 - RNA, 59 nt, Homo Sapiens
aggaacaacuuucuccuuaugauugucagcauguaaaucacaacccccuauaccuggaa

SEQ ID NO: 351332 - RNA, 59 nt, Homo Sapiens
uuaauuccauuuucgaagccuaucaaugccauguaaaaaguuguauugaaauaguaacu

SEQ ID NO: 351333 - RNA, 59 nt, Homo Sapiens
ccuucuugcuuuucugugggagcagcacccauguaaauagagcuugcuuuuguugcuuc

SEQ ID NO: 351334 - RNA, 59 nt, Homo Sapiens
uuuuuaaaaugguaaaaaaaaaaagauaacauguaaauggucauguccuuacaggucuu

SEQ ID NO: 351335 - RNA, 59 nt, Homo Sapiens
cuugaagacacauccuggaaaauaggacacauguaaauccucuggaaauaucuacaacu

SEQ ID NO: 351336 - RNA, 59 nt, Homo Sapiens
agcaagagcacugccucuaugcacuuuggcauguaaacauucgucaccucuuccacaga

SEQ ID NO: 351337 - RNA, 59 nt, Homo Sapiens
agcuuguaucuccuucccuggaucuaucacauguaaacguucgguagaugccuuuguua

SEQ ID NO: 351338 - RNA, 59 nt, Homo Sapiens
ccuuauaaaucauguaauuuagugccacucauguaaaucaguaaaaucacaaaggucua

SEQ ID NO: 351339 - RNA, 59 nt, Homo Sapiens
cucugcucaugaaugaacaaagaagcaggcauguaaaauggauccuuguccuaacguca

SEQ ID NO: 351340 - RNA, 59 nt, Homo Sapiens
gcugagguggcuaaauaccuagccuuuuacauguaaaccugucugcaaaauuagcuuuu

SEQ ID NO: 351341 - RNA, 59 nt, Homo Sapiens
cccacccccgaaaauguucaauaaugucccauguaaaaccugcuacaaauggcagcuua

SEQ ID NO: 351342 - RNA, 59 nt, Homo Sapiens
auagaauuuguggaaggagagaggauacacauguaaaauuacaucuggucucuuccuuc

SEQ ID NO: 351343 - RNA, 59 nt, Homo Sapiens
uaagauucuucucagcaguugcugaaaagcauguaaauaacuacauaauagccugagaa

SEQ ID NO: 351344 - RNA, 59 nt, Homo Sapiens
uuauauuuuaauaggaaguugacucccagcauguaaaagugauccacgcagccggagug

SEQ ID NO: 351345 - RNA, 59 nt, Homo Sapiens
agggacuugguguuaaaacaggauuagagcauguaaagguacaucuagauucauauuug

SEQ ID NO: 351346 - RNA, 59 nt, Homo Sapiens
aauguaucuucaaauucagauuuaauaaacauguaaagauccucuguauauaaaaguug

SEQ ID NO: 351347 - RNA, 59 nt, Homo Sapiens
augugauaucaaugaagaaauauuuguagcauguaaacgguuauuucuguuucuuaaaa

SEQ ID NO: 351348 - RNA, 59 nt, Homo Sapiens
gauuuuacuggauucuguucacuguagagcauguaaaauuuagguugcuccugaaacug

SEQ ID NO: 351349 - RNA, 59 nt, Homo Sapiens
uauuaaaggaacguauuuuuaauauaugacauguaaaaauuuguuucucauuaaauauu

SEQ ID NO: 351350 - RNA, 59 nt, Homo Sapiens
gugcaccaagcaggaaaugacaaagcuuucauguaaacuugcaaaaggacucucaggac

SEQ ID NO: 351351 - RNA, 59 nt, Homo Sapiens
acauaaauaacaaaucucaaauauuaaaccauguaaagaucuguuuucuuucuaaugag

SEQ ID NO: 351352 - RNA, 59 nt, Homo Sapiens
auagugauaucaaauauucuuauaugugccauguaaaauagugcugguaauuauauggu

SEQ ID NO: 351353 - RNA, 59 nt, Homo Sapiens
gguugccuuauuauggagaacaaggucugcauguaaauggugugauguagacaauguua

SEQ ID NO: 351354 - RNA, 59 nt, Homo Sapiens
aauuuuagugcaauaugaaguaguucuuccauguaaaauagguauuaugaugcaucaac

SEQ ID NO: 351355 - RNA, 59 nt, Homo Sapiens
aagugauguguaggcauuguuguugaauucauguaaauguugcugcaugccaagaagua

SEQ ID NO: 351356 - RNA, 59 nt, Homo Sapiens
gacaaaaaccaaguuaucugcaauauggacauguaaaaaauagcugcauuaaaaaaaua

SEQ ID NO: 351357 - RNA, 59 nt, Homo Sapiens
gugagaaauuacuucaaaauuauuuucaacauguaaaaaaacauuuuuugaaaagcuuu

SEQ ID NO: 351358 - RNA, 59 nt, Homo Sapiens
cuuacacacacugccagagauacucuaggcauguaaagcacaaacauacauauaaaauc

SEQ ID NO: 351359 - RNA, 59 nt, Homo Sapiens
ggguggugagguuuugaaagacagauuuccauguaaaugugcacaagccaggcauggcu

SEQ ID NO: 351360 - RNA, 59 nt, Homo Sapiens
uaaacacaaaauugguuucaaaauguuuucauguaaaaauaaauuaacuuuucuguaau

SEQ ID NO: 351361 - RNA, 59 nt, Homo Sapiens
aucuggccaaacaacugugguuaaaaacacauguaaaaugcuuuuuaacagcugauacu

SEQ ID NO: 351362 - RNA, 59 nt, Homo Sapiens
cauuuuggaauauuugagaauguaugauacauguaaaauuaaaaaaacuauuagaacug

SEQ ID NO: 351363 - RNA, 59 nt, Homo Sapiens
gcaaagaucuguguguguuggggagcugucauguaaaucaaagccaagguugucaaaga

SEQ ID NO: 351364 - RNA, 59 nt, Homo Sapiens
cguguuagcccauuugaggucuggggaaucauguaaaggguacccagaccucacuuuua

SEQ ID NO: 351365 - RNA, 59 nt, Homo Sapiens
agcaugucccugccucccaugaaucuuaccauguaaauccaaaucucugcaauccugug

SEQ ID NO: 351366 - RNA, 50 nt, Homo Sapiens
ugaagaaauguagugugugacauguaaaaacuuucauccugguuuccacu

SEQ ID NO: 351367 - RNA, 59 nt, Homo Sapiens
gcaguaauuuaggggagacagaggaguuucauguaaagagcaugcaguuuggagucaga

SEQ ID NO: 351368 - RNA, 59 nt, Homo Sapiens
guguauauauacacacauacauaugccaacauguaaauaaccucauguuuauuccuaau

SEQ ID NO: 351369 - RNA, 59 nt, Homo Sapiens
uucuguguccuucuacuccagcaucgucucauguaaaauaagaaagcccuaaaauacua

SEQ ID NO: 351370 - RNA, 59 nt, Homo Sapiens
aagugaccuaagaacacuuuaaaaagcaacauguaaaugauuggaaauuaauauaguac

SEQ ID NO: 351371 - RNA, 59 nt, Homo Sapiens
aaaaaacaauauuuauuguaauuauucaccauguaaaacguucucucuaugguaaagau

SEQ ID NO: 351372 - RNA, 59 nt, Homo Sapiens
uaaucaacagaugaagagaaauugcucuccauguaaauguauuugccuaauggcaacuc

SEQ ID NO: 351373 - RNA, 59 nt, Homo Sapiens
ugcucaaccugguuuccaaaggugugugacauguaaaaauggaaauagugaaaaaaugu

SEQ ID NO: 351374 - RNA, 59 nt, Homo Sapiens
aaacacuauguuaguaucuauuucacacacauguaaaugacccuggcucuucacccagg

SEQ ID NO: 351375 - RNA, 59 nt, Homo Sapiens
aaaaaccuuguauuuaacucauugcuugucauguaaauuagguucgauacagcguauuu

SEQ ID NO: 351376 - RNA, 59 nt, Homo Sapiens
ucaaucugcaugugcuucuuacuacacagcauguaaaagaucuauugcaccuaaggaau

SEQ ID NO: 351377 - RNA, 59 nt, Homo Sapiens
cgauuguauguuuuggaaggaucaagaugcauguaaaguugguucuugagcucucugac

SEQ ID NO: 351378 - RNA, 59 nt, Homo Sapiens
auguauuacaaucucaaagcaacacacugcauguaaaagaacgauuaagucuaccaaag

SEQ ID NO: 351379 - RNA, 59 nt, Homo Sapiens
ccagacugcagguuggacccugggagacccauguaaauagagccaggcaacuucagucc

SEQ ID NO: 351380 - RNA, 59 nt, Homo Sapiens
uccuguuauucuggaaaaacacauuucaucauguaaaauauuuguaccgacagaaauag

SEQ ID NO: 351381 - RNA, 59 nt, Homo Sapiens
uucggauucacuucuuguauauuuugcugcauguaaaguaaaucauuuuguauuuggag

SEQ ID NO: 351382 - RNA, 59 nt, Homo Sapiens
gaggguuuccaggaguaguacuaugacaucauguaaacacauucaguuuucauguugga

SEQ ID NO: 351383 - RNA, 59 nt, Homo Sapiens
ucuuguuuuuaaucuugugcaugauaccccauguaaaauccaccuugugcaagauuucu

SEQ ID NO: 351384 - RNA, 59 nt, Homo Sapiens
guguguguauauaagcucccacauagauacauguaaaacauauucacacccaugcacgc

SEQ ID NO: 351385 - RNA, 59 nt, Homo Sapiens
cucauagggagauguacuguauuauauaacauguaaaguugauuuucuugugacaagag

SEQ ID NO: 351386 - RNA, 59 nt, Homo Sapiens
aacuauuuuuuuaaaugucaaacuucuaucauguaaauggacuuauagagaacaaaaag

SEQ ID NO: 351387 - RNA, 59 nt, Homo Sapiens
uaccucgauagcauaagagagaccuaagacauguaaaauacguauauugcaguaucauc

SEQ ID NO: 351388 - RNA, 59 nt, Homo Sapiens
gagauuaacugggauuaagugagaugacgcauguaaagaugcuguguaaacuguaauuc

SEQ ID NO: 351389 - RNA, 59 nt, Homo Sapiens
aauacauauuauuuaccccacuguaacaucauguaaacuaaguauguuuuuaaacaauu

SEQ ID NO: 351390 - RNA, 59 nt, Homo Sapiens
gggauugauuaaugucccgcuccugaauacauguaaaauuuguacaaaaauaucuucua

SEQ ID NO: 351391 - RNA, 59 nt, Homo Sapiens
ugaugggccaggguguaggauucauucuccauguaaaguuuccuuucauccugccuagc

SEQ ID NO: 351392 - RNA, 59 nt, Homo Sapiens
caucuuuuucuugcuucuaaaacauauuucauguaaacauuguacauuuauuauuguaa

SEQ ID NO: 351393 - RNA, 59 nt, Homo Sapiens
guuauuaguaauuuuuucuuuugcauuaccauguaaaauuuagacauuugaauuuugua

SEQ ID NO: 351394 - RNA, 59 nt, Homo Sapiens
uuuuauaaacucuuggacuauguauuugacauguaaaauauguacaguauuaacgucaa

SEQ ID NO: 351395 - RNA, 59 nt, Homo Sapiens
gauccuuuuagauuaaaaauaaaaugucgcauguaaaggcugaagucgcguuuuaucag

SEQ ID NO: 351396 - RNA, 59 nt, Homo Sapiens
uuugccacucaucuguguuuuacuugagacauguaaauaugauagggaaggaacugaau

SEQ ID NO: 351397 - RNA, 59 nt, Homo Sapiens
ucacauguucuguguucauuaucccuacacauguaaauuaauuauuuuaucaauacuag

SEQ ID NO: 351398 - RNA, 59 nt, Homo Sapiens
uuuuaggaugucaucauuuugaugugaaucauguaaauguugauaauaugcuguuuauu

SEQ ID NO: 351399 - RNA, 59 nt, Homo Sapiens
cacagugcuguaauuuuguauguagcaaucauguaaauacauguauggauuuuauaaua

SEQ ID NO: 351400 - RNA, 59 nt, Homo Sapiens
gucugugugccuguaucaacaugugacuucauguaaaguuucuuuguguucacaguucu

SEQ ID NO: 351401 - RNA, 59 nt, Homo Sapiens
agcucuugcauugcauagaugaaccucagcauguaaagaacuauuuuuuuaaagaagug

SEQ ID NO: 351402 - RNA, 59 nt, Homo Sapiens
gaacuuggguagguaaauaagauaacucacauguaaaagagggggcaagguggaaugca

SEQ ID NO: 351403 - RNA, 59 nt, Homo Sapiens
uagugcaacccagucgggcugccaguaaacauguaaauaguggugcuagccaggaagaa

SEQ ID NO: 351404 - RNA, 59 nt, Homo Sapiens
cuaugcaaguguuuuuacaaaggccacuacauguaaaaacuucauaaggaucaagguuc

SEQ ID NO: 351405 - RNA, 59 nt, Homo Sapiens
agaacucaacugcuguuuacuucuuugcccauguaaaugugaaaauaguuuaaagugcu

SEQ ID NO: 351406 - RNA, 59 nt, Homo Sapiens
uuaggaaugaacagaggccuguagagaaccauguaaacaccauguuggugcccuucaga

SEQ ID NO: 351407 - RNA, 59 nt, Homo Sapiens
aaaaaaaaaaacaacaacaaggcccaggacauguaaaaaccauuuaguaaaauguagcu

SEQ ID NO: 351408 - RNA, 59 nt, Homo Sapiens
gauuuuuuguucugauuuuuacuguacuacauguaaacuucuauagcuauuuacuugua

SEQ ID NO: 351409 - RNA, 59 nt, Homo Sapiens
uguuaaaaaucaaaaucuuaguaauuggacauguaaacuuucauuccuuuuaucuacau

SEQ ID NO: 351410 - RNA, 59 nt, Homo Sapiens
aaaagucauaaaaugcuucucguuggcgacauguaaaaugccacuguauguuguacaaa

SEQ ID NO: 351411 - RNA, 59 nt, Homo Sapiens
cucauuuucuuuaggacauaacccauaaucauguaaaugaucuuuuuuaauucaguaca

SEQ ID NO: 351412 - RNA, 59 nt, Homo Sapiens
aguauuaaaauuuggccaaaaacagaaaacauguaaagcguaauacgaauuguuucaca

SEQ ID NO: 351413 - RNA, 59 nt, Homo Sapiens
auuaagcauagcgccuggcagauuaagugcauguaaagcuaaauguuuguugaaugaau

SEQ ID NO: 351414 - RNA, 59 nt, Homo Sapiens
uguagcaguguacccacgcuggguauuaccauguaaauaaucugugagugaaaguugcc

SEQ ID NO: 351415 - RNA, 59 nt, Homo Sapiens
aagaacucuuaggaacauugccuuuuggacauguaaaauauuuaggauuugaccacaca

SEQ ID NO: 351416 - RNA, 59 nt, Homo Sapiens
acaccagcugcuaucaagcaagcuuauaucauguaaauuauaugaauuaggagauguuu

SEQ ID NO: 351417 - RNA, 59 nt, Homo Sapiens
cagagaauucacugacguguggcuuaauacauguaaaucuagaccucugacaucauggu

SEQ ID NO: 351418 - RNA, 59 nt, Homo Sapiens
uuccuugaauuaugcaaugcaacauuuuacauguaaauagcacuggucauauacugaug

SEQ ID NO: 351419 - RNA, 59 nt, Homo Sapiens
cacguguacaccacaaacgagcucccagacauguaaacacacgucucccacacgugagc

SEQ ID NO: 351420 - RNA, 59 nt, Homo Sapiens
ucaauguucuaucuggaagcuuaaaauaacauguaaacuagcuuagcuguuuauugucu

SEQ ID NO: 351421 - RNA, 59 nt, Homo Sapiens
acuucauauaugauuuaaagaguguauagcauguaaauuuuauguucaguguguuugga

SEQ ID NO: 351422 - RNA, 59 nt, Homo Sapiens
agggaccuucagcucacggcgugcacaugcauguaaaccugcuuugcuuaugcaugugu

SEQ ID NO: 351423 - RNA, 59 nt, Homo Sapiens
gcauaucguuuauugagguuuuguccugacauguaaaaaguucaucucuguggucugug

SEQ ID NO: 351424 - RNA, 59 nt, Homo Sapiens
ggugaaaguuagucguuuuugggcuggaacauguaaaagaugugaccuuucguaaauuu

SEQ ID NO: 351425 - RNA, 59 nt, Homo Sapiens
uaauguaucaaaauuagcaucuugucacucauguaaaacaagugauauaauauccugua

SEQ ID NO: 351426 - RNA, 59 nt, Homo Sapiens
uuaauuacaauuaauaaaugaaauaggcccauguaaauucauuacacaauguccuuaau

SEQ ID NO: 351427 - RNA, 59 nt, Homo Sapiens
uuugucuggagucacaguaugcaugcaggcauguaaauagaugucuuucugguuuuaac

SEQ ID NO: 351428 - RNA, 59 nt, Homo Sapiens
auucaaggauuauaguaauaaaauccuugcauguaaaucuagucugucccaaauaaaau

SEQ ID NO: 351429 - RNA, 59 nt, Homo Sapiens
uguuuaagacuuccgcugcuauuucgaagcauguaaaggaaaaucagaucaucaacagu

SEQ ID NO: 351430 - RNA, 59 nt, Homo Sapiens
guuucaggagacuuuguauuuagaauauucauguaaaacuugugaacaagcuuucauuu

SEQ ID NO: 351431 - RNA, 59 nt, Homo Sapiens
ccuuuucucagaaggacucuuuauauuuccauguaaaucuagaucuuuggagcaauuaa

SEQ ID NO: 351432 - RNA, 59 nt, Homo Sapiens
aaggcuacagaugugcugacaaggcacuucauguaaagugucagaaggagcuacaaaac

SEQ ID NO: 351433 - RNA, 59 nt, Homo Sapiens
cauaucuuaauauauuucuaaauguuuggcauguaaauguaaacucagcaucaaaauau

SEQ ID NO: 351434 - RNA, 59 nt, Homo Sapiens
cuuuaaaaguaaucuuauguccuuuccuacauguaaaauauuuuguuaaucuaugccau

SEQ ID NO: 351435 - RNA, 59 nt, Homo Sapiens
aauuagugaauguaagauacuuuagaaagcauguaaaguacuagaaacaaugagguggc

SEQ ID NO: 351436 - RNA, 59 nt, Homo Sapiens
acaaggcagguggaggggaggccaguguacauguaaaugcccacagcccagcauugggu

SEQ ID NO: 351437 - RNA, 59 nt, Homo Sapiens
aauuuucauugaacuuaaagagugaaaaccauguaaacuauugaaacuauuguaaucca

SEQ ID NO: 351438 - RNA, 59 nt, Homo Sapiens
ggaagcauuucacauccaaacgagaaaaucauguaaacaugugucuuuucuguagagca

SEQ ID NO: 351439 - RNA, 59 nt, Homo Sapiens
cuuuaaagcaaaauccucagugaaugcugcauguaaagcgucuuauauuaugagauacu

SEQ ID NO: 351440 - RNA, 59 nt, Homo Sapiens
aacaauagauccagcuuuaugucaguauucauguaaauauuuuucuuaaucuuuaagau

SEQ ID NO: 351441 - RNA, 59 nt, Homo Sapiens
uauuucaaguagugaugauuuaaauuauucauguaaaaggcuucaacaguguaaagaga

SEQ ID NO: 351442 - RNA, 59 nt, Homo Sapiens
cuacaaaucacaaucugauugguaaacugcauguaaaggcuggaugugaagaagguuug

SEQ ID NO: 351443 - RNA, 59 nt, Homo Sapiens
aucuuguaggugagacuuuuggcccuaaacauguaaauaugacgucuuuuaauaauacu

SEQ ID NO: 351444 - RNA, 59 nt, Homo Sapiens
uauucuuucacucauaauaaacucuuacgcauguaaaaaucagcagacaaaaauaaguc

SEQ ID NO: 351445 - RNA, 59 nt, Homo Sapiens
aaaguguuaaauucacauauuuuguuuaacauguaaacauguagucuaauauauacaca

SEQ ID NO: 351446 - RNA, 59 nt, Homo Sapiens
cgccugcaaacgcugccugccuacgccugcauguaaacaaccaguggucucacauggug

SEQ ID NO: 351447 - RNA, 59 nt, Homo Sapiens
ugaugcugacuggcguuagcugauuaacccauguaaauaggcacuuaaauagaagcagg

SEQ ID NO: 351448 - RNA, 59 nt, Homo Sapiens
gcugguagaauuucaauggaagcauaauccauguaaaauauauuuuaguugauauuuug

SEQ ID NO: 351449 - RNA, 59 nt, Homo Sapiens
ucauuuuguauuuacuuugcaguaaguaucauguaaauaugcaaauguugaauguaaua

SEQ ID NO: 351450 - RNA, 59 nt, Homo Sapiens
auaauauguacuuuggguuuuuaacaccgcauguaaagucaaaauaaaauauacaaauc

SEQ ID NO: 351451 - RNA, 59 nt, Homo Sapiens
agaucaccaagggcucauguuggugacaucauguaaaauuuuccuggguagaagggaaa

SEQ ID NO: 351452 - RNA, 59 nt, Homo Sapiens
cacagcuaucauagaaaagaaacuugccucauguaaacuggauugagaaauucucagug

SEQ ID NO: 351453 - RNA, 59 nt, Homo Sapiens
cuuggcaaaauuggauuucuucaaaaauacauguaaaggucuguuguugaauuguacuc

SEQ ID NO: 351454 - RNA, 59 nt, Homo Sapiens
uccucuggaaaaagacuccgaauucuguccauguaaagaaaucaugggcugacugagac

SEQ ID NO: 351455 - RNA, 59 nt, Homo Sapiens
aaucgcaaagcaagggggaaaaccuucaucauguaaagcugggcaauggcacuacaugu

SEQ ID NO: 351456 - RNA, 59 nt, Homo Sapiens
aaguguguguauacuguaauaauacauuacauguaaauucuuaucucaguuaugaguau

SEQ ID NO: 351457 - RNA, 59 nt, Homo Sapiens
gauauuacuucuagaggagcaaaucuucacauguaaauacauguauaccugagaauuug

SEQ ID NO: 351458 - RNA, 59 nt, Homo Sapiens
agagcucuaagaugauccuugaaucauuccauguaaaacacuuaguccauccgacaccu

SEQ ID NO: 351459 - RNA, 59 nt, Homo Sapiens
cauaaauccuuuugcacugacuguuaagucauguaaauuuuaagugauuaucuuuucuu

SEQ ID NO: 351460 - RNA, 59 nt, Homo Sapiens
uguuuccuuuuaguuguugauggaauauacauguaaaaagugauuaguaugcuaugcua

SEQ ID NO: 351461 - RNA, 59 nt, Homo Sapiens
cuaacaggagugcccauuggcagauuacacauguaaauaugaccucagacaaaaaggaa

SEQ ID NO: 351462 - RNA, 59 nt, Homo Sapiens
guguuuguguuucuccucccccuuacuugcauguaaaucacaaaaacugugugacuuac

SEQ ID NO: 351463 - RNA, 59 nt, Homo Sapiens
agggauuguguuguucuuguguugguucccauguaaagaagcagcagagaaaugcgaug

SEQ ID NO: 351464 - RNA, 59 nt, Homo Sapiens
ggacuggauauuaaauaaaaauuuauugacauguaaagauggcaauuauuaacaacaac

SEQ ID NO: 351465 - RNA, 58 nt, Homo Sapiens
gcucuuuguguuugaauaaaguaguaaugcauguaaacauauacguguuuagagcucu

SEQ ID NO: 351466 - RNA, 59 nt, Homo Sapiens
cugaaaagaacuuucaacacagcauacuucauguaaaagaaauuguuuguuugcuuucu

SEQ ID NO: 351467 - RNA, 59 nt, Homo Sapiens
cuucuguucaauuucauagacuccuuuaccauguaaaauuugucugauauuugauuugu

SEQ ID NO: 351468 - RNA, 59 nt, Homo Sapiens
cuggagauugugcucugcagcgagccccccauguaaaguggggacgggggcugcuucuc

SEQ ID NO: 351469 - RNA, 59 nt, Homo Sapiens
caaaaggaaaagggagugggaauugcuaucauguaaaauaucaaaguuaaaauacuaag

SEQ ID NO: 351470 - RNA, 59 nt, Homo Sapiens
ugaaaaguaacugauuuguauucugugagcauguaaaagcggaaaguuagugcuuguuc

SEQ ID NO: 351471 - RNA, 59 nt, Homo Sapiens
uuaagggccugaaucucuucuggaaagcacauguaaaagaaagaaagugucuccuuucc

SEQ ID NO: 351472 - RNA, 59 nt, Homo Sapiens
ugacacagacaaaauaaaaauauggugugcauguaaacccucuaauacagaauaagcaa

SEQ ID NO: 351473 - RNA, 59 nt, Homo Sapiens
gugguggacuuuaaaaccguuucugcuagcauguaaagauuugcacgcuuggacuucag

SEQ ID NO: 351474 - RNA, 59 nt, Homo Sapiens
agguggcagggcagagaugucguggcauccauguaaagucugcucaggcucucccacuu

SEQ ID NO: 351475 - RNA, 59 nt, Homo Sapiens
gagcucuguuuaaauaaauauuguccuuucauguaaauuauucuggauguagauugagc

SEQ ID NO: 351476 - RNA, 59 nt, Homo Sapiens
acgcaaagaaucuccugguagagaagcgacauguaaaaaacugguggaaaaagguuuug

SEQ ID NO: 351477 - RNA, 59 nt, Homo Sapiens
ucuuaaugagagugucugucuaugccaaucauguaaaaugacguuucuugaaaaagauu

SEQ ID NO: 351478 - RNA, 59 nt, Homo Sapiens
aagaagcacaaaagaauauuauuucauaacauguaaaaauuauauaaaacguaaauuuc

SEQ ID NO: 351479 - RNA, 59 nt, Homo Sapiens
aacaucugacugaaagaaaaauuaaaagucauguaaaagugguggaguaccgcgcagac

SEQ ID NO: 351480 - RNA, 59 nt, Homo Sapiens
gucuggcguguaguaggcucugugaucagcauguaaaguagaugguugugaggaguaaa

SEQ ID NO: 351481 - RNA, 59 nt, Homo Sapiens
gcuaacuguuuuuguuaaagaaggggaagcauguaaacacaaaacuaacucugggauua

SEQ ID NO: 351482 - RNA, 59 nt, Homo Sapiens
gcaaauaaaccacuuucuaaagaggaauccauguaaauuuauacuaaaccucacaaagu

SEQ ID NO: 351483 - RNA, 59 nt, Homo Sapiens
uaaccccaccuccccaccccaaucauucacauguaaaaagaucucuuguacgcagaugu

SEQ ID NO: 351484 - RNA, 59 nt, Homo Sapiens
cacuccuugcuuugucucccucugguucucauguaaacccacucucucccuguggcugg

SEQ ID NO: 351485 - RNA, 59 nt, Homo Sapiens
agggcuuuguaaacuccacaccaaagauacauguaaaauuacaggaugguuacugagga

SEQ ID NO: 351486 - RNA, 59 nt, Homo Sapiens
aauaauacaguauuaacauucuuucagcccauguaaauaaagggacucauuuuucuuug

SEQ ID NO: 351487 - RNA, 59 nt, Homo Sapiens
ugcccuauguuugugccuuuuauaauguccauguaaacacuuuuaauguauauguuugu

SEQ ID NO: 351488 - RNA, 59 nt, Homo Sapiens
cacagcgguggugcccaggcuacagaggacauguaaauagggcccccucuccguaggug

SEQ ID NO: 351489 - RNA, 59 nt, Homo Sapiens
auacauuguucuaagucuuuucuuauuuacauguaaauaauggggauucugcucucuuu

SEQ ID NO: 351490 - RNA, 59 nt, Homo Sapiens
uuuuuuuuuuuucuuuuuuuuuaaaaacucauguaaagguuuauguuuuaaaauaggau

SEQ ID NO: 351491 - RNA, 59 nt, Homo Sapiens
cugcauagcagcgaguucucgauugcaaacauguaaaacauuuuaugguuuugauuuca

SEQ ID NO: 351492 - RNA, 59 nt, Homo Sapiens
cuguacuuggcaugcgcaauaaagcagcacauguaaaaaaaaaauacacagugcaagga

SEQ ID NO: 351493 - RNA, 59 nt, Homo Sapiens
gaagccauuaaaauuuuacuaaaauugugcauguaaauuaauugucagcauuccauguc

SEQ ID NO: 351494 - RNA, 59 nt, Homo Sapiens
aguuccccugacugaagagagccuguggccauguaaaaagagaauuaaacucuuguugc

SEQ ID NO: 351495 - RNA, 59 nt, Homo Sapiens
uaaggggaucuaaaaaaauguuuuuagaacauguaaaauguuuaauggugaaaguugga

SEQ ID NO: 351496 - RNA, 59 nt, Homo Sapiens
uuggcuguuaggaauaauguugcucugaacauguaaauaaagaucuuuguguucacaua

SEQ ID NO: 351497 - RNA, 59 nt, Homo Sapiens
ugggccaccagagaacccuucuguauuugcauguaaaagaaugcauguuaacaguuggu

SEQ ID NO: 351498 - RNA, 59 nt, Homo Sapiens
ucaauuuuacguagagucaauauuccugacauguaaaaauuguucguugauccucaucu

SEQ ID NO: 351499 - RNA, 59 nt, Homo Sapiens
aauuguuugucugauuagccuguauuaaacauguaaauuuccuguuacaaauccugcac

SEQ ID NO: 351500 - RNA, 59 nt, Homo Sapiens
ugguauaguaauuuuuuauuguauguguucauguaaauuuccuauauuuguguguauau

SEQ ID NO: 351501 - RNA, 59 nt, Homo Sapiens
cagcucaaauugcaugaucuuuacuacagcauguaaauuuaaggaauuuauuucucccu

SEQ ID NO: 351502 - RNA, 59 nt, Homo Sapiens
auuaucuugucacuguaguuauggaauuacauguaaaacggauuaauugaccccugucu

SEQ ID NO: 351503 - RNA, 59 nt, Homo Sapiens
gcauacaacuuaaggaauuuuuuccuccucauguaaauuuuacuuuucaugcuuauaua

SEQ ID NO: 351504 - RNA, 59 nt, Homo Sapiens
cauucagcuugcuuaauugcuuucauagacauguaaagacacaccagaaggaaacccua

SEQ ID NO: 351505 - RNA, 59 nt, Homo Sapiens
ccaaaguauaaaaauuucuggaauacugacauguaaagacuacaguuaauucugacacu

SEQ ID NO: 351506 - RNA, 59 nt, Homo Sapiens
agaccacccaaccucacccuccugacccccauguaaauauuguucugcugucugggacu

SEQ ID NO: 351507 - RNA, 59 nt, Homo Sapiens
gauucuuggaaguauuauguaaguuauuacauguaaaagcucuuagaauggugccuuga

SEQ ID NO: 351508 - RNA, 59 nt, Homo Sapiens
uuucuuaagccccagaaagccaaaaagaacauguaaacucuucaccucaacuagcuaca

SEQ ID NO: 351509 - RNA, 59 nt, Homo Sapiens
cugcuaucauggaaauuaaauguuugguacauguaaagucuuugaaaguguaacuggaa

SEQ ID NO: 351510 - RNA, 59 nt, Homo Sapiens
aagucagacaauguuuuaaauugaaugaucauguaaauauuacacaucaaaccaaugac

SEQ ID NO: 351511 - RNA, 59 nt, Homo Sapiens
ucagaaguuaauagaagaaugaaauaaugcauguaaauugcucagcagcgugccuagca

SEQ ID NO: 351512 - RNA, 59 nt, Homo Sapiens
gcuggacacuuaugugcaaggauucccuucauguaaauucuuggucucacaugacacuu

SEQ ID NO: 351513 - RNA, 59 nt, Homo Sapiens
uucacaggagaaaguaacaccuaacugaacauguaaaaaccuuugcuguuuccucaagc

SEQ ID NO: 351514 - RNA, 59 nt, Homo Sapiens
gcagagaaaacaaaaccaaaugguguuugcauguaaauuuggauggaugaauagauaga

SEQ ID NO: 351515 - RNA, 59 nt, Homo Sapiens
augugggaaagccuucagugaacucuguacauguaaacaaaaaacucacacuggagaga

SEQ ID NO: 351516 - RNA, 59 nt, Homo Sapiens
gcccaguaauaaaauuuuacagaaaguaucauguaaacacagguuauauuuaauaagaa

SEQ ID NO: 351517 - RNA, 59 nt, Homo Sapiens
gcacagacaccguaacacacaaauauuggcauguaaacacauaugagaaccuuuguaua

SEQ ID NO: 351518 - RNA, 59 nt, Homo Sapiens
ucauaaauucuuuggacaaaggaauauuucauguaaauuaguuuccuuuuauucuaacg

SEQ ID NO: 351519 - RNA, 59 nt, Homo Sapiens
uggaauagucuguugaauuuuuuaaaaaacauguaaacacuuuaggguaacaagauuuc

SEQ ID NO: 351520 - RNA, 59 nt, Homo Sapiens
aagagauacuuaacaauaauuugaacaaacauguaaaagguuuuuacuuagaucaugag

SEQ ID NO: 351521 - RNA, 59 nt, Homo Sapiens
ucuuccagcaacaaucauuuuuauacuugcauguaaacaaaaacguaggaaaccauucu

SEQ ID NO: 351522 - RNA, 59 nt, Homo Sapiens
uauguggcagagggucuaucaagagacaucauguaaacaagauaugagaggccauaagc

SEQ ID NO: 351523 - RNA, 59 nt, Homo Sapiens
uauacucucaacauuuaaaaaaaaaugugcauguaaauaaacgcucugaacccccuaua

SEQ ID NO: 351524 - RNA, 59 nt, Homo Sapiens
uaugugcacauauggauguauauuccagccauguaaaaaucaaauagaagauuuacuau

SEQ ID NO: 351525 - RNA, 59 nt, Homo Sapiens
aauauuuaucuagagaauacaaagacccacauguaaaugauagguauuaucuccaugua

SEQ ID NO: 351526 - RNA, 59 nt, Homo Sapiens
uacacuacugagaauagcaugguuuuggccauguaaaccaauuuucaaaguucuaauga

SEQ ID NO: 351527 - RNA, 59 nt, Homo Sapiens
ugcgugucuccaugugcguccauauuuaacauguaaaaaugucccccccgcuccguccc

SEQ ID NO: 351528 - RNA, 59 nt, Homo Sapiens
guaugucauuuuuauuuccauuuuauaaacauguaaauaauagugauaacuuguuaaua

SEQ ID NO: 351529 - RNA, 59 nt, Homo Sapiens
ggaaaagcguuuuugaagcucucauuguucauguaaaaaucauacacguggcauguugc

SEQ ID NO: 351530 - RNA, 59 nt, Homo Sapiens
cuagggcucccguccugcuuuggcagugccauguaaauccccacugggaccaacccugg

SEQ ID NO: 351531 - RNA, 59 nt, Homo Sapiens
aaauguuuuccuuaugacacugguuucgacauguaaaauguguuugaaaaccugcuuug

SEQ ID NO: 351532 - RNA, 59 nt, Homo Sapiens
uuacugugaguguggagauguuaucccaccauguaaagucgccugcgcaggggagggcu

SEQ ID NO: 351533 - RNA, 59 nt, Homo Sapiens
uucugacaacugguggcagaauuuauggccauguaaacgaaaauaagaaaaugcuaaau

SEQ ID NO: 351534 - RNA, 59 nt, Homo Sapiens
cauuuucucuuaaacaaaacacauaaauucauguaaagcuaacauaucugccaugagga

SEQ ID NO: 351535 - RNA, 59 nt, Homo Sapiens
aagggaucaauuucaaacccuuuuuauuucauguaaaauaccugccgcaacagaaauug

SEQ ID NO: 351536 - RNA, 59 nt, Homo Sapiens
aggcuuacaaauuuucuuuuuuaaagaaucauguaaaacucaauccuauuggggaccuu

SEQ ID NO: 351537 - RNA, 59 nt, Homo Sapiens
gccuuuuuaaaauuuaauuuuaaauaagccauguaaaauuucuugaagaaguauaauug

SEQ ID NO: 351538 - RNA, 59 nt, Homo Sapiens
uugcacaguuacuuguucauccauuuuuucauguaaauuuuuaggaaaucccugucuuu

SEQ ID NO: 351539 - RNA, 59 nt, Homo Sapiens
acugacuuccuaguaacuguuguuacgagcauguaaaggccaucucaagagcucgccca

SEQ ID NO: 351540 - RNA, 59 nt, Homo Sapiens
ugguuuuggugcucaagggucgggacgcucauguaaauuagaaagucauucgcguggcu

SEQ ID NO: 351541 - RNA, 59 nt, Homo Sapiens
ggcucccuagaaucuggagagcuuaccaacauguaaagcuguucauuuuuccaccgugg

SEQ ID NO: 351542 - RNA, 59 nt, Homo Sapiens
uauuaugugcaucuguuauuuuuccaauacauguaaacaguugcagcaugaugcuuugu

SEQ ID NO: 351543 - RNA, 59 nt, Homo Sapiens
uugcagccguuuuacaaauaucuguggaacauguaaauacugucaaauggaaaauaaaa

SEQ ID NO: 351544 - RNA, 59 nt, Homo Sapiens
aauacauucuuggaggagcaugguguuuucauguaaauaugucuucaauuuguauaaaa

SEQ ID NO: 351545 - RNA, 59 nt, Homo Sapiens
gcuguuacgaaagcuuggcucuccaaagacauguaaaagguuuaauaugauucacuuuu

SEQ ID NO: 351546 - RNA, 59 nt, Homo Sapiens
uauuuuaggauuguaauuaagaagauauucauguaaauaguugcaacucauuagcuagu

SEQ ID NO: 351547 - RNA, 59 nt, Homo Sapiens
uucuuuuuguaugaaaauuguuuuguggucauguaaaacauaaaaauaaauauuuggua

SEQ ID NO: 351548 - RNA, 59 nt, Homo Sapiens
agaccuaagcuaauuauuuaaaauaaauacauguaaaggccacugccacauucucagca

SEQ ID NO: 351549 - RNA, 59 nt, Homo Sapiens
gacagugaacucugucugccugaacgagccauguaaauuaaguucuagagcagcucucu

SEQ ID NO: 351550 - RNA, 59 nt, Homo Sapiens
augaaaacuuaacucugcugguuauugcacauguaaaauuugggaaagaaaacgaaaau

SEQ ID NO: 351551 - RNA, 59 nt, Homo Sapiens
cuuugacaucuuuuuuuuuaaaauauaugcauguaaaaauaggucuucagcauaagcug

SEQ ID NO: 351552 - RNA, 59 nt, Homo Sapiens
acauguuagauaaauuuuugcucauuacccauguaaacccaccaaaccuacuaggucuu

SEQ ID NO: 351553 - RNA, 59 nt, Homo Sapiens
gccaccaggguucuuuugaaauaguaccacauguaaaagggaauuuggcuuucacuuca

SEQ ID NO: 351554 - RNA, 59 nt, Homo Sapiens
guguaugguguguauuccauaucuauucccauguaaauccaaauacuuauucuuuauuu

SEQ ID NO: 351555 - RNA, 59 nt, Homo Sapiens
guaagacaauagcauuucuagaacaauuacauguaaacaaauauuuucuuuauuuguag

SEQ ID NO: 351556 - RNA, 59 nt, Homo Sapiens
gcagaaucacaugugcacacacacauacacauguaaacauuggaaugcauaaguuuuaa

SEQ ID NO: 351557 - RNA, 59 nt, Homo Sapiens
auauggccuacagagaauagaaacaaauccauguaaacaauuuugaaggaggcauggga

SEQ ID NO: 351558 - RNA, 59 nt, Homo Sapiens
cuuccaaaucuaacuuugcacaaguaacccauguaaaaaaaaauguacauuuuucaaaa

SEQ ID NO: 351559 - RNA, 59 nt, Homo Sapiens
gcuauuuaaucuugggaacugaagccagucauguaaacauacuauaccaaucuaguccc

SEQ ID NO: 351560 - RNA, 59 nt, Homo Sapiens
uuggagagucccacccacuaagcacugugcauguaaacagguuccuuugcucagaugaa

SEQ ID NO: 351561 - RNA, 59 nt, Homo Sapiens
guauggaccuacauacacacaaaugaaugcauguaaaaucuggugauacugaauaaagu

SEQ ID NO: 351562 - RNA, 59 nt, Homo Sapiens
caggcaguauacauuuauuacaucauauacauguaaaaugugcacauaugaaaauggca

SEQ ID NO: 351563 - RNA, 59 nt, Homo Sapiens
cuugauagcuaaauaacuugagaaaacuacauguaaaauaauuguacaaaaaaguuaua

SEQ ID NO: 351564 - RNA, 59 nt, Homo Sapiens
uuaaagacauaaauauagaguaaguucaacauguaaauucacaauuauuuagcuuuuug

SEQ ID NO: 351565 - RNA, 59 nt, Homo Sapiens
ccuaggucuauuuggauuaucauguuuugcauguaaaagcuuaggacaaaucugcaaag

SEQ ID NO: 351566 - RNA, 59 nt, Homo Sapiens
cuuuccauguuuuuucuucaaaacugguccauguaaauaguuuuagcauuuguauaaag

SEQ ID NO: 351567 - RNA, 59 nt, Homo Sapiens
ugaauucaaauaaaaucauaacuucugcacauguaaaauuuguaauugacaucuaguag

SEQ ID NO: 351568 - RNA, 59 nt, Homo Sapiens
guaacucaggggggcagaagcuuuugugucauguaaauuaaacuguaguacccuuauuc

SEQ ID NO: 351569 - RNA, 59 nt, Homo Sapiens
uccuuccagccagaaagaaaaacugguugcauguaaaaugaauaaucuaguagaaaaau

SEQ ID NO: 351570 - RNA, 59 nt, Homo Sapiens
gguuccuuugcucagaugaaagcacugugcauguaaacauuggagagucccacccacua

SEQ ID NO: 351571 - RNA, 59 nt, Homo Sapiens
acagcaaaagaggcuuuucuucuuaauuacauguaaacaaagacaugggauuuucugac

SEQ ID NO: 351572 - RNA, 65 nt, Homo Sapiens
ggaauaaguauaauuaucauccagccucccagaagaauacucaacaacccuuggccaagcaugaa

SEQ ID NO: 351573 - RNA, 65 nt, Homo Sapiens
aggacugugggacccagauuugaagacccaauaaaaauacucaacuuuuuaaaaaagauagugaa

SEQ ID NO: 351574 - RNA, 65 nt, Homo Sapiens
gguauauucuuguguuaacugcccauuggccugaaaauacucauuguaagccugaaaaaaaaaau

SEQ ID NO: 351575 - RNA, 65 nt, Homo Sapiens
auuauacaguggcagauuucuuuagcugccacaguaauacucauuccuugugugugucuuggagu

SEQ ID NO: 351576 - RNA, 65 nt, Homo Sapiens
ccauuaaauuuucaaaauguaauuuaaaaggauuaaauacucauuuaauaauuuaaaauaauuau

SEQ ID NO: 351577 - RNA, 65 nt, Homo Sapiens
ugaaacaggguuuuucaaguuguauaauucucugaaauacucagcuuuugucauauggguaaaaa

SEQ ID NO: 351578 - RNA, 65 nt, Homo Sapiens
aguuuaauuuucucugggggcaugaucucacaaagaauacucaagucuuuuucuucuuauggaau

SEQ ID NO: 351579 - RNA, 65 nt, Homo Sapiens
cugucuuuuacagcucuuugcauuuuguagaccuuaauacucagguuaaauauucauugcauuua

SEQ ID NO: 351580 - RNA, 65 nt, Homo Sapiens
cagccagaacaugagagggagaacuaacucaagacaauacucagcagagagcaucccguguggau

SEQ ID NO: 351581 - RNA, 65 nt, Homo Sapiens
gaaguaauguacccuuuuuuucugaaacugaauuaaauacucauuuuaucuuugacucuccuuga

SEQ ID NO: 351582 - RNA, 65 nt, Homo Sapiens
ccaaagcagcauaauauguguuauauaaacauaauaauacucagauauccaaauguucagauagc

SEQ ID NO: 351583 - RNA, 65 nt, Homo Sapiens
agaggauuauuuuauuauguuuauuaaucaccucuaauacucauccacaugaaggguacacauua

SEQ ID NO: 351584 - RNA, 65 nt, Homo Sapiens
acguacaugcuucaauaauucuuuuuugugucuuaaauacucauaggggaaaaaaacagcucacc

SEQ ID NO: 351585 - RNA, 65 nt, Homo Sapiens
ucaguaagacagugcagugcucaguaaggcagugcaauacucaguaacaguguaguacucaguaa

SEQ ID NO: 351586 - RNA, 65 nt, Homo Sapiens
guacucaggaaugcagcacaguacucaggcagugcaauacucagugcgguacucaguaacacagu

SEQ ID NO: 351587 - RNA, 65 nt, Homo Sapiens
ugugggagcgacaucaaugaaugucaaauguuuuuaauacucagaugugaggacugagaagaaca

SEQ ID NO: 351588 - RNA, 65 nt, Homo Sapiens
uaaaugcacaaaguauaaagauuaugagcagaacaaauacucaacaggucugguacauauuggaa

SEQ ID NO: 351589 - RNA, 65 nt, Homo Sapiens
auuaccauugguugaggccauaucguuguccuucaaauacucagcguguguaacacacacacccc

SEQ ID NO: 351590 - RNA, 65 nt, Homo Sapiens
agggucuuaucagacgcccguuggucuccuacccaaauacucacauacccuuugcagaaaugcuu

SEQ ID NO: 351591 - RNA, 65 nt, Homo Sapiens
uguucuccaaucccagguagacuguaaaaguagcuaauacucacauucuacaagaucccuauuug

SEQ ID NO: 351592 - RNA, 65 nt, Homo Sapiens
uacaaguuuucuauccuccuaggaucaggcuuuuaaauacucauuuucugcuuuuaguucuuaag

SEQ ID NO: 351593 - RNA, 65 nt, Homo Sapiens
aaugaaaauacaucuuuuugaauaugaaaaauguaaauacucauguauaugauauucuuuaaaca

SEQ ID NO: 351594 - RNA, 65 nt, Homo Sapiens
aaauaagugggccacuuaggauuuuguuuuuauccaauacucauucagccuucaguuguacuaga

SEQ ID NO: 351595 - RNA, 65 nt, Homo Sapiens
ugaguuccuuccauuugaccgggcucugauugggcaauacucauuacugaugacuuacaaauaau

SEQ ID NO: 351596 - RNA, 65 nt, Homo Sapiens
uguacacauucagaugcagacucccaaucacccucaauacucacgucaacaugcccccaauuucu

SEQ ID NO: 351597 - RNA, 65 nt, Homo Sapiens
cgucuacucugauguugggagcauucacucccaggaauacucauucuaauucuucucaugcauau

SEQ ID NO: 351598 - RNA, 65 nt, Homo Sapiens
auauguauaauaucauauuugucauaaacaugaauaauacucagucucccaugaagaauuucuag

SEQ ID NO: 351599 - RNA, 65 nt, Homo Sapiens
aggcugagugcagguauacguggggauguuauuuaaauacucagcaaaguccacauauggauauu

SEQ ID NO: 351600 - RNA, 65 nt, Homo Sapiens
uacugucuuuuagagucagucugaaguaugacacaaauacucauaugagggaauauuucaguuuc

SEQ ID NO: 351601 - RNA, 65 nt, Homo Sapiens
ugacccuuguaacugaugagaggucugaaguuuauaauacucacuugauccuuuaugcacuguga

SEQ ID NO: 351602 - RNA, 65 nt, Homo Sapiens
agaagugcacaggcuacuuguacagagaaaaaauuaauacucaaaggaaaucuucauuuuuuaga

SEQ ID NO: 351603 - RNA, 65 nt, Homo Sapiens
uucccuuccuaagaaacugccuuccacaauuaaagaauacucauagaaagaaaauaaucauaaau

SEQ ID NO: 351604 - RNA, 65 nt, Homo Sapiens
uuguuaaagagcuuucaauguauauuaaaaccuucaauacucagaaaugauggauuccuccaagg

SEQ ID NO: 351605 - RNA, 65 nt, Homo Sapiens
guaucucuagauaagaagauaugcaccacguugaaaauacucaguguagaucucuauguguauag

SEQ ID NO: 351606 - RNA, 65 nt, Homo Sapiens
guacauacauuuuuguauguuuagauauuaccguaaauacucaggauuggagcugcuuguaagua

SEQ ID NO: 351607 - RNA, 65 nt, Homo Sapiens
auccuucucucuuaaaaaggaauuuauuguaaaagaauacucacacuaaauuaaauucaaauuuc

SEQ ID NO: 351608 - RNA, 65 nt, Homo Sapiens
gugagauaauauucuaagaggcucuagaaacaugaaauacucaguagugauggguuucccacuuc

SEQ ID NO: 351609 - RNA, 65 nt, Homo Sapiens
aaguuugggcugauuauauuguaaugauguuagauaauacucaacaugauucaguaugacaaacu

SEQ ID NO: 351610 - RNA, 65 nt, Homo Sapiens
gcuccuuccguaagaaaaugaaauauucuaugccuaauacucacacgcaacauuucuuguacuuu

SEQ ID NO: 351611 - RNA, 65 nt, Homo Sapiens
gauuguaggaucaaaaaaggcagaugaaauuacuuaauacucaguguuuuggagaguauuccuuu

SEQ ID NO: 351612 - RNA, 65 nt, Homo Sapiens
gcaagauugcaaugauuauggaaaaauagaaagcgaauacucaguuuaagccaaggaaaauauug

SEQ ID NO: 351613 - RNA, 65 nt, Homo Sapiens
aagcaaaauuauuuuaaaugacuuaauuguaugcuaauacucaucugauaauaaaugcuucuuaa

SEQ ID NO: 351614 - RNA, 65 nt, Homo Sapiens
cuuaaacaaauguaugauuacaucaaggcuucaaaaauacucacauggcuauguuuuagccagug

SEQ ID NO: 351615 - RNA, 65 nt, Homo Sapiens
cucgguauauauauaugugucgaauauucugauacaauacucaacagacuacagggaucucacga

SEQ ID NO: 351616 - RNA, 65 nt, Homo Sapiens
cauucuuuugcacaccuguucagcuugguguacuuaauacucauguucucaccugaaaaugugga

SEQ ID NO: 351617 - RNA, 65 nt, Homo Sapiens
uaaauauuugcauuuaggaaauuaucuuaacaaauaauacucagcuaaacauugcuguucacuag

SEQ ID NO: 351618 - RNA, 65 nt, Homo Sapiens
uaaaaugaacaggaaaguguaacuaacaauuuugaaauacucauacgcacuuagucauucguggu

SEQ ID NO: 351619 - RNA, 65 nt, Homo Sapiens
uucccacauacauucacuauaucuuuucucccugaaauacucacaauauacauauguaucuuaua

SEQ ID NO: 351620 - RNA, 65 nt, Homo Sapiens
guggcucuucuauaggcuucuuuugugauuuuggaaauacucaauaaaaacaugaauguugugca

SEQ ID NO: 351621 - RNA, 65 nt, Homo Sapiens
guacuugauuauuuuauuucaagagaauggaggaaaauacucagagaggccuuaaaauucuggau

SEQ ID NO: 351622 - RNA, 65 nt, Homo Sapiens
acaugugauucauuuucugagaaacagauauuuuaaauacucacauuggugguaggacuaagaag

SEQ ID NO: 351623 - RNA, 65 nt, Homo Sapiens
uucucgaguuuuauacaguuuacauuggucaccuaaauacucauauaaaauucuauuaaugucua

SEQ ID NO: 351624 - RNA, 65 nt, Homo Sapiens
cugaucuuuuuuuuguuugugaguaggucuaggggaauacucagucucagcuaugggcuucccua

SEQ ID NO: 351625 - RNA, 65 nt, Homo Sapiens
uaauuuuuaaauuuuuguggacagacacaugccccaauacucagccuuccugaguagcugcaacu

SEQ ID NO: 351626 - RNA, 65 nt, Homo Sapiens
accagagcucuaaugugggauaucaaaucgcacugaauacucaacgugcaauagcaauuaaaaua

SEQ ID NO: 351627 - RNA, 65 nt, Homo Sapiens
uuucaauguaucaaagauacaaccuuugucuuaaaaauacucagcaaagagaacuuucuuccuga

SEQ ID NO: 351628 - RNA, 65 nt, Homo Sapiens
gucagugccuauacaagacacugacuguuuuaacaaauacucauaaagaggagguccaugccaaa

SEQ ID NO: 351629 - RNA, 65 nt, Homo Sapiens
uuuucagacuuuuuuguaaaauuuauuuguauaaaaauacucauccugugcagauuuucccacug

SEQ ID NO: 351630 - RNA, 65 nt, Homo Sapiens
gaugagaaaaaauuggcauuuuguuauauauaauaaauacucaguguuuuuucuuucccauguau

SEQ ID NO: 351631 - RNA, 65 nt, Homo Sapiens
guucuguuuuuuuaaaaacuccacaauaccuuuuuaauacucaguaaucaaggauuuaauuaagg

SEQ ID NO: 351632 - RNA, 65 nt, Homo Sapiens
ccuaccucgcaugguugcuguguagguuucauuguaauacucauguaguaucauguaauguuccg

SEQ ID NO: 351633 - RNA, 65 nt, Homo Sapiens
ccacgaagguuacauuuaugcugaauacauuuguaaauacucaguuuuauacuguauguauauga

SEQ ID NO: 351634 - RNA, 65 nt, Homo Sapiens
aacuuuaauguuuuuugccacagcuuuugcaacuuaauacucaaaugaguaacauuugcuguuuu

SEQ ID NO: 351635 - RNA, 65 nt, Homo Sapiens
ggcaagauaaccauaauaauuuuagugagaagauuaauacucaaggaccugacuugauaauuacu

SEQ ID NO: 351636 - RNA, 65 nt, Homo Sapiens
ccuggggaagcugugaaagaaccaaaagagaucacaauacucaaaagagagagagagagaaaaaa

SEQ ID NO: 351637 - RNA, 65 nt, Homo Sapiens
aguacauaugaaagugaccuccaaggggauuggugaauacucauaaggaucuucaggcugaacag

SEQ ID NO: 351638 - RNA, 65 nt, Homo Sapiens
augcugcauaaaaauaccaaacuucagcaacuguuaauacucagaucauauaccucuuaauaaau

SEQ ID NO: 351639 - RNA, 65 nt, Homo Sapiens
auaaauagaacaagggacuuuuuguugauaauccaaauacucaaaguuuacguaaugaaaauuau

SEQ ID NO: 351640 - RNA, 65 nt, Homo Sapiens
ccaauuguucuuauauucuauagaaguucgcucaaaauacucaacaggggaauaggcagcggaca

SEQ ID NO: 351641 - RNA, 65 nt, Homo Sapiens
ucaaaauauuauagauuauagcuaaaauccagauuaauacucauuugggguuuuuuauaguggaa

SEQ ID NO: 351642 - RNA, 65 nt, Homo Sapiens
auuauuauucauuagggaaacuaagcacaugaaaaaauacucaacagaagauaugcaaauggcua

SEQ ID NO: 351643 - RNA, 65 nt, Homo Sapiens
agauugucuuccuuuauauuauuuagaugguuuuuaauacucagcgcugguugcaaagaauugau

SEQ ID NO: 351644 - RNA, 64 nt, Homo Sapiens
aauagugggucuucgaguuuuuaaagucuauaaaaaauacucaaggaggaaaaaaacccaguau

SEQ ID NO: 351645 - RNA, 65 nt, Homo Sapiens
auggggagagguuuauuuaaggucuuuuguuuugaaauacucagggaaggguuguguucuucagg

SEQ ID NO: 351646 - RNA, 65 nt, Homo Sapiens
cucucagugcuuccuuauggauacuugaagaauguaauacucaaaaaauaaaaaauccgaacagc

SEQ ID NO: 351647 - RNA, 65 nt, Homo Sapiens
gucaauuugagaaaaaggacuuuuguacauuuuuuaauacucauuuauaacugauuuauaaaggu

SEQ ID NO: 351648 - RNA, 65 nt, Homo Sapiens
uuuaugauuguccuauaugaguagucagcucuuguaauacucauaaaauauaaacuugaaaguau

SEQ ID NO: 351649 - RNA, 65 nt, Homo Sapiens
gauuaaaauggaauaaagaaaggaaaacuugaaucaauacucauuuaucauaaggaaaaauagaa

SEQ ID NO: 351650 - RNA, 65 nt, Homo Sapiens
agagcagcuagcucuuugguuuuuaagcuaucagcaauacucaucuaaaccuucagaagcuauuu

SEQ ID NO: 351651 - RNA, 65 nt, Homo Sapiens
gacagcaauucacagccugcuuaagccccaggcugaauacucaggagaacauauauauauauaua

SEQ ID NO: 351652 - RNA, 65 nt, Homo Sapiens
gcuaaacauggcuuaaucuuaaacccauguguuaaaauacucaguaaaacaaacaaacaaacaaa

SEQ ID NO: 351653 - RNA, 65 nt, Homo Sapiens
aacugagguaacugucauuagaaaagguuucuuaaaauacucacaaagcuguuauuggcuucuua

SEQ ID NO: 351654 - RNA, 65 nt, Homo Sapiens
gauuaauagcauucgaagauccccagacuucauagaauacucagggaaagcauuuaaagggugau

SEQ ID NO: 351655 - RNA, 65 nt, Homo Sapiens
uauggacaacuuuuugccacuaacugaauucuccaaauacucacacgugaaauuucaaaaaagaa

SEQ ID NO: 351656 - RNA, 65 nt, Homo Sapiens
caaaacaaaacaaaaaaaaacagaaguuacaaaugaauacucacggauauguauaguuuuauguu

SEQ ID NO: 351657 - RNA, 65 nt, Homo Sapiens
uucccaaaagcuccaggauuugugugcuguugccgaauacucaggacggaccugaauucugauuu

SEQ ID NO: 351658 - RNA, 65 nt, Homo Sapiens
auacuaaagguuuggugcuuuaugucuaaaaacugaauacucagauucagcaauggcuacaugac

SEQ ID NO: 351659 - RNA, 65 nt, Homo Sapiens
uauuuuuacuuaaauuuucuaauccaguagguuaaaauacucacagugaaacugauuaguugcaa

SEQ ID NO: 351660 - RNA, 65 nt, Homo Sapiens
gugaguacgcucuaugcauaaaaugcaacuaagaaaauacucauacauaaaauaacaauguuucc

SEQ ID NO: 351661 - RNA, 65 nt, Homo Sapiens
auauuuuggcuucauuuugacaacauuguuuugcaaauacucagaaacaacuccacucauaguau

SEQ ID NO: 351662 - RNA, 65 nt, Homo Sapiens
auacuuuggauccauuucaucaguacuguuuugcaaauacucagcaagaaguccacugacaguau

SEQ ID NO: 351663 - RNA, 65 nt, Homo Sapiens
uggaaaugcuacaaacauauguaccacagaaguucaauacucauuuccaaaucuuaauucaacua

SEQ ID NO: 351664 - RNA, 65 nt, Homo Sapiens
aaaucaccaugagauggggagaaaugauaacauuaaauacucaauggccuauuagcaaagauuaa

SEQ ID NO: 351665 - RNA, 65 nt, Homo Sapiens
aguaaagugugugggcaaucacccguaaaauaugaaauacucagaacuaaguugguacccuaccu

SEQ ID NO: 351666 - RNA, 65 nt, Homo Sapiens
uaaagugcuuuguuauuauucuuuggggaauacggaauacucaaauguaggucuuucacagcuag

SEQ ID NO: 351667 - RNA, 64 nt, Homo Sapiens
auacagcuuuuuaucuuuguaaauaaaauacagcaaauacucagcaaauaggcuaaaugugaac

SEQ ID NO: 351668 - RNA, 65 nt, Homo Sapiens
caaaaagaguuugguucugcccaccucauuagacuaauacucauuauguauugauggggacuuuu

SEQ ID NO: 351669 - RNA, 65 nt, Homo Sapiens
acaauauuuaaugagaaaucuauugguuaauuagaaauacucagcaagacauacacaauuaauua

SEQ ID NO: 351670 - RNA, 65 nt, Homo Sapiens
uuuauuguaaggaaacuuuaaagcauuuuuuaggaaauacucaaaagcaagguuggaaaauguuu

SEQ ID NO: 351671 - RNA, 65 nt, Homo Sapiens
ucucugucacauuagacuauccaucaugaccagcaaauacucauuuuaggaaaaaaaaaagcaug

SEQ ID NO: 351672 - RNA, 65 nt, Homo Sapiens
uuuucauuuugguuuuguguuuugguuaauaaaacaauacucaaauacaaaagguaucuuuuuua

SEQ ID NO: 351673 - RNA, 65 nt, Homo Sapiens
gcaacgugcaauacaaaaaucguaucucaagggaaaauacucaaagaaagaaaaguggcagcacu

SEQ ID NO: 351674 - RNA, 65 nt, Homo Sapiens
guaaaaauacguuuuuuguaaaggcaauuguacauaauacucaucacuuaauucaccacacucuc

SEQ ID NO: 351675 - RNA, 65 nt, Homo Sapiens
accaugcuuaaaaaucacgucauucuuuaaacaaaaauacucaagaucauuuauauuuauuugga

SEQ ID NO: 351676 - RNA, 65 nt, Homo Sapiens
gcuuuaccauauaucaggaauuauauccaggaugcaauacucagacacuagcuuuuuucucacuu

SEQ ID NO: 351677 - RNA, 65 nt, Homo Sapiens
gauguuuauauauaaacucuauauccuaauuuacuaauacucaucagaugucagccuuugcucuc

SEQ ID NO: 351678 - RNA, 65 nt, Homo Sapiens
ucaggaguguccuaugugagaauugagccaaggaaaauacucaugcaaccagccugagucgcggu

SEQ ID NO: 351679 - RNA, 65 nt, Homo Sapiens
gagcaaaaggacgccaugugagcauuaggaaaaaaaauacucacucuuacuaacaauuuuuauac

SEQ ID NO: 351680 - RNA, 65 nt, Homo Sapiens
aucagaaaauaguacuuauugauuucaagauuauaaauacucaugaccacaaauaaucaagaguu

SEQ ID NO: 351681 - RNA, 65 nt, Homo Sapiens
uaauucugauaaaaggaauaagagcuuuuacaaucaauacucaccaaauaagagcaagaguugau

SEQ ID NO: 351682 - RNA, 65 nt, Homo Sapiens
auagggagaaaccaagagaaauguaauaauagaaaaauacucauaacuuaucacauggagaccua

SEQ ID NO: 351683 - RNA, 65 nt, Homo Sapiens
aauugaacugcaaaucacuuaaugagucacauugaaauacucagucaaaguucaucacacagcuu

SEQ ID NO: 351684 - RNA, 65 nt, Homo Sapiens
gggaggguccgaguccuuacugcccuaggcucuuaaauacucauuuggccagacucugaccccac

SEQ ID NO: 351685 - RNA, 65 nt, Homo Sapiens
ucuaacauuaugguaauaaccaguguaagaaggaaaauacucaucacagaguaauauaugugaug

SEQ ID NO: 351686 - RNA, 65 nt, Homo Sapiens
uaggauguaacagugaagcuaguauuuuugaauacaauacucaucguuaugaagacuuaaggccc

SEQ ID NO: 351687 - RNA, 65 nt, Homo Sapiens
uccaggguaugaccuagggaaugaacuagcuaugaaauacucaggguuaggaauccuagcacuug

SEQ ID NO: 351688 - RNA, 65 nt, Homo Sapiens
gugcaaauaacuuuugguguuguagcuaaauaaggaauacucaugccaagauugcacaauugugc

SEQ ID NO: 351689 - RNA, 65 nt, Homo Sapiens
augaugaaauucuuauguugaauauguuagaaucaaauacucauuuuucauuagauacaguagug

SEQ ID NO: 351690 - RNA, 65 nt, Homo Sapiens
gugugagguuuccuauuuugacaaguuaacuuguaaauacucagguuuuacgauguauaauuuac

SEQ ID NO: 351691 - RNA, 65 nt, Homo Sapiens
ggcaguucugcuucagcuuagagcagaacccauaaaauacucaaguacugggauaggcaagcaug

SEQ ID NO: 351692 - RNA, 65 nt, Homo Sapiens
auuuuuuauauauuugguauuuuuugaaaauuccaaauacucaugucucaaguaagcuuaaacua

SEQ ID NO: 351693 - RNA, 65 nt, Homo Sapiens
ugagacauuuuaagaucucaaguuuuuauuuaacuaauacucaaaauauggacuuuucauguaug

SEQ ID NO: 351694 - RNA, 65 nt, Homo Sapiens
ugauacgguguuaaaaaaaaucaugguaaggcuacaauacucaaguaacaagguuugggacaaug

SEQ ID NO: 351695 - RNA, 65 nt, Homo Sapiens
guagaauaugaauaaauagaauaauaaaauuccaaaauacucaaugggaaaugacuaguaauaua

SEQ ID NO: 351696 - RNA, 65 nt, Homo Sapiens
agaucugacuuguaagcaguucauagaagcugcucaauacucaagaaucuugcaagacaguuauu

SEQ ID NO: 351697 - RNA, 51 nt, Homo Sapiens
uuucccuuacccagaaaugaaaauacucaauauggaccauuuaggaauuau

SEQ ID NO: 351698 - RNA, 65 nt, Homo Sapiens
cccaaguuuacagcuuguacuuuacuuuaauguguaauacucaacucaagguacaagacaauugc

SEQ ID NO: 351699 - RNA, 65 nt, Homo Sapiens
agcugagugaauauguuuguuacuguaaaacuugaaauacucaggaagaaaucauuuuuaaugug

SEQ ID NO: 351700 - RNA, 65 nt, Homo Sapiens
uuuguccaguguuuuucuuuagggauggagaagagaauacucauuggcagagaaacugagagaaa

SEQ ID NO: 351701 - RNA, 65 nt, Homo Sapiens
uucaacauauggcucaucucgaaacauuugucucuaauacucaaaccucucuggaaaaucgaagu

SEQ ID NO: 351702 - RNA, 65 nt, Homo Sapiens
ugaaaaucauuaaugccaacaucaauuucagcuacaauacucaucuaugacguaccguugagaag

SEQ ID NO: 351703 - RNA, 65 nt, Homo Sapiens
guugcuauuucacuuuuugaauucuguuuuauuuaaauacucauuaauucuuucuuuccuacuac

SEQ ID NO: 351704 - RNA, 65 nt, Homo Sapiens
auggcuuuugguuaguguugaugucuguuguauguaauacucacaggcaaagaacucgugggagg

SEQ ID NO: 351705 - RNA, 65 nt, Homo Sapiens
uuacaggggaauuugugaccggaaaaggauauaggaauacucaucaaucaguguguguacugcag

SEQ ID NO: 351706 - RNA, 65 nt, Homo Sapiens
gccauucaacaaggagucaaguagaucugaaauuaaauacucaacagacuccuccuuuuuuagcu

SEQ ID NO: 351707 - RNA, 65 nt, Homo Sapiens
ucaagagaaguuuaggagggggagcaucccuagugaauacucacaccacaagaaggacaaacuug

SEQ ID NO: 351708 - RNA, 65 nt, Homo Sapiens
uaagguucagguguuuucaaguuggaaagaucauaaauacucaaaauuguuuucaaguuagcaag

SEQ ID NO: 351709 - RNA, 65 nt, Homo Sapiens
aauugucucauaaaguccucccugcuccuaaaagaaauacucagguugcuacaacuuggugcaug

SEQ ID NO: 351710 - RNA, 65 nt, Homo Sapiens
aaggagaauccauuuagcacaaccguuacccaggcaauacucaagcgauggagauugggaaacuu

SEQ ID NO: 351711 - RNA, 65 nt, Homo Sapiens
cccacuuaaauuauuaauguaguagauggauacugaauacucagggggaagagcuuuaggauucu

SEQ ID NO: 351712 - RNA, 65 nt, Homo Sapiens
ucuuuacuucacucacuaucaaaaccucuauagugaauacucacaugaaggcaaccuuggcugau

SEQ ID NO: 351713 - RNA, 65 nt, Homo Sapiens
cucccuggcagaacacggagaaucaggauuucuuaaauacucaacagagaggcugagcagagcaa

SEQ ID NO: 351714 - RNA, 65 nt, Homo Sapiens
gggaauuuagagguuguagcaucuucugcuggaguaauacucaggcuauucuaauaacagaugau

SEQ ID NO: 351715 - RNA, 65 nt, Homo Sapiens
aguaguaccuuuaaaguaacacuuuguacauaacaaauacucagcaaaugugaaacuuuauuugc

SEQ ID NO: 351716 - RNA, 65 nt, Homo Sapiens
aauugcauccucugaccuacaauaaauaaugcuggaauacucaagaguguauuuuacucugauca

SEQ ID NO: 351717 - RNA, 65 nt, Homo Sapiens
cugaacauauccaugcgcaauaaagugauuugaaaaauacucauuuucugcaauucagcuuuguu

SEQ ID NO: 351718 - RNA, 65 nt, Homo Sapiens
uguuuaugaccaaaauaaauccugguuauauaugaaauacucauagggccaaauagcacauaaca

SEQ ID NO: 351719 - RNA, 65 nt, Homo Sapiens
aguaauuccacucccaugaagcacaaaugaaaaacaauacucaaccacuguuauuacuguuaccu

SEQ ID NO: 351720 - RNA, 65 nt, Homo Sapiens
uuagguauuacuacauaguuuuaaugcagcaacauaauacucacuaugggaaacauuuuuuggca

SEQ ID NO: 351721 - RNA, 65 nt, Homo Sapiens
aaaauauaguuaauuguggcugcuuuuccaucuaaaauacucaccucuaacuauuaggaggaaug

SEQ ID NO: 351722 - RNA, 65 nt, Homo Sapiens
guguacaccuuugacuacagcauguauaucuguggaauacucaauauggauaccacauauuaaac

SEQ ID NO: 351723 - RNA, 65 nt, Homo Sapiens
cuguuaugucuugcuaauuuuauuuuuagaacuccaauacucaccuaacuucauuauuuuaaaaa

SEQ ID NO: 351724 - RNA, 65 nt, Homo Sapiens
aguccuuuuguuugcgguuuuccuuuagauguucaaauacucagucacccucucugauauuuuug

SEQ ID NO: 351725 - RNA, 65 nt, Homo Sapiens
cuucugacccuggcuuccagggaccuaugucuuuuaauacucacugucacauugggcaaaguugc

SEQ ID NO: 351726 - RNA, 65 nt, Homo Sapiens
aucuaagaaggauagguuauaaagggagguaccuaaauacucaaauaauguauauauucuuuuuc

SEQ ID NO: 351727 - RNA, 65 nt, Homo Sapiens
cuguagcuuagagugcucacuuacuaccucugaacaauacucacgcuguaguuugucucuuucuu

SEQ ID NO: 351728 - RNA, 65 nt, Homo Sapiens
uugagguuuuagauugaaacuuugaauaaaucaaaaauacucauucuuauuuacugcaaccuucu

SEQ ID NO: 351729 - RNA, 65 nt, Homo Sapiens
ugguaugcccuugcccuguucuauaaauaucuauaaauacucauauauauacacaccuacacaug

SEQ ID NO: 351730 - RNA, 65 nt, Homo Sapiens
aaacauuugcggaaugaauggagccacaccuggugaauacucagugguccuuuccgcucuccuaa

SEQ ID NO: 351731 - RNA, 65 nt, Homo Sapiens
agauaaggugugaauguaugaaccucccccauuuaaauacucagaacuauggguuuuuucaggug

SEQ ID NO: 351732 - RNA, 65 nt, Homo Sapiens
aaugaaccucuuuaaagccucagaaucguggagagaauacucagaaaaggagcgcuuucuagggu

SEQ ID NO: 351733 - RNA, 65 nt, Homo Sapiens
cugcugcauguagcucuugccuugagaaaugucuuaauacucacaccuggacucauuugagaaga

SEQ ID NO: 351734 - RNA, 65 nt, Homo Sapiens
gagguucauugccagggcaggagguauuuccagaaaauacucaugccuguguucuguuccuugcu

SEQ ID NO: 351735 - RNA, 65 nt, Homo Sapiens
guucuguuuuugcuacucuauugucauuccuguuuaauacucacuguacuuguauuugagacaaa

SEQ ID NO: 351736 - RNA, 65 nt, Homo Sapiens
ucucuucuuugucuaccauuucaaauugacuugugaauacucagagcaguuauuuuucaauccuc

SEQ ID NO: 351737 - RNA, 65 nt, Homo Sapiens
uacaauucaauauauaauuauggagguucauguauaauacucauuacaaggaauugccuuccgaa

SEQ ID NO: 351738 - RNA, 65 nt, Homo Sapiens
aaacaaaguuaccaauuccagagugugacuggaaaaauacucagccagugaagcaauggaagcug

SEQ ID NO: 351739 - RNA, 65 nt, Homo Sapiens
acucaucacuuccuaauuauaaaacaaagguaauaaauacucagcaauauguaaacuuacaguua

SEQ ID NO: 351740 - RNA, 65 nt, Homo Sapiens
aaugugcauauaucauuauuuugcucuuuuucuuaaauacucauuuuaccuuccuucuucauacu

SEQ ID NO: 351741 - RNA, 65 nt, Homo Sapiens
ugacuuacugcucauuuuacuuuuuauauagccugaauacucacuaaggcccagguagguagaag

SEQ ID NO: 351742 - RNA, 65 nt, Homo Sapiens
aaacauacugucuucaccauuuuaaauugucguaaaauacucauaugguuuuuuuucuuuuaauu

SEQ ID NO: 351743 - RNA, 65 nt, Homo Sapiens
uuauaauuaauuuuaguuuuacuaagugugcuaaaaauacucauuguuuaaaacaaguagcuguu

SEQ ID NO: 351744 - RNA, 65 nt, Homo Sapiens
uuuuaaaaaaaguuuuuuucuauauaagcuauaaaaauacucauucaaugcacaaauuaagaauc

SEQ ID NO: 351745 - RNA, 65 nt, Homo Sapiens
gaaaaaaauccuacugcuggugagaauugccuuaaaauacucaagaacuuguaggugacaugaca

SEQ ID NO: 351746 - RNA, 65 nt, Homo Sapiens
uaagguaaaaugccaugaugcaugagaaauacaaaaauacucagagucuuuaaagugacuaaugg

SEQ ID NO: 351747 - RNA, 65 nt, Homo Sapiens
uucacaagaaaaugcaaguuacuuuuuuuggaaauaauacucacugauuauggauaaaauggaau

SEQ ID NO: 351748 - RNA, 65 nt, Homo Sapiens
gauacccugcuaucgauggucgcuacaaaccaggaaauacucaaguuauuauguguauacauugg

SEQ ID NO: 351749 - RNA, 65 nt, Homo Sapiens
auaguuauaacgucguuacuuguacuaugaaggaaaauacucagugucagcuugagccugcauuc

SEQ ID NO: 351750 - RNA, 65 nt, Homo Sapiens
gcaacccucccccaucccuaguuauuagguuaaaaaauacucagauuacuauuucuauuacuaug

SEQ ID NO: 351751 - RNA, 65 nt, Homo Sapiens
uugcccaguuaaauguucaccaaucauuuuaacuaaauacucagacuuagaagucagaugcuuca

SEQ ID NO: 351752 - RNA, 65 nt, Homo Sapiens
uuacuaauuuauucuucacuaaaauauuuuacccaaauacucaauucuagacccuauacauuuug

SEQ ID NO: 351753 - RNA, 65 nt, Homo Sapiens
ggggguuggguuuggggacaaugccacuauaguuuaauacucagaagaggggagcuugagggaca

SEQ ID NO: 351754 - RNA, 65 nt, Homo Sapiens
ugcaauaggugagagaauguugaacagaauuaagaaauacucaugcacuugcuuuugaauugcac

SEQ ID NO: 351755 - RNA, 65 nt, Homo Sapiens
cauuuaaccuucccguuauuauuuuuuucuauuaaaauacucaugguuuugguuuuguuuuuaau

SEQ ID NO: 351756 - RNA, 65 nt, Homo Sapiens
aaaaacauacuuacauuucagacauauccaaagggaauacucacauuuuguuaagaaguugaacu

SEQ ID NO: 351757 - RNA, 65 nt, Homo Sapiens
uaaagauuuucugugcguauuuuaaaagucguguuaauacucaugauaauuauuagggaccuggc

SEQ ID NO: 351758 - RNA, 65 nt, Homo Sapiens
ggccuagcugcuacaaagaagacauguuuuagacaaauacucauguguaugggcaaaaaacucga

SEQ ID NO: 351759 - RNA, 65 nt, Homo Sapiens
ugggguuuggauuuccccaggaagauggagaauggaauacucacucuugggucuaaucuuucccc

SEQ ID NO: 351760 - RNA, 65 nt, Homo Sapiens
accuccaacagcugcuuuaaauuuaagauuuacuuaauacucagaaaauucagauaaagccauag

SEQ ID NO: 351761 - RNA, 65 nt, Homo Sapiens
uucggccuaaaauaugcagaagacagaugaggucaaauacucaguuggcucucuuuaucucccuu

SEQ ID NO: 351762 - RNA, 65 nt, Homo Sapiens
uuuguagaugaaaaagcauguacaguguucuguuuaauacucauccuuguauaaaaaaaauaguu

SEQ ID NO: 351763 - RNA, 65 nt, Homo Sapiens
aaaaugccacauuucaauuaccaagaaauguauugaauacucaagugcaguuaggaaaaaaaaau

SEQ ID NO: 351764 - RNA, 65 nt, Homo Sapiens
uuuaaaauuacuuuaaagucuaucacuuccgagcaaauacucagauaugggcaaauuguguucuu

SEQ ID NO: 351765 - RNA, 65 nt, Homo Sapiens
gccugaugcugguuuuucugcuauuaacugaaauaaauacucagacagucuucccugggagacua

SEQ ID NO: 351766 - RNA, 65 nt, Homo Sapiens
uccucccagacuuucuacacguuucccauuacuuuaauacucaccuuaaggucugggaguguucu

SEQ ID NO: 351767 - RNA, 65 nt, Homo Sapiens
gguauauuccaguagcuaucaguggugucuuguuuaauacucauuugauggcacuggcacauuac

SEQ ID NO: 351768 - RNA, 65 nt, Homo Sapiens
guuguaaaaccccucaaagcuuuuuuuauggaaauaauacucaagggggagacacuuuaccagua

SEQ ID NO: 351769 - RNA, 65 nt, Homo Sapiens; identical to SEQ ID NO: 351758

SEQ ID NO: 351770 - RNA, 65 nt, Homo Sapiens
cuuguaaaaaacauauccugaacugagauaugcaaaauacucauuuucaaguuauggaaaugugu

SEQ ID NO: 351771 - RNA, 65 nt, Homo Sapiens
ugucccuuuaaaaauaauucauaguauauacgugaaauacucagcccaaaaauuuagaugccuua

SEQ ID NO: 351772 - RNA, 65 nt, Homo Sapiens
ugggcuuaugcauuaaguuucauuucuacauuuuuaauacucacauucuguacauauauguauua

SEQ ID NO: 351773 - RNA, 65 nt, Homo Sapiens
aagaugucuuucauguguauaugccucugccauagaauacucagucuuguggucaagagaguucu

SEQ ID NO: 351774 - RNA, 65 nt, Homo Sapiens
uuguuuuuuuuuuucuuuuagugcugacaaaauaaaauacucauuuuugcauaaaaagguuccua

SEQ ID NO: 351775 - RNA, 65 nt, Homo Sapiens
ugacuuuugaggguuuuuauuucuguuauucacaaaauacucauucucauuuauguauauuguau

SEQ ID NO: 351776 - RNA, 65 nt, Homo Sapiens
uuccugugagucuugcgagguggaaguaaugauuaaauacucauguguucagaaaacauaaacuu

SEQ ID NO: 351777 - RNA, 65 nt, Homo Sapiens
guucucggaaauuugcuaauaaguuuuaucuuugcaauacucaagaugaccuuccgcacaucucu

SEQ ID NO: 351778 - RNA, 65 nt, Homo Sapiens
uauuucacuacuuaaauuaugggaguuugaaaauaaauacucacauuuucuaaauagacccuuau

SEQ ID NO: 351779 - RNA, 65 nt, Homo Sapiens
ugcguuucauguguuuuauaaauuauuagauugccaauacucaugcuuuaucugauaugcugaga

SEQ ID NO: 351780 - RNA, 65 nt, Homo Sapiens
uauguaaugauuuggaccaaaaaguauuuugcugaaauacucagguaauugagauagcaaugguu

SEQ ID NO: 351781 - RNA, 65 nt, Homo Sapiens
ccucugaccuaccuuugccuuuuucugucauggagaauacucacccuucagaaacagaccaaagg

SEQ ID NO: 351782 - RNA, 65 nt, Homo Sapiens
uccaacuugugauuccugauauuuccacuuuggagaauacucagugagugacacuacacucuaga

SEQ ID NO: 351783 - RNA, 65 nt, Homo Sapiens
aauauguaaguuuuuugguuauuaaaacuuuaaaaaauacucaaauccuugaucagagauaaacu

SEQ ID NO: 351784 - RNA, 65 nt, Homo Sapiens
accccaagauacagaaggaaggcgaugccaacauuaauacucagggauaugaggauggucaggug

SEQ ID NO: 351785 - RNA, 65 nt, Homo Sapiens
acuagagggagggagggggauuuauagacuauuuuaauacucagcuagauuuuuggucacuugcu

SEQ ID NO: 351786 - RNA, 65 nt, Homo Sapiens
uggauuggaacuaucaugguacuggagaaggacuuaauacucagagagaugcauuuacaaaacag

SEQ ID NO: 351787 - RNA, 65 nt, Homo Sapiens
cauuauuuuugaaaaaaaaaauauuuuuauagaugaauacucaggcuaaccuaguggaugugauc

SEQ ID NO: 351788 - RNA, 65 nt, Homo Sapiens
uccuggccgccuuuguaaccccagagcuuuuuggaaauacucagaaggaaaccucaaugcugccu

SEQ ID NO: 351789 - RNA, 65 nt, Homo Sapiens
guuugaagggagaccuggccgaagugaggaaggcaaauacucaggauucuguuccccucuucgca

SEQ ID NO: 351790 - RNA, 65 nt, Homo Sapiens
uuccugggcauuaagucuaauuugcugcugaugaaaauacucagugaggaaggggagaucguaga

SEQ ID NO: 351791 - RNA, 65 nt, Homo Sapiens
auggucaugugagcuucuggucaccggaagccagaaauacucagcugccauguugauccacaaag

SEQ ID NO: 351792 - RNA, 65 nt, Homo Sapiens
acagcgugagauuucaacagaacuuguuuggaacaaauacucacuuaaaacuucagcagaagaaa

SEQ ID NO: 351793 - RNA, 65 nt, Homo Sapiens
uccaucaagaggaauugugucagcccagucacaaaaauacucagccuuuccccauuucuaucucc

SEQ ID NO: 351794 - RNA, 65 nt, Homo Sapiens
gcauuguucagcugguacaggaagucuucuuuaugaauacucagaugaaccggaaaucugaacgg

SEQ ID NO: 351795 - RNA, 65 nt, Homo Sapiens
augugaaguguuaauacuagcuucucuuuugaaacaauacucauauguuuuaauuccaugaaucg

SEQ ID NO: 351796 - RNA, 65 nt, Homo Sapiens
ccagcucauuacagcaugaggagccauguggcacaaauacucaugcuguuucaaacuugcaugug

SEQ ID NO: 351797 - RNA, 65 nt, Homo Sapiens
cuuguggaauuuuauaauuucuuuuauaaguuucaaauacucagauugcuugcauuuucugauga

SEQ ID NO: 351798 - RNA, 65 nt, Homo Sapiens
uuggucccuaucuuccagcaagacagaagaaauaaaauacucaacagaacuaugcuggaugcugu

SEQ ID NO: 351799 - RNA, 65 nt, Homo Sapiens
cucuuaguuuacuuauguugaauggcuuagcuauuaauacucaaauugaguuaaaaugaaaauuc

SEQ ID NO: 351800 - RNA, 65 nt, Homo Sapiens
aagcauuauacuguggaauacugccuuuugacaaaaauacucaugccuuuacaauuguuaguaaa

SEQ ID NO: 351801 - RNA, 65 nt, Homo Sapiens
aauauauaauguaccauauauauuaauagucaacaaauacucagauauucuaaggucaaugccau

SEQ ID NO: 351802 - RNA, 65 nt, Homo Sapiens
acauauuaaagaaaaguuacuuacuguauuuaugaaauacucagcuuaggcauuuuuacuuuaac

SEQ ID NO: 351803 - RNA, 65 nt, Homo Sapiens
uuuuaauuuuuuuaauuuuuuugagcuguaguuagaauacucaauagugacauuugauucaauug

SEQ ID NO: 351804 - RNA, 65 nt, Homo Sapiens
caaaagacagucgagaagccuuggaucaaucuugaaauacucaacgugaaaguugaucauacgaa

SEQ ID NO: 351805 - RNA, 65 nt, Homo Sapiens
uucugaggcuuaggagaauacuagcuuuuauuuuuaauacucaaucuuaaguucaucucugucac

SEQ ID NO: 351806 - RNA, 65 nt, Homo Sapiens
ccuuuaaugcucuggguucaugucagauacauuaaaauacucacugaagagaagcccuaugaaug

SEQ ID NO: 351807 - RNA, 65 nt, Homo Sapiens
uuuaaaaaaagaaguggagguguuuacaccagcaaaauacucauuuuuuaaguguaauuaaguug

SEQ ID NO: 351808 - RNA, 65 nt, Homo Sapiens
gcacaccacugucuuccccagucagcucccucuaaaauacucagcggccagggcggcugccacuc

SEQ ID NO: 351809 - RNA, 65 nt, Homo Sapiens
uaacuuuaugacaacuuagggggcuugagccaugaaauacucacguuuaagucaguaaggauaca

SEQ ID NO: 351810 - RNA, 65 nt, Homo Sapiens
gaugcccaacucuucuauagguuguuauggcuggaaauacucacuuuaccagagaacuaauaaau

SEQ ID NO: 351811 - RNA, 65 nt, Homo Sapiens
gucagugcagguuaugagauaggucacucagggucaauacucaggucagggccacucgggcucag

SEQ ID NO: 351812 - RNA, 65 nt, Homo Sapiens
ccuuauugccaggaaagcaugcaaaauuuuuaaugaauacucacauuacaagugugaagaaugug

SEQ ID NO: 351813 - RNA, 65 nt, Homo Sapiens
guuauuggacuaaauaaucaaagacaaagaagaaaaauacucaaucugauaccuucaugaaauuc

SEQ ID NO: 351814 - RNA, 65 nt, Homo Sapiens
aguccaaauaugcuaaaaauuauuauacacuguagaauacucacaguuucccuguuugccuuuga

SEQ ID NO: 351815 - RNA, 65 nt, Homo Sapiens
cuaagauaccaaaaccacagugccgacagcucuccaauacucagguuaaugcugaaaaaucaucc

SEQ ID NO: 351816 - RNA, 65 nt, Homo Sapiens
uaagaguaccuuuguuuucuugaucuguuacuuuuaauacucagguaaugcuacaaauauuacag

SEQ ID NO: 351817 - RNA, 65 nt, Homo Sapiens
cuccaugagcucuggaagguauaugcaucuucuguaauacucagauagguauaagauuuuucaca

SEQ ID NO: 351818 - RNA, 65 nt, Homo Sapiens
uccuggaccccagagucauuccuccauuugguuaaaauacucagugcagggaacucuuacauccu

SEQ ID NO: 351819 - RNA, 65 nt, Homo Sapiens
aagaugguaucagagagaaacccaucaauugcucaaauacucagaaaguacugucaaaagccuaa

SEQ ID NO: 351820 - RNA, 65 nt, Homo Sapiens
aggacgaggaagaggacuuugcaauccaggaacaaaauacucacccaggcggacaaggcugacaa

SEQ ID NO: 351821 - RNA, 65 nt, Homo Sapiens
ugauucucguaaaacgcgcacacauauacaguauaaauacucauuuauauauauauauacacaca

SEQ ID NO: 351822 - RNA, 65 nt, Homo Sapiens
uugacauaauagguccucuuggggguauuugcaagaauacucauucaugcuguuuuggggggugg

SEQ ID NO: 351823 - RNA, 65 nt, Homo Sapiens
uggaaaaaacuucaugauagaaaacugguuauagcaauacucaaaguuuguauuuuguuugaauc

SEQ ID NO: 351824 - RNA, 65 nt, Homo Sapiens
agccccgugcuagcagcgcuccgugcucuuccccaaauacucacggcucuaauuccccaaaccug

SEQ ID NO: 351825 - RNA, 65 nt, Homo Sapiens
uuugggucaccuaaucauagauuucucagggcaucaauacucaaauauaggcugauuaugcccca

SEQ ID NO: 351826 - RNA, 65 nt, Homo Sapiens
ucccuccacccucaacaggacuaacaaggccaggaaauacucacuagggugcaggaggacagcag

SEQ ID NO: 351827 - RNA, 65 nt, Homo Sapiens
aguugcauuugccauggccaaaaaaaugaagacaaaauacucagacaugcacugaugcugcuugc

SEQ ID NO: 351828 - RNA, 65 nt, Homo Sapiens
cagcuccuccacaggagacuuucaguucccacucuaauacucacacagcagucaccugaucacug

SEQ ID NO: 351829 - RNA, 65 nt, Homo Sapiens
auuuggaaaggucuguccugaauuaucaaaguaagaauacucagauuuccauaagcucuucucac

SEQ ID NO: 351830 - RNA, 65 nt, Homo Sapiens
cuuccaagauacaggguccacuagaaauuggcuguaauacucauugagccaaguugucauaucaa

SEQ ID NO: 351831 - RNA, 65 nt, Homo Sapiens
cuacagaagaauauuggauugauuggaguuaauguaauacucaucauuuaccacugugcuuggca

SEQ ID NO: 351832 - RNA, 65 nt, Homo Sapiens
aucauauuuaaaucuuacuuuaaggcucaauaaauaauacucauaaugucucauuuuagugacuc

SEQ ID NO: 351833 - RNA, 65 nt, Homo Sapiens
ucuuauucuuuuuaaauuuuaaauauuuuguuauaaauacucacaggauaccuuauuucccuagc

SEQ ID NO: 351834 - RNA, 57 nt, Homo Sapiens
cgagacaugguccagccuaagcuuacuaauacucacuuagugauuuguaaaauuugc

SEQ ID NO: 351835 - RNA, 65 nt, Homo Sapiens
acucaugagggcuuccaaugugcugccccccucuuaauacucaccaauaaauucuacuuccuguc

SEQ ID NO: 351836 - RNA, 65 nt, Homo Sapiens
uacaugguuugaaaugugcauuuuuuucuugaaggaauacucacagaaguuuaauuuaauacugu

SEQ ID NO: 351837 - RNA, 65 nt, Homo Sapiens
agggcuaguuauuccgauuuacacauauagcauaaaauacucagcacacacauauauauacucac

SEQ ID NO: 351838 - RNA, 65 nt, Homo Sapiens
ucacaacuuagcauuuugccaacaacuagcuggacaauacucaaugagucucuagggcaaggaga

SEQ ID NO: 351839 - RNA, 65 nt, Homo Sapiens
acugggaaaaacuuuuucaaauccugggacauaaaaauacucacuaguacugauugguucagcau

SEQ ID NO: 351840 - RNA, 65 nt, Homo Sapiens
uuuuuuaacucauguagugaauugaguacuuggagaauacucacggagcaacaccaugcauauag

SEQ ID NO: 351841 - RNA, 65 nt, Homo Sapiens
agaaugguggaagguuaaacagguggccuggguuuaauacucaagacaccccugcaaguggccaa

SEQ ID NO: 351842 - RNA, 65 nt, Homo Sapiens
cucaguauuaccuacucaaugacuuguauuuauuaaauacucaaaauuucuuuaaucaguuucuc

SEQ ID NO: 351843 - RNA, 64 nt, Homo Sapiens
uaagucaguguuaaaauuuuaguagguccgcuagcaguacuaaucaugugaggaaaugaugaga

SEQ ID NO: 351844 - RNA, 64 nt, Homo Sapiens
ccuugaccgacaugaacuguacacagaauuguuccaguacuauggagugcucacaaaggauacu

SEQ ID NO: 351845 - RNA, 64 nt, Homo Sapiens; identical to SEQ ID NO: 297037

SEQ ID NO: 351846 - RNA, 64 nt, Homo Sapiens; identical to SEQ ID NO: 297038

SEQ ID NO: 351847 - RNA, 64 nt, Homo Sapiens; identical to SEQ ID NO: 297039

SEQ ID NO: 351848 - RNA, 64 nt, Homo Sapiens; identical to SEQ ID NO: 297040

SEQ ID NO: 351849 - RNA, 64 nt, Homo Sapiens; identical to SEQ ID NO: 234645

SEQ ID NO: 351850 - RNA, 64 nt, Homo Sapiens; identical to SEQ ID NO: 234646

SEQ ID NO: 351851 - RNA, 64 nt, Homo Sapiens; identical to SEQ ID NO: 234647

SEQ ID NO: 351852 - RNA, 64 nt, Homo Sapiens; identical to SEQ ID NO: 234648

SEQ ID NO: 351853 - RNA, 64 nt, Homo Sapiens; identical to SEQ ID NO: 234649

SEQ ID NO: 351854 - RNA, 64 nt, Homo Sapiens; identical to SEQ ID NO: 234650

SEQ ID NO: 351855 - RNA, 64 nt, Homo Sapiens; identical to SEQ ID NO: 234651

SEQ ID NO: 351856 - RNA, 64 nt, Homo Sapiens; identical to SEQ ID NO: 234652

SEQ ID NO: 351857 - RNA, 64 nt, Homo Sapiens; identical to SEQ ID NO: 234653

SEQ ID NO: 351858 - RNA, 64 nt, Homo Sapiens; identical to SEQ ID NO: 234654

SEQ ID NO: 351859 - RNA, 64 nt, Homo Sapiens; identical to SEQ ID NO: 234655

SEQ ID NO: 351860 - RNA, 64 nt, Homo Sapiens; identical to SEQ ID NO: 234656

SEQ ID NO: 351861 - RNA, 64 nt, Homo Sapiens; identical to SEQ ID NO: 234657

SEQ ID NO: 351862 - RNA, 64 nt, Homo Sapiens; identical to SEQ ID NO: 234658

SEQ ID NO: 351863 - RNA, 64 nt, Homo Sapiens; identical to SEQ ID NO: 234659

SEQ ID NO: 351864 - RNA, 64 nt, Homo Sapiens; identical to SEQ ID NO: 234660

SEQ ID NO: 351865 - RNA, 64 nt, Homo Sapiens; identical to SEQ ID NO: 234661

SEQ ID NO: 351866 - RNA, 64 nt, Homo Sapiens; identical to SEQ ID NO: 234662

SEQ ID NO: 351867 - RNA, 64 nt, Homo Sapiens; identical to SEQ ID NO: 234663

SEQ ID NO: 351868 - RNA, 64 nt, Homo Sapiens; identical to SEQ ID NO: 234664

SEQ ID NO: 351869 - RNA, 64 nt, Homo Sapiens; identical to SEQ ID NO: 234665

SEQ ID NO: 351870 - RNA, 63 nt, Homo Sapiens; identical to SEQ ID NO: 234666

SEQ ID NO: 351871 - RNA, 64 nt, Homo Sapiens; identical to SEQ ID NO: 234667

SEQ ID NO: 351872 - RNA, 64 nt, Homo Sapiens; identical to SEQ ID NO: 234668

SEQ ID NO: 351873 - RNA, 64 nt, Homo Sapiens; identical to SEQ ID NO: 234669

SEQ ID NO: 351874 - RNA, 64 nt, Homo Sapiens; identical to SEQ ID NO: 234670

SEQ ID NO: 351875 - RNA, 64 nt, Homo Sapiens; identical to SEQ ID NO: 234671

SEQ ID NO: 351876 - RNA, 64 nt, Homo Sapiens; identical to SEQ ID NO: 234672

SEQ ID NO: 351877 - RNA, 64 nt, Homo Sapiens; identical to SEQ ID NO: 234673

SEQ ID NO: 351878 - RNA, 64 nt, Homo Sapiens; identical to SEQ ID NO: 234674

SEQ ID NO: 351879 - RNA, 64 nt, Homo Sapiens; identical to SEQ ID NO: 234675

SEQ ID NO: 351880 - RNA, 64 nt, Homo Sapiens; identical to SEQ ID NO: 234676

SEQ ID NO: 351881 - RNA, 64 nt, Homo Sapiens; identical to SEQ ID NO: 234677

SEQ ID NO: 351882 - RNA, 64 nt, Homo Sapiens; identical to SEQ ID NO: 234678

SEQ ID NO: 351883 - RNA, 64 nt, Homo Sapiens; identical to SEQ ID NO: 234679

SEQ ID NO: 351884 - RNA, 64 nt, Homo Sapiens; identical to SEQ ID NO: 234680

SEQ ID NO: 351885 - RNA, 64 nt, Homo Sapiens; identical to SEQ ID NO: 234681

SEQ ID NO: 351886 - RNA, 64 nt, Homo Sapiens; identical to SEQ ID NO: 234682

SEQ ID NO: 351887 - RNA, 64 nt, Homo Sapiens; identical to SEQ ID NO: 234683

SEQ ID NO: 351888 - RNA, 64 nt, Homo Sapiens; identical to SEQ ID NO: 234684

SEQ ID NO: 351889 - RNA, 64 nt, Homo Sapiens; identical to SEQ ID NO: 234685

SEQ ID NO: 351890 - RNA, 64 nt, Homo Sapiens; identical to SEQ ID NO: 234686

SEQ ID NO: 351891 - RNA, 64 nt, Homo Sapiens; identical to SEQ ID NO: 234687

SEQ ID NO: 351892 - RNA, 64 nt, Homo Sapiens; identical to SEQ ID NO: 234688

SEQ ID NO: 351893 - RNA, 64 nt, Homo Sapiens; identical to SEQ ID NO: 234689

SEQ ID NO: 351894 - RNA, 64 nt, Homo Sapiens; identical to SEQ ID NO: 234690

SEQ ID NO: 351895 - RNA, 64 nt, Homo Sapiens; identical to SEQ ID NO: 234691

SEQ ID NO: 351896 - RNA, 64 nt, Homo Sapiens; identical to SEQ ID NO: 234692

SEQ ID NO: 351897 - RNA, 64 nt, Homo Sapiens; identical to SEQ ID NO: 234693

SEQ ID NO: 351898 - RNA, 64 nt, Homo Sapiens; identical to SEQ ID NO: 234694

SEQ ID NO: 351899 - RNA, 64 nt, Homo Sapiens; identical to SEQ ID NO: 234695

SEQ ID NO: 351900 - RNA, 64 nt, Homo Sapiens; identical to SEQ ID NO: 234696

SEQ ID NO: 351901 - RNA, 64 nt, Homo Sapiens; identical to SEQ ID NO: 53771

SEQ ID NO: 351902 - RNA, 64 nt, Homo Sapiens; identical to SEQ ID NO: 53772

SEQ ID NO: 351903 - RNA, 64 nt, Homo Sapiens; identical to SEQ ID NO: 53773

SEQ ID NO: 351904 - RNA, 64 nt, Homo Sapiens; identical to SEQ ID NO: 53774

SEQ ID NO: 351905 - RNA, 64 nt, Homo Sapiens; identical to SEQ ID NO: 53775

SEQ ID NO: 351906 - RNA, 64 nt, Homo Sapiens; identical to SEQ ID NO: 53776

SEQ ID NO: 351907 - RNA, 64 nt, Homo Sapiens; identical to SEQ ID NO: 53777

SEQ ID NO: 351908 - RNA, 64 nt, Homo Sapiens; identical to SEQ ID NO: 53778

SEQ ID NO: 351909 - RNA, 64 nt, Homo Sapiens; identical to SEQ ID NO: 53779

SEQ ID NO: 351910 - RNA, 64 nt, Homo Sapiens; identical to SEQ ID NO: 53780

SEQ ID NO: 351911 - RNA, 64 nt, Homo Sapiens; identical to SEQ ID NO: 53781

SEQ ID NO: 351912 - RNA, 64 nt, Homo Sapiens; identical to SEQ ID NO: 53782

SEQ ID NO: 351913 - RNA, 64 nt, Homo Sapiens; identical to SEQ ID NO: 53783

SEQ ID NO: 351914 - RNA, 64 nt, Homo Sapiens; identical to SEQ ID NO: 53784

SEQ ID NO: 351915 - RNA, 64 nt, Homo Sapiens; identical to SEQ ID NO: 53785

SEQ ID NO: 351916 - RNA, 64 nt, Homo Sapiens; identical to SEQ ID NO: 53786

SEQ ID NO: 351917 - RNA, 64 nt, Homo Sapiens; identical to SEQ ID NO: 53787

SEQ ID NO: 351918 - RNA, 64 nt, Homo Sapiens; identical to SEQ ID NO: 53788

SEQ ID NO: 351919 - RNA, 64 nt, Homo Sapiens; identical to SEQ ID NO: 53789

SEQ ID NO: 351920 - RNA, 64 nt, Homo Sapiens; identical to SEQ ID NO: 53790

SEQ ID NO: 351921 - RNA, 64 nt, Homo Sapiens; identical to SEQ ID NO: 53791

SEQ ID NO: 351922 - RNA, 64 nt, Homo Sapiens; identical to SEQ ID NO: 53792

SEQ ID NO: 351923 - RNA, 64 nt, Homo Sapiens; identical to SEQ ID NO: 53793

SEQ ID NO: 351924 - RNA, 64 nt, Homo Sapiens; identical to SEQ ID NO: 53794

SEQ ID NO: 351925 - RNA, 64 nt, Homo Sapiens; identical to SEQ ID NO: 53795

SEQ ID NO: 351926 - RNA, 64 nt, Homo Sapiens; identical to SEQ ID NO: 53796

SEQ ID NO: 351927 - RNA, 64 nt, Homo Sapiens; identical to SEQ ID NO: 53797

SEQ ID NO: 351928 - RNA, 64 nt, Homo Sapiens; identical to SEQ ID NO: 53798

SEQ ID NO: 351929 - RNA, 64 nt, Homo Sapiens; identical to SEQ ID NO: 53799

SEQ ID NO: 351930 - RNA, 64 nt, Homo Sapiens; identical to SEQ ID NO: 53800

SEQ ID NO: 351931 - RNA, 64 nt, Homo Sapiens; identical to SEQ ID NO: 53801

SEQ ID NO: 351932 - RNA, 64 nt, Homo Sapiens; identical to SEQ ID NO: 53802

SEQ ID NO: 351933 - RNA, 64 nt, Homo Sapiens; identical to SEQ ID NO: 53803

SEQ ID NO: 351934 - RNA, 64 nt, Homo Sapiens; identical to SEQ ID NO: 53804

SEQ ID NO: 351935 - RNA, 64 nt, Homo Sapiens; identical to SEQ ID NO: 53805

SEQ ID NO: 351936 - RNA, 64 nt, Homo Sapiens; identical to SEQ ID NO: 53806

SEQ ID NO: 351937 - RNA, 64 nt, Homo Sapiens; identical to SEQ ID NO: 53807

SEQ ID NO: 351938 - RNA, 64 nt, Homo Sapiens; identical to SEQ ID NO: 53808

SEQ ID NO: 351939 - RNA, 64 nt, Homo Sapiens; identical to SEQ ID NO: 53809

SEQ ID NO: 351940 - RNA, 64 nt, Homo Sapiens; identical to SEQ ID NO: 53810

SEQ ID NO: 351941 - RNA, 64 nt, Homo Sapiens; identical to SEQ ID NO: 53811

SEQ ID NO: 351942 - RNA, 64 nt, Homo Sapiens; identical to SEQ ID NO: 53812

SEQ ID NO: 351943 - RNA, 64 nt, Homo Sapiens; identical to SEQ ID NO: 53813

SEQ ID NO: 351944 - RNA, 64 nt, Homo Sapiens; identical to SEQ ID NO: 53814

SEQ ID NO: 351945 - RNA, 64 nt, Homo Sapiens; identical to SEQ ID NO: 53815

SEQ ID NO: 351946 - RNA, 64 nt, Homo Sapiens
ggcaacaaugagcagaccaaccuaaauuuggggaaauuaggagaggcagagauagaaccuggag

SEQ ID NO: 351947 - RNA, 64 nt, Homo Sapiens
ccacuccuggcugagagaggaagagcugcaacggaauuaggaagaccaagacacagaucacccg

SEQ ID NO: 351948 - RNA, 64 nt, Homo Sapiens
aaaugugucauacuguuuuaggaucaagacuaggaauuaggagccagguugacaaggacuuuuu

SEQ ID NO: 351949 - RNA, 64 nt, Homo Sapiens
gucuuuagagguauuuugauuuaaaguauacuuaaauuaggauuucuuaaagaaaacauaggga

SEQ ID NO: 351950 - RNA, 64 nt, Homo Sapiens
ggaucgcgagagagaugaaaggaaggaggcuuggaauuaggaugccaggcagacucagacacag

SEQ ID NO: 351951 - RNA, 54 nt, Homo Sapiens
gguaagaaucgccuuaauuuuuggaauuaggaaauuguucacuuucuaacuuga

SEQ ID NO: 351952 - RNA, 64 nt, Homo Sapiens
agagacugggauuagggguucugugcucuugccuaauuaggaacauucucccaugucucuugug

SEQ ID NO: 351953 - RNA, 64 nt, Homo Sapiens
aauuauuuucucacagucuggugagcaggcaauuaauuaggaguaagggggccuaguagagcgu

SEQ ID NO: 351954 - RNA, 64 nt, Homo Sapiens
uuucuucuucacaggccuucuuucaaggcaaauugaaaaucacuggcaacaugggucucgcuau

SEQ ID NO: 351955 - RNA, 64 nt, Homo Sapiens
gcuaagcucugaagaacucccuuuggcuacuuuugaaaaucaagaugagauauauagauauaua

SEQ ID NO: 351956 - RNA, 64 nt, Homo Sapiens
cuucaacgccagugacuguguaccuccagcagaagaaaaucaggugucuggucuugggggcacu

SEQ ID NO: 351957 - RNA, 64 nt, Homo Sapiens
aagcccugaagucgggagaggugaccacaggucugaaaaucagccagugccaacauugcuugcc

SEQ ID NO: 351958 - RNA, 64 nt, Homo Sapiens
uacuucaaaacgcauacugcagcaucuacacuuugaaaaucaaguuguuaauaaacuauuaugc

SEQ ID NO: 351959 - RNA, 64 nt, Homo Sapiens
agggaaaaugauuaccucuuuaaauucaacaccugaaaaucaugacuuucauugguaaaacuuu

SEQ ID NO: 351960 - RNA, 64 nt, Homo Sapiens
uccuaacaaagaagucugucauuuccccaaaucagaaaaucacaguucuauaccagaaugggaa

SEQ ID NO: 351961 - RNA, 64 nt, Homo Sapiens
cauguuuucucucacccucuucauauaaauguaugaaaaucaacugaaauaauaaggccgauuu

SEQ ID NO: 351962 - RNA, 64 nt, Homo Sapiens
cucauuauuuauaguugaauugugaguuuuguaugaaaaucagcuauguaauaagguuuauuuc

SEQ ID NO: 351963 - RNA, 64 nt, Homo Sapiens
uuguauuuacacaaacccagagggaaucuugugugaaaaucagcguucuaagaaaugcauaguu

SEQ ID NO: 351964 - RNA, 64 nt, Homo Sapiens
uggggaguaaaaaaaugaaauuuaagaaaaaggugaaaaucauuucagugcauuuauuguacau

SEQ ID NO: 351965 - RNA, 64 nt, Homo Sapiens
aaugugaauuuugccagaggugguuuuugaacaggaaaaucauaauucauaucauuggagaagu

SEQ ID NO: 351966 - RNA, 64 nt, Homo Sapiens
aauaucaaauugaagaaaaacucaauccucccaugaaaaucaguucgccuggccuccaagucgu

SEQ ID NO: 351967 - RNA, 64 nt, Homo Sapiens
gaaaaacaaaaaagaagaauaaaauaauuuggaugaaaaucauguuuauuuaaauaguaauguc

SEQ ID NO: 351968 - RNA, 64 nt, Homo Sapiens
caugagacuauuaaagaugugccagaguuucaaugaaaaucauuaaaguaggacagcuaagaaa

SEQ ID NO: 351969 - RNA, 64 nt, Homo Sapiens
aaacaaaauuucuucauggaaaucauauacauuagaaaaucacagucagauguuuaaucaaucc

SEQ ID NO: 351970 - RNA, 64 nt, Homo Sapiens
cugcccugcucagcagucaccauagcagcugacugaaaaucagcacugccugaguaguuuugau

SEQ ID NO: 351971 - RNA, 64 nt, Homo Sapiens
acagacuaaggcaguggcuguaaauaguucaugugaaaaucauggaaacuagguaacagguucu

SEQ ID NO: 351972 - RNA, 64 nt, Homo Sapiens
uauaaucccugagauuuguaagcaggaaauaaaggaaaaucaaguugggugcaaguaaagauug

SEQ ID NO: 351973 - RNA, 64 nt, Homo Sapiens
aacuucuagcauauagacuacuugguggcagaaugaaaaucagcauaaauaaaaguacaguuuu

SEQ ID NO: 351974 - RNA, 64 nt, Homo Sapiens
uuuuagauuaaaaaaauuuuaauuguucuugggagaaaaucaacacuuuguagaaagcaaacaa

SEQ ID NO: 351975 - RNA, 64 nt, Homo Sapiens
ugaacacaauugauacuucaggugcuuuugaugugaaaaucaugaaaagaggaacagguggaug

SEQ ID NO: 351976 - RNA, 64 nt, Homo Sapiens
ucuucacucccaauaacuaaugcuaagaaaugcugaaaaucaaaguaaaaaauuaaagcccaua

SEQ ID NO: 351977 - RNA, 64 nt, Homo Sapiens
auaauuuuacuauuucuuuuaaaaguauguuuuggaaaaucaaugauuuuaaugcauagcagua

SEQ ID NO: 351978 - RNA, 64 nt, Homo Sapiens
cauguaugaugugcauauaugcuaaaagaaugcagaaaaucauuuuaugaauagccaaauuugg

SEQ ID NO: 351979 - RNA, 64 nt, Homo Sapiens
caguaugagaguuuaguuauuaaccuuucaaccugaaaaucaaguugaaauauauagauuauug

SEQ ID NO: 351980 - RNA, 64 nt, Homo Sapiens
ggaggcaaaauuuugacaggaauauauauauauugaaaaucaaagcaacagaguaagacaaaaa

SEQ ID NO: 351981 - RNA, 64 nt, Homo Sapiens
gcaaaaguuaaaucucaaaaugaccuuauaauuggaaaaucagagaaacaccuagaauaauguu

SEQ ID NO: 351982 - RNA, 64 nt, Homo Sapiens
cuuuguccuguucuguguaaauaacuagacaaaggaaaaucaucaucuuggacgcuaccuuaca

SEQ ID NO: 351983 - RNA, 64 nt, Homo Sapiens
cauuauuuuucauuuuguuuguucuaagaggauugaaaaucaguuuaguuuaaaugucuuucug

SEQ ID NO: 351984 - RNA, 64 nt, Homo Sapiens
cauuaaaaugcaaauuuuccuauuuauuugaguagaaaaucacuuaccagugagcauauauauu

SEQ ID NO: 351985 - RNA, 64 nt, Homo Sapiens
uggcacaucaucauaauccauuuucucuuugcuagaaaaucagcccauagagugcauucccaaa

SEQ ID NO: 351986 - RNA, 64 nt, Homo Sapiens
ccaguauccccacaaaacaaguuaaaacuuaagugaaaaucauucugcuuuugaaucuuaaaag

SEQ ID NO: 351987 - RNA, 64 nt, Homo Sapiens
caagauguacuaaauauguauauuagaaauuauagaaaaucauguuguccguuuucaaauucau

SEQ ID NO: 351988 - RNA, 64 nt, Homo Sapiens
gacaugugcugcuaguuuauaaacuggcauugacgaaaaucauuugaaucucuucuggcugaga

SEQ ID NO: 351989 - RNA, 64 nt, Homo Sapiens
caaauguaacucccacauugaguuuaucuauauugaaaaucauuuacauuggccuauauuugga

SEQ ID NO: 351990 - RNA, 64 nt, Homo Sapiens
uccucugaggaggaguuuuuaauuguauuugcuagaaaaucaggauguaauaaagauuuguaua

SEQ ID NO: 351991 - RNA, 64 nt, Homo Sapiens
gcaaucaucuagaucucacauacaaagagcaucagaaaaucaggcuuugagggcaugcuuccca

SEQ ID NO: 351992 - RNA, 64 nt, Homo Sapiens
cuuaucuggaaauucaauaaugagaauauacuuagaaaaucacaacugugugcaggaagucucg

SEQ ID NO: 351993 - RNA, 64 nt, Homo Sapiens
acacuuucacuagaagcccagcaaggcuguuuuugaaaaucauuaggagggaguaacagaaaga

SEQ ID NO: 351994 - RNA, 64 nt, Homo Sapiens
gggaauuaagaaagccucguuuacggcauggaaagaaaaucaguuaugacauuuuaugagcugu

SEQ ID NO: 351995 - RNA, 64 nt, Homo Sapiens
uauaguauuucauaguaauacagucucccaaauagaaaaucaugagaacuuuaauuugcacuac

SEQ ID NO: 351996 - RNA, 64 nt, Homo Sapiens
uaaaucccagaaaagaggaaggacuuggcugugagaaaaucaccuccugcuuucuuuugcggua

SEQ ID NO: 351997 - RNA, 64 nt, Homo Sapiens
gcuuuaucugauaugcugagauuuugagguagaggaaaaucaaugaaauuaacaagaacucauu

SEQ ID NO: 351998 - RNA, 64 nt, Homo Sapiens
uugagaauaauuauuucagacuaaugaguugcuggaaaaucauaaacaaagcaaauuucauuau

SEQ ID NO: 351999 - RNA, 64 nt, Homo Sapiens
aaauacacuauagagucaaaauaccauuuacaaagaaaaucaaaagcauuucuauauuuugucu

SEQ ID NO: 352000 - RNA, 64 nt, Homo Sapiens
ucguaaguuagcaaaagaaauuuuuuucaccuuugaaaaucacgugauguuaaaggacaaaugc

SEQ ID NO: 352001 - RNA, 64 nt, Homo Sapiens
gaaagaaugagucuaauaucgugaacaaaaggaagaaaaucaaguccaaaagucacuuuugaau

SEQ ID NO: 352002 - RNA, 64 nt, Homo Sapiens
ugugcuuuucagcuugacacguugaagagcuauugaaaaucauuguacgagauuuagucaacuu

SEQ ID NO: 352003 - RNA, 64 nt, Homo Sapiens
acaggagaaaggccuuaugaaugcguugaguguggaaaaucauuucgccgaagcucuucacucu

SEQ ID NO: 352004 - RNA, 64 nt, Homo Sapiens
acuggagaaaggccauaugaaugcauugauuguggaaaaucauuucgccacaguucuucguucc

SEQ ID NO: 352005 - RNA, 64 nt, Homo Sapiens
ugccaaaauccaaggcaauucuagaagcaacuaggaaaaucacugccugucuucagagaaccca

SEQ ID NO: 352006 - RNA, 64 nt, Homo Sapiens
uauauaaccaauagugaaaucucaccaaacacaagaaaaucaaaucuccaaagccuugugugaa

SEQ ID NO: 352007 - RNA, 64 nt, Homo Sapiens
ggaacuuuuaaugaaggacagugucuucuuugaagaaaaucaagcucguguuuuuauucgaagc

SEQ ID NO: 352008 - RNA, 64 nt, Homo Sapiens
gauuaaaaaaaacacaucuaguaagacguaaggggaaaaucacauccucuuuggagaugauuau

SEQ ID NO: 352009 - RNA, 64 nt, Homo Sapiens
uaccuuuuuuucuguaugcuuuuuacacaugauccaacguuaacuuagacucccugagguuccg

SEQ ID NO: 352010 - RNA, 64 nt, Homo Sapiens
auugcagaaguagcuuaucauagcaucuuuucuacaacguuaaauaguggugaaaggagacuag

SEQ ID NO: 352011 - RNA, 64 nt, Homo Sapiens
uauugaauauguauuucgguuuugauggaccuuucaacguuauucguaguaaaugaugcuucgg

SEQ ID NO: 352012 - RNA, 64 nt, Homo Sapiens
cuucuuuuucauauuucuacacauauucagacaucaacguuaucauuuuacuaaggcagcuaag

SEQ ID NO: 352013 - RNA, 64 nt, Homo Sapiens
uuguccgauuuauguguauugccagagaguaguacaacguuaaaaggaaguaggaaacuguagg

SEQ ID NO: 352014 - RNA, 64 nt, Homo Sapiens
uaaaaagcuucuuuuaccuagacuggaaauaagacaacguuaagucugcuacagcguaaaauua

SEQ ID NO: 352015 - RNA, 64 nt, Homo Sapiens
cucuguacucaaaccuguggcaaauucauccuagcaacguuauuugacgaggggcaugaacauu

SEQ ID NO: 352016 - RNA, 64 nt, Homo Sapiens
ccaggaguauuagacuagcuaauaguaaaggccucaacguuauucuuuacuucauguugaaaac

SEQ ID NO: 352017 - RNA, 64 nt, Homo Sapiens
ucagccaccugggacuucgaaacgaaaccuuggccaacguuaccccuucaugggagacaacgau

SEQ ID NO: 352018 - RNA, 64 nt, Homo Sapiens
uuuuugaauguaguaaguaaacacuuuuuggacucaacguuacaucuuuuuugugugauuuaag

SEQ ID NO: 352019 - RNA, 64 nt, Homo Sapiens
uauguacagaagaaaaaaagaaguaaaucuccuucaacguuauaaaggcaaagguaucucuuag

SEQ ID NO: 352020 - RNA, 64 nt, Homo Sapiens
guuuaacaaaauacuccuaggccagauuucuauucaacguuagacuuauacaaauaaccuacau

SEQ ID NO: 352021 - RNA, 64 nt, Homo Sapiens
ggaucugacaacaaacugauuuauagacauuaugcaacguuauauuuugucuucuguguggauu

SEQ ID NO: 352022 - RNA, 64 nt, Homo Sapiens
ucaccuuaggucacgaguuugagaccagccugaccaacguuaaguaaccccgucuuuacuaaaa

SEQ ID NO: 352023 - RNA, 64 nt, Homo Sapiens
uacauguaaauagacaaaagucauguugcagguucaacguuauuguauguuacaauagauagug

SEQ ID NO: 352024 - RNA, 64 nt, Homo Sapiens
uauucuagaaacuuucugaaucaggguuuuuuuucaacguuaaagugguauacggugucagguu

SEQ ID NO: 352025 - RNA, 64 nt, Homo Sapiens
agaacuuacugcugaccuuuaaauccuuguuaagcaacguuagugagaauguauuuccuuuucu

SEQ ID NO: 352026 - RNA, 64 nt, Homo Sapiens
uccagagauggaacauuuuugagcaaaacaccaucaacguuaauaggauaaaaacuuucagaau

SEQ ID NO: 352027 - RNA, 64 nt, Homo Sapiens
uuuaugggguauaguggccaaauagcacauccuccaacguuaaaagacaguggaucaugaaaag

SEQ ID NO: 352028 - RNA, 64 nt, Homo Sapiens
caggccaacucauacucauuuggaucuauuuagacaacguuaaccaauauaucuauagcuuuag

SEQ ID NO: 352029 - RNA, 64 nt, Homo Sapiens
ggugggccgagggugucuagggguucugccuggucaacguuauuugucgucccaucuuuuggca

SEQ ID NO: 352030 - RNA, 64 nt, Homo Sapiens
cuaacgaaauuuccaugaagaaaacacgcauuugcaacguuaacuauauaaaaugugucacaga

SEQ ID NO: 352031 - RNA, 64 nt, Homo Sapiens
auuuucuaauccgcuguuuuaggguagacacugacaacguuauguguggucuuuaaccuguugu

SEQ ID NO: 352032 - RNA, 64 nt, Homo Sapiens
cagggcuccucccagcuuguaccuagagccagaccaacguuacugcuccuccucggaaccgcuc

SEQ ID NO: 352033 - RNA, 64 nt, Homo Sapiens
aucauuuuuaggguuauuguacuaagugccguuucaacguuacauuuugugaccuuuuuuguaa

SEQ ID NO: 352034 - RNA, 64 nt, Homo Sapiens
gccuaugaguugugugaagcucuuggcuuuuuuccaacguuacuuuguaacuaaugagggugga

SEQ ID NO: 352035 - RNA, 64 nt, Homo Sapiens
cucuuagccuacaagguggcacgcuguguuuaaacaacguuaaaguugcuacuguuugccucaa

SEQ ID NO: 352036 - RNA, 64 nt, Homo Sapiens
aauucuggauuuucuuaucauacgaugagaaauucaacguuaauuuacuguuuuuagaugaaug

SEQ ID NO: 352037 - RNA, 64 nt, Homo Sapiens
uuuuaaacaggugaucacguuucguguucauacucaacguuaauaaaaggagagaguuuguagu

SEQ ID NO: 352038 - RNA, 64 nt, Homo Sapiens
gaaaagacaagcgagagcacacuauucucauugccaacguuaaaccuuauuuaaaagccaaacg

SEQ ID NO: 352039 - RNA, 64 nt, Homo Sapiens
uuauacuguagcaaauacauuuaaaaauuaaucacaacguuaagaugaaauuauauuuuuggaa

SEQ ID NO: 352040 - RNA, 64 nt, Homo Sapiens
ggacacuuguaagucaaucauauugugcuguuaacaacguuaguaaagagauaagcauuaaacc

SEQ ID NO: 352041 - RNA, 64 nt, Homo Sapiens
ucuuaacagacuuucuauagaaggaaauaaagaacaacguuauuaccaaggggaaggggagaga

SEQ ID NO: 352042 - RNA, 64 nt, Homo Sapiens
cacuucucagagauaucuucccaggugcccaucccaacguuacuauuauaucauaauuugauuc

SEQ ID NO: 352043 - RNA, 64 nt, Homo Sapiens
caaagaaaucauaggugaaacccccuacccuccccaacguuaaaugcucgagaggaaucuucca

SEQ ID NO: 352044 - RNA, 64 nt, Homo Sapiens
gcccuuuagccauauugaaaacaaauaucuuuuucaacguuaucuuagcucuacuaguugaucu

SEQ ID NO: 352045 - RNA, 64 nt, Homo Sapiens
cucuuuuugaugaguuucugaaacuggagcgguucaacguuauccagugugaaaaucagugagu

SEQ ID NO: 352046 - RNA, 64 nt, Homo Sapiens
uuuccugaaugaugaaguuuuuuccucaagggagcaacguuagcccuccagauagccacugccu

SEQ ID NO: 352047 - RNA, 64 nt, Homo Sapiens
uugcaggccacgugacauaagcugaccaggaagccaacguuaacuuucaccagccuaaggccug

SEQ ID NO: 352048 - RNA, 64 nt, Homo Sapiens; identical to SEQ ID NO: 157838

SEQ ID NO: 352049 - RNA, 64 nt, Homo Sapiens; identical to SEQ ID NO: 157839

SEQ ID NO: 352050 - RNA, 64 nt, Homo Sapiens; identical to SEQ ID NO: 157840

SEQ ID NO: 352051 - RNA, 64 nt, Homo Sapiens; identical to SEQ ID NO: 157841

SEQ ID NO: 352052 - RNA, 64 nt, Homo Sapiens; identical to SEQ ID NO: 157842

SEQ ID NO: 352053 - RNA, 64 nt, Homo Sapiens; identical to SEQ ID NO: 157843

SEQ ID NO: 352054 - RNA, 64 nt, Homo Sapiens; identical to SEQ ID NO: 157844

SEQ ID NO: 352055 - RNA, 64 nt, Homo Sapiens; identical to SEQ ID NO: 157845

SEQ ID NO: 352056 - RNA, 64 nt, Homo Sapiens; identical to SEQ ID NO: 157846

SEQ ID NO: 352057 - RNA, 64 nt, Homo Sapiens; identical to SEQ ID NO: 157847

SEQ ID NO: 352058 - RNA, 64 nt, Homo Sapiens; identical to SEQ ID NO: 157848

SEQ ID NO: 352059 - RNA, 64 nt, Homo Sapiens; identical to SEQ ID NO: 157849

SEQ ID NO: 352060 - RNA, 64 nt, Homo Sapiens; identical to SEQ ID NO: 157850

SEQ ID NO: 352061 - RNA, 64 nt, Homo Sapiens; identical to SEQ ID NO: 157851

SEQ ID NO: 352062 - RNA, 64 nt, Homo Sapiens; identical to SEQ ID NO: 157852

SEQ ID NO: 352063 - RNA, 64 nt, Homo Sapiens; identical to SEQ ID NO: 157853

SEQ ID NO: 352064 - RNA, 64 nt, Homo Sapiens; identical to SEQ ID NO: 157854

SEQ ID NO: 352065 - RNA, 64 nt, Homo Sapiens; identical to SEQ ID NO: 157855

SEQ ID NO: 352066 - RNA, 64 nt, Homo Sapiens; identical to SEQ ID NO: 157856

SEQ ID NO: 352067 - RNA, 64 nt, Homo Sapiens; identical to SEQ ID NO: 157857

SEQ ID NO: 352068 - RNA, 64 nt, Homo Sapiens; identical to SEQ ID NO: 157858

SEQ ID NO: 352069 - RNA, 64 nt, Homo Sapiens; identical to SEQ ID NO: 157859

SEQ ID NO: 352070 - RNA, 64 nt, Homo Sapiens; identical to SEQ ID NO: 157860

SEQ ID NO: 352071 - RNA, 64 nt, Homo Sapiens; identical to SEQ ID NO: 157861

SEQ ID NO: 352072 - RNA, 64 nt, Homo Sapiens; identical to SEQ ID NO: 157862

SEQ ID NO: 352073 - RNA, 64 nt, Homo Sapiens; identical to SEQ ID NO: 157863

SEQ ID NO: 352074 - RNA, 64 nt, Homo Sapiens; identical to SEQ ID NO: 157864

SEQ ID NO: 352075 - RNA, 64 nt, Homo Sapiens; identical to SEQ ID NO: 157865

SEQ ID NO: 352076 - RNA, 64 nt, Homo Sapiens; identical to SEQ ID NO: 157866

SEQ ID NO: 352077 - RNA, 64 nt, Homo Sapiens; identical to SEQ ID NO: 157867

SEQ ID NO: 352078 - RNA, 64 nt, Homo Sapiens; identical to SEQ ID NO: 157868

SEQ ID NO: 352079 - RNA, 64 nt, Homo Sapiens; identical to SEQ ID NO: 157869

SEQ ID NO: 352080 - RNA, 64 nt, Homo Sapiens; identical to SEQ ID NO: 157870

SEQ ID NO: 352081 - RNA, 64 nt, Homo Sapiens; identical to SEQ ID NO: 157871

SEQ ID NO: 352082 - RNA, 64 nt, Homo Sapiens; identical to SEQ ID NO: 157872

SEQ ID NO: 352083 - RNA, 64 nt, Homo Sapiens; identical to SEQ ID NO: 157873

SEQ ID NO: 352084 - RNA, 64 nt, Homo Sapiens; identical to SEQ ID NO: 157874

SEQ ID NO: 352085 - RNA, 64 nt, Homo Sapiens; identical to SEQ ID NO: 157875

SEQ ID NO: 352086 - RNA, 64 nt, Homo Sapiens; identical to SEQ ID NO: 157876

SEQ ID NO: 352087 - RNA, 64 nt, Homo Sapiens; identical to SEQ ID NO: 157877

SEQ ID NO: 352088 - RNA, 64 nt, Homo Sapiens; identical to SEQ ID NO: 157878

SEQ ID NO: 352089 - RNA, 64 nt, Homo Sapiens; identical to SEQ ID NO: 157879

SEQ ID NO: 352090 - RNA, 64 nt, Homo Sapiens; identical to SEQ ID NO: 157880

SEQ ID NO: 352091 - RNA, 64 nt, Homo Sapiens; identical to SEQ ID NO: 157881

SEQ ID NO: 352092 - RNA, 64 nt, Homo Sapiens; identical to SEQ ID NO: 157882

SEQ ID NO: 352093 - RNA, 64 nt, Homo Sapiens; identical to SEQ ID NO: 157883

SEQ ID NO: 352094 - RNA, 64 nt, Homo Sapiens; identical to SEQ ID NO: 157884

SEQ ID NO: 352095 - RNA, 64 nt, Homo Sapiens; identical to SEQ ID NO: 157885

SEQ ID NO: 352096 - RNA, 64 nt, Homo Sapiens; identical to SEQ ID NO: 157886

SEQ ID NO: 352097 - RNA, 64 nt, Homo Sapiens; identical to SEQ ID NO: 157887

SEQ ID NO: 352098 - RNA, 64 nt, Homo Sapiens; identical to SEQ ID NO: 157888

SEQ ID NO: 352099 - RNA, 64 nt, Homo Sapiens; identical to SEQ ID NO: 157889

SEQ ID NO: 352100 - RNA, 64 nt, Homo Sapiens
cuuggccuggcacagugguucuauuaagcuguuuaaagaucaccagagaguccaagcuggugaa

SEQ ID NO: 352101 - RNA, 64 nt, Homo Sapiens
ucagagugugcgaaauaauaaucucggaauggaaaaagaucauugucuguuaauuuaugacaug

SEQ ID NO: 352102 - RNA, 64 nt, Homo Sapiens
ccccaacuaaaggauauuaaaguuaggggaaagaaaagaucauugaaagucaugauaauuucug

SEQ ID NO: 352103 - RNA, 64 nt, Homo Sapiens
guaaauuauaguauauguaaguagcuaaugaaguaaagaucaugaagaaagaaauugauaggug

SEQ ID NO: 352104 - RNA, 64 nt, Homo Sapiens
agucaacacaagauggcaaaucaggaucaggugaaaagaucaagaaacgugugaaaacucccua

SEQ ID NO: 352105 - RNA, 64 nt, Homo Sapiens
uuuuauauguagaaaagugggguccuuuugaauaaaagaucauucaacuaaaaauauuaaaauu

SEQ ID NO: 352106 - RNA, 64 nt, Homo Sapiens
ucuccacuuuaaccucuucuaaaauacccaaccaaaagaucacuguuucucucaacacuauuua

SEQ ID NO: 352107 - RNA, 64 nt, Homo Sapiens
cuugaacauuguuauuuauauuuuuuaaaauggaaaagaucacuauguuuguugugcuaaccac

SEQ ID NO: 352108 - RNA, 64 nt, Homo Sapiens
gaaauggaaaauaaucuaacucgaaggcgccugaaaagaucaaauucuauaucccagauaccuu

SEQ ID NO: 352109 - RNA, 64 nt, Homo Sapiens
uauuggauuuguagguccugugccaccaaaacccaaagaucaaagguccaucaucaaaacacca

SEQ ID NO: 352110 - RNA, 64 nt, Homo Sapiens
agaaaaagauaaggaaagaagagagaagagagacaaagaucacuacagaccaaaacagaagaag

SEQ ID NO: 352111 - RNA, 64 nt, Homo Sapiens
gccuuuugagauucuccaacuugacaaaugugccaaagaucaacagacagaaaauaucauccug

SEQ ID NO: 352112 - RNA, 64 nt, Homo Sapiens
uugauauuauuccagguuuuuaaacugcucaucuaaagaucauguuuaaugguggaacaaaugu

SEQ ID NO: 352113 - RNA, 64 nt, Homo Sapiens
gcaggugagcauccacuuuggucuugagcucugcaaagaucagaaauucuuuuuaauugaagau

SEQ ID NO: 352114 - RNA, 64 nt, Homo Sapiens
gaccauguuauuccugaccagaaagauuaaucugaaagaucagauuaccauuaaauucacacau

SEQ ID NO: 352115 - RNA, 64 nt, Homo Sapiens
uauauauauauauuuguaaugucauuuguaauguaaagaucagugcaacacagucacugcugug

SEQ ID NO: 352116 - RNA, 64 nt, Homo Sapiens
uggacacauuauaucuccaacaagguguggguggaaagaucaaauuaaccugcuuuuuugaaag

SEQ ID NO: 352117 - RNA, 64 nt, Homo Sapiens
auuucuaggaacccccaaaaggagaauaguaaaaaaagaucauacuuaaaauuuguauuacaau

SEQ ID NO: 352118 - RNA, 64 nt, Homo Sapiens
agauuuuggaauucgugcaggaagccaugaaaggaaagaucagugaagacagcaaucacgguuc

SEQ ID NO: 352119 - RNA, 64 nt, Homo Sapiens
gccacuccagcgucaucggacucucucuuauuacaaagaucacugcccaggaccaucuucccga

SEQ ID NO: 352120 - RNA, 64 nt, Homo Sapiens
cuugaaagcgaaauacuugaaaagaggugaccauaaagaucacaccaauuuagaaugaauauua

SEQ ID NO: 352121 - RNA, 64 nt, Homo Sapiens
uacccuuuuccaaccuaccucacaagguuaucagaaagaucaaauuaaauaauagaugugaaaa

SEQ ID NO: 352122 - RNA, 64 nt, Homo Sapiens; identical to SEQ ID NO: 170678

SEQ ID NO: 352123 - RNA, 60 nt, Homo Sapiens; identical to SEQ ID NO: 170679

SEQ ID NO: 352124 - RNA, 64 nt, Homo Sapiens; identical to SEQ ID NO: 170680

SEQ ID NO: 352125 - RNA, 64 nt, Homo Sapiens; identical to SEQ ID NO: 170681

SEQ ID NO: 352126 - RNA, 64 nt, Homo Sapiens; identical to SEQ ID NO: 170682

SEQ ID NO: 352127 - RNA, 64 nt, Homo Sapiens; identical to SEQ ID NO: 170683

SEQ ID NO: 352128 - RNA, 64 nt, Homo Sapiens; identical to SEQ ID NO: 170684

SEQ ID NO: 352129 - RNA, 64 nt, Homo Sapiens; identical to SEQ ID NO: 170685

SEQ ID NO: 352130 - RNA, 64 nt, Homo Sapiens; identical to SEQ ID NO: 170686

SEQ ID NO: 352131 - RNA, 64 nt, Homo Sapiens; identical to SEQ ID NO: 170687

SEQ ID NO: 352132 - RNA, 64 nt, Homo Sapiens; identical to SEQ ID NO: 170688

SEQ ID NO: 352133 - RNA, 64 nt, Homo Sapiens; identical to SEQ ID NO: 170689

SEQ ID NO: 352134 - RNA, 64 nt, Homo Sapiens; identical to SEQ ID NO: 170690

SEQ ID NO: 352135 - RNA, 64 nt, Homo Sapiens; identical to SEQ ID NO: 170691

SEQ ID NO: 352136 - RNA, 64 nt, Homo Sapiens; identical to SEQ ID NO: 170692

SEQ ID NO: 352137 - RNA, 64 nt, Homo Sapiens; identical to SEQ ID NO: 170693

SEQ ID NO: 352138 - RNA, 64 nt, Homo Sapiens; identical to SEQ ID NO: 170694

SEQ ID NO: 352139 - RNA, 64 nt, Homo Sapiens; identical to SEQ ID NO: 170695

SEQ ID NO: 352140 - RNA, 64 nt, Homo Sapiens; identical to SEQ ID NO: 170696

SEQ ID NO: 352141 - RNA, 64 nt, Homo Sapiens; identical to SEQ ID NO: 170697

SEQ ID NO: 352142 - RNA, 64 nt, Homo Sapiens; identical to SEQ ID NO: 170698

SEQ ID NO: 352143 - RNA, 64 nt, Homo Sapiens; identical to SEQ ID NO: 170699

SEQ ID NO: 352144 - RNA, 64 nt, Homo Sapiens; identical to SEQ ID NO: 170700

SEQ ID NO: 352145 - RNA, 64 nt, Homo Sapiens; identical to SEQ ID NO: 170701

SEQ ID NO: 352146 - RNA, 64 nt, Homo Sapiens; identical to SEQ ID NO: 170702

SEQ ID NO: 352147 - RNA, 64 nt, Homo Sapiens; identical to SEQ ID NO: 170703

SEQ ID NO: 352148 - RNA, 64 nt, Homo Sapiens; identical to SEQ ID NO: 170704

SEQ ID NO: 352149 - RNA, 64 nt, Homo Sapiens; identical to SEQ ID NO: 170705

SEQ ID NO: 352150 - RNA, 64 nt, Homo Sapiens; identical to SEQ ID NO: 170706

SEQ ID NO: 352151 - RNA, 64 nt, Homo Sapiens; identical to SEQ ID NO: 170707

SEQ ID NO: 352152 - RNA, 64 nt, Homo Sapiens; identical to SEQ ID NO: 170708

SEQ ID NO: 352153 - RNA, 64 nt, Homo Sapiens; identical to SEQ ID NO: 170709

SEQ ID NO: 352154 - RNA, 64 nt, Homo Sapiens; identical to SEQ ID NO: 170710

SEQ ID NO: 352155 - RNA, 64 nt, Homo Sapiens; identical to SEQ ID NO: 170711

SEQ ID NO: 352156 - RNA, 64 nt, Homo Sapiens; identical to SEQ ID NO: 170712

SEQ ID NO: 352157 - RNA, 64 nt, Homo Sapiens; identical to SEQ ID NO: 170713

SEQ ID NO: 352158 - RNA, 64 nt, Homo Sapiens; identical to SEQ ID NO: 170714

SEQ ID NO: 352159 - RNA, 64 nt, Homo Sapiens; identical to SEQ ID NO: 170715

SEQ ID NO: 352160 - RNA, 50 nt, Homo Sapiens; identical to SEQ ID NO: 170716

SEQ ID NO: 352161 - RNA, 64 nt, Homo Sapiens; identical to SEQ ID NO: 170717

SEQ ID NO: 352162 - RNA, 64 nt, Homo Sapiens; identical to SEQ ID NO: 170718

SEQ ID NO: 352163 - RNA, 64 nt, Homo Sapiens; identical to SEQ ID NO: 170719

SEQ ID NO: 352164 - RNA, 64 nt, Homo Sapiens; identical to SEQ ID NO: 170720

SEQ ID NO: 352165 - RNA, 64 nt, Homo Sapiens; identical to SEQ ID NO: 170721

SEQ ID NO: 352166 - RNA, 64 nt, Homo Sapiens; identical to SEQ ID NO: 205245

SEQ ID NO: 352167 - RNA, 64 nt, Homo Sapiens; identical to SEQ ID NO: 205246

SEQ ID NO: 352168 - RNA, 64 nt, Homo Sapiens; identical to SEQ ID NO: 205247

SEQ ID NO: 352169 - RNA, 64 nt, Homo Sapiens; identical to SEQ ID NO: 205248

SEQ ID NO: 352170 - RNA, 64 nt, Homo Sapiens; identical to SEQ ID NO: 205249

SEQ ID NO: 352171 - RNA, 64 nt, Homo Sapiens; identical to SEQ ID NO: 205250

SEQ ID NO: 352172 - RNA, 64 nt, Homo Sapiens; identical to SEQ ID NO: 205251

SEQ ID NO: 352173 - RNA, 64 nt, Homo Sapiens; identical to SEQ ID NO: 205252

SEQ ID NO: 352174 - RNA, 64 nt, Homo Sapiens; identical to SEQ ID NO: 205253

SEQ ID NO: 352175 - RNA, 64 nt, Homo Sapiens; identical to SEQ ID NO: 205254

SEQ ID NO: 352176 - RNA, 64 nt, Homo Sapiens; identical to SEQ ID NO: 205255

SEQ ID NO: 352177 - RNA, 64 nt, Homo Sapiens
aacacuuggugcugggaaccucaggguauugcuugccacuaagccaugaaaccagagacaaaau

SEQ ID NO: 352178 - RNA, 64 nt, Homo Sapiens
uggucuagcuagaccugcacuguccaguacaguagccacuaaauacauguggcuaaacuuaaau

SEQ ID NO: 352179 - RNA, 64 nt, Homo Sapiens
aaaacaaaguauugcuaaguacuauaacauauuggccacuaaaauucauauugagauuaucuug

SEQ ID NO: 352180 - RNA, 64 nt, Homo Sapiens
ugaaaaaccuuuuguuuauuagcaccaauuucuugccacuaagcuauuuguuuuauuauacauc

SEQ ID NO: 352181 - RNA, 64 nt, Homo Sapiens
ggccacggccacagucaugguggccacggccacagccacuaaucaggaggccaggccacccugc

SEQ ID NO: 352182 - RNA, 64 nt, Homo Sapiens
gauggaccaguagacaacugguccacucagggcugccacuaaccuguagaacaccccugugcaa

SEQ ID NO: 352183 - RNA, 64 nt, Homo Sapiens
guguuuaugaagaacagugaguaccuagaacugugccacuaauuaaaggaaauccuaagaaggu

SEQ ID NO: 352184 - RNA, 64 nt, Homo Sapiens
ugagguguuugaggguguggacuggcauccagcagccacuaacaaacacacaacugguguguaa

SEQ ID NO: 352185 - RNA, 64 nt, Homo Sapiens
gcauaggaccuaaccagugaagcuagaggcuacagccacuaaacuugcuucaggccaacgauag

SEQ ID NO: 352186 - RNA, 64 nt, Homo Sapiens
cuuuccgugccuagaccuccgcggccugugaggagccacuaaacccacucugcugccccaccac

SEQ ID NO: 352187 - RNA, 64 nt, Homo Sapiens
uacauuguucuuauucuggccuggggcauccugugccacuaaacgcaaccucgcugagggcaga

SEQ ID NO: 352188 - RNA, 64 nt, Homo Sapiens
cauuguguaugauaacaaaaggaagauuccugcagccacuaauguucugacgguagcuuuugga

SEQ ID NO: 352189 - RNA, 64 nt, Homo Sapiens
agccauguaaccuugggaaauuaaauuugacuuagccacuaacuaaagucaggagaucagaauu

SEQ ID NO: 352190 - RNA, 64 nt, Homo Sapiens
ugcuucacuccuuuuuucucgggaggggucaggagccacuaagugguucccagaagggagaucu

SEQ ID NO: 352191 - RNA, 64 nt, Homo Sapiens
gauguuuugacagucuccuagugcuccugguagugccacuaagggaaaaccaaggugcgcauuc

SEQ ID NO: 352192 - RNA, 64 nt, Homo Sapiens
agauaggcuuagcaggaugggcgcaguggcucacgccacuaaucccaacauuuuaggaggccua

SEQ ID NO: 352193 - RNA, 64 nt, Homo Sapiens
agaacaauggcuggguggaucgcacguaaagcuugccacuaaaaaucaaagcagagguuaacag

SEQ ID NO: 352194 - RNA, 64 nt, Homo Sapiens
caguagugauaguuguaccgcaaugugacuuaaugccacuaaauugacacuuaaaaaugguuua

SEQ ID NO: 352195 - RNA, 64 nt, Homo Sapiens
gugucuucagauagcccuguccuggugguauuuagccacuaaccuuugccugguacaguauggg

SEQ ID NO: 352196 - RNA, 64 nt, Homo Sapiens
aacaugcucucuuuucaccccccaccuccugagagccacuaauguaagauacagaaacauagcu

SEQ ID NO: 352197 - RNA, 64 nt, Homo Sapiens
uuccuugaaauuucucagcgggagucuccucacugccacuaaaauccacccagcccacuaacug

SEQ ID NO: 352198 - RNA, 64 nt, Homo Sapiens
auagucacacauuuacaaauuuuucaagagguuagccacuaagacuuuaauaauuuuacaaggg

SEQ ID NO: 352199 - RNA, 64 nt, Homo Sapiens
cuucccuaagucacauaucagaauaggaagauaugccacuaacuucuaaagaaguucaaacccu

SEQ ID NO: 352200 - RNA, 64 nt, Homo Sapiens
aggcauuggccuugaaaaccuggacagcccagcagccacuaaggcucagauuguuaaagcucuc

SEQ ID NO: 352201 - RNA, 64 nt, Homo Sapiens
cgcaaguaagagcuaauucauucauuccaugugugccacuaaauaaagagauugagcaagugcc

SEQ ID NO: 352202 - RNA, 64 nt, Homo Sapiens
agcuuuuuggauaaaauugacuuguggcucagcugccacuaaagccuggucuaguuuccugggc

SEQ ID NO: 352203 - RNA, 64 nt, Homo Sapiens
aaaauaauuuaugcaaugaauuggcuuaugaaaugccacuaauuauagauguuaaaaaugcagu

SEQ ID NO: 352204 - RNA, 64 nt, Homo Sapiens
aaaaggauaaaugaaugaugcuucuaggaucuaagccacuaaauugauuuuauagggaaucuau

SEQ ID NO: 352205 - RNA, 64 nt, Homo Sapiens
uguguaaaauggacugaaauagugcuguuacuuggccacuaagaaaaugcacaaagaagaaggc

SEQ ID NO: 352206 - RNA, 64 nt, Homo Sapiens
aacgugcuugaaucuaauaaagucauuacugccugccacuaagacuuuuguuuguuuccaauug

SEQ ID NO: 352207 - RNA, 64 nt, Homo Sapiens
uguacccauaaaaaugguuauuuugaauguuaaugccacuaaaugcgaugaugguugcucaaca

SEQ ID NO: 352208 - RNA, 64 nt, Homo Sapiens
gucucacagaggccuggguucaagucccaccucugccacuaacuggcaugugacccuaucuauc

SEQ ID NO: 352209 - RNA, 64 nt, Homo Sapiens
cauauuacauuucucauaguauggacaacuuuuugccacuaacugaauucuccaaauacucaca

SEQ ID NO: 352210 - RNA, 64 nt, Homo Sapiens
cuuauuguugggaaagaacacuaguccuaccucugccacuaaugagguguuuggaggagguacc

SEQ ID NO: 352211 - RNA, 64 nt, Homo Sapiens
ccccgaccccccgcaucugcggggggcccuugaugccacuaaucccagccugcugcagccuccu

SEQ ID NO: 352212 - RNA, 64 nt, Homo Sapiens
gcuacauaauuacuuucaauugcaguccauguuggccacuaacuuuuauucaggaccuaguauc

SEQ ID NO: 352213 - RNA, 64 nt, Homo Sapiens
auaugaaaaaagucguaucuagagaaugcaaauggccacuaagugaaaagaaaaaucacagaag

SEQ ID NO: 352214 - RNA, 64 nt, Homo Sapiens
cacaguaauuuguuauagcauguguuggucguaagccacuaaauaaacuuuaugaugauaaauu

SEQ ID NO: 352215 - RNA, 64 nt, Homo Sapiens
ucuuauccgaggggucugugguuguaucagaagagccacuaaaccaaucccccuuuccaaaauu

SEQ ID NO: 352216 - RNA, 64 nt, Homo Sapiens
ugacaggccacgcuggucucagaugcccagugaagccacuaacaugagugaggggagggcugug

SEQ ID NO: 352217 - RNA, 64 nt, Homo Sapiens
cuuuuuuacuucuccugaaggaaauauguuaguugccacuaagucaugauaaaauugaucagug

SEQ ID NO: 352218 - RNA, 64 nt, Homo Sapiens
uccaaagauucccuccaauuccccaagauuagaugccacuaaucuagauuuugggugucugagg

SEQ ID NO: 352219 - RNA, 64 nt, Homo Sapiens
uagcauguuauccacuguggaagccuucuuccaggccacuaagguagaucguuuccugacagag

SEQ ID NO: 352220 - RNA, 64 nt, Homo Sapiens
gauuauaauuaagcuguccuuugucuguaauacugccacuaaguuguggcauacguuauuggcu

SEQ ID NO: 352221 - RNA, 64 nt, Homo Sapiens
aaaacaaaugaugggagaguuacuugguuguggugccacuaaacacucagagaaucucauuuug

SEQ ID NO: 352222 - RNA, 64 nt, Homo Sapiens
auuaaaauccaucugcuuaucugaacuucccaacgccacuaauuaauucaauaaauggaauuga

SEQ ID NO: 352223 - RNA, 64 nt, Homo Sapiens
uaaaagagucugcucuaucaaugcaaucagacaggccacuaaggcccuccccccauuuacaugc

SEQ ID NO: 352224 - RNA, 64 nt, Homo Sapiens
aagcagcccuguaggcuucaaagaaucaguguaagccacuaaaaggaacugaaaaccuaggugu

SEQ ID NO: 352225 - RNA, 64 nt, Homo Sapiens
cauuuguggguuuuuauuuccuaugauguauacugccacuaaccuuccaaaaauuacuuaguau

SEQ ID NO: 352226 - RNA, 64 nt, Homo Sapiens
aauagaacccuuaucacuagaagaaccauuuucugccacuaaauaucucugauguuuccaugag

SEQ ID NO: 352227 - RNA, 64 nt, Homo Sapiens
uuuauuugguuuuugguugucaucgauuuacauugccacuaauaaaccauauugagaauuucua

SEQ ID NO: 352228 - RNA, 64 nt, Homo Sapiens
cuaauuuaaaggagaguuacuuuguuguaugugugccacuaaaauaggggcugcccuugcccug

SEQ ID NO: 352229 - RNA, 64 nt, Homo Sapiens
uauuagugaaucaugcuuauuuuuuacucuuaaugccacuaauauacaucccuaauaucacagg

SEQ ID NO: 352230 - RNA, 64 nt, Homo Sapiens
acuuuggaaaucucuuuguauuuuuacuugaagugccacuaauggacagcagauauuuucuggc

SEQ ID NO: 352231 - RNA, 64 nt, Homo Sapiens
agaggaggggccgcugccacggcccucuggaguggccacuaagcuacaccuguagcccuggaga

SEQ ID NO: 352232 - RNA, 64 nt, Homo Sapiens
guaaauaugauuuagggguuuuaugagauucucugccacuaacaguguuuuguucuuuagacau

SEQ ID NO: 352233 - RNA, 64 nt, Homo Sapiens
cagccucaggagaauaaaugcuugucacaaaagugccacuaaaaaaagcauuaggagggucauu

SEQ ID NO: 352234 - RNA, 64 nt, Homo Sapiens
cguggguggggggauagacacagccuaggcuguggccacuaagagggcugcuucugugaguucu

SEQ ID NO: 352235 - RNA, 64 nt, Homo Sapiens
gagcaggguugagaaucgggaaaacuagaccccugccacuaacaggcuaggagacuuugggcag

SEQ ID NO: 352236 - RNA, 64 nt, Homo Sapiens
uguuacaugggaauaaggaauuucauucacuucagccacuaagaaaaguuuagaaucacgaaag

SEQ ID NO: 352237 - RNA, 64 nt, Homo Sapiens
acauguggcuguuaagcccuuguccagugugguagccacuaaccgauauuuuguagacuuuugc

SEQ ID NO: 352238 - RNA, 64 nt, Homo Sapiens
cccaccagcugagguccgagccgcaguuuggccagccacuaaguucucuuuuuagacacaacag

SEQ ID NO: 352239 - RNA, 64 nt, Homo Sapiens
uugguaaguuugggagaguugucuggaugcuggugccacuaauagaaggaguuaguagaaaaca

SEQ ID NO: 352240 - RNA, 64 nt, Homo Sapiens
cugaacuuuuacccugcuuuguggugccacguuagccacuaaauuuauuugcacaccuguaugu

SEQ ID NO: 352241 - RNA, 64 nt, Homo Sapiens
gagaacuuuaauaauucuacaacaggagaugcaagccacuaacauuuaauauggaaauguuugg

SEQ ID NO: 352242 - RNA, 64 nt, Homo Sapiens
ggacuaauauguaucuuucuaagaccaauguuuggccacuaacuauagaggucuuuggacucua

SEQ ID NO: 352243 - RNA, 64 nt, Homo Sapiens
guugaguuuugacugcuuggcaggucaaaauagugccacuaacgcaaagagaagcaaaaucuac

SEQ ID NO: 352244 - RNA, 64 nt, Homo Sapiens
cuacguuucauauauuauauggugcuuuguauaugccacuaauaaaaugaaucuaaacauugaa

SEQ ID NO: 352245 - RNA, 64 nt, Homo Sapiens
gccaaggacucauuacuugucuuauauuuuuacugccacuaaacugccuguauuucuguauguc

SEQ ID NO: 352246 - RNA, 64 nt, Homo Sapiens
cacaaaaagggggauugggcccaacagcaacacagccacuaaaagaggaggugacaaaccauuu

SEQ ID NO: 352247 - RNA, 64 nt, Homo Sapiens
ggaaccaaggcuacuuggaagucuaauauaguuugccacuaaaaccuagcacucagaucuucgu

SEQ ID NO: 352248 - RNA, 64 nt, Homo Sapiens
gaaggcagagaggucccuaguugauggggaacuugccacuaagaggcccaaauucucaagguug

SEQ ID NO: 352249 - RNA, 64 nt, Homo Sapiens
auaaugacugaaaaaaauuaaauauuuuggucuagccacuaaacauuuaacaauggauuagaaa

SEQ ID NO: 352250 - RNA, 64 nt, Homo Sapiens
ccgccccgcuggccgccagcgaggaccagggccugccacuaagcuuagcccugagcgccagcgc

SEQ ID NO: 352251 - RNA, 64 nt, Homo Sapiens
cugguucugcccuuggaagccauuuccugcucaugccacuaacagcaugcugccaaacuguuca

SEQ ID NO: 352252 - RNA, 64 nt, Homo Sapiens
acaaaccaaacuuuuagccugaaaccaacuuuaugccacuaagucauagccucaguugucccag

SEQ ID NO: 352253 - RNA, 64 nt, Homo Sapiens
auaaugaauauuuuauacugcauccuuuacauuagccacuaaauacguuauugcuugaugaaga

SEQ ID NO: 352254 - RNA, 64 nt, Homo Sapiens
agacaagggcuguuacucauuuccccuuaccuuagccacuaagaaacacaaugacaaugacauc

SEQ ID NO: 352255 - RNA, 64 nt, Homo Sapiens
acauuuucaaaggaaaaauaaaguaguccuguuugccacuaaaaaaaaaugaaguaaggaaaac

SEQ ID NO: 352256 - RNA, 64 nt, Homo Sapiens
gauuauuuaauuccagauugcccuccccguagcagccacuaaaaaagagcaucccuucagcuuc

SEQ ID NO: 352257 - RNA, 64 nt, Homo Sapiens
acagcugacgguuucuccccggggcuuggggauugccacuaagucagauuugaggacugaagcu

SEQ ID NO: 352258 - RNA, 64 nt, Homo Sapiens
uaaaaaaaaauuaaaaguuaucaucuaaaagcuggccacuaaauagaugaggugaagaucacug

SEQ ID NO: 352259 - RNA, 64 nt, Homo Sapiens
uuaguuuugcacauauuuuccggaagauucuggagccacuaacaugcugcaacugaccagcugc

SEQ ID NO: 352260 - RNA, 64 nt, Homo Sapiens
uacuuucugucucuauggauccuagcccuagacagccacuaaugucgcuauuuuuccccucugc

SEQ ID NO: 352261 - RNA, 64 nt, Homo Sapiens
uauugagcuagaagaugcuguugugacugucauugccacuaaauauugcuguuuuugacagcau

SEQ ID NO: 352262 - RNA, 64 nt, Homo Sapiens
cauucacacuaagguguaaaucaggaaagaaacugccacuaauuuguucuuucaaauccuguuc

SEQ ID NO: 352263 - RNA, 64 nt, Homo Sapiens
guguauccagaagaagagaugcaagauauugauggccacuaaguacucuggguaccaaauuuaa

SEQ ID NO: 352264 - RNA, 64 nt, Homo Sapiens
acaaaagcucugaaguucuuauuuaccuucauaugccacuaagaccgaagaagaaaacauuuga

SEQ ID NO: 352265 - RNA, 64 nt, Homo Sapiens
gaguuucuggcuccccuccuguuguggaaacuaagccacuaauuaccucuuuguagcacguagu

SEQ ID NO: 352266 - RNA, 64 nt, Homo Sapiens
aaacucuugguuuuguuuuuuuggaaaugagugggccacuaagccacacuuucccuucauccug

SEQ ID NO: 352267 - RNA, 64 nt, Homo Sapiens
agagaacagcccauaaugcuccccgggagcagaggccacuaauggagagugggaagagccugga

SEQ ID NO: 352268 - RNA, 64 nt, Homo Sapiens
cacaaagcaguggggcaugagcuguguuucaggggccacuaaauaacagcugguacugacccca

SEQ ID NO: 352269 - RNA, 64 nt, Homo Sapiens
ggggagauggggcuguuaagagcaaaaucugagugccacuaaauggaagaagguaguccucuaa

SEQ ID NO: 352270 - RNA, 64 nt, Homo Sapiens
acugcaaauggucacccugagaugcuacuaauuugccacuaaauaaugaauugaaauuuuucau

SEQ ID NO: 352271 - RNA, 64 nt, Homo Sapiens
acaagcaagcuggcugcaagacuccaagccacaugccacuaaccuuauucccuuucuuaaagau

SEQ ID NO: 352272 - RNA, 64 nt, Homo Sapiens
auugaucacucguuuaaggauggucuagagucuugccacuaaaucaucaggcaauuuccagggu

SEQ ID NO: 352273 - RNA, 64 nt, Homo Sapiens
gaggagaugguggagacggaaggagagaagcaaggccacuaaaaucauuccuguuuuucuuggc

SEQ ID NO: 352274 - RNA, 64 nt, Homo Sapiens
aaagcauuaaguguguccaguaggcaagaaaaaugccacuaauccauggaauguuuuuaauaag

SEQ ID NO: 352275 - RNA, 64 nt, Homo Sapiens
uuuguuuuguuuguuguuuguuguuuguuuuuuugccacuaauuuuaguauucauucugcauug

SEQ ID NO: 352276 - RNA, 64 nt, Homo Sapiens
uguaaagcuuuggacauacacuuagcugcugugagccacuaauaacauugggcuaauaucugcu

SEQ ID NO: 352277 - RNA, 64 nt, Homo Sapiens
gagaucuuccccuaaccuuugggccaauuuacuggccacuaauuucguuuaaauaccauugugu

SEQ ID NO: 352278 - RNA, 64 nt, Homo Sapiens
guuaauuaucugauacuuuuucuucagucaucuagccacuaaauuuuuuugcaggaagguuugc

SEQ ID NO: 352279 - RNA, 64 nt, Homo Sapiens
guaugugcucuccuucagccggaggggugccgcagccacuaacggcugcaucagacccugguag

SEQ ID NO: 352280 - RNA, 64 nt, Homo Sapiens
ggucuuuucaguauuuacuguguaauacuuaagugccacuaaacauagcaaauugugcugcaca

SEQ ID NO: 352281 - RNA, 64 nt, Homo Sapiens
gcugucucauuccuaacauguaauucaugauuuagccacuaaauuucuaaggagaucauaagaa

SEQ ID NO: 352282 - RNA, 64 nt, Homo Sapiens
cuggucauuaagucaucugacauuaaaucauuuagccacuaaguuauuugucuacucucacuuu

SEQ ID NO: 352283 - RNA, 64 nt, Homo Sapiens
uugccugguacaguauggggugguauuuucaauagccacuaaccuuuagauagcccuguccugg

SEQ ID NO: 352284 - RNA, 64 nt, Homo Sapiens
accccucugcuuuuaacucuuuuguuuuuuuucagccacuaagaagucccaaaugucaucaggu

SEQ ID NO: 352285 - RNA, 64 nt, Homo Sapiens
ucaguguuauaaaaucuguaaggagaaaaaaaaagccacuaaggacuaugguauauauuuugaa

SEQ ID NO: 352286 - RNA, 64 nt, Homo Sapiens
uacgacuuuauuaacagguuacugugaagauuuugccacuaacucuagauuuuaccuuuuugua

SEQ ID NO: 352287 - RNA, 64 nt, Homo Sapiens
uuccauuccacuauuucccauaaugcuucugagagccacuaacuugauugauaaagauccugcc

SEQ ID NO: 352288 - RNA, 64 nt, Homo Sapiens
ggcaguucaccggguccugcaggaccaggugccagccacuaagggggggcaccgccgaugccag

SEQ ID NO: 352289 - RNA, 64 nt, Homo Sapiens
auuaaccaucuaccucuguuaccugaguaacuuggccacuaauaguaccaagaaaaaauuaguc

SEQ ID NO: 352290 - RNA, 64 nt, Homo Sapiens
uggcugucuguuucauuggagaaucaaaucaaaagccacuaacagaacuguguguaugucagug

SEQ ID NO: 352291 - RNA, 64 nt, Homo Sapiens
auucuaaauacuuuucaaugugugagagaggcucgccacuaaguguaaggacaugcuuaugaaa

SEQ ID NO: 352292 - RNA, 64 nt, Homo Sapiens
aacuaguuaccuuuggacuguccaaguggacauagccacuaacccugcccuccuguagcaugug

SEQ ID NO: 352293 - RNA, 64 nt, Homo Sapiens
agugggggcacagggagggaacucuugacacugagccacuaaaauauggacuaauuuuuuggac

SEQ ID NO: 352294 - RNA, 64 nt, Homo Sapiens
guauucaaugacauuaucaucauuuuuagaacgagccacuaaccuauuagagaagaggcagaua

SEQ ID NO: 352295 - RNA, 64 nt, Homo Sapiens
ccaggagguggagguugcagugagccgucaucgcgccacuaagccaagaucgcgccacugcacu

SEQ ID NO: 352296 - RNA, 64 nt, Homo Sapiens
aggucaaggaaggaaaauacuaccuguccccuaugccacuaagccaacgugugugucagcuggu

SEQ ID NO: 352297 - RNA, 64 nt, Homo Sapiens
ugccuccugcaccccacccccaccaaccaggggagccacuaagcugacuaacaacuguccccuc

SEQ ID NO: 352298 - RNA, 64 nt, Homo Sapiens
cuucagacucaaguacccauccccuguggcccuggccacuaaagggccugacacccccuccccg

SEQ ID NO: 352299 - RNA, 64 nt, Homo Sapiens
ugcuguguaaccuugaacuacuaguccuggcucugccacuaacuggcaacuguagaugugguuu

SEQ ID NO: 352300 - RNA, 64 nt, Homo Sapiens
acccgucuccugauuuucagcaugguagacugaggccacuaaacgaggucacagucacgaagcu

SEQ ID NO: 352301 - RNA, 64 nt, Homo Sapiens
cauaguacguggaugucagucuugugcgaugauggccacuaaaguucaguaugaaaccaguuuc

SEQ ID NO: 352302 - RNA, 64 nt, Homo Sapiens
aaauacuauugugaauucaaugaaguguucuuaugccacuaacuuuaaccuauucccuuacuca

SEQ ID NO: 352303 - RNA, 64 nt, Homo Sapiens
ccagugucuugucagcucuggguguuuguucccugccacuaaguggcucagucacaccuuugcu

SEQ ID NO: 352304 - RNA, 64 nt, Homo Sapiens
ugugagcuuccccaggucagcuugucauccuuacgccacuaaccgaccugauuucuuugaccgg

SEQ ID NO: 352305 - RNA, 64 nt, Homo Sapiens
aucuaugauacgaauauaccuucuguuuuuauuggccacuaauaaguuguucugcauaucauug

SEQ ID NO: 352306 - RNA, 64 nt, Homo Sapiens
aaacagagcagaccugaaggcuaaucuuauuuuugccacuaacuuagugaaugacccuaagcaa

SEQ ID NO: 352307 - RNA, 64 nt, Homo Sapiens
ggggaccugagggcuguccucgcugcugagaagagccacuaacucgugaccuccagccugcccc

SEQ ID NO: 352308 - RNA, 64 nt, Homo Sapiens
caggugccccugggcucagguaguuaguuguucagccacuaaugccuuuuaucccccauauggg

SEQ ID NO: 352309 - RNA, 64 nt, Homo Sapiens
agaggaccuuggguucccaauagacaagcguugagccacuaagcagcguugagccuuggaaagg

SEQ ID NO: 352310 - RNA, 64 nt, Homo Sapiens
agaaagucuaagaguucagaacuuuucaaagugagccacuaaacuacgugauucccucccuuuc

SEQ ID NO: 352311 - RNA, 64 nt, Homo Sapiens
uacaccuaacucaccuaacucauacugugcuggagccacuaacuagagcagcccuggagucaug

SEQ ID NO: 352312 - RNA, 64 nt, Homo Sapiens
aauuguuugaauauuaucccauugaauacccagagccacuaaaucuuuuuuuacuagaaaauaa

SEQ ID NO: 352313 - RNA, 64 nt, Homo Sapiens
ugugaacaacaagaaaucauuggcaucaccugaugccacuaauuuucuccucuacugaacccac

SEQ ID NO: 352314 - RNA, 64 nt, Homo Sapiens
uuguuuuaccuaguucuuucucagggugggcagagccacuaaaccgguguaaguggcucugucc

SEQ ID NO: 352315 - RNA, 64 nt, Homo Sapiens; identical to SEQ ID NO: 107011

SEQ ID NO: 352316 - RNA, 64 nt, Homo Sapiens; identical to SEQ ID NO: 107012

SEQ ID NO: 352317 - RNA, 64 nt, Homo Sapiens; identical to SEQ ID NO: 107013

SEQ ID NO: 352318 - RNA, 64 nt, Homo Sapiens; identical to SEQ ID NO: 107014

SEQ ID NO: 352319 - RNA, 64 nt, Homo Sapiens; identical to SEQ ID NO: 107015

SEQ ID NO: 352320 - RNA, 64 nt, Homo Sapiens; identical to SEQ ID NO: 107016

SEQ ID NO: 352321 - RNA, 64 nt, Homo Sapiens; identical to SEQ ID NO: 107017

SEQ ID NO: 352322 - RNA, 64 nt, Homo Sapiens; identical to SEQ ID NO: 107018

SEQ ID NO: 352323 - RNA, 64 nt, Homo Sapiens; identical to SEQ ID NO: 107019

SEQ ID NO: 352324 - RNA, 64 nt, Homo Sapiens; identical to SEQ ID NO: 107020

SEQ ID NO: 352325 - RNA, 64 nt, Homo Sapiens; identical to SEQ ID NO: 107021

SEQ ID NO: 352326 - RNA, 64 nt, Homo Sapiens; identical to SEQ ID NO: 107022

SEQ ID NO: 352327 - RNA, 64 nt, Homo Sapiens; identical to SEQ ID NO: 107023

SEQ ID NO: 352328 - RNA, 64 nt, Homo Sapiens; identical to SEQ ID NO: 107024

SEQ ID NO: 352329 - RNA, 64 nt, Homo Sapiens; identical to SEQ ID NO: 107025

SEQ ID NO: 352330 - RNA, 64 nt, Homo Sapiens; identical to SEQ ID NO: 107026

SEQ ID NO: 352331 - RNA, 64 nt, Homo Sapiens; identical to SEQ ID NO: 107027

SEQ ID NO: 352332 - RNA, 64 nt, Homo Sapiens; identical to SEQ ID NO: 107028

SEQ ID NO: 352333 - RNA, 64 nt, Homo Sapiens; identical to SEQ ID NO: 107029

SEQ ID NO: 352334 - RNA, 64 nt, Homo Sapiens; identical to SEQ ID NO: 107030

SEQ ID NO: 352335 - RNA, 64 nt, Homo Sapiens; identical to SEQ ID NO: 107031

SEQ ID NO: 352336 - RNA, 64 nt, Homo Sapiens; identical to SEQ ID NO: 107032

SEQ ID NO: 352337 - RNA, 64 nt, Homo Sapiens
ccuauuuugccagugggaacuccuaaaucaaguuggcuucuaaucaaagcuuuuaaacccuauu

SEQ ID NO: 352338 - RNA, 64 nt, Homo Sapiens
uguguuucugaucugaugcaagcaagaaacacugggcuucuagaaccaggcaacuugggaacua

SEQ ID NO: 352339 - RNA, 64 nt, Homo Sapiens; identical to SEQ ID NO: 307734

SEQ ID NO: 352340 - RNA, 64 nt, Homo Sapiens; identical to SEQ ID NO: 307735

SEQ ID NO: 352341 - RNA, 64 nt, Homo Sapiens; identical to SEQ ID NO: 307736

SEQ ID NO: 352342 - RNA, 64 nt, Homo Sapiens; identical to SEQ ID NO: 307737

SEQ ID NO: 352343 - RNA, 64 nt, Homo Sapiens; identical to SEQ ID NO: 307738

SEQ ID NO: 352344 - RNA, 64 nt, Homo Sapiens; identical to SEQ ID NO: 307739

SEQ ID NO: 352345 - RNA, 64 nt, Homo Sapiens; identical to SEQ ID NO: 307740

SEQ ID NO: 352346 - RNA, 64 nt, Homo Sapiens; identical to SEQ ID NO: 307741

SEQ ID NO: 352347 - RNA, 59 nt, Homo Sapiens; identical to SEQ ID NO: 307742

SEQ ID NO: 352348 - RNA, 64 nt, Homo Sapiens; identical to SEQ ID NO: 307743

SEQ ID NO: 352349 - RNA, 64 nt, Homo Sapiens; identical to SEQ ID NO: 307744

SEQ ID NO: 352350 - RNA, 64 nt, Homo Sapiens; identical to SEQ ID NO: 307745

SEQ ID NO: 352351 - RNA, 64 nt, Homo Sapiens; identical to SEQ ID NO: 307746

SEQ ID NO: 352352 - RNA, 64 nt, Homo Sapiens; identical to SEQ ID NO: 307747

SEQ ID NO: 352353 - RNA, 64 nt, Homo Sapiens; identical to SEQ ID NO: 307748

SEQ ID NO: 352354 - RNA, 64 nt, Homo Sapiens; identical to SEQ ID NO: 307749

SEQ ID NO: 352355 - RNA, 64 nt, Homo Sapiens; identical to SEQ ID NO: 307750

SEQ ID NO: 352356 - RNA, 64 nt, Homo Sapiens; identical to SEQ ID NO: 307751

SEQ ID NO: 352357 - RNA, 64 nt, Homo Sapiens; identical to SEQ ID NO: 307752

SEQ ID NO: 352358 - RNA, 64 nt, Homo Sapiens; identical to SEQ ID NO: 307753

SEQ ID NO: 352359 - RNA, 64 nt, Homo Sapiens; identical to SEQ ID NO: 307754

SEQ ID NO: 352360 - RNA, 64 nt, Homo Sapiens; identical to SEQ ID NO: 307755

SEQ ID NO: 352361 - RNA, 64 nt, Homo Sapiens; identical to SEQ ID NO: 307756

SEQ ID NO: 352362 - RNA, 64 nt, Homo Sapiens; identical to SEQ ID NO: 307757

SEQ ID NO: 352363 - RNA, 64 nt, Homo Sapiens; identical to SEQ ID NO: 307758

SEQ ID NO: 352364 - RNA, 64 nt, Homo Sapiens; identical to SEQ ID NO: 307759

SEQ ID NO: 352365 - RNA, 64 nt, Homo Sapiens; identical to SEQ ID NO: 307760

SEQ ID NO: 352366 - RNA, 64 nt, Homo Sapiens; identical to SEQ ID NO: 307761

SEQ ID NO: 352367 - RNA, 64 nt, Homo Sapiens; identical to SEQ ID NO: 307762

SEQ ID NO: 352368 - RNA, 64 nt, Homo Sapiens; identical to SEQ ID NO: 307763

SEQ ID NO: 352369 - RNA, 64 nt, Homo Sapiens; identical to SEQ ID NO: 307764

SEQ ID NO: 352370 - RNA, 64 nt, Homo Sapiens; identical to SEQ ID NO: 307765

SEQ ID NO: 352371 - RNA, 64 nt, Homo Sapiens; identical to SEQ ID NO: 307766

SEQ ID NO: 352372 - RNA, 64 nt, Homo Sapiens; identical to SEQ ID NO: 307767

SEQ ID NO: 352373 - RNA, 64 nt, Homo Sapiens; identical to SEQ ID NO: 307768

SEQ ID NO: 352374 - RNA, 64 nt, Homo Sapiens; identical to SEQ ID NO: 307769

SEQ ID NO: 352375 - RNA, 64 nt, Homo Sapiens; identical to SEQ ID NO: 307770

SEQ ID NO: 352376 - RNA, 64 nt, Homo Sapiens; identical to SEQ ID NO: 307771

SEQ ID NO: 352377 - RNA, 64 nt, Homo Sapiens; identical to SEQ ID NO: 307772

SEQ ID NO: 352378 - RNA, 64 nt, Homo Sapiens; identical to SEQ ID NO: 307773

SEQ ID NO: 352379 - RNA, 64 nt, Homo Sapiens; identical to SEQ ID NO: 307774

SEQ ID NO: 352380 - RNA, 64 nt, Homo Sapiens; identical to SEQ ID NO: 307775

SEQ ID NO: 352381 - RNA, 64 nt, Homo Sapiens; identical to SEQ ID NO: 307776

SEQ ID NO: 352382 - RNA, 64 nt, Homo Sapiens; identical to SEQ ID NO: 307777

SEQ ID NO: 352383 - RNA, 64 nt, Homo Sapiens; identical to SEQ ID NO: 307778

SEQ ID NO: 352384 - RNA, 64 nt, Homo Sapiens; identical to SEQ ID NO: 307779

SEQ ID NO: 352385 - RNA, 64 nt, Homo Sapiens; identical to SEQ ID NO: 307780

SEQ ID NO: 352386 - RNA, 64 nt, Homo Sapiens; identical to SEQ ID NO: 307781

SEQ ID NO: 352387 - RNA, 64 nt, Homo Sapiens; identical to SEQ ID NO: 307782

SEQ ID NO: 352388 - RNA, 64 nt, Homo Sapiens; identical to SEQ ID NO: 307783

SEQ ID NO: 352389 - RNA, 64 nt, Homo Sapiens; identical to SEQ ID NO: 307784

SEQ ID NO: 352390 - RNA, 64 nt, Homo Sapiens; identical to SEQ ID NO: 307785

SEQ ID NO: 352391 - RNA, 64 nt, Homo Sapiens; identical to SEQ ID NO: 307786

SEQ ID NO: 352392 - RNA, 64 nt, Homo Sapiens; identical to SEQ ID NO: 307787

SEQ ID NO: 352393 - RNA, 64 nt, Homo Sapiens; identical to SEQ ID NO: 307788

SEQ ID NO: 352394 - RNA, 64 nt, Homo Sapiens; identical to SEQ ID NO: 307789

SEQ ID NO: 352395 - RNA, 64 nt, Homo Sapiens; identical to SEQ ID NO: 307790

SEQ ID NO: 352396 - RNA, 64 nt, Homo Sapiens; identical to SEQ ID NO: 307791

SEQ ID NO: 352397 - RNA, 64 nt, Homo Sapiens; identical to SEQ ID NO: 307792

SEQ ID NO: 352398 - RNA, 64 nt, Homo Sapiens; identical to SEQ ID NO: 307793

SEQ ID NO: 352399 - RNA, 64 nt, Homo Sapiens; identical to SEQ ID NO: 307794

SEQ ID NO: 352400 - RNA, 64 nt, Homo Sapiens; identical to SEQ ID NO: 307795

SEQ ID NO: 352401 - RNA, 64 nt, Homo Sapiens; identical to SEQ ID NO: 307796

SEQ ID NO: 352402 - RNA, 62 nt, Homo Sapiens; identical to SEQ ID NO: 307797

SEQ ID NO: 352403 - RNA, 64 nt, Homo Sapiens; identical to SEQ ID NO: 307798

SEQ ID NO: 352404 - RNA, 64 nt, Homo Sapiens; identical to SEQ ID NO: 307799

SEQ ID NO: 352405 - RNA, 64 nt, Homo Sapiens; identical to SEQ ID NO: 307800

SEQ ID NO: 352406 - RNA, 64 nt, Homo Sapiens; identical to SEQ ID NO: 307801

SEQ ID NO: 352407 - RNA, 64 nt, Homo Sapiens; identical to SEQ ID NO: 307802

SEQ ID NO: 352408 - RNA, 64 nt, Homo Sapiens; identical to SEQ ID NO: 307803

SEQ ID NO: 352409 - RNA, 64 nt, Homo Sapiens; identical to SEQ ID NO: 307804

SEQ ID NO: 352410 - RNA, 64 nt, Homo Sapiens; identical to SEQ ID NO: 307805

SEQ ID NO: 352411 - RNA, 64 nt, Homo Sapiens; identical to SEQ ID NO: 307806

SEQ ID NO: 352412 - RNA, 64 nt, Homo Sapiens; identical to SEQ ID NO: 307807

SEQ ID NO: 352413 - RNA, 64 nt, Homo Sapiens; identical to SEQ ID NO: 307808

SEQ ID NO: 352414 - RNA, 64 nt, Homo Sapiens; identical to SEQ ID NO: 307809

SEQ ID NO: 352415 - RNA, 64 nt, Homo Sapiens
acaguuguagcagcagcagacgaagccauugcagaggcagaauaugcugagugucuggagucag

SEQ ID NO: 352416 - RNA, 64 nt, Homo Sapiens
cccacccuugagaauguggagaacucccauggagaggcagaauggcaggagguuucaugucccg

SEQ ID NO: 352417 - RNA, 64 nt, Homo Sapiens
agcgucccccgugaaagccacucauacacgccugaggcagaagcgagcacgucugcagggcccu

SEQ ID NO: 352418 - RNA, 64 nt, Homo Sapiens
guaugaucccagggagggugcggcucuucacagcaggcagaagccaguggggggccuguggccc

SEQ ID NO: 352419 - RNA, 64 nt, Homo Sapiens
agaaaauaguucuucaggaguacagagucaaaguaggcagaauauauuuugcuuuugggaauuu

SEQ ID NO: 352420 - RNA, 64 nt, Homo Sapiens
cagaacaccuacauuuuugucagcauuauaagaaaggcagaaugcuucuaaagaaaauauguuu

SEQ ID NO: 352421 - RNA, 64 nt, Homo Sapiens
aaaacccuuuuugucaauaagcugauguaagaacaggcagaaggcucccauuuuucugaaagug

SEQ ID NO: 352422 - RNA, 64 nt, Homo Sapiens
gucauaagccaggaaaugaagaacagccuuguccaggcagaacauugcuggagagcgaaagaug

SEQ ID NO: 352423 - RNA, 64 nt, Homo Sapiens
aggcccucccaccccuucucuaacacuagcuucaaggcagaagccacagcagccucuguccagc

SEQ ID NO: 352424 - RNA, 64 nt, Homo Sapiens
cuggaacccaggugagggcaagaugaaggcuuccaggcagaacagcugcagagaguuuggcuau

SEQ ID NO: 352425 - RNA, 64 nt, Homo Sapiens
gcucgccucuuuaggguccaugguggcagcagagaggcagaagugggaguccagagccaggaac

SEQ ID NO: 352426 - RNA, 64 nt, Homo Sapiens
uccaguccaugcucuucuggacguggacucucugaggcagaacugagcuuuuccaggccucuua

SEQ ID NO: 352427 - RNA, 64 nt, Homo Sapiens
aucgcuugaaccugggagguuacucgggaggcugaggcagaagacacacgccuguagucccagc

SEQ ID NO: 352428 - RNA, 64 nt, Homo Sapiens
gggcccaaagacacacacccacaugggcuagggaaggcagaacuggccuacgugacacaaggag

SEQ ID NO: 352429 - RNA, 64 nt, Homo Sapiens
ugccuucccuaguuuaauuaaacucgaaugacuuaggcagaacaaaaaacgaaaaacaaaaaaa

SEQ ID NO: 352430 - RNA, 64 nt, Homo Sapiens
uucccaguauuucuggauaagcauuuggccugaaaggcagaaugugugaucagggaaguugggg

SEQ ID NO: 352431 - RNA, 64 nt, Homo Sapiens
uccaagaauggaguaagauucuuccccacugcagaggcagaacgccauaauccaggagggucuc

SEQ ID NO: 352432 - RNA, 64 nt, Homo Sapiens
cauucauucagacuuugcuacauuuuuuaauguuaggcagaacagaagagacuuaggaucaaga

SEQ ID NO: 352433 - RNA, 64 nt, Homo Sapiens
uacugucccuuacuggggcagcagagggcuucggaggcagaagugaggccugggguuuuggggg

SEQ ID NO: 352434 - RNA, 64 nt, Homo Sapiens
auauucagugucccuguuccucacucagagaggaaggcagaaccagucaggcuuauuucaguaa

SEQ ID NO: 352435 - RNA, 64 nt, Homo Sapiens
aguuaauauuuaauuaaauagcaguuuuugacccaggcagaauacuacauugcauaugggcaua

SEQ ID NO: 352436 - RNA, 64 nt, Homo Sapiens
agcugcagucccacgugggcgucacccgccuggcaggcagaaggauccucucagcagucuuccu

SEQ ID NO: 352437 - RNA, 64 nt, Homo Sapiens
gugucuguggucgggugcugcucacuccagcagcaggcagaacccagccucagaaaccaggccu

SEQ ID NO: 352438 - RNA, 64 nt, Homo Sapiens
cuggccacagaggagccucccucagggugcagggaggcagaagccugaggcacccgaauggucc

SEQ ID NO: 352439 - RNA, 64 nt, Homo Sapiens
aaaauccucgguaacauugaagugaguuauaaugaggcagaaacauacugacaaaauacaugga

SEQ ID NO: 352440 - RNA, 64 nt, Homo Sapiens
cuguagugauaaccucucuccauuguaacaguaaaggcagaaaggauaccaucuggcggcugca

SEQ ID NO: 352441 - RNA, 64 nt, Homo Sapiens
gagaucauuuaguugggucugaaaagaguaucaaaggcagaaagaaggaugaaagacaaagaag

SEQ ID NO: 352442 - RNA, 64 nt, Homo Sapiens
acaaccacucaccaguccuaaucaaagcuaggaaaggcagaaaccaaagacagggaauaguggg

SEQ ID NO: 352443 - RNA, 64 nt, Homo Sapiens
ccucuacggccccgacggacgcuugugaggcccgaggcagaagggcccaccccgucccuccucu

SEQ ID NO: 352444 - RNA, 64 nt, Homo Sapiens
aagcaaaggagaguccugggagcccacaagauccaggcagaaggagauggguuuggggcuggcc

SEQ ID NO: 352445 - RNA, 64 nt, Homo Sapiens
auuccaggccucaacagcugcccuugaggagcacaggcagaagugugaacuugugaauguaauu

SEQ ID NO: 352446 - RNA, 64 nt, Homo Sapiens
gauaacauaaaguggauucaucuuguaucauuauaggcagaagguauuuggcaaauuuuuaugu

SEQ ID NO: 352447 - RNA, 64 nt, Homo Sapiens
uguggaugaauucaggcacugaggcugccuaugaaggcagaagagcuggaacuggagccaaggg

SEQ ID NO: 352448 - RNA, 64 nt, Homo Sapiens
cuggcaagaaaugaggaagauaaauguuaugaaaaggcagaauagaccagauaucuuguuggca

SEQ ID NO: 352449 - RNA, 64 nt, Homo Sapiens
augcuccaagaaccaacacuagacaaagcccgggaggcagaaaggcagccccgaggcugagacc

SEQ ID NO: 352450 - RNA, 64 nt, Homo Sapiens
aaaaugacuguagaacuuauaaucuggaggaaauaggcagaaacgaugacccaaucugccuuug

SEQ ID NO: 352451 - RNA, 64 nt, Homo Sapiens
augggauggcaaaggugguggugcuuucaucuucaggcagaagccucugcccaucccccucaag

SEQ ID NO: 352452 - RNA, 64 nt, Homo Sapiens
gucauuuugauaggagcguuuuguuauuuuuacaaggcagaaugggguguaacaguugaauuaa

SEQ ID NO: 352453 - RNA, 64 nt, Homo Sapiens
ggcuccgcuguguggauggggagaucggggccagaggcagaacccuggugaggaagcuccaguc

SEQ ID NO: 352454 - RNA, 64 nt, Homo Sapiens
guugggcagcugaacaguguuggcuuucaugaggaggcagaaagcagaggcuggccucagacuc

SEQ ID NO: 352455 - RNA, 64 nt, Homo Sapiens
gggacacccacgcccuucucuccagaagccgggcaggcagaauccggccagacgacggggcuga

SEQ ID NO: 352456 - RNA, 64 nt, Homo Sapiens
cuauuuuuauacuuaaaacaugucagcagagcauaggcagaauaaaaugguuuaaauaccccac

SEQ ID NO: 352457 - RNA, 64 nt, Homo Sapiens
gauggaauuuggcuucaagacaccaaggcagaacaggcagaaggccggaggugcagcuaaaggc

SEQ ID NO: 352458 - RNA, 64 nt, Homo Sapiens
ggcagaagggauggaauuuggcuaaaggccaccaaggcagaacacccagggcuccggaggugca

SEQ ID NO: 352459 - RNA, 64 nt, Homo Sapiens
ggccgggcgcgguggcucauaccacaauagaaaaaggcagaaaacagagucucagggaaagaga

SEQ ID NO: 352460 - RNA, 64 nt, Homo Sapiens
aucccuugacccugagagguuacucaggaagcugaggcagaaagcacaugccugugaucccagc

SEQ ID NO: 352461 - RNA, 64 nt, Homo Sapiens
caguuugggguucugggucgguuccagcggcuuuaggcagaaagugcucgcucucacccagcac

SEQ ID NO: 352462 - RNA, 64 nt, Homo Sapiens
cagguccuaucaaaggaggcugccggaacucaagaggcagaaaaagaccaguuaggcggugcag

SEQ ID NO: 352463 - RNA, 64 nt, Homo Sapiens
ggcuggacucagcaggaacaccaaaucccggaccaggcagaaaccacccaagacugaggggcuc

SEQ ID NO: 352464 - RNA, 64 nt, Homo Sapiens
aagauuguuugaaaaaaaaaaaaggggagcagggaggcagaaaguccuggaaaaguaaauuguu

SEQ ID NO: 352465 - RNA, 64 nt, Homo Sapiens
gcaagcacaauaccauuaaaaagccucaagcccaaggcagaagaccuaucugcauuugagcccu

SEQ ID NO: 352466 - RNA, 64 nt, Homo Sapiens
auaggcagggcagcuguggcuggggagagacuuuaggcagaagcugugaugcaggcugacugcc

SEQ ID NO: 352467 - RNA, 64 nt, Homo Sapiens
cguuccuacaggugcacaaucuaagagagcuaauuaaccucagagucuggaguuaacagcuuuu

SEQ ID NO: 352468 - RNA, 64 nt, Homo Sapiens
gaacuuauaguaaggaaacucacuugauuuuaucuaaccucaaacuuuccaaguuuaauggauc

SEQ ID NO: 352469 - RNA, 64 nt, Homo Sapiens
uugcuuacaaucuuuauuaugcauucuuauaacauaaccucagaguaucuuuaccaaagguuuu

SEQ ID NO: 352470 - RNA, 64 nt, Homo Sapiens
ggcagcugcuagggagaucagggaaacacugauguaaccucaaagccucucaccauuccucuug

SEQ ID NO: 352471 - RNA, 64 nt, Homo Sapiens
gauagcaguuaaaauguucuaaauaaaagcagguuaaccucaauauuuccuguauaauucacuu

SEQ ID NO: 352472 - RNA, 64 nt, Homo Sapiens
uuuuaacacaugcauaucuuugaauaacuuuacauaaccucaguaagacacacucaggcuuuag

SEQ ID NO: 352473 - RNA, 64 nt, Homo Sapiens
gaauucaggauuuuuuagcagaggauuucagaguuaaccucaugcaauucuagcauuuuguuug

SEQ ID NO: 352474 - RNA, 64 nt, Homo Sapiens
auuaggucagcaugugaaauuuacuucuggaaauuaaccucaauuaaucuguugaaaagugcag

SEQ ID NO: 352475 - RNA, 64 nt, Homo Sapiens
gaaaccauaaagcuuggagucagccacaaaacuguaaccucaaguuucugaaauacacuaagag

SEQ ID NO: 352476 - RNA, 64 nt, Homo Sapiens
uguauuaaauagcauuggggaggacuuaacguccuaaccucaaucuccaguacacagucugaua

SEQ ID NO: 352477 - RNA, 64 nt, Homo Sapiens
gagaaaaacaagugaaaaggucaagauacaaauguguauuaaaaaaaaaaaagccuauuaauag

SEQ ID NO: 352478 - RNA, 64 nt, Homo Sapiens
uaccaaugaacuguuuagaaacaagacacacuuuuguauuaaaauugcuugcaguaacaaauau

SEQ ID NO: 352479 - RNA, 64 nt, Homo Sapiens
aaaugcaaggucacacauauuaaugacagccuguuguauuaaugauggcuccaggucagugucu

SEQ ID NO: 352480 - RNA, 64 nt, Homo Sapiens
uccagcagaagcagaugcaccugacaaaaauggauguauuaauuggcucuauaaacuaugugcc

SEQ ID NO: 352481 - RNA, 64 nt, Homo Sapiens
uaugcucuggaaaaccugaggccaaauauugaucuguauuaagcuccagugcuuuauccacauu

SEQ ID NO: 352482 - RNA, 64 nt, Homo Sapiens
ugaagacaccagaguguaugcauacaaaucucacuguauuaaagaugcagguuuucuaauugua

SEQ ID NO: 352483 - RNA, 64 nt, Homo Sapiens
guagaaaauauaucuuaaacuaguugaccuagauuguauuaauagcuacuuaagauguuucaaa

SEQ ID NO: 352484 - RNA, 64 nt, Homo Sapiens
caguagaauacaguuuuuauuuuguaaacacuaauguauuaaacuugcuauacauuaaagcaaa

SEQ ID NO: 352485 - RNA, 64 nt, Homo Sapiens
aaacacaagagaagucuuuaaaaagccugcauuguguauuaaacaccagguaauaugugcaaaa

SEQ ID NO: 352486 - RNA, 64 nt, Homo Sapiens
uuuguugauguagcuuguaucucugagaauuuauuguauuaaaauuaauacugagauauuuuua

SEQ ID NO: 352487 - RNA, 64 nt, Homo Sapiens
agccugcauucugagcuggauguaaguuugaauuuguauuaaaacuaucuucucauuguuuguu

SEQ ID NO: 352488 - RNA, 64 nt, Homo Sapiens
ucugauaaaguuccuuaagcuauuuagaaaauuuuguauuaauuagcaaaauuccuguguucaa

SEQ ID NO: 352489 - RNA, 64 nt, Homo Sapiens
uauaguuuaaaugcuguucuuaugaaaaauaaaauguauuaaaaaauaaugguuugguucacuu

SEQ ID NO: 352490 - RNA, 64 nt, Homo Sapiens
cuguggcuaugagaggccucagaagaccgaagcauguauuaaugaggaaagaguaagacuguua

SEQ ID NO: 352491 - RNA, 64 nt, Homo Sapiens
uguauauuuucauauauaugacagaacaagaauauguauuaauagugccuaauguaucuauauu

SEQ ID NO: 352492 - RNA, 64 nt, Homo Sapiens
uugggacauuuuucuaggaaauaaaauuccucgguguauuaaucuaagguuucaaaguauaaaa

SEQ ID NO: 352493 - RNA, 64 nt, Homo Sapiens
cuuugccagucuuuaagaucuuggcuuaauuuaauguauuaaucuguuugugcaaacauaauac

SEQ ID NO: 352494 - RNA, 64 nt, Homo Sapiens
gaagcccaaauucauauaaaaguugcguuuaaguuguauuaaaaauagauauauaagaaaaaau

SEQ ID NO: 352495 - RNA, 64 nt, Homo Sapiens
uauuuuacguguuuccauguaucucacuuugugcuguauuaaaaaaaccuccauuuugaaaauc

SEQ ID NO: 352496 - RNA, 64 nt, Homo Sapiens
uuuguuuuauuauguaauugauaaaauggugauguguauuaauguuaguucaaccauauauuua

SEQ ID NO: 352497 - RNA, 64 nt, Homo Sapiens
gauauuuugcuuccuguaauuagcagccucaaguuguauuaaauacgaugccagauuagauuua

SEQ ID NO: 352498 - RNA, 64 nt, Homo Sapiens
cucuuugucuacacauguaauagaacucuugcuuuguauuaaacccauuauuugaacacuuggg

SEQ ID NO: 352499 - RNA, 63 nt, Homo Sapiens
acugccagauucaguuaauaaaauaaaugagcuauguauuaacaauacauuucuccuuugaua

SEQ ID NO: 352500 - RNA, 64 nt, Homo Sapiens
gugaaaauugucuucuucugugaaucuauuauacuguauuaagaaauaauuuuauggcucacua

SEQ ID NO: 352501 - RNA, 64 nt, Homo Sapiens
auaaaauuaauaaaaguaaaccuuacugaaaaucuguauuaaaaccaauuagguugaaaaugcc

SEQ ID NO: 352502 - RNA, 64 nt, Homo Sapiens
uuaaugauuaaaaagagcauccacacacacauuuuguauuaauucggaaugucucccccagcug

SEQ ID NO: 352503 - RNA, 64 nt, Homo Sapiens
aauagaagauggaucucuagcucugagcuauucguguauuaacucguauucaagaagguuccac

SEQ ID NO: 352504 - RNA, 64 nt, Homo Sapiens
uuggaccgaugaugucucuacuacuggaucuaucuguauuaacagcaauguuacucucaaugaa

SEQ ID NO: 352505 - RNA, 64 nt, Homo Sapiens
aaauaaauaaguaaauaaccucuaaaaaaugaaguguauuaaguuucuguaacccuaaagcugc

SEQ ID NO: 352506 - RNA, 64 nt, Homo Sapiens
accacacccuuucugcauccaguaguucccuuguuguauuaauaggaaucaggauuuagccuca

SEQ ID NO: 352507 - RNA, 64 nt, Homo Sapiens
ugcugaugugguuuacaauaaaugcaaagcuuuauguauuaacuuaaagugucuaguuuuuuga

SEQ ID NO: 352508 - RNA, 64 nt, Homo Sapiens
uaacacugagauuuuuuuaagcaccccucuuucauguauuaaaaaagcaaaacuuuuugaagaa

SEQ ID NO: 352509 - RNA, 64 nt, Homo Sapiens
ucuccauugucuuaacccugaacaagacacucuauguauuaaugaaguauguggcaguaaauac

SEQ ID NO: 352510 - RNA, 64 nt, Homo Sapiens
ucaucagucuugaagaacaucuuagcauguuagguguauuaaccuuuauucucaaacuggcaaa

SEQ ID NO: 352511 - RNA, 64 nt, Homo Sapiens
aauaaaaugcuugccccagaagaauuucuauucuuguauuaacauauuagaugauauuuauugc

SEQ ID NO: 352512 - RNA, 64 nt, Homo Sapiens
uuuauuuauuuggagauguugacucuaaguguguuguauuaauaccccagccccacccacucau

SEQ ID NO: 352513 - RNA, 64 nt, Homo Sapiens
aaagucuggaaacuuucauaucaauaauugauuauguauuaacugaaacaaaagacuagagaaa

SEQ ID NO: 352514 - RNA, 64 nt, Homo Sapiens
aaagacuagagaaagacacagugggaauugauuauguauuaacugaggaauaaaagacugaaga

SEQ ID NO: 352515 - RNA, 64 nt, Homo Sapiens
uauuagaaaucuacagaucuguagucaugcacuuuguauuaauagccuguaggauguacuguau

SEQ ID NO: 352516 - RNA, 64 nt, Homo Sapiens
guaaaacuuacuaaaagaaaauuuucuuucacucuguauuaaaauuuuagccuauuaaauuuuu

SEQ ID NO: 352517 - RNA, 64 nt, Homo Sapiens
ccuugcuauguagaaugacuauucuaaauauuaauguauuaaaaagaaaauacaacaaaaugua

SEQ ID NO: 352518 - RNA, 64 nt, Homo Sapiens
cuuagugggaauggaaguauauguaucuaucuuguguauuaacuucugacuuauuuauacaaga

SEQ ID NO: 352519 - RNA, 64 nt, Homo Sapiens
gccaauuccguuuauccaaaaagguacauguuuuuguauuaaaaaguaaacagggaucagugac

SEQ ID NO: 352520 - RNA, 64 nt, Homo Sapiens
ccuuuuuuguguguuuguguguuuuuuuaagugcuguauuaauaauacuuucugaaagaaaagg

SEQ ID NO: 352521 - RNA, 64 nt, Homo Sapiens
gugugaaagucacagcuuguaaauaaguguuguauguauuaaaccuuuuccaguucuccaaagc

SEQ ID NO: 352522 - RNA, 64 nt, Homo Sapiens
uccauugucagcacagccuaggaaggucagauccuguauuaauuacucuuaguggagaugccag

SEQ ID NO: 352523 - RNA, 64 nt, Homo Sapiens
cauauuauguaauauauuguuagauuaaaaccauuguauuaagacuuuaaaauguaagcauugu

SEQ ID NO: 352524 - RNA, 64 nt, Homo Sapiens
uacauuuguaauuuaaggucuuuuaaaauguacauguauuaaauucuuugauaacagggauuga

SEQ ID NO: 352525 - RNA, 64 nt, Homo Sapiens
cuacucaaagcaaaagugcucaugacagaaaauauguauuaacaucagaaguuuaaauauuaag

SEQ ID NO: 352526 - RNA, 64 nt, Homo Sapiens
agccaaauucugucuccugcauacacuccggcaugcauccaacaccaauggcuuucuagaugag

SEQ ID NO: 352527 - RNA, 64 nt, Homo Sapiens
uugagauucaagaaaaauuucuauucuuuuuuuugcauccaauugugccugaacuuuuaaaaua

SEQ ID NO: 352528 - RNA, 64 nt, Homo Sapiens
auugcaacccagggcaaaugagcaguuggaggaagcauccaaaggagacaaggauaaguuauag

SEQ ID NO: 352529 - RNA, 64 nt, Homo Sapiens
uaacuuaacucuuaccuauuggggccaggagggugcauccaauuguccugcauuucuuuggugg

SEQ ID NO: 352530 - RNA, 64 nt, Homo Sapiens
gaauaagagauacaaggucuuguguaaagauuugagggaagaauaccuucucuuaagcaaucag

SEQ ID NO: 352531 - RNA, 64 nt, Homo Sapiens
aacagcaaggauggggcaucuuggaggaaucagaagggaagauccugugaagaaaucauaacac

SEQ ID NO: 352532 - RNA, 64 nt, Homo Sapiens
uuaaaaaguaagugcucagagaagaaaggggagaagggaagaggaauagucaugaaaagaaagg

SEQ ID NO: 352533 - RNA, 64 nt, Homo Sapiens
ggggagaagggaagagguuaagucaugaaaagaaagggaagaaauagcaaguuuaggagagaau

SEQ ID NO: 352534 - RNA, 64 nt, Homo Sapiens
ggggcugagguuggaggccuacuaauuucccuguagggaagacucccagcacuucuggaacugu

SEQ ID NO: 352535 - RNA, 64 nt, Homo Sapiens
cagcugacccguguaugugcagaugcaguuccgaagggaagaacaguccucgggugauucagag

SEQ ID NO: 352536 - RNA, 64 nt, Homo Sapiens
ucacaguucucuggaugcccagacaccucucuucagggaagaugagucugacugguuugcccca

SEQ ID NO: 352537 - RNA, 64 nt, Homo Sapiens
ucuucagggaagaugagucugacugguuugccccagggaagagcauauccuuaccauuauuuua

SEQ ID NO: 352538 - RNA, 64 nt, Homo Sapiens
ugcaggggagacuggggcccccuaucaaucaaucagggaagaaacaguggcagcccagccaccu

SEQ ID NO: 352539 - RNA, 64 nt, Homo Sapiens
auaguuaauaacgucucucaaucccgguagcuucagggaagaucggaagacacugaccuuuccc

SEQ ID NO: 352540 - RNA, 64 nt, Homo Sapiens
ccugucggguuuuuagcacaggagcggggagggcagggaagaugaggauugcagaagacgagcg

SEQ ID NO: 352541 - RNA, 64 nt, Homo Sapiens
agaaggaaagauuuuguuguaggucucugaacccagggaagacaucagcagagaaguuuucugg

SEQ ID NO: 352542 - RNA, 64 nt, Homo Sapiens
uucucucugaaagcagaaaaaggcacugauauaaagggaagagaaggaggcucaccggagggaa

SEQ ID NO: 352543 - RNA, 64 nt, Homo Sapiens
acugauauaaagggaagagaaggaggcucaccggagggaagagaacauagugaagauucccgcc

SEQ ID NO: 352544 - RNA, 64 nt, Homo Sapiens
uagaagggaaccauggguccuuaauuuauaaaggagggaagagguuagaguaaauggacuugcc

SEQ ID NO: 352545 - RNA, 64 nt, Homo Sapiens
aaugacacagcuugagcguuuaguccgggucuacagggaagaacuucugcaaccuaacguuuaa

SEQ ID NO: 352546 - RNA, 64 nt, Homo Sapiens
uuagugguaaagagugaaugagugauuagacagcagggaagauauagacaggagggaagauauu

SEQ ID NO: 352547 - RNA, 64 nt, Homo Sapiens
uuagugauuagacagcagggagugauuagacaggagggaagauauagacaggaaggaagacauu

SEQ ID NO: 352548 - RNA, 64 nt, Homo Sapiens
caaagacuuauuuugaaaguuggaaggagaagggagggaagagagcagaagggaagaaggugua

SEQ ID NO: 352549 - RNA, 64 nt, Homo Sapiens
aaaguuggaaggagaagggagggaagagagcagaagggaagaagguguaagucaagcucuugaa

SEQ ID NO: 352550 - RNA, 64 nt, Homo Sapiens
ucagggacagggaccaggauggaggaggagcccuagggaagaaguccucugagugagaugccca

SEQ ID NO: 352551 - RNA, 64 nt, Homo Sapiens
gaggcugaagaauugacggcggagagggcaauagagggaagacugcacuucuucccuaugucca

SEQ ID NO: 352552 - RNA, 64 nt, Homo Sapiens
gaaucgggcucacgaaugcccuuccccuaagguuagggaagaaauucccuccguucugcuucag

SEQ ID NO: 352553 - RNA, 64 nt, Homo Sapiens
ccuauacuugguuugcuacccaauugcucccaucagggaagaaccaaacccggaagaucagaug

SEQ ID NO: 352554 - RNA, 64 nt, Homo Sapiens
uuaugccuuuucuuuucuguuugacagcuuggaaagggaagaucgaggagcugcuuguuguuug

SEQ ID NO: 352555 - RNA, 64 nt, Homo Sapiens
uagguuugaauugcuuuuuugggaggaggaagaaagggaagaaugagaagcaggcggguugggu

SEQ ID NO: 352556 - RNA, 64 nt, Homo Sapiens
uagguuugaauugcuuuuuagggaggaggaagaaagggaagaaugagaagcaggcggguugggu

SEQ ID NO: 352557 - RNA, 64 nt, Homo Sapiens
uugguuugguuuaugugucacugccgcagcagccagggaagaccccaacuuagagcaauaacgg

SEQ ID NO: 352558 - RNA, 64 nt, Homo Sapiens
cuaggccuuagcuugcccucgucugggagguuggagggaagaauguguggcucccuccuucccu

SEQ ID NO: 352559 - RNA, 64 nt, Homo Sapiens
ugaggaaggcccaccccugggacugaaaaucaagagggaagaggggaggggacuggaaagcuga

SEQ ID NO: 352560 - RNA, 64 nt, Homo Sapiens
cgggaggagucauggggaugugccucugggguguagggaagaggcuuguggccucugggcugua

SEQ ID NO: 352561 - RNA, 64 nt, Homo Sapiens
acagggauuuccccucucuaacccugaaaugggcagggaagaaaucaguacaucuuuuguaaaa

SEQ ID NO: 352562 - RNA, 64 nt, Homo Sapiens
uucaaagguuuauugcuuagccauaugaaaaauaagggaagauuuuuuagcaaggggacccaca

SEQ ID NO: 352563 - RNA, 64 nt, Homo Sapiens
ugcagcucugggggcccuuuccacuucuggcuauagggaagaaccugaauacugaacuugauuc

SEQ ID NO: 352564 - RNA, 64 nt, Homo Sapiens
aaaaacguuuaugauauuaagaucaaagggaggaagggaagacagcaguauuaauucacccuag

SEQ ID NO: 352565 - RNA, 64 nt, Homo Sapiens
caugcugcauacuugccuaguagcaaaacaauacagggaagagucaaaagggcuucuccaacug

SEQ ID NO: 352566 - RNA, 64 nt, Homo Sapiens
guccagguuauaaccugguaccagcagacuuugcagggaagaaagaguuguuccaaucauguaa

SEQ ID NO: 352567 - RNA, 64 nt, Homo Sapiens
aaucauguaaccuucuguaggggauuacugagacagggaagagaagugcaagaauugguugcug

SEQ ID NO: 352568 - RNA, 64 nt, Homo Sapiens
cuuucuccccucccgcuaguaucuuuacaggagcagggaagagcaguagaggauguauaauuuu

SEQ ID NO: 352569 - RNA, 64 nt, Homo Sapiens
uaggcuaaauaggaguuacagaaaacuguuaaauagggaagaacuacauuaaauuuaaauauuc

SEQ ID NO: 352570 - RNA, 64 nt, Homo Sapiens
ggaggugcccuucacucuaagcuuaacacuuaguagggaagagauucucaaaugagaaaaaggg

SEQ ID NO: 352571 - RNA, 64 nt, Homo Sapiens
gagaaaaagggcuccggcuauaugggcaacaaagagggaagauacagguugccaguuauacauu

SEQ ID NO: 352572 - RNA, 64 nt, Homo Sapiens
gagacuguugaagcucucaauagguggcaguuuuagggaagauuuccauucaguguagggaaga

SEQ ID NO: 352573 - RNA, 64 nt, Homo Sapiens
gguggcaguuuuagggaagauuuccauucaguguagggaagacauuuguaauaaugaaaacuga

SEQ ID NO: 352574 - RNA, 64 nt, Homo Sapiens
ucccccagcuuguuugccaugaacugauuccuggagggaagaccauuccuguuacaaaugaaaa

SEQ ID NO: 352575 - RNA, 64 nt, Homo Sapiens
gugcauacaugcggggaccccagacugucagcacagggaagauggaucccauccuaauuuuuau

SEQ ID NO: 352576 - RNA, 64 nt, Homo Sapiens
aagcaccuuuuugacagugaacauggucuaaaaaagggaagauauuguagaagauuucacacac

SEQ ID NO: 352577 - RNA, 64 nt, Homo Sapiens
aaguguggcugaugguagccucuaguuugaagugagggaagaaugaguagucaggaacugguca

SEQ ID NO: 352578 - RNA, 64 nt, Homo Sapiens
ugaguagucaggaacuggucacuuugaaugugggagggaagauauucacgacaagguuuucuac

SEQ ID NO: 352579 - RNA, 64 nt, Homo Sapiens
uaggaugggaaagcuaacaagaauaacaaauagaagggaagagaaauucaccaugaaaaaacaa

SEQ ID NO: 352580 - RNA, 64 nt, Homo Sapiens
gagcugaauuuguagcauacuuguagggggagguagggaagaaucuuucugucaaacaaugagg

SEQ ID NO: 352581 - RNA, 64 nt, Homo Sapiens
uaaaaaacaauuccaaaugugaaacuagaaugagagggaagagauagcauggcaugcagcacac

SEQ ID NO: 352582 - RNA, 64 nt, Homo Sapiens
uuucgugacaauguacgccuuucccucagaauucagggaagagacugucgccugccuuccuccg

SEQ ID NO: 352583 - RNA, 64 nt, Homo Sapiens
cugugcaggagccuucauuucagcuucaauuaauagggaagaauuuaugauagcucuauagaug

SEQ ID NO: 352584 - RNA, 64 nt, Homo Sapiens
ucuaccucacaguguccauacaaauuaguuccagagggaagauauaccacaaaauuacucaaaa

SEQ ID NO: 352585 - RNA, 64 nt, Homo Sapiens
gaggaaugcuggacuggagggccccacccaaucaagggaagaaggccuggcugcccaucaugug

SEQ ID NO: 352586 - RNA, 64 nt, Homo Sapiens
aucaacgccucacugaaacauagguugggacaccagggaagaaggggcuguaacguggcacugg

SEQ ID NO: 352587 - RNA, 64 nt, Homo Sapiens
ccugucggguuuuuagcacaaguggggggagggcagggaagauguuagaggauugcagaagacg

SEQ ID NO: 352588 - RNA, 64 nt, Homo Sapiens
acugggccugaccuaccugacggggucugucgggagggaagagaucuucggugcuucccgggcc

SEQ ID NO: 352589 - RNA, 64 nt, Homo Sapiens
cuucacaccauaacuagguaacaguuugauaacuagggaagaaagcagaacaguuaagcagccg

SEQ ID NO: 352590 - RNA, 64 nt, Homo Sapiens
aggccaccugcaggucacugaaacuucaagcaccagggaagaucuaacauuugagucccuucca

SEQ ID NO: 352591 - RNA, 64 nt, Homo Sapiens
aucaaaaucuguagagcagggcaaguaacauggaagggaagaaaaggugaaaaauuagaaaugu

SEQ ID NO: 352592 - RNA, 64 nt, Homo Sapiens
agccugugugcagggaaagagguuagaggccuuuagggaagaaauuggucccuaucuuccagca

SEQ ID NO: 352593 - RNA, 64 nt, Homo Sapiens
gcuguaggggagcaugguuugcuucuguaacuguagggaagaaaccuuacgaggauuucuggaa

SEQ ID NO: 352594 - RNA, 64 nt, Homo Sapiens
gaagagucuauuaugagcugauucagggaagagaagggaagagagauggggagugagaugagua

SEQ ID NO: 352595 - RNA, 64 nt, Homo Sapiens
agggaagagagaagagucuagagaugaguaauucagggaagagaggacauacaagauggggagu

SEQ ID NO: 352596 - RNA, 64 nt, Homo Sapiens
uguaaaauuuuuuuagaagagauggcuuauuaacagggaagaagcuuguuauauuccaguugua

SEQ ID NO: 352597 - RNA, 64 nt, Homo Sapiens
aagaauagccuuaguguuuagauuuuuuuaugauagggaagaugcggccaucacugggauauuu

SEQ ID NO: 352598 - RNA, 64 nt, Homo Sapiens
uccuaauggaggcgccuccagcucuggguggaagagggaagagaagccacugacugggggcaga

SEQ ID NO: 352599 - RNA, 64 nt, Homo Sapiens
cacagcagggccaccauuccuuaagcgugaucggagggaagacaaggugggaccauggugcucu

SEQ ID NO: 352600 - RNA, 64 nt, Homo Sapiens
agacuuugauacuaccagggucucucagggauggagggaagaccugaaagagaggacugguucu

SEQ ID NO: 352601 - RNA, 64 nt, Homo Sapiens
acccuguuacuuauguagaaacugaggcccagagagggaagaugaccugccccaaguggugagc

SEQ ID NO: 352602 - RNA, 64 nt, Homo Sapiens
uauaauccuagacuggaagaguagaauaucauauagggaagaaaccuuaaacaccacaguguuc

SEQ ID NO: 352603 - RNA, 64 nt, Homo Sapiens
agaaucaggcagucgcccacuucucuccagaugaagggaagacauucauaggucccaaaucugc

SEQ ID NO: 352604 - RNA, 64 nt, Homo Sapiens
agaaagcaaaggaacagaaggggcagaaggaaggagggaagaaaggggagaagaaggaagggaa

SEQ ID NO: 352605 - RNA, 64 nt, Homo Sapiens
gcagagaaaagcaaggagagcucaccuggccuccagggaagaauuuuuccugucaguuggaccc

SEQ ID NO: 352606 - RNA, 64 nt, Homo Sapiens; identical to SEQ ID NO: 246269

SEQ ID NO: 352607 - RNA, 64 nt, Homo Sapiens; identical to SEQ ID NO: 246270

SEQ ID NO: 352608 - RNA, 64 nt, Homo Sapiens; identical to SEQ ID NO: 246271

SEQ ID NO: 352609 - RNA, 64 nt, Homo Sapiens; identical to SEQ ID NO: 246272

SEQ ID NO: 352610 - RNA, 64 nt, Homo Sapiens; identical to SEQ ID NO: 246273

SEQ ID NO: 352611 - RNA, 64 nt, Homo Sapiens; identical to SEQ ID NO: 246274

SEQ ID NO: 352612 - RNA, 64 nt, Homo Sapiens; identical to SEQ ID NO: 246275

SEQ ID NO: 352613 - RNA, 64 nt, Homo Sapiens; identical to SEQ ID NO: 246276

SEQ ID NO: 352614 - RNA, 51 nt, Homo Sapiens; identical to SEQ ID NO: 246277

SEQ ID NO: 352615 - RNA, 64 nt, Homo Sapiens; identical to SEQ ID NO: 246278

SEQ ID NO: 352616 - RNA, 64 nt, Homo Sapiens; identical to SEQ ID NO: 246279

SEQ ID NO: 352617 - RNA, 56 nt, Homo Sapiens; identical to SEQ ID NO: 246280

SEQ ID NO: 352618 - RNA, 64 nt, Homo Sapiens; identical to SEQ ID NO: 246281

SEQ ID NO: 352619 - RNA, 64 nt, Homo Sapiens; identical to SEQ ID NO: 246282

SEQ ID NO: 352620 - RNA, 64 nt, Homo Sapiens; identical to SEQ ID NO: 246283

SEQ ID NO: 352621 - RNA, 64 nt, Homo Sapiens; identical to SEQ ID NO: 246284

SEQ ID NO: 352622 - RNA, 64 nt, Homo Sapiens; identical to SEQ ID NO: 246285

SEQ ID NO: 352623 - RNA, 64 nt, Homo Sapiens; identical to SEQ ID NO: 246286

SEQ ID NO: 352624 - RNA, 64 nt, Homo Sapiens; identical to SEQ ID NO: 246287

SEQ ID NO: 352625 - RNA, 64 nt, Homo Sapiens; identical to SEQ ID NO: 246288

SEQ ID NO: 352626 - RNA, 64 nt, Homo Sapiens; identical to SEQ ID NO: 246289

SEQ ID NO: 352627 - RNA, 64 nt, Homo Sapiens; identical to SEQ ID NO: 246290

SEQ ID NO: 352628 - RNA, 64 nt, Homo Sapiens; identical to SEQ ID NO: 246291

SEQ ID NO: 352629 - RNA, 64 nt, Homo Sapiens; identical to SEQ ID NO: 246292

SEQ ID NO: 352630 - RNA, 64 nt, Homo Sapiens; identical to SEQ ID NO: 246293

SEQ ID NO: 352631 - RNA, 64 nt, Homo Sapiens; identical to SEQ ID NO: 246294

SEQ ID NO: 352632 - RNA, 64 nt, Homo Sapiens; identical to SEQ ID NO: 246295

SEQ ID NO: 352633 - RNA, 64 nt, Homo Sapiens; identical to SEQ ID NO: 246296

SEQ ID NO: 352634 - RNA, 64 nt, Homo Sapiens; identical to SEQ ID NO: 246297

SEQ ID NO: 352635 - RNA, 64 nt, Homo Sapiens; identical to SEQ ID NO: 246298

SEQ ID NO: 352636 - RNA, 64 nt, Homo Sapiens; identical to SEQ ID NO: 246299

SEQ ID NO: 352637 - RNA, 64 nt, Homo Sapiens; identical to SEQ ID NO: 246300

SEQ ID NO: 352638 - RNA, 64 nt, Homo Sapiens; identical to SEQ ID NO: 246301

SEQ ID NO: 352639 - RNA, 61 nt, Homo Sapiens
cuggaugcugucagaggcgauggagaaacgcaaaggcuacuagacgcaacaauagaauuac

SEQ ID NO: 352640 - RNA, 61 nt, Homo Sapiens
aaauucuacuaaguuuucccauauucuugauaaaggcuaaauuugaaauaauuuauuuaga

SEQ ID NO: 352641 - RNA, 61 nt, Homo Sapiens
ugugaugaugacacuuugguaagccccucagaaaggcuaacauccuucacauauuucccau

SEQ ID NO: 352642 - RNA, 61 nt, Homo Sapiens
uacuuucuuuuccuuuuccuuguuagccacaaaaggcuacuguauuugucauguuaaaaag

SEQ ID NO: 352643 - RNA, 61 nt, Homo Sapiens
ugcauaagaaagaguaaacauaggauuucauaaaggcuaauauauagaaguguugcaugua

SEQ ID NO: 352644 - RNA, 61 nt, Homo Sapiens; identical to SEQ ID NO: 97548

SEQ ID NO: 352645 - RNA, 61 nt, Homo Sapiens
ucaagacgaggugcgguggcgugaacauuuaaaaggcuauuccacugugaggcaagcugag

SEQ ID NO: 352646 - RNA, 61 nt, Homo Sapiens
ccagaaauauuucccacaacuucgaguagagaaaggcuauccuggcgccucaaccagcagc

SEQ ID NO: 352647 - RNA, 61 nt, Homo Sapiens
cgauaugaauuucagaaaugagaaaaaggcuaaaggcuauggguuggguugaccaguaagu

SEQ ID NO: 352648 - RNA, 61 nt, Homo Sapiens
ggcuaugcgauaugaauuucaguaaguagaaaaaggcuaaacaguacugguuggguugacc

SEQ ID NO: 352649 - RNA, 64 nt, Homo Sapiens; identical to SEQ ID NO: 279561

SEQ ID NO: 352650 - RNA, 64 nt, Homo Sapiens; identical to SEQ ID NO: 279562

SEQ ID NO: 352651 - RNA, 64 nt, Homo Sapiens; identical to SEQ ID NO: 279563

SEQ ID NO: 352652 - RNA, 64 nt, Homo Sapiens; identical to SEQ ID NO: 279564

SEQ ID NO: 352653 - RNA, 64 nt, Homo Sapiens; identical to SEQ ID NO: 279565

SEQ ID NO: 352654 - RNA, 64 nt, Homo Sapiens; identical to SEQ ID NO: 279566

SEQ ID NO: 352655 - RNA, 64 nt, Homo Sapiens; identical to SEQ ID NO: 279567

SEQ ID NO: 352656 - RNA, 64 nt, Homo Sapiens; identical to SEQ ID NO: 279568

SEQ ID NO: 352657 - RNA, 64 nt, Homo Sapiens; identical to SEQ ID NO: 279569

SEQ ID NO: 352658 - RNA, 64 nt, Homo Sapiens; identical to SEQ ID NO: 279570

SEQ ID NO: 352659 - RNA, 64 nt, Homo Sapiens; identical to SEQ ID NO: 279571

SEQ ID NO: 352660 - RNA, 64 nt, Homo Sapiens; identical to SEQ ID NO: 279572

SEQ ID NO: 352661 - RNA, 64 nt, Homo Sapiens; identical to SEQ ID NO: 279573

SEQ ID NO: 352662 - RNA, 61 nt, Homo Sapiens; identical to SEQ ID NO: 279574

SEQ ID NO: 352663 - RNA, 64 nt, Homo Sapiens; identical to SEQ ID NO: 279575

SEQ ID NO: 352664 - RNA, 64 nt, Homo Sapiens; identical to SEQ ID NO: 279576

SEQ ID NO: 352665 - RNA, 64 nt, Homo Sapiens; identical to SEQ ID NO: 279577

SEQ ID NO: 352666 - RNA, 64 nt, Homo Sapiens; identical to SEQ ID NO: 279578

SEQ ID NO: 352667 - RNA, 64 nt, Homo Sapiens; identical to SEQ ID NO: 279579

SEQ ID NO: 352668 - RNA, 63 nt, Homo Sapiens; identical to SEQ ID NO: 279580

SEQ ID NO: 352669 - RNA, 64 nt, Homo Sapiens; identical to SEQ ID NO: 279581

SEQ ID NO: 352670 - RNA, 64 nt, Homo Sapiens; identical to SEQ ID NO: 279582

SEQ ID NO: 352671 - RNA, 64 nt, Homo Sapiens; identical to SEQ ID NO: 279583

SEQ ID NO: 352672 - RNA, 64 nt, Homo Sapiens; identical to SEQ ID NO: 279584

SEQ ID NO: 352673 - RNA, 64 nt, Homo Sapiens; identical to SEQ ID NO: 279585

SEQ ID NO: 352674 - RNA, 64 nt, Homo Sapiens; identical to SEQ ID NO: 279586

SEQ ID NO: 352675 - RNA, 64 nt, Homo Sapiens; identical to SEQ ID NO: 279587

SEQ ID NO: 352676 - RNA, 64 nt, Homo Sapiens; identical to SEQ ID NO: 279588

SEQ ID NO: 352677 - RNA, 64 nt, Homo Sapiens; identical to SEQ ID NO: 279589

SEQ ID NO: 352678 - RNA, 64 nt, Homo Sapiens; identical to SEQ ID NO: 279590

SEQ ID NO: 352679 - RNA, 64 nt, Homo Sapiens; identical to SEQ ID NO: 108616

SEQ ID NO: 352680 - RNA, 64 nt, Homo Sapiens; identical to SEQ ID NO: 108617

SEQ ID NO: 352681 - RNA, 64 nt, Homo Sapiens; identical to SEQ ID NO: 108618

SEQ ID NO: 352682 - RNA, 64 nt, Homo Sapiens; identical to SEQ ID NO: 108619

SEQ ID NO: 352683 - RNA, 64 nt, Homo Sapiens; identical to SEQ ID NO: 108620

SEQ ID NO: 352684 - RNA, 64 nt, Homo Sapiens; identical to SEQ ID NO: 108621

SEQ ID NO: 352685 - RNA, 64 nt, Homo Sapiens; identical to SEQ ID NO: 108622

SEQ ID NO: 352686 - RNA, 64 nt, Homo Sapiens; identical to SEQ ID NO: 108623

SEQ ID NO: 352687 - RNA, 61 nt, Homo Sapiens; identical to SEQ ID NO: 108624

SEQ ID NO: 352688 - RNA, 64 nt, Homo Sapiens; identical to SEQ ID NO: 108625

SEQ ID NO: 352689 - RNA, 64 nt, Homo Sapiens; identical to SEQ ID NO: 108626

SEQ ID NO: 352690 - RNA, 64 nt, Homo Sapiens; identical to SEQ ID NO: 108627

SEQ ID NO: 352691 - RNA, 64 nt, Homo Sapiens; identical to SEQ ID NO: 108628

SEQ ID NO: 352692 - RNA, 64 nt, Homo Sapiens; identical to SEQ ID NO: 108629

SEQ ID NO: 352693 - RNA, 64 nt, Homo Sapiens; identical to SEQ ID NO: 108630

SEQ ID NO: 352694 - RNA, 64 nt, Homo Sapiens; identical to SEQ ID NO: 108631

SEQ ID NO: 352695 - RNA, 64 nt, Homo Sapiens; identical to SEQ ID NO: 108632

SEQ ID NO: 352696 - RNA, 64 nt, Homo Sapiens; identical to SEQ ID NO: 108633

SEQ ID NO: 352697 - RNA, 64 nt, Homo Sapiens; identical to SEQ ID NO: 108634

SEQ ID NO: 352698 - RNA, 64 nt, Homo Sapiens; identical to SEQ ID NO: 108635

SEQ ID NO: 352699 - RNA, 64 nt, Homo Sapiens; identical to SEQ ID NO: 108636

SEQ ID NO: 352700 - RNA, 64 nt, Homo Sapiens; identical to SEQ ID NO: 108637

SEQ ID NO: 352701 - RNA, 64 nt, Homo Sapiens; identical to SEQ ID NO: 108638

SEQ ID NO: 352702 - RNA, 64 nt, Homo Sapiens; identical to SEQ ID NO: 108639

SEQ ID NO: 352703 - RNA, 64 nt, Homo Sapiens; identical to SEQ ID NO: 108640

SEQ ID NO: 352704 - RNA, 64 nt, Homo Sapiens; identical to SEQ ID NO: 108641

SEQ ID NO: 352705 - RNA, 64 nt, Homo Sapiens; identical to SEQ ID NO: 108642

SEQ ID NO: 352706 - RNA, 64 nt, Homo Sapiens; identical to SEQ ID NO: 108643

SEQ ID NO: 352707 - RNA, 64 nt, Homo Sapiens; identical to SEQ ID NO: 108644

SEQ ID NO: 352708 - RNA, 64 nt, Homo Sapiens; identical to SEQ ID NO: 108645

SEQ ID NO: 352709 - RNA, 64 nt, Homo Sapiens; identical to SEQ ID NO: 108646

SEQ ID NO: 352710 - RNA, 64 nt, Homo Sapiens; identical to SEQ ID NO: 108647

SEQ ID NO: 352711 - RNA, 64 nt, Homo Sapiens; identical to SEQ ID NO: 108648

SEQ ID NO: 352712 - RNA, 64 nt, Homo Sapiens; identical to SEQ ID NO: 108649

SEQ ID NO: 352713 - RNA, 64 nt, Homo Sapiens; identical to SEQ ID NO: 108650

SEQ ID NO: 352714 - RNA, 64 nt, Homo Sapiens; identical to SEQ ID NO: 108651

SEQ ID NO: 352715 - RNA, 64 nt, Homo Sapiens; identical to SEQ ID NO: 108652

SEQ ID NO: 352716 - RNA, 64 nt, Homo Sapiens; identical to SEQ ID NO: 108653

SEQ ID NO: 352717 - RNA, 64 nt, Homo Sapiens; identical to SEQ ID NO: 108654

SEQ ID NO: 352718 - RNA, 64 nt, Homo Sapiens; identical to SEQ ID NO: 108655

SEQ ID NO: 352719 - RNA, 64 nt, Homo Sapiens; identical to SEQ ID NO: 108656

SEQ ID NO: 352720 - RNA, 64 nt, Homo Sapiens; identical to SEQ ID NO: 108657

SEQ ID NO: 352721 - RNA, 64 nt, Homo Sapiens; identical to SEQ ID NO: 108658

SEQ ID NO: 352722 - RNA, 64 nt, Homo Sapiens; identical to SEQ ID NO: 108659

SEQ ID NO: 352723 - RNA, 64 nt, Homo Sapiens; identical to SEQ ID NO: 108660

SEQ ID NO: 352724 - RNA, 64 nt, Homo Sapiens; identical to SEQ ID NO: 108661

SEQ ID NO: 352725 - RNA, 64 nt, Homo Sapiens; identical to SEQ ID NO: 108662

SEQ ID NO: 352726 - RNA, 64 nt, Homo Sapiens; identical to SEQ ID NO: 108663

SEQ ID NO: 352727 - RNA, 64 nt, Homo Sapiens; identical to SEQ ID NO: 108664

SEQ ID NO: 352728 - RNA, 64 nt, Homo Sapiens; identical to SEQ ID NO: 108665

SEQ ID NO: 352729 - RNA, 64 nt, Homo Sapiens; identical to SEQ ID NO: 108666

SEQ ID NO: 352730 - RNA, 64 nt, Homo Sapiens; identical to SEQ ID NO: 108667

SEQ ID NO: 352731 - RNA, 64 nt, Homo Sapiens; identical to SEQ ID NO: 108668

SEQ ID NO: 352732 - RNA, 64 nt, Homo Sapiens; identical to SEQ ID NO: 108669

SEQ ID NO: 352733 - RNA, 64 nt, Homo Sapiens; identical to SEQ ID NO: 108670

SEQ ID NO: 352734 - RNA, 64 nt, Homo Sapiens; identical to SEQ ID NO: 108671

SEQ ID NO: 352735 - RNA, 64 nt, Homo Sapiens; identical to SEQ ID NO: 108672

SEQ ID NO: 352736 - RNA, 64 nt, Homo Sapiens; identical to SEQ ID NO: 108673

SEQ ID NO: 352737 - RNA, 64 nt, Homo Sapiens; identical to SEQ ID NO: 108674

SEQ ID NO: 352738 - RNA, 64 nt, Homo Sapiens; identical to SEQ ID NO: 108675

SEQ ID NO: 352739 - RNA, 64 nt, Homo Sapiens; identical to SEQ ID NO: 108676

SEQ ID NO: 352740 - RNA, 64 nt, Homo Sapiens; identical to SEQ ID NO: 108677

SEQ ID NO: 352741 - RNA, 64 nt, Homo Sapiens; identical to SEQ ID NO: 108678

SEQ ID NO: 352742 - RNA, 64 nt, Homo Sapiens; identical to SEQ ID NO: 108679

SEQ ID NO: 352743 - RNA, 64 nt, Homo Sapiens; identical to SEQ ID NO: 108680

SEQ ID NO: 352744 - RNA, 64 nt, Homo Sapiens; identical to SEQ ID NO: 108681

SEQ ID NO: 352745 - RNA, 64 nt, Homo Sapiens; identical to SEQ ID NO: 108682

SEQ ID NO: 352746 - RNA, 64 nt, Homo Sapiens; identical to SEQ ID NO: 108683

SEQ ID NO: 352747 - RNA, 64 nt, Homo Sapiens; identical to SEQ ID NO: 108684

SEQ ID NO: 352748 - RNA, 64 nt, Homo Sapiens; identical to SEQ ID NO: 108685

SEQ ID NO: 352749 - RNA, 64 nt, Homo Sapiens; identical to SEQ ID NO: 108686

SEQ ID NO: 352750 - RNA, 64 nt, Homo Sapiens; identical to SEQ ID NO: 108687

SEQ ID NO: 352751 - RNA, 64 nt, Homo Sapiens; identical to SEQ ID NO: 108688

SEQ ID NO: 352752 - RNA, 64 nt, Homo Sapiens; identical to SEQ ID NO: 108689

SEQ ID NO: 352753 - RNA, 64 nt, Homo Sapiens; identical to SEQ ID NO: 108690

SEQ ID NO: 352754 - RNA, 64 nt, Homo Sapiens; identical to SEQ ID NO: 108691

SEQ ID NO: 352755 - RNA, 64 nt, Homo Sapiens; identical to SEQ ID NO: 108692

SEQ ID NO: 352756 - RNA, 64 nt, Homo Sapiens; identical to SEQ ID NO: 108693

SEQ ID NO: 352757 - RNA, 64 nt, Homo Sapiens; identical to SEQ ID NO: 108694

SEQ ID NO: 352758 - RNA, 64 nt, Homo Sapiens; identical to SEQ ID NO: 108695

SEQ ID NO: 352759 - RNA, 64 nt, Homo Sapiens; identical to SEQ ID NO: 108696

SEQ ID NO: 352760 - RNA, 64 nt, Homo Sapiens; identical to SEQ ID NO: 108697

SEQ ID NO: 352761 - RNA, 64 nt, Homo Sapiens; identical to SEQ ID NO: 108698

SEQ ID NO: 352762 - RNA, 64 nt, Homo Sapiens; identical to SEQ ID NO: 108699

SEQ ID NO: 352763 - RNA, 64 nt, Homo Sapiens; identical to SEQ ID NO: 108700

SEQ ID NO: 352764 - RNA, 64 nt, Homo Sapiens; identical to SEQ ID NO: 108701

SEQ ID NO: 352765 - RNA, 64 nt, Homo Sapiens; identical to SEQ ID NO: 108702

SEQ ID NO: 352766 - RNA, 64 nt, Homo Sapiens; identical to SEQ ID NO: 108703

SEQ ID NO: 352767 - RNA, 64 nt, Homo Sapiens; identical to SEQ ID NO: 108704

SEQ ID NO: 352768 - RNA, 64 nt, Homo Sapiens; identical to SEQ ID NO: 108705

SEQ ID NO: 352769 - RNA, 64 nt, Homo Sapiens; identical to SEQ ID NO: 108706

SEQ ID NO: 352770 - RNA, 64 nt, Homo Sapiens; identical to SEQ ID NO: 108707

SEQ ID NO: 352771 - RNA, 64 nt, Homo Sapiens; identical to SEQ ID NO: 108708

SEQ ID NO: 352772 - RNA, 64 nt, Homo Sapiens; identical to SEQ ID NO: 108709

SEQ ID NO: 352773 - RNA, 64 nt, Homo Sapiens; identical to SEQ ID NO: 108710

SEQ ID NO: 352774 - RNA, 64 nt, Homo Sapiens; identical to SEQ ID NO: 108711

SEQ ID NO: 352775 - RNA, 64 nt, Homo Sapiens; identical to SEQ ID NO: 108712

SEQ ID NO: 352776 - RNA, 64 nt, Homo Sapiens; identical to SEQ ID NO: 108713

SEQ ID NO: 352777 - RNA, 64 nt, Homo Sapiens; identical to SEQ ID NO: 108714

SEQ ID NO: 352778 - RNA, 64 nt, Homo Sapiens; identical to SEQ ID NO: 108715

SEQ ID NO: 352779 - RNA, 64 nt, Homo Sapiens; identical to SEQ ID NO: 108716

SEQ ID NO: 352780 - RNA, 64 nt, Homo Sapiens; identical to SEQ ID NO: 108717

SEQ ID NO: 352781 - RNA, 64 nt, Homo Sapiens; identical to SEQ ID NO: 108718

SEQ ID NO: 352782 - RNA, 64 nt, Homo Sapiens; identical to SEQ ID NO: 108719

SEQ ID NO: 352783 - RNA, 64 nt, Homo Sapiens; identical to SEQ ID NO: 108720

SEQ ID NO: 352784 - RNA, 64 nt, Homo Sapiens; identical to SEQ ID NO: 108721

SEQ ID NO: 352785 - RNA, 64 nt, Homo Sapiens; identical to SEQ ID NO: 108722

SEQ ID NO: 352786 - RNA, 64 nt, Homo Sapiens; identical to SEQ ID NO: 108723

SEQ ID NO: 352787 - RNA, 64 nt, Homo Sapiens; identical to SEQ ID NO: 108724

SEQ ID NO: 352788 - RNA, 64 nt, Homo Sapiens; identical to SEQ ID NO: 108725

SEQ ID NO: 352789 - RNA, 64 nt, Homo Sapiens; identical to SEQ ID NO: 108726

SEQ ID NO: 352790 - RNA, 64 nt, Homo Sapiens; identical to SEQ ID NO: 108727

SEQ ID NO: 352791 - RNA, 64 nt, Homo Sapiens; identical to SEQ ID NO: 108728

SEQ ID NO: 352792 - RNA, 64 nt, Homo Sapiens; identical to SEQ ID NO: 108729

SEQ ID NO: 352793 - RNA, 64 nt, Homo Sapiens; identical to SEQ ID NO: 108730

SEQ ID NO: 352794 - RNA, 64 nt, Homo Sapiens; identical to SEQ ID NO: 108731

SEQ ID NO: 352795 - RNA, 64 nt, Homo Sapiens; identical to SEQ ID NO: 108732

SEQ ID NO: 352796 - RNA, 64 nt, Homo Sapiens; identical to SEQ ID NO: 108733

SEQ ID NO: 352797 - RNA, 64 nt, Homo Sapiens; identical to SEQ ID NO: 108734

SEQ ID NO: 352798 - RNA, 64 nt, Homo Sapiens; identical to SEQ ID NO: 108735

SEQ ID NO: 352799 - RNA, 64 nt, Homo Sapiens; identical to SEQ ID NO: 108736

SEQ ID NO: 352800 - RNA, 64 nt, Homo Sapiens; identical to SEQ ID NO: 108737

SEQ ID NO: 352801 - RNA, 64 nt, Homo Sapiens; identical to SEQ ID NO: 108738

SEQ ID NO: 352802 - RNA, 64 nt, Homo Sapiens; identical to SEQ ID NO: 108739

SEQ ID NO: 352803 - RNA, 64 nt, Homo Sapiens; identical to SEQ ID NO: 108740

SEQ ID NO: 352804 - RNA, 64 nt, Homo Sapiens; identical to SEQ ID NO: 108741

SEQ ID NO: 352805 - RNA, 64 nt, Homo Sapiens; identical to SEQ ID NO: 108742

SEQ ID NO: 352806 - RNA, 64 nt, Homo Sapiens; identical to SEQ ID NO: 108743

SEQ ID NO: 352807 - RNA, 64 nt, Homo Sapiens; identical to SEQ ID NO: 108744

SEQ ID NO: 352808 - RNA, 64 nt, Homo Sapiens; identical to SEQ ID NO: 108745

SEQ ID NO: 352809 - RNA, 64 nt, Homo Sapiens; identical to SEQ ID NO: 108746

SEQ ID NO: 352810 - RNA, 64 nt, Homo Sapiens; identical to SEQ ID NO: 108747

SEQ ID NO: 352811 - RNA, 64 nt, Homo Sapiens; identical to SEQ ID NO: 108748

SEQ ID NO: 352812 - RNA, 64 nt, Homo Sapiens; identical to SEQ ID NO: 108749

SEQ ID NO: 352813 - RNA, 64 nt, Homo Sapiens; identical to SEQ ID NO: 108750

SEQ ID NO: 352814 - RNA, 64 nt, Homo Sapiens; identical to SEQ ID NO: 108751

SEQ ID NO: 352815 - RNA, 64 nt, Homo Sapiens; identical to SEQ ID NO: 108752

SEQ ID NO: 352816 - RNA, 64 nt, Homo Sapiens; identical to SEQ ID NO: 108753

SEQ ID NO: 352817 - RNA, 64 nt, Homo Sapiens; identical to SEQ ID NO: 108754

SEQ ID NO: 352818 - RNA, 64 nt, Homo Sapiens; identical to SEQ ID NO: 108755

SEQ ID NO: 352819 - RNA, 64 nt, Homo Sapiens; identical to SEQ ID NO: 108756

SEQ ID NO: 352820 - RNA, 64 nt, Homo Sapiens; identical to SEQ ID NO: 108757

SEQ ID NO: 352821 - RNA, 64 nt, Homo Sapiens; identical to SEQ ID NO: 108758

SEQ ID NO: 352822 - RNA, 64 nt, Homo Sapiens; identical to SEQ ID NO: 108759

SEQ ID NO: 352823 - RNA, 64 nt, Homo Sapiens; identical to SEQ ID NO: 108760

SEQ ID NO: 352824 - RNA, 64 nt, Homo Sapiens; identical to SEQ ID NO: 108761

SEQ ID NO: 352825 - RNA, 64 nt, Homo Sapiens; identical to SEQ ID NO: 108762

SEQ ID NO: 352826 - RNA, 64 nt, Homo Sapiens; identical to SEQ ID NO: 108763

SEQ ID NO: 352827 - RNA, 64 nt, Homo Sapiens; identical to SEQ ID NO: 108764

SEQ ID NO: 352828 - RNA, 64 nt, Homo Sapiens; identical to SEQ ID NO: 108765

SEQ ID NO: 352829 - RNA, 64 nt, Homo Sapiens
ggggacagucuggccaacuuuuuuguuuaauaccuuccccaagagaggagauacuuauuggucu

SEQ ID NO: 352830 - RNA, 64 nt, Homo Sapiens
ugucaauugaaaucuuaacuagccagcacaucccuuccccaaacucuaaagucauuuaacuaau

SEQ ID NO: 352831 - RNA, 64 nt, Homo Sapiens
uuaaaggcccugcagaaauaauuauuauaugugcuuccccaaguaaauaacaauauagaacaac

SEQ ID NO: 352832 - RNA, 64 nt, Homo Sapiens
acaguuccaaugugccuguucacucaccucucccuuccccaacccuucucuacuuggcugcugu

SEQ ID NO: 352833 - RNA, 64 nt, Homo Sapiens
cuucucuacuuggcugcuguuuuaaaguuugcccuuccccaaauuuggauuuuuauuacagauc

SEQ ID NO: 352834 - RNA, 64 nt, Homo Sapiens
ucuguaguacguaguuuugucuuaccuguuaacuuuccccaauugagauaaaaguguuuuaaaa

SEQ ID NO: 352835 - RNA, 64 nt, Homo Sapiens
uuugaacacugcccaucagcuacagucauuacuguuccccaacccacaacuaucuuuuaagaag

SEQ ID NO: 352836 - RNA, 64 nt, Homo Sapiens
acagauagcucaccuuggaccugugguccuuuucuuccccaacauauuuaaucuucccuguucu

SEQ ID NO: 352837 - RNA, 64 nt, Homo Sapiens
gcccauuugcccacuucccaccccuccugacagguuccccaacaauggaucccugggccccacu

SEQ ID NO: 352838 - RNA, 64 nt, Homo Sapiens
uuuucuucuaagccuguguguuauaauuuaccaguuccccaaaaugccauuuuuaacgccgaac

SEQ ID NO: 352839 - RNA, 64 nt, Homo Sapiens
uguaaauaaaauaaaaaauauuugucuccaccuuuuccccaaaagcaacagcaagacauauuuu

SEQ ID NO: 352840 - RNA, 64 nt, Homo Sapiens
ugcacaggaggccagaaaccugguaaacugugguuuccccaagcuuuaucaucagcucuuucag

SEQ ID NO: 352841 - RNA, 64 nt, Homo Sapiens
uaggacuuuuaugggcucggcaaagcuaugucuauuccccaauagguggcaucucaggggaaca

SEQ ID NO: 352842 - RNA, 64 nt, Homo Sapiens
gauucucauguuaaccaaguuuuaaaaguucaaauuccccaaaaaggcuuguccaaggcuggcc

SEQ ID NO: 352843 - RNA, 64 nt, Homo Sapiens
agggauuacuuagaagacauuuuuguacaugcucuuccccaaggauuguacguauuauacaaau

SEQ ID NO: 352844 - RNA, 64 nt, Homo Sapiens
ucuuaauugcuuuauuuuggucuuguacuuugaauuccccaaagaguaauaaucguuuuuguuu

SEQ ID NO: 352845 - RNA, 64 nt, Homo Sapiens
agacaauuuguuguacccauaauaauucuuggucuuccccaaagacuagccccaguuuugacag

SEQ ID NO: 352846 - RNA, 64 nt, Homo Sapiens
uccccugagcagugugagcucucacaccucgcuguuccccaacagccgggcucugaggccacac

SEQ ID NO: 352847 - RNA, 64 nt, Homo Sapiens
ucuguuuugaagccugcaauccccgcagaggggcuuccccaagccugaggauucccuagggcug

SEQ ID NO: 352848 - RNA, 64 nt, Homo Sapiens
uuuccaugaauugcauuuuuuggagacuuacauauuccccaaucaaugaaaauucauguccaua

SEQ ID NO: 352849 - RNA, 64 nt, Homo Sapiens
gugaugaucucaaguccuuucaaaguuuuucucuuuccccaaaagcuauauauuauucuagcau

SEQ ID NO: 352850 - RNA, 64 nt, Homo Sapiens
aaucuuacaaaguguugguccagagucccaucucuuccccaacccuggauaccaguagcuuccc

SEQ ID NO: 352851 - RNA, 64 nt, Homo Sapiens
aagcaagggcacagggauuagaccuguggcacacuuccccaauucccucaucuguaggauuugg

SEQ ID NO: 352852 - RNA, 64 nt, Homo Sapiens
uugaucacuccgccuucuccugccacaucuugucuuccccaaaaauuacuuuugugaacgcuuc

SEQ ID NO: 352853 - RNA, 64 nt, Homo Sapiens
aucugccagagaacuccuaucucagccugaaaguuuccccaaccaugucugcuugagauauuuc

SEQ ID NO: 352854 - RNA, 64 nt, Homo Sapiens
ccuggccuucacugucucccuugcccuuugacuuuuccccaaucaaagggaacugcagugcugg

SEQ ID NO: 352855 - RNA, 64 nt, Homo Sapiens
aaccaagccccauggccucagaauuuccccccaguuccccaagugucucuggggaccugaagcc

SEQ ID NO: 352856 - RNA, 64 nt, Homo Sapiens
ccaggggaguggguaggccauagccaaggaucgauuccccaaccacagcaaaggcaacacucuu

SEQ ID NO: 352857 - RNA, 64 nt, Homo Sapiens
gggcugguccagguagcucuccugaaccuccuccuuccccaagcugagaagcugagagcuggag

SEQ ID NO: 352858 - RNA, 64 nt, Homo Sapiens
ucagaauugcucaaagaaaauuuccuuucuuuuuuuccccaaaguccugcuuauuuauaaauca

SEQ ID NO: 352859 - RNA, 64 nt, Homo Sapiens
auuaaacucuaauguaccaaaaaaccacuuuuuuuuccccaaguaaucccagauaugguugcac

SEQ ID NO: 352860 - RNA, 64 nt, Homo Sapiens
cccucagaagcagauuauucuaauuuauuuuaucuuccccaaggucuaagcacuuuacuuguau

SEQ ID NO: 352861 - RNA, 64 nt, Homo Sapiens
cauaugccccucugaaguuguuccuuuuagcuaauuccccaaccugggcaggagaaagagcaga

SEQ ID NO: 352862 - RNA, 64 nt, Homo Sapiens
ggcuggccuugugcagacccuggacugcauccgguuccccaaagcccugcugcauucgaguguc

SEQ ID NO: 352863 - RNA, 64 nt, Homo Sapiens
aggccagggccccuguucuagggguuaggguucuuuccccaaaggaacuuaaaaagacaagcgu

SEQ ID NO: 352864 - RNA, 64 nt, Homo Sapiens
cacccaagccccgugcuagcagcgcuccgugcucuuccccaaauacucacggcucuaauucccc

SEQ ID NO: 352865 - RNA, 64 nt, Homo Sapiens
cuccgugcucuuccccaaauacucacggcucuaauuccccaaaccugaaacuucauacccuggg

SEQ ID NO: 352866 - RNA, 64 nt, Homo Sapiens
aauacccuugugauuucuuauggacacugaucacuuccccaauccacaaauugugaagauuuca

SEQ ID NO: 352867 - RNA, 64 nt, Homo Sapiens
uaauacuuuuauaauuuccuuggacauuuauuaguuccccaaaucguggauugugaagauuuca

SEQ ID NO: 352868 - RNA, 64 nt, Homo Sapiens
uggaccuuuuuuuuuucuaaacuguuuguuuuacuuccccaaaaacagugcuacacucgucucc

SEQ ID NO: 352869 - RNA, 64 nt, Homo Sapiens
caagacaaucgaggucuggcaccuccccacuuuuuuccccaagagugguuaggacaucuccccc

SEQ ID NO: 352870 - RNA, 64 nt, Homo Sapiens; identical to SEQ ID NO: 102089

SEQ ID NO: 352871 - RNA, 64 nt, Homo Sapiens; identical to SEQ ID NO: 102090

SEQ ID NO: 352872 - RNA, 64 nt, Homo Sapiens; identical to SEQ ID NO: 102091

SEQ ID NO: 352873 - RNA, 64 nt, Homo Sapiens; identical to SEQ ID NO: 102092

SEQ ID NO: 352874 - RNA, 64 nt, Homo Sapiens; identical to SEQ ID NO: 102093

SEQ ID NO: 352875 - RNA, 64 nt, Homo Sapiens; identical to SEQ ID NO: 102094

SEQ ID NO: 352876 - RNA, 64 nt, Homo Sapiens; identical to SEQ ID NO: 102095

SEQ ID NO: 352877 - RNA, 64 nt, Homo Sapiens; identical to SEQ ID NO: 102096

SEQ ID NO: 352878 - RNA, 64 nt, Homo Sapiens; identical to SEQ ID NO: 171556

SEQ ID NO: 352879 - RNA, 64 nt, Homo Sapiens; identical to SEQ ID NO: 171557

SEQ ID NO: 352880 - RNA, 64 nt, Homo Sapiens; identical to SEQ ID NO: 171558

SEQ ID NO: 352881 - RNA, 64 nt, Homo Sapiens; identical to SEQ ID NO: 171559

SEQ ID NO: 352882 - RNA, 64 nt, Homo Sapiens; identical to SEQ ID NO: 171560

SEQ ID NO: 352883 - RNA, 64 nt, Homo Sapiens; identical to SEQ ID NO: 171561

SEQ ID NO: 352884 - RNA, 64 nt, Homo Sapiens; identical to SEQ ID NO: 171562

SEQ ID NO: 352885 - RNA, 64 nt, Homo Sapiens; identical to SEQ ID NO: 171563

SEQ ID NO: 352886 - RNA, 64 nt, Homo Sapiens; identical to SEQ ID NO: 171564

SEQ ID NO: 352887 - RNA, 64 nt, Homo Sapiens; identical to SEQ ID NO: 171565

SEQ ID NO: 352888 - RNA, 64 nt, Homo Sapiens; identical to SEQ ID NO: 171566

SEQ ID NO: 352889 - RNA, 64 nt, Homo Sapiens; identical to SEQ ID NO: 171567

SEQ ID NO: 352890 - RNA, 64 nt, Homo Sapiens; identical to SEQ ID NO: 171568

SEQ ID NO: 352891 - RNA, 64 nt, Homo Sapiens; identical to SEQ ID NO: 171569

SEQ ID NO: 352892 - RNA, 64 nt, Homo Sapiens; identical to SEQ ID NO: 171570

SEQ ID NO: 352893 - RNA, 64 nt, Homo Sapiens; identical to SEQ ID NO: 171571

SEQ ID NO: 352894 - RNA, 64 nt, Homo Sapiens; identical to SEQ ID NO: 171572

SEQ ID NO: 352895 - RNA, 64 nt, Homo Sapiens; identical to SEQ ID NO: 171573

SEQ ID NO: 352896 - RNA, 64 nt, Homo Sapiens; identical to SEQ ID NO: 171574

SEQ ID NO: 352897 - RNA, 64 nt, Homo Sapiens; identical to SEQ ID NO: 171575

SEQ ID NO: 352898 - RNA, 64 nt, Homo Sapiens; identical to SEQ ID NO: 171576

SEQ ID NO: 352899 - RNA, 64 nt, Homo Sapiens; identical to SEQ ID NO: 171577

SEQ ID NO: 352900 - RNA, 64 nt, Homo Sapiens; identical to SEQ ID NO: 171578

SEQ ID NO: 352901 - RNA, 64 nt, Homo Sapiens; identical to SEQ ID NO: 171579

SEQ ID NO: 352902 - RNA, 64 nt, Homo Sapiens; identical to SEQ ID NO: 171580

SEQ ID NO: 352903 - RNA, 64 nt, Homo Sapiens; identical to SEQ ID NO: 171581

SEQ ID NO: 352904 - RNA, 64 nt, Homo Sapiens; identical to SEQ ID NO: 171582

SEQ ID NO: 352905 - RNA, 64 nt, Homo Sapiens; identical to SEQ ID NO: 171583

SEQ ID NO: 352906 - RNA, 64 nt, Homo Sapiens; identical to SEQ ID NO: 171584

SEQ ID NO: 352907 - RNA, 64 nt, Homo Sapiens; identical to SEQ ID NO: 171585

SEQ ID NO: 352908 - RNA, 64 nt, Homo Sapiens; identical to SEQ ID NO: 171586

SEQ ID NO: 352909 - RNA, 64 nt, Homo Sapiens; identical to SEQ ID NO: 171587

SEQ ID NO: 352910 - RNA, 64 nt, Homo Sapiens; identical to SEQ ID NO: 171588

SEQ ID NO: 352911 - RNA, 64 nt, Homo Sapiens; identical to SEQ ID NO: 171589

SEQ ID NO: 352912 - RNA, 64 nt, Homo Sapiens; identical to SEQ ID NO: 171590

SEQ ID NO: 352913 - RNA, 64 nt, Homo Sapiens; identical to SEQ ID NO: 171591

SEQ ID NO: 352914 - RNA, 64 nt, Homo Sapiens; identical to SEQ ID NO: 171592

SEQ ID NO: 352915 - RNA, 64 nt, Homo Sapiens; identical to SEQ ID NO: 171593

SEQ ID NO: 352916 - RNA, 64 nt, Homo Sapiens; identical to SEQ ID NO: 171594

SEQ ID NO: 352917 - RNA, 64 nt, Homo Sapiens; identical to SEQ ID NO: 171595

SEQ ID NO: 352918 - RNA, 64 nt, Homo Sapiens; identical to SEQ ID NO: 171596

SEQ ID NO: 352919 - RNA, 64 nt, Homo Sapiens; identical to SEQ ID NO: 171597

SEQ ID NO: 352920 - RNA, 64 nt, Homo Sapiens; identical to SEQ ID NO: 171598

SEQ ID NO: 352921 - RNA, 64 nt, Homo Sapiens; identical to SEQ ID NO: 171599

SEQ ID NO: 352922 - RNA, 64 nt, Homo Sapiens; identical to SEQ ID NO: 171600

SEQ ID NO: 352923 - RNA, 64 nt, Homo Sapiens; identical to SEQ ID NO: 171601

SEQ ID NO: 352924 - RNA, 64 nt, Homo Sapiens; identical to SEQ ID NO: 171602

SEQ ID NO: 352925 - RNA, 64 nt, Homo Sapiens; identical to SEQ ID NO: 171603

SEQ ID NO: 352926 - RNA, 64 nt, Homo Sapiens; identical to SEQ ID NO: 171604

SEQ ID NO: 352927 - RNA, 64 nt, Homo Sapiens; identical to SEQ ID NO: 171605

SEQ ID NO: 352928 - RNA, 64 nt, Homo Sapiens; identical to SEQ ID NO: 171606

SEQ ID NO: 352929 - RNA, 64 nt, Homo Sapiens; identical to SEQ ID NO: 171607

SEQ ID NO: 352930 - RNA, 64 nt, Homo Sapiens; identical to SEQ ID NO: 171608

SEQ ID NO: 352931 - RNA, 64 nt, Homo Sapiens; identical to SEQ ID NO: 171609

SEQ ID NO: 352932 - RNA, 64 nt, Homo Sapiens; identical to SEQ ID NO: 171610

SEQ ID NO: 352933 - RNA, 64 nt, Homo Sapiens; identical to SEQ ID NO: 171611

SEQ ID NO: 352934 - RNA, 64 nt, Homo Sapiens; identical to SEQ ID NO: 171612

SEQ ID NO: 352935 - RNA, 64 nt, Homo Sapiens; identical to SEQ ID NO: 171613

SEQ ID NO: 352936 - RNA, 64 nt, Homo Sapiens; identical to SEQ ID NO: 171614

SEQ ID NO: 352937 - RNA, 64 nt, Homo Sapiens; identical to SEQ ID NO: 171615

SEQ ID NO: 352938 - RNA, 64 nt, Homo Sapiens; identical to SEQ ID NO: 171616

SEQ ID NO: 352939 - RNA, 64 nt, Homo Sapiens; identical to SEQ ID NO: 171617

SEQ ID NO: 352940 - RNA, 64 nt, Homo Sapiens; identical to SEQ ID NO: 171618

SEQ ID NO: 352941 - RNA, 64 nt, Homo Sapiens; identical to SEQ ID NO: 171619

SEQ ID NO: 352942 - RNA, 64 nt, Homo Sapiens; identical to SEQ ID NO: 171620

SEQ ID NO: 352943 - RNA, 64 nt, Homo Sapiens; identical to SEQ ID NO: 171621

SEQ ID NO: 352944 - RNA, 64 nt, Homo Sapiens; identical to SEQ ID NO: 171622

SEQ ID NO: 352945 - RNA, 64 nt, Homo Sapiens; identical to SEQ ID NO: 171623

SEQ ID NO: 352946 - RNA, 64 nt, Homo Sapiens; identical to SEQ ID NO: 171624

SEQ ID NO: 352947 - RNA, 64 nt, Homo Sapiens; identical to SEQ ID NO: 171625

SEQ ID NO: 352948 - RNA, 64 nt, Homo Sapiens; identical to SEQ ID NO: 171626

SEQ ID NO: 352949 - RNA, 64 nt, Homo Sapiens; identical to SEQ ID NO: 171627

SEQ ID NO: 352950 - RNA, 64 nt, Homo Sapiens; identical to SEQ ID NO: 171628

SEQ ID NO: 352951 - RNA, 64 nt, Homo Sapiens
gucuuuuuacccccaagauaucugucuucaguagcgacugaaucugccacucucagaauaaguu

SEQ ID NO: 352952 - RNA, 50 nt, Homo Sapiens
uccaggacacaaaugugugacgacugaaaucaggaagauuuuucuaucag

SEQ ID NO: 352953 - RNA, 64 nt, Homo Sapiens
ggaggacacaguuucuauuguaaauuuggauuuacgacugaagaaggacauuuucucuuuaaaa

SEQ ID NO: 352954 - RNA, 64 nt, Homo Sapiens
aaauuuucucuuugaaaauccaggccuuccugcucgacugaaaaucaguaaagccuccuggcac

SEQ ID NO: 352955 - RNA, 64 nt, Homo Sapiens
agaucggauugcucuuugaucacacauacacacacgacugaauccacacacacacacacacaca

SEQ ID NO: 352956 - RNA, 64 nt, Homo Sapiens
acugcacuccagccggggugacagagugagacuccgacugaaaauaaauaaauaaauaaauaaa

SEQ ID NO: 352957 - RNA, 64 nt, Homo Sapiens
uuccacuuucuucaucuuguaaacacuguauuuucgacugaaaacuuuugauacgaucuuguga

SEQ ID NO: 352958 - RNA, 64 nt, Homo Sapiens
uuaaugaaagggauguucaugacagcaucauauacgacugaaagaagaaaacuagauuuucaac

SEQ ID NO: 352959 - RNA, 64 nt, Homo Sapiens
aagcacuuguuucaaguuuuguucugcacucccacgacugaaguuguagauugagcugaauaac

SEQ ID NO: 352960 - RNA, 64 nt, Homo Sapiens
aguucaucugaugccucugaugaaaaaaagaacacgacugaaaagcaguugguugaauaauuau

SEQ ID NO: 352961 - RNA, 64 nt, Homo Sapiens
gauuuuuuuuuaauaaacugcaucgagauccaaccgacugaauuguuaaaaaaaaaaaaaauaa

SEQ ID NO: 352962 - RNA, 64 nt, Homo Sapiens
uggaauccuaguaaaaguguacuuuaauaaacugcgacugaacggguggauggagacacuucua

SEQ ID NO: 352963 - RNA, 64 nt, Homo Sapiens
gucuuuuuggggguuucagaguggccggagaaaccgacugaagggacugaccagcuagcuagga

SEQ ID NO: 352964 - RNA, 64 nt, Homo Sapiens
aaacauuaggagaggcaaaauuuuuaauuuuaaacgacugaagagguuuuucuuuuuauuuuuu

SEQ ID NO: 352965 - RNA, 64 nt, Homo Sapiens
auacaaacagucucuuaguuugcaaaguguuaaacgacugaaauguacuacuggaacuaaugac

SEQ ID NO: 352966 - RNA, 64 nt, Homo Sapiens
ccagccgggcuccugaagcccgcugaaaggucagcgacugaaggccuugcagacaaccgucugg

SEQ ID NO: 352967 - RNA, 64 nt, Homo Sapiens
ugacuuccauuuggcaauuguugaauuauaacugcgacugaaacaaacagguucauagagauga

SEQ ID NO: 352968 - RNA, 64 nt, Homo Sapiens
cugagggggccgacagugcccuccaagacagagacgacugaacuuuugggguggagacuagagg

SEQ ID NO: 352969 - RNA, 64 nt, Homo Sapiens
uagaagucuguccgucuaugcagcucuuuucuagcgacugaaaggccugaggggacaccagacu

SEQ ID NO: 352970 - RNA, 64 nt, Homo Sapiens
ugugaaacgacacuguauuguuucccaugaguugcgacugaaaauccgcaguguccaaaccuag

SEQ ID NO: 352971 - RNA, 64 nt, Homo Sapiens
uuucagcaauuccugcagagccugcagcccaggacgacugaagcucuugcagccccugcagacg

SEQ ID NO: 352972 - RNA, 64 nt, Homo Sapiens
gcagcacagacugccaaguacuguuuuuuuuaaccgacugaaaucacuuugggauauuuuuucc

SEQ ID NO: 352973 - RNA, 64 nt, Homo Sapiens
ugggaagaggaguacacgguagcccggaucugugcgacugaagguggugcgggcaggaggcggg

SEQ ID NO: 352974 - RNA, 64 nt, Homo Sapiens
agggaaaaguuagggaacccauuugcucucuagacgacugaauaaaacgggggaauuacugugu

SEQ ID NO: 352975 - RNA, 64 nt, Homo Sapiens
cacuuuaguauaaagggcacgggcuuaaacauuacgacugaaugaacauacagaaggaauuuag

SEQ ID NO: 352976 - RNA, 64 nt, Homo Sapiens
uggaacccuuguccuccgcuugaagggguaaacccgacugaaaccuagagacuucacccggggg

SEQ ID NO: 352977 - RNA, 64 nt, Homo Sapiens
agucagcaaccauuuuacuuuguguguuuuuucacgacugaacaccagcugcuaucaagcaagc

SEQ ID NO: 352978 - RNA, 64 nt, Homo Sapiens
ugccugcagguaucacuuugauccuaugugggagcgacugaaaauagaaugagcuugguuaagc

SEQ ID NO: 352979 - RNA, 64 nt, Homo Sapiens
guccuggggcucuccaggcagugggguuaugugucgacugaagggugaugugcagaagagcuug

SEQ ID NO: 352980 - RNA, 64 nt, Homo Sapiens
aagcaucugaagacuggguuggcacuuccagguucgacugaauccgagugccugccucggcugu

SEQ ID NO: 352981 - RNA, 64 nt, Homo Sapiens
gaugccauccaaguuguauauuuuuuuaaucucucgacugaauggacuuugcacacuuuggccc

SEQ ID NO: 352982 - RNA, 64 nt, Homo Sapiens
auaaaacuggguugagggaugcuggaaccaguuacgacugaagucaguguagaccugagcuggg

SEQ ID NO: 352983 - RNA, 64 nt, Homo Sapiens
uacaccuguaaacgaguagcggagauuuguucagcgacugaauaacacgaacagugccccuaac

SEQ ID NO: 352984 - RNA, 64 nt, Homo Sapiens
aaacucugucucaaaaaaaacacuccagccugggcgacugaauagcgccgagauagcgccauug

SEQ ID NO: 352985 - RNA, 64 nt, Homo Sapiens
cuccugcaagagggcaacuccagccaguguucagcgacugaacagccaauaggagcccuugguu

SEQ ID NO: 352986 - RNA, 64 nt, Homo Sapiens
ccauaucaguaacuucgagugaguuuccuaaggccgacugaagcucuguuuacacauaagagug

SEQ ID NO: 352987 - RNA, 64 nt, Homo Sapiens
gaaauugcuuuguauuguauauuacaaugaucaccgacugaaaauauuguuuuacaauaguucu

SEQ ID NO: 352988 - RNA, 64 nt, Homo Sapiens
gugcucagugggagccaggaagccucaggcuucacgacugaaugcacccaauauccgaccuggc

SEQ ID NO: 352989 - RNA, 64 nt, Homo Sapiens
gugugggauuuccgaggcccuguucgcaguuugccgacugaagacguggcagauuuccuguucu

SEQ ID NO: 352990 - RNA, 64 nt, Homo Sapiens
uagacaucaggugaggaugauggagguagacagucgacugaaugucagcuggaaaauccaguca

SEQ ID NO: 352991 - RNA, 64 nt, Homo Sapiens
ccuuucuugucuccuuuggaaucauucaacuuaacgacugaagcgguuuucuccuugggguuga

SEQ ID NO: 352992 - RNA, 64 nt, Homo Sapiens
gguguugcaccuaaucaucaguccaucuuacaaccgacugaagguuaauaccuauacacacuaa

SEQ ID NO: 352993 - RNA, 64 nt, Homo Sapiens
cugucacauagcucugacguuuuguuguaauaaauguuuucaggccgggcacuguggcucacgc

SEQ ID NO: 352994 - RNA, 64 nt, Homo Sapiens
aaauaauaauaauaauaaauaaauaaaaaauaaauguuuucaguaaaaccagccugggguuggu

SEQ ID NO: 352995 - RNA, 64 nt, Homo Sapiens
gucuuucuuuuuuuguuuuuguuuucuguuuguuuguuuucauguugaaugcccacaccaccau

SEQ ID NO: 352996 - RNA, 64 nt, Homo Sapiens
uuaauuaucacauuuuaaauuacuuuguggacuguguuuucaaaacuuugcaaauucaucuguu

SEQ ID NO: 352997 - RNA, 64 nt, Homo Sapiens
cugcagaagaaaauuuugcucuuauaaaaccucauguuuucaucauucccaucuuuucuuuuua

SEQ ID NO: 352998 - RNA, 64 nt, Homo Sapiens
guaccaaugaacacauccagcugaucccaaaagcuguuuucagguauaaggacaaggagaggag

SEQ ID NO: 352999 - RNA, 64 nt, Homo Sapiens
acuacuggcaaggaacuuacccagcuguuauacauguuuucaguucucuuugggggccaugucc

SEQ ID NO: 353000 - RNA, 64 nt, Homo Sapiens
ugucugacuuugaaauuccauuuacaauguaguauguuuucaaugaaaaaccauaaaguaacau

SEQ ID NO: 353001 - RNA, 64 nt, Homo Sapiens
gccuuugucucucagacucucuaucauaaauacauguuuucacauauuuuucugaguuuguuuu

SEQ ID NO: 353002 - RNA, 64 nt, Homo Sapiens
auuuuuguuuccuuuucuuguuugugugaugagauguuuucauccagagaccccaucacugagu

SEQ ID NO: 353003 - RNA, 64 nt, Homo Sapiens
ucagaacacugauaacacucagaaaaccacaguguguuuucauauuuggaacuuuguaauagcg

SEQ ID NO: 353004 - RNA, 64 nt, Homo Sapiens
aaacauccuaugaauuugaaaguuuccuaaguguuguuuucaaagaacugguuuauuuuauagu

SEQ ID NO: 353005 - RNA, 64 nt, Homo Sapiens
ugcaaauuguuuuuauuuaaagauggugagaaaguguuuucauuaaaauauguuuucaaaacca

SEQ ID NO: 353006 - RNA, 64 nt, Homo Sapiens
uuaaagauggugagaaaguguuuucauuaaaauauguuuucaaaaccauuuucaggccgggcac

SEQ ID NO: 353007 - RNA, 64 nt, Homo Sapiens
aauauuuuaggauuuauucaaaaacagacuauucuguuuucagcuucagaauuguucuuugaau

SEQ ID NO: 353008 - RNA, 64 nt, Homo Sapiens
uuuauuuuauuauccuauuuucuaccauuaucuauguuuucauggugcuauuaauuacaaguuu

SEQ ID NO: 353009 - RNA, 64 nt, Homo Sapiens
acugaacuuguaauuugaaucuaguaugguguucuguuuucagcugacuuggacaaccugacug

SEQ ID NO: 353010 - RNA, 64 nt, Homo Sapiens
ugcagcaagaggaccccgcucucuucaggaaaaguguuuucauuucucaggaugcuucuuaccu

SEQ ID NO: 353011 - RNA, 64 nt, Homo Sapiens
agaagcaacuugcauuagagagggaacuguuaaauguuuucaacccaguucaucugguggaugu

SEQ ID NO: 353012 - RNA, 64 nt, Homo Sapiens
auuuuaggaauuacugcuuuuagauacuuuaucauguuuucaugaauguucauuuuuuucugua

SEQ ID NO: 353013 - RNA, 64 nt, Homo Sapiens
auaugauauuaagaaagcguauuauagguacaucuguuuucacuuaugcuaucuguaggcugaa

SEQ ID NO: 353014 - RNA, 64 nt, Homo Sapiens
gaaagagugggguggcuguucacccuccucagaauguuuucagccauuccaggauaacagcuug

SEQ ID NO: 353015 - RNA, 64 nt, Homo Sapiens
ucaaacauguaugaguagucaaugugucaggcuguguuuucacugacacagcaauuuaaauuau

SEQ ID NO: 353016 - RNA, 64 nt, Homo Sapiens
uucuuguugguguccuuugaccccuucuguggauuguuuucaguaugacugguaaaaauguucu

SEQ ID NO: 353017 - RNA, 64 nt, Homo Sapiens
ucuuuuagcaauauacauaguuuguguggacauauguuuucauuugaacauauuucuacaagau

SEQ ID NO: 353018 - RNA, 64 nt, Homo Sapiens
uugcuuuuuuaggggaaauauaauuucucaggauuguuuucaaauuacuucuguguccuaaggg

SEQ ID NO: 353019 - RNA, 64 nt, Homo Sapiens
uguaagaaaaggcccauuacauaaccaauaccuuuguuuucaugccaaauaauguguagucucu

SEQ ID NO: 353020 - RNA, 64 nt, Homo Sapiens
aacaagaauugaguugauggaugcuuccaggauuuguuuucagacagaaguguuucuggaagug

SEQ ID NO: 353021 - RNA, 64 nt, Homo Sapiens
ugccaagcacuucaggccuauguuuugcuuauauuguuuucaggugcucaaaaugcaaaacaca

SEQ ID NO: 353022 - RNA, 64 nt, Homo Sapiens
ucaaaauaaaauaucauauaaauauugagggaaauguuuucauauuuuucaaaauagguuuuua

SEQ ID NO: 353023 - RNA, 64 nt, Homo Sapiens
aaaguauguuuugcauguauuguuccaaguuaaguguuuucagaauuuguguaguuuggugcuu

SEQ ID NO: 353024 - RNA, 64 nt, Homo Sapiens
cugcauuuguguaguuugguuggaguugaaaugcuguuuucauuuuuacgaugacuacuuuugg

SEQ ID NO: 353025 - RNA, 64 nt, Homo Sapiens
uauagaguuuauaaaaugacuauggauaggggacuguuuucacuuuuagaucaaaauggguuuu

SEQ ID NO: 353026 - RNA, 64 nt, Homo Sapiens
agaguggaggaggcuggccaaagagacugugggcuguuuucagucagggagcaugugcauuguu

SEQ ID NO: 353027 - RNA, 64 nt, Homo Sapiens
ucaaucuggauucauauuuaauuugaagguagaauguuuucaaauguucuccagucauuauguu

SEQ ID NO: 353028 - RNA, 64 nt, Homo Sapiens
uuucuggcuuagaacaaaggggcuuaauuauugauguuuucauagagaauauaaaaauaaagca

SEQ ID NO: 353029 - RNA, 64 nt, Homo Sapiens
guaaucaagaaaguuagucauguuuuauguaccauguuuucacacgugucucuucucuucgacu

SEQ ID NO: 353030 - RNA, 64 nt, Homo Sapiens
gauuuguuugguauaaauaaagaauuauuuguuuuguuuucaaugacaguaagcuacaaaucau

SEQ ID NO: 353031 - RNA, 64 nt, Homo Sapiens
uuauacguuuuuuugagauguguaacucucucauuguuuucauucaguuaagaaccacugacaa

SEQ ID NO: 353032 - RNA, 64 nt, Homo Sapiens
uucuaaaguccacuucaguugaacuuagguauaguguuuucaaacucacaaucuucacaaagua

SEQ ID NO: 353033 - RNA, 64 nt, Homo Sapiens
uugacgcucuucuuuucauuccaaauuugguguuuguuuucaccgagcaaucaguauuauugga

SEQ ID NO: 353034 - RNA, 64 nt, Homo Sapiens
aaucuaaggugcaauuucuauaggcccugguucauguuuucaucgaucaguggccauauuacug

SEQ ID NO: 353035 - RNA, 64 nt, Homo Sapiens
uuaccuccaucauaguugcuuuuuucauaguucuuguuuucauguuuuauuuuuaaaaagacau

SEQ ID NO: 353036 - RNA, 64 nt, Homo Sapiens
aaauguuuacauugaugaugaguaauauugcauguguuuucaggugaucagauaaaauauauuu

SEQ ID NO: 353037 - RNA, 64 nt, Homo Sapiens
aauucuaagugccgccuuccauuuuuuuucaguauguuuucacuggcuuauguuuucagauaug

SEQ ID NO: 353038 - RNA, 64 nt, Homo Sapiens
uuccauuuuuuuucaguauguuuucacuggcuuauguuuucagauaugauuuuccuuuuucgca

SEQ ID NO: 353039 - RNA, 64 nt, Homo Sapiens
guucuuuacauauaaaucugcuucaaccuuaggauguuuucagaccagaggcaacuuauucaug

SEQ ID NO: 353040 - RNA, 64 nt, Homo Sapiens
aucuauaaucccuaaaaugcaauaaaaacuaguauguuuucacgguguauauuuuuuuucaaaa

SEQ ID NO: 353041 - RNA, 64 nt, Homo Sapiens
ugguuauuguagggaguauaguucaugaaagaguuguuuucaugugcauauaacgugauauuug

SEQ ID NO: 353042 - RNA, 64 nt, Homo Sapiens
acagagaugauuaauuucaauauuaauagaguauuguuuucaaaucuuagugcagaaauaacau

SEQ ID NO: 353043 - RNA, 64 nt, Homo Sapiens
aaauuaauauauaaauaauuggcccuaugacuauuguuuucaaauaguuaaauaggacaaagca

SEQ ID NO: 353044 - RNA, 64 nt, Homo Sapiens
ccuuuaacuuuuuacggugugcaaagggugaacauguuuucaacauuucagaugccaccguaua

SEQ ID NO: 353045 - RNA, 64 nt, Homo Sapiens
ccuaacauuuaaggauucuuauaagucauauaccuguuuucaguaaaauauaaauucuggacaa

SEQ ID NO: 353046 - RNA, 64 nt, Homo Sapiens
guaaaaguuaauauacuaaaaaaaugacugaaauuguuuucaugcaucuucauugucaguucuc

SEQ ID NO: 353047 - RNA, 64 nt, Homo Sapiens
uagagcuuaaacuaaaugauuuaauaaaacagcauguuuucagguuaagucuuuggguuuuguu

SEQ ID NO: 353048 - RNA, 64 nt, Homo Sapiens
uggaccaaaagaugugccauacauucaaaaaacuuguuuucacaaaagugucagaaaauaguua

SEQ ID NO: 353049 - RNA, 64 nt, Homo Sapiens
aagaaaaccuccacagccuucuggaugaagaaccuguuuucaaauauacuuguugcagauacag

SEQ ID NO: 353050 - RNA, 64 nt, Homo Sapiens
uuguuuuuguuuuucuguucuuuguuguggcucuuguuuucauuuuuguuguacguguagaucu

SEQ ID NO: 353051 - RNA, 64 nt, Homo Sapiens
uacuugaauuugucauaaagcuaaauauuuuauauguuuucaaagauuauuuuuucauauuaau

SEQ ID NO: 353052 - RNA, 64 nt, Homo Sapiens
ugcuaauuuaaaaauauuuauuuuaucauuuuaauguuuucauggacuuuuuugcugaugguaa

SEQ ID NO: 353053 - RNA, 64 nt, Homo Sapiens
ccccucccgcugccccaugcuuugcaaauugguguguuuucagcauuuacacagcacuuuguag

SEQ ID NO: 353054 - RNA, 64 nt, Homo Sapiens
cuuuaugcagguuaggggauaaaggacagcuugguguuuucacaguuccauauuccacucauuc

SEQ ID NO: 353055 - RNA, 64 nt, Homo Sapiens
acaguaaacagaaacccaaaaaucucaucuuggguguuuucagggcuuguuuugaguuuugcug

SEQ ID NO: 353056 - RNA, 64 nt, Homo Sapiens
gguuaagacaguuuucaguguaccguaaauguuguguuuucagaaaaagacaaaacgauggugc

SEQ ID NO: 353057 - RNA, 64 nt, Homo Sapiens
gcugcuuuacacaaucuguucuauaagguucagguguuuucaaguuggaaagaucauaaauacu

SEQ ID NO: 353058 - RNA, 64 nt, Homo Sapiens
uuuucaaguuggaaagaucauaaauacucaaaauuguuuucaaguuagcaaguucuuuuaacag

SEQ ID NO: 353059 - RNA, 64 nt, Homo Sapiens
uagacuuauuguacacacuuaguuuuuauucacuuguuuucacucugaauuuuaauauuuggcu

SEQ ID NO: 353060 - RNA, 64 nt, Homo Sapiens
guuuagauucuuuaugugccuuucaugaaagauauguuuucauuaauuuuacugguggaccugu

SEQ ID NO: 353061 - RNA, 64 nt, Homo Sapiens
ugaugucguacugguuuuaaauaggaauucacuguguuuucauuuugccgagugacuuucuaac

SEQ ID NO: 353062 - RNA, 64 nt, Homo Sapiens
ugaugucguacugguuuuaaauaggaauucacuguguuuucauuagagcacaaugcuguguaac

SEQ ID NO: 353063 - RNA, 64 nt, Homo Sapiens
uguaucugagucagccagagcaaugcuuuuauaauguuuucaaccaauaucagcucuaaaggac

SEQ ID NO: 353064 - RNA, 64 nt, Homo Sapiens
aucauaauugaauuuccaaguauuaguagucacuuguuuucauugacucagcuaaacaauaagu

SEQ ID NO: 353065 - RNA, 64 nt, Homo Sapiens
uugacuuucccucugaauauuuaguacuuucaaauguuuucaauuaaacaucuuucauauuuug

SEQ ID NO: 353066 - RNA, 64 nt, Homo Sapiens
auuacuucauuuauguuuacaucauguuuagaaauguuuucauuuacuguggucuuuggucacu

SEQ ID NO: 353067 - RNA, 64 nt, Homo Sapiens
uuuaaaaauaaguuuaagaaauuuaagagaauuguguuuucauuaaguuuugcauaucuuuugu

SEQ ID NO: 353068 - RNA, 64 nt, Homo Sapiens
cuuuccauacauccauuucugaaguauucaggaauguuuucauaaucgaaagaaacggguaucc

SEQ ID NO: 353069 - RNA, 64 nt, Homo Sapiens
uaaacgccauaggcuaggcugaacuguauguuacuguuuucaugcuuauacauauauuuucaau

SEQ ID NO: 353070 - RNA, 64 nt, Homo Sapiens
uuucccauuucucaagaaauauggugggagggaauguuuucaaauuuuagagucuuauuugauu

SEQ ID NO: 353071 - RNA, 64 nt, Homo Sapiens
gagaagggcagcugcuuagacccuggauagaaauuguuuucaaaucugagcaaggccuacuugg

SEQ ID NO: 353072 - RNA, 64 nt, Homo Sapiens
aaagaauuuuucuaucaaacucaacguguaaacuuguuuucauuauucuaguuaagccauaagu

SEQ ID NO: 353073 - RNA, 64 nt, Homo Sapiens
uacagaauugcauuuuugcucccucugagauaacuguuuucaucguaugacauugugugguuga

SEQ ID NO: 353074 - RNA, 64 nt, Homo Sapiens
ccuugaaauaaauuuugacuuugauuagucugaauguuuucagggaaguuacaguaguaccauu

SEQ ID NO: 353075 - RNA, 64 nt, Homo Sapiens
ucuauaugucuccuuuuugugacaguaaaauaaguguuuucaaauguuuguuguuguuguugaa

SEQ ID NO: 353076 - RNA, 64 nt, Homo Sapiens
caucucgguaaucauggaaccuaaggaugugauuuguuuucauuguuuguauguacuacuuuua

SEQ ID NO: 353077 - RNA, 64 nt, Homo Sapiens
auuauaggcuguaauuauaaaauauauuggcuuuuguuuucaaugugaaagauacauuaaaugg

SEQ ID NO: 353078 - RNA, 64 nt, Homo Sapiens
aaugcaauaaaauauauaucugguuguauuagucuguuuucacgcugcugauaaagacauaccu

SEQ ID NO: 353079 - RNA, 64 nt, Homo Sapiens
cccacucuacuguuagcaguuuacuguauuagucuguuuucacacugcugauaaagacauuccu

SEQ ID NO: 353080 - RNA, 64 nt, Homo Sapiens
uaacauuuacacagugcuuuuuaccacuguggaauguuuucacacucauuuuuccuuacaacaa

SEQ ID NO: 353081 - RNA, 64 nt, Homo Sapiens
auuugauucaggggaccuguguuuccaugucaaauguuuucaaauaaaaugaaauaugaguuuc

SEQ ID NO: 353082 - RNA, 64 nt, Homo Sapiens
cauuauacauugcuuuggucaauagcuggacauuuguuuucaguaacagcuguuagguuaaaaa

SEQ ID NO: 353083 - RNA, 64 nt, Homo Sapiens
ugccauccuugacauaagaggcauuacuuuauuauguuuucacuaacugugagaguauacauag

SEQ ID NO: 353084 - RNA, 64 nt, Homo Sapiens
guuguuaauugaaauagaauucagcucaagcaguuguuuucagugagugaguuaacaauaaaag

SEQ ID NO: 353085 - RNA, 64 nt, Homo Sapiens
auggacuguugccuauugagcauuguggaugauguguuuucagauuuccaggugaaguucugac

SEQ ID NO: 353086 - RNA, 64 nt, Homo Sapiens
caaaaaccauguuucuuuuucuuguauaacuuuuuguuuucagcaacauaaauugauuuuuagc

SEQ ID NO: 353087 - RNA, 64 nt, Homo Sapiens
uuggguuuucuuaaugccagugugaauuugcagauguuuucagaaaaucaagucacaguaacaa

SEQ ID NO: 353088 - RNA, 64 nt, Homo Sapiens
uggauaggcucaaccuaccuaugucaaauaaccuuguuuucacuuuuucauugacucucacuaa

SEQ ID NO: 353089 - RNA, 64 nt, Homo Sapiens
ucccucaucagacugugacuagagugugcaggaauguuuucaaacuagcaaaugcccagccuuc

SEQ ID NO: 353090 - RNA, 64 nt, Homo Sapiens
uguguccacaguucagauccggugaacaugaccguguuuucaacgacccguuuccaccgcagca

SEQ ID NO: 353091 - RNA, 64 nt, Homo Sapiens
gccuuuuauggccuugacgaagccaaauguuuacuguuuucauuuuuccccagggugacaucgu

SEQ ID NO: 353092 - RNA, 64 nt, Homo Sapiens
acuugguuugcauauaaaagguagacagcugauauguuuucaugaauaaauauugucagccaga

SEQ ID NO: 353093 - RNA, 64 nt, Homo Sapiens
ucaugacccaauuuguguuauucaucuuuaauccuguuuucagucucuauguguacagcaguau

SEQ ID NO: 353094 - RNA, 64 nt, Homo Sapiens
uuuauuccacuggcaccauuagugaauauuuaguuguuuucauaaacgaugcugugaugaagac

SEQ ID NO: 353095 - RNA, 64 nt, Homo Sapiens
cucacuccucacagccauccuaggagauacauauuguuuucauccugcauuuacagaaaaagaa

SEQ ID NO: 353096 - RNA, 64 nt, Homo Sapiens
uuucuuucaacauguucaacaccaugccuggcuguguuuucacuugggauuacaggugcgcacc

SEQ ID NO: 353097 - RNA, 64 nt, Homo Sapiens
uuuuugugugugcgugaagguagacuuccaaguuuguuuucacuuuagauguaauucuucauuc

SEQ ID NO: 353098 - RNA, 64 nt, Homo Sapiens
agucaagcuaggaucugcaguuagaagcaaugaauguuuucaucuuugcaauuuuuuuuuaaac

SEQ ID NO: 353099 - RNA, 64 nt, Homo Sapiens
uaucuuuguagcgguuucccggcagaacugaaaguguuuucaggcuagcgcucaaugcuugaau

SEQ ID NO: 353100 - RNA, 64 nt, Homo Sapiens
uucgugcagauaacuggaagaaaguuacaguauguguuuucacuuuauuuucacugucuuuuug

SEQ ID NO: 353101 - RNA, 64 nt, Homo Sapiens
ccaaacugguagugguauguauauaaguguaacauguuuucauuucuuaaaaauaaaaaaaaau

SEQ ID NO: 353102 - RNA, 64 nt, Homo Sapiens
guuuaaauuagugcuauuuugauuuuguaagagcuguuuucagucucugauguacguuuuuaag

SEQ ID NO: 353103 - RNA, 64 nt, Homo Sapiens
aucuuucucugauguacguuagccuauuuuguuuuguuuucagcauauucugugaugacagaga

SEQ ID NO: 353104 - RNA, 64 nt, Homo Sapiens
ucuuuuucuguaaaugcagguuauuuaagcucucuguuuucauuuucgacauuacuguggcaaa

SEQ ID NO: 353105 - RNA, 64 nt, Homo Sapiens
ccugagcagaagagcuuggguuuugugucugccauguuuucauuagccaggucucuauuccaug

SEQ ID NO: 353106 - RNA, 64 nt, Homo Sapiens
auucugaaaauaccagugugcuacccuuguuuuauguuuucagucgaaaaaauuccggacaaga

SEQ ID NO: 353107 - RNA, 64 nt, Homo Sapiens
ggccuucuuaaauuguggccucaagaaaauuggauguuuucauuauuagcugaagaaguuauuc

SEQ ID NO: 353108 - RNA, 64 nt, Homo Sapiens
acagagcauuccauuuuguccuguuaaaaccuuuuguuuucaccuaaacccuuucugcuuaguu

SEQ ID NO: 353109 - RNA, 64 nt, Homo Sapiens
gaguuuugugauccugcuuauuguaacugacaacuguuuucaacuccaagagcuaaacuauugg

SEQ ID NO: 353110 - RNA, 64 nt, Homo Sapiens
cgugcuaugacucucuccaguuugaauaugcaauuguuuucacaggcaggaugucuguuuucug

SEQ ID NO: 353111 - RNA, 64 nt, Homo Sapiens
guggugacaguguaauuuaauuaaaagguguaaauguuuucaucucuuaggcuugcugucuccu

SEQ ID NO: 353112 - RNA, 64 nt, Homo Sapiens
cuauaaccagguaaagggacuuuucuauuuugacuguuuucauaaucucuuuccuaaacugaca

SEQ ID NO: 353113 - RNA, 64 nt, Homo Sapiens
gcacccauaucccacccugguuuaaagcacuuacuguuuucagaguaacacgucccacccccuu

SEQ ID NO: 353114 - RNA, 64 nt, Homo Sapiens
cauccucuaaaaucaaaggugcuuacuguauacuuguuuucaaguauucuuugaaaaaaaagau

SEQ ID NO: 353115 - RNA, 64 nt, Homo Sapiens
auucauuugaaaaugaaaaaauuuuaaaaaauuauguuuucauccuucugauuugauaguauuu

SEQ ID NO: 353116 - RNA, 64 nt, Homo Sapiens
gacuuuguugcccaguggccaacgcccgagugucuguuuucaggagccccaggucaagccuugu

SEQ ID NO: 353117 - RNA, 64 nt, Homo Sapiens
gcacucaacuuggccuuuugauugcacaagccuuuguuuucaguccuagugaauaaaguugugu

SEQ ID NO: 353118 - RNA, 64 nt, Homo Sapiens
aauuaaacuuuuuuaagcuggcaccugccuuggauguuuucagcagccccgcagggacuggccc

SEQ ID NO: 353119 - RNA, 64 nt, Homo Sapiens
ucugcugucucuggggucagcaguucccagggacuguuuucacccacauccucugggccucugg

SEQ ID NO: 353120 - RNA, 64 nt, Homo Sapiens
auuuggguaauauuagaaagaagaagguagauuuuguuuucaauaauuacuaauacaaggguua

SEQ ID NO: 353121 - RNA, 64 nt, Homo Sapiens
cuucagagguaccuggcaccaauuuuauugccuguguuuucaggguaaagaagauaaauaggug

SEQ ID NO: 353122 - RNA, 64 nt, Homo Sapiens
cccuaggauuuuuuuaaauagaugcugcuugcuauguuuucaaaccuuuuugagccauaggauc

SEQ ID NO: 353123 - RNA, 64 nt, Homo Sapiens
cagacuguaaauggcuugugauacucuugauacuuguuuucaaauauguuuacuaacuguagug

SEQ ID NO: 353124 - RNA, 64 nt, Homo Sapiens
ccuuccauuccccauagagggcuggauuuguggguguuuucaggaggugugagcauccuggcuc

SEQ ID NO: 353125 - RNA, 64 nt, Homo Sapiens
uuccugggaacagacaccaggauagauggagaaguguuuucagaccuucucuguguacucugga

SEQ ID NO: 353126 - RNA, 64 nt, Homo Sapiens
gaaaacauucacuugguauuaauggagaaucgcauguuuucaauaaaggaagaaaacuuuuuaa

SEQ ID NO: 353127 - RNA, 64 nt, Homo Sapiens
guuccauucuguuaaaguaaaaaaaaaaaaaaaauguuuucaaagagacuccgucucaaaaaaa

SEQ ID NO: 353128 - RNA, 64 nt, Homo Sapiens
ucuuggauauagcagcaauauacauauuuuaaauuguuuucagcaguguuaaaugugauaaaag

SEQ ID NO: 353129 - RNA, 64 nt, Homo Sapiens
caacuaacaaacauauuccauuuuagcuacuguuuguuuucauuuuuucuaucauuugaaaccu

SEQ ID NO: 353130 - RNA, 64 nt, Homo Sapiens
ggggaaaaauaacugauuccaaugacauucauuuuguuuucaucugugauagucauggaugcuu

SEQ ID NO: 353131 - RNA, 64 nt, Homo Sapiens
aauacccaagauucaugcuacuguaccacagauuuguuuucacagcaauaaaucuucaguucuu

SEQ ID NO: 353132 - RNA, 64 nt, Homo Sapiens
ugaacauggucuuuuaaaaacuagucagaugaauuguuuucaucugaagccugcuaucuuuuuu

SEQ ID NO: 353133 - RNA, 64 nt, Homo Sapiens
uaaccccacucccaugaagaauugccuggaaagauguuuucaaggaauuugaaccauaaaacac

SEQ ID NO: 353134 - RNA, 64 nt, Homo Sapiens
ccaggggcugauucacuuccuugggagauggugguguuuucaugaacaucuuugauccuuccau

SEQ ID NO: 353135 - RNA, 64 nt, Homo Sapiens
augcuuuuaucucgagugugugcuuuucagacuuuguuuucagagagaccuggccuuccuguug

SEQ ID NO: 353136 - RNA, 64 nt, Homo Sapiens
cucugggccaagaucacaugcuccaggggaugacuguuuucaauggccacuggggggcuggggu

SEQ ID NO: 353137 - RNA, 64 nt, Homo Sapiens
gauggagagaugagaagcaauuccaccaaacucauguuuucacaggaggguucaguguggagag

SEQ ID NO: 353138 - RNA, 64 nt, Homo Sapiens
gccaagcuccucaaacaggguucaguccacguuguguuuucacaccuuucuccaaggaucgaac

SEQ ID NO: 353139 - RNA, 64 nt, Homo Sapiens
auuuucuuaagaaauugcuuaauagaugucuugcuguuuucaguucauuucagugggccaggaa

SEQ ID NO: 353140 - RNA, 64 nt, Homo Sapiens
uuauauuuucacaacuacuuaucguauuucacuguguuuucaauggaaauuuaaaaggaaaaaa

SEQ ID NO: 353141 - RNA, 64 nt, Homo Sapiens
gaaagaaaaaaaaugucuggcuucuucuacuauuuguuuucacuaccaaacuguguuacuaaau

SEQ ID NO: 353142 - RNA, 64 nt, Homo Sapiens
uuaaauugcugcaaagaugguuucuuuuguaagauguuuucaacguuuacauucaauccaagcc

SEQ ID NO: 353143 - RNA, 64 nt, Homo Sapiens
auauauagcauuuaugguaaucauauuagacuucuguuuucaaucucguauagaagucuucaug

SEQ ID NO: 353144 - RNA, 64 nt, Homo Sapiens
agaaagaacuaucuucaucugagagaggcuaaaauguuuucagcuaggaacaaaucuuccuggu

SEQ ID NO: 353145 - RNA, 64 nt, Homo Sapiens
auuacuaacuucuaaaacuguacuuugauucacauguuuucaaauggaguuggaguucauucau

SEQ ID NO: 353146 - RNA, 64 nt, Homo Sapiens
aauagucugguuuaguauuaaauuuugaugaagauguuuucauugaacuaccaacucucuaguu

SEQ ID NO: 353147 - RNA, 64 nt, Homo Sapiens
gugauuuuaguauuuacaguacuuaacuuuaagguguuuucaauucucuaauaaucggguuggg

SEQ ID NO: 353148 - RNA, 64 nt, Homo Sapiens
ccuuccuccuccuagccucucuccagugagacgcuguuuucaccagauucauacacuuuugaga

SEQ ID NO: 353149 - RNA, 64 nt, Homo Sapiens
cccucccuggaauagugaguaggggagccacuucuguuuucagcugacaugcuaacuagacuuc

SEQ ID NO: 353150 - RNA, 64 nt, Homo Sapiens
auucaaagugcuguuuaguacaauauacuaucuguguuuucaccagaaaagcauucaaguauga

SEQ ID NO: 353151 - RNA, 64 nt, Homo Sapiens
gaaaacaaguccuuccauaaaagauauuucaaauuguuuucagucuuacacacgcugaguacag

SEQ ID NO: 353152 - RNA, 64 nt, Homo Sapiens
uauuuuucuuguugcaucuuaaguguuggucuuucuaauguagcaguguuuuacucuuuuucua

SEQ ID NO: 353153 - RNA, 64 nt, Homo Sapiens
acuguauagguagauccagaaaauauuuuagaagcuaauguagguuuauuuuuucccuccugac

SEQ ID NO: 353154 - RNA, 64 nt, Homo Sapiens
aaaguuuagacuuauaaaaagccuuacauauaagcuaauguagacauacauaaaaauguagccu

SEQ ID NO: 353155 - RNA, 64 nt, Homo Sapiens
auuagcuauuauuuguaggagccagaaagcuuaacuaauguaagggacuuuugauauacucaaa

SEQ ID NO: 353156 - RNA, 64 nt, Homo Sapiens
aucagucuucaugugaccugcaguauuuuuuuuucuaauguauuugucagaaaucuguuguaga

SEQ ID NO: 353157 - RNA, 64 nt, Homo Sapiens
uaaaggguacaguugcauaaaguggguuuuuauccuaauguauuggaaauaaaugauaaacuuu

SEQ ID NO: 353158 - RNA, 64 nt, Homo Sapiens
ucucaggguacuuucugggauugcucacauuucucuaauguacugcacuugaugccaguaggaa

SEQ ID NO: 353159 - RNA, 64 nt, Homo Sapiens
ugaaucaccacuuuauauccacaaaggcaaauaacuaauguaugauaauagaauaauuugcacu

SEQ ID NO: 353160 - RNA, 64 nt, Homo Sapiens
ccuugggacagguguguaauguuagugugcaugacuaauguaagaaauuguuauucuacuaaua

SEQ ID NO: 353161 - RNA, 64 nt, Homo Sapiens
uucuaaagaaaagaaucagaaaucaaucuuucuacuaauguaaauuugagauuauuuuuaaaaa

SEQ ID NO: 353162 - RNA, 64 nt, Homo Sapiens
uggacauuuuuguaacucaguuacagccaugcuccuaauguacacagguguaccucaauccaca

SEQ ID NO: 353163 - RNA, 64 nt, Homo Sapiens
uaagcaucuccacuaugguggaauaagacuacuucuaauguaacaggcaauuuggcuaaaaaau

SEQ ID NO: 353164 - RNA, 64 nt, Homo Sapiens
ucuguuacauaauuaaacuaaagacuaucuuaagcuaauguacuacagaauugauauuuaucuc

SEQ ID NO: 353165 - RNA, 64 nt, Homo Sapiens
uuguuaguugcuuagaaauguaacuuuagguauucuaauguauuuaguuuauuuuuccaaaaca

SEQ ID NO: 353166 - RNA, 64 nt, Homo Sapiens; identical to SEQ ID NO: 163826

SEQ ID NO: 353167 - RNA, 64 nt, Homo Sapiens; identical to SEQ ID NO: 163827

SEQ ID NO: 353168 - RNA, 64 nt, Homo Sapiens; identical to SEQ ID NO: 163828

SEQ ID NO: 353169 - RNA, 64 nt, Homo Sapiens; identical to SEQ ID NO: 163829

SEQ ID NO: 353170 - RNA, 64 nt, Homo Sapiens; identical to SEQ ID NO: 163830

SEQ ID NO: 353171 - RNA, 64 nt, Homo Sapiens; identical to SEQ ID NO: 163831

SEQ ID NO: 353172 - RNA, 64 nt, Homo Sapiens; identical to SEQ ID NO: 163832

SEQ ID NO: 353173 - RNA, 64 nt, Homo Sapiens; identical to SEQ ID NO: 163833

SEQ ID NO: 353174 - RNA, 64 nt, Homo Sapiens; identical to SEQ ID NO: 163834

SEQ ID NO: 353175 - RNA, 64 nt, Homo Sapiens; identical to SEQ ID NO: 163835

SEQ ID NO: 353176 - RNA, 64 nt, Homo Sapiens; identical to SEQ ID NO: 163836

SEQ ID NO: 353177 - RNA, 64 nt, Homo Sapiens; identical to SEQ ID NO: 163837

SEQ ID NO: 353178 - RNA, 64 nt, Homo Sapiens; identical to SEQ ID NO: 163838

SEQ ID NO: 353179 - RNA, 64 nt, Homo Sapiens; identical to SEQ ID NO: 163839

SEQ ID NO: 353180 - RNA, 64 nt, Homo Sapiens; identical to SEQ ID NO: 163840

SEQ ID NO: 353181 - RNA, 64 nt, Homo Sapiens; identical to SEQ ID NO: 163841

SEQ ID NO: 353182 - RNA, 64 nt, Homo Sapiens; identical to SEQ ID NO: 163842

SEQ ID NO: 353183 - RNA, 64 nt, Homo Sapiens; identical to SEQ ID NO: 163843

SEQ ID NO: 353184 - RNA, 64 nt, Homo Sapiens; identical to SEQ ID NO: 163844

SEQ ID NO: 353185 - RNA, 64 nt, Homo Sapiens; identical to SEQ ID NO: 163845

SEQ ID NO: 353186 - RNA, 64 nt, Homo Sapiens; identical to SEQ ID NO: 163846

SEQ ID NO: 353187 - RNA, 64 nt, Homo Sapiens; identical to SEQ ID NO: 163847

SEQ ID NO: 353188 - RNA, 64 nt, Homo Sapiens; identical to SEQ ID NO: 163848

SEQ ID NO: 353189 - RNA, 64 nt, Homo Sapiens; identical to SEQ ID NO: 163849

SEQ ID NO: 353190 - RNA, 64 nt, Homo Sapiens; identical to SEQ ID NO: 163850

SEQ ID NO: 353191 - RNA, 64 nt, Homo Sapiens; identical to SEQ ID NO: 163851

SEQ ID NO: 353192 - RNA, 64 nt, Homo Sapiens; identical to SEQ ID NO: 163852

SEQ ID NO: 353193 - RNA, 64 nt, Homo Sapiens; identical to SEQ ID NO: 163853

SEQ ID NO: 353194 - RNA, 64 nt, Homo Sapiens; identical to SEQ ID NO: 163854

SEQ ID NO: 353195 - RNA, 64 nt, Homo Sapiens; identical to SEQ ID NO: 163855

SEQ ID NO: 353196 - RNA, 64 nt, Homo Sapiens; identical to SEQ ID NO: 163856

SEQ ID NO: 353197 - RNA, 64 nt, Homo Sapiens; identical to SEQ ID NO: 163857

SEQ ID NO: 353198 - RNA, 64 nt, Homo Sapiens; identical to SEQ ID NO: 163858

SEQ ID NO: 353199 - RNA, 64 nt, Homo Sapiens; identical to SEQ ID NO: 163859

SEQ ID NO: 353200 - RNA, 64 nt, Homo Sapiens; identical to SEQ ID NO: 163860

SEQ ID NO: 353201 - RNA, 64 nt, Homo Sapiens; identical to SEQ ID NO: 163861

SEQ ID NO: 353202 - RNA, 64 nt, Homo Sapiens; identical to SEQ ID NO: 163862

SEQ ID NO: 353203 - RNA, 64 nt, Homo Sapiens; identical to SEQ ID NO: 163863

SEQ ID NO: 353204 - RNA, 64 nt, Homo Sapiens; identical to SEQ ID NO: 163864

SEQ ID NO: 353205 - RNA, 64 nt, Homo Sapiens; identical to SEQ ID NO: 163865

SEQ ID NO: 353206 - RNA, 64 nt, Homo Sapiens; identical to SEQ ID NO: 163866

SEQ ID NO: 353207 - RNA, 64 nt, Homo Sapiens; identical to SEQ ID NO: 163867

SEQ ID NO: 353208 - RNA, 64 nt, Homo Sapiens; identical to SEQ ID NO: 163868

SEQ ID NO: 353209 - RNA, 64 nt, Homo Sapiens; identical to SEQ ID NO: 163869

SEQ ID NO: 353210 - RNA, 64 nt, Homo Sapiens; identical to SEQ ID NO: 163870

SEQ ID NO: 353211 - RNA, 64 nt, Homo Sapiens; identical to SEQ ID NO: 163871

SEQ ID NO: 353212 - RNA, 64 nt, Homo Sapiens; identical to SEQ ID NO: 163872

SEQ ID NO: 353213 - RNA, 64 nt, Homo Sapiens; identical to SEQ ID NO: 163873

SEQ ID NO: 353214 - RNA, 64 nt, Homo Sapiens; identical to SEQ ID NO: 163874

SEQ ID NO: 353215 - RNA, 64 nt, Homo Sapiens; identical to SEQ ID NO: 163875

SEQ ID NO: 353216 - RNA, 64 nt, Homo Sapiens; identical to SEQ ID NO: 163876

SEQ ID NO: 353217 - RNA, 64 nt, Homo Sapiens; identical to SEQ ID NO: 163877

SEQ ID NO: 353218 - RNA, 64 nt, Homo Sapiens; identical to SEQ ID NO: 163878

SEQ ID NO: 353219 - RNA, 64 nt, Homo Sapiens; identical to SEQ ID NO: 163879

SEQ ID NO: 353220 - RNA, 64 nt, Homo Sapiens; identical to SEQ ID NO: 163880

SEQ ID NO: 353221 - RNA, 64 nt, Homo Sapiens; identical to SEQ ID NO: 163881

SEQ ID NO: 353222 - RNA, 64 nt, Homo Sapiens; identical to SEQ ID NO: 163882

SEQ ID NO: 353223 - RNA, 64 nt, Homo Sapiens; identical to SEQ ID NO: 163883

SEQ ID NO: 353224 - RNA, 64 nt, Homo Sapiens; identical to SEQ ID NO: 163884

SEQ ID NO: 353225 - RNA, 64 nt, Homo Sapiens; identical to SEQ ID NO: 163885

SEQ ID NO: 353226 - RNA, 64 nt, Homo Sapiens; identical to SEQ ID NO: 163886

SEQ ID NO: 353227 - RNA, 64 nt, Homo Sapiens; identical to SEQ ID NO: 163887

SEQ ID NO: 353228 - RNA, 64 nt, Homo Sapiens; identical to SEQ ID NO: 163888

SEQ ID NO: 353229 - RNA, 64 nt, Homo Sapiens; identical to SEQ ID NO: 163889

SEQ ID NO: 353230 - RNA, 64 nt, Homo Sapiens; identical to SEQ ID NO: 163890

SEQ ID NO: 353231 - RNA, 64 nt, Homo Sapiens; identical to SEQ ID NO: 163891

SEQ ID NO: 353232 - RNA, 64 nt, Homo Sapiens; identical to SEQ ID NO: 163892

SEQ ID NO: 353233 - RNA, 64 nt, Homo Sapiens; identical to SEQ ID NO: 163893

SEQ ID NO: 353234 - RNA, 64 nt, Homo Sapiens; identical to SEQ ID NO: 163894

SEQ ID NO: 353235 - RNA, 64 nt, Homo Sapiens; identical to SEQ ID NO: 163895

SEQ ID NO: 353236 - RNA, 64 nt, Homo Sapiens; identical to SEQ ID NO: 163896

SEQ ID NO: 353237 - RNA, 64 nt, Homo Sapiens; identical to SEQ ID NO: 163897

SEQ ID NO: 353238 - RNA, 64 nt, Homo Sapiens; identical to SEQ ID NO: 163898

SEQ ID NO: 353239 - RNA, 64 nt, Homo Sapiens; identical to SEQ ID NO: 163899

SEQ ID NO: 353240 - RNA, 64 nt, Homo Sapiens; identical to SEQ ID NO: 163900

SEQ ID NO: 353241 - RNA, 64 nt, Homo Sapiens; identical to SEQ ID NO: 163901

SEQ ID NO: 353242 - RNA, 64 nt, Homo Sapiens; identical to SEQ ID NO: 163902

SEQ ID NO: 353243 - RNA, 64 nt, Homo Sapiens; identical to SEQ ID NO: 163903

SEQ ID NO: 353244 - RNA, 64 nt, Homo Sapiens; identical to SEQ ID NO: 163904

SEQ ID NO: 353245 - RNA, 64 nt, Homo Sapiens; identical to SEQ ID NO: 163905

SEQ ID NO: 353246 - RNA, 64 nt, Homo Sapiens; identical to SEQ ID NO: 163906

SEQ ID NO: 353247 - RNA, 64 nt, Homo Sapiens; identical to SEQ ID NO: 163907

SEQ ID NO: 353248 - RNA, 64 nt, Homo Sapiens; identical to SEQ ID NO: 163908

SEQ ID NO: 353249 - RNA, 64 nt, Homo Sapiens; identical to SEQ ID NO: 163909

SEQ ID NO: 353250 - RNA, 64 nt, Homo Sapiens; identical to SEQ ID NO: 163910

SEQ ID NO: 353251 - RNA, 64 nt, Homo Sapiens; identical to SEQ ID NO: 163911

SEQ ID NO: 353252 - RNA, 64 nt, Homo Sapiens; identical to SEQ ID NO: 163912

SEQ ID NO: 353253 - RNA, 64 nt, Homo Sapiens; identical to SEQ ID NO: 163913

SEQ ID NO: 353254 - RNA, 64 nt, Homo Sapiens; identical to SEQ ID NO: 163914

SEQ ID NO: 353255 - RNA, 64 nt, Homo Sapiens; identical to SEQ ID NO: 163915

SEQ ID NO: 353256 - RNA, 64 nt, Homo Sapiens; identical to SEQ ID NO: 163916

SEQ ID NO: 353257 - RNA, 64 nt, Homo Sapiens; identical to SEQ ID NO: 163917

SEQ ID NO: 353258 - RNA, 64 nt, Homo Sapiens; identical to SEQ ID NO: 163918

SEQ ID NO: 353259 - RNA, 64 nt, Homo Sapiens; identical to SEQ ID NO: 163919

SEQ ID NO: 353260 - RNA, 64 nt, Homo Sapiens; identical to SEQ ID NO: 163920

SEQ ID NO: 353261 - RNA, 64 nt, Homo Sapiens; identical to SEQ ID NO: 163921

SEQ ID NO: 353262 - RNA, 64 nt, Homo Sapiens; identical to SEQ ID NO: 163922

SEQ ID NO: 353263 - RNA, 64 nt, Homo Sapiens; identical to SEQ ID NO: 163923

SEQ ID NO: 353264 - RNA, 64 nt, Homo Sapiens; identical to SEQ ID NO: 163924

SEQ ID NO: 353265 - RNA, 64 nt, Homo Sapiens; identical to SEQ ID NO: 163925

SEQ ID NO: 353266 - RNA, 64 nt, Homo Sapiens; identical to SEQ ID NO: 163926

SEQ ID NO: 353267 - RNA, 64 nt, Homo Sapiens; identical to SEQ ID NO: 163927

SEQ ID NO: 353268 - RNA, 64 nt, Homo Sapiens; identical to SEQ ID NO: 163928

SEQ ID NO: 353269 - RNA, 64 nt, Homo Sapiens; identical to SEQ ID NO: 163929

SEQ ID NO: 353270 - RNA, 64 nt, Homo Sapiens; identical to SEQ ID NO: 163930

SEQ ID NO: 353271 - RNA, 64 nt, Homo Sapiens; identical to SEQ ID NO: 163931

SEQ ID NO: 353272 - RNA, 64 nt, Homo Sapiens; identical to SEQ ID NO: 163932

SEQ ID NO: 353273 - RNA, 64 nt, Homo Sapiens; identical to SEQ ID NO: 163933

SEQ ID NO: 353274 - RNA, 64 nt, Homo Sapiens; identical to SEQ ID NO: 163934

SEQ ID NO: 353275 - RNA, 64 nt, Homo Sapiens; identical to SEQ ID NO: 163935

SEQ ID NO: 353276 - RNA, 64 nt, Homo Sapiens; identical to SEQ ID NO: 163936

SEQ ID NO: 353277 - RNA, 64 nt, Homo Sapiens; identical to SEQ ID NO: 163937

SEQ ID NO: 353278 - RNA, 64 nt, Homo Sapiens; identical to SEQ ID NO: 163938

SEQ ID NO: 353279 - RNA, 64 nt, Homo Sapiens; identical to SEQ ID NO: 163939

SEQ ID NO: 353280 - RNA, 64 nt, Homo Sapiens; identical to SEQ ID NO: 163940

SEQ ID NO: 353281 - RNA, 64 nt, Homo Sapiens
caaucgaaugcuauauuauuaguacaccuuuccuggaugauaugauaaucaaaacauuuuuuac

SEQ ID NO: 353282 - RNA, 64 nt, Homo Sapiens
aaaugcuaauauaaaaaugccaaagaaaggguggggaugauaaguucagagaacuacaaacugu

SEQ ID NO: 353283 - RNA, 64 nt, Homo Sapiens
uuauaguauuguauuauucugauuaauuuacugaggaugauacaaguaacauuuucuaagugaa

SEQ ID NO: 353284 - RNA, 64 nt, Homo Sapiens
uguucaauaugucaagcugacaguguucagauguggaugauauugaguggcugccagcaagaga

SEQ ID NO: 353285 - RNA, 64 nt, Homo Sapiens; identical to SEQ ID NO: 140968

SEQ ID NO: 353286 - RNA, 64 nt, Homo Sapiens; identical to SEQ ID NO: 140969

SEQ ID NO: 353287 - RNA, 64 nt, Homo Sapiens; identical to SEQ ID NO: 140970

SEQ ID NO: 353288 - RNA, 64 nt, Homo Sapiens; identical to SEQ ID NO: 140971

SEQ ID NO: 353289 - RNA, 64 nt, Homo Sapiens; identical to SEQ ID NO: 140972

SEQ ID NO: 353290 - RNA, 64 nt, Homo Sapiens; identical to SEQ ID NO: 140973

SEQ ID NO: 353291 - RNA, 64 nt, Homo Sapiens; identical to SEQ ID NO: 140974

SEQ ID NO: 353292 - RNA, 64 nt, Homo Sapiens; identical to SEQ ID NO: 140975

SEQ ID NO: 353293 - RNA, 64 nt, Homo Sapiens; identical to SEQ ID NO: 140976

SEQ ID NO: 353294 - RNA, 64 nt, Homo Sapiens; identical to SEQ ID NO: 140977

SEQ ID NO: 353295 - RNA, 64 nt, Homo Sapiens; identical to SEQ ID NO: 140978

SEQ ID NO: 353296 - RNA, 64 nt, Homo Sapiens; identical to SEQ ID NO: 140979

SEQ ID NO: 353297 - RNA, 64 nt, Homo Sapiens; identical to SEQ ID NO: 140980

SEQ ID NO: 353298 - RNA, 64 nt, Homo Sapiens; identical to SEQ ID NO: 140981

SEQ ID NO: 353299 - RNA, 64 nt, Homo Sapiens; identical to SEQ ID NO: 140982

SEQ ID NO: 353300 - RNA, 64 nt, Homo Sapiens; identical to SEQ ID NO: 140983

SEQ ID NO: 353301 - RNA, 64 nt, Homo Sapiens; identical to SEQ ID NO: 140984

SEQ ID NO: 353302 - RNA, 64 nt, Homo Sapiens; identical to SEQ ID NO: 140985

SEQ ID NO: 353303 - RNA, 64 nt, Homo Sapiens; identical to SEQ ID NO: 140986

SEQ ID NO: 353304 - RNA, 64 nt, Homo Sapiens; identical to SEQ ID NO: 140987

SEQ ID NO: 353305 - RNA, 64 nt, Homo Sapiens; identical to SEQ ID NO: 140988

SEQ ID NO: 353306 - RNA, 64 nt, Homo Sapiens; identical to SEQ ID NO: 140989

SEQ ID NO: 353307 - RNA, 64 nt, Homo Sapiens; identical to SEQ ID NO: 140990

SEQ ID NO: 353308 - RNA, 64 nt, Homo Sapiens; identical to SEQ ID NO: 140991

SEQ ID NO: 353309 - RNA, 64 nt, Homo Sapiens; identical to SEQ ID NO: 140992

SEQ ID NO: 353310 - RNA, 64 nt, Homo Sapiens; identical to SEQ ID NO: 140993

SEQ ID NO: 353311 - RNA, 64 nt, Homo Sapiens; identical to SEQ ID NO: 140994

SEQ ID NO: 353312 - RNA, 64 nt, Homo Sapiens; identical to SEQ ID NO: 140995

SEQ ID NO: 353313 - RNA, 64 nt, Homo Sapiens; identical to SEQ ID NO: 140996

SEQ ID NO: 353314 - RNA, 64 nt, Homo Sapiens; identical to SEQ ID NO: 140997

SEQ ID NO: 353315 - RNA, 64 nt, Homo Sapiens; identical to SEQ ID NO: 140998

SEQ ID NO: 353316 - RNA, 64 nt, Homo Sapiens; identical to SEQ ID NO: 140999

SEQ ID NO: 353317 - RNA, 64 nt, Homo Sapiens; identical to SEQ ID NO: 141000

SEQ ID NO: 353318 - RNA, 64 nt, Homo Sapiens; identical to SEQ ID NO: 141001

SEQ ID NO: 353319 - RNA, 64 nt, Homo Sapiens; identical to SEQ ID NO: 141002

SEQ ID NO: 353320 - RNA, 64 nt, Homo Sapiens; identical to SEQ ID NO: 141003

SEQ ID NO: 353321 - RNA, 64 nt, Homo Sapiens; identical to SEQ ID NO: 141004

SEQ ID NO: 353322 - RNA, 64 nt, Homo Sapiens; identical to SEQ ID NO: 141005

SEQ ID NO: 353323 - RNA, 64 nt, Homo Sapiens; identical to SEQ ID NO: 141006

SEQ ID NO: 353324 - RNA, 64 nt, Homo Sapiens; identical to SEQ ID NO: 141007

SEQ ID NO: 353325 - RNA, 64 nt, Homo Sapiens; identical to SEQ ID NO: 141008

SEQ ID NO: 353326 - RNA, 64 nt, Homo Sapiens; identical to SEQ ID NO: 141009

SEQ ID NO: 353327 - RNA, 64 nt, Homo Sapiens; identical to SEQ ID NO: 141010

SEQ ID NO: 353328 - RNA, 64 nt, Homo Sapiens; identical to SEQ ID NO: 141011

SEQ ID NO: 353329 - RNA, 64 nt, Homo Sapiens; identical to SEQ ID NO: 141012

SEQ ID NO: 353330 - RNA, 64 nt, Homo Sapiens; identical to SEQ ID NO: 141013

SEQ ID NO: 353331 - RNA, 64 nt, Homo Sapiens; identical to SEQ ID NO: 141014

SEQ ID NO: 353332 - RNA, 64 nt, Homo Sapiens; identical to SEQ ID NO: 141015

SEQ ID NO: 353333 - RNA, 64 nt, Homo Sapiens; identical to SEQ ID NO: 141016

SEQ ID NO: 353334 - RNA, 64 nt, Homo Sapiens; identical to SEQ ID NO: 141017

SEQ ID NO: 353335 - RNA, 64 nt, Homo Sapiens; identical to SEQ ID NO: 141018

SEQ ID NO: 353336 - RNA, 64 nt, Homo Sapiens; identical to SEQ ID NO: 141019

SEQ ID NO: 353337 - RNA, 64 nt, Homo Sapiens; identical to SEQ ID NO: 141020

SEQ ID NO: 353338 - RNA, 64 nt, Homo Sapiens; identical to SEQ ID NO: 141021

SEQ ID NO: 353339 - RNA, 64 nt, Homo Sapiens; identical to SEQ ID NO: 141022

SEQ ID NO: 353340 - RNA, 64 nt, Homo Sapiens; identical to SEQ ID NO: 141023

SEQ ID NO: 353341 - RNA, 64 nt, Homo Sapiens; identical to SEQ ID NO: 141024

SEQ ID NO: 353342 - RNA, 64 nt, Homo Sapiens; identical to SEQ ID NO: 141025

SEQ ID NO: 353343 - RNA, 64 nt, Homo Sapiens; identical to SEQ ID NO: 141026

SEQ ID NO: 353344 - RNA, 64 nt, Homo Sapiens; identical to SEQ ID NO: 141027

SEQ ID NO: 353345 - RNA, 64 nt, Homo Sapiens; identical to SEQ ID NO: 141028

SEQ ID NO: 353346 - RNA, 64 nt, Homo Sapiens; identical to SEQ ID NO: 141029

SEQ ID NO: 353347 - RNA, 64 nt, Homo Sapiens; identical to SEQ ID NO: 141030

SEQ ID NO: 353348 - RNA, 64 nt, Homo Sapiens; identical to SEQ ID NO: 141031

SEQ ID NO: 353349 - RNA, 64 nt, Homo Sapiens; identical to SEQ ID NO: 141032

SEQ ID NO: 353350 - RNA, 64 nt, Homo Sapiens; identical to SEQ ID NO: 141033

SEQ ID NO: 353351 - RNA, 64 nt, Homo Sapiens; identical to SEQ ID NO: 141034

SEQ ID NO: 353352 - RNA, 64 nt, Homo Sapiens; identical to SEQ ID NO: 141035

SEQ ID NO: 353353 - RNA, 64 nt, Homo Sapiens; identical to SEQ ID NO: 141036

SEQ ID NO: 353354 - RNA, 64 nt, Homo Sapiens; identical to SEQ ID NO: 141037

SEQ ID NO: 353355 - RNA, 64 nt, Homo Sapiens; identical to SEQ ID NO: 141038

SEQ ID NO: 353356 - RNA, 64 nt, Homo Sapiens; identical to SEQ ID NO: 141039

SEQ ID NO: 353357 - RNA, 64 nt, Homo Sapiens; identical to SEQ ID NO: 141040

SEQ ID NO: 353358 - RNA, 64 nt, Homo Sapiens; identical to SEQ ID NO: 141041

SEQ ID NO: 353359 - RNA, 64 nt, Homo Sapiens; identical to SEQ ID NO: 141042

SEQ ID NO: 353360 - RNA, 64 nt, Homo Sapiens; identical to SEQ ID NO: 141043

SEQ ID NO: 353361 - RNA, 64 nt, Homo Sapiens; identical to SEQ ID NO: 141044

SEQ ID NO: 353362 - RNA, 64 nt, Homo Sapiens; identical to SEQ ID NO: 141045

SEQ ID NO: 353363 - RNA, 64 nt, Homo Sapiens; identical to SEQ ID NO: 141046

SEQ ID NO: 353364 - RNA, 64 nt, Homo Sapiens; identical to SEQ ID NO: 141047

SEQ ID NO: 353365 - RNA, 64 nt, Homo Sapiens; identical to SEQ ID NO: 141048

SEQ ID NO: 353366 - RNA, 64 nt, Homo Sapiens; identical to SEQ ID NO: 141049

SEQ ID NO: 353367 - RNA, 64 nt, Homo Sapiens; identical to SEQ ID NO: 141050

SEQ ID NO: 353368 - RNA, 64 nt, Homo Sapiens; identical to SEQ ID NO: 141051

SEQ ID NO: 353369 - RNA, 64 nt, Homo Sapiens; identical to SEQ ID NO: 141052

SEQ ID NO: 353370 - RNA, 64 nt, Homo Sapiens; identical to SEQ ID NO: 141053

SEQ ID NO: 353371 - RNA, 64 nt, Homo Sapiens; identical to SEQ ID NO: 141054

SEQ ID NO: 353372 - RNA, 64 nt, Homo Sapiens; identical to SEQ ID NO: 141055

SEQ ID NO: 353373 - RNA, 64 nt, Homo Sapiens; identical to SEQ ID NO: 141056

SEQ ID NO: 353374 - RNA, 64 nt, Homo Sapiens; identical to SEQ ID NO: 141057

SEQ ID NO: 353375 - RNA, 64 nt, Homo Sapiens; identical to SEQ ID NO: 141058

SEQ ID NO: 353376 - RNA, 64 nt, Homo Sapiens; identical to SEQ ID NO: 141059

SEQ ID NO: 353377 - RNA, 64 nt, Homo Sapiens; identical to SEQ ID NO: 141060

SEQ ID NO: 353378 - RNA, 64 nt, Homo Sapiens; identical to SEQ ID NO: 141061

SEQ ID NO: 353379 - RNA, 64 nt, Homo Sapiens; identical to SEQ ID NO: 141062

SEQ ID NO: 353380 - RNA, 64 nt, Homo Sapiens; identical to SEQ ID NO: 141063

SEQ ID NO: 353381 - RNA, 64 nt, Homo Sapiens; identical to SEQ ID NO: 141064

SEQ ID NO: 353382 - RNA, 64 nt, Homo Sapiens; identical to SEQ ID NO: 141065

SEQ ID NO: 353383 - RNA, 64 nt, Homo Sapiens; identical to SEQ ID NO: 141066

SEQ ID NO: 353384 - RNA, 64 nt, Homo Sapiens; identical to SEQ ID NO: 141067

SEQ ID NO: 353385 - RNA, 64 nt, Homo Sapiens; identical to SEQ ID NO: 141068

SEQ ID NO: 353386 - RNA, 64 nt, Homo Sapiens; identical to SEQ ID NO: 141069

SEQ ID NO: 353387 - RNA, 64 nt, Homo Sapiens; identical to SEQ ID NO: 141070

SEQ ID NO: 353388 - RNA, 64 nt, Homo Sapiens; identical to SEQ ID NO: 141071

SEQ ID NO: 353389 - RNA, 64 nt, Homo Sapiens; identical to SEQ ID NO: 141072

SEQ ID NO: 353390 - RNA, 64 nt, Homo Sapiens; identical to SEQ ID NO: 141073

SEQ ID NO: 353391 - RNA, 64 nt, Homo Sapiens; identical to SEQ ID NO: 141074

SEQ ID NO: 353392 - RNA, 64 nt, Homo Sapiens; identical to SEQ ID NO: 141075

SEQ ID NO: 353393 - RNA, 64 nt, Homo Sapiens; identical to SEQ ID NO: 141076

SEQ ID NO: 353394 - RNA, 64 nt, Homo Sapiens; identical to SEQ ID NO: 141077

SEQ ID NO: 353395 - RNA, 64 nt, Homo Sapiens; identical to SEQ ID NO: 141078

SEQ ID NO: 353396 - RNA, 64 nt, Homo Sapiens; identical to SEQ ID NO: 141079

SEQ ID NO: 353397 - RNA, 64 nt, Homo Sapiens; identical to SEQ ID NO: 141080

SEQ ID NO: 353398 - RNA, 64 nt, Homo Sapiens; identical to SEQ ID NO: 141081

SEQ ID NO: 353399 - RNA, 64 nt, Homo Sapiens; identical to SEQ ID NO: 141082

SEQ ID NO: 353400 - RNA, 64 nt, Homo Sapiens; identical to SEQ ID NO: 141083

SEQ ID NO: 353401 - RNA, 64 nt, Homo Sapiens; identical to SEQ ID NO: 141084

SEQ ID NO: 353402 - RNA, 64 nt, Homo Sapiens; identical to SEQ ID NO: 141085

SEQ ID NO: 353403 - RNA, 64 nt, Homo Sapiens; identical to SEQ ID NO: 141086

SEQ ID NO: 353404 - RNA, 64 nt, Homo Sapiens; identical to SEQ ID NO: 141087

SEQ ID NO: 353405 - RNA, 64 nt, Homo Sapiens; identical to SEQ ID NO: 141088

SEQ ID NO: 353406 - RNA, 64 nt, Homo Sapiens; identical to SEQ ID NO: 141089

SEQ ID NO: 353407 - RNA, 64 nt, Homo Sapiens; identical to SEQ ID NO: 141090

SEQ ID NO: 353408 - RNA, 64 nt, Homo Sapiens; identical to SEQ ID NO: 141091

SEQ ID NO: 353409 - RNA, 64 nt, Homo Sapiens; identical to SEQ ID NO: 141092

SEQ ID NO: 353410 - RNA, 64 nt, Homo Sapiens; identical to SEQ ID NO: 141093

SEQ ID NO: 353411 - RNA, 64 nt, Homo Sapiens; identical to SEQ ID NO: 141094

SEQ ID NO: 353412 - RNA, 64 nt, Homo Sapiens; identical to SEQ ID NO: 141095

SEQ ID NO: 353413 - RNA, 64 nt, Homo Sapiens; identical to SEQ ID NO: 141096

SEQ ID NO: 353414 - RNA, 64 nt, Homo Sapiens; identical to SEQ ID NO: 141097

SEQ ID NO: 353415 - RNA, 64 nt, Homo Sapiens; identical to SEQ ID NO: 141098

SEQ ID NO: 353416 - RNA, 64 nt, Homo Sapiens; identical to SEQ ID NO: 141099

SEQ ID NO: 353417 - RNA, 64 nt, Homo Sapiens; identical to SEQ ID NO: 141100

SEQ ID NO: 353418 - RNA, 64 nt, Homo Sapiens; identical to SEQ ID NO: 141101

SEQ ID NO: 353419 - RNA, 64 nt, Homo Sapiens; identical to SEQ ID NO: 141102

SEQ ID NO: 353420 - RNA, 64 nt, Homo Sapiens; identical to SEQ ID NO: 141103

SEQ ID NO: 353421 - RNA, 64 nt, Homo Sapiens; identical to SEQ ID NO: 141104

SEQ ID NO: 353422 - RNA, 64 nt, Homo Sapiens; identical to SEQ ID NO: 141105

SEQ ID NO: 353423 - RNA, 64 nt, Homo Sapiens; identical to SEQ ID NO: 141106

SEQ ID NO: 353424 - RNA, 64 nt, Homo Sapiens; identical to SEQ ID NO: 141107

SEQ ID NO: 353425 - RNA, 64 nt, Homo Sapiens; identical to SEQ ID NO: 141108

SEQ ID NO: 353426 - RNA, 64 nt, Homo Sapiens; identical to SEQ ID NO: 141109

SEQ ID NO: 353427 - RNA, 64 nt, Homo Sapiens; identical to SEQ ID NO: 141110

SEQ ID NO: 353428 - RNA, 64 nt, Homo Sapiens; identical to SEQ ID NO: 294262

SEQ ID NO: 353429 - RNA, 64 nt, Homo Sapiens; identical to SEQ ID NO: 294263

SEQ ID NO: 353430 - RNA, 64 nt, Homo Sapiens; identical to SEQ ID NO: 294264

SEQ ID NO: 353431 - RNA, 64 nt, Homo Sapiens; identical to SEQ ID NO: 294265

SEQ ID NO: 353432 - RNA, 64 nt, Homo Sapiens; identical to SEQ ID NO: 294266

SEQ ID NO: 353433 - RNA, 64 nt, Homo Sapiens; identical to SEQ ID NO: 294267

SEQ ID NO: 353434 - RNA, 64 nt, Homo Sapiens; identical to SEQ ID NO: 294268

SEQ ID NO: 353435 - RNA, 64 nt, Homo Sapiens; identical to SEQ ID NO: 294269

SEQ ID NO: 353436 - RNA, 64 nt, Homo Sapiens; identical to SEQ ID NO: 294270

SEQ ID NO: 353437 - RNA, 64 nt, Homo Sapiens; identical to SEQ ID NO: 294271

SEQ ID NO: 353438 - RNA, 64 nt, Homo Sapiens; identical to SEQ ID NO: 294272

SEQ ID NO: 353439 - RNA, 64 nt, Homo Sapiens; identical to SEQ ID NO: 294273

SEQ ID NO: 353440 - RNA, 64 nt, Homo Sapiens; identical to SEQ ID NO: 294274

SEQ ID NO: 353441 - RNA, 64 nt, Homo Sapiens; identical to SEQ ID NO: 294275

SEQ ID NO: 353442 - RNA, 64 nt, Homo Sapiens; identical to SEQ ID NO: 294276

SEQ ID NO: 353443 - RNA, 64 nt, Homo Sapiens; identical to SEQ ID NO: 294277

SEQ ID NO: 353444 - RNA, 64 nt, Homo Sapiens; identical to SEQ ID NO: 294278

SEQ ID NO: 353445 - RNA, 64 nt, Homo Sapiens; identical to SEQ ID NO: 294279

SEQ ID NO: 353446 - RNA, 64 nt, Homo Sapiens; identical to SEQ ID NO: 294280

SEQ ID NO: 353447 - RNA, 64 nt, Homo Sapiens; identical to SEQ ID NO: 294281

SEQ ID NO: 353448 - RNA, 64 nt, Homo Sapiens; identical to SEQ ID NO: 294282

SEQ ID NO: 353449 - RNA, 64 nt, Homo Sapiens; identical to SEQ ID NO: 294283

SEQ ID NO: 353450 - RNA, 64 nt, Homo Sapiens; identical to SEQ ID NO: 294284

SEQ ID NO: 353451 - RNA, 64 nt, Homo Sapiens; identical to SEQ ID NO: 294285

SEQ ID NO: 353452 - RNA, 64 nt, Homo Sapiens; identical to SEQ ID NO: 294286

SEQ ID NO: 353453 - RNA, 64 nt, Homo Sapiens; identical to SEQ ID NO: 294287

SEQ ID NO: 353454 - RNA, 64 nt, Homo Sapiens; identical to SEQ ID NO: 294288

SEQ ID NO: 353455 - RNA, 64 nt, Homo Sapiens; identical to SEQ ID NO: 294289

SEQ ID NO: 353456 - RNA, 64 nt, Homo Sapiens; identical to SEQ ID NO: 294290

SEQ ID NO: 353457 - RNA, 64 nt, Homo Sapiens; identical to SEQ ID NO: 294291

SEQ ID NO: 353458 - RNA, 64 nt, Homo Sapiens; identical to SEQ ID NO: 294292

SEQ ID NO: 353459 - RNA, 64 nt, Homo Sapiens; identical to SEQ ID NO: 294293

SEQ ID NO: 353460 - RNA, 64 nt, Homo Sapiens; identical to SEQ ID NO: 294294

SEQ ID NO: 353461 - RNA, 64 nt, Homo Sapiens; identical to SEQ ID NO: 294295

SEQ ID NO: 353462 - RNA, 64 nt, Homo Sapiens; identical to SEQ ID NO: 294296

SEQ ID NO: 353463 - RNA, 64 nt, Homo Sapiens; identical to SEQ ID NO: 294297

SEQ ID NO: 353464 - RNA, 64 nt, Homo Sapiens; identical to SEQ ID NO: 294298

SEQ ID NO: 353465 - RNA, 64 nt, Homo Sapiens; identical to SEQ ID NO: 294299

SEQ ID NO: 353466 - RNA, 64 nt, Homo Sapiens
cuugaacccaggagguggagguugcagugagcugagaucacaccacugcacuccggccugggcg

SEQ ID NO: 353467 - RNA, 64 nt, Homo Sapiens
guuuuaaagcuaaacguaauuuccacuugggacuagaucacaacugaagauaacaagagauuua

SEQ ID NO: 353468 - RNA, 64 nt, Homo Sapiens
aacaaugaaugcucauauguaauugaaauacuucagaucacaugaaaaugcugauuuaacauuu

SEQ ID NO: 353469 - RNA, 64 nt, Homo Sapiens
auuagaaugguaucuguucauuuuagugauaugaagaucacaacuaacaacugacaaaucagag

SEQ ID NO: 353470 - RNA, 64 nt, Homo Sapiens
uucagacuguugugucuguguuagaauugccugaagaucacacacugguuugggugggacaaag

SEQ ID NO: 353471 - RNA, 64 nt, Homo Sapiens
uaacaauagggucuaugucagaggcagauggguuagaucacacaucuauggacaggcugggaca

SEQ ID NO: 353472 - RNA, 64 nt, Homo Sapiens
aaauucuuaucucuguaugugauuggaaaagaaaagaucacauuuguauauucaacaaucuuuc

SEQ ID NO: 353473 - RNA, 64 nt, Homo Sapiens
aagaaucacucgaaccugggagguggagguugcgagaucacaccacugcacuccagugugagca

SEQ ID NO: 353474 - RNA, 64 nt, Homo Sapiens
uuacuccacaggaaaauguaagcuacuuugucauagaucacaaaagaaucauaaugcuaacaaa

SEQ ID NO: 353475 - RNA, 64 nt, Homo Sapiens
ucguagaaaaacauuuuauauguacuauucuuaaagaucacaauuauuuuuaaacuuucuauuu

SEQ ID NO: 353476 - RNA, 64 nt, Homo Sapiens
acugcacuccagccuggcgaguugcagugagcugagaucacacccuugaacccgggaggcaaag

SEQ ID NO: 353477 - RNA, 64 nt, Homo Sapiens
gucaggaguuugagaccagcaggcugaggugggcagaucacaaguguaaucccagcacuuuggg

SEQ ID NO: 353478 - RNA, 64 nt, Homo Sapiens
ugccgggaacgggcaagacauguuuugaaauguaagaucacagacuguuuuuugcaagaccaca

SEQ ID NO: 353479 - RNA, 64 nt, Homo Sapiens
auugguaauucugaauaaggaucugaauaaauccagaucacagacuguuccuuuaccaauaugu

SEQ ID NO: 353480 - RNA, 64 nt, Homo Sapiens
uugaugcugcacagccccaucuggggcauuggcaagaucacaggaaugccguacagagcagagg

SEQ ID NO: 353481 - RNA, 64 nt, Homo Sapiens
caugcacacacguguagcucauguacacgugcacagaucacacagcauacacaugcacgcuuac

SEQ ID NO: 353482 - RNA, 64 nt, Homo Sapiens; identical to SEQ ID NO: 210956

SEQ ID NO: 353483 - RNA, 64 nt, Homo Sapiens; identical to SEQ ID NO: 210957

SEQ ID NO: 353484 - RNA, 64 nt, Homo Sapiens; identical to SEQ ID NO: 210958

SEQ ID NO: 353485 - RNA, 64 nt, Homo Sapiens; identical to SEQ ID NO: 210959

SEQ ID NO: 353486 - RNA, 64 nt, Homo Sapiens; identical to SEQ ID NO: 312521

SEQ ID NO: 353487 - RNA, 64 nt, Homo Sapiens; identical to SEQ ID NO: 312522

SEQ ID NO: 353488 - RNA, 64 nt, Homo Sapiens; identical to SEQ ID NO: 312523

SEQ ID NO: 353489 - RNA, 64 nt, Homo Sapiens; identical to SEQ ID NO: 312524

SEQ ID NO: 353490 - RNA, 64 nt, Homo Sapiens; identical to SEQ ID NO: 312525

SEQ ID NO: 353491 - RNA, 64 nt, Homo Sapiens; identical to SEQ ID NO: 312526

SEQ ID NO: 353492 - RNA, 64 nt, Homo Sapiens; identical to SEQ ID NO: 312527

SEQ ID NO: 353493 - RNA, 64 nt, Homo Sapiens; identical to SEQ ID NO: 312528

SEQ ID NO: 353494 - RNA, 64 nt, Homo Sapiens; identical to SEQ ID NO: 312529

SEQ ID NO: 353495 - RNA, 64 nt, Homo Sapiens; identical to SEQ ID NO: 312530

SEQ ID NO: 353496 - RNA, 64 nt, Homo Sapiens; identical to SEQ ID NO: 312531

SEQ ID NO: 353497 - RNA, 64 nt, Homo Sapiens; identical to SEQ ID NO: 312532

SEQ ID NO: 353498 - RNA, 64 nt, Homo Sapiens; identical to SEQ ID NO: 312533

SEQ ID NO: 353499 - RNA, 64 nt, Homo Sapiens; identical to SEQ ID NO: 312534

SEQ ID NO: 353500 - RNA, 64 nt, Homo Sapiens; identical to SEQ ID NO: 312535

SEQ ID NO: 353501 - RNA, 64 nt, Homo Sapiens; identical to SEQ ID NO: 312536

SEQ ID NO: 353502 - RNA, 64 nt, Homo Sapiens; identical to SEQ ID NO: 312537

SEQ ID NO: 353503 - RNA, 64 nt, Homo Sapiens; identical to SEQ ID NO: 312538

SEQ ID NO: 353504 - RNA, 64 nt, Homo Sapiens; identical to SEQ ID NO: 312539

SEQ ID NO: 353505 - RNA, 64 nt, Homo Sapiens; identical to SEQ ID NO: 312540

SEQ ID NO: 353506 - RNA, 64 nt, Homo Sapiens; identical to SEQ ID NO: 312541

SEQ ID NO: 353507 - RNA, 64 nt, Homo Sapiens; identical to SEQ ID NO: 312542

SEQ ID NO: 353508 - RNA, 64 nt, Homo Sapiens; identical to SEQ ID NO: 312543

SEQ ID NO: 353509 - RNA, 64 nt, Homo Sapiens; identical to SEQ ID NO: 312544

SEQ ID NO: 353510 - RNA, 64 nt, Homo Sapiens; identical to SEQ ID NO: 312545

SEQ ID NO: 353511 - RNA, 64 nt, Homo Sapiens; identical to SEQ ID NO: 312546

SEQ ID NO: 353512 - RNA, 64 nt, Homo Sapiens; identical to SEQ ID NO: 312547

SEQ ID NO: 353513 - RNA, 64 nt, Homo Sapiens; identical to SEQ ID NO: 312548

SEQ ID NO: 353514 - RNA, 64 nt, Homo Sapiens; identical to SEQ ID NO: 312549

SEQ ID NO: 353515 - RNA, 64 nt, Homo Sapiens; identical to SEQ ID NO: 312550

SEQ ID NO: 353516 - RNA, 64 nt, Homo Sapiens; identical to SEQ ID NO: 312551

SEQ ID NO: 353517 - RNA, 64 nt, Homo Sapiens; identical to SEQ ID NO: 312552

SEQ ID NO: 353518 - RNA, 64 nt, Homo Sapiens; identical to SEQ ID NO: 312553

SEQ ID NO: 353519 - RNA, 64 nt, Homo Sapiens; identical to SEQ ID NO: 312554

SEQ ID NO: 353520 - RNA, 64 nt, Homo Sapiens; identical to SEQ ID NO: 312555

SEQ ID NO: 353521 - RNA, 64 nt, Homo Sapiens; identical to SEQ ID NO: 312556

SEQ ID NO: 353522 - RNA, 64 nt, Homo Sapiens; identical to SEQ ID NO: 312557

SEQ ID NO: 353523 - RNA, 64 nt, Homo Sapiens; identical to SEQ ID NO: 312558

SEQ ID NO: 353524 - RNA, 64 nt, Homo Sapiens; identical to SEQ ID NO: 312559

SEQ ID NO: 353525 - RNA, 64 nt, Homo Sapiens; identical to SEQ ID NO: 312560

SEQ ID NO: 353526 - RNA, 64 nt, Homo Sapiens; identical to SEQ ID NO: 312561

SEQ ID NO: 353527 - RNA, 64 nt, Homo Sapiens; identical to SEQ ID NO: 312562

SEQ ID NO: 353528 - RNA, 64 nt, Homo Sapiens; identical to SEQ ID NO: 312563

SEQ ID NO: 353529 - RNA, 64 nt, Homo Sapiens; identical to SEQ ID NO: 312564

SEQ ID NO: 353530 - RNA, 64 nt, Homo Sapiens; identical to SEQ ID NO: 312565

SEQ ID NO: 353531 - RNA, 64 nt, Homo Sapiens; identical to SEQ ID NO: 312566

SEQ ID NO: 353532 - RNA, 64 nt, Homo Sapiens; identical to SEQ ID NO: 312567

SEQ ID NO: 353533 - RNA, 64 nt, Homo Sapiens; identical to SEQ ID NO: 312568

SEQ ID NO: 353534 - RNA, 64 nt, Homo Sapiens
gcuguuugggaauuuuccuugcugcuaccgcgcugccaccaaauggaauugaccagcggcuguu

SEQ ID NO: 353535 - RNA, 64 nt, Homo Sapiens
acuguucucucuugagaaccuguggccucaaccagccaccaagcugauguggcccaaguccauc

SEQ ID NO: 353536 - RNA, 64 nt, Homo Sapiens
gacuaaagaggacgccguccuuaaaaccugacgugccaccaaagccuuccuuuguuccucaaac

SEQ ID NO: 353537 - RNA, 64 nt, Homo Sapiens
agcauuuuuuuuucauguguggcaucuuuuucaugccaccaacaaacuuguugugugugugcgu

SEQ ID NO: 353538 - RNA, 64 nt, Homo Sapiens
gaggugcaggggagucaccgcccagaccuccccagccaccaaccgaccccaccucuguuccuaa

SEQ ID NO: 353539 - RNA, 64 nt, Homo Sapiens
gaggcccugcccggggcuggggccuaguccagcagccaccaaagucuggcagacuuucugcauu

SEQ ID NO: 353540 - RNA, 64 nt, Homo Sapiens
cccagagauggcagguguguagccacucacuggggccaccaaaauggcccuccuccuuuuccac

SEQ ID NO: 353541 - RNA, 64 nt, Homo Sapiens
uuuuuccuaccacuaccuuauggccacugccucagccaccaagcgggucagcuggucucaaaac

SEQ ID NO: 353542 - RNA, 64 nt, Homo Sapiens; identical to SEQ ID NO: 157974

SEQ ID NO: 353543 - RNA, 64 nt, Homo Sapiens; identical to SEQ ID NO: 157975

SEQ ID NO: 353544 - RNA, 64 nt, Homo Sapiens; identical to SEQ ID NO: 157976

SEQ ID NO: 353545 - RNA, 64 nt, Homo Sapiens; identical to SEQ ID NO: 157977

SEQ ID NO: 353546 - RNA, 64 nt, Homo Sapiens; identical to SEQ ID NO: 157978

SEQ ID NO: 353547 - RNA, 64 nt, Homo Sapiens; identical to SEQ ID NO: 157979

SEQ ID NO: 353548 - RNA, 64 nt, Homo Sapiens; identical to SEQ ID NO: 157980

SEQ ID NO: 353549 - RNA, 64 nt, Homo Sapiens; identical to SEQ ID NO: 157981

SEQ ID NO: 353550 - RNA, 64 nt, Homo Sapiens; identical to SEQ ID NO: 157982

SEQ ID NO: 353551 - RNA, 64 nt, Homo Sapiens; identical to SEQ ID NO: 157983

SEQ ID NO: 353552 - RNA, 62 nt, Homo Sapiens
guucugcccuccgcagggagagggguuggcuuggggugaaaauuacuuccuuuguuacaggg

SEQ ID NO: 353553 - RNA, 62 nt, Homo Sapiens
caugagguccugaaggcuuagggcccauguugggggugaagugugcuagugggucccuaaga

SEQ ID NO: 353554 - RNA, 62 nt, Homo Sapiens
cgccagagcccuggcuggugaugugcuggcugggggugaaucccaaugagggucccucucag

SEQ ID NO: 353555 - RNA, 62 nt, Homo Sapiens
cgccagagcccuggauggugaugcgcuggcugggggugaaucccaaugagggucccucucag

SEQ ID NO: 353556 - RNA, 62 nt, Homo Sapiens
cgccagagcccuggcuggugacaugcuggcugggggugaauccgaaugacagugcagacguu

SEQ ID NO: 353557 - RNA, 62 nt, Homo Sapiens
aagaaacaugguccauuagaggggaaagcccaggggugaaucuucacgccccaaacagugcc

SEQ ID NO: 353558 - RNA, 62 nt, Homo Sapiens
uuaagccuauggaaccggcuuugcuguucuggggggugaaaauagacuaacuacuggagaaa

SEQ ID NO: 353559 - RNA, 62 nt, Homo Sapiens
uaauguuuuaauaucacaucucacaaauaacaggggugaauguuucucucuagcaaucuagg

SEQ ID NO: 353560 - RNA, 62 nt, Homo Sapiens
gagaucuuaagcaaacagucccaaaccucuuaggggugaaaaaagaaacaugccacuugauu

SEQ ID NO: 353561 - RNA, 62 nt, Homo Sapiens
ucaggguaccuguuagccccugacaacucaguggggugaaguuuuggaggucagagucugcu

SEQ ID NO: 353562 - RNA, 62 nt, Homo Sapiens
aucugggccaaccaggggucugcauccuuucuggggugaagaucuuagcugcacuccaacau

SEQ ID NO: 353563 - RNA, 62 nt, Homo Sapiens
agcuggcagauacaaaagacucugcucaggaaggggugaaaucacaaauccuaagauuuuuu

SEQ ID NO: 353564 - RNA, 64 nt, Homo Sapiens
cccugccgaaucaguuuuguggauuacaggcaugagucaccaugcucggccucccaaagugcug

SEQ ID NO: 353565 - RNA, 64 nt, Homo Sapiens
guggcaggcuugcuaggcccacgaaguucagaacagucaccaaucaggagcaccuccuaccacc

SEQ ID NO: 353566 - RNA, 64 nt, Homo Sapiens
agacaccauauuuauggagaacauuaggacaaaaagucaccaacuuacuuuguaacauuuuaau

SEQ ID NO: 353567 - RNA, 64 nt, Homo Sapiens
uccagacaaggcccacugcaguuccuauggcgccagucaccagcuccuagacagcacuugggua

SEQ ID NO: 353568 - RNA, 64 nt, Homo Sapiens
agagccauauguaugaaagcaaauucgaagaguuagucaccaagccucccagauaauugcuucc

SEQ ID NO: 353569 - RNA, 64 nt, Homo Sapiens
uucucacuguuaacauuaggugcuuagcuaucauagucaccauuuauaauagaaagccagccac

SEQ ID NO: 353570 - RNA, 64 nt, Homo Sapiens
acugucccuuccagcugccccagacaggaagcagagucaccacgcagcagugucccuucuuggg

SEQ ID NO: 353571 - RNA, 64 nt, Homo Sapiens
acugguugagauggaauagaauaacugggcuaugagucaccagcccacuuugugacccagcaag

SEQ ID NO: 353572 - RNA, 64 nt, Homo Sapiens
gccaccagggggcaggagugcacuaccugcugucagucaccagaguggccgcucagugcccagc

SEQ ID NO: 353573 - RNA, 64 nt, Homo Sapiens
auuuugaagacuugcaugcauggugugggacuuaagucaccauaaggacugcugggaaaacagg

SEQ ID NO: 353574 - RNA, 64 nt, Homo Sapiens
cugccucucccucucacccaagaaccagcucucuagucaccaccagaccauuucccaaggucac

SEQ ID NO: 353575 - RNA, 64 nt, Homo Sapiens
cuuuuggaauaguuucaccugagaaaacauaguuggcuauuaucuaucuuaaccuguucaggcu

SEQ ID NO: 353576 - RNA, 64 nt, Homo Sapiens
cuuuaaaguguuauuuuauuaauuaaaaggauauggcuauuauuauauauucucuaaagauuug

SEQ ID NO: 353577 - RNA, 64 nt, Homo Sapiens; identical to SEQ ID NO: 217042

SEQ ID NO: 353578 - RNA, 64 nt, Homo Sapiens; identical to SEQ ID NO: 217043

SEQ ID NO: 353579 - RNA, 64 nt, Homo Sapiens; identical to SEQ ID NO: 217044

SEQ ID NO: 353580 - RNA, 64 nt, Homo Sapiens; identical to SEQ ID NO: 217045

SEQ ID NO: 353581 - RNA, 64 nt, Homo Sapiens; identical to SEQ ID NO: 217046

SEQ ID NO: 353582 - RNA, 64 nt, Homo Sapiens; identical to SEQ ID NO: 217047

SEQ ID NO: 353583 - RNA, 64 nt, Homo Sapiens; identical to SEQ ID NO: 217048

SEQ ID NO: 353584 - RNA, 64 nt, Homo Sapiens; identical to SEQ ID NO: 217049

SEQ ID NO: 353585 - RNA, 64 nt, Homo Sapiens; identical to SEQ ID NO: 217050

SEQ ID NO: 353586 - RNA, 64 nt, Homo Sapiens; identical to SEQ ID NO: 217051

SEQ ID NO: 353587 - RNA, 64 nt, Homo Sapiens; identical to SEQ ID NO: 217052

SEQ ID NO: 353588 - RNA, 64 nt, Homo Sapiens; identical to SEQ ID NO: 217053

SEQ ID NO: 353589 - RNA, 64 nt, Homo Sapiens; identical to SEQ ID NO: 217054

SEQ ID NO: 353590 - RNA, 64 nt, Homo Sapiens; identical to SEQ ID NO: 217055

SEQ ID NO: 353591 - RNA, 64 nt, Homo Sapiens; identical to SEQ ID NO: 217056

SEQ ID NO: 353592 - RNA, 64 nt, Homo Sapiens; identical to SEQ ID NO: 217057

SEQ ID NO: 353593 - RNA, 64 nt, Homo Sapiens; identical to SEQ ID NO: 217058

SEQ ID NO: 353594 - RNA, 64 nt, Homo Sapiens; identical to SEQ ID NO: 70741

SEQ ID NO: 353595 - RNA, 64 nt, Homo Sapiens; identical to SEQ ID NO: 70742

SEQ ID NO: 353596 - RNA, 64 nt, Homo Sapiens; identical to SEQ ID NO: 70743

SEQ ID NO: 353597 - RNA, 64 nt, Homo Sapiens; identical to SEQ ID NO: 70744

SEQ ID NO: 353598 - RNA, 63 nt, Homo Sapiens; identical to SEQ ID NO: 118067

SEQ ID NO: 353599 - RNA, 64 nt, Homo Sapiens; identical to SEQ ID NO: 118068

SEQ ID NO: 353600 - RNA, 64 nt, Homo Sapiens; identical to SEQ ID NO: 118069

SEQ ID NO: 353601 - RNA, 64 nt, Homo Sapiens; identical to SEQ ID NO: 118070

SEQ ID NO: 353602 - RNA, 64 nt, Homo Sapiens; identical to SEQ ID NO: 118071

SEQ ID NO: 353603 - RNA, 64 nt, Homo Sapiens; identical to SEQ ID NO: 118072

SEQ ID NO: 353604 - RNA, 64 nt, Homo Sapiens; identical to SEQ ID NO: 118073

SEQ ID NO: 353605 - RNA, 64 nt, Homo Sapiens; identical to SEQ ID NO: 118074

SEQ ID NO: 353606 - RNA, 64 nt, Homo Sapiens; identical to SEQ ID NO: 118075

SEQ ID NO: 353607 - RNA, 64 nt, Homo Sapiens; identical to SEQ ID NO: 118076

SEQ ID NO: 353608 - RNA, 64 nt, Homo Sapiens; identical to SEQ ID NO: 118077

SEQ ID NO: 353609 - RNA, 64 nt, Homo Sapiens; identical to SEQ ID NO: 118078

SEQ ID NO: 353610 - RNA, 64 nt, Homo Sapiens; identical to SEQ ID NO: 118079

SEQ ID NO: 353611 - RNA, 64 nt, Homo Sapiens; identical to SEQ ID NO: 118080

SEQ ID NO: 353612 - RNA, 64 nt, Homo Sapiens; identical to SEQ ID NO: 118081

SEQ ID NO: 353613 - RNA, 64 nt, Homo Sapiens; identical to SEQ ID NO: 118082

SEQ ID NO: 353614 - RNA, 64 nt, Homo Sapiens; identical to SEQ ID NO: 118083

SEQ ID NO: 353615 - RNA, 64 nt, Homo Sapiens; identical to SEQ ID NO: 118084

SEQ ID NO: 353616 - RNA, 64 nt, Homo Sapiens; identical to SEQ ID NO: 118085

SEQ ID NO: 353617 - RNA, 64 nt, Homo Sapiens; identical to SEQ ID NO: 118086

SEQ ID NO: 353618 - RNA, 64 nt, Homo Sapiens; identical to SEQ ID NO: 118087

SEQ ID NO: 353619 - RNA, 64 nt, Homo Sapiens; identical to SEQ ID NO: 118088

SEQ ID NO: 353620 - RNA, 64 nt, Homo Sapiens; identical to SEQ ID NO: 118089

SEQ ID NO: 353621 - RNA, 64 nt, Homo Sapiens; identical to SEQ ID NO: 118090

SEQ ID NO: 353622 - RNA, 64 nt, Homo Sapiens; identical to SEQ ID NO: 118091

SEQ ID NO: 353623 - RNA, 64 nt, Homo Sapiens; identical to SEQ ID NO: 118092

SEQ ID NO: 353624 - RNA, 64 nt, Homo Sapiens; identical to SEQ ID NO: 118093

SEQ ID NO: 353625 - RNA, 64 nt, Homo Sapiens; identical to SEQ ID NO: 118094

SEQ ID NO: 353626 - RNA, 64 nt, Homo Sapiens; identical to SEQ ID NO: 118095

SEQ ID NO: 353627 - RNA, 64 nt, Homo Sapiens; identical to SEQ ID NO: 118096

SEQ ID NO: 353628 - RNA, 64 nt, Homo Sapiens; identical to SEQ ID NO: 118097

SEQ ID NO: 353629 - RNA, 64 nt, Homo Sapiens; identical to SEQ ID NO: 118098

SEQ ID NO: 353630 - RNA, 64 nt, Homo Sapiens; identical to SEQ ID NO: 118099

SEQ ID NO: 353631 - RNA, 64 nt, Homo Sapiens; identical to SEQ ID NO: 118100

SEQ ID NO: 353632 - RNA, 64 nt, Homo Sapiens; identical to SEQ ID NO: 118101

SEQ ID NO: 353633 - RNA, 64 nt, Homo Sapiens; identical to SEQ ID NO: 118102

SEQ ID NO: 353634 - RNA, 64 nt, Homo Sapiens; identical to SEQ ID NO: 118103

SEQ ID NO: 353635 - RNA, 64 nt, Homo Sapiens; identical to SEQ ID NO: 118104

SEQ ID NO: 353636 - RNA, 64 nt, Homo Sapiens; identical to SEQ ID NO: 118105

SEQ ID NO: 353637 - RNA, 64 nt, Homo Sapiens; identical to SEQ ID NO: 118106

SEQ ID NO: 353638 - RNA, 64 nt, Homo Sapiens; identical to SEQ ID NO: 118107

SEQ ID NO: 353639 - RNA, 64 nt, Homo Sapiens; identical to SEQ ID NO: 118108

SEQ ID NO: 353640 - RNA, 64 nt, Homo Sapiens; identical to SEQ ID NO: 118109

SEQ ID NO: 353641 - RNA, 64 nt, Homo Sapiens; identical to SEQ ID NO: 118110

SEQ ID NO: 353642 - RNA, 64 nt, Homo Sapiens; identical to SEQ ID NO: 118111

SEQ ID NO: 353643 - RNA, 64 nt, Homo Sapiens; identical to SEQ ID NO: 118112

SEQ ID NO: 353644 - RNA, 64 nt, Homo Sapiens; identical to SEQ ID NO: 118113

SEQ ID NO: 353645 - RNA, 64 nt, Homo Sapiens; identical to SEQ ID NO: 118114

SEQ ID NO: 353646 - RNA, 64 nt, Homo Sapiens; identical to SEQ ID NO: 118115

SEQ ID NO: 353647 - RNA, 64 nt, Homo Sapiens; identical to SEQ ID NO: 118116

SEQ ID NO: 353648 - RNA, 64 nt, Homo Sapiens; identical to SEQ ID NO: 118117

SEQ ID NO: 353649 - RNA, 64 nt, Homo Sapiens; identical to SEQ ID NO: 118118

SEQ ID NO: 353650 - RNA, 64 nt, Homo Sapiens; identical to SEQ ID NO: 118119

SEQ ID NO: 353651 - RNA, 64 nt, Homo Sapiens; identical to SEQ ID NO: 118120

SEQ ID NO: 353652 - RNA, 64 nt, Homo Sapiens; identical to SEQ ID NO: 118121

SEQ ID NO: 353653 - RNA, 64 nt, Homo Sapiens; identical to SEQ ID NO: 87364

SEQ ID NO: 353654 - RNA, 64 nt, Homo Sapiens; identical to SEQ ID NO: 87365

SEQ ID NO: 353655 - RNA, 64 nt, Homo Sapiens; identical to SEQ ID NO: 87366

SEQ ID NO: 353656 - RNA, 64 nt, Homo Sapiens; identical to SEQ ID NO: 87367

SEQ ID NO: 353657 - RNA, 64 nt, Homo Sapiens; identical to SEQ ID NO: 87368

SEQ ID NO: 353658 - RNA, 64 nt, Homo Sapiens; identical to SEQ ID NO: 87369

SEQ ID NO: 353659 - RNA, 64 nt, Homo Sapiens; identical to SEQ ID NO: 87370

SEQ ID NO: 353660 - RNA, 64 nt, Homo Sapiens; identical to SEQ ID NO: 87371

SEQ ID NO: 353661 - RNA, 64 nt, Homo Sapiens; identical to SEQ ID NO: 87372

SEQ ID NO: 353662 - RNA, 64 nt, Homo Sapiens; identical to SEQ ID NO: 87373

SEQ ID NO: 353663 - RNA, 64 nt, Homo Sapiens; identical to SEQ ID NO: 87374

SEQ ID NO: 353664 - RNA, 64 nt, Homo Sapiens; identical to SEQ ID NO: 87375

SEQ ID NO: 353665 - RNA, 64 nt, Homo Sapiens; identical to SEQ ID NO: 87376

SEQ ID NO: 353666 - RNA, 64 nt, Homo Sapiens; identical to SEQ ID NO: 87377

SEQ ID NO: 353667 - RNA, 64 nt, Homo Sapiens; identical to SEQ ID NO: 87378

SEQ ID NO: 353668 - RNA, 64 nt, Homo Sapiens; identical to SEQ ID NO: 87379

SEQ ID NO: 353669 - RNA, 64 nt, Homo Sapiens; identical to SEQ ID NO: 87380

SEQ ID NO: 353670 - RNA, 64 nt, Homo Sapiens; identical to SEQ ID NO: 87381

SEQ ID NO: 353671 - RNA, 64 nt, Homo Sapiens; identical to SEQ ID NO: 87382

SEQ ID NO: 353672 - RNA, 64 nt, Homo Sapiens; identical to SEQ ID NO: 87383

SEQ ID NO: 353673 - RNA, 64 nt, Homo Sapiens; identical to SEQ ID NO: 87384

SEQ ID NO: 353674 - RNA, 64 nt, Homo Sapiens; identical to SEQ ID NO: 87385

SEQ ID NO: 353675 - RNA, 64 nt, Homo Sapiens; identical to SEQ ID NO: 87386

SEQ ID NO: 353676 - RNA, 64 nt, Homo Sapiens; identical to SEQ ID NO: 87387

SEQ ID NO: 353677 - RNA, 64 nt, Homo Sapiens; identical to SEQ ID NO: 87388

SEQ ID NO: 353678 - RNA, 64 nt, Homo Sapiens; identical to SEQ ID NO: 87389

SEQ ID NO: 353679 - RNA, 64 nt, Homo Sapiens; identical to SEQ ID NO: 87390

SEQ ID NO: 353680 - RNA, 64 nt, Homo Sapiens; identical to SEQ ID NO: 87391

SEQ ID NO: 353681 - RNA, 64 nt, Homo Sapiens; identical to SEQ ID NO: 87392

SEQ ID NO: 353682 - RNA, 64 nt, Homo Sapiens; identical to SEQ ID NO: 87393

SEQ ID NO: 353683 - RNA, 64 nt, Homo Sapiens; identical to SEQ ID NO: 87394

SEQ ID NO: 353684 - RNA, 64 nt, Homo Sapiens; identical to SEQ ID NO: 87395

SEQ ID NO: 353685 - RNA, 64 nt, Homo Sapiens; identical to SEQ ID NO: 87396

SEQ ID NO: 353686 - RNA, 64 nt, Homo Sapiens; identical to SEQ ID NO: 87397

SEQ ID NO: 353687 - RNA, 64 nt, Homo Sapiens; identical to SEQ ID NO: 87398

SEQ ID NO: 353688 - RNA, 64 nt, Homo Sapiens; identical to SEQ ID NO: 87399

SEQ ID NO: 353689 - RNA, 64 nt, Homo Sapiens; identical to SEQ ID NO: 87400

SEQ ID NO: 353690 - RNA, 64 nt, Homo Sapiens; identical to SEQ ID NO: 87401

SEQ ID NO: 353691 - RNA, 64 nt, Homo Sapiens; identical to SEQ ID NO: 87402

SEQ ID NO: 353692 - RNA, 64 nt, Homo Sapiens; identical to SEQ ID NO: 87403

SEQ ID NO: 353693 - RNA, 64 nt, Homo Sapiens; identical to SEQ ID NO: 87404

SEQ ID NO: 353694 - RNA, 64 nt, Homo Sapiens; identical to SEQ ID NO: 87405

SEQ ID NO: 353695 - RNA, 64 nt, Homo Sapiens; identical to SEQ ID NO: 87406

SEQ ID NO: 353696 - RNA, 64 nt, Homo Sapiens; identical to SEQ ID NO: 106476

SEQ ID NO: 353697 - RNA, 64 nt, Homo Sapiens; identical to SEQ ID NO: 106477

SEQ ID NO: 353698 - RNA, 64 nt, Homo Sapiens; identical to SEQ ID NO: 69094

SEQ ID NO: 353699 - RNA, 64 nt, Homo Sapiens; identical to SEQ ID NO: 69095

SEQ ID NO: 353700 - RNA, 64 nt, Homo Sapiens; identical to SEQ ID NO: 69096

SEQ ID NO: 353701 - RNA, 64 nt, Homo Sapiens; identical to SEQ ID NO: 69097

SEQ ID NO: 353702 - RNA, 64 nt, Homo Sapiens; identical to SEQ ID NO: 69098

SEQ ID NO: 353703 - RNA, 64 nt, Homo Sapiens; identical to SEQ ID NO: 69099

SEQ ID NO: 353704 - RNA, 64 nt, Homo Sapiens
acaugcacuuuccauauuuucaaaauuauaaaauaccuuuaaagauuacaauugaggaaaaagu

SEQ ID NO: 353705 - RNA, 64 nt, Homo Sapiens
uuuauuucuguaugagacaaaaugucuguaauuaaccuuuaauuuuuugccuucacaaaagccu

SEQ ID NO: 353706 - RNA, 64 nt, Homo Sapiens
agaaauaaugucaaaaauauuuaggaauuuaauaaccuuuaagucagaaacuaaaacaaauacu

SEQ ID NO: 353707 - RNA, 64 nt, Homo Sapiens
uaaaagcuaagaugccuucuaacuucauaagcaaaccuuuaacuaauuauguaucugaaaguca

SEQ ID NO: 353708 - RNA, 64 nt, Homo Sapiens
agauaaacccugcaaauguaaagaguguaacaaaaccuuuaaacagcccucaccggugaauaaa

SEQ ID NO: 353709 - RNA, 64 nt, Homo Sapiens
uauaaaaccauagaaauguaaaagaugugacaaaaccuuuaagccauacuccaggcuucuuaaa

SEQ ID NO: 353710 - RNA, 64 nt, Homo Sapiens
auuauaaugauaagcauuauucauaaaacuuguuaccuuuaagaagguggaaguggcaaaccau

SEQ ID NO: 353711 - RNA, 64 nt, Homo Sapiens
uaauuguucccuuucuguuuucauauagugaauaaccuuuaaaggguuguuuuguuuuguuuug

SEQ ID NO: 353712 - RNA, 64 nt, Homo Sapiens
agaucuacauuuuguacauauuuauauaaaauuuaccuuuaaguauuuacuuuaaaaaauuuaa

SEQ ID NO: 353713 - RNA, 64 nt, Homo Sapiens
uaaagcaaauuggagacugggcacaguggcucccaccuuuaaucccagcaccuggggaggcuga

SEQ ID NO: 353714 - RNA, 64 nt, Homo Sapiens
aagggaaaaauuaaaaauaccuagacugcaauaaaccuuuaaauuggauuuucagugagaauuu

SEQ ID NO: 353715 - RNA, 64 nt, Homo Sapiens
gcaggaaaagccagagaagccgguggagagcagcaccuuuaagagcccucucucucugcuugcc

SEQ ID NO: 353716 - RNA, 64 nt, Homo Sapiens
uuguagcagaaccccgggucaucucaugucagaaaccuuuaauccaggccuaaauuugcauaga

SEQ ID NO: 353717 - RNA, 64 nt, Homo Sapiens
uuagauucauaucauuuaauuucacauauucaacaccuuuaaauguuguaaucuuaauaugcga

SEQ ID NO: 353718 - RNA, 64 nt, Homo Sapiens
aauggucuaacuggcaucucuuguaucaagaaguaccuuuaagguagaccuuuucagggugccc

SEQ ID NO: 353719 - RNA, 64 nt, Homo Sapiens
aaagcuucuagucuccauaagauaagaaauccuuaccuuuaaaacaacuuuuugcuuugcuuug

SEQ ID NO: 353720 - RNA, 64 nt, Homo Sapiens
acgaaggugacucacuuugccuuugcuaaaucucaccuuuaaaaaaaacugcuucuaauccuuc

SEQ ID NO: 353721 - RNA, 64 nt, Homo Sapiens
ccccaccugagccccagcucgcugaccuugccucaccuuuaaccccucugagcugcacuucacc

SEQ ID NO: 353722 - RNA, 64 nt, Homo Sapiens
uugcagaccuuccuucacccacucuggaaaccgcaccuuuaacugccccgcuucaccccuucug

SEQ ID NO: 353723 - RNA, 64 nt, Homo Sapiens; identical to SEQ ID NO: 274666

SEQ ID NO: 353724 - RNA, 64 nt, Homo Sapiens; identical to SEQ ID NO: 274667

SEQ ID NO: 353725 - RNA, 64 nt, Homo Sapiens
uaauuuaaauuucauuuuagguaagucauaucagauaucagaccuuaaaauucuguaguguaug

SEQ ID NO: 353726 - RNA, 64 nt, Homo Sapiens
ucagaccuaauuuaaauuucguguaugguaagucauaucagauacccccuuuuaaaauucugua

SEQ ID NO: 353727 - RNA, 64 nt, Homo Sapiens
cuccaaaaaguauuugaaauuuuauaucagauuuauaucagaccucaaggccagucauuuuuaa

SEQ ID NO: 353728 - RNA, 64 nt, Homo Sapiens
uauaucagacccuccaaaaagucauuuuuaauuuauaucagauuuuaugcuguggucaaggcca

SEQ ID NO: 353729 - RNA, 64 nt, Homo Sapiens
cuacaagagacaaagaaaugauuuugccuccuggauaucagaaaaauccaugugaaaauguagu

SEQ ID NO: 353730 - RNA, 64 nt, Homo Sapiens
uauucagaauaaguaggagaaugaaaacugcagcauaucagacagcaauuuaacagcuugaaac

SEQ ID NO: 353731 - RNA, 64 nt, Homo Sapiens
gucuagauagagaaaguauuaauauauaggagggauaucagaauguuuagcuucuaaaugaaau

SEQ ID NO: 353732 - RNA, 64 nt, Homo Sapiens
ccuuuuuuccugccacagaaguaauaagccauuuauaucagaaaagauuuuuguuagucaucau

SEQ ID NO: 353733 - RNA, 64 nt, Homo Sapiens
ucaccaaauauaugccuuacugcauuuucacaacauaucagacuuuuuuaaacuucaguuuuac

SEQ ID NO: 353734 - RNA, 64 nt, Homo Sapiens
gaguaaucgguugguugguuacacaggacuuauuauaucagaguaagggaacaugugaaugaau

SEQ ID NO: 353735 - RNA, 64 nt, Homo Sapiens
gacaaggauggcuggcuggucaguguccaccaguuggaagcaauauaagugacuccggaugcau

SEQ ID NO: 353736 - RNA, 64 nt, Homo Sapiens
uuuaugaagaaugaugguggaacaaucaggagauuggaagcaaaaggaaaaagucuagacccag

SEQ ID NO: 353737 - RNA, 58 nt, Homo Sapiens
gucuggaugaccaucgguagcaaccuauuggaagcauacaaagcaguuuauuuuagag

SEQ ID NO: 353738 - RNA, 64 nt, Homo Sapiens
cuuuauaauuuacccauuucuauacaacaggcaguggaagcaguuucagagaacuuuuugcaug

SEQ ID NO: 353739 - RNA, 64 nt, Homo Sapiens
cuugagagagacaagaugaaauuugaguuuguuuuggaagcaugcucaucuccucacacugcug

SEQ ID NO: 353740 - RNA, 64 nt, Homo Sapiens
cacugccuccaagucaggcagaccuuggugaaucuggaagcaagaggaccugagccagaugcac

SEQ ID NO: 353741 - RNA, 64 nt, Homo Sapiens
uugcccuuuagaauaaauauacauaauaauuuuguggaagcauuuuuuucacaccuuuugcauu

SEQ ID NO: 353742 - RNA, 64 nt, Homo Sapiens
uugagcaaugaaauccguaaagcagaagccaagauggaagcagugaaauuaaaccauccuuguc

SEQ ID NO: 353743 - RNA, 64 nt, Homo Sapiens
acugauuucaugcagguccuaaaucgaacucaaauggaagcaaaaucagaacuauuaauagcau

SEQ ID NO: 353744 - RNA, 64 nt, Homo Sapiens
guugccuggauuuggaggcaagcaagaagaggaguggaagcacaagugaaguuuuccuaaggca

SEQ ID NO: 353745 - RNA, 64 nt, Homo Sapiens
uuuauucuguuccccagcaaaaggauaccugcuuuggaagcaugggcuugauaccaaucgagcu

SEQ ID NO: 353746 - RNA, 64 nt, Homo Sapiens
acagacaccguggacagcgcgccugaauuugggauggaagcagguaaagauguuuuaagcuaaa

SEQ ID NO: 353747 - RNA, 64 nt, Homo Sapiens
acuuuaauuuuauauaacguuggaaacauauuuuuggaagcaaauggacaacaccacgaccaca

SEQ ID NO: 353748 - RNA, 64 nt, Homo Sapiens
caaaaagggcugcuguggcauaaaguaucuauuguggaagcagcggguuggcugugccacucca

SEQ ID NO: 353749 - RNA, 64 nt, Homo Sapiens
ugggguggcaugggagagaaggaaaccaagcccuuggaagcaaguacacccuggaugucacuuu

SEQ ID NO: 353750 - RNA, 64 nt, Homo Sapiens
auuuuccccccaaguggaggauucuccugcaaguuggaagcacacucuaguggugauccggcuc

SEQ ID NO: 353751 - RNA, 64 nt, Homo Sapiens
aaccugaguccggcucuucagcaggcugcacaaguggaagcaacuaauucuggugcucaggcug

SEQ ID NO: 353752 - RNA, 64 nt, Homo Sapiens
gucagucaguaauuucacaaccguuaucagaguuuggaagcagaaauagcuguuaacuaaaauc

SEQ ID NO: 353753 - RNA, 64 nt, Homo Sapiens
agaugacugacugccaauacuugucaccauucccuggaagcagcuaccuaggggaaacaagaug

SEQ ID NO: 353754 - RNA, 64 nt, Homo Sapiens
uugauuugcaaauuuggauuuacacccauuguuuuggaagcacaucagcugaauaaaguugagg

SEQ ID NO: 353755 - RNA, 64 nt, Homo Sapiens
gcaccagcugcugggguggggacucaccgucaccuggaagcaggugucggccuccucccgacuu

SEQ ID NO: 353756 - RNA, 64 nt, Homo Sapiens
aaauagggccccaccuauuuagcaaaauggggguuggaagcaaaacaauggggaaaaguuaagg

SEQ ID NO: 353757 - RNA, 64 nt, Homo Sapiens
gacucagugcagugggcagggaagacauaacagauggaagcaaaggaauccugccugccuucag

SEQ ID NO: 353758 - RNA, 64 nt, Homo Sapiens
uguauugaaggcccauugaaugacuaauccaggcuggaagcauucccaugugggugucugaguc

SEQ ID NO: 353759 - RNA, 64 nt, Homo Sapiens; identical to SEQ ID NO: 45477

SEQ ID NO: 353760 - RNA, 64 nt, Homo Sapiens; identical to SEQ ID NO: 45478

SEQ ID NO: 353761 - RNA, 64 nt, Homo Sapiens; identical to SEQ ID NO: 45479

SEQ ID NO: 353762 - RNA, 64 nt, Homo Sapiens; identical to SEQ ID NO: 45480

SEQ ID NO: 353763 - RNA, 64 nt, Homo Sapiens; identical to SEQ ID NO: 45481

SEQ ID NO: 353764 - RNA, 64 nt, Homo Sapiens; identical to SEQ ID NO: 45482

SEQ ID NO: 353765 - RNA, 64 nt, Homo Sapiens; identical to SEQ ID NO: 45483

SEQ ID NO: 353766 - RNA, 64 nt, Homo Sapiens; identical to SEQ ID NO: 45484

SEQ ID NO: 353767 - RNA, 64 nt, Homo Sapiens; identical to SEQ ID NO: 45485

SEQ ID NO: 353768 - RNA, 64 nt, Homo Sapiens; identical to SEQ ID NO: 45486

SEQ ID NO: 353769 - RNA, 64 nt, Homo Sapiens; identical to SEQ ID NO: 45487

SEQ ID NO: 353770 - RNA, 56 nt, Homo Sapiens; identical to SEQ ID NO: 45488

SEQ ID NO: 353771 - RNA, 64 nt, Homo Sapiens; identical to SEQ ID NO: 45489

SEQ ID NO: 353772 - RNA, 64 nt, Homo Sapiens; identical to SEQ ID NO: 45490

SEQ ID NO: 353773 - RNA, 64 nt, Homo Sapiens; identical to SEQ ID NO: 45491

SEQ ID NO: 353774 - RNA, 64 nt, Homo Sapiens; identical to SEQ ID NO: 45492

SEQ ID NO: 353775 - RNA, 64 nt, Homo Sapiens; identical to SEQ ID NO: 45493

SEQ ID NO: 353776 - RNA, 64 nt, Homo Sapiens; identical to SEQ ID NO: 45494

SEQ ID NO: 353777 - RNA, 64 nt, Homo Sapiens; identical to SEQ ID NO: 45495

SEQ ID NO: 353778 - RNA, 64 nt, Homo Sapiens; identical to SEQ ID NO: 45496

SEQ ID NO: 353779 - RNA, 64 nt, Homo Sapiens; identical to SEQ ID NO: 45497

SEQ ID NO: 353780 - RNA, 64 nt, Homo Sapiens; identical to SEQ ID NO: 45498

SEQ ID NO: 353781 - RNA, 64 nt, Homo Sapiens; identical to SEQ ID NO: 45499

SEQ ID NO: 353782 - RNA, 64 nt, Homo Sapiens; identical to SEQ ID NO: 45500

SEQ ID NO: 353783 - RNA, 64 nt, Homo Sapiens; identical to SEQ ID NO: 45501

SEQ ID NO: 353784 - RNA, 64 nt, Homo Sapiens; identical to SEQ ID NO: 45502

SEQ ID NO: 353785 - RNA, 64 nt, Homo Sapiens; identical to SEQ ID NO: 45503

SEQ ID NO: 353786 - RNA, 64 nt, Homo Sapiens; identical to SEQ ID NO: 45504

SEQ ID NO: 353787 - RNA, 64 nt, Homo Sapiens; identical to SEQ ID NO: 45505

SEQ ID NO: 353788 - RNA, 64 nt, Homo Sapiens; identical to SEQ ID NO: 45506

SEQ ID NO: 353789 - RNA, 64 nt, Homo Sapiens; identical to SEQ ID NO: 45507

SEQ ID NO: 353790 - RNA, 64 nt, Homo Sapiens; identical to SEQ ID NO: 45508

SEQ ID NO: 353791 - RNA, 64 nt, Homo Sapiens; identical to SEQ ID NO: 45509

SEQ ID NO: 353792 - RNA, 64 nt, Homo Sapiens; identical to SEQ ID NO: 45510

SEQ ID NO: 353793 - RNA, 64 nt, Homo Sapiens; identical to SEQ ID NO: 45511

SEQ ID NO: 353794 - RNA, 64 nt, Homo Sapiens; identical to SEQ ID NO: 45512

SEQ ID NO: 353795 - RNA, 64 nt, Homo Sapiens; identical to SEQ ID NO: 45513

SEQ ID NO: 353796 - RNA, 64 nt, Homo Sapiens; identical to SEQ ID NO: 45514

SEQ ID NO: 353797 - RNA, 64 nt, Homo Sapiens; identical to SEQ ID NO: 45515

SEQ ID NO: 353798 - RNA, 64 nt, Homo Sapiens; identical to SEQ ID NO: 45516

SEQ ID NO: 353799 - RNA, 64 nt, Homo Sapiens; identical to SEQ ID NO: 45517

SEQ ID NO: 353800 - RNA, 64 nt, Homo Sapiens; identical to SEQ ID NO: 45518

SEQ ID NO: 353801 - RNA, 64 nt, Homo Sapiens; identical to SEQ ID NO: 45519

SEQ ID NO: 353802 - RNA, 64 nt, Homo Sapiens; identical to SEQ ID NO: 45520

SEQ ID NO: 353803 - RNA, 64 nt, Homo Sapiens; identical to SEQ ID NO: 45521

SEQ ID NO: 353804 - RNA, 64 nt, Homo Sapiens; identical to SEQ ID NO: 45522

SEQ ID NO: 353805 - RNA, 64 nt, Homo Sapiens; identical to SEQ ID NO: 45523

SEQ ID NO: 353806 - RNA, 64 nt, Homo Sapiens; identical to SEQ ID NO: 45524

SEQ ID NO: 353807 - RNA, 64 nt, Homo Sapiens; identical to SEQ ID NO: 45525

SEQ ID NO: 353808 - RNA, 64 nt, Homo Sapiens; identical to SEQ ID NO: 45526

SEQ ID NO: 353809 - RNA, 64 nt, Homo Sapiens; identical to SEQ ID NO: 45527

SEQ ID NO: 353810 - RNA, 64 nt, Homo Sapiens; identical to SEQ ID NO: 45528

SEQ ID NO: 353811 - RNA, 64 nt, Homo Sapiens; identical to SEQ ID NO: 45529

SEQ ID NO: 353812 - RNA, 64 nt, Homo Sapiens; identical to SEQ ID NO: 45530

SEQ ID NO: 353813 - RNA, 64 nt, Homo Sapiens; identical to SEQ ID NO: 45531

SEQ ID NO: 353814 - RNA, 64 nt, Homo Sapiens; identical to SEQ ID NO: 45532

SEQ ID NO: 353815 - RNA, 64 nt, Homo Sapiens; identical to SEQ ID NO: 45533

SEQ ID NO: 353816 - RNA, 64 nt, Homo Sapiens; identical to SEQ ID NO: 45534

SEQ ID NO: 353817 - RNA, 64 nt, Homo Sapiens; identical to SEQ ID NO: 45535

SEQ ID NO: 353818 - RNA, 64 nt, Homo Sapiens; identical to SEQ ID NO: 45536

SEQ ID NO: 353819 - RNA, 64 nt, Homo Sapiens; identical to SEQ ID NO: 45537

SEQ ID NO: 353820 - RNA, 64 nt, Homo Sapiens; identical to SEQ ID NO: 45538

SEQ ID NO: 353821 - RNA, 64 nt, Homo Sapiens; identical to SEQ ID NO: 45539

SEQ ID NO: 353822 - RNA, 64 nt, Homo Sapiens; identical to SEQ ID NO: 45540

SEQ ID NO: 353823 - RNA, 64 nt, Homo Sapiens; identical to SEQ ID NO: 45541

SEQ ID NO: 353824 - RNA, 64 nt, Homo Sapiens; identical to SEQ ID NO: 45542

SEQ ID NO: 353825 - RNA, 64 nt, Homo Sapiens; identical to SEQ ID NO: 45543

SEQ ID NO: 353826 - RNA, 64 nt, Homo Sapiens; identical to SEQ ID NO: 45544

SEQ ID NO: 353827 - RNA, 64 nt, Homo Sapiens; identical to SEQ ID NO: 45545

SEQ ID NO: 353828 - RNA, 64 nt, Homo Sapiens; identical to SEQ ID NO: 45546

SEQ ID NO: 353829 - RNA, 64 nt, Homo Sapiens; identical to SEQ ID NO: 45547

SEQ ID NO: 353830 - RNA, 64 nt, Homo Sapiens; identical to SEQ ID NO: 45548

SEQ ID NO: 353831 - RNA, 64 nt, Homo Sapiens; identical to SEQ ID NO: 45549

SEQ ID NO: 353832 - RNA, 64 nt, Homo Sapiens; identical to SEQ ID NO: 45550

SEQ ID NO: 353833 - RNA, 64 nt, Homo Sapiens; identical to SEQ ID NO: 45551

SEQ ID NO: 353834 - RNA, 64 nt, Homo Sapiens; identical to SEQ ID NO: 45552

SEQ ID NO: 353835 - RNA, 64 nt, Homo Sapiens; identical to SEQ ID NO: 45553

SEQ ID NO: 353836 - RNA, 64 nt, Homo Sapiens; identical to SEQ ID NO: 45554

SEQ ID NO: 353837 - RNA, 64 nt, Homo Sapiens; identical to SEQ ID NO: 45555

SEQ ID NO: 353838 - RNA, 64 nt, Homo Sapiens; identical to SEQ ID NO: 45556

SEQ ID NO: 353839 - RNA, 64 nt, Homo Sapiens; identical to SEQ ID NO: 45557

SEQ ID NO: 353840 - RNA, 64 nt, Homo Sapiens; identical to SEQ ID NO: 45558

SEQ ID NO: 353841 - RNA, 64 nt, Homo Sapiens; identical to SEQ ID NO: 45559

SEQ ID NO: 353842 - RNA, 64 nt, Homo Sapiens; identical to SEQ ID NO: 45560

SEQ ID NO: 353843 - RNA, 64 nt, Homo Sapiens; identical to SEQ ID NO: 45561

SEQ ID NO: 353844 - RNA, 64 nt, Homo Sapiens; identical to SEQ ID NO: 45562

SEQ ID NO: 353845 - RNA, 64 nt, Homo Sapiens; identical to SEQ ID NO: 45563

SEQ ID NO: 353846 - RNA, 64 nt, Homo Sapiens; identical to SEQ ID NO: 45564

SEQ ID NO: 353847 - RNA, 64 nt, Homo Sapiens; identical to SEQ ID NO: 45565

SEQ ID NO: 353848 - RNA, 64 nt, Homo Sapiens; identical to SEQ ID NO: 45566

SEQ ID NO: 353849 - RNA, 64 nt, Homo Sapiens; identical to SEQ ID NO: 45567

SEQ ID NO: 353850 - RNA, 64 nt, Homo Sapiens; identical to SEQ ID NO: 45568

SEQ ID NO: 353851 - RNA, 64 nt, Homo Sapiens; identical to SEQ ID NO: 45569

SEQ ID NO: 353852 - RNA, 64 nt, Homo Sapiens; identical to SEQ ID NO: 45570

SEQ ID NO: 353853 - RNA, 64 nt, Homo Sapiens; identical to SEQ ID NO: 45571

SEQ ID NO: 353854 - RNA, 64 nt, Homo Sapiens; identical to SEQ ID NO: 45572

SEQ ID NO: 353855 - RNA, 64 nt, Homo Sapiens; identical to SEQ ID NO: 45573

SEQ ID NO: 353856 - RNA, 64 nt, Homo Sapiens; identical to SEQ ID NO: 45574

SEQ ID NO: 353857 - RNA, 64 nt, Homo Sapiens; identical to SEQ ID NO: 45575

SEQ ID NO: 353858 - RNA, 64 nt, Homo Sapiens; identical to SEQ ID NO: 45576

SEQ ID NO: 353859 - RNA, 64 nt, Homo Sapiens; identical to SEQ ID NO: 45577

SEQ ID NO: 353860 - RNA, 64 nt, Homo Sapiens; identical to SEQ ID NO: 45578

SEQ ID NO: 353861 - RNA, 64 nt, Homo Sapiens; identical to SEQ ID NO: 45579

SEQ ID NO: 353862 - RNA, 64 nt, Homo Sapiens; identical to SEQ ID NO: 45580

SEQ ID NO: 353863 - RNA, 64 nt, Homo Sapiens; identical to SEQ ID NO: 45581

SEQ ID NO: 353864 - RNA, 64 nt, Homo Sapiens; identical to SEQ ID NO: 45582

SEQ ID NO: 353865 - RNA, 64 nt, Homo Sapiens; identical to SEQ ID NO: 45583

SEQ ID NO: 353866 - RNA, 64 nt, Homo Sapiens; identical to SEQ ID NO: 45584

SEQ ID NO: 353867 - RNA, 64 nt, Homo Sapiens; identical to SEQ ID NO: 45585

SEQ ID NO: 353868 - RNA, 64 nt, Homo Sapiens; identical to SEQ ID NO: 45586

SEQ ID NO: 353869 - RNA, 64 nt, Homo Sapiens; identical to SEQ ID NO: 45587

SEQ ID NO: 353870 - RNA, 64 nt, Homo Sapiens; identical to SEQ ID NO: 45588

SEQ ID NO: 353871 - RNA, 64 nt, Homo Sapiens; identical to SEQ ID NO: 45589

SEQ ID NO: 353872 - RNA, 64 nt, Homo Sapiens; identical to SEQ ID NO: 45590

SEQ ID NO: 353873 - RNA, 64 nt, Homo Sapiens; identical to SEQ ID NO: 45591

SEQ ID NO: 353874 - RNA, 64 nt, Homo Sapiens; identical to SEQ ID NO: 45592

SEQ ID NO: 353875 - RNA, 64 nt, Homo Sapiens; identical to SEQ ID NO: 45593

SEQ ID NO: 353876 - RNA, 64 nt, Homo Sapiens; identical to SEQ ID NO: 45594

SEQ ID NO: 353877 - RNA, 64 nt, Homo Sapiens; identical to SEQ ID NO: 45595

SEQ ID NO: 353878 - RNA, 64 nt, Homo Sapiens; identical to SEQ ID NO: 45596

SEQ ID NO: 353879 - RNA, 64 nt, Homo Sapiens; identical to SEQ ID NO: 45597

SEQ ID NO: 353880 - RNA, 64 nt, Homo Sapiens; identical to SEQ ID NO: 45598

SEQ ID NO: 353881 - RNA, 64 nt, Homo Sapiens; identical to SEQ ID NO: 45599

SEQ ID NO: 353882 - RNA, 64 nt, Homo Sapiens; identical to SEQ ID NO: 45600

SEQ ID NO: 353883 - RNA, 64 nt, Homo Sapiens; identical to SEQ ID NO: 45601

SEQ ID NO: 353884 - RNA, 64 nt, Homo Sapiens; identical to SEQ ID NO: 45602

SEQ ID NO: 353885 - RNA, 64 nt, Homo Sapiens; identical to SEQ ID NO: 45603

SEQ ID NO: 353886 - RNA, 64 nt, Homo Sapiens; identical to SEQ ID NO: 45604

SEQ ID NO: 353887 - RNA, 64 nt, Homo Sapiens; identical to SEQ ID NO: 45605

SEQ ID NO: 353888 - RNA, 64 nt, Homo Sapiens; identical to SEQ ID NO: 45606

SEQ ID NO: 353889 - RNA, 64 nt, Homo Sapiens; identical to SEQ ID NO: 45607

SEQ ID NO: 353890 - RNA, 64 nt, Homo Sapiens; identical to SEQ ID NO: 45608

SEQ ID NO: 353891 - RNA, 64 nt, Homo Sapiens; identical to SEQ ID NO: 45609

SEQ ID NO: 353892 - RNA, 64 nt, Homo Sapiens; identical to SEQ ID NO: 45610

SEQ ID NO: 353893 - RNA, 64 nt, Homo Sapiens; identical to SEQ ID NO: 45611

SEQ ID NO: 353894 - RNA, 64 nt, Homo Sapiens; identical to SEQ ID NO: 45612

SEQ ID NO: 353895 - RNA, 64 nt, Homo Sapiens; identical to SEQ ID NO: 45613

SEQ ID NO: 353896 - RNA, 64 nt, Homo Sapiens; identical to SEQ ID NO: 45614

SEQ ID NO: 353897 - RNA, 64 nt, Homo Sapiens; identical to SEQ ID NO: 45615

SEQ ID NO: 353898 - RNA, 64 nt, Homo Sapiens; identical to SEQ ID NO: 45616

SEQ ID NO: 353899 - RNA, 64 nt, Homo Sapiens; identical to SEQ ID NO: 45617

SEQ ID NO: 353900 - RNA, 64 nt, Homo Sapiens; identical to SEQ ID NO: 45618

SEQ ID NO: 353901 - RNA, 64 nt, Homo Sapiens; identical to SEQ ID NO: 45619

SEQ ID NO: 353902 - RNA, 64 nt, Homo Sapiens; identical to SEQ ID NO: 45620

SEQ ID NO: 353903 - RNA, 64 nt, Homo Sapiens; identical to SEQ ID NO: 45621

SEQ ID NO: 353904 - RNA, 64 nt, Homo Sapiens; identical to SEQ ID NO: 45622

SEQ ID NO: 353905 - RNA, 64 nt, Homo Sapiens; identical to SEQ ID NO: 45623

SEQ ID NO: 353906 - RNA, 64 nt, Homo Sapiens; identical to SEQ ID NO: 45624

SEQ ID NO: 353907 - RNA, 64 nt, Homo Sapiens; identical to SEQ ID NO: 45625

SEQ ID NO: 353908 - RNA, 64 nt, Homo Sapiens; identical to SEQ ID NO: 45626

SEQ ID NO: 353909 - RNA, 64 nt, Homo Sapiens; identical to SEQ ID NO: 45627

SEQ ID NO: 353910 - RNA, 64 nt, Homo Sapiens; identical to SEQ ID NO: 45628

SEQ ID NO: 353911 - RNA, 64 nt, Homo Sapiens; identical to SEQ ID NO: 45629

SEQ ID NO: 353912 - RNA, 64 nt, Homo Sapiens; identical to SEQ ID NO: 45630

SEQ ID NO: 353913 - RNA, 64 nt, Homo Sapiens; identical to SEQ ID NO: 45631

SEQ ID NO: 353914 - RNA, 64 nt, Homo Sapiens; identical to SEQ ID NO: 45632

SEQ ID NO: 353915 - RNA, 64 nt, Homo Sapiens; identical to SEQ ID NO: 45633

SEQ ID NO: 353916 - RNA, 64 nt, Homo Sapiens; identical to SEQ ID NO: 45634

SEQ ID NO: 353917 - RNA, 64 nt, Homo Sapiens; identical to SEQ ID NO: 45635

SEQ ID NO: 353918 - RNA, 64 nt, Homo Sapiens; identical to SEQ ID NO: 45636

SEQ ID NO: 353919 - RNA, 64 nt, Homo Sapiens; identical to SEQ ID NO: 45637

SEQ ID NO: 353920 - RNA, 64 nt, Homo Sapiens; identical to SEQ ID NO: 45638

SEQ ID NO: 353921 - RNA, 64 nt, Homo Sapiens; identical to SEQ ID NO: 45639

SEQ ID NO: 353922 - RNA, 64 nt, Homo Sapiens; identical to SEQ ID NO: 45640

SEQ ID NO: 353923 - RNA, 64 nt, Homo Sapiens; identical to SEQ ID NO: 45641

SEQ ID NO: 353924 - RNA, 64 nt, Homo Sapiens; identical to SEQ ID NO: 45642

SEQ ID NO: 353925 - RNA, 64 nt, Homo Sapiens; identical to SEQ ID NO: 45643

SEQ ID NO: 353926 - RNA, 64 nt, Homo Sapiens; identical to SEQ ID NO: 45644

SEQ ID NO: 353927 - RNA, 64 nt, Homo Sapiens; identical to SEQ ID NO: 45645

SEQ ID NO: 353928 - RNA, 64 nt, Homo Sapiens; identical to SEQ ID NO: 45646

SEQ ID NO: 353929 - RNA, 64 nt, Homo Sapiens; identical to SEQ ID NO: 45647

SEQ ID NO: 353930 - RNA, 64 nt, Homo Sapiens; identical to SEQ ID NO: 45648

SEQ ID NO: 353931 - RNA, 64 nt, Homo Sapiens; identical to SEQ ID NO: 45649

SEQ ID NO: 353932 - RNA, 64 nt, Homo Sapiens; identical to SEQ ID NO: 45650

SEQ ID NO: 353933 - RNA, 64 nt, Homo Sapiens; identical to SEQ ID NO: 45651

SEQ ID NO: 353934 - RNA, 64 nt, Homo Sapiens; identical to SEQ ID NO: 45652

SEQ ID NO: 353935 - RNA, 64 nt, Homo Sapiens; identical to SEQ ID NO: 45653

SEQ ID NO: 353936 - RNA, 64 nt, Homo Sapiens; identical to SEQ ID NO: 45654

SEQ ID NO: 353937 - RNA, 64 nt, Homo Sapiens; identical to SEQ ID NO: 45655

SEQ ID NO: 353938 - RNA, 64 nt, Homo Sapiens; identical to SEQ ID NO: 72506

SEQ ID NO: 353939 - RNA, 64 nt, Homo Sapiens; identical to SEQ ID NO: 72507

SEQ ID NO: 353940 - RNA, 64 nt, Homo Sapiens; identical to SEQ ID NO: 72508

SEQ ID NO: 353941 - RNA, 64 nt, Homo Sapiens; identical to SEQ ID NO: 72509

SEQ ID NO: 353942 - RNA, 64 nt, Homo Sapiens; identical to SEQ ID NO: 72510

SEQ ID NO: 353943 - RNA, 64 nt, Homo Sapiens; identical to SEQ ID NO: 72511

SEQ ID NO: 353944 - RNA, 64 nt, Homo Sapiens; identical to SEQ ID NO: 72512

SEQ ID NO: 353945 - RNA, 64 nt, Homo Sapiens; identical to SEQ ID NO: 72513

SEQ ID NO: 353946 - RNA, 64 nt, Homo Sapiens; identical to SEQ ID NO: 72514

SEQ ID NO: 353947 - RNA, 64 nt, Homo Sapiens; identical to SEQ ID NO: 72515

SEQ ID NO: 353948 - RNA, 64 nt, Homo Sapiens; identical to SEQ ID NO: 72516

SEQ ID NO: 353949 - RNA, 64 nt, Homo Sapiens; identical to SEQ ID NO: 72517

SEQ ID NO: 353950 - RNA, 64 nt, Homo Sapiens; identical to SEQ ID NO: 72518

SEQ ID NO: 353951 - RNA, 64 nt, Homo Sapiens; identical to SEQ ID NO: 72519

SEQ ID NO: 353952 - RNA, 64 nt, Homo Sapiens; identical to SEQ ID NO: 72520

SEQ ID NO: 353953 - RNA, 64 nt, Homo Sapiens; identical to SEQ ID NO: 72521

SEQ ID NO: 353954 - RNA, 64 nt, Homo Sapiens; identical to SEQ ID NO: 72522

SEQ ID NO: 353955 - RNA, 64 nt, Homo Sapiens; identical to SEQ ID NO: 72523

SEQ ID NO: 353956 - RNA, 64 nt, Homo Sapiens; identical to SEQ ID NO: 72524

SEQ ID NO: 353957 - RNA, 64 nt, Homo Sapiens; identical to SEQ ID NO: 72525

SEQ ID NO: 353958 - RNA, 64 nt, Homo Sapiens; identical to SEQ ID NO: 72526

SEQ ID NO: 353959 - RNA, 64 nt, Homo Sapiens; identical to SEQ ID NO: 72527

SEQ ID NO: 353960 - RNA, 64 nt, Homo Sapiens; identical to SEQ ID NO: 72528

SEQ ID NO: 353961 - RNA, 64 nt, Homo Sapiens; identical to SEQ ID NO: 72529

SEQ ID NO: 353962 - RNA, 64 nt, Homo Sapiens; identical to SEQ ID NO: 72530

SEQ ID NO: 353963 - RNA, 64 nt, Homo Sapiens; identical to SEQ ID NO: 72531

SEQ ID NO: 353964 - RNA, 64 nt, Homo Sapiens; identical to SEQ ID NO: 72532

SEQ ID NO: 353965 - RNA, 64 nt, Homo Sapiens; identical to SEQ ID NO: 72533

SEQ ID NO: 353966 - RNA, 64 nt, Homo Sapiens; identical to SEQ ID NO: 72534

SEQ ID NO: 353967 - RNA, 64 nt, Homo Sapiens; identical to SEQ ID NO: 72535

SEQ ID NO: 353968 - RNA, 64 nt, Homo Sapiens; identical to SEQ ID NO: 72536

SEQ ID NO: 353969 - RNA, 64 nt, Homo Sapiens; identical to SEQ ID NO: 72537

SEQ ID NO: 353970 - RNA, 64 nt, Homo Sapiens; identical to SEQ ID NO: 72538

SEQ ID NO: 353971 - RNA, 64 nt, Homo Sapiens; identical to SEQ ID NO: 72539

SEQ ID NO: 353972 - RNA, 64 nt, Homo Sapiens; identical to SEQ ID NO: 72540

SEQ ID NO: 353973 - RNA, 64 nt, Homo Sapiens; identical to SEQ ID NO: 72541

SEQ ID NO: 353974 - RNA, 64 nt, Homo Sapiens; identical to SEQ ID NO: 72542

SEQ ID NO: 353975 - RNA, 64 nt, Homo Sapiens; identical to SEQ ID NO: 72543

SEQ ID NO: 353976 - RNA, 64 nt, Homo Sapiens; identical to SEQ ID NO: 72544

SEQ ID NO: 353977 - RNA, 64 nt, Homo Sapiens; identical to SEQ ID NO: 72545

SEQ ID NO: 353978 - RNA, 64 nt, Homo Sapiens; identical to SEQ ID NO: 72546

SEQ ID NO: 353979 - RNA, 64 nt, Homo Sapiens; identical to SEQ ID NO: 72547

SEQ ID NO: 353980 - RNA, 64 nt, Homo Sapiens; identical to SEQ ID NO: 72548

SEQ ID NO: 353981 - RNA, 64 nt, Homo Sapiens; identical to SEQ ID NO: 72549

SEQ ID NO: 353982 - RNA, 64 nt, Homo Sapiens; identical to SEQ ID NO: 72550

SEQ ID NO: 353983 - RNA, 64 nt, Homo Sapiens; identical to SEQ ID NO: 72551

SEQ ID NO: 353984 - RNA, 64 nt, Homo Sapiens; identical to SEQ ID NO: 72552

SEQ ID NO: 353985 - RNA, 64 nt, Homo Sapiens; identical to SEQ ID NO: 72553

SEQ ID NO: 353986 - RNA, 64 nt, Homo Sapiens; identical to SEQ ID NO: 72554

SEQ ID NO: 353987 - RNA, 64 nt, Homo Sapiens; identical to SEQ ID NO: 72555

SEQ ID NO: 353988 - RNA, 64 nt, Homo Sapiens; identical to SEQ ID NO: 72556

SEQ ID NO: 353989 - RNA, 64 nt, Homo Sapiens; identical to SEQ ID NO: 72557

SEQ ID NO: 353990 - RNA, 64 nt, Homo Sapiens; identical to SEQ ID NO: 72558

SEQ ID NO: 353991 - RNA, 64 nt, Homo Sapiens; identical to SEQ ID NO: 72559

SEQ ID NO: 353992 - RNA, 64 nt, Homo Sapiens; identical to SEQ ID NO: 72560

SEQ ID NO: 353993 - RNA, 64 nt, Homo Sapiens; identical to SEQ ID NO: 72561

SEQ ID NO: 353994 - RNA, 64 nt, Homo Sapiens; identical to SEQ ID NO: 72562

SEQ ID NO: 353995 - RNA, 64 nt, Homo Sapiens; identical to SEQ ID NO: 72563

SEQ ID NO: 353996 - RNA, 64 nt, Homo Sapiens; identical to SEQ ID NO: 72564

SEQ ID NO: 353997 - RNA, 64 nt, Homo Sapiens; identical to SEQ ID NO: 72565

SEQ ID NO: 353998 - RNA, 64 nt, Homo Sapiens; identical to SEQ ID NO: 72566

SEQ ID NO: 353999 - RNA, 64 nt, Homo Sapiens; identical to SEQ ID NO: 72567

SEQ ID NO: 354000 - RNA, 64 nt, Homo Sapiens; identical to SEQ ID NO: 72568

SEQ ID NO: 354001 - RNA, 64 nt, Homo Sapiens; identical to SEQ ID NO: 72569

SEQ ID NO: 354002 - RNA, 64 nt, Homo Sapiens; identical to SEQ ID NO: 72570

SEQ ID NO: 354003 - RNA, 64 nt, Homo Sapiens; identical to SEQ ID NO: 72571

SEQ ID NO: 354004 - RNA, 64 nt, Homo Sapiens; identical to SEQ ID NO: 72572

SEQ ID NO: 354005 - RNA, 64 nt, Homo Sapiens; identical to SEQ ID NO: 72573

SEQ ID NO: 354006 - RNA, 64 nt, Homo Sapiens; identical to SEQ ID NO: 72574

SEQ ID NO: 354007 - RNA, 64 nt, Homo Sapiens; identical to SEQ ID NO: 72575

SEQ ID NO: 354008 - RNA, 64 nt, Homo Sapiens; identical to SEQ ID NO: 72576

SEQ ID NO: 354009 - RNA, 64 nt, Homo Sapiens; identical to SEQ ID NO: 72577

SEQ ID NO: 354010 - RNA, 64 nt, Homo Sapiens; identical to SEQ ID NO: 72578

SEQ ID NO: 354011 - RNA, 64 nt, Homo Sapiens; identical to SEQ ID NO: 72579

SEQ ID NO: 354012 - RNA, 64 nt, Homo Sapiens; identical to SEQ ID NO: 72580

SEQ ID NO: 354013 - RNA, 64 nt, Homo Sapiens; identical to SEQ ID NO: 72581

SEQ ID NO: 354014 - RNA, 64 nt, Homo Sapiens; identical to SEQ ID NO: 72582

SEQ ID NO: 354015 - RNA, 64 nt, Homo Sapiens; identical to SEQ ID NO: 72583

SEQ ID NO: 354016 - RNA, 64 nt, Homo Sapiens; identical to SEQ ID NO: 72584

SEQ ID NO: 354017 - RNA, 64 nt, Homo Sapiens; identical to SEQ ID NO: 72585

SEQ ID NO: 354018 - RNA, 64 nt, Homo Sapiens; identical to SEQ ID NO: 72586

SEQ ID NO: 354019 - RNA, 64 nt, Homo Sapiens; identical to SEQ ID NO: 72587

SEQ ID NO: 354020 - RNA, 64 nt, Homo Sapiens; identical to SEQ ID NO: 72588

SEQ ID NO: 354021 - RNA, 64 nt, Homo Sapiens; identical to SEQ ID NO: 72589

SEQ ID NO: 354022 - RNA, 64 nt, Homo Sapiens; identical to SEQ ID NO: 72590

SEQ ID NO: 354023 - RNA, 64 nt, Homo Sapiens; identical to SEQ ID NO: 72591

SEQ ID NO: 354024 - RNA, 64 nt, Homo Sapiens; identical to SEQ ID NO: 72592

SEQ ID NO: 354025 - RNA, 64 nt, Homo Sapiens; identical to SEQ ID NO: 72593

SEQ ID NO: 354026 - RNA, 64 nt, Homo Sapiens; identical to SEQ ID NO: 72594

SEQ ID NO: 354027 - RNA, 64 nt, Homo Sapiens; identical to SEQ ID NO: 72595

SEQ ID NO: 354028 - RNA, 64 nt, Homo Sapiens; identical to SEQ ID NO: 72596

SEQ ID NO: 354029 - RNA, 64 nt, Homo Sapiens; identical to SEQ ID NO: 72597

SEQ ID NO: 354030 - RNA, 64 nt, Homo Sapiens; identical to SEQ ID NO: 72598

SEQ ID NO: 354031 - RNA, 64 nt, Homo Sapiens; identical to SEQ ID NO: 72599

SEQ ID NO: 354032 - RNA, 64 nt, Homo Sapiens; identical to SEQ ID NO: 72600

SEQ ID NO: 354033 - RNA, 64 nt, Homo Sapiens; identical to SEQ ID NO: 72601

SEQ ID NO: 354034 - RNA, 64 nt, Homo Sapiens
ggcugcgcagcugagguacuuuuacauuaaaaaaacuggcuacauuaaggcuggcauucuuacu

SEQ ID NO: 354035 - RNA, 64 nt, Homo Sapiens
gcccuauaccugccaaucacauuacugacaccccacuggcuauuugaggucagggacagggcau

SEQ ID NO: 354036 - RNA, 64 nt, Homo Sapiens
agcagcauguacccaaaguguucugauuccuucaacuggcuacugagucaugauccuugcugau

SEQ ID NO: 354037 - RNA, 64 nt, Homo Sapiens
ggaaaucuuauaaaaacuagucaagccuaaugcaacuggcuaaaggauaguaccacccucaccc

SEQ ID NO: 354038 - RNA, 64 nt, Homo Sapiens
uaucaccacuucuuuuucccuuccaggcacacggacuggcuauuggcacgcacugacuuugaua

SEQ ID NO: 354039 - RNA, 58 nt, Homo Sapiens
acuggacacauccugccuggaccccaccacuggcuaaaagacgaagccuuccccauga

SEQ ID NO: 354040 - RNA, 64 nt, Homo Sapiens
agucaauaaacagaaagaauauuugcaaaacccagaagcuaaaagaagcuaagaauauuauuuu

SEQ ID NO: 354041 - RNA, 64 nt, Homo Sapiens
auauuauuuuauuugcaaaaauuauuguauaaaggaagcuaagauauacauaaaacacucugau

SEQ ID NO: 354042 - RNA, 64 nt, Homo Sapiens
uaauuaauauucccauuuuacagaugaggaaacugaagcuaagagaagcuaaguaauaugccca

SEQ ID NO: 354043 - RNA, 64 nt, Homo Sapiens
ucccauuuuacagaugaggaaacugaagcuaagagaagcuaaguaauaugcccaagguccacau

SEQ ID NO: 354044 - RNA, 64 nt, Homo Sapiens
uaaaguuccuuuccuggugcuaaaaaaguaaucagaagcuaaaguaauaaaguaaaaauaaaaa

SEQ ID NO: 354045 - RNA, 64 nt, Homo Sapiens
ugggugcaguggcucaugccugaggucauaaucagaagcuaagccaguaucuauuccaagauac

SEQ ID NO: 354046 - RNA, 64 nt, Homo Sapiens
cuaacucagaaugggauuaaaaauuuuagaagcagaagcuaauauauaaaugaaguuugggauu

SEQ ID NO: 354047 - RNA, 64 nt, Homo Sapiens
gauaauagagaaguccauuuaaaaauuauuuuuagaagcuaaagaaaguaauuaugcuuccugu

SEQ ID NO: 354048 - RNA, 64 nt, Homo Sapiens
ugugucuacaaugguacagcaaauuuguuugccugaagcuaaagaaugguucuggguacaccag

SEQ ID NO: 354049 - RNA, 64 nt, Homo Sapiens
gccacuggcagcacaggcugacaacugacccagagaagcuaaaaaaggggaguaauaauguaaa

SEQ ID NO: 354050 - RNA, 64 nt, Homo Sapiens
auaaguuaaggcuuucugcacugguacucucaaggaagcuaauuuucuuucuggggggggcggg

SEQ ID NO: 354051 - RNA, 64 nt, Homo Sapiens
cugggauuacaggcaugagccaucgcccagcccagaagcuaauuuuuuaauauuguauaugguc

SEQ ID NO: 354052 - RNA, 64 nt, Homo Sapiens; identical to SEQ ID NO: 236646

SEQ ID NO: 354053 - RNA, 64 nt, Homo Sapiens; identical to SEQ ID NO: 236647

SEQ ID NO: 354054 - RNA, 64 nt, Homo Sapiens; identical to SEQ ID NO: 236648

SEQ ID NO: 354055 - RNA, 64 nt, Homo Sapiens; identical to SEQ ID NO: 236649

SEQ ID NO: 354056 - RNA, 64 nt, Homo Sapiens; identical to SEQ ID NO: 236650

SEQ ID NO: 354057 - RNA, 64 nt, Homo Sapiens; identical to SEQ ID NO: 236651

SEQ ID NO: 354058 - RNA, 64 nt, Homo Sapiens; identical to SEQ ID NO: 236652

SEQ ID NO: 354059 - RNA, 64 nt, Homo Sapiens; identical to SEQ ID NO: 236653

SEQ ID NO: 354060 - RNA, 64 nt, Homo Sapiens; identical to SEQ ID NO: 236654

SEQ ID NO: 354061 - RNA, 62 nt, Homo Sapiens; identical to SEQ ID NO: 236655

SEQ ID NO: 354062 - RNA, 64 nt, Homo Sapiens; identical to SEQ ID NO: 236656

SEQ ID NO: 354063 - RNA, 64 nt, Homo Sapiens; identical to SEQ ID NO: 236657

SEQ ID NO: 354064 - RNA, 64 nt, Homo Sapiens; identical to SEQ ID NO: 236658

SEQ ID NO: 354065 - RNA, 64 nt, Homo Sapiens; identical to SEQ ID NO: 236659

SEQ ID NO: 354066 - RNA, 64 nt, Homo Sapiens; identical to SEQ ID NO: 236660

SEQ ID NO: 354067 - RNA, 64 nt, Homo Sapiens; identical to SEQ ID NO: 236661

SEQ ID NO: 354068 - RNA, 50 nt, Homo Sapiens; identical to SEQ ID NO: 236662

SEQ ID NO: 354069 - RNA, 64 nt, Homo Sapiens; identical to SEQ ID NO: 236663

SEQ ID NO: 354070 - RNA, 64 nt, Homo Sapiens; identical to SEQ ID NO: 236664

SEQ ID NO: 354071 - RNA, 64 nt, Homo Sapiens; identical to SEQ ID NO: 236665

SEQ ID NO: 354072 - RNA, 64 nt, Homo Sapiens; identical to SEQ ID NO: 236666

SEQ ID NO: 354073 - RNA, 64 nt, Homo Sapiens; identical to SEQ ID NO: 236667

SEQ ID NO: 354074 - RNA, 64 nt, Homo Sapiens; identical to SEQ ID NO: 236668

SEQ ID NO: 354075 - RNA, 64 nt, Homo Sapiens; identical to SEQ ID NO: 236669

SEQ ID NO: 354076 - RNA, 64 nt, Homo Sapiens; identical to SEQ ID NO: 236670

SEQ ID NO: 354077 - RNA, 64 nt, Homo Sapiens; identical to SEQ ID NO: 236671

SEQ ID NO: 354078 - RNA, 64 nt, Homo Sapiens; identical to SEQ ID NO: 236672

SEQ ID NO: 354079 - RNA, 64 nt, Homo Sapiens; identical to SEQ ID NO: 236673

SEQ ID NO: 354080 - RNA, 64 nt, Homo Sapiens; identical to SEQ ID NO: 236674

SEQ ID NO: 354081 - RNA, 64 nt, Homo Sapiens; identical to SEQ ID NO: 236675

SEQ ID NO: 354082 - RNA, 64 nt, Homo Sapiens; identical to SEQ ID NO: 236676

SEQ ID NO: 354083 - RNA, 64 nt, Homo Sapiens; identical to SEQ ID NO: 236677

SEQ ID NO: 354084 - RNA, 64 nt, Homo Sapiens; identical to SEQ ID NO: 236678

SEQ ID NO: 354085 - RNA, 64 nt, Homo Sapiens; identical to SEQ ID NO: 236679

SEQ ID NO: 354086 - RNA, 64 nt, Homo Sapiens; identical to SEQ ID NO: 236680

SEQ ID NO: 354087 - RNA, 64 nt, Homo Sapiens; identical to SEQ ID NO: 236681

SEQ ID NO: 354088 - RNA, 64 nt, Homo Sapiens; identical to SEQ ID NO: 236682

SEQ ID NO: 354089 - RNA, 64 nt, Homo Sapiens; identical to SEQ ID NO: 236683

SEQ ID NO: 354090 - RNA, 64 nt, Homo Sapiens; identical to SEQ ID NO: 236684

SEQ ID NO: 354091 - RNA, 64 nt, Homo Sapiens; identical to SEQ ID NO: 236685

SEQ ID NO: 354092 - RNA, 64 nt, Homo Sapiens; identical to SEQ ID NO: 236686

SEQ ID NO: 354093 - RNA, 64 nt, Homo Sapiens; identical to SEQ ID NO: 236687

SEQ ID NO: 354094 - RNA, 64 nt, Homo Sapiens; identical to SEQ ID NO: 236688

SEQ ID NO: 354095 - RNA, 64 nt, Homo Sapiens; identical to SEQ ID NO: 236689

SEQ ID NO: 354096 - RNA, 64 nt, Homo Sapiens; identical to SEQ ID NO: 236690

SEQ ID NO: 354097 - RNA, 64 nt, Homo Sapiens; identical to SEQ ID NO: 236691

SEQ ID NO: 354098 - RNA, 64 nt, Homo Sapiens; identical to SEQ ID NO: 236692

SEQ ID NO: 354099 - RNA, 64 nt, Homo Sapiens; identical to SEQ ID NO: 195961

SEQ ID NO: 354100 - RNA, 64 nt, Homo Sapiens; identical to SEQ ID NO: 195962

SEQ ID NO: 354101 - RNA, 64 nt, Homo Sapiens; identical to SEQ ID NO: 195963

SEQ ID NO: 354102 - RNA, 64 nt, Homo Sapiens; identical to SEQ ID NO: 195964

SEQ ID NO: 354103 - RNA, 64 nt, Homo Sapiens; identical to SEQ ID NO: 195965

SEQ ID NO: 354104 - RNA, 64 nt, Homo Sapiens; identical to SEQ ID NO: 195966

SEQ ID NO: 354105 - RNA, 64 nt, Homo Sapiens; identical to SEQ ID NO: 195967

SEQ ID NO: 354106 - RNA, 64 nt, Homo Sapiens; identical to SEQ ID NO: 195968

SEQ ID NO: 354107 - RNA, 64 nt, Homo Sapiens; identical to SEQ ID NO: 195969

SEQ ID NO: 354108 - RNA, 64 nt, Homo Sapiens; identical to SEQ ID NO: 195970

SEQ ID NO: 354109 - RNA, 64 nt, Homo Sapiens; identical to SEQ ID NO: 195971

SEQ ID NO: 354110 - RNA, 64 nt, Homo Sapiens; identical to SEQ ID NO: 195972

SEQ ID NO: 354111 - RNA, 64 nt, Homo Sapiens; identical to SEQ ID NO: 195973

SEQ ID NO: 354112 - RNA, 64 nt, Homo Sapiens; identical to SEQ ID NO: 195974

SEQ ID NO: 354113 - RNA, 64 nt, Homo Sapiens; identical to SEQ ID NO: 195975

SEQ ID NO: 354114 - RNA, 64 nt, Homo Sapiens; identical to SEQ ID NO: 195976

SEQ ID NO: 354115 - RNA, 64 nt, Homo Sapiens; identical to SEQ ID NO: 195977

SEQ ID NO: 354116 - RNA, 64 nt, Homo Sapiens; identical to SEQ ID NO: 195978

SEQ ID NO: 354117 - RNA, 64 nt, Homo Sapiens; identical to SEQ ID NO: 195979

SEQ ID NO: 354118 - RNA, 64 nt, Homo Sapiens; identical to SEQ ID NO: 195980

SEQ ID NO: 354119 - RNA, 64 nt, Homo Sapiens; identical to SEQ ID NO: 195981

SEQ ID NO: 354120 - RNA, 64 nt, Homo Sapiens; identical to SEQ ID NO: 195982

SEQ ID NO: 354121 - RNA, 64 nt, Homo Sapiens; identical to SEQ ID NO: 195983

SEQ ID NO: 354122 - RNA, 64 nt, Homo Sapiens; identical to SEQ ID NO: 195984

SEQ ID NO: 354123 - RNA, 64 nt, Homo Sapiens; identical to SEQ ID NO: 195985

SEQ ID NO: 354124 - RNA, 64 nt, Homo Sapiens; identical to SEQ ID NO: 195986

SEQ ID NO: 354125 - RNA, 64 nt, Homo Sapiens; identical to SEQ ID NO: 195987

SEQ ID NO: 354126 - RNA, 64 nt, Homo Sapiens; identical to SEQ ID NO: 128854

SEQ ID NO: 354127 - RNA, 64 nt, Homo Sapiens; identical to SEQ ID NO: 128855

SEQ ID NO: 354128 - RNA, 64 nt, Homo Sapiens; identical to SEQ ID NO: 128856

SEQ ID NO: 354129 - RNA, 64 nt, Homo Sapiens; identical to SEQ ID NO: 128857

SEQ ID NO: 354130 - RNA, 64 nt, Homo Sapiens; identical to SEQ ID NO: 128858

SEQ ID NO: 354131 - RNA, 64 nt, Homo Sapiens; identical to SEQ ID NO: 128859

SEQ ID NO: 354132 - RNA, 64 nt, Homo Sapiens; identical to SEQ ID NO: 128860

SEQ ID NO: 354133 - RNA, 64 nt, Homo Sapiens; identical to SEQ ID NO: 128861

SEQ ID NO: 354134 - RNA, 64 nt, Homo Sapiens; identical to SEQ ID NO: 128862

SEQ ID NO: 354135 - RNA, 64 nt, Homo Sapiens; identical to SEQ ID NO: 128863

SEQ ID NO: 354136 - RNA, 64 nt, Homo Sapiens; identical to SEQ ID NO: 128864

SEQ ID NO: 354137 - RNA, 64 nt, Homo Sapiens; identical to SEQ ID NO: 128865

SEQ ID NO: 354138 - RNA, 64 nt, Homo Sapiens; identical to SEQ ID NO: 128866

SEQ ID NO: 354139 - RNA, 64 nt, Homo Sapiens; identical to SEQ ID NO: 128867

SEQ ID NO: 354140 - RNA, 64 nt, Homo Sapiens; identical to SEQ ID NO: 128868

SEQ ID NO: 354141 - RNA, 64 nt, Homo Sapiens; identical to SEQ ID NO: 128869

SEQ ID NO: 354142 - RNA, 64 nt, Homo Sapiens; identical to SEQ ID NO: 128870

SEQ ID NO: 354143 - RNA, 64 nt, Homo Sapiens; identical to SEQ ID NO: 128871

SEQ ID NO: 354144 - RNA, 64 nt, Homo Sapiens; identical to SEQ ID NO: 128872

SEQ ID NO: 354145 - RNA, 64 nt, Homo Sapiens; identical to SEQ ID NO: 128873

SEQ ID NO: 354146 - RNA, 64 nt, Homo Sapiens; identical to SEQ ID NO: 128874

SEQ ID NO: 354147 - RNA, 64 nt, Homo Sapiens; identical to SEQ ID NO: 128875

SEQ ID NO: 354148 - RNA, 64 nt, Homo Sapiens; identical to SEQ ID NO: 128876

SEQ ID NO: 354149 - RNA, 64 nt, Homo Sapiens; identical to SEQ ID NO: 128877

SEQ ID NO: 354150 - RNA, 64 nt, Homo Sapiens; identical to SEQ ID NO: 128878

SEQ ID NO: 354151 - RNA, 64 nt, Homo Sapiens; identical to SEQ ID NO: 128879

SEQ ID NO: 354152 - RNA, 64 nt, Homo Sapiens; identical to SEQ ID NO: 128880

SEQ ID NO: 354153 - RNA, 64 nt, Homo Sapiens; identical to SEQ ID NO: 128881

SEQ ID NO: 354154 - RNA, 64 nt, Homo Sapiens; identical to SEQ ID NO: 128882

SEQ ID NO: 354155 - RNA, 64 nt, Homo Sapiens; identical to SEQ ID NO: 128883

SEQ ID NO: 354156 - RNA, 64 nt, Homo Sapiens; identical to SEQ ID NO: 128884

SEQ ID NO: 354157 - RNA, 64 nt, Homo Sapiens; identical to SEQ ID NO: 128885

SEQ ID NO: 354158 - RNA, 64 nt, Homo Sapiens; identical to SEQ ID NO: 128886

SEQ ID NO: 354159 - RNA, 64 nt, Homo Sapiens
aaagagaacucuccauagaagcccuggccaaagauaggaggaagccucucaggagaagccagag

SEQ ID NO: 354160 - RNA, 64 nt, Homo Sapiens
uggagcaagaugaacaggcauccaucccuccagcuaggaggaaagccaagagcccuccccuuuc

SEQ ID NO: 354161 - RNA, 64 nt, Homo Sapiens
caacugcaaaucuaaaauuaccauuagacgcaguuaggaggauggccacaagguggugcuucug

SEQ ID NO: 354162 - RNA, 64 nt, Homo Sapiens
cggguuaaaaauuguuuuaaugcgugccuaguucuaggaggaaaucuucucuuucauacauaua

SEQ ID NO: 354163 - RNA, 64 nt, Homo Sapiens
cuggaggcucugagggagaugggcuugggggcuguaggaggaggcagggauuccagggugucag

SEQ ID NO: 354164 - RNA, 64 nt, Homo Sapiens
cuggaugcucugaggcagaugggcuugggggcucuaggaggaggcagggacuccagggugucag

SEQ ID NO: 354165 - RNA, 64 nt, Homo Sapiens
guauuuaaaaccccagauuuccucgugacaauuauaggaggaagaaaugaaacuugaaucuguc

SEQ ID NO: 354166 - RNA, 64 nt, Homo Sapiens
gaaggcuggggagggcugggauaagugggaaagguaggaggagagacaagccuggaaggaggca

SEQ ID NO: 354167 - RNA, 64 nt, Homo Sapiens
uugguguuuauugaaaauuaaccaaacuuaauacuaggagaagacugaaucauuaaugaugucu

SEQ ID NO: 354168 - RNA, 64 nt, Homo Sapiens
gcuaagccuucaucauaauuuguucccucaguaauaggagaaauauaaauacaguaaguuuaga

SEQ ID NO: 354169 - RNA, 64 nt, Homo Sapiens
aaguuuucagucacagaucacgccuuaaaagacauaggagaauucauacuggagagaaaccuua

SEQ ID NO: 354170 - RNA, 64 nt, Homo Sapiens
aggucuucagucaagcuucauccuaugcaaaacauaggagaauucaugcaggagagaaauguca

SEQ ID NO: 354171 - RNA, 64 nt, Homo Sapiens
uauacaggagagaaaccucauccuaugcaaaacauaggagaauuaggucuucagucaagcuuca

SEQ ID NO: 354172 - RNA, 64 nt, Homo Sapiens
uauacuggagagaaagcuuaacaccuuaaagacauaggagaauuaaaguuuccauuuggaaauc

SEQ ID NO: 354173 - RNA, 64 nt, Homo Sapiens
uuuuugguguguguuggaauuuucuugcugcuucuaggagaacugguaguuaacacaucaaaua

SEQ ID NO: 354174 - RNA, 64 nt, Homo Sapiens
caaaauacaucagcuugguaccaccuaauguuuauaggagaaagaauugucaaauuaccgugua

SEQ ID NO: 354175 - RNA, 64 nt, Homo Sapiens; identical to SEQ ID NO: 227821

SEQ ID NO: 354176 - RNA, 64 nt, Homo Sapiens; identical to SEQ ID NO: 227822

SEQ ID NO: 354177 - RNA, 64 nt, Homo Sapiens; identical to SEQ ID NO: 227823

SEQ ID NO: 354178 - RNA, 64 nt, Homo Sapiens; identical to SEQ ID NO: 227824

SEQ ID NO: 354179 - RNA, 64 nt, Homo Sapiens; identical to SEQ ID NO: 227825

SEQ ID NO: 354180 - RNA, 64 nt, Homo Sapiens; identical to SEQ ID NO: 227826

SEQ ID NO: 354181 - RNA, 64 nt, Homo Sapiens; identical to SEQ ID NO: 227827

SEQ ID NO: 354182 - RNA, 64 nt, Homo Sapiens; identical to SEQ ID NO: 227828

SEQ ID NO: 354183 - RNA, 64 nt, Homo Sapiens; identical to SEQ ID NO: 227829

SEQ ID NO: 354184 - RNA, 64 nt, Homo Sapiens; identical to SEQ ID NO: 227830

SEQ ID NO: 354185 - RNA, 64 nt, Homo Sapiens; identical to SEQ ID NO: 227831

SEQ ID NO: 354186 - RNA, 64 nt, Homo Sapiens; identical to SEQ ID NO: 227832

SEQ ID NO: 354187 - RNA, 64 nt, Homo Sapiens; identical to SEQ ID NO: 227833

SEQ ID NO: 354188 - RNA, 64 nt, Homo Sapiens; identical to SEQ ID NO: 227834

SEQ ID NO: 354189 - RNA, 64 nt, Homo Sapiens; identical to SEQ ID NO: 227835

SEQ ID NO: 354190 - RNA, 64 nt, Homo Sapiens; identical to SEQ ID NO: 227836

SEQ ID NO: 354191 - RNA, 64 nt, Homo Sapiens; identical to SEQ ID NO: 227837

SEQ ID NO: 354192 - RNA, 64 nt, Homo Sapiens; identical to SEQ ID NO: 227838

SEQ ID NO: 354193 - RNA, 64 nt, Homo Sapiens; identical to SEQ ID NO: 227839

SEQ ID NO: 354194 - RNA, 64 nt, Homo Sapiens; identical to SEQ ID NO: 227840

SEQ ID NO: 354195 - RNA, 64 nt, Homo Sapiens; identical to SEQ ID NO: 227841

SEQ ID NO: 354196 - RNA, 64 nt, Homo Sapiens; identical to SEQ ID NO: 227842

SEQ ID NO: 354197 - RNA, 64 nt, Homo Sapiens
cggcaggaugacacagaccaucaagcaauagcagagguuucaccgacuggguuaagggagcugc

SEQ ID NO: 354198 - RNA, 64 nt, Homo Sapiens
caacucuggaucaugucagguugcggucuugauuagguuucaguguguuugcuacacugaccuc

SEQ ID NO: 354199 - RNA, 64 nt, Homo Sapiens
uggaaagccauucaucuuaaugguuucaacacagagguuucaagauaccagucuauuuaucagu

SEQ ID NO: 354200 - RNA, 64 nt, Homo Sapiens
ugucuucagagacaaauguuagaaauaaacaaguagguuucaguuugcguccuuuuggaaucac

SEQ ID NO: 354201 - RNA, 64 nt, Homo Sapiens
gcccucuauaagcuucugacuagacagaguagugagguuucauucacaaaauggacuccugaag

SEQ ID NO: 354202 - RNA, 64 nt, Homo Sapiens
aaauggacuccugaaguagaaucucaauuucaggagguuucacaagugcugagauccucaaaua

SEQ ID NO: 354203 - RNA, 64 nt, Homo Sapiens
auuaaaauuugauguucaaagaggacuggauaaaagguuucaagccuuuucauguuaauaauuu

SEQ ID NO: 354204 - RNA, 64 nt, Homo Sapiens
gucuuaaaaagauacuuuaucuugcaaugacaagagguuucaugagaaacaugaacugaaaagu

SEQ ID NO: 354205 - RNA, 64 nt, Homo Sapiens
ugaggucaacacagguagcaugaauauuuuuugaagguuucagaugagaaagcuuuuauuccuu

SEQ ID NO: 354206 - RNA, 64 nt, Homo Sapiens
ucuuaucacauaagagagauggucacagaaaggcagguuucauuaagggcuucggccacaggca

SEQ ID NO: 354207 - RNA, 64 nt, Homo Sapiens
aaguaaaacucucaguuucuucauaaguaguggaagguuucacuuauacaugauauuugacuuu

SEQ ID NO: 354208 - RNA, 64 nt, Homo Sapiens
aaguaaagaucugaguuucuucauaaguaguggaagguuucacuuauaaaugguauuugacuuu

SEQ ID NO: 354209 - RNA, 64 nt, Homo Sapiens
guacuguagaggccaggcuggaaguaaguaauuuagguuucaugaccuaggauuaagcuggaga

SEQ ID NO: 354210 - RNA, 64 nt, Homo Sapiens
accgcauucugaccuccuccggucacagugggagagguuucaccuuuaaguaugaggguuuguu

SEQ ID NO: 354211 - RNA, 64 nt, Homo Sapiens
uuuuugguuuuucaccauugauauuguauuuagaagguuucaggugggugaaaccuccuauucc

SEQ ID NO: 354212 - RNA, 64 nt, Homo Sapiens
agggaccucaaccuaggugcaauccugucaugugagguuucagcuucaguccuccuugggagac

SEQ ID NO: 354213 - RNA, 64 nt, Homo Sapiens; identical to SEQ ID NO: 309431

SEQ ID NO: 354214 - RNA, 64 nt, Homo Sapiens; identical to SEQ ID NO: 309432

SEQ ID NO: 354215 - RNA, 64 nt, Homo Sapiens; identical to SEQ ID NO: 309433

SEQ ID NO: 354216 - RNA, 64 nt, Homo Sapiens; identical to SEQ ID NO: 309434

SEQ ID NO: 354217 - RNA, 64 nt, Homo Sapiens; identical to SEQ ID NO: 309435

SEQ ID NO: 354218 - RNA, 64 nt, Homo Sapiens; identical to SEQ ID NO: 309436

SEQ ID NO: 354219 - RNA, 64 nt, Homo Sapiens; identical to SEQ ID NO: 309437

SEQ ID NO: 354220 - RNA, 64 nt, Homo Sapiens; identical to SEQ ID NO: 309438

SEQ ID NO: 354221 - RNA, 64 nt, Homo Sapiens; identical to SEQ ID NO: 309439

SEQ ID NO: 354222 - RNA, 64 nt, Homo Sapiens; identical to SEQ ID NO: 309440

SEQ ID NO: 354223 - RNA, 64 nt, Homo Sapiens; identical to SEQ ID NO: 309441

SEQ ID NO: 354224 - RNA, 64 nt, Homo Sapiens; identical to SEQ ID NO: 309442

SEQ ID NO: 354225 - RNA, 64 nt, Homo Sapiens; identical to SEQ ID NO: 309443

SEQ ID NO: 354226 - RNA, 64 nt, Homo Sapiens; identical to SEQ ID NO: 309444

SEQ ID NO: 354227 - RNA, 64 nt, Homo Sapiens; identical to SEQ ID NO: 309445

SEQ ID NO: 354228 - RNA, 64 nt, Homo Sapiens; identical to SEQ ID NO: 309446

SEQ ID NO: 354229 - RNA, 64 nt, Homo Sapiens; identical to SEQ ID NO: 309447

SEQ ID NO: 354230 - RNA, 64 nt, Homo Sapiens; identical to SEQ ID NO: 309448

SEQ ID NO: 354231 - RNA, 64 nt, Homo Sapiens; identical to SEQ ID NO: 309449

SEQ ID NO: 354232 - RNA, 64 nt, Homo Sapiens; identical to SEQ ID NO: 309450

SEQ ID NO: 354233 - RNA, 64 nt, Homo Sapiens; identical to SEQ ID NO: 309451

SEQ ID NO: 354234 - RNA, 64 nt, Homo Sapiens; identical to SEQ ID NO: 309452

SEQ ID NO: 354235 - RNA, 64 nt, Homo Sapiens; identical to SEQ ID NO: 309453

SEQ ID NO: 354236 - RNA, 64 nt, Homo Sapiens; identical to SEQ ID NO: 309454

SEQ ID NO: 354237 - RNA, 64 nt, Homo Sapiens; identical to SEQ ID NO: 309455

SEQ ID NO: 354238 - RNA, 64 nt, Homo Sapiens; identical to SEQ ID NO: 309456

SEQ ID NO: 354239 - RNA, 64 nt, Homo Sapiens; identical to SEQ ID NO: 309457

SEQ ID NO: 354240 - RNA, 64 nt, Homo Sapiens; identical to SEQ ID NO: 309458

SEQ ID NO: 354241 - RNA, 64 nt, Homo Sapiens; identical to SEQ ID NO: 309459

SEQ ID NO: 354242 - RNA, 64 nt, Homo Sapiens; identical to SEQ ID NO: 309460

SEQ ID NO: 354243 - RNA, 64 nt, Homo Sapiens; identical to SEQ ID NO: 309461

SEQ ID NO: 354244 - RNA, 64 nt, Homo Sapiens; identical to SEQ ID NO: 309462

SEQ ID NO: 354245 - RNA, 64 nt, Homo Sapiens; identical to SEQ ID NO: 309463

SEQ ID NO: 354246 - RNA, 64 nt, Homo Sapiens; identical to SEQ ID NO: 309464

SEQ ID NO: 354247 - RNA, 64 nt, Homo Sapiens; identical to SEQ ID NO: 309465

SEQ ID NO: 354248 - RNA, 64 nt, Homo Sapiens; identical to SEQ ID NO: 309466

SEQ ID NO: 354249 - RNA, 64 nt, Homo Sapiens; identical to SEQ ID NO: 309467

SEQ ID NO: 354250 - RNA, 64 nt, Homo Sapiens; identical to SEQ ID NO: 309468

SEQ ID NO: 354251 - RNA, 64 nt, Homo Sapiens; identical to SEQ ID NO: 347916

SEQ ID NO: 354252 - RNA, 64 nt, Homo Sapiens; identical to SEQ ID NO: 347917

SEQ ID NO: 354253 - RNA, 64 nt, Homo Sapiens; identical to SEQ ID NO: 347918

SEQ ID NO: 354254 - RNA, 64 nt, Homo Sapiens; identical to SEQ ID NO: 347919

SEQ ID NO: 354255 - RNA, 64 nt, Homo Sapiens; identical to SEQ ID NO: 347920

SEQ ID NO: 354256 - RNA, 64 nt, Homo Sapiens; identical to SEQ ID NO: 347921

SEQ ID NO: 354257 - RNA, 64 nt, Homo Sapiens; identical to SEQ ID NO: 347922

SEQ ID NO: 354258 - RNA, 64 nt, Homo Sapiens; identical to SEQ ID NO: 347923

SEQ ID NO: 354259 - RNA, 64 nt, Homo Sapiens; identical to SEQ ID NO: 347924

SEQ ID NO: 354260 - RNA, 64 nt, Homo Sapiens; identical to SEQ ID NO: 347925

SEQ ID NO: 354261 - RNA, 64 nt, Homo Sapiens
uaacuuguuuucuucauccaccagauuuguuuaccacucaaaaucuaaugcauguauuuguaaa

SEQ ID NO: 354262 - RNA, 64 nt, Homo Sapiens
guuuuuacaaugcuucuaaaugcaaaauacuuugcacucaaaaugugccagaaaaaccgucacu

SEQ ID NO: 354263 - RNA, 64 nt, Homo Sapiens
cuguuuaguugcaacaaucucuugugacuaaugucacucaaagcaucuuguaaauccuagggcu

SEQ ID NO: 354264 - RNA, 64 nt, Homo Sapiens
cuuggagcuccugacugcagggacucuguccccacacucaaaaagacucagcucacucaaugag

SEQ ID NO: 354265 - RNA, 64 nt, Homo Sapiens
augggaaguccggccccagugaacuaaagugcugcacucaaaugccacauggcacagagauucu

SEQ ID NO: 354266 - RNA, 64 nt, Homo Sapiens
agggacuaucuaucuuaauacaaaugaaaaauuccacucaaaaugagaaggaacauaccccuua

SEQ ID NO: 354267 - RNA, 64 nt, Homo Sapiens
uuuacaguucucccaagggaucaucuuggucacauacaauuauuaagcugaauacauucugcuu

SEQ ID NO: 354268 - RNA, 64 nt, Homo Sapiens
ucaguccucuuucaaagguaaagccaaguuuauauacaauuauauuuaccugugaaauaguuca

SEQ ID NO: 354269 - RNA, 64 nt, Homo Sapiens
gaaaaucuuagauuuuguuuagaaugagaaaauauacaauuagaauuauuuuagaaauaguagg

SEQ ID NO: 354270 - RNA, 64 nt, Homo Sapiens
uuugagguuaauuauaugauagugaggaacauuuuacaauuauuuacaguguuugacauuaauu

SEQ ID NO: 354271 - RNA, 64 nt, Homo Sapiens
ugagacuuuuuuccccaaaggauacugacuguaauacaauuaccaauucacaaugauaaaaaua

SEQ ID NO: 354272 - RNA, 64 nt, Homo Sapiens
acagaccugugaaauaaagggcauuuugaccuaauacaauuaauuuucuggauaacucuuaaag

SEQ ID NO: 354273 - RNA, 64 nt, Homo Sapiens
ucucuaauuuuggauaauauuuguacaauuaaguuacaauuacaaccauuagcauaauuuugug

SEQ ID NO: 354274 - RNA, 64 nt, Homo Sapiens
uuacaauuacaucucuaauuauaauuuuguguuguacaauuaagaguaggcuuuuaccauuagc

SEQ ID NO: 354275 - RNA, 64 nt, Homo Sapiens
aucucccucacucuauaguuggaaaagugccuaauacaauuagaagucaacaucuaacuaguga

SEQ ID NO: 354276 - RNA, 64 nt, Homo Sapiens
aaaaauuagcacaucccuuugugugaaugucaucuacaauuaaauggguacaggggaauuaugu

SEQ ID NO: 354277 - RNA, 64 nt, Homo Sapiens
guucccaaagucaguuauucaaaaacaaaauuucuacaauuacagguuacuuucuuguuuuugg

SEQ ID NO: 354278 - RNA, 64 nt, Homo Sapiens
guucccaaagacacaguuguauaaagaaaauuucuacaauuacagguuacuuucuuguucuugg

SEQ ID NO: 354279 - RNA, 64 nt, Homo Sapiens; identical to SEQ ID NO: 101897

SEQ ID NO: 354280 - RNA, 64 nt, Homo Sapiens; identical to SEQ ID NO: 101898

SEQ ID NO: 354281 - RNA, 64 nt, Homo Sapiens; identical to SEQ ID NO: 101899

SEQ ID NO: 354282 - RNA, 64 nt, Homo Sapiens; identical to SEQ ID NO: 101900

SEQ ID NO: 354283 - RNA, 64 nt, Homo Sapiens; identical to SEQ ID NO: 101901

SEQ ID NO: 354284 - RNA, 64 nt, Homo Sapiens; identical to SEQ ID NO: 101902

SEQ ID NO: 354285 - RNA, 64 nt, Homo Sapiens; identical to SEQ ID NO: 354267

SEQ ID NO: 354286 - RNA, 64 nt, Homo Sapiens; identical to SEQ ID NO: 354268

SEQ ID NO: 354287 - RNA, 64 nt, Homo Sapiens; identical to SEQ ID NO: 354269

SEQ ID NO: 354288 - RNA, 64 nt, Homo Sapiens; identical to SEQ ID NO: 354270

SEQ ID NO: 354289 - RNA, 64 nt, Homo Sapiens; identical to SEQ ID NO: 354271

SEQ ID NO: 354290 - RNA, 64 nt, Homo Sapiens; identical to SEQ ID NO: 354272

SEQ ID NO: 354291 - RNA, 64 nt, Homo Sapiens; identical to SEQ ID NO: 354273

SEQ ID NO: 354292 - RNA, 64 nt, Homo Sapiens; identical to SEQ ID NO: 354274

SEQ ID NO: 354293 - RNA, 64 nt, Homo Sapiens; identical to SEQ ID NO: 354275

SEQ ID NO: 354294 - RNA, 64 nt, Homo Sapiens; identical to SEQ ID NO: 354276

SEQ ID NO: 354295 - RNA, 64 nt, Homo Sapiens; identical to SEQ ID NO: 354277

SEQ ID NO: 354296 - RNA, 64 nt, Homo Sapiens; identical to SEQ ID NO: 354278

SEQ ID NO: 354297 - RNA, 64 nt, Homo Sapiens; identical to SEQ ID NO: 101897

SEQ ID NO: 354298 - RNA, 64 nt, Homo Sapiens; identical to SEQ ID NO: 101898

SEQ ID NO: 354299 - RNA, 64 nt, Homo Sapiens; identical to SEQ ID NO: 101899

SEQ ID NO: 354300 - RNA, 64 nt, Homo Sapiens; identical to SEQ ID NO: 101900

SEQ ID NO: 354301 - RNA, 64 nt, Homo Sapiens; identical to SEQ ID NO: 101901

SEQ ID NO: 354302 - RNA, 64 nt, Homo Sapiens; identical to SEQ ID NO: 101902

SEQ ID NO: 354303 - RNA, 63 nt, Homo Sapiens
ggacuguugugaggcuuggcuaauaauacuuaccuaccucacauuccaucuaccaaaugggug

SEQ ID NO: 354304 - RNA, 63 nt, Homo Sapiens
gcucucccugucaaaaagcagagaguuuggggucuaccucagaaggaguagcccccuuuuuca

SEQ ID NO: 354305 - RNA, 63 nt, Homo Sapiens
auuuaccuuuuacaagguuagaaaagucucauacuaccucaucuuuauuguggcgcuuuugua

SEQ ID NO: 354306 - RNA, 63 nt, Homo Sapiens
gcaaccucugccuuccagguuccagcaauucuccuaccucagcucccaaguagcugagaugac

SEQ ID NO: 354307 - RNA, 63 nt, Homo Sapiens
guaaaaucuuaagccaauggaacccuugauuuccuaccucaguguacacccaacuauugguug

SEQ ID NO: 354308 - RNA, 63 nt, Homo Sapiens
uuaaauagccagcauguaauacaaguaacuacacuaccucauaucuacaugauuuucaaguug

SEQ ID NO: 354309 - RNA, 63 nt, Homo Sapiens
ggauaaaaaggauuacaugaagauaacuaaccccuaccucacagccagcauggauaauaaccc

SEQ ID NO: 354310 - RNA, 63 nt, Homo Sapiens
ggauuuaaugaugucaagcucuaacaauauuaccuaccucauauccucaucuguaaaaugggg

SEQ ID NO: 354311 - RNA, 62 nt, Homo Sapiens
uugcaaaaaaaguuugcuaauuuuaaguccuuucguauaagaauuaaugagacaauuuuccu

SEQ ID NO: 354312 - RNA, 64 nt, Homo Sapiens
gcauaucgucauguuaauaaauuuaaaacaucauucguauaaaauauuuuaauuuucuuguauu

SEQ ID NO: 354313 - RNA, 64 nt, Homo Sapiens
uagucccuuaaaaauuaaauuuaccuuuaugaggucguauaauuugguuaaaauauuacugauc

SEQ ID NO: 354314 - RNA, 64 nt, Homo Sapiens
aucuauuaaccauucuaaauaauuagaucccacaucguauaaauuacaaaaagccauuguugag

SEQ ID NO: 354315 - RNA, 64 nt, Homo Sapiens
uuccaugauuuuauuuucuggucauuuaucauagucguauaagugagagaaauauucauuaucu

SEQ ID NO: 354316 - RNA, 64 nt, Homo Sapiens
caauaugaauacagggcaugauguggcauguucaucguauaacaacacguacuuaaaugaaagc

SEQ ID NO: 354317 - RNA, 64 nt, Homo Sapiens
uuaguagguagauuuauuuaaucaauaaaucacuucguauaaucuauaauggauguuaaccagu

SEQ ID NO: 354318 - RNA, 64 nt, Homo Sapiens
ucuggauuuuuuuuuuuuuuuccugggccuaaaaucguauaaaacuuaacucuaaagcuccaug

SEQ ID NO: 354319 - RNA, 64 nt, Homo Sapiens
gauacguucuuuggauuauguaaacuugaacuuuucguauaauaaacuaauuuauuugcuuuuu

SEQ ID NO: 354320 - RNA, 64 nt, Homo Sapiens
gacucauccugucugcuaacuucucaaaaaaauaucguauaaguagauuuccaaaucagucguu

SEQ ID NO: 354321 - RNA, 64 nt, Homo Sapiens
aacauuuggguacuuagaggauaaagcuucguggucguauaaauuuagaucauuuggauugauu

SEQ ID NO: 354322 - RNA, 64 nt, Homo Sapiens
aauguaggaagaccuucaccaaccuuauacaaacucguauaaagaggccuuuguucagcaaaga

SEQ ID NO: 354323 - RNA, 64 nt, Homo Sapiens
cagacuuuaagauugcccggaggaagcaaacucuucguauaaaaaaagcaggccaucugcuuaa

SEQ ID NO: 354324 - RNA, 64 nt, Homo Sapiens
aacauauaugggcuguuagauaguaauuguaauuucguauaaauaguaaaugaguacaucuuga

SEQ ID NO: 354325 - RNA, 64 nt, Homo Sapiens
ggcacugcuccauccuccccgauucaaaggauguucguauaaauccuguauaauuuauuuuaaa

SEQ ID NO: 354326 - RNA, 64 nt, Homo Sapiens
acucaagcaucaacaccaaauuauuccucccuucucguauaaauagagugacuauccacaggag

SEQ ID NO: 354327 - RNA, 64 nt, Homo Sapiens
uuuuuuuuuuuugacuucuagauccuuugcauuuucguauaaaauuugaagucaacuucuauca

SEQ ID NO: 354328 - RNA, 64 nt, Homo Sapiens
uucacacauauucuuaaugauaauugugcacaucucguauaauaagauuuugcugagaugaagc

SEQ ID NO: 354329 - RNA, 64 nt, Homo Sapiens
gucauugcuuccuccuaugguacagccgccaaccucguauaacaugcccccggccccgcgcccc

SEQ ID NO: 354330 - RNA, 64 nt, Homo Sapiens
uccuuuuacaaaaaugaaaauaauaaacauguuuucguauaaaauaacacaaaaugauauacac

SEQ ID NO: 354331 - RNA, 64 nt, Homo Sapiens
auggagaacagugauuuuuuucacaucaugacacucguauaagcgaacaagugaacacauugug

SEQ ID NO: 354332 - RNA, 64 nt, Homo Sapiens
ccaaagauaaggacuagauacuacuuucucuuuuucguauaaucuuguagacacuuacuugaug

SEQ ID NO: 354333 - RNA, 64 nt, Homo Sapiens
cucacuggccaguagcugccaaaaagaacacccaucguauaaggaaauccagccccauagaaaa

SEQ ID NO: 354334 - RNA, 64 nt, Homo Sapiens
gauauguuuguauuguuuuucuuaaagaggaaccucguauaagcuucaagccucacaaaccuuc

SEQ ID NO: 354335 - RNA, 64 nt, Homo Sapiens
auaguagacaacugcuuaauuggccauuuuguaaucguauaaaagggagaagacucuuuuuuuu

SEQ ID NO: 354336 - RNA, 64 nt, Homo Sapiens
uucuagauaagauaaacaaauuacuuuuacaugaucguauaaguauaauacugaauaaauaaau

SEQ ID NO: 354337 - RNA, 64 nt, Homo Sapiens
gcuaaagguugagaacuacugcuuuagaaugaagucguauaauaaagucucugaaaaggccuua

SEQ ID NO: 354338 - RNA, 64 nt, Homo Sapiens
augaaggcaaagguucucugaagacuacguuuguucguauaacuugaggagcauaaacauugug

SEQ ID NO: 354339 - RNA, 64 nt, Homo Sapiens
guuuacaaauaacgguuuuuugaagaguuacauuucguauaaaauuuuauuuuuuauuuccacu

SEQ ID NO: 354340 - RNA, 64 nt, Homo Sapiens
aucugcucauauuagaacacagaaauuggcaauaucguauaaaaaaaacaaaaaucuuggggga

SEQ ID NO: 354341 - RNA, 64 nt, Homo Sapiens
uugucaaguggaaacaugcuuaaagauucuauuuucguauaacaguuaugccuugcuauuuuaa

SEQ ID NO: 354342 - RNA, 64 nt, Homo Sapiens
aaacucuguauaacuuuuaaauggcuggaacuacucguauaaggacuagacuguauuuuugaca

SEQ ID NO: 354343 - RNA, 64 nt, Homo Sapiens
uuggacuaaaagguuuuauugaaauaaagccucuuaaaaugaaaaaucauauacuuuuaacauc

SEQ ID NO: 354344 - RNA, 64 nt, Homo Sapiens
accuacugugugcucagcacuaaagguuuguugauaaaaugacaauuaaaaaauggcauuuagc

SEQ ID NO: 354345 - RNA, 64 nt, Homo Sapiens
gauuaaaacucaguuuuuaaauuaaccaucaacuuaaaaugaaugguaaaagaucaaaaugcau

SEQ ID NO: 354346 - RNA, 64 nt, Homo Sapiens
uaaaaugaaugguaaaagaucaaaaugcauaugguaaaaugauugcuuucagauaacaagauac

SEQ ID NO: 354347 - RNA, 64 nt, Homo Sapiens
aagauaccaaucuuauauuguauuuugacugcucuaaaaugauuaaacaguuuucacuuacauu

SEQ ID NO: 354348 - RNA, 64 nt, Homo Sapiens
auguauauaaagcuuuuugguaauauguuacaauuaaaaugacaagcacuauaucacaaucucu

SEQ ID NO: 354349 - RNA, 64 nt, Homo Sapiens
aauaguuuuguaucgggaauuucucagagcugaguaaaaugaaggaaaagcauguuauguguuu

SEQ ID NO: 354350 - RNA, 64 nt, Homo Sapiens
cauuuuuuaggacaucuuaaaucuaaacaaaaaauaaaaugaacaucucuugaaaccuguuaaa

SEQ ID NO: 354351 - RNA, 64 nt, Homo Sapiens
guuuccugaagcauuuaguuacaaccugaaggaauaaaaugauuuguggaaaugcuuaaaauag

SEQ ID NO: 354352 - RNA, 64 nt, Homo Sapiens
cguaguucaguaauugccagcaauauaacacggcuaaaaugaaguuuuuacaguauaugacaua

SEQ ID NO: 354353 - RNA, 64 nt, Homo Sapiens
uuuaauugccagagagaaggaugcaaucacuagguaaaaugagguuuuuaggauuauuuauuga

SEQ ID NO: 354354 - RNA, 64 nt, Homo Sapiens
uuuucugguuuuaaagagauugccaagaugucuguaaaaugauuuagacaaaacagaguauaga

SEQ ID NO: 354355 - RNA, 64 nt, Homo Sapiens
aaaccaacccucaaaaaacaaucaacacauugcuuaaaaugaugguugauaggauguuuaaaac

SEQ ID NO: 354356 - RNA, 64 nt, Homo Sapiens
ucuauauauugacuuucuuaaaaauacuuauuuuuaaaaugaaauacauacuaugccagauuac

SEQ ID NO: 354357 - RNA, 64 nt, Homo Sapiens
auagucucuugagugguaagaguuugcuauaauauaaaaugacauauaaauuaacugaaauuac

SEQ ID NO: 354358 - RNA, 64 nt, Homo Sapiens
uuaaaggcaagaagugugugugugccauucuuuauaaaaugauuaguaaacauaaaccccaacu

SEQ ID NO: 354359 - RNA, 64 nt, Homo Sapiens
cuggagcuuuacauuuucugcagaaggaccuguauaaaaugaauagagacuggcagugagagcc

SEQ ID NO: 354360 - RNA, 64 nt, Homo Sapiens
uagaucuuauuauucuguuaauaaauaaauaaaauaaaaugaaagugagacucugucucaaaaa

SEQ ID NO: 354361 - RNA, 64 nt, Homo Sapiens
cuucuaggcugggcauggugcagaccacucuuucuaaaaugaauccuccuaagagaaaccuucc

SEQ ID NO: 354362 - RNA, 64 nt, Homo Sapiens
accucugcacuuuaauuuuuacaauucauggugcuaaaaugaaagagagaaaugggauuucauc

SEQ ID NO: 354363 - RNA, 64 nt, Homo Sapiens
acaugacuucuguuuuugaaaugucccauuguucuaaaaugauauuuuacagacuuuauucacu

SEQ ID NO: 354364 - RNA, 64 nt, Homo Sapiens
gugaagguauuccagaucuacauaagaugauaaauaaaaugaagaguaauuaaaaugagaaaua

SEQ ID NO: 354365 - RNA, 64 nt, Homo Sapiens
aauacauaagaugauaaauauauaaaauaguaauuaaaaugagaugaaauacuugaaauagacc

SEQ ID NO: 354366 - RNA, 64 nt, Homo Sapiens
ugcuacguuccguuauucaauuaaaaugacucaauaaaaugacucuuaaagacacaaugcacac

SEQ ID NO: 354367 - RNA, 64 nt, Homo Sapiens
caauaaaaugacuugcuacgacacaaugcacacuuaaaaugacuaagucaaauaaaucuuaaag

SEQ ID NO: 354368 - RNA, 64 nt, Homo Sapiens
caagucaaauaaaucuuaaacaaucagggcacauuaaaaugauaaaaaaaaagugaagugaaaa

SEQ ID NO: 354369 - RNA, 64 nt, Homo Sapiens
aagagcuaguauguuguaaaaccugccaccugaauaaaaugaaaaaaaaaguguuuuuuugaga

SEQ ID NO: 354370 - RNA, 64 nt, Homo Sapiens
ugggauuacaggcgugagccaccgugcccggcccuaaaaugaaauuauuaauguugguucugaa

SEQ ID NO: 354371 - RNA, 64 nt, Homo Sapiens
aaggagauuuauuuuccuuaaacauccaauaauuuaaaaugauuuucaauaauaauaaucaaau

SEQ ID NO: 354372 - RNA, 64 nt, Homo Sapiens
ccaacaugggaugggaaggaaugggcaaagagauuaaaaugacagaaguuagcuguagaugacc

SEQ ID NO: 354373 - RNA, 64 nt, Homo Sapiens
gaaacaagauaauaaauguacaaaacaugaaaauuaaaaugaacaauauaggaaaauaauugua

SEQ ID NO: 354374 - RNA, 64 nt, Homo Sapiens
uugcaguggugcuuauacaaaucuacacaagugauaaaaugacacagaacuauauacacacauu

SEQ ID NO: 354375 - RNA, 64 nt, Homo Sapiens
gugugcaaaagcacacauauguaugucuguguuauaaaaugacugugcuuguucguaacagaug

SEQ ID NO: 354376 - RNA, 64 nt, Homo Sapiens
uuggcucaaugggaagagaggagagggagaaaaauaaaaugaaaggaaaaaaaaaaguuugcaa

SEQ ID NO: 354377 - RNA, 64 nt, Homo Sapiens
aaaaaaaccuuuaaauguucgucuauacccuaaguaaaaugaggacgaaagacaaauauuuuga

SEQ ID NO: 354378 - RNA, 64 nt, Homo Sapiens
agaacauuacaagccuaaugucuccauaauuuuauaaaaugaaaucuuagugucuaaauccuug

SEQ ID NO: 354379 - RNA, 64 nt, Homo Sapiens
uuuaauuagcacauauugaaccaaagaucauuuuuaaaaugaaaauaguuggaaauguaaucau

SEQ ID NO: 354380 - RNA, 64 nt, Homo Sapiens
gauucaacuucugccucggauguaagagucuuguuaaaaugaugguccuccucuaagaccauau

SEQ ID NO: 354381 - RNA, 64 nt, Homo Sapiens
uccaaguuuaccaguagaaauugccaagauacucuaaaaugacaagugagauccucucaccauu

SEQ ID NO: 354382 - RNA, 64 nt, Homo Sapiens
uuuuuuaaaacaaucuagccuauuguuacuuuuuuaaaaugaaucuuuucaucuguaaauguuu

SEQ ID NO: 354383 - RNA, 64 nt, Homo Sapiens
cuauuaugacugccuuugcaaauauuuuuguacguaaaaugauugaaauuauuuauugugaugu

SEQ ID NO: 354384 - RNA, 64 nt, Homo Sapiens
uuguacaaguaggauaugaauuaaagaguuuuuguaaaaugauuaauacauucucuauuaguuu

SEQ ID NO: 354385 - RNA, 64 nt, Homo Sapiens
gcuauuugaggacucugguugaugacucaaaggauaaaaugaacugaaggacuuuauauaaaag

SEQ ID NO: 354386 - RNA, 64 nt, Homo Sapiens
aggcuguaaaauuuggagacaggagauacugcaauaaaaugauucagagcaugauaucuauaau

SEQ ID NO: 354387 - RNA, 64 nt, Homo Sapiens
ugauuauauauuggaauuguuuacagauuuaauauaaaaugaacguugaacugcucugcauuaa

SEQ ID NO: 354388 - RNA, 64 nt, Homo Sapiens
uuacuacaaaauuugaaauuaaauucaaccacuguaaaaugaaaucauuaagcauugggugggu

SEQ ID NO: 354389 - RNA, 64 nt, Homo Sapiens
uucaacuguugauugcaggaguccuucugcuggauaaaaugaggcaaugaggucugaaauggag

SEQ ID NO: 354390 - RNA, 64 nt, Homo Sapiens
uguaugcauuaaaccaaguccauuuugaaugaccuaaaaugaaguaacacaaucagaaauccca

SEQ ID NO: 354391 - RNA, 64 nt, Homo Sapiens
uguuacgguuguauauagaggucugaaggauuuuuaaaaugauuugcacuuuuucacugcaugc

SEQ ID NO: 354392 - RNA, 64 nt, Homo Sapiens
ugguagaauucagcaauaugagaaaaccagccccuaaaaugauagccacaagagauuaauugug

SEQ ID NO: 354393 - RNA, 64 nt, Homo Sapiens
gcauucaagcacuuuuacaaaauuaccaaauucuuaaaaugaagccacagcuagacuugcauuu

SEQ ID NO: 354394 - RNA, 64 nt, Homo Sapiens
uguaaacugcaaauacuacagauaauucugauaauaaaaugauaugcacgcugaauccugcuau

SEQ ID NO: 354395 - RNA, 64 nt, Homo Sapiens
uuuguugguacauauuacacaaaacauugugccuuaaaaugagucauacaucuuuuaaauugga

SEQ ID NO: 354396 - RNA, 64 nt, Homo Sapiens
agcucuauauguaaaugauggguuuguugguauuuaaaaugaauacaacuugaauguaauuaaa

SEQ ID NO: 354397 - RNA, 64 nt, Homo Sapiens
uuuuuuggaagcgauaaacuuuaaauauacuuauuaaaaugaaauucuauuaaguuuuucagau

SEQ ID NO: 354398 - RNA, 64 nt, Homo Sapiens
ggcucagauccuaguuuuaaaaaccauuucccauuaaaaugaaguuggaggaacagcugcuucu

SEQ ID NO: 354399 - RNA, 64 nt, Homo Sapiens
aauauaaagaaagaaagagacaagucaaauguaguaaaaugacaacacuuggugacucuaggug

SEQ ID NO: 354400 - RNA, 64 nt, Homo Sapiens
uuaaucacuauuuaacuucuuucugcaccugauguaaaaugacacauaguuuuaagcuacaccu

SEQ ID NO: 354401 - RNA, 64 nt, Homo Sapiens
aaaaagaauguggccaaacauccauaauauuucauaaaaugaaguuccacaagaagugcauagg

SEQ ID NO: 354402 - RNA, 64 nt, Homo Sapiens
acauguuuuuguuuucuuugaguuuauuuccaaauaaaaugaggccuuucuauccuacaacaag

SEQ ID NO: 354403 - RNA, 64 nt, Homo Sapiens
guaaaauagcuuguauaguguacaugcaauuuauuaaaaugauugggaagggcuacugcagcuu

SEQ ID NO: 354404 - RNA, 64 nt, Homo Sapiens
uuuuuucauaauguaaugccguauuuauuguuuuuaaaaugaaaggaauacuaauaagucuuaa

SEQ ID NO: 354405 - RNA, 64 nt, Homo Sapiens
uaauuugaauaaauuuuguaugguaaaggaucaauaaaaugauuuuuuuuaagaguucaggcuu

SEQ ID NO: 354406 - RNA, 64 nt, Homo Sapiens
ugucucucuaaaacaguaaacauaucuuacaaauuaaaaugacuuuuaggcugggugcaguggc

SEQ ID NO: 354407 - RNA, 64 nt, Homo Sapiens
agacugugucucaaaauaaauaaauaaaauaaaauaaaaugacguacagagauucuauauucua

SEQ ID NO: 354408 - RNA, 64 nt, Homo Sapiens
aaauauagccccuagccuaauaacuuaucauuuguaaaaugacuuauaaaaauauuaccucaau

SEQ ID NO: 354409 - RNA, 64 nt, Homo Sapiens
uuccaagguuuuaguuacucaggaaggaguuaauuaaaaugauuuuauuuuggucugauggaug

SEQ ID NO: 354410 - RNA, 64 nt, Homo Sapiens
guauugguuauuuuaaaaaguuguaaagauuucauaaaaugauaauuguacuacugugcuuauc

SEQ ID NO: 354411 - RNA, 64 nt, Homo Sapiens
uguuuuccuggaacaaugcuggauaugcucccuauaaaaugaaaaguauuuucuaauguuucug

SEQ ID NO: 354412 - RNA, 64 nt, Homo Sapiens
ugugcauggcauuuuauauguuaauuuuuuaguuuaaaaugaaguauauugaauguuugccuuu

SEQ ID NO: 354413 - RNA, 64 nt, Homo Sapiens
ugccuuuagcaccauuuuauuugguuugucccacuaaaaugacucgagaaguguuuagacaaac

SEQ ID NO: 354414 - RNA, 64 nt, Homo Sapiens
uaaagaguaguucauaaaaaaaucaacauacugauaaaaugacuuuguacuccacaaaauuaug

SEQ ID NO: 354415 - RNA, 64 nt, Homo Sapiens
uuguacuccacaaaauuaugacugaaagguuuauuaaaaugauuguaauauauagaaaguaucu

SEQ ID NO: 354416 - RNA, 64 nt, Homo Sapiens
caccauguaaggucacauuuaguaaaugcugaaauaaaaugauuaaugcauuuaucaauaaaag

SEQ ID NO: 354417 - RNA, 64 nt, Homo Sapiens
aauuuuuuugaugugcuuacauaaccauggugauuaaaaugaguuuauauuuuuucucaaaaau

SEQ ID NO: 354418 - RNA, 64 nt, Homo Sapiens
ugucaacuuuaagguauguuuagcuguaacccuuuaaaaugaaacuagcucagucccuaugagg

SEQ ID NO: 354419 - RNA, 64 nt, Homo Sapiens
aaaccuuucagcuauguuugaggacuacugcccuuaaaaugaaaaguuacauuaacuauuucaa

SEQ ID NO: 354420 - RNA, 64 nt, Homo Sapiens
uguaggcugaccucaacccuguaacguaacccauuaaaaugaauuucuuuuuuuuuaagacaga

SEQ ID NO: 354421 - RNA, 64 nt, Homo Sapiens
cugagauuacagacgugagccacugcguccugccuaaaaugaauuuucuagaugauugaauaac

SEQ ID NO: 354422 - RNA, 64 nt, Homo Sapiens
cugaaaauaguagaucagaaaucucaguuuaauauaaaaugagcuaaguuuuuaaaaauaaauu

SEQ ID NO: 354423 - RNA, 64 nt, Homo Sapiens
caccggauggauucugaugaaaacgaaaacaaaguaaaaugacuggcuuagcagauucuuugaa

SEQ ID NO: 354424 - RNA, 64 nt, Homo Sapiens
augaaguuaccguggcgaaguugacaaauaccacuaaaaugauuaugauuuagaaguaacuuuc

SEQ ID NO: 354425 - RNA, 64 nt, Homo Sapiens
aagaccuaauugaaagaaaaaucauagaaauaaguaaaaugauuuguuuuauaauuuauccacc

SEQ ID NO: 354426 - RNA, 64 nt, Homo Sapiens
auaaauauguaaauacaugcuuuaauuugcaauuuaaaaugaagggguuaaauaaguuagacau

SEQ ID NO: 354427 - RNA, 64 nt, Homo Sapiens
uuaguauuugagaugaguuguugggacaugcaaauaaaaugaagaaugaacuuucgugucuuuu

SEQ ID NO: 354428 - RNA, 64 nt, Homo Sapiens
cuuggggugggaggggagaaagggaaccuuuucuuaaaaugaaaauaauuacugcuauuuuaaa

SEQ ID NO: 354429 - RNA, 64 nt, Homo Sapiens
uuuauaauggaucaugcauaauuucucaggagaauaaaaugagaauucauauauacguucaucu

SEQ ID NO: 354430 - RNA, 64 nt, Homo Sapiens
ccugcaccucuuugggccucaguuuccccaucuguaaaaugaaggaguuggaccaaugcccccu

SEQ ID NO: 354431 - RNA, 64 nt, Homo Sapiens
gaagauggucacuuuaaccuuguaaauauuuaucuaaaaugauauuuacaaaacuguaauauau

SEQ ID NO: 354432 - RNA, 64 nt, Homo Sapiens
acgaacuuaaaaaauaaaagggcuuuuugucaaauaaaaugaauggguauguguugccaaagcu

SEQ ID NO: 354433 - RNA, 64 nt, Homo Sapiens
uuuauuauggguauguguuguugggccacgauuuuaaaaugacuuuucuuuuuuuucuuggugu

SEQ ID NO: 354434 - RNA, 64 nt, Homo Sapiens
ucagaccaauaaaaucaaggauguuaaaguaaccuaaaaugaauuacaguuacaggaaauuaaa

SEQ ID NO: 354435 - RNA, 64 nt, Homo Sapiens
ugugagccaauuguuucugagcaauacacaaauuuaaaaugaguaucuguuuucucaugcacag

SEQ ID NO: 354436 - RNA, 64 nt, Homo Sapiens
gucacuuuugcagauauucuucgguuugaauaauuaaaaugaaccagauaucagggugguuaau

SEQ ID NO: 354437 - RNA, 64 nt, Homo Sapiens
uaauuaaaaugaaccagauaucagggugguuaauuaaaaugaaccagauaucagggugguuuau

SEQ ID NO: 354438 - RNA, 64 nt, Homo Sapiens
aucuucuaacaugauauauucaggauuuacacauuaaaaugauuauuuaaauuguggcagugau

SEQ ID NO: 354439 - RNA, 64 nt, Homo Sapiens
uuuacuugacuguucuauuuguuuguccaaaagauaaaaugaugagagagauucgagaggucuu

SEQ ID NO: 354440 - RNA, 64 nt, Homo Sapiens
uuacuggauucuguucaacugacuguagagcauguaaaaugauuauuagguugcuccugaaacu

SEQ ID NO: 354441 - RNA, 64 nt, Homo Sapiens
caaauaccaagguauuccuuguaaggauggacacuaaaaugaaaggcucuaccagaccagaagg

SEQ ID NO: 354442 - RNA, 64 nt, Homo Sapiens
auuuggaggcauuugcaugguagucuuugaacaguaaaaugauguguugacuauacugauacac

SEQ ID NO: 354443 - RNA, 64 nt, Homo Sapiens
acaucucauguuuuaucauuuggauggaguaauuuaaaaugaauuaaauuccagagaacaaugg

SEQ ID NO: 354444 - RNA, 64 nt, Homo Sapiens
gccagccaccgaauaaagauaaaaguucaguucuuaaaaugaguuuuuaugagauaacagucag

SEQ ID NO: 354445 - RNA, 64 nt, Homo Sapiens
uaguaguaguccugagccucagcguccucaucuauaaaaugacuggcgaaaauacuucacaagc

SEQ ID NO: 354446 - RNA, 64 nt, Homo Sapiens
cuuuuuuuucugagauuacuuuugggguaauauuuaaaaugagagacauuuuguaacccuguaa

SEQ ID NO: 354447 - RNA, 63 nt, Homo Sapiens
gaaggcaaauucuuuaaucaaauaaagcgcauuauaaaaugagauguuuauuggauuauugac

SEQ ID NO: 354448 - RNA, 64 nt, Homo Sapiens
aagccugugguuucacuuauagguuaaaaugcucuaaaaugagaacucaggccuucuaaaaagc

SEQ ID NO: 354449 - RNA, 64 nt, Homo Sapiens
aguagaauuccaagaaaaauaauuuaaggcuuuguaaaaugaagucaugugauuuuugagucuc

SEQ ID NO: 354450 - RNA, 64 nt, Homo Sapiens
ccaagguuuaggaggugagauuuauugugaucacuaaaaugaggguaugcaccuaccauuuucc

SEQ ID NO: 354451 - RNA, 64 nt, Homo Sapiens
caacggcucauucauaguuaaacaaaaaugaagcuaaaaugaaucuguguuucagugacugaua

SEQ ID NO: 354452 - RNA, 64 nt, Homo Sapiens
auucuuuaaaguuggacagguuuuaaugcugucuuaaaaugaacuguucaguguauuuuauuac

SEQ ID NO: 354453 - RNA, 64 nt, Homo Sapiens
aaacaaaaguuugacagugacugaauaacaaaauuaaaaugaugaauuuaacaaagggagccug

SEQ ID NO: 354454 - RNA, 64 nt, Homo Sapiens
cuuggcugaaaaaaaaaaaugcuuuuaaaaaagauaaaaugaaaaggagagcucucuuuuucuc

SEQ ID NO: 354455 - RNA, 64 nt, Homo Sapiens
uuuuucaccucaaaauaagaucgaugguaucuuguaaaaugaggguagugccacuucuuaguau

SEQ ID NO: 354456 - RNA, 64 nt, Homo Sapiens
caggaaaucagcacaaagccugauaguacuuuacuaaaaugacugcauucuuuggauuccuuca

SEQ ID NO: 354457 - RNA, 64 nt, Homo Sapiens
uuucuuuuuuggcacaugugaaucuuguuuuguguaaaaugaaauuacuuucucuuguucucug

SEQ ID NO: 354458 - RNA, 64 nt, Homo Sapiens
ugucaagacaaaggcaaaacagaaaccaagauuuuaaaaugaaguuuuuugaaaacacaucagu

SEQ ID NO: 354459 - RNA, 64 nt, Homo Sapiens
augauuaacuuauauugcaugaacugguggcacuuaaaaugauacaagugcauuaauauaaaca

SEQ ID NO: 354460 - RNA, 64 nt, Homo Sapiens
auugagaaauauaagaugaaauagacagggauaguaaaaugaaauuuuagccauagggucuuuu

SEQ ID NO: 354461 - RNA, 64 nt, Homo Sapiens
acaaagaacguugaaguucauguuuuaauaauuuuaaaaugagcugcuuguccuuuugaauucc

SEQ ID NO: 354462 - RNA, 64 nt, Homo Sapiens
augcauucacaguuucuguaucucuuuugccucguaaaaugaaacuaugcaaucuugaauauuu

SEQ ID NO: 354463 - RNA, 64 nt, Homo Sapiens
uaugauuuauguugauguguuguaaagguccaaguaaaaugaggccagacuuaauauuaaagaa

SEQ ID NO: 354464 - RNA, 64 nt, Homo Sapiens
uauuuagaugcaauaauuaaacaugaaaagguucuaaaaugauaagauuagguaaaaugagauu

SEQ ID NO: 354465 - RNA, 64 nt, Homo Sapiens
uuacaugaaaagguucuaaaaauaacagauuagguaaaaugagauuuuaauucuuaaguggcca

SEQ ID NO: 354466 - RNA, 64 nt, Homo Sapiens
uuguuauuaaaguauaugcauguucauuuauuacuaaaaugaacguucucugucucuguuucuu

SEQ ID NO: 354467 - RNA, 64 nt, Homo Sapiens
aauugauauucugauauaaaauguaugguaaaguuaaaaugacauauauuuuugauaauuuuuc

SEQ ID NO: 354468 - RNA, 64 nt, Homo Sapiens
agauguauauuuagauuaauuucaugcuuucagauaaaaugaguuauauauaaaaugaacauag

SEQ ID NO: 354469 - RNA, 64 nt, Homo Sapiens
auaguucaugcuuucagauauauaaauauauauauaaaaugaacuuuuguuguugcuauguaca

SEQ ID NO: 354470 - RNA, 64 nt, Homo Sapiens
acucuuuuuuaaaugugcuucacuacaauaaaacuaaaaugaaaagaaaauuaaaaauacuacu

SEQ ID NO: 354471 - RNA, 64 nt, Homo Sapiens
aauaguucagguggaagaaacuaaauuaaaaaguuaaaaugauuaaaugccacucucaugcauu

SEQ ID NO: 354472 - RNA, 64 nt, Homo Sapiens
uuuaaauggacucauagccugaugauguuaauaauaaaaugauugacacuuggcuacaugggaa

SEQ ID NO: 354473 - RNA, 64 nt, Homo Sapiens
auggaauuaaucagcaaaugaucugaguuuucaguaaaaugauugccauauuuuguuaguugac

SEQ ID NO: 354474 - RNA, 64 nt, Homo Sapiens
uaaaugggcuaggugaauuuaguuuccuuggcaauaaaaugagcgcugaaucuguuuggguucc

SEQ ID NO: 354475 - RNA, 64 nt, Homo Sapiens
aacuaacaaaaauuagucuugaccagguccucuauaaaaugaagaucuuuccaagaccaucaug

SEQ ID NO: 354476 - RNA, 64 nt, Homo Sapiens
uugccagaaagauauaaaacgaggaaggcuuugauaaaaugaaacuggaaucuaaauagucagu

SEQ ID NO: 354477 - RNA, 64 nt, Homo Sapiens
acauacuaccuaccucauguaguuucuuccucuguaaaaugaggaugugccuucucugagacuc

SEQ ID NO: 354478 - RNA, 64 nt, Homo Sapiens
uugcuugagccaagugcuuaaaaaguuaauaaaauaaaaugaucuguaugauaccugcaauuga

SEQ ID NO: 354479 - RNA, 64 nt, Homo Sapiens
acuuuguguuuuggcaaucguuuuauaacuaaaauaaaaugaaagcuaaaucuacacgcuguga

SEQ ID NO: 354480 - RNA, 64 nt, Homo Sapiens
uaaaauugugcauuuaaaguacaauuccuuauaauaaaaugaagugauauuugcauuuucugua

SEQ ID NO: 354481 - RNA, 64 nt, Homo Sapiens
ugauaaacuggaguacuacuccuaaauauguguguaaaaugagcuagauuuauacauucuguug

SEQ ID NO: 354482 - RNA, 64 nt, Homo Sapiens
gaaaggaacuuucuaauaaaagauauauaugcuguaaaaugaggaacuuuaucacauaugauag

SEQ ID NO: 354483 - RNA, 64 nt, Homo Sapiens
acaaaaaauaaaauauuuguaacucuaaagguuauaaaaugaaauugcccuaguugaauuaaga

SEQ ID NO: 354484 - RNA, 64 nt, Homo Sapiens
uuuuuaaaagauguaaacugcaagccuguaguauuaaaaugauuacauaucauuauuucauggu

SEQ ID NO: 354485 - RNA, 64 nt, Homo Sapiens
uguauuucaauaagcaguguugguagucuguuucuaaaaugaaaaguuuuuguauagacuucuu

SEQ ID NO: 354486 - RNA, 64 nt, Homo Sapiens
auagacauauuucuuuugcuuucuuaaaacagcuuaaaaugaugaacuuuuauaauuuuaauuu

SEQ ID NO: 354487 - RNA, 64 nt, Homo Sapiens
uuaguaaaggagugaauuaauaaaguaguaauaguaaaaugaaaggaacuugacuguacaguuu

SEQ ID NO: 354488 - RNA, 64 nt, Homo Sapiens
uuauguuuaaagagauucuguuauguaagaggcuuaaaaugauccaaaugaaaccagaaggugg

SEQ ID NO: 354489 - RNA, 64 nt, Homo Sapiens
acccagaagggcacaaggggcaggcuugaguuuuuaaaaugacuucuaccccuuuugaugaccc

SEQ ID NO: 354490 - RNA, 64 nt, Homo Sapiens
aacacuuuuuuguuuuuaaacaaauaaaauacauuaaaaugaauauauuuuagauauauugguu

SEQ ID NO: 354491 - RNA, 64 nt, Homo Sapiens
uauuuuaaaaaaaauuucugaauuauagccaguuuaaaaugaauaaagaucaaauuauccauga

SEQ ID NO: 354492 - RNA, 64 nt, Homo Sapiens
uaggccuugguacaugaugcuggauuaccucucuuaaaaugacacccuuccucgccuguuggug

SEQ ID NO: 354493 - RNA, 64 nt, Homo Sapiens
cauuuuuauuauuuugccauuggaagguuaacuuuaaaaugagcccuaucacugagaaauacgu

SEQ ID NO: 354494 - RNA, 64 nt, Homo Sapiens
uuuaauucuaauaaaccagcuguuauaaaaauuauaaaaugaucucuguuuuuccugucagaga

SEQ ID NO: 354495 - RNA, 64 nt, Homo Sapiens
uuaugcaaagcagcuuauauuccuuuguuucugauaaaaugaagacuuuaaaucagucaguagu

SEQ ID NO: 354496 - RNA, 64 nt, Homo Sapiens
agugaauacuuugaugauugccaacaguggcuaauaaaaugacggcuaccacacucauggguca

SEQ ID NO: 354497 - RNA, 63 nt, Homo Sapiens
auuuguccaacaacugucagaauaaagaacauucuaaaaugagaaguucacugucacucuugu

SEQ ID NO: 354498 - RNA, 64 nt, Homo Sapiens
auucaaauuuucuuuagugcuuaaaauuaaguuuuaaaaugaaaucagacacugcagguuugua

SEQ ID NO: 354499 - RNA, 64 nt, Homo Sapiens
uuuaaaaugaaaucagacacugcagguuuguauauaaaaugaaaagcuauacuacuuuuuacaa

SEQ ID NO: 354500 - RNA, 64 nt, Homo Sapiens
gaaugucuucaaucauauuuagcuacaccuuuaauaaaaugaaggagcauauucucuaguauau

SEQ ID NO: 354501 - RNA, 64 nt, Homo Sapiens
aaauugagguacaacucucuucuaacaaauacucuaaaaugauaugauuuuggagagauccuau

SEQ ID NO: 354502 - RNA, 64 nt, Homo Sapiens
gcuuuaaucagcauuguaaauuuauaaugaagauuaaaaugaaguuagggauuaauguccucca

SEQ ID NO: 354503 - RNA, 64 nt, Homo Sapiens
ugccaguccauuacacugaauauaugguuuuauuuaaaaugaaaaucucacauagagacaugcu

SEQ ID NO: 354504 - RNA, 64 nt, Homo Sapiens
cuauuauuuauauaacaugagauuuaguaacuuauaaaaugagguuuaguaauuuaauuuaaau

SEQ ID NO: 354505 - RNA, 64 nt, Homo Sapiens
aaguuaaauauuaagugugugacuuaugguuaaauaaaaugaaaauacaagacuuuuuuuuuug

SEQ ID NO: 354506 - RNA, 64 nt, Homo Sapiens
gauuaugugacugugagauuaugcuuguauuuaguaaaaugauuagcuguaugugaaugaaaau

SEQ ID NO: 354507 - RNA, 64 nt, Homo Sapiens
aacacagaccaaaaggucuguuaacagcuuucuguaaaaugagguaaaagguaccaauuagcuu

SEQ ID NO: 354508 - RNA, 64 nt, Homo Sapiens; identical to SEQ ID NO: 81945

SEQ ID NO: 354509 - RNA, 64 nt, Homo Sapiens; identical to SEQ ID NO: 81946

SEQ ID NO: 354510 - RNA, 64 nt, Homo Sapiens; identical to SEQ ID NO: 81947

SEQ ID NO: 354511 - RNA, 64 nt, Homo Sapiens; identical to SEQ ID NO: 81948

SEQ ID NO: 354512 - RNA, 64 nt, Homo Sapiens; identical to SEQ ID NO: 81949

SEQ ID NO: 354513 - RNA, 64 nt, Homo Sapiens; identical to SEQ ID NO: 81950

SEQ ID NO: 354514 - RNA, 64 nt, Homo Sapiens; identical to SEQ ID NO: 81951

SEQ ID NO: 354515 - RNA, 64 nt, Homo Sapiens; identical to SEQ ID NO: 81952

SEQ ID NO: 354516 - RNA, 64 nt, Homo Sapiens; identical to SEQ ID NO: 81953

SEQ ID NO: 354517 - RNA, 64 nt, Homo Sapiens; identical to SEQ ID NO: 81954

SEQ ID NO: 354518 - RNA, 64 nt, Homo Sapiens; identical to SEQ ID NO: 81955

SEQ ID NO: 354519 - RNA, 64 nt, Homo Sapiens; identical to SEQ ID NO: 81956

SEQ ID NO: 354520 - RNA, 64 nt, Homo Sapiens; identical to SEQ ID NO: 81957

SEQ ID NO: 354521 - RNA, 64 nt, Homo Sapiens; identical to SEQ ID NO: 81958

SEQ ID NO: 354522 - RNA, 64 nt, Homo Sapiens; identical to SEQ ID NO: 81959

SEQ ID NO: 354523 - RNA, 64 nt, Homo Sapiens; identical to SEQ ID NO: 81960

SEQ ID NO: 354524 - RNA, 64 nt, Homo Sapiens; identical to SEQ ID NO: 81961

SEQ ID NO: 354525 - RNA, 64 nt, Homo Sapiens; identical to SEQ ID NO: 81962

SEQ ID NO: 354526 - RNA, 64 nt, Homo Sapiens; identical to SEQ ID NO: 311206

SEQ ID NO: 354527 - RNA, 64 nt, Homo Sapiens; identical to SEQ ID NO: 311207

SEQ ID NO: 354528 - RNA, 64 nt, Homo Sapiens; identical to SEQ ID NO: 311208

SEQ ID NO: 354529 - RNA, 64 nt, Homo Sapiens; identical to SEQ ID NO: 311209

SEQ ID NO: 354530 - RNA, 64 nt, Homo Sapiens; identical to SEQ ID NO: 311210

SEQ ID NO: 354531 - RNA, 64 nt, Homo Sapiens; identical to SEQ ID NO: 311211

SEQ ID NO: 354532 - RNA, 64 nt, Homo Sapiens; identical to SEQ ID NO: 311212

SEQ ID NO: 354533 - RNA, 64 nt, Homo Sapiens; identical to SEQ ID NO: 311213

SEQ ID NO: 354534 - RNA, 64 nt, Homo Sapiens; identical to SEQ ID NO: 311214

SEQ ID NO: 354535 - RNA, 64 nt, Homo Sapiens; identical to SEQ ID NO: 311215

SEQ ID NO: 354536 - RNA, 64 nt, Homo Sapiens; identical to SEQ ID NO: 311216

SEQ ID NO: 354537 - RNA, 64 nt, Homo Sapiens; identical to SEQ ID NO: 311217

SEQ ID NO: 354538 - RNA, 59 nt, Homo Sapiens
aucaaaguauccaauauuuucauuuaaaguagucuuaaaguauuccauuagguucuuuu

SEQ ID NO: 354539 - RNA, 59 nt, Homo Sapiens
cugauuuuuuuuuucuucugacuuugagauagucuuauuggguuuagauccucuuuaau

SEQ ID NO: 354540 - RNA, 59 nt, Homo Sapiens
cugaauaagauuugaguaaugaaagucuguagucuuaaaacucuaaaacaguuguacug

SEQ ID NO: 354541 - RNA, 59 nt, Homo Sapiens
aaugcuaacucuugcaugucaagaaacauuagucuuaggaauucuucaaaaaauggcau

SEQ ID NO: 354542 - RNA, 59 nt, Homo Sapiens
cuccuugaaacacuugaacaccuuguuaauagucuuaccauugcucuacuaugcuaagu

SEQ ID NO: 354543 - RNA, 59 nt, Homo Sapiens
uuaucaacuccuuaaaugugugauucauauagucuuaaauuaauggaguguuaaaauuc

SEQ ID NO: 354544 - RNA, 59 nt, Homo Sapiens
uuaucuuccauucuauuuuuuuuugauauuagucuuaugacacaguaucaacauuagaa

SEQ ID NO: 354545 - RNA, 59 nt, Homo Sapiens
uaucuauuggccacgaugaacugaaaaguuagucuuaauauauaggagaaaucaguuug

SEQ ID NO: 354546 - RNA, 59 nt, Homo Sapiens
auuaaauuuauuauuuaagaugguagcacuagucuuaaauuguauaaaauauccccuaa

SEQ ID NO: 354547 - RNA, 59 nt, Homo Sapiens
auuaaauuuauuauuaaagauaguagcacuagucuuaaauuugauauaacaucuccuaa

SEQ ID NO: 354548 - RNA, 59 nt, Homo Sapiens
uagucugaaacauuuuuauucugcuuucuuagucuuaccuuuuagagauguaaaacauu

SEQ ID NO: 354549 - RNA, 59 nt, Homo Sapiens
guuuggggacauuauaaacuaugauuuucuagucuuaagcuauaggccuuuuucuuggg

SEQ ID NO: 354550 - RNA, 64 nt, Homo Sapiens; identical to SEQ ID NO: 43717

SEQ ID NO: 354551 - RNA, 64 nt, Homo Sapiens; identical to SEQ ID NO: 43718

SEQ ID NO: 354552 - RNA, 64 nt, Homo Sapiens; identical to SEQ ID NO: 43719

SEQ ID NO: 354553 - RNA, 64 nt, Homo Sapiens; identical to SEQ ID NO: 43720

SEQ ID NO: 354554 - RNA, 64 nt, Homo Sapiens; identical to SEQ ID NO: 43721

SEQ ID NO: 354555 - RNA, 64 nt, Homo Sapiens; identical to SEQ ID NO: 43722

SEQ ID NO: 354556 - RNA, 64 nt, Homo Sapiens; identical to SEQ ID NO: 43723

SEQ ID NO: 354557 - RNA, 64 nt, Homo Sapiens; identical to SEQ ID NO: 43724

SEQ ID NO: 354558 - RNA, 64 nt, Homo Sapiens; identical to SEQ ID NO: 43725

SEQ ID NO: 354559 - RNA, 64 nt, Homo Sapiens; identical to SEQ ID NO: 43726

SEQ ID NO: 354560 - RNA, 64 nt, Homo Sapiens; identical to SEQ ID NO: 43727

SEQ ID NO: 354561 - RNA, 64 nt, Homo Sapiens; identical to SEQ ID NO: 43728

SEQ ID NO: 354562 - RNA, 64 nt, Homo Sapiens; identical to SEQ ID NO: 43729

SEQ ID NO: 354563 - RNA, 64 nt, Homo Sapiens; identical to SEQ ID NO: 43730

SEQ ID NO: 354564 - RNA, 64 nt, Homo Sapiens; identical to SEQ ID NO: 43731

SEQ ID NO: 354565 - RNA, 64 nt, Homo Sapiens; identical to SEQ ID NO: 43732

SEQ ID NO: 354566 - RNA, 64 nt, Homo Sapiens; identical to SEQ ID NO: 43733

SEQ ID NO: 354567 - RNA, 64 nt, Homo Sapiens; identical to SEQ ID NO: 43734

SEQ ID NO: 354568 - RNA, 64 nt, Homo Sapiens; identical to SEQ ID NO: 43735

SEQ ID NO: 354569 - RNA, 64 nt, Homo Sapiens; identical to SEQ ID NO: 43736

SEQ ID NO: 354570 - RNA, 64 nt, Homo Sapiens; identical to SEQ ID NO: 43737

SEQ ID NO: 354571 - RNA, 64 nt, Homo Sapiens; identical to SEQ ID NO: 43738

SEQ ID NO: 354572 - RNA, 64 nt, Homo Sapiens; identical to SEQ ID NO: 43739

SEQ ID NO: 354573 - RNA, 64 nt, Homo Sapiens; identical to SEQ ID NO: 43740

SEQ ID NO: 354574 - RNA, 64 nt, Homo Sapiens; identical to SEQ ID NO: 43741

SEQ ID NO: 354575 - RNA, 64 nt, Homo Sapiens; identical to SEQ ID NO: 43742

SEQ ID NO: 354576 - RNA, 64 nt, Homo Sapiens; identical to SEQ ID NO: 43743

SEQ ID NO: 354577 - RNA, 64 nt, Homo Sapiens; identical to SEQ ID NO: 43744

SEQ ID NO: 354578 - RNA, 64 nt, Homo Sapiens; identical to SEQ ID NO: 43745

SEQ ID NO: 354579 - RNA, 64 nt, Homo Sapiens; identical to SEQ ID NO: 43746

SEQ ID NO: 354580 - RNA, 64 nt, Homo Sapiens; identical to SEQ ID NO: 44393

SEQ ID NO: 354581 - RNA, 64 nt, Homo Sapiens; identical to SEQ ID NO: 44394

SEQ ID NO: 354582 - RNA, 64 nt, Homo Sapiens; identical to SEQ ID NO: 44395

SEQ ID NO: 354583 - RNA, 64 nt, Homo Sapiens; identical to SEQ ID NO: 44396

SEQ ID NO: 354584 - RNA, 64 nt, Homo Sapiens; identical to SEQ ID NO: 44397

SEQ ID NO: 354585 - RNA, 64 nt, Homo Sapiens; identical to SEQ ID NO: 44398

SEQ ID NO: 354586 - RNA, 64 nt, Homo Sapiens
ugaggcaacagcagcaagggcuggucuggacaagaaaagccauagcccggcagccccuaccaug

SEQ ID NO: 354587 - RNA, 64 nt, Homo Sapiens
uuuaaauugaaauauaauagcugcaucagcccugaaaagccaaauucaaccacauggcuggaga

SEQ ID NO: 354588 - RNA, 64 nt, Homo Sapiens
guguaugcucucaaguuccaaaaugaauaaagacaaaagccaagaaaugaaugaauaaauaaau

SEQ ID NO: 354589 - RNA, 64 nt, Homo Sapiens
ggguuauagggguacacuuaagucuuucucugaaaaaagccaaagaaagggacaauuuggcuga

SEQ ID NO: 354590 - RNA, 64 nt, Homo Sapiens
ucuucaacaucugagucaccagcuauuauuaaagaaaagccaugaaagaauaaaaaguuugaau

SEQ ID NO: 354591 - RNA, 64 nt, Homo Sapiens
uucuuccaauccaagcccacuaccuccuaagaagaaaagccacuuugccaaagagcaucuaccu

SEQ ID NO: 354592 - RNA, 61 nt, Homo Sapiens
ugugggacucaaaugcaaacaaaguacagaaaaaagccacauccugaaaaacaucaaguag

SEQ ID NO: 354593 - RNA, 64 nt, Homo Sapiens
auguaaauuaccaguaaaguucucccagggccuuaaaagccaucucuuguuuccaaaaaccaug

SEQ ID NO: 354594 - RNA, 64 nt, Homo Sapiens
uuuaagauuuaauuugccaauuuaaauccuguugaaaagccaugaacucuagggauagucaccu

SEQ ID NO: 354595 - RNA, 64 nt, Homo Sapiens
aacaguucaucauuuggugcagauggcccaaaacaaaagccacaaauggaaaacacaaaacuua

SEQ ID NO: 354596 - RNA, 64 nt, Homo Sapiens
gugaaaaaaaguuagauuguucauuuauaaaagaaaaagccaaauugacuuuuaccacaaaucu

SEQ ID NO: 354597 - RNA, 64 nt, Homo Sapiens
gggaauuuugcagugacaggucaacgucaaugccaaaagccaaggaccaaaagacuaaaaucuu

SEQ ID NO: 354598 - RNA, 64 nt, Homo Sapiens
ggcgggagugguauguggcccugaauaaaagaggaaaagccaaacgagggugcagcccccgggu

SEQ ID NO: 354599 - RNA, 64 nt, Homo Sapiens
gaacuuucuuucacgguuacuguuccugaaaagaaaaagccaccuagcccuaucaagccaaaga

SEQ ID NO: 354600 - RNA, 64 nt, Homo Sapiens
ggaacuugaaguauaauauacuuaauauaacauaaaaagccaguuggguucuaaauuguaguug

SEQ ID NO: 354601 - RNA, 64 nt, Homo Sapiens
aaguaugccaguguaaugaaacugcccuuauuuuaaaagccagucaaagauuccacugauugac

SEQ ID NO: 354602 - RNA, 64 nt, Homo Sapiens
gccuauugaguauaucaaacgccacaucacaaaaaaaagccaguaaagccacaucacaaaaaaa

SEQ ID NO: 354603 - RNA, 64 nt, Homo Sapiens
ucacaaaaaaaagccagugcagccacaucacaaaaaaagccacaacuucuacaauaguguggaa

SEQ ID NO: 354604 - RNA, 64 nt, Homo Sapiens
gugacaagugacaaaaucuaaccauguuguggaaaaaagccagacauauuguaucuuuuuaaaa

SEQ ID NO: 354605 - RNA, 64 nt, Homo Sapiens
guauagugacucagaauccuuuuuaauguagucuaaaagccaaacacugaaaguguucaugugc

SEQ ID NO: 354606 - RNA, 64 nt, Homo Sapiens
gugcaaaaagacaacuaaaauacccauuuggaccaaaagccaccagauugcuuagugccugaca

SEQ ID NO: 354607 - RNA, 64 nt, Homo Sapiens
aauaaaggaggagauuuuauuuacagauuuuuuuaaaagccaccuggguugacaccuuccuacu

SEQ ID NO: 354608 - RNA, 64 nt, Homo Sapiens
caaaaaguguuugagguucuuugguuuuguuaguaaaagccaguucuguggugaugaccuaugg

SEQ ID NO: 354609 - RNA, 64 nt, Homo Sapiens
acuuuuacuaaacauaagguaauucauacuggagaaaagccauacaaaugagaagaauguggca

SEQ ID NO: 354610 - RNA, 64 nt, Homo Sapiens
cuucagaaagauuguacaaauacaaggaauguggaaaagccauuauuaucugcucagauuuuac

SEQ ID NO: 354611 - RNA, 64 nt, Homo Sapiens
gcaaaggaccuggcguggccaaaaaaaaaaaaaaaaaagccaggcuccguccccacccccugcc

SEQ ID NO: 354612 - RNA, 64 nt, Homo Sapiens
gcaggccgggcacaguggcuacauccuggacuuaaaaagccaggucuuaugggcaccacaggga

SEQ ID NO: 354613 - RNA, 64 nt, Homo Sapiens
uagggaggcacucaagaugaaaacuacuucaacuaaaagccaaccacuugaacaaggugaguga

SEQ ID NO: 354614 - RNA, 64 nt, Homo Sapiens
acacuauucucauugccaacguuaaaccuuauuuaaaagccaaacgugcccugagcccucuccu

SEQ ID NO: 354615 - RNA, 64 nt, Homo Sapiens
cacagcuauggaaccugagcacaucugacacccuaaaagccaucuguucccuccgucuccccag

SEQ ID NO: 354616 - RNA, 64 nt, Homo Sapiens
agccugaagauuggcccuguuaagaaaauguuccaaaagccauaaauucuguucucuauuaaau

SEQ ID NO: 354617 - RNA, 64 nt, Homo Sapiens
auuaccauugcuuccuccaggaagacaaaaccgaaaaagccaaaacaaaagcuuuucauuaucu

SEQ ID NO: 354618 - RNA, 64 nt, Homo Sapiens
ggagaaagcgcccuuccagggaaagacucacgagaaaagccaguguaaucuggccggccuggga

SEQ ID NO: 354619 - RNA, 64 nt, Homo Sapiens
ccugcaucuggggacacacuggacagcuuucuagaaaagccacaaaaccccuuugcaggugagg

SEQ ID NO: 354620 - RNA, 64 nt, Homo Sapiens
aguuaucucauguaccucugagugccuucuucccaaaagccagcaguaccauaccugcugucag

SEQ ID NO: 354621 - RNA, 64 nt, Homo Sapiens
aaguguguaauauaccauagugauaaauaugaccaaaagccauaaaugacugugagauguauga

SEQ ID NO: 354622 - RNA, 64 nt, Homo Sapiens
auguuuuacuuaaaauaucuuggcauaagcucaaaaaagccaggaucuuuauggaaaaauuuua

SEQ ID NO: 354623 - RNA, 64 nt, Homo Sapiens
uuaacauucuaaaggauuuaaauacuggaauuugaaaagccaaacugugaaaccauugggagaa

SEQ ID NO: 354624 - RNA, 64 nt, Homo Sapiens
ugaaguaaaaguauucaguaacuuuaaucucuaaaaaagccaagauuuuucuagguggauggcu

SEQ ID NO: 354625 - RNA, 64 nt, Homo Sapiens
auguacccuccgagaaagaaaucgaaaaaagaaaaaaagccaugcaguucaggaaagcuuaagc

SEQ ID NO: 354626 - RNA, 64 nt, Homo Sapiens; identical to SEQ ID NO: 133252

SEQ ID NO: 354627 - RNA, 64 nt, Homo Sapiens; identical to SEQ ID NO: 133253

SEQ ID NO: 354628 - RNA, 64 nt, Homo Sapiens; identical to SEQ ID NO: 133254

SEQ ID NO: 354629 - RNA, 64 nt, Homo Sapiens; identical to SEQ ID NO: 133255

SEQ ID NO: 354630 - RNA, 64 nt, Homo Sapiens; identical to SEQ ID NO: 133256

SEQ ID NO: 354631 - RNA, 64 nt, Homo Sapiens; identical to SEQ ID NO: 133257

SEQ ID NO: 354632 - RNA, 64 nt, Homo Sapiens; identical to SEQ ID NO: 133258

SEQ ID NO: 354633 - RNA, 64 nt, Homo Sapiens; identical to SEQ ID NO: 133259

SEQ ID NO: 354634 - RNA, 64 nt, Homo Sapiens; identical to SEQ ID NO: 133260

SEQ ID NO: 354635 - RNA, 64 nt, Homo Sapiens; identical to SEQ ID NO: 133261

SEQ ID NO: 354636 - RNA, 64 nt, Homo Sapiens; identical to SEQ ID NO: 133262

SEQ ID NO: 354637 - RNA, 57 nt, Homo Sapiens; identical to SEQ ID NO: 133263

SEQ ID NO: 354638 - RNA, 64 nt, Homo Sapiens; identical to SEQ ID NO: 133264

SEQ ID NO: 354639 - RNA, 64 nt, Homo Sapiens; identical to SEQ ID NO: 133265

SEQ ID NO: 354640 - RNA, 64 nt, Homo Sapiens; identical to SEQ ID NO: 133266

SEQ ID NO: 354641 - RNA, 64 nt, Homo Sapiens; identical to SEQ ID NO: 133267

SEQ ID NO: 354642 - RNA, 64 nt, Homo Sapiens; identical to SEQ ID NO: 133268

SEQ ID NO: 354643 - RNA, 64 nt, Homo Sapiens; identical to SEQ ID NO: 133269

SEQ ID NO: 354644 - RNA, 64 nt, Homo Sapiens; identical to SEQ ID NO: 133270

SEQ ID NO: 354645 - RNA, 64 nt, Homo Sapiens
cacauaccuucauguggcucuauuuccacugaacaaaaccuacgccuuccucucucuaccaguc

SEQ ID NO: 354646 - RNA, 64 nt, Homo Sapiens
cacauaccuucaugugguucuauuuccacugaacaaaaccuacaccuuccucucucuaccaguc

SEQ ID NO: 354647 - RNA, 64 nt, Homo Sapiens
cacguaccuucaugugauucagaagucacugaacaaaaccuacaucagcuggcugagacacuga

SEQ ID NO: 354648 - RNA, 64 nt, Homo Sapiens
uucauaugauauacauguuauuuauuucuucacuaaaaccuauuuuuuaaaaucaaacucaguu

SEQ ID NO: 354649 - RNA, 64 nt, Homo Sapiens
uaaauaugcuuuagaauuuuucucccuuacuguuaaaaccuaauagggcuguguuauauuaagu

SEQ ID NO: 354650 - RNA, 64 nt, Homo Sapiens
auacauuuggauaaacaacauugagauuaugaugaaaaccuacauauuccauguuuggaagacc

SEQ ID NO: 354651 - RNA, 64 nt, Homo Sapiens
uccagcguacuauaaugaaaacauccuuguuuugaaaaccuaaaagacaggcucuguauauaua

SEQ ID NO: 354652 - RNA, 64 nt, Homo Sapiens
cacuauagaagggaauaguaacaaauuguguaaaaaaaccuauguucucugaaauggguaaagg

SEQ ID NO: 354653 - RNA, 64 nt, Homo Sapiens
uaccugauuauugcacauuacauuuuuuaacugaaaaaccuaguuagcuuauauaaggucauua

SEQ ID NO: 354654 - RNA, 64 nt, Homo Sapiens
gauuguauauaguaagaaaagaucaaaagacuuuaaaaccuaaaugacuuuugacauacaaacu

SEQ ID NO: 354655 - RNA, 64 nt, Homo Sapiens
uaguaauuaugaauuuaagaccauauuauuaucaaaaaccuagagaccaaucauauaucugaaa

SEQ ID NO: 354656 - RNA, 64 nt, Homo Sapiens
caucucaagucuagugaagacagccaacagaaacaaaaccuagcauagggauagaaaauaccau

SEQ ID NO: 354657 - RNA, 64 nt, Homo Sapiens
gaaauaaaaaugcaugauuaaaaacuaagaauaaaaaaccuauuuuuauguuuccuaaaggaaa

SEQ ID NO: 354658 - RNA, 64 nt, Homo Sapiens
ucuccagaacaugagaugagcagcuuacaguuugaaaaccuagcccagagcaucuugaccuaau

SEQ ID NO: 354659 - RNA, 64 nt, Homo Sapiens
gagcuaaaggcuuugucugcacccucuccagcauaaaaccuaguugguuuuuaccccacccuca

SEQ ID NO: 354660 - RNA, 64 nt, Homo Sapiens
ucauguuaaaaaaaaaaauguauuucauaucuauaaaaccuauauagccauuuagcugaagccc

SEQ ID NO: 354661 - RNA, 64 nt, Homo Sapiens
ggcacaugccuguauuacugaaagcuaaauccucaaaaccuaguaaggggacuaaugauucauu

SEQ ID NO: 354662 - RNA, 64 nt, Homo Sapiens
gauuacuauaaacaccuguaugcacacaaacuagaaaaccuagaaaaaauuaauaaauuccuug

SEQ ID NO: 354663 - RNA, 64 nt, Homo Sapiens
aaaucaacucaagauggauuaaagacuuaaauauaaaaccuaaaaguauuaaauuccuagaaga

SEQ ID NO: 354664 - RNA, 64 nt, Homo Sapiens
ugaaaaccaaaauuauaggauuucuuuuuuaguaaaaaccuauaaaaccaaaauuauaggauuu

SEQ ID NO: 354665 - RNA, 64 nt, Homo Sapiens
uaaaaaccaaaauuauaggauuucuuuuuuaguaaaaaccuauaaaccaaaauuauaggauuuu

SEQ ID NO: 354666 - RNA, 64 nt, Homo Sapiens
uaaaaaccaaaauuauaggagccacuggugaguaaaaaccuauaaauauuucggggguaauaga

SEQ ID NO: 354667 - RNA, 61 nt, Homo Sapiens
aaggggggugacaaggucccguagaaccagggguguguaugggcacggggaagguuuugga

SEQ ID NO: 354668 - RNA, 61 nt, Homo Sapiens
agggucauacccccucccucgcuaguggagggguguguaacguaccccccaaccuccagga

SEQ ID NO: 354669 - RNA, 61 nt, Homo Sapiens
cugcuuuucucagccccaagccucuagucuggguguguacggagggucuagccugggugug

SEQ ID NO: 354670 - RNA, 61 nt, Homo Sapiens
uagucuggguguguacggagggucuagccuggguguguacggagggucuagccugggugag

SEQ ID NO: 354671 - RNA, 61 nt, Homo Sapiens
uagccugggugaguacggagggucuagccuggguguguauggaggaucuagccugggugag

SEQ ID NO: 354672 - RNA, 61 nt, Homo Sapiens
uagccugggugaguauggagggucuagccuggguguguauggagggucuagccugggugag

SEQ ID NO: 354673 - RNA, 61 nt, Homo Sapiens; identical to SEQ ID NO: 354672

SEQ ID NO: 354674 - RNA, 61 nt, Homo Sapiens
uagccugggugaguauggagggucuagccuggguguguacggagggucuagucugagugcg

SEQ ID NO: 354675 - RNA, 64 nt, Homo Sapiens; identical to SEQ ID NO: 71724

SEQ ID NO: 354676 - RNA, 64 nt, Homo Sapiens; identical to SEQ ID NO: 71725

SEQ ID NO: 354677 - RNA, 64 nt, Homo Sapiens; identical to SEQ ID NO: 71726

SEQ ID NO: 354678 - RNA, 64 nt, Homo Sapiens; identical to SEQ ID NO: 71727

SEQ ID NO: 354679 - RNA, 64 nt, Homo Sapiens; identical to SEQ ID NO: 71728

SEQ ID NO: 354680 - RNA, 64 nt, Homo Sapiens; identical to SEQ ID NO: 71729

SEQ ID NO: 354681 - RNA, 64 nt, Homo Sapiens; identical to SEQ ID NO: 71730

SEQ ID NO: 354682 - RNA, 64 nt, Homo Sapiens; identical to SEQ ID NO: 71731

SEQ ID NO: 354683 - RNA, 64 nt, Homo Sapiens; identical to SEQ ID NO: 71732

SEQ ID NO: 354684 - RNA, 64 nt, Homo Sapiens; identical to SEQ ID NO: 71733

SEQ ID NO: 354685 - RNA, 64 nt, Homo Sapiens; identical to SEQ ID NO: 71734

SEQ ID NO: 354686 - RNA, 64 nt, Homo Sapiens; identical to SEQ ID NO: 71735

SEQ ID NO: 354687 - RNA, 64 nt, Homo Sapiens; identical to SEQ ID NO: 71736

SEQ ID NO: 354688 - RNA, 64 nt, Homo Sapiens; identical to SEQ ID NO: 71737

SEQ ID NO: 354689 - RNA, 64 nt, Homo Sapiens; identical to SEQ ID NO: 71738

SEQ ID NO: 354690 - RNA, 64 nt, Homo Sapiens; identical to SEQ ID NO: 71739

SEQ ID NO: 354691 - RNA, 64 nt, Homo Sapiens; identical to SEQ ID NO: 71740

SEQ ID NO: 354692 - RNA, 64 nt, Homo Sapiens; identical to SEQ ID NO: 71741

SEQ ID NO: 354693 - RNA, 64 nt, Homo Sapiens; identical to SEQ ID NO: 71742

SEQ ID NO: 354694 - RNA, 64 nt, Homo Sapiens; identical to SEQ ID NO: 71743

SEQ ID NO: 354695 - RNA, 64 nt, Homo Sapiens; identical to SEQ ID NO: 71744

SEQ ID NO: 354696 - RNA, 64 nt, Homo Sapiens; identical to SEQ ID NO: 71745

SEQ ID NO: 354697 - RNA, 64 nt, Homo Sapiens; identical to SEQ ID NO: 71746

SEQ ID NO: 354698 - RNA, 64 nt, Homo Sapiens; identical to SEQ ID NO: 71747

SEQ ID NO: 354699 - RNA, 64 nt, Homo Sapiens; identical to SEQ ID NO: 71748

SEQ ID NO: 354700 - RNA, 64 nt, Homo Sapiens; identical to SEQ ID NO: 71749

SEQ ID NO: 354701 - RNA, 64 nt, Homo Sapiens; identical to SEQ ID NO: 71750

SEQ ID NO: 354702 - RNA, 64 nt, Homo Sapiens; identical to SEQ ID NO: 71751

SEQ ID NO: 354703 - RNA, 64 nt, Homo Sapiens; identical to SEQ ID NO: 71752

SEQ ID NO: 354704 - RNA, 64 nt, Homo Sapiens; identical to SEQ ID NO: 71753

SEQ ID NO: 354705 - RNA, 64 nt, Homo Sapiens; identical to SEQ ID NO: 282668

SEQ ID NO: 354706 - RNA, 64 nt, Homo Sapiens; identical to SEQ ID NO: 282669

SEQ ID NO: 354707 - RNA, 64 nt, Homo Sapiens; identical to SEQ ID NO: 282670

SEQ ID NO: 354708 - RNA, 64 nt, Homo Sapiens; identical to SEQ ID NO: 282671

SEQ ID NO: 354709 - RNA, 64 nt, Homo Sapiens; identical to SEQ ID NO: 282672

SEQ ID NO: 354710 - RNA, 64 nt, Homo Sapiens; identical to SEQ ID NO: 282673

SEQ ID NO: 354711 - RNA, 64 nt, Homo Sapiens; identical to SEQ ID NO: 282674

SEQ ID NO: 354712 - RNA, 64 nt, Homo Sapiens; identical to SEQ ID NO: 282675

SEQ ID NO: 354713 - RNA, 64 nt, Homo Sapiens; identical to SEQ ID NO: 282676

SEQ ID NO: 354714 - RNA, 64 nt, Homo Sapiens; identical to SEQ ID NO: 282677

SEQ ID NO: 354715 - RNA, 64 nt, Homo Sapiens; identical to SEQ ID NO: 282678

SEQ ID NO: 354716 - RNA, 64 nt, Homo Sapiens; identical to SEQ ID NO: 282679

SEQ ID NO: 354717 - RNA, 64 nt, Homo Sapiens
cucugagaggaaguacugaaagaugaauugacauacaacguauguuuccagugaagucaauuga

SEQ ID NO: 354718 - RNA, 64 nt, Homo Sapiens
auugauauuauugucuguuuggccugacuuggggacaacguauucucuaauucaguguuuugga

SEQ ID NO: 354719 - RNA, 64 nt, Homo Sapiens
agcagggguuuuuaggcacucuuuaaaugggaaaacaacguaggcccccuggcugaagagucug

SEQ ID NO: 354720 - RNA, 64 nt, Homo Sapiens
caaucauacuuaacaaaacuacugaugguuuaugacaacguaggguaacuacaguucauucugu

SEQ ID NO: 354721 - RNA, 64 nt, Homo Sapiens
auauuauaggaauuucuuuucuaucuuuaugaaaacaacguauauaaaauauaucuagaaaacc

SEQ ID NO: 354722 - RNA, 64 nt, Homo Sapiens
ugguuuuuaaugucugagcuagugauuugccucaacaacguaaacuuccuaaugauuagcacuu

SEQ ID NO: 354723 - RNA, 64 nt, Homo Sapiens
ccuuuguagugugaauaugauguuaaaauuaaaaacaacguauuauaugacacaccuuugaauu

SEQ ID NO: 354724 - RNA, 64 nt, Homo Sapiens
gggcaaaugaaaaccuuuccuacaguuccuaugaacaacguaccaacacuuucugauuucuucu

SEQ ID NO: 354725 - RNA, 64 nt, Homo Sapiens
auaaguauagacuaauuaaccuaagcuaccuuuaacaacguagaauuuagauggguucauauau

SEQ ID NO: 354726 - RNA, 64 nt, Homo Sapiens
ucacuggaauuuacucacgcaaucucaguagaguacaacguagauacagaaccuaggagaguca

SEQ ID NO: 354727 - RNA, 64 nt, Homo Sapiens
uuauuuagaaucacuuuaauguaacaugaaacacacaacguaagauauuaaauuacuggaucua

SEQ ID NO: 354728 - RNA, 64 nt, Homo Sapiens
ccuaauaccgaugaguuaaaucuugcaaguuaacacaacguaacacuuaaaagcauacauuuuc

SEQ ID NO: 354729 - RNA, 64 nt, Homo Sapiens
acccuggcuccccuuuccuuggaggcacugcaccacaacguaggauuguuuauacggaugacug

SEQ ID NO: 354730 - RNA, 64 nt, Homo Sapiens
ccuaauucugaaaguccucauauuuaaaggcuagacaacguaaugaaauuuuuaacuauuugua

SEQ ID NO: 354731 - RNA, 64 nt, Homo Sapiens
cugugauuucagguuuuuuccuuuuuuuacauuuacaacguaucaauaaacaguagugauuuaa

SEQ ID NO: 354732 - RNA, 64 nt, Homo Sapiens
agaaugggacauggccccaugcuuauuuuuguuuacaacguaacauggcaugagagagggcaga

SEQ ID NO: 354733 - RNA, 64 nt, Homo Sapiens
uacgugcagcacuacggccugggcagugccugugacaacguagagcgcgugcugaagagugugg

SEQ ID NO: 354734 - RNA, 64 nt, Homo Sapiens
gugcacguuggccucagauggacuacaggagauuacaacguacaaggcagauggagcauugacg

SEQ ID NO: 354735 - RNA, 64 nt, Homo Sapiens
uccuuccgccgccucgauacacgggacguugagcacaacguaucuccuggcuacaauuucaggu

SEQ ID NO: 354736 - RNA, 64 nt, Homo Sapiens
uaauuguaacauugcaguaaaaaugauucuaauaacaacguaugucauaaauuuauaacuuuag

SEQ ID NO: 354737 - RNA, 64 nt, Homo Sapiens
auuacuuguuuacauccaaccaucucauucuuguacaacguagaacucauuugcacuggacugu

SEQ ID NO: 354738 - RNA, 64 nt, Homo Sapiens
accagcauugugugugcagagcacucgcauugacacaacguaacagaacugggcuugcucagac

SEQ ID NO: 354739 - RNA, 64 nt, Homo Sapiens
uugguuuucauguguuuuuccugauguuccaaaaacaacguaaccgaugucacuacuuguuuuu

SEQ ID NO: 354740 - RNA, 64 nt, Homo Sapiens
uuaaggcaucuuuccucuugccccaaaggcagcaacaacguacucauauguacacagagccaug

SEQ ID NO: 354741 - RNA, 64 nt, Homo Sapiens
caaauaugugguccaucucuugcuccauucauacacaacguaauuuaacuuuuuguaggauacu

SEQ ID NO: 354742 - RNA, 64 nt, Homo Sapiens
agcuaauuaaggucacaaacuaaaaguaggaauaacaacguaaaugaaacugugugguguucgc

SEQ ID NO: 354743 - RNA, 64 nt, Homo Sapiens
aauaaaagcagucgaccgcauuuuuccaacacacacaacguaaauguagacugauguuuuagca

SEQ ID NO: 354744 - RNA, 64 nt, Homo Sapiens
ccuguuucuaaaaacaaaacaaacaaacaaacaaacaacguaucuuacugacuaaacuggaaug

SEQ ID NO: 354745 - RNA, 64 nt, Homo Sapiens
uucauuauuuguacauaaaauagaauuuauggguacaacguaugaagcuccuguuuuuggaaag

SEQ ID NO: 354746 - RNA, 64 nt, Homo Sapiens
ucacuguccagagaauugcuuuuguaaaugcuccacaacguaugggcaaaaguuuaaggacuac

SEQ ID NO: 354747 - RNA, 64 nt, Homo Sapiens
ggcccuuuccguggauuucauuuggggcaaagaaacaacguaguuuuguuuuuguuuucagccu

SEQ ID NO: 354748 - RNA, 64 nt, Homo Sapiens
ggcuggaaaguguccccugcacuaggagcugaaaacaacguagacugaguuguugggcugaaca

SEQ ID NO: 354749 - RNA, 64 nt, Homo Sapiens
uguuauacucaguguugauuucuucggucacuacacaacguaaaaucauuuguuucuuuugacu

SEQ ID NO: 354750 - RNA, 64 nt, Homo Sapiens
uuccuuuaaauguugauaucugccauuuguggaaacaacguaaauucuacuuaaguguaaacaa

SEQ ID NO: 354751 - RNA, 64 nt, Homo Sapiens
uaaaacauggcggguaccgacuaaguggaauaauacaacguaacacaagacuuuauauuuuaag

SEQ ID NO: 354752 - RNA, 64 nt, Homo Sapiens
gcacugaugcgauuuuuuguucuuuuauguuuauacaacguaucuauguuguguaggggaaauu

SEQ ID NO: 354753 - RNA, 64 nt, Homo Sapiens
gccuggccagaccaggugaccuuagauuuggugaacaacguacuauggaagccacaucacuauu

SEQ ID NO: 354754 - RNA, 64 nt, Homo Sapiens
auccugugauacuaagaucucagucauaugaauuacaacguaguauuuacuggcaagaaggaga

SEQ ID NO: 354755 - RNA, 64 nt, Homo Sapiens
uucaguguacaagucacugaacccauuguuucuuucugaagagacuuuccuuucaaggcuuccc

SEQ ID NO: 354756 - RNA, 64 nt, Homo Sapiens
caccucuggccugcgucgcccaguucuuuguggcucugaagaauuggccgcuguggaaaagagc

SEQ ID NO: 354757 - RNA, 64 nt, Homo Sapiens
cugcauagauuuucuuuuaaauugguucuuuguuucugaagaaagaauuuuuuuuaacuucaug

SEQ ID NO: 354758 - RNA, 64 nt, Homo Sapiens
uuuaacuucaugguuuuauuuauaauaauuuguuucugaagaaauuugccgagaguuacagguc

SEQ ID NO: 354759 - RNA, 64 nt, Homo Sapiens
aaauacguacuauaaagcuuuuguucacacacacucugaagaauccuguaagccccugaauuaa

SEQ ID NO: 354760 - RNA, 64 nt, Homo Sapiens
auggcuuuucuggucuucggcugcucaggguucaucugaagauucgaaugaaaagaaaugcaug

SEQ ID NO: 354761 - RNA, 64 nt, Homo Sapiens
ccuuuauauucucucaauaucagaacuccugaauucugaagauugcccuccucccauuaauagg

SEQ ID NO: 354762 - RNA, 64 nt, Homo Sapiens
agcaucugugaugccaucccaggaugugagugggucugaagauacauucccaaauaaacgaccu

SEQ ID NO: 354763 - RNA, 64 nt, Homo Sapiens
uauuauguucagaagccaaccaccagccccucccucugaagaaguaauuuaggcuucagcaucu

SEQ ID NO: 354764 - RNA, 64 nt, Homo Sapiens
ccaugucuuuuuaaaaucuauguauuuggaagccucugaagagaaugguuauagcggguggggu

SEQ ID NO: 354765 - RNA, 64 nt, Homo Sapiens
uucaguggcccagagguuauuuuuuuccuauugcucugaagacugcacugguugcugcaaagcu

SEQ ID NO: 354766 - RNA, 64 nt, Homo Sapiens
auuaauuuauuauuauaaugaccuaauuuauuaaucugaagauuaaccauuuuuuugucuuaga

SEQ ID NO: 354767 - RNA, 64 nt, Homo Sapiens
ggcuuucauacaaauagacuaaguggaaaauauaucugaagagggguauguguuacauauggcc

SEQ ID NO: 354768 - RNA, 64 nt, Homo Sapiens
cagccauuuuuaaaaagguuuuuuauuuucucugucugaagaacggguagaaauguauggugau

SEQ ID NO: 354769 - RNA, 64 nt, Homo Sapiens
ggucccugcucauggaugacuaugcuucuucgauucugaagacaaguguaagcauuaaggacau

SEQ ID NO: 354770 - RNA, 64 nt, Homo Sapiens
augugucccaagcuuuccuucagaaaaacuagaaucugaagaagaccaaccagcccgcucaaug

SEQ ID NO: 354771 - RNA, 64 nt, Homo Sapiens
ggggaaauaugaacuguauuuuaaauuuguuaggucugaagaaucuaaaacuguuaauuuaacc

SEQ ID NO: 354772 - RNA, 64 nt, Homo Sapiens
uaauacaaagcuguuaccuucuacagaauuuaagucugaagauguaaagagagaacaggccuug

SEQ ID NO: 354773 - RNA, 64 nt, Homo Sapiens
aggcucugggaucccaaauggacccuuuuaacuuucugaagaugggaccguccccuggaggaaa

SEQ ID NO: 354774 - RNA, 64 nt, Homo Sapiens
aacaaggaacacuaaaacaguguugauucuugucucugaagacaaauaauuaaaccuuuuuuuu

SEQ ID NO: 354775 - RNA, 64 nt, Homo Sapiens
gggggucaggacagggccugauuugagccuccucucugaagaugauuuggccgagcggaaggug

SEQ ID NO: 354776 - RNA, 64 nt, Homo Sapiens
ggacaggaggugcugaggcuggcugcaccugcucucugaagacgccuuccucucuagguucauu

SEQ ID NO: 354777 - RNA, 64 nt, Homo Sapiens
cuucggccugaaggcauuuuacacaccguccauuucugaagagguguucuuuuauaugcagcaa

SEQ ID NO: 354778 - RNA, 64 nt, Homo Sapiens
cugccucugcacacacaucaagaggcaaggagcuucugaagaaauggcucgagcagccuuggga

SEQ ID NO: 354779 - RNA, 64 nt, Homo Sapiens
aacauuuucuuucauuccaguggccuuagucaucucugaagaaauacuuacuugauuuuuuuuu

SEQ ID NO: 354780 - RNA, 64 nt, Homo Sapiens
uuccucgcccuccuccacccgagaugccagagucucugaagaagaagcuuggguuaacucagua

SEQ ID NO: 354781 - RNA, 64 nt, Homo Sapiens
aaucaaaccuaaccuuuuuguuuggggcaccaaaucugaagacaaaauuaauuugcaccaguaa

SEQ ID NO: 354782 - RNA, 64 nt, Homo Sapiens
gaaaaaagaacguauuuuuugugcuuugaagaucucugaagaauuucuuuuauaauagaauggg

SEQ ID NO: 354783 - RNA, 64 nt, Homo Sapiens
cgaauuuguugaaaagucccugaaagccauggguucugaagaggaagaaugagucagguggcac

SEQ ID NO: 354784 - RNA, 64 nt, Homo Sapiens
guuuugcggucaucagacuuccaaggucggcgcgucugaagagcaugcaucucuccaaaagcca

SEQ ID NO: 354785 - RNA, 64 nt, Homo Sapiens
agggucgugggcugggcgcgucaugacauaagcaucugaagaagggaauguguuugugaaugcc

SEQ ID NO: 354786 - RNA, 64 nt, Homo Sapiens
cacucucuguucaguuugacuuggcaaggaggacucugaagauguuccauugguggcagcagug

SEQ ID NO: 354787 - RNA, 64 nt, Homo Sapiens
cucaaaaagcccacccaacuuuuucggucagucuucugaagaauaacaguccuuauucagaaac

SEQ ID NO: 354788 - RNA, 64 nt, Homo Sapiens
cagaggcaacuucaugguuccauuuagagccaagucugaagaaugacugcugcuccuggaaacc

SEQ ID NO: 354789 - RNA, 64 nt, Homo Sapiens
gaggcaggagaauggcgugaguagucccagcuacucugaagacugggcgugguggcgggcgccu

SEQ ID NO: 354790 - RNA, 64 nt, Homo Sapiens
uggggcccuguagcugcagccccagaacgcuccuucugaagaaauuccaggggacgauggaaua

SEQ ID NO: 354791 - RNA, 64 nt, Homo Sapiens
ucucaguaugggguuucccucuggaaaaagaaaaucugaagacauuacaguugccuauugccuc

SEQ ID NO: 354792 - RNA, 64 nt, Homo Sapiens
uuccaguugcacaaauggguaacuaucaggaauaucugaagacauuggcuucuccacugcgaga

SEQ ID NO: 354793 - RNA, 64 nt, Homo Sapiens
uacaucuaauaaaguaacacguaucucuugccuaaaggacuauauuucaaauaauuuuuuaaau

SEQ ID NO: 354794 - RNA, 64 nt, Homo Sapiens
auauuauauaauucacuuugcucugcuguucuaaaaggacuauugguuugauuuuuggauacca

SEQ ID NO: 354795 - RNA, 64 nt, Homo Sapiens
uucugugucugcuguguauuuggugacacuucauaaggacuagucccuucugggguaucagagc

SEQ ID NO: 354796 - RNA, 64 nt, Homo Sapiens
gucaacuguggcaccuguaaccucccggaacaugaaggacuaugcucugaggcuauacucugug

SEQ ID NO: 354797 - RNA, 64 nt, Homo Sapiens
ggggugggguggggagaaaucacauaaccuuaaaaaggacuauauuaaucaccuucuuuguaau

SEQ ID NO: 354798 - RNA, 64 nt, Homo Sapiens
cuguagugaauccucuguuuagaacaccaaagauaaggacuagauacuacuuucucuuuuucgu

SEQ ID NO: 354799 - RNA, 64 nt, Homo Sapiens
uuaaauuacuaucauuuaugcacauaucaaugugaaggacuaauuaccuaaggacuaauuuaaa

SEQ ID NO: 354800 - RNA, 64 nt, Homo Sapiens
uuaaacacauaucaaugugagaaaaggcauaccuaaggacuaaugagcaacagaacaaaaggca

SEQ ID NO: 354801 - RNA, 64 nt, Homo Sapiens
uuuguacuguacccuaggggcccccucaggaaagaaggacuauaucauugucuuucucuccuag

SEQ ID NO: 354802 - RNA, 64 nt, Homo Sapiens
uccuauguaucagguuaagaagcauuuggaaaugaaggacuagcccaugcacuccacaaagggg

SEQ ID NO: 354803 - RNA, 58 nt, Homo Sapiens
aagccuccguggaacauucuggaucugacccucccagucucaucuccugacccuccca

SEQ ID NO: 354804 - RNA, 58 nt, Homo Sapiens
aucugacccucccagucucaucuccugacccucccacucccaucuccuuaccucugga

SEQ ID NO: 354805 - RNA, 58 nt, Homo Sapiens
uucaguauggguugagggucacagaccucccucccaucugggugccugaguuuugacu

SEQ ID NO: 354806 - RNA, 58 nt, Homo Sapiens
gaaaaaaguauaguaucgaguacccguucccucccagaggugggaguaacugcuggua

SEQ ID NO: 354807 - RNA, 58 nt, Homo Sapiens
gacagggcuucuccugcgggggcgaggccccucccaguaagggcguggcucugggugg

SEQ ID NO: 354808 - RNA, 58 nt, Homo Sapiens
gggacuucgcagaggcaagcgaccgaggcccucccaaagaggcccgcccugcccgggc

SEQ ID NO: 354809 - RNA, 58 nt, Homo Sapiens
ggcagcgaguccugccccgcccgcagcucccucccacaccccgccuggccaagaugac

SEQ ID NO: 354810 - RNA, 58 nt, Homo Sapiens
uuaguuuuuaaucaucaggacuaucucacccucccacuccuguuuuuaaaacucagaa

SEQ ID NO: 354811 - RNA, 58 nt, Homo Sapiens
ccucgccagggcucccuucucucugcuucccucccaggggcuugcucugucccuuccu

SEQ ID NO: 354812 - RNA, 58 nt, Homo Sapiens
cgcagcaccaagggcuugcucugcagaccccucccagcgggacuggacccagugcccu

SEQ ID NO: 354813 - RNA, 58 nt, Homo Sapiens
acuuucacucccucuccaaggaaugaggcccucccaaccuuaccacugaucuggccaa

SEQ ID NO: 354814 - RNA, 58 nt, Homo Sapiens
ugguacuaaaauuucagugucaaggaaucccucccaucuggaugcucaagauuacgug

SEQ ID NO: 354815 - RNA, 58 nt, Homo Sapiens
gaccgaccccuggcccaagcggaccuaccccucccaggcccagcucuaccccucccag

SEQ ID NO: 354816 - RNA, 58 nt, Homo Sapiens
gaccuaccccucccagggacagcucuaccccucccaggcacuggccaugcugcugccc

SEQ ID NO: 354817 - RNA, 58 nt, Homo Sapiens
ccucccuaccuuggacaggacccugacccccucccagccucagugcagcaagacugac

SEQ ID NO: 354818 - RNA, 58 nt, Homo Sapiens
ccacccccagauagagggaaauguggagcccucccaccggacaggugccgagcccugc

SEQ ID NO: 354819 - RNA, 58 nt, Homo Sapiens
gggcgugucccuccucuuccuguagugccccucccauggcccagcagcuuggcugagc

SEQ ID NO: 354820 - RNA, 58 nt, Homo Sapiens
cuucucccuccccucacccgcugcccagcccucccagcuggugucacucugccucuaa

SEQ ID NO: 354821 - RNA, 58 nt, Homo Sapiens
uguggaauuucuuucuucuccccuucuucccucccaaaagcuuagcuauguauaaagu

SEQ ID NO: 354822 - RNA, 58 nt, Homo Sapiens
guuuuggaggagggaguggaguaagaugcccucccacuuuuaucaguuuaguaguagu

SEQ ID NO: 354823 - RNA, 58 nt, Homo Sapiens
ugaucugacuggaaaacaauccuguauccccucccaaagaaucaugggcuuuuuuuuu

SEQ ID NO: 354824 - RNA, 58 nt, Homo Sapiens
uccaacuccaagcucccuccacaaguuucccucccaggccccccacaccccagugugg

SEQ ID NO: 354825 - RNA, 58 nt, Homo Sapiens
uugcuucucuucugguguugcuucuccucccucccauucucucugcaacucccugcgg

SEQ ID NO: 354826 - RNA, 58 nt, Homo Sapiens
ggugggccugggcucagcaaacagcccucccucccaguauuucaucaaggacagggaa

SEQ ID NO: 354827 - RNA, 58 nt, Homo Sapiens
ccaguauuucaucaaggacagggaauaucccucccacacacaggccagcugcucaccc

SEQ ID NO: 354828 - RNA, 58 nt, Homo Sapiens
caccugucuacccagagccagugacugucccucccagcagccuccaaaggguccaaag

SEQ ID NO: 354829 - RNA, 58 nt, Homo Sapiens
cucugggcugaggcuggucguccuggagcccucccaguaccucgggcugcaagagcug

SEQ ID NO: 354830 - RNA, 58 nt, Homo Sapiens
gucccucugugggagcccgggugccaggcccucccaacaccacaccacccuccaggcc

SEQ ID NO: 354831 - RNA, 58 nt, Homo Sapiens
gccuucccagagucaaccuccugugacgcccucccagagccaaccucgggugacaccc

SEQ ID NO: 354832 - RNA, 58 nt, Homo Sapiens
gcccucccagagccaaccucgggugacacccucccagagucaaccucaugugacaccu

SEQ ID NO: 354833 - RNA, 58 nt, Homo Sapiens
cccauacugguacugcuguaagccucaccccucccaccauacgccgccuucacuccac

SEQ ID NO: 354834 - RNA, 58 nt, Homo Sapiens
aacuucaacuccuccauggaccacucuccccucccacaggaguugacgacagggagua

SEQ ID NO: 354835 - RNA, 58 nt, Homo Sapiens
ccgucacuccuccccacugccgccccuccccucccacucucgucuccuuccccucgcc

SEQ ID NO: 354836 - RNA, 58 nt, Homo Sapiens
ugcaggcccucagcccgggcugugccagcccucccagccccaggcccaucugagggac

SEQ ID NO: 354837 - RNA, 58 nt, Homo Sapiens
uuuuccuuugucgccuccccagcaccugcccucccagucucccaccccggccccaggc

SEQ ID NO: 354838 - RNA, 58 nt, Homo Sapiens
aguagcacugauguguuuuguaaucugccccucccagcccuccguggaggcugccagg

SEQ ID NO: 354839 - RNA, 58 nt, Homo Sapiens
uuccucccaccucaccugucccccaccucccucccaccagggggguuucagggcugaa

SEQ ID NO: 354840 - RNA, 58 nt, Homo Sapiens
uggagccuguuacccguuaggcucuuggcccucccacccgggaggaguggcaucuggg

SEQ ID NO: 354841 - RNA, 58 nt, Homo Sapiens
aagcgaagccacucuuaccucucccuuccccucccaccugcccccugcguaggcaccc

SEQ ID NO: 354842 - RNA, 58 nt, Homo Sapiens
ccuuggucugucucgcuuuaucugucgccccucccagcgcugagagccuccccuggcu

SEQ ID NO: 354843 - RNA, 58 nt, Homo Sapiens
uucccauucauagaaucauaaauaaugccccucccaacaauggacagcugcuuuugac

SEQ ID NO: 354844 - RNA, 58 nt, Homo Sapiens
cucaucccugcuucuuugggcuuguccucccucccacaucgcuuacaccuaauauaag

SEQ ID NO: 354845 - RNA, 58 nt, Homo Sapiens
guccacuggcuccaggcuccagccuccucccucccagcccgguugccccccacucuaa

SEQ ID NO: 354846 - RNA, 58 nt, Homo Sapiens
gggcugcccaccaagcccugccagcucccccucccauaucagucccugugguccccca

SEQ ID NO: 354847 - RNA, 58 nt, Homo Sapiens
uccucagacccagcaaaagcuggcuccucccucccaugaauuguucuccagcauuuua

SEQ ID NO: 354848 - RNA, 58 nt, Homo Sapiens
agccagggcggagacugucucuuguugucccucccauugcccuguugucuggaggguu

SEQ ID NO: 354849 - RNA, 58 nt, Homo Sapiens
ccagcccggggcagucugacugucggugcccucccaggaacggggaaggccuccgucu

SEQ ID NO: 354850 - RNA, 58 nt, Homo Sapiens
acaggaaaccaaggucugaccuaggguucccucccagucuucacaucacucuggccuc

SEQ ID NO: 354851 - RNA, 58 nt, Homo Sapiens
acguggagagcuucaauuguugcucgcgcccucccagcuucucuucugccaacuaacg

SEQ ID NO: 354852 - RNA, 58 nt, Homo Sapiens
gcucucugcccugcgcguucguguugcccccucccacagaguuaccuggugagagacc

SEQ ID NO: 354853 - RNA, 58 nt, Homo Sapiens
gaaguuugugcuuaaaaaaccucccuuccccucccacuagggggugugggguuccguu

SEQ ID NO: 354854 - RNA, 58 nt, Homo Sapiens
gccaacccccaccccguuucuccuccagcccucccaauggucaggucugaggccagua

SEQ ID NO: 354855 - RNA, 58 nt, Homo Sapiens
ugggugugagcagcacccauccaccguccccucccagggagcaagggcagggacaggg

SEQ ID NO: 354856 - RNA, 58 nt, Homo Sapiens
agcugaaagaggccaaacaggcccuccucccucccagcuccaccccgcaagcaccauc

SEQ ID NO: 354857 - RNA, 58 nt, Homo Sapiens
aaauuccagagcuuugggggagaauccacccucccaucaucugcuucccccaaggccu

SEQ ID NO: 354858 - RNA, 58 nt, Homo Sapiens
agcuucccuccccuuccuccaaaacccucccucccaccuccccacacccauugaguca

SEQ ID NO: 354859 - RNA, 58 nt, Homo Sapiens
uuucaucccugcuucuggacuugggguacccucccaauugccacauccuaucuggucc

SEQ ID NO: 354860 - RNA, 58 nt, Homo Sapiens
aguccguggacauuucagagggagaucccccucccauuuaacuguccucacaggcccu

SEQ ID NO: 354861 - RNA, 58 nt, Homo Sapiens
auuccccuuuaagagcuuccacugcacccccucccaagggacacagcgguaggaaugg

SEQ ID NO: 354862 - RNA, 58 nt, Homo Sapiens
uugaggguugguccuguccccaccuccacccucccacccccuggaagaggaagggccc

SEQ ID NO: 354863 - RNA, 58 nt, Homo Sapiens
ccccaugauucaauuaccucccccgggucccucccacaacacaugggaauucugagag

SEQ ID NO: 354864 - RNA, 58 nt, Homo Sapiens
ccccugauucgaugaccucccccugggucccucccacaacaugugggaauuccagaag

SEQ ID NO: 354865 - RNA, 58 nt, Homo Sapiens
acccagccgccgccguugagcaccacuccccucccaagcugaggagcccuuacccucc

SEQ ID NO: 354866 - RNA, 58 nt, Homo Sapiens
acuccccucccaagacccagagcccuuacccucccaccguccagggagggagcugagg

SEQ ID NO: 354867 - RNA, 58 nt, Homo Sapiens
gagaggcugaaggaauggaaccuuuauucccucccaggaguuuaauagagacuuccug

SEQ ID NO: 354868 - RNA, 58 nt, Homo Sapiens
caccagacacagggcacggucugggccacccucccaggucagugggacaagauggaca

SEQ ID NO: 354869 - RNA, 58 nt, Homo Sapiens
gauugugauacauacuaaaguuaacaagcccucccaguagugggcccagccaccuauu

SEQ ID NO: 354870 - RNA, 58 nt, Homo Sapiens
uguaggagauuagugaggcaucaaagcucccucccaucggauccucaugugccucucc

SEQ ID NO: 354871 - RNA, 58 nt, Homo Sapiens
agacugggucucagagccgugccacccacccucccacacagccggccacagggagaac

SEQ ID NO: 354872 - RNA, 58 nt, Homo Sapiens
acgcagcucaauaagggugagggucacucccucccagaagccccgucuggacgagccu

SEQ ID NO: 354873 - RNA, 58 nt, Homo Sapiens
gggcacccuccugggagcaggccuuccucccucccacccccaauguccuguugguagg

SEQ ID NO: 354874 - RNA, 58 nt, Homo Sapiens
cacccuaccugcccugccugccugcugccccucccagccugccaagaaaacgguaggg

SEQ ID NO: 354875 - RNA, 58 nt, Homo Sapiens
ucgugccuucauucugcagcggcauggucccucccauucuggcuccaccugcagccuc

SEQ ID NO: 354876 - RNA, 58 nt, Homo Sapiens
ccucugugggcccuugucggcuuagcuccccucccaggaugccaccggaaccccagcc

SEQ ID NO: 354877 - RNA, 58 nt, Homo Sapiens
gaggcugugcacagacugucacugcagacccucccaggcgggaccgugggccgaggug

SEQ ID NO: 354878 - RNA, 58 nt, Homo Sapiens
caucagagcccacucaggacgaccugggcccucccaccgggccugggugggcaggcag

SEQ ID NO: 354879 - RNA, 58 nt, Homo Sapiens
ccgucucagcccugugcuccgucaccuucccucccaccccuucauaaaggccucccuu

SEQ ID NO: 354880 - RNA, 58 nt, Homo Sapiens
gcuugaggcucccuauacuucuugcucucccucccaggagcccuagggaaaggcugcu

SEQ ID NO: 354881 - RNA, 58 nt, Homo Sapiens
aguccagccaggggcugccucugcccugcccucccaggggccuccaggaguauggguc

SEQ ID NO: 354882 - RNA, 58 nt, Homo Sapiens
ucccaccugauaugcagugcagucccuacccucccaccuuuacuuugucccagguugg

SEQ ID NO: 354883 - RNA, 58 nt, Homo Sapiens
cugggguuggggaggagcaggggccacccccucccacccagcugcuuccugcucagcu

SEQ ID NO: 354884 - RNA, 58 nt, Homo Sapiens
guagugccuugugggguauccaggaacacccucccagcaggggaugggaacccugucc

SEQ ID NO: 354885 - RNA, 58 nt, Homo Sapiens
uccuggccucgaccccuaagggcuucgccccucccaggggccuguaacuaagucgggu

SEQ ID NO: 354886 - RNA, 58 nt, Homo Sapiens
cagggagggcuuggggcugcaccuccuacccucccaccagaacgcaccccacugggag

SEQ ID NO: 354887 - RNA, 58 nt, Homo Sapiens
gcaccuaugagauggccaugcucaaccccccucccagacaggcccucccugucuccag

SEQ ID NO: 354888 - RNA, 58 nt, Homo Sapiens
cccugcuuagccagcuucuguguguccgcccucccagcuccagcccugcaggccgucu

SEQ ID NO: 354889 - RNA, 58 nt, Homo Sapiens
cccaguguaaaaaugucccaaguguagccccucccaccgcagagccuguuucuaacgu

SEQ ID NO: 354890 - RNA, 58 nt, Homo Sapiens
uaacagagaaaagggagcccgaggcuggcccucccagauuugggcugauguaagacua

SEQ ID NO: 354891 - RNA, 58 nt, Homo Sapiens
caaagcuucuaaaacugggggcagccuccccucccaagugagcugauggugucaucca

SEQ ID NO: 354892 - RNA, 58 nt, Homo Sapiens
agucaccuccacugcacaacuggcuguccccucccaccauccaaguuccuagaccuca

SEQ ID NO: 354893 - RNA, 58 nt, Homo Sapiens
agccauguccauccagcccugacacccccccucccaaacacccccgagcccccuugga

SEQ ID NO: 354894 - RNA, 58 nt, Homo Sapiens
caacuccccaccuccagccgcccugaaccccucccauuucuccccguacugaccucaa

SEQ ID NO: 354895 - RNA, 58 nt, Homo Sapiens
ggagcagcuccagagccauucagccccucccucccacucccccauuauucuuucuguc

SEQ ID NO: 354896 - RNA, 58 nt, Homo Sapiens
acuaucuugggagggagaaggccugggucccucccacugaguccggggggaaccaaga

SEQ ID NO: 354897 - RNA, 58 nt, Homo Sapiens
ugagacuggucuuugggaggccaucagccccucccacucucucuucuagggcuuccca

SEQ ID NO: 354898 - RNA, 58 nt, Homo Sapiens
ucuugggcagggcucuuuucgucccagccccucccauuaggcugggaaaaacuaagcu

SEQ ID NO: 354899 - RNA, 58 nt, Homo Sapiens
uaggcugcacuggggccgaaccaucccucccucccaaugaagcccagccagccucuac

SEQ ID NO: 354900 - RNA, 58 nt, Homo Sapiens
aacaaaugaauccagcgugggcugcccucccucccacagaugggacugucaaaguugu

SEQ ID NO: 354901 - RNA, 58 nt, Homo Sapiens
accuccucuucugacgugccuuuugcaccccucccauuaggacaaucaguccccuccc

SEQ ID NO: 354902 - RNA, 58 nt, Homo Sapiens
ugcaccccucccauuaggacaaucaguccccucccaucugggaguccccuuuucuuuu

SEQ ID NO: 354903 - RNA, 58 nt, Homo Sapiens
cuuuccccuccaaccaguucaaucucaucccucccagcagcuccccuuccaccccccg

SEQ ID NO: 354904 - RNA, 58 nt, Homo Sapiens
ugccccugcccguccccacccagucuugcccucccauccucucaucuauucccccgcu

SEQ ID NO: 354905 - RNA, 58 nt, Homo Sapiens
cagcccugccuccgcccucaccuacaugcccucccagccccucccaucucuggacgag

SEQ ID NO: 354906 - RNA, 58 nt, Homo Sapiens
uccgcccucaccuacaugcccucccagccccucccaucucuggacgaggccuccuucc

SEQ ID NO: 354907 - RNA, 58 nt, Homo Sapiens
acugugcugagagcuuuccucgcagaggcccucccaacgaacagcucucucagaagca

SEQ ID NO: 354908 - RNA, 58 nt, Homo Sapiens
cucucucuccuaccugccucccugcagucccucccauggaugacucaggccucccaga

SEQ ID NO: 354909 - RNA, 58 nt, Homo Sapiens
cuuggcaaugucugugccaccuccugagcccucccagcauguccucacaugcucaugc

SEQ ID NO: 354910 - RNA, 58 nt, Homo Sapiens
uaagcacacagggguuaaagcugugugucccucccaguggcuguggcagugacaguga

SEQ ID NO: 354911 - RNA, 58 nt, Homo Sapiens
cuuccugccuccugccccaaugaucacacccucccaucaacgugugugugugugucgg

SEQ ID NO: 354912 - RNA, 58 nt, Homo Sapiens
ggcuggcccaggaccgugggcagugccccccucccaugucagcucugggaggcaggcg

SEQ ID NO: 354913 - RNA, 58 nt, Homo Sapiens
cccccaaucuaccuggugauuuacccuccccucccacaucagcccccgaccuuauuua

SEQ ID NO: 354914 - RNA, 58 nt, Homo Sapiens
cguccuggggaugcucagggagaccuggcccucccagcaggcacuucugcaucacgga

SEQ ID NO: 354915 - RNA, 58 nt, Homo Sapiens
ccguuaccuaacuguacguccacagucccccucccacuuauauauauauacacaaaug

SEQ ID NO: 354916 - RNA, 58 nt, Homo Sapiens
caugaauccuuacucagcuacaggacagcccucccagcucucuccaagugugccaggc

SEQ ID NO: 354917 - RNA, 58 nt, Homo Sapiens
caccugcacccuagcuucgugggcaggacccucccacagguggggaauggcuggggcu

SEQ ID NO: 354918 - RNA, 58 nt, Homo Sapiens
cuuaguguucccucccucaauugcugugcccucccaggaggacagaaaaagcuggguc

SEQ ID NO: 354919 - RNA, 58 nt, Homo Sapiens
cccugccuuggcaccgucaccgcggcuucccucccagugugcaggcagggcugggaca

SEQ ID NO: 354920 - RNA, 58 nt, Homo Sapiens
uuccacauauguaagucucugggcggcgcccucccagcucccugccucuguuucccca

SEQ ID NO: 354921 - RNA, 58 nt, Homo Sapiens
aacucaagguacgcccacugcaaggccucccucccaccgcggccccugccuggccacc

SEQ ID NO: 354922 - RNA, 58 nt, Homo Sapiens
cccagccucccgcggggccacacacuuccccucccaacacacacacacaccugccauc

SEQ ID NO: 354923 - RNA, 58 nt, Homo Sapiens
ugaggggggccccagggguucucaggaccccucccaccaccucccagugcuuccacgu

SEQ ID NO: 354924 - RNA, 58 nt, Homo Sapiens
cugagcacagauguucccccaucucgcucccucccaggacucugaccccagcauucuc

SEQ ID NO: 354925 - RNA, 58 nt, Homo Sapiens
ugccacccacaucuuccauuuccauguccccucccagagcugguggacccagggaaca

SEQ ID NO: 354926 - RNA, 58 nt, Homo Sapiens
ccgcaguauuucagggacagcucguguucccucccagcgaggggcacaggacccugcc

SEQ ID NO: 354927 - RNA, 50 nt, Homo Sapiens; identical to SEQ ID NO: 58436

SEQ ID NO: 354928 - RNA, 58 nt, Homo Sapiens
uucuaggcgaauaguccccauuccaucccccucccaccuccccacacuucacagcauc

SEQ ID NO: 354929 - RNA, 58 nt, Homo Sapiens
ccuguggggaaacuguucccuggccacccccucccagcccccucaccccaccucugca

SEQ ID NO: 354930 - RNA, 58 nt, Homo Sapiens
ccguuccacuccucccugccucccgcagcccucccaugccugaccccccugccgugcc

SEQ ID NO: 354931 - RNA, 58 nt, Homo Sapiens
ucccuuccuggccuggccggcucgagaccccucccauggagaagcccagccccucccc

SEQ ID NO: 354932 - RNA, 58 nt, Homo Sapiens
cccccuugcccaggccucccagggggugcccucccagagggauggcuuggggggcucc

SEQ ID NO: 354933 - RNA, 58 nt, Homo Sapiens
cccuccccgggcagcagagacccgccugcccucccaccagcacaaggcgugagcccac

SEQ ID NO: 354934 - RNA, 58 nt, Homo Sapiens
uccccccauuccucaaauccacucccaccccucccaugccucccucccuccuuccucu

SEQ ID NO: 354935 - RNA, 58 nt, Homo Sapiens
ccacuucugccuguuuuaaaccccucagcccucccagccuuuccccacagccccccag

SEQ ID NO: 354936 - RNA, 58 nt, Homo Sapiens
gcacuggagucugaggccugggaccccccccucccacccccuaacccauguuucucau

SEQ ID NO: 354937 - RNA, 58 nt, Homo Sapiens
aagcugggggcccaucgccguggggagucccucccaccacccucgccgcaggcagcug

SEQ ID NO: 354938 - RNA, 58 nt, Homo Sapiens
aauggcccagaccccagccuccccuccucccucccauccucacccaggccaaggccca

SEQ ID NO: 354939 - RNA, 58 nt, Homo Sapiens
cccacaagccuggucaucagccaggcagcccucccagugcccaagggccaccaacccc

SEQ ID NO: 354940 - RNA, 58 nt, Homo Sapiens
cuccuuaccuuggucuuuucgauaccuucccucccagguuaguucaguuuaaaauguu

SEQ ID NO: 354941 - RNA, 58 nt, Homo Sapiens
uuuaguuccucaucacaaaauuuuucuccccucccaaaauauuucauggacaaauuuu

SEQ ID NO: 354942 - RNA, 58 nt, Homo Sapiens
guccaccaagggcuccugcucugguauccccucccaggagugccucacucaccuggga

SEQ ID NO: 354943 - RNA, 58 nt, Homo Sapiens
ucccuguguauaaauauuuauggcccuccccucccaccgggcgcagcaacgcaucgug

SEQ ID NO: 354944 - RNA, 58 nt, Homo Sapiens
gccuggcagccauccagaggcugcccuucccucccacaagcccaaucagggucucgug

SEQ ID NO: 354945 - RNA, 58 nt, Homo Sapiens
agcuggccgcccagcaggagaaucccuucccucccagacaggaugaggaagacaggcc

SEQ ID NO: 354946 - RNA, 58 nt, Homo Sapiens
auggccccaccugcucuuucucuuuccucccucccagucgaggugugaccccaccugc

SEQ ID NO: 354947 - RNA, 58 nt, Homo Sapiens
agucugcacggcccaucugcuucaccuucccucccagccacgugccaguggccacagc

SEQ ID NO: 354948 - RNA, 58 nt, Homo Sapiens
ccugggggccagccagggcccuuugugccccucccagcacaggccugaugcagguguc

SEQ ID NO: 354949 - RNA, 58 nt, Homo Sapiens
caugugagcaccccaugaagggaccgcccccucccaaggauggucccuuugggugcag

SEQ ID NO: 354950 - RNA, 58 nt, Homo Sapiens
ucuguccuagccccucccuaaucccuggcccucccagcugucugggacuucaguggac

SEQ ID NO: 354951 - RNA, 58 nt, Homo Sapiens
gaagggacuacucucuucacaaggggcucccucccagauuggccugaguaaacuugga

SEQ ID NO: 354952 - RNA, 58 nt, Homo Sapiens
augggccagagcuucagcccgaaugugucccucccaccgggggcucagcugcuucagg

SEQ ID NO: 354953 - RNA, 58 nt, Homo Sapiens
ccugaccucaagagauccacucgccuugcccucccaaagugcugggauuacaggcuug

SEQ ID NO: 354954 - RNA, 58 nt, Homo Sapiens
aaacuauagccauauccaaaucuuuucccccucccaagaguucucagugucuacaugu

SEQ ID NO: 354955 - RNA, 58 nt, Homo Sapiens
ccaacucucgcguguuggagagaaggggcccucccagcacaaaguugcauuccucccc

SEQ ID NO: 354956 - RNA, 58 nt, Homo Sapiens
ugagggcugucgagugagcugccccagccccucccagcccuugcccagccugggggag

SEQ ID NO: 354957 - RNA, 58 nt, Homo Sapiens
gcugugcguuccugagggcccagcuccgcccucccaagaaggcggagcugaggacagc

SEQ ID NO: 354958 - RNA, 58 nt, Homo Sapiens
ccgucccagcauucgcacuugggcccaccccucccaccugcuucaggaacacccgcca

SEQ ID NO: 354959 - RNA, 55 nt, Homo Sapiens; identical to SEQ ID NO: 113265

SEQ ID NO: 354960 - RNA, 64 nt, Homo Sapiens; identical to SEQ ID NO: 113266

SEQ ID NO: 354961 - RNA, 64 nt, Homo Sapiens; identical to SEQ ID NO: 113267

SEQ ID NO: 354962 - RNA, 64 nt, Homo Sapiens; identical to SEQ ID NO: 113268

SEQ ID NO: 354963 - RNA, 64 nt, Homo Sapiens; identical to SEQ ID NO: 113269

SEQ ID NO: 354964 - RNA, 64 nt, Homo Sapiens; identical to SEQ ID NO: 113270

SEQ ID NO: 354965 - RNA, 64 nt, Homo Sapiens; identical to SEQ ID NO: 113271

SEQ ID NO: 354966 - RNA, 64 nt, Homo Sapiens; identical to SEQ ID NO: 113272

SEQ ID NO: 354967 - RNA, 64 nt, Homo Sapiens; identical to SEQ ID NO: 113273

SEQ ID NO: 354968 - RNA, 64 nt, Homo Sapiens; identical to SEQ ID NO: 113274

SEQ ID NO: 354969 - RNA, 64 nt, Homo Sapiens; identical to SEQ ID NO: 113275

SEQ ID NO: 354970 - RNA, 64 nt, Homo Sapiens; identical to SEQ ID NO: 113276

SEQ ID NO: 354971 - RNA, 64 nt, Homo Sapiens; identical to SEQ ID NO: 113277

SEQ ID NO: 354972 - RNA, 64 nt, Homo Sapiens; identical to SEQ ID NO: 113278

SEQ ID NO: 354973 - RNA, 64 nt, Homo Sapiens
uggcauuucaguuaaaagaaugugaaaaaacccugggcugaaguuaagucauuuuuaguuuggu

SEQ ID NO: 354974 - RNA, 64 nt, Homo Sapiens
uagugacuguuugauuuuaaggguguggaggugugggcugaagggccauuggggaggcagaugc

SEQ ID NO: 354975 - RNA, 64 nt, Homo Sapiens
uucucuuuaggcggaaaugcgggaggaggccacugggcugaauuccauugggugcauagagaug

SEQ ID NO: 354976 - RNA, 64 nt, Homo Sapiens
gucuccacgucucuuuguguccuggugaugauaugggcugaaauuuugucuggguauagucacu

SEQ ID NO: 354977 - RNA, 64 nt, Homo Sapiens
ugggccuugaaggauggaugcuuaugagggggcagggcugaagcaugaacagucagaaaaauac

SEQ ID NO: 354978 - RNA, 56 nt, Homo Sapiens
cucccucuggaaacugaguugcugcugggcugaauugcuaugaaauugugaucuag

SEQ ID NO: 354979 - RNA, 64 nt, Homo Sapiens
guccuuugcccgguggugggaggauggagggauugggcugaagcugcuccaccucauccuugcu

SEQ ID NO: 354980 - RNA, 64 nt, Homo Sapiens
aaagcuccccgggcgucagaguugagcccugccugggcugaaggacugucuucacgaagucagu

SEQ ID NO: 354981 - RNA, 64 nt, Homo Sapiens
gcugugaccaaaacucccuucagggggagagccugggcugaacaggccaaggacaucaucuagg

SEQ ID NO: 354982 - RNA, 64 nt, Homo Sapiens
cagguggcuucugccacccuaagacggugagacagggcugaaaugcgugauguuccuuagccca

SEQ ID NO: 354983 - RNA, 64 nt, Homo Sapiens
agagaaugaggaagcaaagagugagaaagaauaggggcugaagacgccacucccagauggcucu

SEQ ID NO: 354984 - RNA, 64 nt, Homo Sapiens
cacuuuccacucccugcuuaggauucuguucccugggcugaaacugaaauaagcuaauuuuuug

SEQ ID NO: 354985 - RNA, 64 nt, Homo Sapiens
ggggccucuggagcaggccuggcuuuuaaauggggggcugaauuccagcucacacacaccucaa

SEQ ID NO: 354986 - RNA, 64 nt, Homo Sapiens
aucaccuggggagauuuguaagcuucugcugucugggcugaacccccagagguucggauugaau

SEQ ID NO: 354987 - RNA, 64 nt, Homo Sapiens
ccaugccaugaagacaccaaggcagcccuauugagaaaucuaccugucguggccgggcgcagug

SEQ ID NO: 354988 - RNA, 64 nt, Homo Sapiens
aaaaaaaaaaaaaagaaagaaagaaagaaagaaagaaaucuaccugucaaggaacuaagguauu

SEQ ID NO: 354989 - RNA, 64 nt, Homo Sapiens
uuuucuuagaacauguggaaaccaugccuggccagaaaucuaugugggauuacaggcgugagcc

SEQ ID NO: 354990 - RNA, 64 nt, Homo Sapiens
uuuucuuuucccuuuuuuuucacuuuggacaauggaaaucuacaaagacccauccucccgcugu

SEQ ID NO: 354991 - RNA, 64 nt, Homo Sapiens
gguucaaagauuuuuuuuucuuuuucucauauaagaaaucuagguguaaauauugaguacagaa

SEQ ID NO: 354992 - RNA, 64 nt, Homo Sapiens
cuuuacgagagggucucacccaaauuuauggggagaaaucuauuucucaaaaaaaaaaaucuuc

SEQ ID NO: 354993 - RNA, 64 nt, Homo Sapiens
auucucuauauaggacuucuuaaaauuuagaagggaaaucuagcuacuucaaauugucuguuaa

SEQ ID NO: 354994 - RNA, 64 nt, Homo Sapiens
aacuuuauaauuacuuuaauauuuuugauaacuagaaaucuaguauugccauaaaggaaacuaa

SEQ ID NO: 354995 - RNA, 64 nt, Homo Sapiens
agcacuuguuuucaggacaacacuucauuuucaggaaaucuacuuccuacagagccaaaaugcc

SEQ ID NO: 354996 - RNA, 64 nt, Homo Sapiens
ugaugaacucaccuaauuaugaggugggaggagcgaaaucuaaauuucuuuugcuauaguuaua

SEQ ID NO: 354997 - RNA, 64 nt, Homo Sapiens; identical to SEQ ID NO: 119910

SEQ ID NO: 354998 - RNA, 64 nt, Homo Sapiens; identical to SEQ ID NO: 119911

SEQ ID NO: 354999 - RNA, 64 nt, Homo Sapiens; identical to SEQ ID NO: 119912

SEQ ID NO: 355000 - RNA, 64 nt, Homo Sapiens; identical to SEQ ID NO: 119913

SEQ ID NO: 355001 - RNA, 64 nt, Homo Sapiens; identical to SEQ ID NO: 119914

SEQ ID NO: 355002 - RNA, 64 nt, Homo Sapiens; identical to SEQ ID NO: 119915

SEQ ID NO: 355003 - RNA, 64 nt, Homo Sapiens; identical to SEQ ID NO: 119916

SEQ ID NO: 355004 - RNA, 64 nt, Homo Sapiens; identical to SEQ ID NO: 119917

SEQ ID NO: 355005 - RNA, 64 nt, Homo Sapiens; identical to SEQ ID NO: 119918

SEQ ID NO: 355006 - RNA, 64 nt, Homo Sapiens; identical to SEQ ID NO: 119919

SEQ ID NO: 355007 - RNA, 64 nt, Homo Sapiens; identical to SEQ ID NO: 119920

SEQ ID NO: 355008 - RNA, 64 nt, Homo Sapiens; identical to SEQ ID NO: 119921

SEQ ID NO: 355009 - RNA, 64 nt, Homo Sapiens; identical to SEQ ID NO: 119922

SEQ ID NO: 355010 - RNA, 64 nt, Homo Sapiens; identical to SEQ ID NO: 119923

SEQ ID NO: 355011 - RNA, 64 nt, Homo Sapiens; identical to SEQ ID NO: 119924

SEQ ID NO: 355012 - RNA, 64 nt, Homo Sapiens; identical to SEQ ID NO: 119925

SEQ ID NO: 355013 - RNA, 64 nt, Homo Sapiens; identical to SEQ ID NO: 119926

SEQ ID NO: 355014 - RNA, 64 nt, Homo Sapiens; identical to SEQ ID NO: 119927

SEQ ID NO: 355015 - RNA, 64 nt, Homo Sapiens; identical to SEQ ID NO: 119928

SEQ ID NO: 355016 - RNA, 64 nt, Homo Sapiens; identical to SEQ ID NO: 119929

SEQ ID NO: 355017 - RNA, 64 nt, Homo Sapiens; identical to SEQ ID NO: 119930

SEQ ID NO: 355018 - RNA, 64 nt, Homo Sapiens; identical to SEQ ID NO: 119931

SEQ ID NO: 355019 - RNA, 64 nt, Homo Sapiens; identical to SEQ ID NO: 119932

SEQ ID NO: 355020 - RNA, 64 nt, Homo Sapiens; identical to SEQ ID NO: 119933

SEQ ID NO: 355021 - RNA, 64 nt, Homo Sapiens; identical to SEQ ID NO: 119934

SEQ ID NO: 355022 - RNA, 64 nt, Homo Sapiens; identical to SEQ ID NO: 119935

SEQ ID NO: 355023 - RNA, 64 nt, Homo Sapiens; identical to SEQ ID NO: 119936

SEQ ID NO: 355024 - RNA, 64 nt, Homo Sapiens; identical to SEQ ID NO: 119937

SEQ ID NO: 355025 - RNA, 64 nt, Homo Sapiens; identical to SEQ ID NO: 119938

SEQ ID NO: 355026 - RNA, 64 nt, Homo Sapiens; identical to SEQ ID NO: 119939

SEQ ID NO: 355027 - RNA, 64 nt, Homo Sapiens; identical to SEQ ID NO: 119940

SEQ ID NO: 355028 - RNA, 64 nt, Homo Sapiens; identical to SEQ ID NO: 119941

SEQ ID NO: 355029 - RNA, 64 nt, Homo Sapiens; identical to SEQ ID NO: 119942

SEQ ID NO: 355030 - RNA, 64 nt, Homo Sapiens; identical to SEQ ID NO: 119943

SEQ ID NO: 355031 - RNA, 64 nt, Homo Sapiens; identical to SEQ ID NO: 119944

SEQ ID NO: 355032 - RNA, 64 nt, Homo Sapiens; identical to SEQ ID NO: 119945

SEQ ID NO: 355033 - RNA, 64 nt, Homo Sapiens; identical to SEQ ID NO: 119946

SEQ ID NO: 355034 - RNA, 64 nt, Homo Sapiens; identical to SEQ ID NO: 119947

SEQ ID NO: 355035 - RNA, 64 nt, Homo Sapiens; identical to SEQ ID NO: 119948

SEQ ID NO: 355036 - RNA, 64 nt, Homo Sapiens; identical to SEQ ID NO: 119949

SEQ ID NO: 355037 - RNA, 64 nt, Homo Sapiens; identical to SEQ ID NO: 119950

SEQ ID NO: 355038 - RNA, 64 nt, Homo Sapiens; identical to SEQ ID NO: 119951

SEQ ID NO: 355039 - RNA, 64 nt, Homo Sapiens; identical to SEQ ID NO: 119952

SEQ ID NO: 355040 - RNA, 64 nt, Homo Sapiens; identical to SEQ ID NO: 119953

SEQ ID NO: 355041 - RNA, 64 nt, Homo Sapiens; identical to SEQ ID NO: 119954

SEQ ID NO: 355042 - RNA, 64 nt, Homo Sapiens; identical to SEQ ID NO: 119955

SEQ ID NO: 355043 - RNA, 64 nt, Homo Sapiens; identical to SEQ ID NO: 119956

SEQ ID NO: 355044 - RNA, 64 nt, Homo Sapiens; identical to SEQ ID NO: 119957

SEQ ID NO: 355045 - RNA, 64 nt, Homo Sapiens; identical to SEQ ID NO: 119958

SEQ ID NO: 355046 - RNA, 64 nt, Homo Sapiens; identical to SEQ ID NO: 119959

SEQ ID NO: 355047 - RNA, 64 nt, Homo Sapiens; identical to SEQ ID NO: 119960

SEQ ID NO: 355048 - RNA, 64 nt, Homo Sapiens; identical to SEQ ID NO: 119961

SEQ ID NO: 355049 - RNA, 58 nt, Homo Sapiens; identical to SEQ ID NO: 119962

SEQ ID NO: 355050 - RNA, 64 nt, Homo Sapiens; identical to SEQ ID NO: 119963

SEQ ID NO: 355051 - RNA, 64 nt, Homo Sapiens; identical to SEQ ID NO: 119964

SEQ ID NO: 355052 - RNA, 64 nt, Homo Sapiens; identical to SEQ ID NO: 119965

SEQ ID NO: 355053 - RNA, 64 nt, Homo Sapiens; identical to SEQ ID NO: 119966

SEQ ID NO: 355054 - RNA, 64 nt, Homo Sapiens; identical to SEQ ID NO: 119967

SEQ ID NO: 355055 - RNA, 64 nt, Homo Sapiens; identical to SEQ ID NO: 119968

SEQ ID NO: 355056 - RNA, 64 nt, Homo Sapiens; identical to SEQ ID NO: 119969

SEQ ID NO: 355057 - RNA, 64 nt, Homo Sapiens; identical to SEQ ID NO: 119970

SEQ ID NO: 355058 - RNA, 55 nt, Homo Sapiens; identical to SEQ ID NO: 119971

SEQ ID NO: 355059 - RNA, 64 nt, Homo Sapiens; identical to SEQ ID NO: 119972

SEQ ID NO: 355060 - RNA, 64 nt, Homo Sapiens; identical to SEQ ID NO: 119973

SEQ ID NO: 355061 - RNA, 64 nt, Homo Sapiens; identical to SEQ ID NO: 119974

SEQ ID NO: 355062 - RNA, 64 nt, Homo Sapiens; identical to SEQ ID NO: 119975

SEQ ID NO: 355063 - RNA, 64 nt, Homo Sapiens; identical to SEQ ID NO: 119976

SEQ ID NO: 355064 - RNA, 64 nt, Homo Sapiens; identical to SEQ ID NO: 119977

SEQ ID NO: 355065 - RNA, 64 nt, Homo Sapiens; identical to SEQ ID NO: 119978

SEQ ID NO: 355066 - RNA, 64 nt, Homo Sapiens; identical to SEQ ID NO: 119979

SEQ ID NO: 355067 - RNA, 64 nt, Homo Sapiens; identical to SEQ ID NO: 119980

SEQ ID NO: 355068 - RNA, 64 nt, Homo Sapiens; identical to SEQ ID NO: 119981

SEQ ID NO: 355069 - RNA, 64 nt, Homo Sapiens; identical to SEQ ID NO: 119982

SEQ ID NO: 355070 - RNA, 64 nt, Homo Sapiens; identical to SEQ ID NO: 119983

SEQ ID NO: 355071 - RNA, 64 nt, Homo Sapiens; identical to SEQ ID NO: 119984

SEQ ID NO: 355072 - RNA, 64 nt, Homo Sapiens; identical to SEQ ID NO: 119985

SEQ ID NO: 355073 - RNA, 64 nt, Homo Sapiens; identical to SEQ ID NO: 119986

SEQ ID NO: 355074 - RNA, 64 nt, Homo Sapiens; identical to SEQ ID NO: 119987

SEQ ID NO: 355075 - RNA, 55 nt, Homo Sapiens; identical to SEQ ID NO: 119988

SEQ ID NO: 355076 - RNA, 64 nt, Homo Sapiens; identical to SEQ ID NO: 119989

SEQ ID NO: 355077 - RNA, 64 nt, Homo Sapiens; identical to SEQ ID NO: 119990

SEQ ID NO: 355078 - RNA, 64 nt, Homo Sapiens; identical to SEQ ID NO: 119991

SEQ ID NO: 355079 - RNA, 64 nt, Homo Sapiens; identical to SEQ ID NO: 119992

SEQ ID NO: 355080 - RNA, 64 nt, Homo Sapiens; identical to SEQ ID NO: 119993

SEQ ID NO: 355081 - RNA, 64 nt, Homo Sapiens; identical to SEQ ID NO: 119994

SEQ ID NO: 355082 - RNA, 64 nt, Homo Sapiens; identical to SEQ ID NO: 119995

SEQ ID NO: 355083 - RNA, 64 nt, Homo Sapiens; identical to SEQ ID NO: 119996

SEQ ID NO: 355084 - RNA, 64 nt, Homo Sapiens; identical to SEQ ID NO: 119997

SEQ ID NO: 355085 - RNA, 64 nt, Homo Sapiens; identical to SEQ ID NO: 119998

SEQ ID NO: 355086 - RNA, 62 nt, Homo Sapiens; identical to SEQ ID NO: 119999

SEQ ID NO: 355087 - RNA, 64 nt, Homo Sapiens; identical to SEQ ID NO: 120000

SEQ ID NO: 355088 - RNA, 64 nt, Homo Sapiens; identical to SEQ ID NO: 120001

SEQ ID NO: 355089 - RNA, 64 nt, Homo Sapiens; identical to SEQ ID NO: 120002

SEQ ID NO: 355090 - RNA, 64 nt, Homo Sapiens; identical to SEQ ID NO: 120003

SEQ ID NO: 355091 - RNA, 64 nt, Homo Sapiens; identical to SEQ ID NO: 120004

SEQ ID NO: 355092 - RNA, 64 nt, Homo Sapiens; identical to SEQ ID NO: 120005

SEQ ID NO: 355093 - RNA, 64 nt, Homo Sapiens; identical to SEQ ID NO: 120006

SEQ ID NO: 355094 - RNA, 64 nt, Homo Sapiens; identical to SEQ ID NO: 120007

SEQ ID NO: 355095 - RNA, 64 nt, Homo Sapiens; identical to SEQ ID NO: 120008

SEQ ID NO: 355096 - RNA, 64 nt, Homo Sapiens; identical to SEQ ID NO: 44100

SEQ ID NO: 355097 - RNA, 64 nt, Homo Sapiens; identical to SEQ ID NO: 44101

SEQ ID NO: 355098 - RNA, 64 nt, Homo Sapiens; identical to SEQ ID NO: 44102

SEQ ID NO: 355099 - RNA, 64 nt, Homo Sapiens; identical to SEQ ID NO: 44103

SEQ ID NO: 355100 - RNA, 64 nt, Homo Sapiens; identical to SEQ ID NO: 44104

SEQ ID NO: 355101 - RNA, 64 nt, Homo Sapiens; identical to SEQ ID NO: 44105

SEQ ID NO: 355102 - RNA, 64 nt, Homo Sapiens; identical to SEQ ID NO: 44106

SEQ ID NO: 355103 - RNA, 64 nt, Homo Sapiens; identical to SEQ ID NO: 44107

SEQ ID NO: 355104 - RNA, 64 nt, Homo Sapiens; identical to SEQ ID NO: 44108

SEQ ID NO: 355105 - RNA, 64 nt, Homo Sapiens; identical to SEQ ID NO: 44109

SEQ ID NO: 355106 - RNA, 64 nt, Homo Sapiens; identical to SEQ ID NO: 44110

SEQ ID NO: 355107 - RNA, 64 nt, Homo Sapiens; identical to SEQ ID NO: 44111

SEQ ID NO: 355108 - RNA, 64 nt, Homo Sapiens; identical to SEQ ID NO: 44112

SEQ ID NO: 355109 - RNA, 64 nt, Homo Sapiens; identical to SEQ ID NO: 44113

SEQ ID NO: 355110 - RNA, 64 nt, Homo Sapiens; identical to SEQ ID NO: 44114

SEQ ID NO: 355111 - RNA, 64 nt, Homo Sapiens; identical to SEQ ID NO: 44115

SEQ ID NO: 355112 - RNA, 64 nt, Homo Sapiens; identical to SEQ ID NO: 44116

SEQ ID NO: 355113 - RNA, 64 nt, Homo Sapiens; identical to SEQ ID NO: 44117

SEQ ID NO: 355114 - RNA, 64 nt, Homo Sapiens; identical to SEQ ID NO: 44118

SEQ ID NO: 355115 - RNA, 64 nt, Homo Sapiens; identical to SEQ ID NO: 44119

SEQ ID NO: 355116 - RNA, 64 nt, Homo Sapiens; identical to SEQ ID NO: 44120

SEQ ID NO: 355117 - RNA, 64 nt, Homo Sapiens; identical to SEQ ID NO: 44121

SEQ ID NO: 355118 - RNA, 64 nt, Homo Sapiens; identical to SEQ ID NO: 44122

SEQ ID NO: 355119 - RNA, 64 nt, Homo Sapiens; identical to SEQ ID NO: 44123

SEQ ID NO: 355120 - RNA, 64 nt, Homo Sapiens; identical to SEQ ID NO: 44124

SEQ ID NO: 355121 - RNA, 64 nt, Homo Sapiens; identical to SEQ ID NO: 44125

SEQ ID NO: 355122 - RNA, 64 nt, Homo Sapiens; identical to SEQ ID NO: 44126

SEQ ID NO: 355123 - RNA, 64 nt, Homo Sapiens; identical to SEQ ID NO: 44127

SEQ ID NO: 355124 - RNA, 64 nt, Homo Sapiens; identical to SEQ ID NO: 44128

SEQ ID NO: 355125 - RNA, 64 nt, Homo Sapiens; identical to SEQ ID NO: 44129

SEQ ID NO: 355126 - RNA, 64 nt, Homo Sapiens; identical to SEQ ID NO: 44130

SEQ ID NO: 355127 - RNA, 64 nt, Homo Sapiens; identical to SEQ ID NO: 44131

SEQ ID NO: 355128 - RNA, 64 nt, Homo Sapiens; identical to SEQ ID NO: 44132

SEQ ID NO: 355129 - RNA, 64 nt, Homo Sapiens; identical to SEQ ID NO: 44133

SEQ ID NO: 355130 - RNA, 64 nt, Homo Sapiens; identical to SEQ ID NO: 44134

SEQ ID NO: 355131 - RNA, 64 nt, Homo Sapiens; identical to SEQ ID NO: 44135

SEQ ID NO: 355132 - RNA, 64 nt, Homo Sapiens; identical to SEQ ID NO: 44136

SEQ ID NO: 355133 - RNA, 64 nt, Homo Sapiens; identical to SEQ ID NO: 44137

SEQ ID NO: 355134 - RNA, 64 nt, Homo Sapiens; identical to SEQ ID NO: 44138

SEQ ID NO: 355135 - RNA, 64 nt, Homo Sapiens; identical to SEQ ID NO: 44139

SEQ ID NO: 355136 - RNA, 64 nt, Homo Sapiens; identical to SEQ ID NO: 44140

SEQ ID NO: 355137 - RNA, 64 nt, Homo Sapiens; identical to SEQ ID NO: 44141

SEQ ID NO: 355138 - RNA, 64 nt, Homo Sapiens; identical to SEQ ID NO: 44142

SEQ ID NO: 355139 - RNA, 64 nt, Homo Sapiens; identical to SEQ ID NO: 44143

SEQ ID NO: 355140 - RNA, 64 nt, Homo Sapiens; identical to SEQ ID NO: 44144

SEQ ID NO: 355141 - RNA, 64 nt, Homo Sapiens; identical to SEQ ID NO: 44145

SEQ ID NO: 355142 - RNA, 64 nt, Homo Sapiens; identical to SEQ ID NO: 44146

SEQ ID NO: 355143 - RNA, 64 nt, Homo Sapiens; identical to SEQ ID NO: 44147

SEQ ID NO: 355144 - RNA, 64 nt, Homo Sapiens; identical to SEQ ID NO: 44148

SEQ ID NO: 355145 - RNA, 64 nt, Homo Sapiens; identical to SEQ ID NO: 44149

SEQ ID NO: 355146 - RNA, 64 nt, Homo Sapiens; identical to SEQ ID NO: 44150

SEQ ID NO: 355147 - RNA, 64 nt, Homo Sapiens; identical to SEQ ID NO: 44151

SEQ ID NO: 355148 - RNA, 64 nt, Homo Sapiens; identical to SEQ ID NO: 44152

SEQ ID NO: 355149 - RNA, 64 nt, Homo Sapiens; identical to SEQ ID NO: 44153

SEQ ID NO: 355150 - RNA, 64 nt, Homo Sapiens; identical to SEQ ID NO: 44154

SEQ ID NO: 355151 - RNA, 64 nt, Homo Sapiens; identical to SEQ ID NO: 44155

SEQ ID NO: 355152 - RNA, 64 nt, Homo Sapiens; identical to SEQ ID NO: 44156

SEQ ID NO: 355153 - RNA, 64 nt, Homo Sapiens; identical to SEQ ID NO: 44157

SEQ ID NO: 355154 - RNA, 64 nt, Homo Sapiens; identical to SEQ ID NO: 44158

SEQ ID NO: 355155 - RNA, 64 nt, Homo Sapiens; identical to SEQ ID NO: 44159

SEQ ID NO: 355156 - RNA, 64 nt, Homo Sapiens; identical to SEQ ID NO: 44160

SEQ ID NO: 355157 - RNA, 64 nt, Homo Sapiens; identical to SEQ ID NO: 44161

SEQ ID NO: 355158 - RNA, 64 nt, Homo Sapiens; identical to SEQ ID NO: 44162

SEQ ID NO: 355159 - RNA, 64 nt, Homo Sapiens; identical to SEQ ID NO: 44163

SEQ ID NO: 355160 - RNA, 64 nt, Homo Sapiens; identical to SEQ ID NO: 44164

SEQ ID NO: 355161 - RNA, 64 nt, Homo Sapiens; identical to SEQ ID NO: 44165

SEQ ID NO: 355162 - RNA, 64 nt, Homo Sapiens; identical to SEQ ID NO: 44166

SEQ ID NO: 355163 - RNA, 64 nt, Homo Sapiens; identical to SEQ ID NO: 44167

SEQ ID NO: 355164 - RNA, 64 nt, Homo Sapiens; identical to SEQ ID NO: 44168

SEQ ID NO: 355165 - RNA, 64 nt, Homo Sapiens; identical to SEQ ID NO: 44169

SEQ ID NO: 355166 - RNA, 64 nt, Homo Sapiens; identical to SEQ ID NO: 44170

SEQ ID NO: 355167 - RNA, 64 nt, Homo Sapiens; identical to SEQ ID NO: 44171

SEQ ID NO: 355168 - RNA, 64 nt, Homo Sapiens; identical to SEQ ID NO: 44172

SEQ ID NO: 355169 - RNA, 64 nt, Homo Sapiens; identical to SEQ ID NO: 44173

SEQ ID NO: 355170 - RNA, 64 nt, Homo Sapiens; identical to SEQ ID NO: 44174

SEQ ID NO: 355171 - RNA, 64 nt, Homo Sapiens; identical to SEQ ID NO: 44175

SEQ ID NO: 355172 - RNA, 64 nt, Homo Sapiens; identical to SEQ ID NO: 44176

SEQ ID NO: 355173 - RNA, 64 nt, Homo Sapiens; identical to SEQ ID NO: 44177

SEQ ID NO: 355174 - RNA, 64 nt, Homo Sapiens; identical to SEQ ID NO: 44178

SEQ ID NO: 355175 - RNA, 64 nt, Homo Sapiens; identical to SEQ ID NO: 44179

SEQ ID NO: 355176 - RNA, 64 nt, Homo Sapiens; identical to SEQ ID NO: 44180

SEQ ID NO: 355177 - RNA, 64 nt, Homo Sapiens; identical to SEQ ID NO: 44181

SEQ ID NO: 355178 - RNA, 64 nt, Homo Sapiens; identical to SEQ ID NO: 44182

SEQ ID NO: 355179 - RNA, 64 nt, Homo Sapiens; identical to SEQ ID NO: 44183

SEQ ID NO: 355180 - RNA, 64 nt, Homo Sapiens; identical to SEQ ID NO: 44184

SEQ ID NO: 355181 - RNA, 64 nt, Homo Sapiens; identical to SEQ ID NO: 44185

SEQ ID NO: 355182 - RNA, 64 nt, Homo Sapiens; identical to SEQ ID NO: 44186

SEQ ID NO: 355183 - RNA, 64 nt, Homo Sapiens; identical to SEQ ID NO: 44187

SEQ ID NO: 355184 - RNA, 64 nt, Homo Sapiens; identical to SEQ ID NO: 44188

SEQ ID NO: 355185 - RNA, 64 nt, Homo Sapiens; identical to SEQ ID NO: 44189

SEQ ID NO: 355186 - RNA, 64 nt, Homo Sapiens; identical to SEQ ID NO: 44190

SEQ ID NO: 355187 - RNA, 64 nt, Homo Sapiens; identical to SEQ ID NO: 44191

SEQ ID NO: 355188 - RNA, 64 nt, Homo Sapiens; identical to SEQ ID NO: 44192

SEQ ID NO: 355189 - RNA, 64 nt, Homo Sapiens; identical to SEQ ID NO: 44193

SEQ ID NO: 355190 - RNA, 64 nt, Homo Sapiens; identical to SEQ ID NO: 44194

SEQ ID NO: 355191 - RNA, 64 nt, Homo Sapiens; identical to SEQ ID NO: 44195

SEQ ID NO: 355192 - RNA, 64 nt, Homo Sapiens; identical to SEQ ID NO: 44196

SEQ ID NO: 355193 - RNA, 64 nt, Homo Sapiens; identical to SEQ ID NO: 44197

SEQ ID NO: 355194 - RNA, 64 nt, Homo Sapiens; identical to SEQ ID NO: 44198

SEQ ID NO: 355195 - RNA, 64 nt, Homo Sapiens; identical to SEQ ID NO: 44199

SEQ ID NO: 355196 - RNA, 64 nt, Homo Sapiens; identical to SEQ ID NO: 44200

SEQ ID NO: 355197 - RNA, 64 nt, Homo Sapiens; identical to SEQ ID NO: 44201

SEQ ID NO: 355198 - RNA, 64 nt, Homo Sapiens; identical to SEQ ID NO: 44202

SEQ ID NO: 355199 - RNA, 64 nt, Homo Sapiens; identical to SEQ ID NO: 44203

SEQ ID NO: 355200 - RNA, 64 nt, Homo Sapiens; identical to SEQ ID NO: 44204

SEQ ID NO: 355201 - RNA, 64 nt, Homo Sapiens; identical to SEQ ID NO: 44205

SEQ ID NO: 355202 - RNA, 64 nt, Homo Sapiens; identical to SEQ ID NO: 44206

SEQ ID NO: 355203 - RNA, 64 nt, Homo Sapiens; identical to SEQ ID NO: 44207

SEQ ID NO: 355204 - RNA, 64 nt, Homo Sapiens; identical to SEQ ID NO: 44208

SEQ ID NO: 355205 - RNA, 64 nt, Homo Sapiens; identical to SEQ ID NO: 44209

SEQ ID NO: 355206 - RNA, 64 nt, Homo Sapiens; identical to SEQ ID NO: 44210

SEQ ID NO: 355207 - RNA, 64 nt, Homo Sapiens; identical to SEQ ID NO: 44211

SEQ ID NO: 355208 - RNA, 64 nt, Homo Sapiens; identical to SEQ ID NO: 44212

SEQ ID NO: 355209 - RNA, 64 nt, Homo Sapiens; identical to SEQ ID NO: 44213

SEQ ID NO: 355210 - RNA, 64 nt, Homo Sapiens; identical to SEQ ID NO: 44214

SEQ ID NO: 355211 - RNA, 64 nt, Homo Sapiens; identical to SEQ ID NO: 44215

SEQ ID NO: 355212 - RNA, 64 nt, Homo Sapiens; identical to SEQ ID NO: 44216

SEQ ID NO: 355213 - RNA, 64 nt, Homo Sapiens; identical to SEQ ID NO: 44217

SEQ ID NO: 355214 - RNA, 64 nt, Homo Sapiens; identical to SEQ ID NO: 44218

SEQ ID NO: 355215 - RNA, 64 nt, Homo Sapiens; identical to SEQ ID NO: 44219

SEQ ID NO: 355216 - RNA, 64 nt, Homo Sapiens; identical to SEQ ID NO: 44220

SEQ ID NO: 355217 - RNA, 64 nt, Homo Sapiens; identical to SEQ ID NO: 44221

SEQ ID NO: 355218 - RNA, 64 nt, Homo Sapiens; identical to SEQ ID NO: 44222

SEQ ID NO: 355219 - RNA, 64 nt, Homo Sapiens; identical to SEQ ID NO: 44223

SEQ ID NO: 355220 - RNA, 64 nt, Homo Sapiens; identical to SEQ ID NO: 44224

SEQ ID NO: 355221 - RNA, 64 nt, Homo Sapiens; identical to SEQ ID NO: 44225

SEQ ID NO: 355222 - RNA, 64 nt, Homo Sapiens; identical to SEQ ID NO: 44226

SEQ ID NO: 355223 - RNA, 64 nt, Homo Sapiens; identical to SEQ ID NO: 44227

SEQ ID NO: 355224 - RNA, 64 nt, Homo Sapiens; identical to SEQ ID NO: 44228

SEQ ID NO: 355225 - RNA, 64 nt, Homo Sapiens; identical to SEQ ID NO: 44229

SEQ ID NO: 355226 - RNA, 64 nt, Homo Sapiens; identical to SEQ ID NO: 44230

SEQ ID NO: 355227 - RNA, 64 nt, Homo Sapiens; identical to SEQ ID NO: 44231

SEQ ID NO: 355228 - RNA, 64 nt, Homo Sapiens; identical to SEQ ID NO: 44232

SEQ ID NO: 355229 - RNA, 64 nt, Homo Sapiens; identical to SEQ ID NO: 44233

SEQ ID NO: 355230 - RNA, 64 nt, Homo Sapiens; identical to SEQ ID NO: 44234

SEQ ID NO: 355231 - RNA, 64 nt, Homo Sapiens; identical to SEQ ID NO: 44235

SEQ ID NO: 355232 - RNA, 64 nt, Homo Sapiens; identical to SEQ ID NO: 44236

SEQ ID NO: 355233 - RNA, 64 nt, Homo Sapiens; identical to SEQ ID NO: 44237

SEQ ID NO: 355234 - RNA, 64 nt, Homo Sapiens; identical to SEQ ID NO: 44238

SEQ ID NO: 355235 - RNA, 64 nt, Homo Sapiens; identical to SEQ ID NO: 44239

SEQ ID NO: 355236 - RNA, 64 nt, Homo Sapiens; identical to SEQ ID NO: 44240

SEQ ID NO: 355237 - RNA, 64 nt, Homo Sapiens; identical to SEQ ID NO: 44241

SEQ ID NO: 355238 - RNA, 64 nt, Homo Sapiens; identical to SEQ ID NO: 44242

SEQ ID NO: 355239 - RNA, 64 nt, Homo Sapiens; identical to SEQ ID NO: 44243

SEQ ID NO: 355240 - RNA, 64 nt, Homo Sapiens; identical to SEQ ID NO: 44244

SEQ ID NO: 355241 - RNA, 64 nt, Homo Sapiens; identical to SEQ ID NO: 44245

SEQ ID NO: 355242 - RNA, 64 nt, Homo Sapiens; identical to SEQ ID NO: 44246

SEQ ID NO: 355243 - RNA, 64 nt, Homo Sapiens; identical to SEQ ID NO: 44247

SEQ ID NO: 355244 - RNA, 64 nt, Homo Sapiens; identical to SEQ ID NO: 44248

SEQ ID NO: 355245 - RNA, 64 nt, Homo Sapiens; identical to SEQ ID NO: 44249

SEQ ID NO: 355246 - RNA, 64 nt, Homo Sapiens; identical to SEQ ID NO: 44250

SEQ ID NO: 355247 - RNA, 64 nt, Homo Sapiens; identical to SEQ ID NO: 44251

SEQ ID NO: 355248 - RNA, 64 nt, Homo Sapiens; identical to SEQ ID NO: 44252

SEQ ID NO: 355249 - RNA, 64 nt, Homo Sapiens; identical to SEQ ID NO: 44253

SEQ ID NO: 355250 - RNA, 64 nt, Homo Sapiens
acugcuguucccagugauauuugggaucugacugaagccagaggcucuguaaaaucagaccaua

SEQ ID NO: 355251 - RNA, 64 nt, Homo Sapiens
ugucuuaaaaguuguuuuuaaaugacaauaaaacaagccagaaugucuuuugugcuggaguguc

SEQ ID NO: 355252 - RNA, 64 nt, Homo Sapiens
gaccacucaacccccaccuggaaggggcaaagaaaagccagaguuccauguuuguacuccugug

SEQ ID NO: 355253 - RNA, 64 nt, Homo Sapiens
caaccuucccucucuccuuggugaagaacaucccaagccagaaagaaguuaacuacaguguuuu

SEQ ID NO: 355254 - RNA, 64 nt, Homo Sapiens
ugggaggggagggcuggcugcuggaagaaggaagaagccagacugguuagacaguacucuuaac

SEQ ID NO: 355255 - RNA, 64 nt, Homo Sapiens
cccaccuggccugcccacagaaagauaggggaagaagccagaacgucuuauaacaccucccaag

SEQ ID NO: 355256 - RNA, 64 nt, Homo Sapiens
cuuauaacaccucccaagaaucuguguuacguugaagccagagugccuccuuggcuggcauggu

SEQ ID NO: 355257 - RNA, 64 nt, Homo Sapiens
gaaaaugugcaugacaacacuagagguaugggcgaagccagaaagaagggaaguuuuggcugaa

SEQ ID NO: 355258 - RNA, 64 nt, Homo Sapiens
cccuugccuuuaaccuuuucugcagugaucuaagaagccagauucaucugcacaaauacguggu

SEQ ID NO: 355259 - RNA, 64 nt, Homo Sapiens
aagggaaaagacacacaagucgcguggguuggagaagccagagccauuccaccuccccuccccc

SEQ ID NO: 355260 - RNA, 64 nt, Homo Sapiens
caccuccccucccccagcaucucucagagaugugaagccagauccucauggcagcgaggcccuc

SEQ ID NO: 355261 - RNA, 64 nt, Homo Sapiens
aguuuuauacagacaaaaccgaaagugugguaaaaagccagagugaacacuaagcugugaugaa

SEQ ID NO: 355262 - RNA, 64 nt, Homo Sapiens
ggaaaaagauuccaugucagcacuucgcugcugcaagccagacaggaggcaaccugaccagaaa

SEQ ID NO: 355263 - RNA, 64 nt, Homo Sapiens
guuaucuagugauaugaccucacugucuugaccaaagccagaauagaaggcaggauuccugaau

SEQ ID NO: 355264 - RNA, 64 nt, Homo Sapiens
ugaauaauaugcagagaugcauauuaggaaugugaagccagaaugggucaguuguagcugcugc

SEQ ID NO: 355265 - RNA, 64 nt, Homo Sapiens
uagcaggcuguuccauguucgucuuuucagaagcaagccagaccuuuuucuuuuuugcuuucuu

SEQ ID NO: 355266 - RNA, 64 nt, Homo Sapiens
cccaagcaggacgaaaaagacucagagcgccaggaagccagagcucuagaggucaggacggcuc

SEQ ID NO: 355267 - RNA, 64 nt, Homo Sapiens
ucuugaaagacuucagccaucagagcccagugggaagccagaggggauuucugaaacuugaacu

SEQ ID NO: 355268 - RNA, 61 nt, Homo Sapiens; identical to SEQ ID NO: 188794

SEQ ID NO: 355269 - RNA, 64 nt, Homo Sapiens
gggcucccuccucuucacauuccccccgaccccaaagccagagaaagccagauggcaccagcug

SEQ ID NO: 355270 - RNA, 64 nt, Homo Sapiens
cucuucacauuccccccgaccccaaagccagagaaagccagauggcaccagcugcuccggaugu

SEQ ID NO: 355271 - RNA, 64 nt, Homo Sapiens
gugcaagcacccgucuacccggucucgcccaccaaagccagaaaaaccaaaguucucaggccaa

SEQ ID NO: 355272 - RNA, 64 nt, Homo Sapiens
ucaugccacaggccuggcuggguucugagucagcaagccagaggcgccuucuggagagccucug

SEQ ID NO: 355273 - RNA, 64 nt, Homo Sapiens
ucauuuugugccacccauuuagcaucagucuaacaagccagaaccaaaaccugcagcaaagaga

SEQ ID NO: 355274 - RNA, 64 nt, Homo Sapiens
guuuguucaaaaccugcagcucccucaccccuguaagccagacaccacccauugucaggugcuc

SEQ ID NO: 355275 - RNA, 64 nt, Homo Sapiens
uguaguuaacauuuauguucccuacucccuacguaagccagacuuuggcaacagugauaguuga

SEQ ID NO: 355276 - RNA, 64 nt, Homo Sapiens
gaucuucauuuuacaggcagaccugucuaacuacaagccagacuuggguuuucuccuguaguuu

SEQ ID NO: 355277 - RNA, 64 nt, Homo Sapiens
cuguguuuccuucauguguuagauauuggcaacaaagccagagguguaauguugguuauaugaa

SEQ ID NO: 355278 - RNA, 64 nt, Homo Sapiens
auagaucuuggaaggagagauccauugaguccagaagccagaucagcaaauggaggaaccucgg

SEQ ID NO: 355279 - RNA, 64 nt, Homo Sapiens
guuauuuagccauucaccuagagaguaaguguugaagccagagccaccuccaacucuggagccu

SEQ ID NO: 355280 - RNA, 64 nt, Homo Sapiens
gugggauguggcgggacaggguugcuggguacagaagccagacuucuuuuacaaguaacucuag

SEQ ID NO: 355281 - RNA, 64 nt, Homo Sapiens
aaggaucauggucaugugagcuucuggucaccggaagccagaaauacucagcugccauguugau

SEQ ID NO: 355282 - RNA, 64 nt, Homo Sapiens
cugugaagagauccuggcauuucugguccaacccaagccagagaaccauuaagaaggggccuuc

SEQ ID NO: 355283 - RNA, 64 nt, Homo Sapiens
ugcucaccccuuucccccgccaaauaagaaacgcaagccagaccacgaugauuguagaaguccc

SEQ ID NO: 355284 - RNA, 64 nt, Homo Sapiens
acuagagccaaaaacuuguucauaaaagugcagaaagccagaggcaagaugaacuugaagauua

SEQ ID NO: 355285 - RNA, 64 nt, Homo Sapiens
acuagauccaaagacuuguucaucaaaguacagaaagccagaggcaagaugaacuugaagauua

SEQ ID NO: 355286 - RNA, 64 nt, Homo Sapiens
acuagaggccaagacuuguucaucaaugugcagaaagccagaggcaaaaugagugugcagauua

SEQ ID NO: 355287 - RNA, 64 nt, Homo Sapiens; identical to SEQ ID NO: 313523

SEQ ID NO: 355288 - RNA, 64 nt, Homo Sapiens; identical to SEQ ID NO: 313524

SEQ ID NO: 355289 - RNA, 64 nt, Homo Sapiens
gugccuaggaaaaggggacagagggcaaggagagaagugagagcuacaauuccagcauuggaga

SEQ ID NO: 355290 - RNA, 64 nt, Homo Sapiens
cccagauagacuaacaacccuuuagugcuccaagaagugagaauuuccgaaaaagaucugccgg

SEQ ID NO: 355291 - RNA, 64 nt, Homo Sapiens
gccuuuuuuuuaaggagcaaaaaucugagaaaaaaagugagagaccucugccuacaaaaccuca

SEQ ID NO: 355292 - RNA, 64 nt, Homo Sapiens
auguugagcagaauguuguacuugaaaaugcuauaagugagaugguaugaaauaaauucugacu

SEQ ID NO: 355293 - RNA, 64 nt, Homo Sapiens
caauaauaacugaacuacagucaaauuaaguagaaagugagacuagaauuaaagaacuugcugu

SEQ ID NO: 355294 - RNA, 64 nt, Homo Sapiens
aauuaagacaaagaacagguggaguggggagggaaagugagaugaugcaguccgaaagcaugug

SEQ ID NO: 355295 - RNA, 64 nt, Homo Sapiens
uuccaggcagaggaacaggaugugcacugccccaaagugagaacuugcucuacguggucaggaa

SEQ ID NO: 355296 - RNA, 64 nt, Homo Sapiens
ggaggacaggugguggagggccuuggcuucugcuaagugagaugggaaccacuggaggguuuga

SEQ ID NO: 355297 - RNA, 64 nt, Homo Sapiens
ugggugaaugauggggaguaaauuuaggaaggggaagugagagaguaugguggcaauaucacaa

SEQ ID NO: 355298 - RNA, 64 nt, Homo Sapiens
uguguguuuuacuaaccuuuuauaucuugccuucaagugagaaggaacaaacaacucucagugg

SEQ ID NO: 355299 - RNA, 64 nt, Homo Sapiens
gaaauugcgccacugcacuccagccugggcaacaaagugagacuccaucucaaaaaaaaaaaaa

SEQ ID NO: 355300 - RNA, 64 nt, Homo Sapiens
cauuugcauaaagcugacugacugaaggaacagaaagugagacagacagauaugaccaaauuua

SEQ ID NO: 355301 - RNA, 64 nt, Homo Sapiens
ccagccgaccggcccugcccagagccuggaagggaagugagaaagcgaccugcacgcacugcgu

SEQ ID NO: 355302 - RNA, 64 nt, Homo Sapiens
aucacagcuccucgcugcguugcagcuucggggcaagugagacaagggacagaacugaacgucc

SEQ ID NO: 355303 - RNA, 64 nt, Homo Sapiens
guaaauuucuguacauguacuguuuucauaugugaagugagaagaaacuuuaugcuuguuuaau

SEQ ID NO: 355304 - RNA, 64 nt, Homo Sapiens
cugaccucugauggcacuuguugacaaaucauucaagugagaccauguuacuagacaugaucuu

SEQ ID NO: 355305 - RNA, 64 nt, Homo Sapiens
aucucucucuuauaucacuugaaugauauauuguaagugagagguaaaggaaaauguaggcaca

SEQ ID NO: 355306 - RNA, 64 nt, Homo Sapiens
aaauugucagugaaauaaaugagauuuuggaauaaagugagaaugggagaagggauauguugug

SEQ ID NO: 355307 - RNA, 64 nt, Homo Sapiens
ugaauuaauaauugugagcccauagacacaagggaagugagaaacagugcucuggugacaugau

SEQ ID NO: 355308 - RNA, 64 nt, Homo Sapiens
gcaagcucugcccuggcuguggguaucaggacugugaccaaagcauuucuagucccuucucucu

SEQ ID NO: 355309 - RNA, 64 nt, Homo Sapiens
gaccccaggcucuuagagacuaaggggcagcuccugaccaaagacgauacagcuuggcacuuua

SEQ ID NO: 355310 - RNA, 64 nt, Homo Sapiens
uccucccaggaaccaaaaaaccccagcuauuuucugaccaaaauguguuucauaacaaaccauc

SEQ ID NO: 355311 - RNA, 64 nt, Homo Sapiens
uaugugguuguuacacuuccgaccacaaggguaaugaccaaauugcagacuacuacuaaucaca

SEQ ID NO: 355312 - RNA, 64 nt, Homo Sapiens
gaaaaggggaaguaauuaagguuacuuaaguaauugaccaaauguaacuagggagugaguggua

SEQ ID NO: 355313 - RNA, 64 nt, Homo Sapiens
aagaaaaugcaaguucuaaauuuugaccaaaaauugaccaaaguuuauucuaugcucucuguac

SEQ ID NO: 355314 - RNA, 64 nt, Homo Sapiens
uugaccaaaguaagaaaauggcucucuguacuuuugaccaaaaacaucuuugcuuuuauucuau

SEQ ID NO: 355315 - RNA, 64 nt, Homo Sapiens
uaaauuggaguuaggaauuucaugaaccucacuaugaccaaaauuaauuuuuugauucaguuug

SEQ ID NO: 355316 - RNA, 64 nt, Homo Sapiens
uuagcuaggccagaggcucguauuguguuucugcugaccaaaguugcauacaccuguaagaagu

SEQ ID NO: 355317 - RNA, 64 nt, Homo Sapiens
auuugccuuaggcugauaggaauguggguuuucuugaccaaauauaucagcaucuaauugaaau

SEQ ID NO: 355318 - RNA, 64 nt, Homo Sapiens
uuucuugaccaaauauaucagcaucuaauugaaaugaccaaauagcauucuuagacuucuguau

SEQ ID NO: 355319 - RNA, 64 nt, Homo Sapiens
uuaguaaccaguuauacccaucucaaaccugugcugaccaaagaugcaggcuccugguuguucc

SEQ ID NO: 355320 - RNA, 64 nt, Homo Sapiens
ucauaugugaaauggccaaaguuuccuggaccagugaccaaaccucuucucaacccaagaaccu

SEQ ID NO: 355321 - RNA, 64 nt, Homo Sapiens
gacuagcccaauuauccuuauaaauugaauauggugaccaaaugcuuugauaucauacuacucu

SEQ ID NO: 355322 - RNA, 64 nt, Homo Sapiens
cauuugaaaguuccaugcagcuuuagcacagaguugaccaaacacuggcguaaguucaauuuac

SEQ ID NO: 355323 - RNA, 63 nt, Homo Sapiens
gacuucauuuguaacccaugaauaaaguuaauuuugaccaaaaacaucccuaugaaguugaaa

SEQ ID NO: 355324 - RNA, 64 nt, Homo Sapiens
gggagauaauuaucagucaugcaauuagcagaagugaccaaauuauuucaaguuuaauaaaaua

SEQ ID NO: 355325 - RNA, 64 nt, Homo Sapiens
acagggguuggcugggaggaggaagaccauucugugaccaaaauaccuuggucauuuuuuuuau

SEQ ID NO: 355326 - RNA, 64 nt, Homo Sapiens
cauuuuuuugaaugaguuuuuuaaauuuuuuagaugaccaaaacuugcagggcaggggaugccc

SEQ ID NO: 355327 - RNA, 64 nt, Homo Sapiens
cccacuaagaaaaacagauuuucagagaacagugugaccaaaaagaggaccccaagagcaguga

SEQ ID NO: 355328 - RNA, 64 nt, Homo Sapiens
ugucucaaagucaacagccccccaacggcggugcugaccaaaaagugaugccauggaacucaag

SEQ ID NO: 355329 - RNA, 64 nt, Homo Sapiens
uggaugaggagggaaaacucugccaaauggaaaaugaccaaauuuaagagggugggacaguccc

SEQ ID NO: 355330 - RNA, 64 nt, Homo Sapiens
augcccugccuaccuucugaaauguuuaccccauugaccaaacuuggcuccagccauugcggug

SEQ ID NO: 355331 - RNA, 64 nt, Homo Sapiens
aggucugcagcuauuucaacauaaaaaaaguguuugaccaaaguaaauauccauauauauuucu

SEQ ID NO: 355332 - RNA, 64 nt, Homo Sapiens
aggaugugcacugcuucacggaaucugcucucugugaccaaaagcaggaguccaauuaugggca

SEQ ID NO: 355333 - RNA, 64 nt, Homo Sapiens
cauuggaauuggaagaacuauaaagugugauucgaucgucaagacaucacuuggauuucuuaau

SEQ ID NO: 355334 - RNA, 64 nt, Homo Sapiens
gacuugcaggaagaugaugauaacggcgaugugaaucgucaaagguacgggccagcuugugccu

SEQ ID NO: 355335 - RNA, 64 nt, Homo Sapiens
aguaaaggacgaggucauuagccauauuguauauaucgucaagcaacacacacaaaaguuccuc

SEQ ID NO: 355336 - RNA, 64 nt, Homo Sapiens
uaaugucaaaauaguuuuggagacuaaauuacucaucgucaaaaggaaaaaaagauuuugguug

SEQ ID NO: 355337 - RNA, 64 nt, Homo Sapiens
uagccgauccuguuacauuucaugggagggguacaucgucaacaguugggauuggggggagggc

SEQ ID NO: 355338 - RNA, 63 nt, Homo Sapiens
caaaagaucaacaaaaaugaaguuuaucuggggaucgucaaaucuuuuucaaauuuaauguau

SEQ ID NO: 355339 - RNA, 64 nt, Homo Sapiens
agaaacuuugaaggagcaggauauaagucucgccaucgucaaaguuauuuucuucugacuuaga

SEQ ID NO: 355340 - RNA, 64 nt, Homo Sapiens
uguugcccucuccuuccauucacuagaggaucgcaucgucaaaagauuuuugcuuggaauaagc

SEQ ID NO: 355341 - RNA, 64 nt, Homo Sapiens
cuucagccgccgacccgggauccgugguuuccguaucgucaaccaccucucccccacccccgac

SEQ ID NO: 355342 - RNA, 64 nt, Homo Sapiens
accguuugcugggcuauuccccugcagugcagacaucgucaaaauucagacaagaggaaauuuu

SEQ ID NO: 355343 - RNA, 64 nt, Homo Sapiens
ugaauagcuuagaauacugccuacaauguaugugaucgucaaugugccucccuugcagcaagca

SEQ ID NO: 355344 - RNA, 58 nt, Homo Sapiens
ugccaagaagaaggagauaaacaugaccaucgucaaagaccugcucaagaaauuuuua

SEQ ID NO: 355345 - RNA, 58 nt, Homo Sapiens
agcugcugaagaaauuuuuaacaucaccaucgucaaagugccaagaagaaggagauaa

SEQ ID NO: 355346 - RNA, 64 nt, Homo Sapiens
aaguuugcgcccucauaagcagcgaccuuguggcaucgucaaaaggaagggauugguuuggcaa

SEQ ID NO: 355347 - RNA, 64 nt, Homo Sapiens
augcccuccuggugccccuggcacugaggcacagaucgucaaggcagguacccccucaacccuu

SEQ ID NO: 355348 - RNA, 64 nt, Homo Sapiens
cuuuccucuucgguuuuacaguggcuuccgugggaucgucaauuucuuguucuuagaguuucgg

SEQ ID NO: 355349 - RNA, 57 nt, Homo Sapiens
ccauuacagauuuuuccugaagaacacaucgucaauaaaucaccugcacccaaaucu

SEQ ID NO: 355350 - RNA, 64 nt, Homo Sapiens
cagauguauuuuugauuucagggaauucuuuaguaucgucaauggugccacauaaaacaugucc

SEQ ID NO: 355351 - RNA, 64 nt, Homo Sapiens
agucuguuuucucugagcauguuggccaacuaguaucgucaaauuauugaguggaucaucucuu

SEQ ID NO: 355352 - RNA, 64 nt, Homo Sapiens
acuuuuaaacauaaagaauuaaagaauuuuuuuaaucgucaaccgcuuugauucgaagggucuu

SEQ ID NO: 355353 - RNA, 64 nt, Homo Sapiens; identical to SEQ ID NO: 169257

SEQ ID NO: 355354 - RNA, 64 nt, Homo Sapiens; identical to SEQ ID NO: 169258

SEQ ID NO: 355355 - RNA, 64 nt, Homo Sapiens; identical to SEQ ID NO: 169259

SEQ ID NO: 355356 - RNA, 64 nt, Homo Sapiens; identical to SEQ ID NO: 169260

SEQ ID NO: 355357 - RNA, 64 nt, Homo Sapiens; identical to SEQ ID NO: 169261

SEQ ID NO: 355358 - RNA, 64 nt, Homo Sapiens; identical to SEQ ID NO: 169262

SEQ ID NO: 355359 - RNA, 64 nt, Homo Sapiens; identical to SEQ ID NO: 169263

SEQ ID NO: 355360 - RNA, 64 nt, Homo Sapiens; identical to SEQ ID NO: 169264

SEQ ID NO: 355361 - RNA, 64 nt, Homo Sapiens; identical to SEQ ID NO: 169265

SEQ ID NO: 355362 - RNA, 64 nt, Homo Sapiens; identical to SEQ ID NO: 169266

SEQ ID NO: 355363 - RNA, 64 nt, Homo Sapiens; identical to SEQ ID NO: 169267

SEQ ID NO: 355364 - RNA, 64 nt, Homo Sapiens; identical to SEQ ID NO: 169268

SEQ ID NO: 355365 - RNA, 64 nt, Homo Sapiens; identical to SEQ ID NO: 169269

SEQ ID NO: 355366 - RNA, 64 nt, Homo Sapiens; identical to SEQ ID NO: 169270

SEQ ID NO: 355367 - RNA, 64 nt, Homo Sapiens; identical to SEQ ID NO: 169271

SEQ ID NO: 355368 - RNA, 64 nt, Homo Sapiens; identical to SEQ ID NO: 169272

SEQ ID NO: 355369 - RNA, 64 nt, Homo Sapiens; identical to SEQ ID NO: 169273

SEQ ID NO: 355370 - RNA, 64 nt, Homo Sapiens; identical to SEQ ID NO: 169274

SEQ ID NO: 355371 - RNA, 64 nt, Homo Sapiens; identical to SEQ ID NO: 169275

SEQ ID NO: 355372 - RNA, 64 nt, Homo Sapiens; identical to SEQ ID NO: 169276

SEQ ID NO: 355373 - RNA, 64 nt, Homo Sapiens; identical to SEQ ID NO: 169277

SEQ ID NO: 355374 - RNA, 64 nt, Homo Sapiens; identical to SEQ ID NO: 169278

SEQ ID NO: 355375 - RNA, 64 nt, Homo Sapiens; identical to SEQ ID NO: 169279

SEQ ID NO: 355376 - RNA, 64 nt, Homo Sapiens
cugcauuccuccacccacccaaccucucuccccgccccuguaucccuccacccaccccucuccc

SEQ ID NO: 355377 - RNA, 64 nt, Homo Sapiens
cccaccccuccacccacccccccuguaccucccaccccuguaucacucccaccccucccacaac

SEQ ID NO: 355378 - RNA, 64 nt, Homo Sapiens
ucccaccccuguauccccaccaccccucccacaaccccuguaccguauccccaccccguacucc

SEQ ID NO: 355379 - RNA, 64 nt, Homo Sapiens
cccaccccguacucccaccccaucccucccccaaccccuguaucgccgacgggggcagcugccc

SEQ ID NO: 355380 - RNA, 64 nt, Homo Sapiens
auguuggaugcuccucacaucugccgauagcuauccccuguaugugucuucuguccccaucuuc

SEQ ID NO: 355381 - RNA, 64 nt, Homo Sapiens
ugccccagcauucugggguucugcuuccucuccuccccuguacgucgucccuacuuccuccucc

SEQ ID NO: 355382 - RNA, 64 nt, Homo Sapiens
cugcauucaggagacagaaggcagucuguuugaaccccuguaggcuugucugaccuuaaugcaa

SEQ ID NO: 355383 - RNA, 64 nt, Homo Sapiens
uauuuucccuguguuugucugggggaucccagagccccuguauuuagcauuaguagcuucugug

SEQ ID NO: 355384 - RNA, 64 nt, Homo Sapiens
accccaccccacagcagggcuccuggcccccaccccccuguacauaauuuuuaaaaccuuuuuu

SEQ ID NO: 355385 - RNA, 64 nt, Homo Sapiens
ccaaagacaggguugugccuuaccccaggagccaccccuguaccccccuugcccugccauucac

SEQ ID NO: 355386 - RNA, 64 nt, Homo Sapiens
uuaaaugcauauuuuagccaaaauguacucauuuagacaacauauccuuacagucucuagaauu

SEQ ID NO: 355387 - RNA, 64 nt, Homo Sapiens
uuauauaugacaguggagguaaauaggagcuaggagacaacaaguauaaaagccaauggaauuc

SEQ ID NO: 355388 - RNA, 64 nt, Homo Sapiens
uugagguuagaggaucaguaacauguuuuuggcaagacaacagaugucugacuccuaauuaaua

SEQ ID NO: 355389 - RNA, 64 nt, Homo Sapiens
ugccuccuuuugacaaauacuauuagauugugagagacaacaguacaccauuggaaaguggaua

SEQ ID NO: 355390 - RNA, 64 nt, Homo Sapiens
uuuguaauugagagcucauuucaaaagcagaaaaagacaacaaauauuaaagcaaggaaaagug

SEQ ID NO: 355391 - RNA, 64 nt, Homo Sapiens
aucauuccagaaggaaaagugugucagggcaagcagacaacacaauuuccuaucagaauauguc

SEQ ID NO: 355392 - RNA, 64 nt, Homo Sapiens
uguauugguuuaaacucgaucagaccaugaaaccagacaacacaagagcacagaauacuguucu

SEQ ID NO: 355393 - RNA, 64 nt, Homo Sapiens
uuuuguauuucacucaaggcugccccuacauaugagacaacauaugaaagcuuuagcacuuuuu

SEQ ID NO: 355394 - RNA, 64 nt, Homo Sapiens; identical to SEQ ID NO: 294474

SEQ ID NO: 355395 - RNA, 64 nt, Homo Sapiens; identical to SEQ ID NO: 294475

SEQ ID NO: 355396 - RNA, 64 nt, Homo Sapiens; identical to SEQ ID NO: 294476

SEQ ID NO: 355397 - RNA, 64 nt, Homo Sapiens; identical to SEQ ID NO: 294477

SEQ ID NO: 355398 - RNA, 64 nt, Homo Sapiens; identical to SEQ ID NO: 294478

SEQ ID NO: 355399 - RNA, 64 nt, Homo Sapiens; identical to SEQ ID NO: 294479

SEQ ID NO: 355400 - RNA, 64 nt, Homo Sapiens; identical to SEQ ID NO: 110917

SEQ ID NO: 355401 - RNA, 64 nt, Homo Sapiens; identical to SEQ ID NO: 110918

SEQ ID NO: 355402 - RNA, 64 nt, Homo Sapiens; identical to SEQ ID NO: 110919

SEQ ID NO: 355403 - RNA, 64 nt, Homo Sapiens; identical to SEQ ID NO: 110920

SEQ ID NO: 355404 - RNA, 64 nt, Homo Sapiens; identical to SEQ ID NO: 110921

SEQ ID NO: 355405 - RNA, 64 nt, Homo Sapiens; identical to SEQ ID NO: 110922

SEQ ID NO: 355406 - RNA, 64 nt, Homo Sapiens; identical to SEQ ID NO: 110923

SEQ ID NO: 355407 - RNA, 64 nt, Homo Sapiens; identical to SEQ ID NO: 110924

SEQ ID NO: 355408 - RNA, 64 nt, Homo Sapiens; identical to SEQ ID NO: 110925

SEQ ID NO: 355409 - RNA, 64 nt, Homo Sapiens; identical to SEQ ID NO: 110926

SEQ ID NO: 355410 - RNA, 64 nt, Homo Sapiens; identical to SEQ ID NO: 110927

SEQ ID NO: 355411 - RNA, 64 nt, Homo Sapiens; identical to SEQ ID NO: 110928

SEQ ID NO: 355412 - RNA, 61 nt, Homo Sapiens; identical to SEQ ID NO: 110929

SEQ ID NO: 355413 - RNA, 64 nt, Homo Sapiens; identical to SEQ ID NO: 110930

SEQ ID NO: 355414 - RNA, 64 nt, Homo Sapiens; identical to SEQ ID NO: 110931

SEQ ID NO: 355415 - RNA, 64 nt, Homo Sapiens; identical to SEQ ID NO: 110932

SEQ ID NO: 355416 - RNA, 64 nt, Homo Sapiens; identical to SEQ ID NO: 110933

SEQ ID NO: 355417 - RNA, 64 nt, Homo Sapiens; identical to SEQ ID NO: 110934

SEQ ID NO: 355418 - RNA, 64 nt, Homo Sapiens; identical to SEQ ID NO: 110935

SEQ ID NO: 355419 - RNA, 64 nt, Homo Sapiens; identical to SEQ ID NO: 110936

SEQ ID NO: 355420 - RNA, 64 nt, Homo Sapiens; identical to SEQ ID NO: 110937

SEQ ID NO: 355421 - RNA, 64 nt, Homo Sapiens; identical to SEQ ID NO: 110938

SEQ ID NO: 355422 - RNA, 64 nt, Homo Sapiens; identical to SEQ ID NO: 110939

SEQ ID NO: 355423 - RNA, 64 nt, Homo Sapiens; identical to SEQ ID NO: 110940

SEQ ID NO: 355424 - RNA, 64 nt, Homo Sapiens; identical to SEQ ID NO: 110941

SEQ ID NO: 355425 - RNA, 64 nt, Homo Sapiens; identical to SEQ ID NO: 110942

SEQ ID NO: 355426 - RNA, 64 nt, Homo Sapiens; identical to SEQ ID NO: 110943

SEQ ID NO: 355427 - RNA, 64 nt, Homo Sapiens; identical to SEQ ID NO: 110944

SEQ ID NO: 355428 - RNA, 64 nt, Homo Sapiens; identical to SEQ ID NO: 110945

SEQ ID NO: 355429 - RNA, 64 nt, Homo Sapiens; identical to SEQ ID NO: 110946

SEQ ID NO: 355430 - RNA, 64 nt, Homo Sapiens; identical to SEQ ID NO: 110947

SEQ ID NO: 355431 - RNA, 64 nt, Homo Sapiens; identical to SEQ ID NO: 110948

SEQ ID NO: 355432 - RNA, 64 nt, Homo Sapiens; identical to SEQ ID NO: 110949

SEQ ID NO: 355433 - RNA, 64 nt, Homo Sapiens; identical to SEQ ID NO: 110950

SEQ ID NO: 355434 - RNA, 64 nt, Homo Sapiens; identical to SEQ ID NO: 110951

SEQ ID NO: 355435 - RNA, 64 nt, Homo Sapiens; identical to SEQ ID NO: 110952

SEQ ID NO: 355436 - RNA, 64 nt, Homo Sapiens; identical to SEQ ID NO: 110953

SEQ ID NO: 355437 - RNA, 64 nt, Homo Sapiens; identical to SEQ ID NO: 110954

SEQ ID NO: 355438 - RNA, 64 nt, Homo Sapiens; identical to SEQ ID NO: 110955

SEQ ID NO: 355439 - RNA, 64 nt, Homo Sapiens; identical to SEQ ID NO: 110956

SEQ ID NO: 355440 - RNA, 64 nt, Homo Sapiens; identical to SEQ ID NO: 110957

SEQ ID NO: 355441 - RNA, 64 nt, Homo Sapiens; identical to SEQ ID NO: 110958

SEQ ID NO: 355442 - RNA, 64 nt, Homo Sapiens; identical to SEQ ID NO: 110959

SEQ ID NO: 355443 - RNA, 64 nt, Homo Sapiens; identical to SEQ ID NO: 110960

SEQ ID NO: 355444 - RNA, 64 nt, Homo Sapiens; identical to SEQ ID NO: 110961

SEQ ID NO: 355445 - RNA, 64 nt, Homo Sapiens; identical to SEQ ID NO: 110962

SEQ ID NO: 355446 - RNA, 64 nt, Homo Sapiens; identical to SEQ ID NO: 110963

SEQ ID NO: 355447 - RNA, 64 nt, Homo Sapiens; identical to SEQ ID NO: 110964

SEQ ID NO: 355448 - RNA, 64 nt, Homo Sapiens; identical to SEQ ID NO: 110965

SEQ ID NO: 355449 - RNA, 64 nt, Homo Sapiens; identical to SEQ ID NO: 110966

SEQ ID NO: 355450 - RNA, 64 nt, Homo Sapiens; identical to SEQ ID NO: 110967

SEQ ID NO: 355451 - RNA, 64 nt, Homo Sapiens; identical to SEQ ID NO: 110968

SEQ ID NO: 355452 - RNA, 64 nt, Homo Sapiens; identical to SEQ ID NO: 110969

SEQ ID NO: 355453 - RNA, 64 nt, Homo Sapiens; identical to SEQ ID NO: 110970

SEQ ID NO: 355454 - RNA, 64 nt, Homo Sapiens; identical to SEQ ID NO: 110971

SEQ ID NO: 355455 - RNA, 64 nt, Homo Sapiens; identical to SEQ ID NO: 110972

SEQ ID NO: 355456 - RNA, 64 nt, Homo Sapiens; identical to SEQ ID NO: 110973

SEQ ID NO: 355457 - RNA, 64 nt, Homo Sapiens; identical to SEQ ID NO: 110974

SEQ ID NO: 355458 - RNA, 64 nt, Homo Sapiens; identical to SEQ ID NO: 110975

SEQ ID NO: 355459 - RNA, 64 nt, Homo Sapiens; identical to SEQ ID NO: 110976

SEQ ID NO: 355460 - RNA, 64 nt, Homo Sapiens; identical to SEQ ID NO: 110977

SEQ ID NO: 355461 - RNA, 64 nt, Homo Sapiens; identical to SEQ ID NO: 110978

SEQ ID NO: 355462 - RNA, 64 nt, Homo Sapiens; identical to SEQ ID NO: 110979

SEQ ID NO: 355463 - RNA, 64 nt, Homo Sapiens; identical to SEQ ID NO: 110980

SEQ ID NO: 355464 - RNA, 64 nt, Homo Sapiens; identical to SEQ ID NO: 110917

SEQ ID NO: 355465 - RNA, 64 nt, Homo Sapiens; identical to SEQ ID NO: 110918

SEQ ID NO: 355466 - RNA, 64 nt, Homo Sapiens; identical to SEQ ID NO: 110919

SEQ ID NO: 355467 - RNA, 64 nt, Homo Sapiens; identical to SEQ ID NO: 110920

SEQ ID NO: 355468 - RNA, 64 nt, Homo Sapiens; identical to SEQ ID NO: 110921

SEQ ID NO: 355469 - RNA, 64 nt, Homo Sapiens; identical to SEQ ID NO: 110922

SEQ ID NO: 355470 - RNA, 64 nt, Homo Sapiens; identical to SEQ ID NO: 110923

SEQ ID NO: 355471 - RNA, 64 nt, Homo Sapiens; identical to SEQ ID NO: 110924

SEQ ID NO: 355472 - RNA, 64 nt, Homo Sapiens; identical to SEQ ID NO: 110925

SEQ ID NO: 355473 - RNA, 64 nt, Homo Sapiens; identical to SEQ ID NO: 110926

SEQ ID NO: 355474 - RNA, 64 nt, Homo Sapiens; identical to SEQ ID NO: 110927

SEQ ID NO: 355475 - RNA, 64 nt, Homo Sapiens; identical to SEQ ID NO: 110928

SEQ ID NO: 355476 - RNA, 61 nt, Homo Sapiens; identical to SEQ ID NO: 110929

SEQ ID NO: 355477 - RNA, 64 nt, Homo Sapiens; identical to SEQ ID NO: 110930

SEQ ID NO: 355478 - RNA, 64 nt, Homo Sapiens; identical to SEQ ID NO: 110931

SEQ ID NO: 355479 - RNA, 64 nt, Homo Sapiens; identical to SEQ ID NO: 110932

SEQ ID NO: 355480 - RNA, 64 nt, Homo Sapiens; identical to SEQ ID NO: 110933

SEQ ID NO: 355481 - RNA, 64 nt, Homo Sapiens; identical to SEQ ID NO: 110934

SEQ ID NO: 355482 - RNA, 64 nt, Homo Sapiens; identical to SEQ ID NO: 110935

SEQ ID NO: 355483 - RNA, 64 nt, Homo Sapiens; identical to SEQ ID NO: 110936

SEQ ID NO: 355484 - RNA, 64 nt, Homo Sapiens; identical to SEQ ID NO: 110937

SEQ ID NO: 355485 - RNA, 64 nt, Homo Sapiens; identical to SEQ ID NO: 110938

SEQ ID NO: 355486 - RNA, 64 nt, Homo Sapiens; identical to SEQ ID NO: 110939

SEQ ID NO: 355487 - RNA, 64 nt, Homo Sapiens; identical to SEQ ID NO: 110940

SEQ ID NO: 355488 - RNA, 64 nt, Homo Sapiens; identical to SEQ ID NO: 110941

SEQ ID NO: 355489 - RNA, 64 nt, Homo Sapiens; identical to SEQ ID NO: 110942

SEQ ID NO: 355490 - RNA, 64 nt, Homo Sapiens; identical to SEQ ID NO: 110943

SEQ ID NO: 355491 - RNA, 64 nt, Homo Sapiens; identical to SEQ ID NO: 110944

SEQ ID NO: 355492 - RNA, 64 nt, Homo Sapiens; identical to SEQ ID NO: 110945

SEQ ID NO: 355493 - RNA, 64 nt, Homo Sapiens; identical to SEQ ID NO: 110946

SEQ ID NO: 355494 - RNA, 64 nt, Homo Sapiens; identical to SEQ ID NO: 110947

SEQ ID NO: 355495 - RNA, 64 nt, Homo Sapiens; identical to SEQ ID NO: 110948

SEQ ID NO: 355496 - RNA, 64 nt, Homo Sapiens; identical to SEQ ID NO: 110949

SEQ ID NO: 355497 - RNA, 64 nt, Homo Sapiens; identical to SEQ ID NO: 110950

SEQ ID NO: 355498 - RNA, 64 nt, Homo Sapiens; identical to SEQ ID NO: 110951

SEQ ID NO: 355499 - RNA, 64 nt, Homo Sapiens; identical to SEQ ID NO: 110952

SEQ ID NO: 355500 - RNA, 64 nt, Homo Sapiens; identical to SEQ ID NO: 110953

SEQ ID NO: 355501 - RNA, 64 nt, Homo Sapiens; identical to SEQ ID NO: 110954

SEQ ID NO: 355502 - RNA, 64 nt, Homo Sapiens; identical to SEQ ID NO: 110955

SEQ ID NO: 355503 - RNA, 64 nt, Homo Sapiens; identical to SEQ ID NO: 110956

SEQ ID NO: 355504 - RNA, 64 nt, Homo Sapiens; identical to SEQ ID NO: 110957

SEQ ID NO: 355505 - RNA, 64 nt, Homo Sapiens; identical to SEQ ID NO: 110958

SEQ ID NO: 355506 - RNA, 64 nt, Homo Sapiens; identical to SEQ ID NO: 110959

SEQ ID NO: 355507 - RNA, 64 nt, Homo Sapiens; identical to SEQ ID NO: 110960

SEQ ID NO: 355508 - RNA, 64 nt, Homo Sapiens; identical to SEQ ID NO: 110961

SEQ ID NO: 355509 - RNA, 64 nt, Homo Sapiens; identical to SEQ ID NO: 110962

SEQ ID NO: 355510 - RNA, 64 nt, Homo Sapiens; identical to SEQ ID NO: 110963

SEQ ID NO: 355511 - RNA, 64 nt, Homo Sapiens; identical to SEQ ID NO: 110964

SEQ ID NO: 355512 - RNA, 64 nt, Homo Sapiens; identical to SEQ ID NO: 110965

SEQ ID NO: 355513 - RNA, 64 nt, Homo Sapiens; identical to SEQ ID NO: 110966

SEQ ID NO: 355514 - RNA, 64 nt, Homo Sapiens; identical to SEQ ID NO: 110967

SEQ ID NO: 355515 - RNA, 64 nt, Homo Sapiens; identical to SEQ ID NO: 110968

SEQ ID NO: 355516 - RNA, 64 nt, Homo Sapiens; identical to SEQ ID NO: 110969

SEQ ID NO: 355517 - RNA, 64 nt, Homo Sapiens; identical to SEQ ID NO: 110970

SEQ ID NO: 355518 - RNA, 64 nt, Homo Sapiens; identical to SEQ ID NO: 110971

SEQ ID NO: 355519 - RNA, 64 nt, Homo Sapiens; identical to SEQ ID NO: 110972

SEQ ID NO: 355520 - RNA, 64 nt, Homo Sapiens; identical to SEQ ID NO: 110973

SEQ ID NO: 355521 - RNA, 64 nt, Homo Sapiens; identical to SEQ ID NO: 110974

SEQ ID NO: 355522 - RNA, 64 nt, Homo Sapiens; identical to SEQ ID NO: 110975

SEQ ID NO: 355523 - RNA, 64 nt, Homo Sapiens; identical to SEQ ID NO: 110976

SEQ ID NO: 355524 - RNA, 64 nt, Homo Sapiens; identical to SEQ ID NO: 110977

SEQ ID NO: 355525 - RNA, 64 nt, Homo Sapiens; identical to SEQ ID NO: 110978

SEQ ID NO: 355526 - RNA, 64 nt, Homo Sapiens; identical to SEQ ID NO: 110979

SEQ ID NO: 355527 - RNA, 64 nt, Homo Sapiens; identical to SEQ ID NO: 110980

SEQ ID NO: 355528 - RNA, 64 nt, Homo Sapiens; identical to SEQ ID NO: 110917

SEQ ID NO: 355529 - RNA, 64 nt, Homo Sapiens; identical to SEQ ID NO: 110918

SEQ ID NO: 355530 - RNA, 64 nt, Homo Sapiens; identical to SEQ ID NO: 110919

SEQ ID NO: 355531 - RNA, 64 nt, Homo Sapiens; identical to SEQ ID NO: 110920

SEQ ID NO: 355532 - RNA, 64 nt, Homo Sapiens; identical to SEQ ID NO: 110921

SEQ ID NO: 355533 - RNA, 64 nt, Homo Sapiens; identical to SEQ ID NO: 110922

SEQ ID NO: 355534 - RNA, 64 nt, Homo Sapiens; identical to SEQ ID NO: 110923

SEQ ID NO: 355535 - RNA, 64 nt, Homo Sapiens; identical to SEQ ID NO: 110924

SEQ ID NO: 355536 - RNA, 64 nt, Homo Sapiens; identical to SEQ ID NO: 110925

SEQ ID NO: 355537 - RNA, 64 nt, Homo Sapiens; identical to SEQ ID NO: 110926

SEQ ID NO: 355538 - RNA, 64 nt, Homo Sapiens; identical to SEQ ID NO: 110927

SEQ ID NO: 355539 - RNA, 64 nt, Homo Sapiens; identical to SEQ ID NO: 110928

SEQ ID NO: 355540 - RNA, 61 nt, Homo Sapiens; identical to SEQ ID NO: 110929

SEQ ID NO: 355541 - RNA, 64 nt, Homo Sapiens; identical to SEQ ID NO: 110930

SEQ ID NO: 355542 - RNA, 64 nt, Homo Sapiens; identical to SEQ ID NO: 110931

SEQ ID NO: 355543 - RNA, 64 nt, Homo Sapiens; identical to SEQ ID NO: 110932

SEQ ID NO: 355544 - RNA, 64 nt, Homo Sapiens; identical to SEQ ID NO: 110933

SEQ ID NO: 355545 - RNA, 64 nt, Homo Sapiens; identical to SEQ ID NO: 110934

SEQ ID NO: 355546 - RNA, 64 nt, Homo Sapiens; identical to SEQ ID NO: 110935

SEQ ID NO: 355547 - RNA, 64 nt, Homo Sapiens; identical to SEQ ID NO: 110936

SEQ ID NO: 355548 - RNA, 64 nt, Homo Sapiens; identical to SEQ ID NO: 110937

SEQ ID NO: 355549 - RNA, 64 nt, Homo Sapiens; identical to SEQ ID NO: 110938

SEQ ID NO: 355550 - RNA, 64 nt, Homo Sapiens; identical to SEQ ID NO: 110939

SEQ ID NO: 355551 - RNA, 64 nt, Homo Sapiens; identical to SEQ ID NO: 110940

SEQ ID NO: 355552 - RNA, 64 nt, Homo Sapiens; identical to SEQ ID NO: 110941

SEQ ID NO: 355553 - RNA, 64 nt, Homo Sapiens; identical to SEQ ID NO: 110942

SEQ ID NO: 355554 - RNA, 64 nt, Homo Sapiens; identical to SEQ ID NO: 110943

SEQ ID NO: 355555 - RNA, 64 nt, Homo Sapiens; identical to SEQ ID NO: 110944

SEQ ID NO: 355556 - RNA, 64 nt, Homo Sapiens; identical to SEQ ID NO: 110945

SEQ ID NO: 355557 - RNA, 64 nt, Homo Sapiens; identical to SEQ ID NO: 110946

SEQ ID NO: 355558 - RNA, 64 nt, Homo Sapiens; identical to SEQ ID NO: 110947

SEQ ID NO: 355559 - RNA, 64 nt, Homo Sapiens; identical to SEQ ID NO: 110948

SEQ ID NO: 355560 - RNA, 64 nt, Homo Sapiens; identical to SEQ ID NO: 110949

SEQ ID NO: 355561 - RNA, 64 nt, Homo Sapiens; identical to SEQ ID NO: 110950

SEQ ID NO: 355562 - RNA, 64 nt, Homo Sapiens; identical to SEQ ID NO: 110951

SEQ ID NO: 355563 - RNA, 64 nt, Homo Sapiens; identical to SEQ ID NO: 110952

SEQ ID NO: 355564 - RNA, 64 nt, Homo Sapiens; identical to SEQ ID NO: 110953

SEQ ID NO: 355565 - RNA, 64 nt, Homo Sapiens; identical to SEQ ID NO: 110954

SEQ ID NO: 355566 - RNA, 64 nt, Homo Sapiens; identical to SEQ ID NO: 110955

SEQ ID NO: 355567 - RNA, 64 nt, Homo Sapiens; identical to SEQ ID NO: 110956

SEQ ID NO: 355568 - RNA, 64 nt, Homo Sapiens; identical to SEQ ID NO: 110957

SEQ ID NO: 355569 - RNA, 64 nt, Homo Sapiens; identical to SEQ ID NO: 110958

SEQ ID NO: 355570 - RNA, 64 nt, Homo Sapiens; identical to SEQ ID NO: 110959

SEQ ID NO: 355571 - RNA, 64 nt, Homo Sapiens; identical to SEQ ID NO: 110960

SEQ ID NO: 355572 - RNA, 64 nt, Homo Sapiens; identical to SEQ ID NO: 110961

SEQ ID NO: 355573 - RNA, 64 nt, Homo Sapiens; identical to SEQ ID NO: 110962

SEQ ID NO: 355574 - RNA, 64 nt, Homo Sapiens; identical to SEQ ID NO: 110963

SEQ ID NO: 355575 - RNA, 64 nt, Homo Sapiens; identical to SEQ ID NO: 110964

SEQ ID NO: 355576 - RNA, 64 nt, Homo Sapiens; identical to SEQ ID NO: 110965

SEQ ID NO: 355577 - RNA, 64 nt, Homo Sapiens; identical to SEQ ID NO: 110966

SEQ ID NO: 355578 - RNA, 64 nt, Homo Sapiens; identical to SEQ ID NO: 110967

SEQ ID NO: 355579 - RNA, 64 nt, Homo Sapiens; identical to SEQ ID NO: 110968

SEQ ID NO: 355580 - RNA, 64 nt, Homo Sapiens; identical to SEQ ID NO: 110969

SEQ ID NO: 355581 - RNA, 64 nt, Homo Sapiens; identical to SEQ ID NO: 110970

SEQ ID NO: 355582 - RNA, 64 nt, Homo Sapiens; identical to SEQ ID NO: 110971

SEQ ID NO: 355583 - RNA, 64 nt, Homo Sapiens; identical to SEQ ID NO: 110972

SEQ ID NO: 355584 - RNA, 64 nt, Homo Sapiens; identical to SEQ ID NO: 110973

SEQ ID NO: 355585 - RNA, 64 nt, Homo Sapiens; identical to SEQ ID NO: 110974

SEQ ID NO: 355586 - RNA, 64 nt, Homo Sapiens; identical to SEQ ID NO: 110975

SEQ ID NO: 355587 - RNA, 64 nt, Homo Sapiens; identical to SEQ ID NO: 110976

SEQ ID NO: 355588 - RNA, 64 nt, Homo Sapiens; identical to SEQ ID NO: 110977

SEQ ID NO: 355589 - RNA, 64 nt, Homo Sapiens; identical to SEQ ID NO: 110978

SEQ ID NO: 355590 - RNA, 64 nt, Homo Sapiens; identical to SEQ ID NO: 110979

SEQ ID NO: 355591 - RNA, 64 nt, Homo Sapiens; identical to SEQ ID NO: 110980

SEQ ID NO: 355592 - RNA, 64 nt, Homo Sapiens; identical to SEQ ID NO: 110917

SEQ ID NO: 355593 - RNA, 64 nt, Homo Sapiens; identical to SEQ ID NO: 110918

SEQ ID NO: 355594 - RNA, 64 nt, Homo Sapiens; identical to SEQ ID NO: 110919

SEQ ID NO: 355595 - RNA, 64 nt, Homo Sapiens; identical to SEQ ID NO: 110920

SEQ ID NO: 355596 - RNA, 64 nt, Homo Sapiens; identical to SEQ ID NO: 110921

SEQ ID NO: 355597 - RNA, 64 nt, Homo Sapiens; identical to SEQ ID NO: 110922

SEQ ID NO: 355598 - RNA, 64 nt, Homo Sapiens; identical to SEQ ID NO: 110923

SEQ ID NO: 355599 - RNA, 64 nt, Homo Sapiens; identical to SEQ ID NO: 110924

SEQ ID NO: 355600 - RNA, 64 nt, Homo Sapiens; identical to SEQ ID NO: 110925

SEQ ID NO: 355601 - RNA, 64 nt, Homo Sapiens; identical to SEQ ID NO: 110926

SEQ ID NO: 355602 - RNA, 64 nt, Homo Sapiens; identical to SEQ ID NO: 110927

SEQ ID NO: 355603 - RNA, 64 nt, Homo Sapiens; identical to SEQ ID NO: 110928

SEQ ID NO: 355604 - RNA, 61 nt, Homo Sapiens; identical to SEQ ID NO: 110929

SEQ ID NO: 355605 - RNA, 64 nt, Homo Sapiens; identical to SEQ ID NO: 110930

SEQ ID NO: 355606 - RNA, 64 nt, Homo Sapiens; identical to SEQ ID NO: 110931

SEQ ID NO: 355607 - RNA, 64 nt, Homo Sapiens; identical to SEQ ID NO: 110932

SEQ ID NO: 355608 - RNA, 64 nt, Homo Sapiens; identical to SEQ ID NO: 110933

SEQ ID NO: 355609 - RNA, 64 nt, Homo Sapiens; identical to SEQ ID NO: 110934

SEQ ID NO: 355610 - RNA, 64 nt, Homo Sapiens; identical to SEQ ID NO: 110935

SEQ ID NO: 355611 - RNA, 64 nt, Homo Sapiens; identical to SEQ ID NO: 110936

SEQ ID NO: 355612 - RNA, 64 nt, Homo Sapiens; identical to SEQ ID NO: 110937

SEQ ID NO: 355613 - RNA, 64 nt, Homo Sapiens; identical to SEQ ID NO: 110938

SEQ ID NO: 355614 - RNA, 64 nt, Homo Sapiens; identical to SEQ ID NO: 110939

SEQ ID NO: 355615 - RNA, 64 nt, Homo Sapiens; identical to SEQ ID NO: 110940

SEQ ID NO: 355616 - RNA, 64 nt, Homo Sapiens; identical to SEQ ID NO: 110941

SEQ ID NO: 355617 - RNA, 64 nt, Homo Sapiens; identical to SEQ ID NO: 110942

SEQ ID NO: 355618 - RNA, 64 nt, Homo Sapiens; identical to SEQ ID NO: 110943

SEQ ID NO: 355619 - RNA, 64 nt, Homo Sapiens; identical to SEQ ID NO: 110944

SEQ ID NO: 355620 - RNA, 64 nt, Homo Sapiens; identical to SEQ ID NO: 110945

SEQ ID NO: 355621 - RNA, 64 nt, Homo Sapiens; identical to SEQ ID NO: 110946

SEQ ID NO: 355622 - RNA, 64 nt, Homo Sapiens; identical to SEQ ID NO: 110947

SEQ ID NO: 355623 - RNA, 64 nt, Homo Sapiens; identical to SEQ ID NO: 110948

SEQ ID NO: 355624 - RNA, 64 nt, Homo Sapiens; identical to SEQ ID NO: 110949

SEQ ID NO: 355625 - RNA, 64 nt, Homo Sapiens; identical to SEQ ID NO: 110950

SEQ ID NO: 355626 - RNA, 64 nt, Homo Sapiens; identical to SEQ ID NO: 110951

SEQ ID NO: 355627 - RNA, 64 nt, Homo Sapiens; identical to SEQ ID NO: 110952

SEQ ID NO: 355628 - RNA, 64 nt, Homo Sapiens; identical to SEQ ID NO: 110953

SEQ ID NO: 355629 - RNA, 64 nt, Homo Sapiens; identical to SEQ ID NO: 110954

SEQ ID NO: 355630 - RNA, 64 nt, Homo Sapiens; identical to SEQ ID NO: 110955

SEQ ID NO: 355631 - RNA, 64 nt, Homo Sapiens; identical to SEQ ID NO: 110956

SEQ ID NO: 355632 - RNA, 64 nt, Homo Sapiens; identical to SEQ ID NO: 110957

SEQ ID NO: 355633 - RNA, 64 nt, Homo Sapiens; identical to SEQ ID NO: 110958

SEQ ID NO: 355634 - RNA, 64 nt, Homo Sapiens; identical to SEQ ID NO: 110959

SEQ ID NO: 355635 - RNA, 64 nt, Homo Sapiens; identical to SEQ ID NO: 110960

SEQ ID NO: 355636 - RNA, 64 nt, Homo Sapiens; identical to SEQ ID NO: 110961

SEQ ID NO: 355637 - RNA, 64 nt, Homo Sapiens; identical to SEQ ID NO: 110962

SEQ ID NO: 355638 - RNA, 64 nt, Homo Sapiens; identical to SEQ ID NO: 110963

SEQ ID NO: 355639 - RNA, 64 nt, Homo Sapiens; identical to SEQ ID NO: 110964

SEQ ID NO: 355640 - RNA, 64 nt, Homo Sapiens; identical to SEQ ID NO: 110965

SEQ ID NO: 355641 - RNA, 64 nt, Homo Sapiens; identical to SEQ ID NO: 110966

SEQ ID NO: 355642 - RNA, 64 nt, Homo Sapiens; identical to SEQ ID NO: 110967

SEQ ID NO: 355643 - RNA, 64 nt, Homo Sapiens; identical to SEQ ID NO: 110968

SEQ ID NO: 355644 - RNA, 64 nt, Homo Sapiens; identical to SEQ ID NO: 110969

SEQ ID NO: 355645 - RNA, 64 nt, Homo Sapiens; identical to SEQ ID NO: 110970

SEQ ID NO: 355646 - RNA, 64 nt, Homo Sapiens; identical to SEQ ID NO: 110971

SEQ ID NO: 355647 - RNA, 64 nt, Homo Sapiens; identical to SEQ ID NO: 110972

SEQ ID NO: 355648 - RNA, 64 nt, Homo Sapiens; identical to SEQ ID NO: 110973

SEQ ID NO: 355649 - RNA, 64 nt, Homo Sapiens; identical to SEQ ID NO: 110974

SEQ ID NO: 355650 - RNA, 64 nt, Homo Sapiens; identical to SEQ ID NO: 110975

SEQ ID NO: 355651 - RNA, 64 nt, Homo Sapiens; identical to SEQ ID NO: 110976

SEQ ID NO: 355652 - RNA, 64 nt, Homo Sapiens; identical to SEQ ID NO: 110977

SEQ ID NO: 355653 - RNA, 64 nt, Homo Sapiens; identical to SEQ ID NO: 110978

SEQ ID NO: 355654 - RNA, 64 nt, Homo Sapiens; identical to SEQ ID NO: 110979

SEQ ID NO: 355655 - RNA, 64 nt, Homo Sapiens; identical to SEQ ID NO: 110980

SEQ ID NO: 355656 - RNA, 64 nt, Homo Sapiens
auagaugagcguagcugagucaguuaaccuacacccaccugaauugggggugcugaugcauccu

SEQ ID NO: 355657 - RNA, 64 nt, Homo Sapiens
ucuccaaggacucggguuucaagaaucucucccaccaccugaaugccggguggggaugggcacc

SEQ ID NO: 355658 - RNA, 64 nt, Homo Sapiens
cgggccuccaacgagagcacgaggagaugcagggccaccugaagcuggccaccgagccauggug

SEQ ID NO: 355659 - RNA, 64 nt, Homo Sapiens
aaucuucgggauccaagaagaagcaaauggauuuccaccugacagcccuuccuuauaggccaaa

SEQ ID NO: 355660 - RNA, 64 nt, Homo Sapiens
ccagucugaaggucucuuagcuugcuuccuuaucccaccugaucuucacuccuuuaacaaaaac

SEQ ID NO: 355661 - RNA, 64 nt, Homo Sapiens
augcaacuaacacuugccuccuaacaccauuccuccaccugaugugucccccacccuauccccu

SEQ ID NO: 355662 - RNA, 64 nt, Homo Sapiens
ugcuccaagggagcguggucguggaagaaacaacccaccugaaggccaaaugccagagauuugg

SEQ ID NO: 355663 - RNA, 64 nt, Homo Sapiens
gccagagauuugggguuggggaaagggccccuccccaccugacacccacuggggugcacuuuaa

SEQ ID NO: 355664 - RNA, 64 nt, Homo Sapiens
gucugagauggcagggcacuugcccugguggcucccaccugaccccaggccuuuuauaggcagg

SEQ ID NO: 355665 - RNA, 64 nt, Homo Sapiens
ggguguacggguucuguuccucugagccugcggcccaccugauguuuacgugugugugugaggg

SEQ ID NO: 355666 - RNA, 64 nt, Homo Sapiens
cuuuguaaguaaacugcccugucuaggucaguacccaccugagcuuuggacgcacacagcuuuu

SEQ ID NO: 355667 - RNA, 64 nt, Homo Sapiens
caccugagcuuuggacgcacacagcuuuuaguacccaccugagcuuuggacacacacagcuucu

SEQ ID NO: 355668 - RNA, 64 nt, Homo Sapiens
uaaccaacucccucccguaacaggcuuuccugcuccaccugagaauccuggugugagaaucaac

SEQ ID NO: 355669 - RNA, 64 nt, Homo Sapiens
gauggaugagcugcuccaaacugccggaggacccccaccugagaggcgccacagaggaagcugc

SEQ ID NO: 355670 - RNA, 64 nt, Homo Sapiens
acuacuuuacuaucuauacuagaaauugcuuucuaggcauuaaugaaaacccauccaguucuuc

SEQ ID NO: 355671 - RNA, 64 nt, Homo Sapiens
aaugcauaccaugcuuucagaagacaggcagcagaggcauuaaagaugugguaagcggaaacag

SEQ ID NO: 355672 - RNA, 64 nt, Homo Sapiens
uauaguuuuaaauacauaaagaaauguuucaguuaggcauuaaccuugauagaaucacucaguu

SEQ ID NO: 355673 - RNA, 64 nt, Homo Sapiens
ugauaauugccuauguucuagguaacaggaaaacaggcauuaaguuuauuuuagucuucccauu

SEQ ID NO: 355674 - RNA, 64 nt, Homo Sapiens
uuccuauuacuaguguuugcagggaauuccagucaggcauuauuucaucuaaggaaaaaagaca

SEQ ID NO: 355675 - RNA, 64 nt, Homo Sapiens
uagaaucauuuuaaucacuuuuccaucuugacgaaggcauuauacucuuucuuccuccuugauu

SEQ ID NO: 355676 - RNA, 64 nt, Homo Sapiens
cgcccccacccgucggcagagcaaccccaccuccaggcauuauggcuccuccaccugguaugag

SEQ ID NO: 355677 - RNA, 64 nt, Homo Sapiens
gcaugccgccuccgggaaugagacccccuccaccaggcauuagaggugagugggagcauagggg

SEQ ID NO: 355678 - RNA, 64 nt, Homo Sapiens
aacuugaagaacugcugguguuacauguuccaaaaggcauuagaccuaucagcuuuguuucgcc

SEQ ID NO: 355679 - RNA, 64 nt, Homo Sapiens
caaauauauuaauuaucauuaaguauuaaauaauaggcauuagaugucuaaugugaguauaauu

SEQ ID NO: 355680 - RNA, 64 nt, Homo Sapiens
ucacaguucacagguaaccauguuguguucuucuaggcauuacuggccuuuucacugacaaguu

SEQ ID NO: 355681 - RNA, 64 nt, Homo Sapiens
gauaauugugcuuuacaacuugaaugcugauucaaggcauuauuuggaugugaguuuaaucuuu

SEQ ID NO: 355682 - RNA, 64 nt, Homo Sapiens
uuggaugauggcagaaacuucaugaaccagcccuuucucagagccagugaugugaguguaucag

SEQ ID NO: 355683 - RNA, 64 nt, Homo Sapiens
gcauaggccacgauaaaggaaggagagaaggggcuucucagacuuauuugcagaagggcccaga

SEQ ID NO: 355684 - RNA, 64 nt, Homo Sapiens
gucaccccaaauggagacacucgcagaccugcaguucucagaccgaaggugcugccuucauccu

SEQ ID NO: 355685 - RNA, 64 nt, Homo Sapiens
agaaaacgcuuuggaucugagcagaguagucaguuucucagacacucauuccauacugcaccgu

SEQ ID NO: 355686 - RNA, 64 nt, Homo Sapiens
gucacacaacacugaugugacuuuuauaugcuuuuucucagaucugguuucuaagaguuuuggg

SEQ ID NO: 355687 - RNA, 64 nt, Homo Sapiens
uacugucuauuaaaauucugauguuucugugaaauucucagaguguuuaauuguacucaauggu

SEQ ID NO: 355688 - RNA, 64 nt, Homo Sapiens
uccaaacugcuguacagagcgagggauggguaaauucucagauuaguuaacacaaucccaccau

SEQ ID NO: 355689 - RNA, 64 nt, Homo Sapiens
auuggaguuggcccaagaaaccucauagccucuguucucagagaacucucaggauacccaguuc

SEQ ID NO: 355690 - RNA, 64 nt, Homo Sapiens
gaauuaaagaacuugcuguuuuucaagcuccagcuucucagaaacuuucaacaauguucucuag

SEQ ID NO: 355691 - RNA, 64 nt, Homo Sapiens
aauuugaaucuguuuucuuagugaauagucgguuuucucagaaugaaaccugggacacgagucu

SEQ ID NO: 355692 - RNA, 64 nt, Homo Sapiens
caaauccuaaaauuccugucccaagccacccaaauucucagaucuuuucuggaacaaggcagaa

SEQ ID NO: 355693 - RNA, 64 nt, Homo Sapiens
cucccacagcugccuacaacagagucucccagccuucucagagagcuaaaaccagaaauuucca

SEQ ID NO: 355694 - RNA, 64 nt, Homo Sapiens
gaaggaaggauucaccaccuccaggaaaagugucuucucagaaacaaccagcugagaagguaau

SEQ ID NO: 355695 - RNA, 64 nt, Homo Sapiens
aaauaaaggagggaccaauaucugggacagugucuucucagaaacaaccagcugagaagguaau

SEQ ID NO: 355696 - RNA, 64 nt, Homo Sapiens
gaauaauggguggugggaaaucuggaacagugucuucucagaaacaaccagccucaaagguaau

SEQ ID NO: 355697 - RNA, 64 nt, Homo Sapiens
aaauaaaggauggacuacagugugggacagugucuucucagaaacaaccagccuugaagguaau

SEQ ID NO: 355698 - RNA, 64 nt, Homo Sapiens
aaauaaaggauggagaaaaaucugggacagugucuucucagaaacaaccagccuugaagguaau

SEQ ID NO: 355699 - RNA, 64 nt, Homo Sapiens
aaauaaaggauggagaaaaaucugggacagugucuucucagaaaccaccagccuugacgguaau

SEQ ID NO: 355700 - RNA, 64 nt, Homo Sapiens
gaaaaaaggauggagaaauaucuaggaaagugucuucucagaaaccaccaaccuugaagguaau

SEQ ID NO: 355701 - RNA, 64 nt, Homo Sapiens
aaaaaaaggauggagaaauaucuaggaaagugucuucucagaaaccaccagccuugaagguaau

SEQ ID NO: 355702 - RNA, 64 nt, Homo Sapiens
gauugauaauugcauucaucuagauugaaaacuuuucucagauguggaaaaaaugauguucauu

SEQ ID NO: 355703 - RNA, 64 nt, Homo Sapiens
cuuguuucaaacacaaaugcuuuuuugauaaaguuucucagauccaauuuuugccuucauuacc

SEQ ID NO: 355704 - RNA, 64 nt, Homo Sapiens
uuaauaucagcaaggugaacugggacauucuucuuucucagaagaagaaacaucuuguaaauug

SEQ ID NO: 355705 - RNA, 64 nt, Homo Sapiens
uaauuuaaaaauaauauauuuucgaaguaguagauucucagaucuuuauucuaacaauuacaug

SEQ ID NO: 355706 - RNA, 64 nt, Homo Sapiens
uagucugugcuaaauauuuugcugaagaagcaguuucucagacacaacaucucagaauuuuaau

SEQ ID NO: 355707 - RNA, 64 nt, Homo Sapiens
cuaccauacuguaaauaugagcuuuauggugucauucucagaaacuuacacauuucugcucucc

SEQ ID NO: 355708 - RNA, 64 nt, Homo Sapiens
aaaagucacagcuuaucccaggcacccuggcagguucucagagccugccuccucccuguuuaua

SEQ ID NO: 355709 - RNA, 64 nt, Homo Sapiens
agugagacuaucagcuaguuguggguggaguguguucucagaagguaugaaguagauguuuucc

SEQ ID NO: 355710 - RNA, 64 nt, Homo Sapiens
gcaacuuuauuuucuaauucaauuaaacaauuauuucucagagguggaaaaaaaauauaauaac

SEQ ID NO: 355711 - RNA, 64 nt, Homo Sapiens
agcagggcgugguggcacacuuuuacucauuuauuucucagaggucucacucacagggggugca

SEQ ID NO: 355712 - RNA, 64 nt, Homo Sapiens
gaggauuucacccugcaugggagagagcaggguuuucucagauuccuuuuuaaucucuauuuau

SEQ ID NO: 355713 - RNA, 64 nt, Homo Sapiens
ugaauauugaaaacaacaacuaaaaaaguggaccuucucagaaaaaaagggcagcaaaugacca

SEQ ID NO: 355714 - RNA, 64 nt, Homo Sapiens
cuuagauuuuuaaaaaagaauuaaaaugugggaguucucagaaagaaauaaacacaugagaaua

SEQ ID NO: 355715 - RNA, 64 nt, Homo Sapiens
aaaauaacgccugauguauagauuaguuagcaaauucucagaaaucccccacauaaaagccuua

SEQ ID NO: 355716 - RNA, 64 nt, Homo Sapiens
ucaaggagagugcagucaaccaguaaauugcagauucucagaauguuuauugacguacugauua

SEQ ID NO: 355717 - RNA, 64 nt, Homo Sapiens
guuauacucuaacaucuguauauuuuuaccaguauucucagaccacuucuaccaaaacauaaau

SEQ ID NO: 355718 - RNA, 64 nt, Homo Sapiens
ucaaggagagugcagucaaccaguaaacugcagauucucagaauguuuauugacguacugauua

SEQ ID NO: 355719 - RNA, 64 nt, Homo Sapiens; identical to SEQ ID NO: 355717

SEQ ID NO: 355720 - RNA, 64 nt, Homo Sapiens
aggagaggaggguuccucuuaggucagauggagguucucagagccaaguccucccucucuacug

SEQ ID NO: 355721 - RNA, 64 nt, Homo Sapiens
uugaaccuuuuuuuuugaaacagcagucccaguauucucagagcaugugucagaguguuguucc

SEQ ID NO: 355722 - RNA, 64 nt, Homo Sapiens
cugucaccccaauuucuccaagccagagguagcuuucucagagccccuuggugguucuguccuc

SEQ ID NO: 355723 - RNA, 64 nt, Homo Sapiens
aaaucauguuucuucucucucaucuuacuuuuucuucucagauuucucccuuccuagaacauuc

SEQ ID NO: 355724 - RNA, 64 nt, Homo Sapiens
ugcgggagccaggagagcaccggcccucaggcuuuucucagacaagaggcacgcccucccccag

SEQ ID NO: 355725 - RNA, 64 nt, Homo Sapiens
gggucugggaagauucagaagguggcugccuauguucucagagcuugcuuuccugagaagaugc

SEQ ID NO: 355726 - RNA, 64 nt, Homo Sapiens
acuuguauuuuuguagugcuggaccacuguaaacuucucagaugaauucucuccuacaguacug

SEQ ID NO: 355727 - RNA, 64 nt, Homo Sapiens
ugggucuuguuuuuugaugguaaaccuacccagcuucucagacuuguuaaauuuugauaccaug

SEQ ID NO: 355728 - RNA, 64 nt, Homo Sapiens
agaaauaaacccacagcuccagagaaggugaccauucucagaacuccagcuauucacucuccag

SEQ ID NO: 355729 - RNA, 64 nt, Homo Sapiens
cccagacgauuuccacuauucacagcauuuccuuuucucagaaggacucuuuauauuuccaugu

SEQ ID NO: 355730 - RNA, 64 nt, Homo Sapiens
auuguauucuauaguuuuuuuauguagucuacauuucucagauguauccccauucgguuuuauu

SEQ ID NO: 355731 - RNA, 64 nt, Homo Sapiens
cuacauuucucagauguauccccauucgguuuuauucucagaacuguuacuagacucaugacuu

SEQ ID NO: 355732 - RNA, 64 nt, Homo Sapiens
gucacacacgccccuuuuguguuuugguucaaguuucucagagccccucagagcuucuacaucu

SEQ ID NO: 355733 - RNA, 64 nt, Homo Sapiens
cuugauauuuuaagcauuuucccaugucaugaguuucucagaaacauguuuuuaacaauuguac

SEQ ID NO: 355734 - RNA, 64 nt, Homo Sapiens
gagcccuccacacuguggacaguauugauaggucuucucagauauguguccaggaugugccuga

SEQ ID NO: 355735 - RNA, 64 nt, Homo Sapiens
auccagggaggcccagguacgacucacacucacauucucagaggccaggcagguggugugugug

SEQ ID NO: 355736 - RNA, 64 nt, Homo Sapiens
guguccugaugacuauagugcagcuaacuuuuuguucucagauuuguagugcauaggugugugu

SEQ ID NO: 355737 - RNA, 64 nt, Homo Sapiens
cacaggcugacaccaaaguggcacaacugcacaguucucagauuucuuugcacagauugauuuu

SEQ ID NO: 355738 - RNA, 64 nt, Homo Sapiens
ugguguggaggcuguugauguuucuggugucaaguucucagaaguugcugccaccaacucuuua

SEQ ID NO: 355739 - RNA, 64 nt, Homo Sapiens
uuucuaaaguccaguacuuuguccagauuuuagauucucagaauaaauguuuuucacagauaga

SEQ ID NO: 355740 - RNA, 64 nt, Homo Sapiens
gcccaguguuuuugcaaagaaagaaccguccguguucucagaaacagauuucacaaauugugcu

SEQ ID NO: 355741 - RNA, 64 nt, Homo Sapiens
uggcugauuggaaggggacaaaguuagauggggguucucagaagaggcccucuuuuccaguagg

SEQ ID NO: 355742 - RNA, 56 nt, Homo Sapiens
ucgaugcccacuuguuguaguggguguucucagaucucuagcaucacgacccauca

SEQ ID NO: 355743 - RNA, 64 nt, Homo Sapiens
agucauuuuuuuucuuuuagcauuugauaugcauuucucagauuccaccaucuuuuugugcuuu

SEQ ID NO: 355744 - RNA, 64 nt, Homo Sapiens; identical to SEQ ID NO: 237274

SEQ ID NO: 355745 - RNA, 64 nt, Homo Sapiens; identical to SEQ ID NO: 237275

SEQ ID NO: 355746 - RNA, 64 nt, Homo Sapiens; identical to SEQ ID NO: 237276

SEQ ID NO: 355747 - RNA, 64 nt, Homo Sapiens; identical to SEQ ID NO: 237277

SEQ ID NO: 355748 - RNA, 64 nt, Homo Sapiens
gauucuuccacccucucacuuuccugccuguuccccacuccacaggagggagcugacguuggcu

SEQ ID NO: 355749 - RNA, 64 nt, Homo Sapiens
ccagguuaauuucuaucucugaucccuccccaacccacuccauauuugggucauggacaguaaa

SEQ ID NO: 355750 - RNA, 64 nt, Homo Sapiens
auuccaccucucuaaaagaagcucagcaguugggccacuccacuagucccuggcugccaaaacu

SEQ ID NO: 355751 - RNA, 64 nt, Homo Sapiens
gugccgaaggagcucugccacucuucaagccuccccacuccaccauuuguucuucaucuccugu

SEQ ID NO: 355752 - RNA, 64 nt, Homo Sapiens
cugggcgacagagcaagacuaagaucaugccacuccacuccagugguggcgguugcugugagcc

SEQ ID NO: 355753 - RNA, 64 nt, Homo Sapiens
ccagucugggcgacagagcagagccaagaucaugccacuccacuuaggagguggcgguugcugu

SEQ ID NO: 355754 - RNA, 64 nt, Homo Sapiens
cuaccugcccaccuggggcuccugugcccccuccccacuccagaggccacccuacaaguugucc

SEQ ID NO: 355755 - RNA, 64 nt, Homo Sapiens
gcgguagccacucuaggucguuggccuuccuugaccacuccauuuaauucucucugcuguuugg

SEQ ID NO: 355756 - RNA, 64 nt, Homo Sapiens
ccugacccuuccaccccgccucacucccuccgucccacuccacuccaggcugccggcaccugcc

SEQ ID NO: 355757 - RNA, 64 nt, Homo Sapiens
cccuuccaccccgccucacucccuccgucccacuccacuccaggcugccggcaccugccccauu

SEQ ID NO: 355758 - RNA, 64 nt, Homo Sapiens
gacuccagccugucccucuuagcacucuagcugcccacuccagggcagggacucgaaacccccu

SEQ ID NO: 355759 - RNA, 64 nt, Homo Sapiens
acccaccgcccaggucuuaacuuucuggcauccaccacuccaugucucuggaugugucacuugg

SEQ ID NO: 355760 - RNA, 64 nt, Homo Sapiens
gaaggggcucuccagaccccuuuuccaugaugacccacuccaagauauuauguguaaauugugu

SEQ ID NO: 355761 - RNA, 64 nt, Homo Sapiens
gcccgguggaauggauucuggccugguguggaaaccacuccauucucgugcccagcacaaguga

SEQ ID NO: 355762 - RNA, 64 nt, Homo Sapiens
cuacaagcagugggacuccugacugauaacuuccccacuccaccuugggccugggcagucugaa

SEQ ID NO: 355763 - RNA, 64 nt, Homo Sapiens
cugugcacacuuccaggccucccuggagagguguccacuccauccuucccuccguggcguaggg

SEQ ID NO: 355764 - RNA, 64 nt, Homo Sapiens
uuaaagacaaggggccaggagccaacaccagaggccacuccacaaccccagcgccagucagcaa

SEQ ID NO: 355765 - RNA, 64 nt, Homo Sapiens
gaggcccuggcugcugccacccacuccaggugggccacuccaagaagccacccaaacugccacu

SEQ ID NO: 355766 - RNA, 64 nt, Homo Sapiens
ugggccacuccaaggaggcccccaaacugccacuccacuccagggcaucuucgccuagaagcca

SEQ ID NO: 355767 - RNA, 64 nt, Homo Sapiens
ccaggugggccacuccaaggagccacccaaacugccacuccacuugggggcaucuucgccuaga

SEQ ID NO: 355768 - RNA, 64 nt, Homo Sapiens
gcauaguccaucccgcuaguccaucccgcuagccccacuccagggacucagacccaucuccaac

SEQ ID NO: 355769 - RNA, 64 nt, Homo Sapiens
acuaugccuuccuguccuuucuacucaaugguccccacuccaagaugaguugacacaaccccuu

SEQ ID NO: 355770 - RNA, 64 nt, Homo Sapiens
cuuucucuacucccugccuccccacccccaccuaccacuccauggaacccagaggaacccccac

SEQ ID NO: 355771 - RNA, 64 nt, Homo Sapiens
gcccaguccuucuccugccccccagacccccucgccacuccagccuucugcagggagugagcuc

SEQ ID NO: 355772 - RNA, 64 nt, Homo Sapiens
cugcuccaucggcacuaaugcuccacucggcgccccacuccaucggccccgcuccaucggcacu

SEQ ID NO: 355773 - RNA, 64 nt, Homo Sapiens
ccgcuccaucggcacuaaugccccacucggcgccccacuccaucagcacuaaugcuccacucca

SEQ ID NO: 355774 - RNA, 64 nt, Homo Sapiens
ccacucggcgccccacuccaucagcacuaaugcuccacuccauuggcacuaacgccccaacucc

SEQ ID NO: 355775 - RNA, 64 nt, Homo Sapiens
ggcacuaaugacccgcuccuuugacauuggugccccacuccaucagcacuaacgcccugcucca

SEQ ID NO: 355776 - RNA, 64 nt, Homo Sapiens
agcacuaacgcccugcuccaucggcacuggugucccacuccauugucacuaacguccggcucca

SEQ ID NO: 355777 - RNA, 64 nt, Homo Sapiens
cacaggggacgggaugaggagcgggaggguuccgccacuccaguuuucuccucugcuucuuugc

SEQ ID NO: 355778 - RNA, 64 nt, Homo Sapiens
ugcuucuuugccucccucagauagaaaacagcccccacuccaguccacuccugaccccucuccu

SEQ ID NO: 355779 - RNA, 64 nt, Homo Sapiens
cccuauauuucuguguauguagaccccugauuucccacuccacaucucagcucugaaggccgug

SEQ ID NO: 355780 - RNA, 64 nt, Homo Sapiens
cugggugagaaagcaagaccccgugauuucaccaccacuccagcgagguugaggcugcagugag

SEQ ID NO: 355781 - RNA, 62 nt, Homo Sapiens
uguucaacagcaacacauagccugacccuccuccacuccaccuccacccacuguccgccucu

SEQ ID NO: 355782 - RNA, 64 nt, Homo Sapiens
cagccccccccuugaaucugcagggagcaacucuccacuccauauuuauuuaaacaauuuuuuc

SEQ ID NO: 355783 - RNA, 64 nt, Homo Sapiens
aacccagagccacauuagaagagcuucgacccacccacuccaggggaaguuucuuccccgagug

SEQ ID NO: 355784 - RNA, 64 nt, Homo Sapiens
aacuugaacugcaggggcagguggccacugacagccacuccaggaugaacagauuuaaagacag

SEQ ID NO: 355785 - RNA, 64 nt, Homo Sapiens; identical to SEQ ID NO: 324845

SEQ ID NO: 355786 - RNA, 64 nt, Homo Sapiens; identical to SEQ ID NO: 324846

SEQ ID NO: 355787 - RNA, 64 nt, Homo Sapiens; identical to SEQ ID NO: 324847

SEQ ID NO: 355788 - RNA, 64 nt, Homo Sapiens; identical to SEQ ID NO: 324848

SEQ ID NO: 355789 - RNA, 64 nt, Homo Sapiens; identical to SEQ ID NO: 324849

SEQ ID NO: 355790 - RNA, 64 nt, Homo Sapiens; identical to SEQ ID NO: 324850

SEQ ID NO: 355791 - RNA, 64 nt, Homo Sapiens; identical to SEQ ID NO: 324851

SEQ ID NO: 355792 - RNA, 64 nt, Homo Sapiens; identical to SEQ ID NO: 324852

SEQ ID NO: 355793 - RNA, 64 nt, Homo Sapiens; identical to SEQ ID NO: 324853

SEQ ID NO: 355794 - RNA, 64 nt, Homo Sapiens; identical to SEQ ID NO: 324854

SEQ ID NO: 355795 - RNA, 64 nt, Homo Sapiens; identical to SEQ ID NO: 324855

SEQ ID NO: 355796 - RNA, 64 nt, Homo Sapiens; identical to SEQ ID NO: 324856

SEQ ID NO: 355797 - RNA, 64 nt, Homo Sapiens; identical to SEQ ID NO: 324857

SEQ ID NO: 355798 - RNA, 64 nt, Homo Sapiens; identical to SEQ ID NO: 324858

SEQ ID NO: 355799 - RNA, 64 nt, Homo Sapiens; identical to SEQ ID NO: 324859

SEQ ID NO: 355800 - RNA, 64 nt, Homo Sapiens; identical to SEQ ID NO: 324860

SEQ ID NO: 355801 - RNA, 64 nt, Homo Sapiens; identical to SEQ ID NO: 324861

SEQ ID NO: 355802 - RNA, 64 nt, Homo Sapiens; identical to SEQ ID NO: 324862

SEQ ID NO: 355803 - RNA, 64 nt, Homo Sapiens; identical to SEQ ID NO: 324863

SEQ ID NO: 355804 - RNA, 64 nt, Homo Sapiens; identical to SEQ ID NO: 324864

SEQ ID NO: 355805 - RNA, 64 nt, Homo Sapiens; identical to SEQ ID NO: 324865

SEQ ID NO: 355806 - RNA, 64 nt, Homo Sapiens; identical to SEQ ID NO: 324866

SEQ ID NO: 355807 - RNA, 64 nt, Homo Sapiens; identical to SEQ ID NO: 324867

SEQ ID NO: 355808 - RNA, 64 nt, Homo Sapiens; identical to SEQ ID NO: 324868

SEQ ID NO: 355809 - RNA, 64 nt, Homo Sapiens; identical to SEQ ID NO: 324869

SEQ ID NO: 355810 - RNA, 64 nt, Homo Sapiens; identical to SEQ ID NO: 324870

SEQ ID NO: 355811 - RNA, 64 nt, Homo Sapiens; identical to SEQ ID NO: 324871

SEQ ID NO: 355812 - RNA, 64 nt, Homo Sapiens; identical to SEQ ID NO: 324872

SEQ ID NO: 355813 - RNA, 64 nt, Homo Sapiens; identical to SEQ ID NO: 324873

SEQ ID NO: 355814 - RNA, 64 nt, Homo Sapiens; identical to SEQ ID NO: 324874

SEQ ID NO: 355815 - RNA, 64 nt, Homo Sapiens; identical to SEQ ID NO: 324875

SEQ ID NO: 355816 - RNA, 64 nt, Homo Sapiens; identical to SEQ ID NO: 324876

SEQ ID NO: 355817 - RNA, 64 nt, Homo Sapiens; identical to SEQ ID NO: 324877

SEQ ID NO: 355818 - RNA, 64 nt, Homo Sapiens; identical to SEQ ID NO: 324878

SEQ ID NO: 355819 - RNA, 64 nt, Homo Sapiens; identical to SEQ ID NO: 324879

SEQ ID NO: 355820 - RNA, 64 nt, Homo Sapiens; identical to SEQ ID NO: 324880

SEQ ID NO: 355821 - RNA, 64 nt, Homo Sapiens; identical to SEQ ID NO: 324881

SEQ ID NO: 355822 - RNA, 64 nt, Homo Sapiens; identical to SEQ ID NO: 324882

SEQ ID NO: 355823 - RNA, 64 nt, Homo Sapiens; identical to SEQ ID NO: 79909

SEQ ID NO: 355824 - RNA, 64 nt, Homo Sapiens; identical to SEQ ID NO: 79910

SEQ ID NO: 355825 - RNA, 64 nt, Homo Sapiens; identical to SEQ ID NO: 79911

SEQ ID NO: 355826 - RNA, 64 nt, Homo Sapiens; identical to SEQ ID NO: 79912

SEQ ID NO: 355827 - RNA, 64 nt, Homo Sapiens; identical to SEQ ID NO: 79913

SEQ ID NO: 355828 - RNA, 64 nt, Homo Sapiens; identical to SEQ ID NO: 79914

SEQ ID NO: 355829 - RNA, 64 nt, Homo Sapiens; identical to SEQ ID NO: 79915

SEQ ID NO: 355830 - RNA, 64 nt, Homo Sapiens; identical to SEQ ID NO: 79916

SEQ ID NO: 355831 - RNA, 64 nt, Homo Sapiens; identical to SEQ ID NO: 79917

SEQ ID NO: 355832 - RNA, 64 nt, Homo Sapiens; identical to SEQ ID NO: 79918

SEQ ID NO: 355833 - RNA, 64 nt, Homo Sapiens; identical to SEQ ID NO: 257521

SEQ ID NO: 355834 - RNA, 64 nt, Homo Sapiens; identical to SEQ ID NO: 257522

SEQ ID NO: 355835 - RNA, 64 nt, Homo Sapiens; identical to SEQ ID NO: 257523

SEQ ID NO: 355836 - RNA, 64 nt, Homo Sapiens; identical to SEQ ID NO: 257524

SEQ ID NO: 355837 - RNA, 64 nt, Homo Sapiens; identical to SEQ ID NO: 259226

SEQ ID NO: 355838 - RNA, 64 nt, Homo Sapiens; identical to SEQ ID NO: 259227

SEQ ID NO: 355839 - RNA, 64 nt, Homo Sapiens; identical to SEQ ID NO: 259228

SEQ ID NO: 355840 - RNA, 64 nt, Homo Sapiens; identical to SEQ ID NO: 259229

SEQ ID NO: 355841 - RNA, 64 nt, Homo Sapiens; identical to SEQ ID NO: 259230

SEQ ID NO: 355842 - RNA, 64 nt, Homo Sapiens; identical to SEQ ID NO: 259231

SEQ ID NO: 355843 - RNA, 64 nt, Homo Sapiens; identical to SEQ ID NO: 259232

SEQ ID NO: 355844 - RNA, 64 nt, Homo Sapiens; identical to SEQ ID NO: 259233

SEQ ID NO: 355845 - RNA, 64 nt, Homo Sapiens; identical to SEQ ID NO: 259234

SEQ ID NO: 355846 - RNA, 64 nt, Homo Sapiens; identical to SEQ ID NO: 259235

SEQ ID NO: 355847 - RNA, 64 nt, Homo Sapiens; identical to SEQ ID NO: 259236

SEQ ID NO: 355848 - RNA, 64 nt, Homo Sapiens; identical to SEQ ID NO: 259237

SEQ ID NO: 355849 - RNA, 64 nt, Homo Sapiens; identical to SEQ ID NO: 259238

SEQ ID NO: 355850 - RNA, 64 nt, Homo Sapiens; identical to SEQ ID NO: 259239

SEQ ID NO: 355851 - RNA, 64 nt, Homo Sapiens; identical to SEQ ID NO: 259240

SEQ ID NO: 355852 - RNA, 64 nt, Homo Sapiens; identical to SEQ ID NO: 259241

SEQ ID NO: 355853 - RNA, 64 nt, Homo Sapiens; identical to SEQ ID NO: 259242

SEQ ID NO: 355854 - RNA, 64 nt, Homo Sapiens; identical to SEQ ID NO: 259243

SEQ ID NO: 355855 - RNA, 64 nt, Homo Sapiens; identical to SEQ ID NO: 259244

SEQ ID NO: 355856 - RNA, 64 nt, Homo Sapiens; identical to SEQ ID NO: 259245

SEQ ID NO: 355857 - RNA, 64 nt, Homo Sapiens; identical to SEQ ID NO: 259246

SEQ ID NO: 355858 - RNA, 64 nt, Homo Sapiens; identical to SEQ ID NO: 259247

SEQ ID NO: 355859 - RNA, 64 nt, Homo Sapiens; identical to SEQ ID NO: 259248

SEQ ID NO: 355860 - RNA, 64 nt, Homo Sapiens; identical to SEQ ID NO: 259249

SEQ ID NO: 355861 - RNA, 64 nt, Homo Sapiens; identical to SEQ ID NO: 259250

SEQ ID NO: 355862 - RNA, 64 nt, Homo Sapiens; identical to SEQ ID NO: 259251

SEQ ID NO: 355863 - RNA, 64 nt, Homo Sapiens; identical to SEQ ID NO: 259252

SEQ ID NO: 355864 - RNA, 64 nt, Homo Sapiens; identical to SEQ ID NO: 259253

SEQ ID NO: 355865 - RNA, 64 nt, Homo Sapiens; identical to SEQ ID NO: 259254

SEQ ID NO: 355866 - RNA, 64 nt, Homo Sapiens; identical to SEQ ID NO: 259255

SEQ ID NO: 355867 - RNA, 64 nt, Homo Sapiens; identical to SEQ ID NO: 259256

SEQ ID NO: 355868 - RNA, 64 nt, Homo Sapiens; identical to SEQ ID NO: 259257

SEQ ID NO: 355869 - RNA, 64 nt, Homo Sapiens; identical to SEQ ID NO: 259258

SEQ ID NO: 355870 - RNA, 64 nt, Homo Sapiens; identical to SEQ ID NO: 259259

SEQ ID NO: 355871 - RNA, 64 nt, Homo Sapiens; identical to SEQ ID NO: 259260

SEQ ID NO: 355872 - RNA, 64 nt, Homo Sapiens; identical to SEQ ID NO: 259261

SEQ ID NO: 355873 - RNA, 64 nt, Homo Sapiens; identical to SEQ ID NO: 259262

SEQ ID NO: 355874 - RNA, 64 nt, Homo Sapiens; identical to SEQ ID NO: 259263

SEQ ID NO: 355875 - RNA, 64 nt, Homo Sapiens; identical to SEQ ID NO: 259264

SEQ ID NO: 355876 - RNA, 64 nt, Homo Sapiens; identical to SEQ ID NO: 259265

SEQ ID NO: 355877 - RNA, 64 nt, Homo Sapiens; identical to SEQ ID NO: 259266

SEQ ID NO: 355878 - RNA, 64 nt, Homo Sapiens; identical to SEQ ID NO: 259267

SEQ ID NO: 355879 - RNA, 64 nt, Homo Sapiens; identical to SEQ ID NO: 259268

SEQ ID NO: 355880 - RNA, 64 nt, Homo Sapiens; identical to SEQ ID NO: 259269

SEQ ID NO: 355881 - RNA, 64 nt, Homo Sapiens; identical to SEQ ID NO: 259270

SEQ ID NO: 355882 - RNA, 64 nt, Homo Sapiens; identical to SEQ ID NO: 259271

SEQ ID NO: 355883 - RNA, 64 nt, Homo Sapiens; identical to SEQ ID NO: 259272

SEQ ID NO: 355884 - RNA, 64 nt, Homo Sapiens; identical to SEQ ID NO: 259273

SEQ ID NO: 355885 - RNA, 64 nt, Homo Sapiens; identical to SEQ ID NO: 259274

SEQ ID NO: 355886 - RNA, 64 nt, Homo Sapiens; identical to SEQ ID NO: 259275

SEQ ID NO: 355887 - RNA, 64 nt, Homo Sapiens; identical to SEQ ID NO: 259276

SEQ ID NO: 355888 - RNA, 64 nt, Homo Sapiens; identical to SEQ ID NO: 259277

SEQ ID NO: 355889 - RNA, 64 nt, Homo Sapiens; identical to SEQ ID NO: 259278

SEQ ID NO: 355890 - RNA, 64 nt, Homo Sapiens; identical to SEQ ID NO: 259279

SEQ ID NO: 355891 - RNA, 64 nt, Homo Sapiens; identical to SEQ ID NO: 259280

SEQ ID NO: 355892 - RNA, 64 nt, Homo Sapiens; identical to SEQ ID NO: 259281

SEQ ID NO: 355893 - RNA, 64 nt, Homo Sapiens; identical to SEQ ID NO: 259282

SEQ ID NO: 355894 - RNA, 64 nt, Homo Sapiens; identical to SEQ ID NO: 259283

SEQ ID NO: 355895 - RNA, 64 nt, Homo Sapiens; identical to SEQ ID NO: 259284

SEQ ID NO: 355896 - RNA, 64 nt, Homo Sapiens; identical to SEQ ID NO: 259285

SEQ ID NO: 355897 - RNA, 64 nt, Homo Sapiens; identical to SEQ ID NO: 259286

SEQ ID NO: 355898 - RNA, 64 nt, Homo Sapiens; identical to SEQ ID NO: 259287

SEQ ID NO: 355899 - RNA, 64 nt, Homo Sapiens; identical to SEQ ID NO: 259288

SEQ ID NO: 355900 - RNA, 64 nt, Homo Sapiens; identical to SEQ ID NO: 259289

SEQ ID NO: 355901 - RNA, 64 nt, Homo Sapiens; identical to SEQ ID NO: 259290

SEQ ID NO: 355902 - RNA, 64 nt, Homo Sapiens; identical to SEQ ID NO: 259291

SEQ ID NO: 355903 - RNA, 64 nt, Homo Sapiens; identical to SEQ ID NO: 259292

SEQ ID NO: 355904 - RNA, 64 nt, Homo Sapiens; identical to SEQ ID NO: 259293

SEQ ID NO: 355905 - RNA, 64 nt, Homo Sapiens; identical to SEQ ID NO: 259294

SEQ ID NO: 355906 - RNA, 64 nt, Homo Sapiens; identical to SEQ ID NO: 259295

SEQ ID NO: 355907 - RNA, 64 nt, Homo Sapiens; identical to SEQ ID NO: 259296

SEQ ID NO: 355908 - RNA, 64 nt, Homo Sapiens; identical to SEQ ID NO: 259297

SEQ ID NO: 355909 - RNA, 64 nt, Homo Sapiens; identical to SEQ ID NO: 259298

SEQ ID NO: 355910 - RNA, 64 nt, Homo Sapiens; identical to SEQ ID NO: 259299

SEQ ID NO: 355911 - RNA, 64 nt, Homo Sapiens; identical to SEQ ID NO: 259300

SEQ ID NO: 355912 - RNA, 64 nt, Homo Sapiens; identical to SEQ ID NO: 259301

SEQ ID NO: 355913 - RNA, 64 nt, Homo Sapiens; identical to SEQ ID NO: 259302

SEQ ID NO: 355914 - RNA, 64 nt, Homo Sapiens; identical to SEQ ID NO: 259303

SEQ ID NO: 355915 - RNA, 64 nt, Homo Sapiens; identical to SEQ ID NO: 259304

SEQ ID NO: 355916 - RNA, 64 nt, Homo Sapiens; identical to SEQ ID NO: 259305

SEQ ID NO: 355917 - RNA, 64 nt, Homo Sapiens; identical to SEQ ID NO: 259306

SEQ ID NO: 355918 - RNA, 64 nt, Homo Sapiens; identical to SEQ ID NO: 259307

SEQ ID NO: 355919 - RNA, 64 nt, Homo Sapiens; identical to SEQ ID NO: 259308

SEQ ID NO: 355920 - RNA, 64 nt, Homo Sapiens; identical to SEQ ID NO: 259309

SEQ ID NO: 355921 - RNA, 64 nt, Homo Sapiens; identical to SEQ ID NO: 259310

SEQ ID NO: 355922 - RNA, 64 nt, Homo Sapiens; identical to SEQ ID NO: 259311

SEQ ID NO: 355923 - RNA, 64 nt, Homo Sapiens; identical to SEQ ID NO: 259312

SEQ ID NO: 355924 - RNA, 64 nt, Homo Sapiens; identical to SEQ ID NO: 259313

SEQ ID NO: 355925 - RNA, 64 nt, Homo Sapiens; identical to SEQ ID NO: 259314

SEQ ID NO: 355926 - RNA, 64 nt, Homo Sapiens; identical to SEQ ID NO: 259315

SEQ ID NO: 355927 - RNA, 64 nt, Homo Sapiens; identical to SEQ ID NO: 259316

SEQ ID NO: 355928 - RNA, 64 nt, Homo Sapiens; identical to SEQ ID NO: 259317

SEQ ID NO: 355929 - RNA, 64 nt, Homo Sapiens; identical to SEQ ID NO: 259318

SEQ ID NO: 355930 - RNA, 64 nt, Homo Sapiens; identical to SEQ ID NO: 259319

SEQ ID NO: 355931 - RNA, 64 nt, Homo Sapiens; identical to SEQ ID NO: 259320

SEQ ID NO: 355932 - RNA, 64 nt, Homo Sapiens; identical to SEQ ID NO: 259321

SEQ ID NO: 355933 - RNA, 64 nt, Homo Sapiens; identical to SEQ ID NO: 259322

SEQ ID NO: 355934 - RNA, 64 nt, Homo Sapiens; identical to SEQ ID NO: 259323

SEQ ID NO: 355935 - RNA, 64 nt, Homo Sapiens; identical to SEQ ID NO: 259324

SEQ ID NO: 355936 - RNA, 64 nt, Homo Sapiens; identical to SEQ ID NO: 259325

SEQ ID NO: 355937 - RNA, 64 nt, Homo Sapiens; identical to SEQ ID NO: 259326

SEQ ID NO: 355938 - RNA, 64 nt, Homo Sapiens; identical to SEQ ID NO: 259327

SEQ ID NO: 355939 - RNA, 64 nt, Homo Sapiens; identical to SEQ ID NO: 259328

SEQ ID NO: 355940 - RNA, 64 nt, Homo Sapiens; identical to SEQ ID NO: 259329

SEQ ID NO: 355941 - RNA, 64 nt, Homo Sapiens; identical to SEQ ID NO: 259330

SEQ ID NO: 355942 - RNA, 64 nt, Homo Sapiens; identical to SEQ ID NO: 259331

SEQ ID NO: 355943 - RNA, 64 nt, Homo Sapiens; identical to SEQ ID NO: 259332

SEQ ID NO: 355944 - RNA, 64 nt, Homo Sapiens; identical to SEQ ID NO: 259333

SEQ ID NO: 355945 - RNA, 64 nt, Homo Sapiens; identical to SEQ ID NO: 259334

SEQ ID NO: 355946 - RNA, 64 nt, Homo Sapiens; identical to SEQ ID NO: 259335

SEQ ID NO: 355947 - RNA, 64 nt, Homo Sapiens; identical to SEQ ID NO: 259336

SEQ ID NO: 355948 - RNA, 64 nt, Homo Sapiens; identical to SEQ ID NO: 259337

SEQ ID NO: 355949 - RNA, 64 nt, Homo Sapiens; identical to SEQ ID NO: 259338

SEQ ID NO: 355950 - RNA, 64 nt, Homo Sapiens; identical to SEQ ID NO: 259339

SEQ ID NO: 355951 - RNA, 64 nt, Homo Sapiens; identical to SEQ ID NO: 259340

SEQ ID NO: 355952 - RNA, 64 nt, Homo Sapiens; identical to SEQ ID NO: 259341

SEQ ID NO: 355953 - RNA, 64 nt, Homo Sapiens; identical to SEQ ID NO: 259342

SEQ ID NO: 355954 - RNA, 64 nt, Homo Sapiens; identical to SEQ ID NO: 259343

SEQ ID NO: 355955 - RNA, 64 nt, Homo Sapiens; identical to SEQ ID NO: 259344

SEQ ID NO: 355956 - RNA, 64 nt, Homo Sapiens; identical to SEQ ID NO: 259345

SEQ ID NO: 355957 - RNA, 64 nt, Homo Sapiens; identical to SEQ ID NO: 259346

SEQ ID NO: 355958 - RNA, 64 nt, Homo Sapiens; identical to SEQ ID NO: 259347

SEQ ID NO: 355959 - RNA, 64 nt, Homo Sapiens; identical to SEQ ID NO: 259348

SEQ ID NO: 355960 - RNA, 64 nt, Homo Sapiens; identical to SEQ ID NO: 259349

SEQ ID NO: 355961 - RNA, 64 nt, Homo Sapiens; identical to SEQ ID NO: 259350

SEQ ID NO: 355962 - RNA, 64 nt, Homo Sapiens; identical to SEQ ID NO: 259351

SEQ ID NO: 355963 - RNA, 64 nt, Homo Sapiens; identical to SEQ ID NO: 259352

SEQ ID NO: 355964 - RNA, 64 nt, Homo Sapiens; identical to SEQ ID NO: 259353

SEQ ID NO: 355965 - RNA, 61 nt, Homo Sapiens
uagaaauuugccuugcugcacaauggcagagucucuagaggggcacuaaauccuuuccuga

SEQ ID NO: 355966 - RNA, 61 nt, Homo Sapiens
uggaagcugagauucagagauucacuucuuuucucuagacuaucccauggaggugaggauu

SEQ ID NO: 355967 - RNA, 61 nt, Homo Sapiens
agcauugaccccccugaaucuguguggcucuucucuagaggguuccuggaccccccaguuc

SEQ ID NO: 355968 - RNA, 61 nt, Homo Sapiens
ugggaggauuguguguaacccucaugauuugucucuagaugcuagaauaagaggugagaau

SEQ ID NO: 355969 - RNA, 61 nt, Homo Sapiens
uucaaugucuuuguggacauuacuguaguauucucuagaacguuuucauugucaagaaugu

SEQ ID NO: 355970 - RNA, 61 nt, Homo Sapiens
guuuauccuaagcacuuguuaauauuccauuucucuagaauuaauuuuuaagcucuuugcc

SEQ ID NO: 355971 - RNA, 61 nt, Homo Sapiens
gauucaaugagugggaaauacauugugccuuucucuagaugugauacguuauaccaaaauc

SEQ ID NO: 355972 - RNA, 61 nt, Homo Sapiens
aggaaucaauaguuaguagugacauuggugcucucuagaaaucucagcaugagcugcuaua

SEQ ID NO: 355973 - RNA, 61 nt, Homo Sapiens
cugucuccuuuccuacaaggaggaauagaugucucuagacucaugcaaccaggugauuuuu

SEQ ID NO: 355974 - RNA, 61 nt, Homo Sapiens
aguuuuaugucauuuguaaaagaagccccuuucucuagagcuuaggaaaacaaaacugcuu

SEQ ID NO: 355975 - RNA, 61 nt, Homo Sapiens
agaauugcuaccucuuguauuuuugagaccaucucuagaaagugauuuugauguauucuaa

SEQ ID NO: 355976 - RNA, 61 nt, Homo Sapiens
ggagguuuucaaagugcaucagcuguccucuucucuagaguugugggugcuaacaccucag

SEQ ID NO: 355977 - RNA, 61 nt, Homo Sapiens
ccagcaggucacacugggggggcugaaguguucucuagaauggguuuucccuugccuuaug

SEQ ID NO: 355978 - RNA, 61 nt, Homo Sapiens
uuaguccuuacugucucacugugugcaaagaucucuagagucggaccucgggcuaguuaag

SEQ ID NO: 355979 - RNA, 61 nt, Homo Sapiens
uggguucuguucugugugggccuguggggagucucuagacaagaucuuuuccaggcccuga

SEQ ID NO: 355980 - RNA, 61 nt, Homo Sapiens
gagaggaaucuaagaaccagauggcuucagcucucuagaggagcugagccuauucacagug

SEQ ID NO: 355981 - RNA, 61 nt, Homo Sapiens
agaacccagcccagaucggaggacaaguuccucucuagaacccaauccaauuuggagcccc

SEQ ID NO: 355982 - RNA, 61 nt, Homo Sapiens
gagccccagcccaacuccagaacccaacccuucucuagaauccagcccagaucugaggcca

SEQ ID NO: 355983 - RNA, 64 nt, Homo Sapiens; identical to SEQ ID NO: 93643

SEQ ID NO: 355984 - RNA, 64 nt, Homo Sapiens; identical to SEQ ID NO: 93644

SEQ ID NO: 355985 - RNA, 64 nt, Homo Sapiens; identical to SEQ ID NO: 93645

SEQ ID NO: 355986 - RNA, 64 nt, Homo Sapiens; identical to SEQ ID NO: 93646

SEQ ID NO: 355987 - RNA, 64 nt, Homo Sapiens; identical to SEQ ID NO: 93647

SEQ ID NO: 355988 - RNA, 64 nt, Homo Sapiens; identical to SEQ ID NO: 93648

SEQ ID NO: 355989 - RNA, 64 nt, Homo Sapiens; identical to SEQ ID NO: 93649

SEQ ID NO: 355990 - RNA, 64 nt, Homo Sapiens; identical to SEQ ID NO: 93650

SEQ ID NO: 355991 - RNA, 64 nt, Homo Sapiens; identical to SEQ ID NO: 93651

SEQ ID NO: 355992 - RNA, 64 nt, Homo Sapiens; identical to SEQ ID NO: 93652

SEQ ID NO: 355993 - RNA, 64 nt, Homo Sapiens; identical to SEQ ID NO: 93653

SEQ ID NO: 355994 - RNA, 64 nt, Homo Sapiens; identical to SEQ ID NO: 93654

SEQ ID NO: 355995 - RNA, 64 nt, Homo Sapiens; identical to SEQ ID NO: 93655

SEQ ID NO: 355996 - RNA, 64 nt, Homo Sapiens; identical to SEQ ID NO: 93656

SEQ ID NO: 355997 - RNA, 64 nt, Homo Sapiens; identical to SEQ ID NO: 93657

SEQ ID NO: 355998 - RNA, 64 nt, Homo Sapiens; identical to SEQ ID NO: 93658

SEQ ID NO: 355999 - RNA, 64 nt, Homo Sapiens; identical to SEQ ID NO: 93659

SEQ ID NO: 356000 - RNA, 64 nt, Homo Sapiens; identical to SEQ ID NO: 93660

SEQ ID NO: 356001 - RNA, 64 nt, Homo Sapiens; identical to SEQ ID NO: 93661

SEQ ID NO: 356002 - RNA, 64 nt, Homo Sapiens; identical to SEQ ID NO: 93662

SEQ ID NO: 356003 - RNA, 64 nt, Homo Sapiens; identical to SEQ ID NO: 93663

SEQ ID NO: 356004 - RNA, 64 nt, Homo Sapiens; identical to SEQ ID NO: 93664

SEQ ID NO: 356005 - RNA, 64 nt, Homo Sapiens
cuacagucgcugaauaaccagaaaucaauuagaugccccgaaauaagagguguaaucuaaugaa

SEQ ID NO: 356006 - RNA, 64 nt, Homo Sapiens
aacgcccacccacgaaggcccagggcgccagacggccccgaaaaggcgcucggggagcguuuaa

SEQ ID NO: 356007 - RNA, 64 nt, Homo Sapiens
ugacauuagaugagagaacaauggccacaucugagccccgaaucccacuaacuggcuaauuagc

SEQ ID NO: 356008 - RNA, 64 nt, Homo Sapiens
ccaugggucucauacagcugccuuauugaaauaggccccgaacccccuaaaugcaaaaaauacu

SEQ ID NO: 356009 - RNA, 64 nt, Homo Sapiens
cucugaggaagaagggauaauagacacaucaaaugccccgaauuuagucacaccaucuuaaaug

SEQ ID NO: 356010 - RNA, 64 nt, Homo Sapiens
cuccuaauaggucaagagaggagaucaaacaccugccccgaagaaagggaugcuguuggcuuca

SEQ ID NO: 356011 - RNA, 64 nt, Homo Sapiens
uuucuuucuuucccccuuaaaaaaaaacacaucugccccgaacacuuucccacuguuauucuuu

SEQ ID NO: 356012 - RNA, 64 nt, Homo Sapiens
ucaccugaccucaacuaaccgaaggugguucgacgccccgaaccuccuaaagaguuauucaaau

SEQ ID NO: 356013 - RNA, 64 nt, Homo Sapiens
uucuggugcagcagccucuggggugcugggccucgccccgaagcccagagcugggccacacagu

SEQ ID NO: 356014 - RNA, 64 nt, Homo Sapiens
uccugccuucaccccauuggggauuugaaucacagccccgaaggccaggacaucuggccugagg

SEQ ID NO: 356015 - RNA, 52 nt, Homo Sapiens
cccauugagcagcacaaagcuggccccgaaucagccgcggcaucgcuucuga

SEQ ID NO: 356016 - RNA, 64 nt, Homo Sapiens
ugauaguguauaaggugcuuguugagcuaagcaagccccgaauuaauuuauugucauguaaaua

SEQ ID NO: 356017 - RNA, 64 nt, Homo Sapiens
agggccucucccuuuaguggagccagguugucgggccccgaaugucacugguggaucuaagaag

SEQ ID NO: 356018 - RNA, 64 nt, Homo Sapiens
ccuugaagaagugcccccugcccuaugcggcccagccccgaaugguccccgcccacccccaugg

SEQ ID NO: 356019 - RNA, 64 nt, Homo Sapiens
cuucacggcgucuccacugugcgauuggcccggagccccgaagacucggagggagcugcucagg

SEQ ID NO: 356020 - RNA, 64 nt, Homo Sapiens
uugagguggacucucaccaaagugagccacuccggccccgaaugccaugcgacacugggaggcc

SEQ ID NO: 356021 - RNA, 64 nt, Homo Sapiens
ccgcucaaugcucucgaugguggcacaaagagcagccccgaagcccugcccgcgccaggauguu

SEQ ID NO: 356022 - RNA, 64 nt, Homo Sapiens
aacugcaagugccugaggaccagaguggccucuagccccgaauugaacacuuuuaaaccuaaag

SEQ ID NO: 356023 - RNA, 64 nt, Homo Sapiens
uucggcccagcucgucccggccuccaccaagccagccccgaagcccgccagccacccugccgga

SEQ ID NO: 356024 - RNA, 64 nt, Homo Sapiens
aggguguaacuaggacauccucaagggcagcuaggccccgaauguacaauguuaagacagggaa

SEQ ID NO: 356025 - RNA, 64 nt, Homo Sapiens
acugcacccaggaggggaacacugcccucgcacggccccgaagggcccccacauuugugccgac

SEQ ID NO: 356026 - RNA, 64 nt, Homo Sapiens
auguuucuaucuuguaugucugugugccccuccugccccgaaagugcugacuauggggaaaucu

SEQ ID NO: 356027 - RNA, 64 nt, Homo Sapiens
uuccgucccucauccuaacugaaauaaaaacccugccccgaaucccuggaauacaugugguaau

SEQ ID NO: 356028 - RNA, 64 nt, Homo Sapiens
ggagaagguuguaggcauggaagagagccaggcagccccgaaagaagagccugggccacggcca

SEQ ID NO: 356029 - RNA, 64 nt, Homo Sapiens
ucucugccccucucucagccucagugucccgagggccccgaagcauuccauucucguggaggag

SEQ ID NO: 356030 - RNA, 64 nt, Homo Sapiens
auugcacagugaaagaauucuggauaucucaggagccccgaaauucuagcucugacuuugcugu

SEQ ID NO: 356031 - RNA, 64 nt, Homo Sapiens
cacgaggcugaggcauccgggcccugagcguccugccccgaauuacccgcugugcugaccaugg

SEQ ID NO: 356032 - RNA, 64 nt, Homo Sapiens
aggcucaugggagguuuggagagagagaugguuggccccgaauguuauuauuauuauuugcaau

SEQ ID NO: 356033 - RNA, 64 nt, Homo Sapiens
ggugugugaggggugaggaggcaucagcaguugagccccgaaggagaucaggcagccccaccug

SEQ ID NO: 356034 - RNA, 64 nt, Homo Sapiens
cagcugggaugaagagagauggcaugucaggcuggccccgaaucauagcucccugagagggcca

SEQ ID NO: 356035 - RNA, 64 nt, Homo Sapiens
acugggcucaagccuuccuccauggcucacugcagccccgaacucuggagugcaguggcacaau

SEQ ID NO: 356036 - RNA, 64 nt, Homo Sapiens
agccuccugaaaccaaaacgcccccgggggccccgccccgaagcgggccgccccccgcgcucgg

SEQ ID NO: 356037 - RNA, 64 nt, Homo Sapiens
guuuuuguuaaaaugcaucugagcaagucagccagccccgaaguccccucagugugugugucuc

SEQ ID NO: 356038 - RNA, 64 nt, Homo Sapiens
caucaccccagugguggcccuguggcagccuauggccccgaaccaaggacugccgcgccuccug

SEQ ID NO: 356039 - RNA, 64 nt, Homo Sapiens
caugccagaguacaaaacacauaguucuuuccccgccccgaaugugacaaugguuuucauagug

SEQ ID NO: 356040 - RNA, 64 nt, Homo Sapiens
uugcaucaaggcuccuuggugcuucucucugaacgccccgaacccagagaaccguucguguugg

SEQ ID NO: 356041 - RNA, 64 nt, Homo Sapiens
gaaggcccuccucccaggagguagggucuuggcugccccgaacuuaaaugcuuuugaaaucucu

SEQ ID NO: 356042 - RNA, 64 nt, Homo Sapiens
cuccugccccaggcuuccagucaccuccacucuagccccgaaccaccuggaggguuggacccac

SEQ ID NO: 356043 - RNA, 64 nt, Homo Sapiens
uagaaaaacaugaccagaaaucaaagaugucagagccccgaagcagcuaauguaauaagcacuc

SEQ ID NO: 356044 - RNA, 64 nt, Homo Sapiens
guggucgccaggcccaggaggggccuuagagcaggccccgaacuaucgccugacugagaacucu

SEQ ID NO: 356045 - RNA, 64 nt, Homo Sapiens
acagucuguuuaaguaagcuaaauguaucuuacugccccgaaaugagaggagacuggucuugaa

SEQ ID NO: 356046 - RNA, 64 nt, Homo Sapiens
ugucaacugcuuguuaauugauuuggggauguuugccccgaaugagagguugaggaaaagacug

SEQ ID NO: 356047 - RNA, 64 nt, Homo Sapiens
ucauggaaugcgguagagccaggggacccugucugccccgaauaacuuucaguaguauggcaga

SEQ ID NO: 356048 - RNA, 64 nt, Homo Sapiens
ccaccacccaaguguccagcgacuuacccagcgugccccgaaucccuccuuccuuccgcccuug

SEQ ID NO: 356049 - RNA, 64 nt, Homo Sapiens
gggcagcgugggguccuggcugguggaacugggagccccgaacccccucuccugcugucccucc

SEQ ID NO: 356050 - RNA, 64 nt, Homo Sapiens
gugggcgcucguguugugcgggcccugcuccucugccccgaaaccacuggcuggucccuucccu

SEQ ID NO: 356051 - RNA, 64 nt, Homo Sapiens
ccacccccgggaccagccaccagugccccugccagccccgaaucaauaaccacagggccugcag

SEQ ID NO: 356052 - RNA, 64 nt, Homo Sapiens
ucagcaccuucccccuaccccagagaacaauccagccccgaaugugcccaggacggccccgucc

SEQ ID NO: 356053 - RNA, 64 nt, Homo Sapiens
gcacuggucgucagggagcucaaccaccaccgaggccccgaaaauucuucuaggcaauuucuug

SEQ ID NO: 356054 - RNA, 64 nt, Homo Sapiens
ccugcagggcgggguaggggagggcaggggcugagccccgaagccagcucaguaccugaggggc

SEQ ID NO: 356055 - RNA, 64 nt, Homo Sapiens
cugaucuggacaaagucgggacagcaccaucccagccccgaagccagggccaugccagcaggcc

SEQ ID NO: 356056 - RNA, 64 nt, Homo Sapiens
uggagcucagcuauucggcgccuccgggccuucagccccgaacucagggagcccucugcccugu

SEQ ID NO: 356057 - RNA, 64 nt, Homo Sapiens
gggcccugucgcgcucccgccccgguccugcacagccccgaaguucgccgggcccggccacccu

SEQ ID NO: 356058 - RNA, 64 nt, Homo Sapiens
cacagagaagcccuauaaucacaggucugugguggccccgaaauggggggccugcuagucagga

SEQ ID NO: 356059 - RNA, 64 nt, Homo Sapiens
gggacucuggccggacggccaaugggcugccugggccccgaagccaagcccuuuccagcuccuc

SEQ ID NO: 356060 - RNA, 64 nt, Homo Sapiens
cgccacguggccuggggcagcaggucccaggccagccccgaagugggguccagggaauggagcu

SEQ ID NO: 356061 - RNA, 64 nt, Homo Sapiens
ggaucuugggcuaggugacaaguucuuggacuuugccccgaaagcacauccauaaaagacaaaa

SEQ ID NO: 356062 - RNA, 64 nt, Homo Sapiens
gucaccucacucagcaccaccgcgccccgcgcgcgccccgaaaguaaaggcugcccuccacacc

SEQ ID NO: 356063 - RNA, 64 nt, Homo Sapiens
uguuuuucuucucccucaguagaauuacccuuuugccccgaacacauuuggcauuccccacuug

SEQ ID NO: 356064 - RNA, 64 nt, Homo Sapiens; identical to SEQ ID NO: 104428

SEQ ID NO: 356065 - RNA, 64 nt, Homo Sapiens; identical to SEQ ID NO: 104429

SEQ ID NO: 356066 - RNA, 64 nt, Homo Sapiens; identical to SEQ ID NO: 104430

SEQ ID NO: 356067 - RNA, 64 nt, Homo Sapiens; identical to SEQ ID NO: 104431

SEQ ID NO: 356068 - RNA, 64 nt, Homo Sapiens; identical to SEQ ID NO: 104432

SEQ ID NO: 356069 - RNA, 64 nt, Homo Sapiens; identical to SEQ ID NO: 104433

SEQ ID NO: 356070 - RNA, 64 nt, Homo Sapiens; identical to SEQ ID NO: 104434

SEQ ID NO: 356071 - RNA, 64 nt, Homo Sapiens; identical to SEQ ID NO: 104435

SEQ ID NO: 356072 - RNA, 64 nt, Homo Sapiens; identical to SEQ ID NO: 104436

SEQ ID NO: 356073 - RNA, 64 nt, Homo Sapiens; identical to SEQ ID NO: 104437

SEQ ID NO: 356074 - RNA, 64 nt, Homo Sapiens; identical to SEQ ID NO: 104438

SEQ ID NO: 356075 - RNA, 64 nt, Homo Sapiens; identical to SEQ ID NO: 104439

SEQ ID NO: 356076 - RNA, 64 nt, Homo Sapiens; identical to SEQ ID NO: 104440

SEQ ID NO: 356077 - RNA, 64 nt, Homo Sapiens; identical to SEQ ID NO: 104441

SEQ ID NO: 356078 - RNA, 64 nt, Homo Sapiens; identical to SEQ ID NO: 104442

SEQ ID NO: 356079 - RNA, 64 nt, Homo Sapiens; identical to SEQ ID NO: 104443

SEQ ID NO: 356080 - RNA, 64 nt, Homo Sapiens; identical to SEQ ID NO: 104444

SEQ ID NO: 356081 - RNA, 64 nt, Homo Sapiens; identical to SEQ ID NO: 104445

SEQ ID NO: 356082 - RNA, 64 nt, Homo Sapiens; identical to SEQ ID NO: 104446

SEQ ID NO: 356083 - RNA, 64 nt, Homo Sapiens; identical to SEQ ID NO: 104447

SEQ ID NO: 356084 - RNA, 64 nt, Homo Sapiens; identical to SEQ ID NO: 104448

SEQ ID NO: 356085 - RNA, 64 nt, Homo Sapiens; identical to SEQ ID NO: 104449

SEQ ID NO: 356086 - RNA, 64 nt, Homo Sapiens; identical to SEQ ID NO: 104450

SEQ ID NO: 356087 - RNA, 64 nt, Homo Sapiens; identical to SEQ ID NO: 104451

SEQ ID NO: 356088 - RNA, 64 nt, Homo Sapiens
uguuaauuugcuuuuuaaaacaaauuuaauuaucacauuuuaaauuacuuuguggacuguguuu

SEQ ID NO: 356089 - RNA, 64 nt, Homo Sapiens
uuuaacuuuuuuacucuuauaaaaccaguuccugacauuuuaaaaaacaauaucuguaaaaugg

SEQ ID NO: 356090 - RNA, 64 nt, Homo Sapiens
caaagcugaucacuuccuauaaggacaaugguagacauuuuauaaagauguuuuuucacaagau

SEQ ID NO: 356091 - RNA, 64 nt, Homo Sapiens
acacuuaaccauuugugaagguuuucuuuagcuuacauuuuaaacauacacaauaaacacuaau

SEQ ID NO: 356092 - RNA, 64 nt, Homo Sapiens
uauauuuagaauuuuuaaacauguacaaagggcuacauuuuaauuuuaaaauagcuucacauua

SEQ ID NO: 356093 - RNA, 64 nt, Homo Sapiens
auauaacauauggauauuaaaaauggggaauugcacauuuuaccuuuuggacaguaauuucuau

SEQ ID NO: 356094 - RNA, 64 nt, Homo Sapiens
agucaguuuaaaacuucugaagugcugucuuuuuacauuuuacucugucccaguuugaaacuua

SEQ ID NO: 356095 - RNA, 64 nt, Homo Sapiens
ugcuguaacuucuuuuaaguaguugauguggaaaacauuuuaaagugaauuugucaaaaugcug

SEQ ID NO: 356096 - RNA, 64 nt, Homo Sapiens
auuuauuaauccucccugccugaucauccucuaaacauuuuaucauaaauauccuguauucuaa

SEQ ID NO: 356097 - RNA, 64 nt, Homo Sapiens
uugaaccacguaucucuggggagugaucagucggacauuuuaauaacugugcagcacaugccgg

SEQ ID NO: 356098 - RNA, 64 nt, Homo Sapiens
uucucuuuccuugcaauaccagcuauaaauaauaacauuuuauuucuauguaaaugauuuuguc

SEQ ID NO: 356099 - RNA, 64 nt, Homo Sapiens
auaaauacgugaaauugcuuugauucuucuauauacauuuuauagcuuagguauucauggaccu

SEQ ID NO: 356100 - RNA, 64 nt, Homo Sapiens
cauuuaaagucuuguuaauggagguuuuaauuaaacauuuuauaucuuaaagagaaaaucuuug

SEQ ID NO: 356101 - RNA, 64 nt, Homo Sapiens
uccgagacuuaacguuguguaaaaccaggcugaaacauuuuauucaacauacaggcauucuuuu

SEQ ID NO: 356102 - RNA, 64 nt, Homo Sapiens
aucuaauauauuuaauuucuugcaucuuucuaccacauuuuaaccuuuacuacuuugggaaagc

SEQ ID NO: 356103 - RNA, 64 nt, Homo Sapiens
ugcauauaucccuacaaauuauuuuaaacagagaacauuuuauuuuauauuaaaccagguaagu

SEQ ID NO: 356104 - RNA, 64 nt, Homo Sapiens
agaacauaacuccuauuaaaaguaaaagugaggcacauuuuacaaaacacuuuuuaaaaagugg

SEQ ID NO: 356105 - RNA, 64 nt, Homo Sapiens
uuguacaguauaguaaaaauacccuuuacuucugacauuuuaaggucacguccuauaguuuggg

SEQ ID NO: 356106 - RNA, 64 nt, Homo Sapiens
uaaaucucugaaacuugaacguaugaugcucuggacauuuuaggaagcuuaaguaaauuucuga

SEQ ID NO: 356107 - RNA, 64 nt, Homo Sapiens
uuugaaaauguuaaauugagaaaccuguuaacuuacauuuuaugaauuggcacauuguauuacu

SEQ ID NO: 356108 - RNA, 64 nt, Homo Sapiens
ugucuuuuuuucuaauuccguuuuguuuuaaagcacauuuuaaauguaguuuucucauuuagua

SEQ ID NO: 356109 - RNA, 64 nt, Homo Sapiens
uuuuuuuuuuccuuacagugagacauuuaagcacacauuuuauucacauagauacuauguccuu

SEQ ID NO: 356110 - RNA, 64 nt, Homo Sapiens
acuagcaaaguuaauuauguauggaauaaaguggacauuuuaaagauaucugguuaaguguuau

SEQ ID NO: 356111 - RNA, 64 nt, Homo Sapiens
aaccauuuacuauggcuuugcauaaaauaaaaguacauuuuauaccuauguaacagcagaguaa

SEQ ID NO: 356112 - RNA, 64 nt, Homo Sapiens
uauuuguacuaaaaugcucauauauaauauaaauacauuuuaauucuuccauuguguagauuuc

SEQ ID NO: 356113 - RNA, 64 nt, Homo Sapiens
aguaucuuccauuguguagaugugcuguagagcaacauuuuaguuucuauuuugucuaggguga

SEQ ID NO: 356114 - RNA, 64 nt, Homo Sapiens
uucuuguggcuagaaguagcuaaacugaucuguuacauuuuauguacucauauacccuuugucu

SEQ ID NO: 356115 - RNA, 64 nt, Homo Sapiens
cacccucaggcaguguuuuguagaagauugacacacauuuuauaguuauuauaacugaagaaua

SEQ ID NO: 356116 - RNA, 64 nt, Homo Sapiens
uauguggcucauuuuauauuuuuuaggucaaauaacauuuuauuuuuuuuuugcauucauuuaa

SEQ ID NO: 356117 - RNA, 64 nt, Homo Sapiens
aaggugcccgcacuaccauauaauuuauauuaauacauuuuaaaaaacuuuaaaaaacuauguc

SEQ ID NO: 356118 - RNA, 64 nt, Homo Sapiens
cuacauuuucuuagaaaauuagauauucagaauaacauuuuaaauaacaauauaauucuuuggc

SEQ ID NO: 356119 - RNA, 64 nt, Homo Sapiens
aaaaaggugaaaaucauuugagugcauuuauuguacauuuuaagugacagugaucaaaguuuuc

SEQ ID NO: 356120 - RNA, 64 nt, Homo Sapiens
augucaauaaauuugcuuuuacguuuguguggugacauuuuagaauaggaacugagguuuacau

SEQ ID NO: 356121 - RNA, 64 nt, Homo Sapiens
gcaaugguuucacaugguuaaaaagacaaaugcaacauuuuaagagaggaagaccuggagcaau

SEQ ID NO: 356122 - RNA, 64 nt, Homo Sapiens
gauuaagcuuuauauuugcuuauuuguuguagcuacauuuuaaaaaaaagauugaacuugauga

SEQ ID NO: 356123 - RNA, 64 nt, Homo Sapiens
gauauuggaauuuauuaaaagauuuuuguucaauacauuuuagauuaggauugacaaguaaaga

SEQ ID NO: 356124 - RNA, 64 nt, Homo Sapiens
caauauugaaguauccauagggcacaauuuucagacauuuuaguaucuguauauagugcauaua

SEQ ID NO: 356125 - RNA, 64 nt, Homo Sapiens
uugaguguuaacauaauaaaucauauacaguaugacauuuuaaggaaauaagucugcauugaug

SEQ ID NO: 356126 - RNA, 64 nt, Homo Sapiens
aacagacaugugcuaguaucugauaacauuaaguacauuuuaugucguuuaauauaauuauuua

SEQ ID NO: 356127 - RNA, 64 nt, Homo Sapiens
aaaugauuuugaaauuaaauauaauauagaauucacauuuuauauagcucucucaaaaauuaau

SEQ ID NO: 356128 - RNA, 64 nt, Homo Sapiens
aaaaauuaauuuuuauuccuuaagcauuuuaaaaacauuuuaaaaaauguuuuguaaauccagg

SEQ ID NO: 356129 - RNA, 64 nt, Homo Sapiens
guaaaguguauucuguacauaauuuacaaauaaaacauuuuauuuuaauuguuacuuauuauuu

SEQ ID NO: 356130 - RNA, 64 nt, Homo Sapiens
uucuaauugugaaaaauauguuuucuguaucgacacauuuuauuaaacuuggcuugauugcuuc

SEQ ID NO: 356131 - RNA, 64 nt, Homo Sapiens
cuguacguuacaaguuuggucauuuugaagcuugacauuuuaguuugccauuauguuaaaaaca

SEQ ID NO: 356132 - RNA, 64 nt, Homo Sapiens
aaggaugaaugccuguauuuggucuaggaacaguacauuuuagucugauuuagaauuacuggua

SEQ ID NO: 356133 - RNA, 64 nt, Homo Sapiens
cuauauuaaauaaauguuuaucucuuuauguauuacauuuuaacugacauuuguguucauuuuu

SEQ ID NO: 356134 - RNA, 64 nt, Homo Sapiens
guuucugguuugucauuuuuuuucacauguaaacacauuuuaguguaaaucaacgugaugauuc

SEQ ID NO: 356135 - RNA, 64 nt, Homo Sapiens
uucaauaagaacacuuuuuacagaauguuauuuuacauuuuaugguaauauuuauacuuguuuc

SEQ ID NO: 356136 - RNA, 64 nt, Homo Sapiens
uaaacaggaaaauacauuuguuugaagagagaauacauuuuauauucauaauaaaacggcuaua

SEQ ID NO: 356137 - RNA, 64 nt, Homo Sapiens
aacacuugaguagucugauuacaaugugaaguuuacauuuuauuccauggauuuauuuuacugc

SEQ ID NO: 356138 - RNA, 64 nt, Homo Sapiens
uauacugugaagacuuuguuuguuucuuuuuagaacauuuuauuuuauuaacagguugaauauu

SEQ ID NO: 356139 - RNA, 64 nt, Homo Sapiens
uuuugcccaucuaaagcacaucgucuuuccuacaacauuuuagcaauagugagguaguaguuag

SEQ ID NO: 356140 - RNA, 64 nt, Homo Sapiens
gcaaugcagauggauguuuggaugaacaacugauacauuuuaguuagaaugcuuuuucagcauu

SEQ ID NO: 356141 - RNA, 64 nt, Homo Sapiens
uguaaguuuuuaaaauuauccauuuguuacuuuaacauuuuaaaauuaugguguuuuccugauu

SEQ ID NO: 356142 - RNA, 64 nt, Homo Sapiens
gauuuuuaaaaauaacuaguguagcuuaucuuaaacauuuuauaaaaccuucagaugucuuuaa

SEQ ID NO: 356143 - RNA, 64 nt, Homo Sapiens
gcauuuucuuauauuaaaaaaugucugcaugauuacauuuuauuuccuuuguaauuuacauuuc

SEQ ID NO: 356144 - RNA, 64 nt, Homo Sapiens
uucuagccauaccucagauaauauguuuaguuuuacauuuuaaaauguuuaaauucucuuucac

SEQ ID NO: 356145 - RNA, 64 nt, Homo Sapiens
ccccuugcccucauucuugaacagcuggaggaauacauuuuauucuguccaugaagcauacacu

SEQ ID NO: 356146 - RNA, 64 nt, Homo Sapiens
augacuugcacuugugcauauacaugauuaauccacauuuuaaaacuagguauaaacauauauu

SEQ ID NO: 356147 - RNA, 64 nt, Homo Sapiens
gcugaaagauacugucgaaauccauagaaucaacacauuuuaaguuggcugucuuucuagguau

SEQ ID NO: 356148 - RNA, 64 nt, Homo Sapiens
aaucugcccuaugaguaucagaaaacagacuaugacauuuuaaaauauuuuuucauugauauuu

SEQ ID NO: 356149 - RNA, 64 nt, Homo Sapiens
auuaucuauggcuguuuuaaugccuacagauuuuacauuuuaaaugugaacuauaaaagcuuuu

SEQ ID NO: 356150 - RNA, 64 nt, Homo Sapiens
uccagauauuauuuaauucccauuagccaccuaaacauuuuaauauguggucaaauaauauagu

SEQ ID NO: 356151 - RNA, 64 nt, Homo Sapiens
uuggacuauggggacuucuacccauucuaugguuacauuuuauuucuuugacuaaaguuaucuc

SEQ ID NO: 356152 - RNA, 64 nt, Homo Sapiens
uuuuauuguuuuuuuuuuccucauaugcuggaccacauuuuagcuucuguuuuugagaagaguu

SEQ ID NO: 356153 - RNA, 64 nt, Homo Sapiens
uuccugaaugaccuuuucauaaacuuugcgguucacauuuuaaagcuguuuggaaguccuggug

SEQ ID NO: 356154 - RNA, 64 nt, Homo Sapiens
uucccugguaaagaggauucguaagcuuaaagggacauuuuauugucuucuucccuaauaguuu

SEQ ID NO: 356155 - RNA, 64 nt, Homo Sapiens
uauuuuugagucuucuucccuuucacuuuguagcacauuuuaguuucuuguaagaaaaaaacau

SEQ ID NO: 356156 - RNA, 64 nt, Homo Sapiens
gcauuacuuugcuaauaaucaacugugugaagauacauuuuaagcaaguuuauacuaaaauuuc

SEQ ID NO: 356157 - RNA, 64 nt, Homo Sapiens
cucauggaugugaugcacugcacauaagugccauacauuuuaucaauuguuaguauuagucuca

SEQ ID NO: 356158 - RNA, 64 nt, Homo Sapiens
auuguuccauggcuggaaguucccuuuagauuucacauuuuauauggcugaucaauuuucauac

SEQ ID NO: 356159 - RNA, 64 nt, Homo Sapiens
gcagaaaaaugugagcucuccugguaaauaguauacauuuuauaagcuauauuuuaaaggccua

SEQ ID NO: 356160 - RNA, 64 nt, Homo Sapiens
cuuuauuuguguaguuuuuaggugguuuuauauaacauuuuaauuacuugugauuuagauguau

SEQ ID NO: 356161 - RNA, 64 nt, Homo Sapiens
aguagccauauguaacgggauuuuaaaaauauauacauuuuacaacauggacuagaaaaggacc

SEQ ID NO: 356162 - RNA, 64 nt, Homo Sapiens
cagguacugucuacaauggcugugcauaccuauaacauuuuagguauuucauauugaauuaugc

SEQ ID NO: 356163 - RNA, 64 nt, Homo Sapiens
uuuccauauacaaguauguuugaguuccaaucuuacauuuuauaccaaguucaaaacacuuuca

SEQ ID NO: 356164 - RNA, 64 nt, Homo Sapiens
auaguaaauaagacucugacuuuacacaagcuacacauuuuauacuuuucauaaaccacaaagu

SEQ ID NO: 356165 - RNA, 64 nt, Homo Sapiens
ggcccaacaguuuguacuucaugaaacauauuguacauuuuacauaguuuaauuuaaaaaauac

SEQ ID NO: 356166 - RNA, 64 nt, Homo Sapiens
aucaaaacuaaaguguuuuuuaacgaauuaauaaacauuuuaauauguuugggaaacauuuuaa

SEQ ID NO: 356167 - RNA, 64 nt, Homo Sapiens
aacgaauuaauaaacauuuucauauguuugggaaacauuuuaauuauaaaauggagacggcuuu

SEQ ID NO: 356168 - RNA, 64 nt, Homo Sapiens
agaaacuuuaaaauguaaaaguuguacacuuucaacauuuuauuacgauuauuauucagcagca

SEQ ID NO: 356169 - RNA, 64 nt, Homo Sapiens
aaaauaauagagcuugagcugucugaacuauuuuacauuuuauggugucucauagccaauccca

SEQ ID NO: 356170 - RNA, 64 nt, Homo Sapiens
aaaggcagacaguuuugcuuuaguacaauaguauacauuuuauaaugaugaacuuauaaugauu

SEQ ID NO: 356171 - RNA, 64 nt, Homo Sapiens
ucacuuuacuuucaaguaauauuggugcuauuuaacauuuuacaguaaauguuacuucugauac

SEQ ID NO: 356172 - RNA, 64 nt, Homo Sapiens
uuaaagauaacucagcauguuuguaaagcaggauacauuuuacuaaaagguucauugguuccaa

SEQ ID NO: 356173 - RNA, 64 nt, Homo Sapiens
aauuuuguuaggccacaaaaacacugcacugugaacauuuuagaaaagguaugucagacuggga

SEQ ID NO: 356174 - RNA, 64 nt, Homo Sapiens
uauagauuuagaggggaaacguacguucugcaaaacauuuuauggugaaauuccuaccguuguu

SEQ ID NO: 356175 - RNA, 64 nt, Homo Sapiens
acacugcguuagaugguaauuuuaagugaucguuacauuuuagguuacugaaaucuuguaagua

SEQ ID NO: 356176 - RNA, 64 nt, Homo Sapiens
acuuuguuauauauaucaaggauguucuggcuuuacauuuuauuuauuagcuguaaauacaugu

SEQ ID NO: 356177 - RNA, 64 nt, Homo Sapiens
gaagaaauggaaucagcuuuuaauaaaauugacaacauuuuauuaccacacuaagucauuauuu

SEQ ID NO: 356178 - RNA, 64 nt, Homo Sapiens
aagcuuuguuggagaaagagaauaugaaaauuacacauuuuauaauuuuuagaugagaaaauac

SEQ ID NO: 356179 - RNA, 64 nt, Homo Sapiens
auauuuucaaucacauacaaguacauagaauuucacauuuuaauuuagcaaauugauuuaccua

SEQ ID NO: 356180 - RNA, 64 nt, Homo Sapiens
acuuggccuagaaaaguuuggucugcacuauaaaacauuuuacuuauuuuccuacauagaacau

SEQ ID NO: 356181 - RNA, 64 nt, Homo Sapiens
aaccaaauaaguauauuuagaacuuguuaaaaauacauuuuaauuuaugauauacauauuauuu

SEQ ID NO: 356182 - RNA, 64 nt, Homo Sapiens
gcaguucuuuuuuuuuguuauuuauuuuaaauauacauuuuaaaugggauugaguuaaaacuau

SEQ ID NO: 356183 - RNA, 64 nt, Homo Sapiens
uauauuccuucaagugaguuagccccugcagcccacauuuuaaguauccccuuccccacguucc

SEQ ID NO: 356184 - RNA, 64 nt, Homo Sapiens
uaucaugcaucgauugguggggaaugguaguacuacauuuuauucggguaauauuccauuguau

SEQ ID NO: 356185 - RNA, 64 nt, Homo Sapiens
caaaucaugacucacacguaguucacaaaagcugacauuuuaaaccuucugcccauccccuuca

SEQ ID NO: 356186 - RNA, 64 nt, Homo Sapiens
gauuugaaaaauaacugacaugguggaugacuguacauuuuaguuagguucuuucuuaaauugu

SEQ ID NO: 356187 - RNA, 64 nt, Homo Sapiens
guagaacucaucuaaaaaugcuucacaaucuugaacauuuuacauuguucuggguuuugguuuu

SEQ ID NO: 356188 - RNA, 64 nt, Homo Sapiens
uuacgugaagcaugugauuaguaugugcagcuuuacauuuuauuccacuguuaaaaccacaugu

SEQ ID NO: 356189 - RNA, 64 nt, Homo Sapiens
ccacugagugguaaaaaggaucacguuuuauuggacauuuuaccacgaucgcauaugcugcauu

SEQ ID NO: 356190 - RNA, 64 nt, Homo Sapiens
uuacggcuuuaaagcaaagggcgauugcucaaggacauuuuauguauuaacauugaacacugcu

SEQ ID NO: 356191 - RNA, 64 nt, Homo Sapiens
cuuaguuucccuuuugauuuaauuuucuuucugcacauuuuaauuuuaauuuguaaauauugac

SEQ ID NO: 356192 - RNA, 64 nt, Homo Sapiens
gcaaaugacuaguaaacaugugggaaaaaauauuacauuuuaagggggaaaaaaaaacccacca

SEQ ID NO: 356193 - RNA, 64 nt, Homo Sapiens
aacugaaaguuuaacuauuuaaaagacuaaaugcacauuuuaugguaucugauauuuuaaaaag

SEQ ID NO: 356194 - RNA, 64 nt, Homo Sapiens
uaucagaucaccugucaggguagucacuuacuugacauuuuaguuguauacacuaucugccagu

SEQ ID NO: 356195 - RNA, 64 nt, Homo Sapiens
cugcacccgauucugaguagaauaaacaauuccuacauuuuaaaaguuauuaaauggauccaga

SEQ ID NO: 356196 - RNA, 64 nt, Homo Sapiens
ucccucuuuacagacacuaauguguuuaaaauacacauuuuaaaaaugcacucagcucaacugc

SEQ ID NO: 356197 - RNA, 64 nt, Homo Sapiens
cuuuuauaccuuuaucuucuggguuuacuauugcacauuuuaagauagaaaaagaaaaaaggcu

SEQ ID NO: 356198 - RNA, 64 nt, Homo Sapiens
auguuuccagaaaugacugauauuuuauauuuauacauuuuagaugacaaagcuugauauuuau

SEQ ID NO: 356199 - RNA, 64 nt, Homo Sapiens
uuagaugacaaagcuugauauuuauugcuguugcacauuuuaaaguuuucuuuuuggguugcuc

SEQ ID NO: 356200 - RNA, 64 nt, Homo Sapiens
ugauuuguuacuauaauuaaccuguauaaaagauacauuuuauggugguuucaguaggucauuu

SEQ ID NO: 356201 - RNA, 64 nt, Homo Sapiens
guugcuuagaauaaucauuacuguuauaugagaaacauuuuaguaauuuaauaaaaggauaaug

SEQ ID NO: 356202 - RNA, 64 nt, Homo Sapiens
uguaauaagauaacugacucccugggacuuguuuacauuuuaucuaccucccauguguggacau

SEQ ID NO: 356203 - RNA, 64 nt, Homo Sapiens
caaacuuuuauagacaaauugauaccuauucgaaacauuuuauauguaacucucugggugacau

SEQ ID NO: 356204 - RNA, 64 nt, Homo Sapiens
aacuggaaauuuuuuaaagacuguuuugccuuauacauuuuagacaauauuuugacucuauuac

SEQ ID NO: 356205 - RNA, 64 nt, Homo Sapiens
caaaaaugcacacuccaguauuuaaaauguauauacauuuuagaaguauccuaugccuauacac

SEQ ID NO: 356206 - RNA, 64 nt, Homo Sapiens
uguauuuauuugacuucauuccguauuugaaagcacauuuuaauuuuuauuugccuuguuuugu

SEQ ID NO: 356207 - RNA, 64 nt, Homo Sapiens
guugguuauuuuuaauaagccucuuccuacuagaacauuuuauuuuccuuguucaccauacaau

SEQ ID NO: 356208 - RNA, 64 nt, Homo Sapiens
aucuauuuuauacuuaccauagacuuaagaaauaacauuuuaaaaaauuguaaagauugacaau

SEQ ID NO: 356209 - RNA, 64 nt, Homo Sapiens
uagaagauccagguuuuagugccuggccaaaacaacauuuuaaguuacaggcgugagccaccgc

SEQ ID NO: 356210 - RNA, 64 nt, Homo Sapiens
ggguuucccuugcccuuuccaaggauaauggugaacauuuuaauucaguucuguguacauuuua

SEQ ID NO: 356211 - RNA, 64 nt, Homo Sapiens
ggauaauggugaacauuuuauuucaguucuguguacauuuuaaaugacaaauguguaugugugg

SEQ ID NO: 356212 - RNA, 64 nt, Homo Sapiens
ccaaaggagaagacaguaagaacagacauaagggacauuuuaguuugggcuaguguccugccuc

SEQ ID NO: 356213 - RNA, 64 nt, Homo Sapiens
ucuccacuggaaagguggaauugaaaugugguccacauuuuaacuagcuauuuccuggggcugu

SEQ ID NO: 356214 - RNA, 64 nt, Homo Sapiens
gcuaacucauuuucuuugaguuaaagcuguguauacauuuuaaaaggcauauagauaguguaug

SEQ ID NO: 356215 - RNA, 64 nt, Homo Sapiens
cuaacaguacgcacugaauagugaaaauaauuagacauuuuaagaaccagagccauagaauuau

SEQ ID NO: 356216 - RNA, 64 nt, Homo Sapiens
acaacugucacuuuguuucggguaauuuuaguagacauuuuauauauacguaguaaugcuagca

SEQ ID NO: 356217 - RNA, 64 nt, Homo Sapiens
cuuugcaucuccaaauuuauuauuugccaucaacacauuuuauauaugagaaaugagaauuauu

SEQ ID NO: 356218 - RNA, 64 nt, Homo Sapiens
ucaaacuaacaaauguauacuuugaagaauaacuacauuuuauuacauucaucaguuggugagu

SEQ ID NO: 356219 - RNA, 64 nt, Homo Sapiens
guauauuguucuaacaaucauauagaaaaaaauaacauuuuaauauaaacaguaccaauaucau

SEQ ID NO: 356220 - RNA, 64 nt, Homo Sapiens
gcauauaauaaagaagcuacuauuuuggaaaaugacauuuuacuauuugccaauguauauugca

SEQ ID NO: 356221 - RNA, 64 nt, Homo Sapiens
aauugcaccagaaauguuuauggaaauauuaagaacauuuuauaaaacauacgaaaaagugauu

SEQ ID NO: 356222 - RNA, 64 nt, Homo Sapiens
aagugaaaauauaacuuuauuuuuuaacucuauuacauuuuauuuugucauguacuaaaauuau

SEQ ID NO: 356223 - RNA, 64 nt, Homo Sapiens
agaaugaccugucacuauaauauacuguauguuuacauuuuauuuaaauuuaaucucuuaugua

SEQ ID NO: 356224 - RNA, 64 nt, Homo Sapiens
gaaacuaugccacagucuggauguguuuacugaaacauuuuaauaaggaaguuuauuuuugaua

SEQ ID NO: 356225 - RNA, 64 nt, Homo Sapiens
uuacuguguauuuuucacuuguuucuaagaucaaacauuuuaauaugugcauguuauauauaaa

SEQ ID NO: 356226 - RNA, 64 nt, Homo Sapiens
cuuuguuggcuauggucuguugugaagugcuagaacauuuuagaaggagucaaaaaaccuuuuc

SEQ ID NO: 356227 - RNA, 64 nt, Homo Sapiens
uggcuuauucaauuucuaaaaggguugccuuaaaacauuuuacucuucaggaauauuuugggau

SEQ ID NO: 356228 - RNA, 64 nt, Homo Sapiens
aauuucagacaucugcauuuuguuacuuuuaaguacauuuuaauccuaagugugugauacaguu

SEQ ID NO: 356229 - RNA, 64 nt, Homo Sapiens
uuacuuucauaugaauaaaaauuuaaguuagguaacauuuuauauuaaaccgauauuuuauauu

SEQ ID NO: 356230 - RNA, 64 nt, Homo Sapiens
gucuucaguuacacauacacaaaauguaaacuugacauuuuaggauucucuaugcauuuaaaaa

SEQ ID NO: 356231 - RNA, 64 nt, Homo Sapiens
ucuuggcugcacaagauauccauuacguacuuauacauuuuaaaaugaguacuaauuuucacug

SEQ ID NO: 356232 - RNA, 64 nt, Homo Sapiens
agcauuuuucucuaaccuauaacaaggagacauuacauuuuacuuuagaacaugagaauagcag

SEQ ID NO: 356233 - RNA, 64 nt, Homo Sapiens
aaucaaaauuguauagcauguaauuuaccaccauacauuuuauucuaauugauacauuuuaugu

SEQ ID NO: 356234 - RNA, 64 nt, Homo Sapiens
uuaauuuaccaccauacauuuguaucuaauugauacauuuuaugauagagccuagcaguuacuu

SEQ ID NO: 356235 - RNA, 64 nt, Homo Sapiens
aaccagaauauguagucuacuauguauacugaagacauuuuaaaucauacuaaaauuucuguca

SEQ ID NO: 356236 - RNA, 64 nt, Homo Sapiens
uuucugaugccacauagucucauguuggugaaucacauuuuaguuuuuaaugaacauuggcugg

SEQ ID NO: 356237 - RNA, 64 nt, Homo Sapiens
aucuuugcaucuaaagcaaacuaauguauauuucacauuuuauugagccgacuuauuuccacaa

SEQ ID NO: 356238 - RNA, 64 nt, Homo Sapiens
uuauacagcaacauuucuucaauuagcagucuagacauuuuauaaacagaaaucuuggaccaau

SEQ ID NO: 356239 - RNA, 64 nt, Homo Sapiens
cuauaaaauacuaugugaaucucuuaaaaaucugacauuuuacagucuguauuagacauacugu

SEQ ID NO: 356240 - RNA, 64 nt, Homo Sapiens
aguaaauagagagagagagacacccccacccaagacauuuuaaucaaguugacucuucgacccc

SEQ ID NO: 356241 - RNA, 64 nt, Homo Sapiens
auuauuuaaacagaaaaagaucucuucuuuuaaaacauuuuaaccuggaagcuuucaugaauau

SEQ ID NO: 356242 - RNA, 64 nt, Homo Sapiens
auauaaauccuguaguuuaauguucugaaauaaaacauuuuaaaaaauguaacugcuaucuuaa

SEQ ID NO: 356243 - RNA, 64 nt, Homo Sapiens
gucagaguucguguucccuguuuguaucuacaauacauuuuaaaaccuuuccuagcuuagagca

SEQ ID NO: 356244 - RNA, 64 nt, Homo Sapiens
gcuggaaucagcaacagcccaagguggauacuuuacauuuuaaacaauuuugagcuaagcacuc

SEQ ID NO: 356245 - RNA, 64 nt, Homo Sapiens
cuuuuuuaaaaguuacugauuucggggggaaaagacauuuuagccauauuccucucuguugugu

SEQ ID NO: 356246 - RNA, 64 nt, Homo Sapiens
auuagcuuguauuauaguuauugagccauaaaacacauuuuaauaccuaauacuguaauuugau

SEQ ID NO: 356247 - RNA, 64 nt, Homo Sapiens
accauccaggccuugguuugauucacugaccaguacauuuuauaugcagagaacucccaguaua

SEQ ID NO: 356248 - RNA, 64 nt, Homo Sapiens
agaaaauuuugcagaagcuauguuuuuaaaguguacauuuuauaaaguuuaucagauauuuuca

SEQ ID NO: 356249 - RNA, 64 nt, Homo Sapiens
guuuucuaucccucuaagaguauacuugaaucagacauuuuaaggaugucacuauggcacuguu

SEQ ID NO: 356250 - RNA, 64 nt, Homo Sapiens
aauaaacaaauuuuaaguauuaguuuaagaccaaacauuuuacuugcuugcuggaaaugaaaua

SEQ ID NO: 356251 - RNA, 64 nt, Homo Sapiens
gggaauguguaugugaagagccacuuucaaaacuacauuuuaaagaggagcuaaccccucuacu

SEQ ID NO: 356252 - RNA, 64 nt, Homo Sapiens
aacgugccuucuguauaaguuuauguuuauuccuacauuuuauucauuuuuaauguauggguaa

SEQ ID NO: 356253 - RNA, 64 nt, Homo Sapiens
gcuuuuaucauuuuugcaauucagacaaggguaaacauuuuacuuuauguaauugccacauccc

SEQ ID NO: 356254 - RNA, 64 nt, Homo Sapiens
aauguccuccaggagaaaguguuagagggaacuaacauuuuaggaaugcuuauucagaaaaaaa

SEQ ID NO: 356255 - RNA, 64 nt, Homo Sapiens
gagaggagcucauuucagauuccuaaagaaauagacauuuuacuguuauuuugaaagggcaucu

SEQ ID NO: 356256 - RNA, 64 nt, Homo Sapiens
uugugucuuuucucaauuuauuagcaaacacaagacauuuuauguauuauuucgauuuacuucc

SEQ ID NO: 356257 - RNA, 64 nt, Homo Sapiens
augcaaauuuaauucuguucacagucuguaaaugacauuuuaaguacuucuagguauuacagaa

SEQ ID NO: 356258 - RNA, 64 nt, Homo Sapiens
uuguucacaguauguaaaucaagcaaagacaaccacauuuuaaugcaguuaagaauaaaccuua

SEQ ID NO: 356259 - RNA, 64 nt, Homo Sapiens
caauagagauucuucauuauaauguucaugaacgacauuuuacuuaaggcuuucuuauuguaaa

SEQ ID NO: 356260 - RNA, 64 nt, Homo Sapiens
uguggacuacagcuuauucaagaauaauguagaaacauuuuauuuguuaauaauuccucuagau

SEQ ID NO: 356261 - RNA, 64 nt, Homo Sapiens
ccugcaggguuuauaaaaaauggccuggagugacacauuuuauuauaccuaauauucacugcau

SEQ ID NO: 356262 - RNA, 64 nt, Homo Sapiens
aaauuugaaaauuguauuuagaauaagaaauuuuacauuuuaaacccuauuguccuuuaugcau

SEQ ID NO: 356263 - RNA, 64 nt, Homo Sapiens
gcuauuucauuaagugugauauaaaccuccucaaacauuuuacuuagaggcaaggauugucuaa

SEQ ID NO: 356264 - RNA, 64 nt, Homo Sapiens
ucacuaucaguguggagacaagcacagcacacagacauuuuaggaaggaaaggaacuacgaaau

SEQ ID NO: 356265 - RNA, 64 nt, Homo Sapiens
agacgcaccugacuuuuuggaguuugcacagcaaacauuuuacacaguuuuauuucuaauaugu

SEQ ID NO: 356266 - RNA, 64 nt, Homo Sapiens
gagucaacaguaaugauugguuguaagccaagggacauuuuaagcuagugaagaguuuuuucug

SEQ ID NO: 356267 - RNA, 64 nt, Homo Sapiens
auugcaugagauuagcaaaaauuuuagcuuaaggacauuuuaaaaaaggauuacagcccuuaaa

SEQ ID NO: 356268 - RNA, 64 nt, Homo Sapiens
guaaaauauuuauugucuucuuuguuugccuccuacauuuuacugaugcaguguccugcccagu

SEQ ID NO: 356269 - RNA, 64 nt, Homo Sapiens
guauccucuuaacuggccauuaucuuguaugugcacauuuuauaaauguacagaaacaucacca

SEQ ID NO: 356270 - RNA, 64 nt, Homo Sapiens
uuagagaguaauuuuguguauucuuauuuacuuaacauuuuacuuuuaauuauguaaauuuggu

SEQ ID NO: 356271 - RNA, 64 nt, Homo Sapiens
uuauugaaacaauguaaaaugagccagagauagaacauuuuaagccaucuucaaacucuagcag

SEQ ID NO: 356272 - RNA, 64 nt, Homo Sapiens
ugauuuuuaucuugucuagauuggcauauuuuuaacauuuuacuuaagauagcaaaccaguucg

SEQ ID NO: 356273 - RNA, 64 nt, Homo Sapiens
uauauaauauguacuuugagacucuucucacuugacauuuuagcacuuggaccacuuuguauac

SEQ ID NO: 356274 - RNA, 64 nt, Homo Sapiens
uuuucuuaauccaguucugccuagaaaauguauuacauuuuauuccccuuuacuagaaguuuua

SEQ ID NO: 356275 - RNA, 64 nt, Homo Sapiens
acuguauggcacaagaaagauaucuauuucuguuacauuuuauuggcccccaaaauuuaauaga

SEQ ID NO: 356276 - RNA, 64 nt, Homo Sapiens
auucuaaguguauaguuucauguggcuuaauauaacauuuuaaaaccaaggcaucucagcuuuc

SEQ ID NO: 356277 - RNA, 64 nt, Homo Sapiens
aaaagggaccaaaaguuauugugguuucuccagcacauuuuaagaggggaaagugauuuuaaag

SEQ ID NO: 356278 - RNA, 64 nt, Homo Sapiens
aguaacgcagguguagaaucgucugaauacuugaacauuuuaacuaccuaaucagcauauuuuu

SEQ ID NO: 356279 - RNA, 64 nt, Homo Sapiens
uguauggauggaauaucccuagaaacuaaagaucacauuuuacccguguggcaguguuguaaaa

SEQ ID NO: 356280 - RNA, 64 nt, Homo Sapiens
aguguaaaguacaucagaaauaaaacuguaucugacauuuuaagccuguaguccauuauuacuu

SEQ ID NO: 356281 - RNA, 64 nt, Homo Sapiens
uuauccucuuaacuggccauuaucuuguaugugcacauuuuauaaauguacagaaacaucacca

SEQ ID NO: 356282 - RNA, 64 nt, Homo Sapiens; identical to SEQ ID NO: 356270

SEQ ID NO: 356283 - RNA, 64 nt, Homo Sapiens; identical to SEQ ID NO: 104428

SEQ ID NO: 356284 - RNA, 64 nt, Homo Sapiens; identical to SEQ ID NO: 104429

SEQ ID NO: 356285 - RNA, 64 nt, Homo Sapiens; identical to SEQ ID NO: 104430

SEQ ID NO: 356286 - RNA, 64 nt, Homo Sapiens; identical to SEQ ID NO: 104431

SEQ ID NO: 356287 - RNA, 64 nt, Homo Sapiens; identical to SEQ ID NO: 104432

SEQ ID NO: 356288 - RNA, 64 nt, Homo Sapiens; identical to SEQ ID NO: 104433

SEQ ID NO: 356289 - RNA, 64 nt, Homo Sapiens; identical to SEQ ID NO: 104434

SEQ ID NO: 356290 - RNA, 64 nt, Homo Sapiens; identical to SEQ ID NO: 104435

SEQ ID NO: 356291 - RNA, 64 nt, Homo Sapiens; identical to SEQ ID NO: 104436

SEQ ID NO: 356292 - RNA, 64 nt, Homo Sapiens; identical to SEQ ID NO: 104437

SEQ ID NO: 356293 - RNA, 64 nt, Homo Sapiens; identical to SEQ ID NO: 104438

SEQ ID NO: 356294 - RNA, 64 nt, Homo Sapiens; identical to SEQ ID NO: 104439

SEQ ID NO: 356295 - RNA, 64 nt, Homo Sapiens; identical to SEQ ID NO: 104440

SEQ ID NO: 356296 - RNA, 64 nt, Homo Sapiens; identical to SEQ ID NO: 104441

SEQ ID NO: 356297 - RNA, 64 nt, Homo Sapiens; identical to SEQ ID NO: 104442

SEQ ID NO: 356298 - RNA, 64 nt, Homo Sapiens; identical to SEQ ID NO: 104443

SEQ ID NO: 356299 - RNA, 64 nt, Homo Sapiens; identical to SEQ ID NO: 104444

SEQ ID NO: 356300 - RNA, 64 nt, Homo Sapiens; identical to SEQ ID NO: 104445

SEQ ID NO: 356301 - RNA, 64 nt, Homo Sapiens; identical to SEQ ID NO: 104446

SEQ ID NO: 356302 - RNA, 64 nt, Homo Sapiens; identical to SEQ ID NO: 104447

SEQ ID NO: 356303 - RNA, 64 nt, Homo Sapiens; identical to SEQ ID NO: 104448

SEQ ID NO: 356304 - RNA, 64 nt, Homo Sapiens; identical to SEQ ID NO: 104449

SEQ ID NO: 356305 - RNA, 64 nt, Homo Sapiens; identical to SEQ ID NO: 104450

SEQ ID NO: 356306 - RNA, 64 nt, Homo Sapiens; identical to SEQ ID NO: 104451

SEQ ID NO: 356307 - RNA, 64 nt, Homo Sapiens; identical to SEQ ID NO: 356088

SEQ ID NO: 356308 - RNA, 64 nt, Homo Sapiens; identical to SEQ ID NO: 356089

SEQ ID NO: 356309 - RNA, 64 nt, Homo Sapiens; identical to SEQ ID NO: 356090

SEQ ID NO: 356310 - RNA, 64 nt, Homo Sapiens; identical to SEQ ID NO: 356091

SEQ ID NO: 356311 - RNA, 64 nt, Homo Sapiens; identical to SEQ ID NO: 356092

SEQ ID NO: 356312 - RNA, 64 nt, Homo Sapiens; identical to SEQ ID NO: 356093

SEQ ID NO: 356313 - RNA, 64 nt, Homo Sapiens; identical to SEQ ID NO: 356094

SEQ ID NO: 356314 - RNA, 64 nt, Homo Sapiens; identical to SEQ ID NO: 356095

SEQ ID NO: 356315 - RNA, 64 nt, Homo Sapiens; identical to SEQ ID NO: 356096

SEQ ID NO: 356316 - RNA, 64 nt, Homo Sapiens; identical to SEQ ID NO: 356097

SEQ ID NO: 356317 - RNA, 64 nt, Homo Sapiens; identical to SEQ ID NO: 356098

SEQ ID NO: 356318 - RNA, 64 nt, Homo Sapiens; identical to SEQ ID NO: 356099

SEQ ID NO: 356319 - RNA, 64 nt, Homo Sapiens; identical to SEQ ID NO: 356100

SEQ ID NO: 356320 - RNA, 64 nt, Homo Sapiens; identical to SEQ ID NO: 356101

SEQ ID NO: 356321 - RNA, 64 nt, Homo Sapiens; identical to SEQ ID NO: 356102

SEQ ID NO: 356322 - RNA, 64 nt, Homo Sapiens; identical to SEQ ID NO: 356103

SEQ ID NO: 356323 - RNA, 64 nt, Homo Sapiens; identical to SEQ ID NO: 356104

SEQ ID NO: 356324 - RNA, 64 nt, Homo Sapiens; identical to SEQ ID NO: 356105

SEQ ID NO: 356325 - RNA, 64 nt, Homo Sapiens; identical to SEQ ID NO: 356106

SEQ ID NO: 356326 - RNA, 64 nt, Homo Sapiens; identical to SEQ ID NO: 356107

SEQ ID NO: 356327 - RNA, 64 nt, Homo Sapiens; identical to SEQ ID NO: 356108

SEQ ID NO: 356328 - RNA, 64 nt, Homo Sapiens; identical to SEQ ID NO: 356109

SEQ ID NO: 356329 - RNA, 64 nt, Homo Sapiens; identical to SEQ ID NO: 356110

SEQ ID NO: 356330 - RNA, 64 nt, Homo Sapiens; identical to SEQ ID NO: 356111

SEQ ID NO: 356331 - RNA, 64 nt, Homo Sapiens; identical to SEQ ID NO: 356112

SEQ ID NO: 356332 - RNA, 64 nt, Homo Sapiens; identical to SEQ ID NO: 356113

SEQ ID NO: 356333 - RNA, 64 nt, Homo Sapiens; identical to SEQ ID NO: 356114

SEQ ID NO: 356334 - RNA, 64 nt, Homo Sapiens; identical to SEQ ID NO: 356115

SEQ ID NO: 356335 - RNA, 64 nt, Homo Sapiens; identical to SEQ ID NO: 356116

SEQ ID NO: 356336 - RNA, 64 nt, Homo Sapiens; identical to SEQ ID NO: 356117

SEQ ID NO: 356337 - RNA, 64 nt, Homo Sapiens; identical to SEQ ID NO: 356118

SEQ ID NO: 356338 - RNA, 64 nt, Homo Sapiens; identical to SEQ ID NO: 356119

SEQ ID NO: 356339 - RNA, 64 nt, Homo Sapiens; identical to SEQ ID NO: 356120

SEQ ID NO: 356340 - RNA, 64 nt, Homo Sapiens; identical to SEQ ID NO: 356121

SEQ ID NO: 356341 - RNA, 64 nt, Homo Sapiens; identical to SEQ ID NO: 356122

SEQ ID NO: 356342 - RNA, 64 nt, Homo Sapiens; identical to SEQ ID NO: 356123

SEQ ID NO: 356343 - RNA, 64 nt, Homo Sapiens; identical to SEQ ID NO: 356124

SEQ ID NO: 356344 - RNA, 64 nt, Homo Sapiens; identical to SEQ ID NO: 356125

SEQ ID NO: 356345 - RNA, 64 nt, Homo Sapiens; identical to SEQ ID NO: 356126

SEQ ID NO: 356346 - RNA, 64 nt, Homo Sapiens; identical to SEQ ID NO: 356127

SEQ ID NO: 356347 - RNA, 64 nt, Homo Sapiens; identical to SEQ ID NO: 356128

SEQ ID NO: 356348 - RNA, 64 nt, Homo Sapiens; identical to SEQ ID NO: 356129

SEQ ID NO: 356349 - RNA, 64 nt, Homo Sapiens; identical to SEQ ID NO: 356130

SEQ ID NO: 356350 - RNA, 64 nt, Homo Sapiens; identical to SEQ ID NO: 356131

SEQ ID NO: 356351 - RNA, 64 nt, Homo Sapiens; identical to SEQ ID NO: 356132

SEQ ID NO: 356352 - RNA, 64 nt, Homo Sapiens; identical to SEQ ID NO: 356133

SEQ ID NO: 356353 - RNA, 64 nt, Homo Sapiens; identical to SEQ ID NO: 356134

SEQ ID NO: 356354 - RNA, 64 nt, Homo Sapiens; identical to SEQ ID NO: 356135

SEQ ID NO: 356355 - RNA, 64 nt, Homo Sapiens; identical to SEQ ID NO: 356136

SEQ ID NO: 356356 - RNA, 64 nt, Homo Sapiens; identical to SEQ ID NO: 356137

SEQ ID NO: 356357 - RNA, 64 nt, Homo Sapiens; identical to SEQ ID NO: 356138

SEQ ID NO: 356358 - RNA, 64 nt, Homo Sapiens; identical to SEQ ID NO: 356139

SEQ ID NO: 356359 - RNA, 64 nt, Homo Sapiens; identical to SEQ ID NO: 356140

SEQ ID NO: 356360 - RNA, 64 nt, Homo Sapiens; identical to SEQ ID NO: 356141

SEQ ID NO: 356361 - RNA, 64 nt, Homo Sapiens; identical to SEQ ID NO: 356142

SEQ ID NO: 356362 - RNA, 64 nt, Homo Sapiens; identical to SEQ ID NO: 356143

SEQ ID NO: 356363 - RNA, 64 nt, Homo Sapiens; identical to SEQ ID NO: 356144

SEQ ID NO: 356364 - RNA, 64 nt, Homo Sapiens; identical to SEQ ID NO: 356145

SEQ ID NO: 356365 - RNA, 64 nt, Homo Sapiens; identical to SEQ ID NO: 356146

SEQ ID NO: 356366 - RNA, 64 nt, Homo Sapiens; identical to SEQ ID NO: 356147

SEQ ID NO: 356367 - RNA, 64 nt, Homo Sapiens; identical to SEQ ID NO: 356148

SEQ ID NO: 356368 - RNA, 64 nt, Homo Sapiens; identical to SEQ ID NO: 356149

SEQ ID NO: 356369 - RNA, 64 nt, Homo Sapiens; identical to SEQ ID NO: 356150

SEQ ID NO: 356370 - RNA, 64 nt, Homo Sapiens; identical to SEQ ID NO: 356151

SEQ ID NO: 356371 - RNA, 64 nt, Homo Sapiens; identical to SEQ ID NO: 356152

SEQ ID NO: 356372 - RNA, 64 nt, Homo Sapiens; identical to SEQ ID NO: 356153

SEQ ID NO: 356373 - RNA, 64 nt, Homo Sapiens; identical to SEQ ID NO: 356154

SEQ ID NO: 356374 - RNA, 64 nt, Homo Sapiens; identical to SEQ ID NO: 356155

SEQ ID NO: 356375 - RNA, 64 nt, Homo Sapiens; identical to SEQ ID NO: 356156

SEQ ID NO: 356376 - RNA, 64 nt, Homo Sapiens; identical to SEQ ID NO: 356157

SEQ ID NO: 356377 - RNA, 64 nt, Homo Sapiens; identical to SEQ ID NO: 356158

SEQ ID NO: 356378 - RNA, 64 nt, Homo Sapiens; identical to SEQ ID NO: 356159

SEQ ID NO: 356379 - RNA, 64 nt, Homo Sapiens; identical to SEQ ID NO: 356160

SEQ ID NO: 356380 - RNA, 64 nt, Homo Sapiens; identical to SEQ ID NO: 356161

SEQ ID NO: 356381 - RNA, 64 nt, Homo Sapiens; identical to SEQ ID NO: 356162

SEQ ID NO: 356382 - RNA, 64 nt, Homo Sapiens; identical to SEQ ID NO: 356163

SEQ ID NO: 356383 - RNA, 64 nt, Homo Sapiens; identical to SEQ ID NO: 356164

SEQ ID NO: 356384 - RNA, 64 nt, Homo Sapiens; identical to SEQ ID NO: 356165

SEQ ID NO: 356385 - RNA, 64 nt, Homo Sapiens; identical to SEQ ID NO: 356166

SEQ ID NO: 356386 - RNA, 64 nt, Homo Sapiens; identical to SEQ ID NO: 356167

SEQ ID NO: 356387 - RNA, 64 nt, Homo Sapiens; identical to SEQ ID NO: 356168

SEQ ID NO: 356388 - RNA, 64 nt, Homo Sapiens; identical to SEQ ID NO: 356169

SEQ ID NO: 356389 - RNA, 64 nt, Homo Sapiens; identical to SEQ ID NO: 356170

SEQ ID NO: 356390 - RNA, 64 nt, Homo Sapiens; identical to SEQ ID NO: 356171

SEQ ID NO: 356391 - RNA, 64 nt, Homo Sapiens; identical to SEQ ID NO: 356172

SEQ ID NO: 356392 - RNA, 64 nt, Homo Sapiens; identical to SEQ ID NO: 356173

SEQ ID NO: 356393 - RNA, 64 nt, Homo Sapiens; identical to SEQ ID NO: 356174

SEQ ID NO: 356394 - RNA, 64 nt, Homo Sapiens; identical to SEQ ID NO: 356175

SEQ ID NO: 356395 - RNA, 64 nt, Homo Sapiens; identical to SEQ ID NO: 356176

SEQ ID NO: 356396 - RNA, 64 nt, Homo Sapiens; identical to SEQ ID NO: 356177

SEQ ID NO: 356397 - RNA, 64 nt, Homo Sapiens; identical to SEQ ID NO: 356178

SEQ ID NO: 356398 - RNA, 64 nt, Homo Sapiens; identical to SEQ ID NO: 356179

SEQ ID NO: 356399 - RNA, 64 nt, Homo Sapiens; identical to SEQ ID NO: 356180

SEQ ID NO: 356400 - RNA, 64 nt, Homo Sapiens; identical to SEQ ID NO: 356181

SEQ ID NO: 356401 - RNA, 64 nt, Homo Sapiens; identical to SEQ ID NO: 356182

SEQ ID NO: 356402 - RNA, 64 nt, Homo Sapiens; identical to SEQ ID NO: 356183

SEQ ID NO: 356403 - RNA, 64 nt, Homo Sapiens; identical to SEQ ID NO: 356184

SEQ ID NO: 356404 - RNA, 64 nt, Homo Sapiens; identical to SEQ ID NO: 356185

SEQ ID NO: 356405 - RNA, 64 nt, Homo Sapiens; identical to SEQ ID NO: 356186

SEQ ID NO: 356406 - RNA, 64 nt, Homo Sapiens; identical to SEQ ID NO: 356187

SEQ ID NO: 356407 - RNA, 64 nt, Homo Sapiens; identical to SEQ ID NO: 356188

SEQ ID NO: 356408 - RNA, 64 nt, Homo Sapiens; identical to SEQ ID NO: 356189

SEQ ID NO: 356409 - RNA, 64 nt, Homo Sapiens; identical to SEQ ID NO: 356190

SEQ ID NO: 356410 - RNA, 64 nt, Homo Sapiens; identical to SEQ ID NO: 356191

SEQ ID NO: 356411 - RNA, 64 nt, Homo Sapiens; identical to SEQ ID NO: 356192

SEQ ID NO: 356412 - RNA, 64 nt, Homo Sapiens; identical to SEQ ID NO: 356193

SEQ ID NO: 356413 - RNA, 64 nt, Homo Sapiens; identical to SEQ ID NO: 356194

SEQ ID NO: 356414 - RNA, 64 nt, Homo Sapiens; identical to SEQ ID NO: 356195

SEQ ID NO: 356415 - RNA, 64 nt, Homo Sapiens; identical to SEQ ID NO: 356196

SEQ ID NO: 356416 - RNA, 64 nt, Homo Sapiens; identical to SEQ ID NO: 356197

SEQ ID NO: 356417 - RNA, 64 nt, Homo Sapiens; identical to SEQ ID NO: 356198

SEQ ID NO: 356418 - RNA, 64 nt, Homo Sapiens; identical to SEQ ID NO: 356199

SEQ ID NO: 356419 - RNA, 64 nt, Homo Sapiens; identical to SEQ ID NO: 356200

SEQ ID NO: 356420 - RNA, 64 nt, Homo Sapiens; identical to SEQ ID NO: 356201

SEQ ID NO: 356421 - RNA, 64 nt, Homo Sapiens; identical to SEQ ID NO: 356202

SEQ ID NO: 356422 - RNA, 64 nt, Homo Sapiens; identical to SEQ ID NO: 356203

SEQ ID NO: 356423 - RNA, 64 nt, Homo Sapiens; identical to SEQ ID NO: 356204

SEQ ID NO: 356424 - RNA, 64 nt, Homo Sapiens; identical to SEQ ID NO: 356205

SEQ ID NO: 356425 - RNA, 64 nt, Homo Sapiens; identical to SEQ ID NO: 356206

SEQ ID NO: 356426 - RNA, 64 nt, Homo Sapiens; identical to SEQ ID NO: 356207

SEQ ID NO: 356427 - RNA, 64 nt, Homo Sapiens; identical to SEQ ID NO: 356208

SEQ ID NO: 356428 - RNA, 64 nt, Homo Sapiens; identical to SEQ ID NO: 356209

SEQ ID NO: 356429 - RNA, 64 nt, Homo Sapiens; identical to SEQ ID NO: 356210

SEQ ID NO: 356430 - RNA, 64 nt, Homo Sapiens; identical to SEQ ID NO: 356211

SEQ ID NO: 356431 - RNA, 64 nt, Homo Sapiens; identical to SEQ ID NO: 356212

SEQ ID NO: 356432 - RNA, 64 nt, Homo Sapiens; identical to SEQ ID NO: 356213

SEQ ID NO: 356433 - RNA, 64 nt, Homo Sapiens; identical to SEQ ID NO: 356214

SEQ ID NO: 356434 - RNA, 64 nt, Homo Sapiens; identical to SEQ ID NO: 356215

SEQ ID NO: 356435 - RNA, 64 nt, Homo Sapiens; identical to SEQ ID NO: 356216

SEQ ID NO: 356436 - RNA, 64 nt, Homo Sapiens; identical to SEQ ID NO: 356217

SEQ ID NO: 356437 - RNA, 64 nt, Homo Sapiens; identical to SEQ ID NO: 356218

SEQ ID NO: 356438 - RNA, 64 nt, Homo Sapiens; identical to SEQ ID NO: 356219

SEQ ID NO: 356439 - RNA, 64 nt, Homo Sapiens; identical to SEQ ID NO: 356220

SEQ ID NO: 356440 - RNA, 64 nt, Homo Sapiens; identical to SEQ ID NO: 356221

SEQ ID NO: 356441 - RNA, 64 nt, Homo Sapiens; identical to SEQ ID NO: 356222

SEQ ID NO: 356442 - RNA, 64 nt, Homo Sapiens; identical to SEQ ID NO: 356223

SEQ ID NO: 356443 - RNA, 64 nt, Homo Sapiens; identical to SEQ ID NO: 356224

SEQ ID NO: 356444 - RNA, 64 nt, Homo Sapiens; identical to SEQ ID NO: 356225

SEQ ID NO: 356445 - RNA, 64 nt, Homo Sapiens; identical to SEQ ID NO: 356226

SEQ ID NO: 356446 - RNA, 64 nt, Homo Sapiens; identical to SEQ ID NO: 356227

SEQ ID NO: 356447 - RNA, 64 nt, Homo Sapiens; identical to SEQ ID NO: 356228

SEQ ID NO: 356448 - RNA, 64 nt, Homo Sapiens; identical to SEQ ID NO: 356229

SEQ ID NO: 356449 - RNA, 64 nt, Homo Sapiens; identical to SEQ ID NO: 356230

SEQ ID NO: 356450 - RNA, 64 nt, Homo Sapiens; identical to SEQ ID NO: 356231

SEQ ID NO: 356451 - RNA, 64 nt, Homo Sapiens; identical to SEQ ID NO: 356232

SEQ ID NO: 356452 - RNA, 64 nt, Homo Sapiens; identical to SEQ ID NO: 356233

SEQ ID NO: 356453 - RNA, 64 nt, Homo Sapiens; identical to SEQ ID NO: 356234

SEQ ID NO: 356454 - RNA, 64 nt, Homo Sapiens; identical to SEQ ID NO: 356235

SEQ ID NO: 356455 - RNA, 64 nt, Homo Sapiens; identical to SEQ ID NO: 356236

SEQ ID NO: 356456 - RNA, 64 nt, Homo Sapiens; identical to SEQ ID NO: 356237

SEQ ID NO: 356457 - RNA, 64 nt, Homo Sapiens; identical to SEQ ID NO: 356238

SEQ ID NO: 356458 - RNA, 64 nt, Homo Sapiens; identical to SEQ ID NO: 356239

SEQ ID NO: 356459 - RNA, 64 nt, Homo Sapiens; identical to SEQ ID NO: 356240

SEQ ID NO: 356460 - RNA, 64 nt, Homo Sapiens; identical to SEQ ID NO: 356241

SEQ ID NO: 356461 - RNA, 64 nt, Homo Sapiens; identical to SEQ ID NO: 356242

SEQ ID NO: 356462 - RNA, 64 nt, Homo Sapiens; identical to SEQ ID NO: 356243

SEQ ID NO: 356463 - RNA, 64 nt, Homo Sapiens; identical to SEQ ID NO: 356244

SEQ ID NO: 356464 - RNA, 64 nt, Homo Sapiens; identical to SEQ ID NO: 356245

SEQ ID NO: 356465 - RNA, 64 nt, Homo Sapiens; identical to SEQ ID NO: 356246

SEQ ID NO: 356466 - RNA, 64 nt, Homo Sapiens; identical to SEQ ID NO: 356247

SEQ ID NO: 356467 - RNA, 64 nt, Homo Sapiens; identical to SEQ ID NO: 356248

SEQ ID NO: 356468 - RNA, 64 nt, Homo Sapiens; identical to SEQ ID NO: 356249

SEQ ID NO: 356469 - RNA, 64 nt, Homo Sapiens; identical to SEQ ID NO: 356250

SEQ ID NO: 356470 - RNA, 64 nt, Homo Sapiens; identical to SEQ ID NO: 356251

SEQ ID NO: 356471 - RNA, 64 nt, Homo Sapiens; identical to SEQ ID NO: 356252

SEQ ID NO: 356472 - RNA, 64 nt, Homo Sapiens; identical to SEQ ID NO: 356253

SEQ ID NO: 356473 - RNA, 64 nt, Homo Sapiens; identical to SEQ ID NO: 356254

SEQ ID NO: 356474 - RNA, 64 nt, Homo Sapiens; identical to SEQ ID NO: 356255

SEQ ID NO: 356475 - RNA, 64 nt, Homo Sapiens; identical to SEQ ID NO: 356256

SEQ ID NO: 356476 - RNA, 64 nt, Homo Sapiens; identical to SEQ ID NO: 356257

SEQ ID NO: 356477 - RNA, 64 nt, Homo Sapiens; identical to SEQ ID NO: 356258

SEQ ID NO: 356478 - RNA, 64 nt, Homo Sapiens; identical to SEQ ID NO: 356259

SEQ ID NO: 356479 - RNA, 64 nt, Homo Sapiens; identical to SEQ ID NO: 356260

SEQ ID NO: 356480 - RNA, 64 nt, Homo Sapiens; identical to SEQ ID NO: 356261

SEQ ID NO: 356481 - RNA, 64 nt, Homo Sapiens; identical to SEQ ID NO: 356262

SEQ ID NO: 356482 - RNA, 64 nt, Homo Sapiens; identical to SEQ ID NO: 356263

SEQ ID NO: 356483 - RNA, 64 nt, Homo Sapiens; identical to SEQ ID NO: 356264

SEQ ID NO: 356484 - RNA, 64 nt, Homo Sapiens; identical to SEQ ID NO: 356265

SEQ ID NO: 356485 - RNA, 64 nt, Homo Sapiens; identical to SEQ ID NO: 356266

SEQ ID NO: 356486 - RNA, 64 nt, Homo Sapiens; identical to SEQ ID NO: 356267

SEQ ID NO: 356487 - RNA, 64 nt, Homo Sapiens; identical to SEQ ID NO: 356268

SEQ ID NO: 356488 - RNA, 64 nt, Homo Sapiens; identical to SEQ ID NO: 356269

SEQ ID NO: 356489 - RNA, 64 nt, Homo Sapiens; identical to SEQ ID NO: 356270

SEQ ID NO: 356490 - RNA, 64 nt, Homo Sapiens; identical to SEQ ID NO: 356271

SEQ ID NO: 356491 - RNA, 64 nt, Homo Sapiens; identical to SEQ ID NO: 356272

SEQ ID NO: 356492 - RNA, 64 nt, Homo Sapiens; identical to SEQ ID NO: 356273

SEQ ID NO: 356493 - RNA, 64 nt, Homo Sapiens; identical to SEQ ID NO: 356274

SEQ ID NO: 356494 - RNA, 64 nt, Homo Sapiens; identical to SEQ ID NO: 356275

SEQ ID NO: 356495 - RNA, 64 nt, Homo Sapiens; identical to SEQ ID NO: 356276

SEQ ID NO: 356496 - RNA, 64 nt, Homo Sapiens; identical to SEQ ID NO: 356277

SEQ ID NO: 356497 - RNA, 64 nt, Homo Sapiens; identical to SEQ ID NO: 356278

SEQ ID NO: 356498 - RNA, 64 nt, Homo Sapiens; identical to SEQ ID NO: 356279

SEQ ID NO: 356499 - RNA, 64 nt, Homo Sapiens; identical to SEQ ID NO: 356280

SEQ ID NO: 356500 - RNA, 64 nt, Homo Sapiens; identical to SEQ ID NO: 356281

SEQ ID NO: 356501 - RNA, 64 nt, Homo Sapiens; identical to SEQ ID NO: 356270

SEQ ID NO: 356502 - RNA, 64 nt, Homo Sapiens
aaucacguuagccuccaaacauagugaugaaauucaauuuaaaaugauaaauagaauacacaga

SEQ ID NO: 356503 - RNA, 64 nt, Homo Sapiens
aaguaaucauuaauuaguuagucaguucacauagcaauuuaaucgcauugauuuauaaauaguu

SEQ ID NO: 356504 - RNA, 64 nt, Homo Sapiens
cugagagcauaaaauaaaccugacuguaugaagucaauuuaagugaugagaacauuuaacuuug

SEQ ID NO: 356505 - RNA, 64 nt, Homo Sapiens
cuuuggaaucgugucuuccaugcuccacuggguucaauuuaaaauaggagaggcuuucucuucu

SEQ ID NO: 356506 - RNA, 64 nt, Homo Sapiens
uauaaugugucaggcugugugcugaaggacacagcaauuuaaaugaccuuuuaggggcagcaau

SEQ ID NO: 356507 - RNA, 64 nt, Homo Sapiens
aaagauaaaggacuagagccuaaggccugucuuccaauuuaaccguucaaggagccagacgaaa

SEQ ID NO: 356508 - RNA, 64 nt, Homo Sapiens
aaagaacugcugugucugacuaccaaacuauccacaauuuaaaucaucucucucucccccuacc

SEQ ID NO: 356509 - RNA, 64 nt, Homo Sapiens
uagauccucuaaucuuucuaaauaggacaauuuccaauuuaauuguuagggagaagauugaugc

SEQ ID NO: 356510 - RNA, 64 nt, Homo Sapiens
uguuuuucucuauagccuuuuuuguauuagaguacaauuuaaagaaguuuaauugugcaacaaa

SEQ ID NO: 356511 - RNA, 64 nt, Homo Sapiens
uacccccuacaaaagcacuccugcaauauucuggcaauuuaauaucuuguuccaagaugagccu

SEQ ID NO: 356512 - RNA, 64 nt, Homo Sapiens
ugggcuaaaaauuaaaaauuccagagguuauauacaauuuaaaugccacaauuuaaaaauaaaa

SEQ ID NO: 356513 - RNA, 64 nt, Homo Sapiens
auaaaaccagagguuauauauuaaauuuaugccacaauuuaaaaaauaaaguguauauuaggau

SEQ ID NO: 356514 - RNA, 64 nt, Homo Sapiens
agucauauuuuaagugggauuuauucauucauggcaauuuaaaacuuauuuuacuuguuuuuaa

SEQ ID NO: 356515 - RNA, 64 nt, Homo Sapiens
uuacuucagugcaauccuacaguuccuuaagaaccaauuuaaaauuuuuaagggacuuuuuaag

SEQ ID NO: 356516 - RNA, 64 nt, Homo Sapiens
uuuuuaagggacuuuuuaaguuuguaaggugcaacaauuuaauauuuuuuuuucuuuuccacug

SEQ ID NO: 356517 - RNA, 64 nt, Homo Sapiens
ugagaacaugggguauacuggcuucugauacugccaauuuaaugggugcuagagaagagacuua

SEQ ID NO: 356518 - RNA, 64 nt, Homo Sapiens
guuuuguaucagaaauacacaaaauaagguggcacaauuuaauuucuuaugaacaacuguaguc

SEQ ID NO: 356519 - RNA, 64 nt, Homo Sapiens
gcgcacacacacacacacacugacaugcucccuccaauuuaaaacugagucaauuuaacaaucc

SEQ ID NO: 356520 - RNA, 64 nt, Homo Sapiens
auccugacaugcucccuccaaagacaaacugagucaauuuaacaaagauauuuuggagauaaac

SEQ ID NO: 356521 - RNA, 64 nt, Homo Sapiens
aaagcaauauacuggucuagauaggauauugagccaauuuaaauaaccacuggucuagcuuuag

SEQ ID NO: 356522 - RNA, 64 nt, Homo Sapiens
aaagcaauguuauugugacaauagguuguugagccaauuuaaguaagaauaaagauuucuuuag

SEQ ID NO: 356523 - RNA, 64 nt, Homo Sapiens
gugguuuaccaucuuuuugggaagcauagcugaacaauuuaauuaaguaguguuuccugauucu

SEQ ID NO: 356524 - RNA, 64 nt, Homo Sapiens
ugaaacaaaugguuauuucuaaaaauagaaugaucaauuuaaucgguggugagaaugcugacug

SEQ ID NO: 356525 - RNA, 64 nt, Homo Sapiens
auuuuaagaaaaaaggaaaacaauacaaaucaaacaauuuaaaugagaaaaaguuuaaaauucu

SEQ ID NO: 356526 - RNA, 64 nt, Homo Sapiens
agaaaaaguuuaaaauucucuuaaaauauuuuuacaauuuaauguaaagaggauagacaaccuc

SEQ ID NO: 356527 - RNA, 64 nt, Homo Sapiens
aaaauuccugucaagaaaaguuuagaacugaaggcaauuuaaucugaaagcaacagagguuugu

SEQ ID NO: 356528 - RNA, 64 nt, Homo Sapiens
uuuauguguugccaauucuuuucucuauugccaacaauuuaaugaguuuuaaagcacuuuguag

SEQ ID NO: 356529 - RNA, 64 nt, Homo Sapiens
auuuaucaaugcaaacaguaauuggcuauaaucacaauuuaauauugcugaguccucauaauca

SEQ ID NO: 356530 - RNA, 64 nt, Homo Sapiens
cacaagcacaauguucaggcuuaaaauuucauagcaauuuaaagaaauagcacaauaaauuucc

SEQ ID NO: 356531 - RNA, 64 nt, Homo Sapiens
guuauguuagaauuuacacugaggagaaaauugucaauuuaagaaaucuaaagugaaaauuuug

SEQ ID NO: 356532 - RNA, 64 nt, Homo Sapiens
caggcccaucccagauguuugugauguccugaaacaauuuaaaaggagacccacagagcuaaug

SEQ ID NO: 356533 - RNA, 64 nt, Homo Sapiens
agagacccacagagcuaauggucguguccugaaacaauuuaaaucaggcccaucccagguguuu

SEQ ID NO: 356534 - RNA, 64 nt, Homo Sapiens
aaucuaaagugaaaauuuuggaggagaaaauugucaauuuaagaauuauguuagcauuuacacu

SEQ ID NO: 356535 - RNA, 64 nt, Homo Sapiens
ucuucacuauaacugagugguaauuuaaagacaacaauuuaaugucacuaauuuucaaaauuaa

SEQ ID NO: 356536 - RNA, 64 nt, Homo Sapiens
ugucacuaauuuucaaaauuaaauaguuuaagcucaauuuaauuuugcuagauauuuaacaaaa

SEQ ID NO: 356537 - RNA, 64 nt, Homo Sapiens
aguuuuauggaauugggagucugacaagugaaaccaauuuaauguaaaguauuuggcuuucaaa

SEQ ID NO: 356538 - RNA, 64 nt, Homo Sapiens
uuucagauuccagagauaucuuacgucuuugauucaauuuaaaauuuguacuuauuuucuuuua

SEQ ID NO: 356539 - RNA, 64 nt, Homo Sapiens
ugggcuucucugagguccacugcagagcaaaauucaauuuaagacucacuguagcauucuuuac

SEQ ID NO: 356540 - RNA, 64 nt, Homo Sapiens
aucacauuagguuuaauuuuuuaaaauguaguuucaauuuaauaaaagcagacugauacuaaau

SEQ ID NO: 356541 - RNA, 61 nt, Homo Sapiens
aaauauggcguauuaugugagaacuacaggcacaguaaaaaaaauuguaccacuccuugaa

SEQ ID NO: 356542 - RNA, 61 nt, Homo Sapiens
uauggucuacuaaggaaacaauagaaaagguacaguaaaaacaauauuuguguaucuaaau

SEQ ID NO: 356543 - RNA, 61 nt, Homo Sapiens
aagcauagcagcagcucugaaaagacacuucacaguaaauaugucaaagguagagacaggu

SEQ ID NO: 356544 - RNA, 61 nt, Homo Sapiens
gagucaaauucagaacgagaugucacuaaaaacaguaaaaaugacucccauccauccucug

SEQ ID NO: 356545 - RNA, 61 nt, Homo Sapiens
uguauuuucuggaaggaagaggcacuuaaggacaguaaagcccuccucuugaaaaugauua

SEQ ID NO: 356546 - RNA, 61 nt, Homo Sapiens
aguuuggauaguuaugcaaauacuugugaaaacaguaaaaucaccuuuguuauuuauguug

SEQ ID NO: 356547 - RNA, 61 nt, Homo Sapiens
aauaguuugagauuuaaaacgcaaauuuugcacaguaaaccugcuauuaaaucauacaaaa

SEQ ID NO: 356548 - RNA, 61 nt, Homo Sapiens
auguaaguggaagcuuuacuuuuguuuuuucacaguaaaccuucauauuaauuccagguga

SEQ ID NO: 356549 - RNA, 61 nt, Homo Sapiens
uuuuuuuuggauacagcacaaacuccaguugacaguaaaaugaagcuucuagguauuuugu

SEQ ID NO: 356550 - RNA, 61 nt, Homo Sapiens
uaaaugcaaaauguuaaguuugaaaugguuaacaguaaauuauuauguuaguuuccaggca

SEQ ID NO: 356551 - RNA, 61 nt, Homo Sapiens
gagcuucugcacagaaaaagaaacuagcaacacaguaaacagacagccuguagaaugggga

SEQ ID NO: 356552 - RNA, 61 nt, Homo Sapiens
aaggacagagaaucaaucuaagugcccaacaacaguaaauucaaugaaaaaaaauguggua

SEQ ID NO: 356553 - RNA, 61 nt, Homo Sapiens
uccuggaagacaacccaggcuaaaacccaaaacaguaaaaagauggauuaaagacuuaaug

SEQ ID NO: 356554 - RNA, 61 nt, Homo Sapiens
uaaagacuauucuguuucuaguuaaacuagcacaguaaaaguuucuuuacagaauggauuu

SEQ ID NO: 356555 - RNA, 61 nt, Homo Sapiens
auugugcuuuaguugcuaguaaucguuucuaacaguaaauugucacagcuaaaaagaaaga

SEQ ID NO: 356556 - RNA, 61 nt, Homo Sapiens
uugaagagaggaggauuuguuaacuggcuuuacaguaaacaucuuucaaauaaauggcagu

SEQ ID NO: 356557 - RNA, 61 nt, Homo Sapiens
guauguaaaaagaaacugcauuuuaagucagacaguaaauguuuuuuuuaauuuacagcaa

SEQ ID NO: 356558 - RNA, 61 nt, Homo Sapiens
uguuaaugaauuauugauuuuuguaucugccacaguaaauuaaagcauuacacaguauuua

SEQ ID NO: 356559 - RNA, 61 nt, Homo Sapiens
aaucauuuguaucaaaggggcagcuguuagcacaguaaaaaucaauuuugugccacugguu

SEQ ID NO: 356560 - RNA, 61 nt, Homo Sapiens
cagaaagcuguagugauaacugcacauuguaacaguaaaggggaggauaccaucuggcggc

SEQ ID NO: 356561 - RNA, 61 nt, Homo Sapiens
auacacauauguauacauauauauauauucuacaguaaaacuguagacuguccucguccuu

SEQ ID NO: 356562 - RNA, 61 nt, Homo Sapiens
gagaucacgacacugcacuccagccugggcaacaguaaaaccuggucuccaaaaaaaaaaa

SEQ ID NO: 356563 - RNA, 61 nt, Homo Sapiens
agaaaauaaaauuguuagcaauuuagugaauacaguaaagguacaacauuuaaugugaaac

SEQ ID NO: 356564 - RNA, 61 nt, Homo Sapiens
cucuuggcuucuguuggaggacugccauuugacaguaaagggucauuuaaaaguaacaaaa

SEQ ID NO: 356565 - RNA, 61 nt, Homo Sapiens
acaaguaaaauaacuugacaacauuggguagacaguaaaaacugugaagaaaauucauuuu

SEQ ID NO: 356566 - RNA, 61 nt, Homo Sapiens
uacuucuuuuuccagggacgaaugguuagggacaguaaaucauuugaaagacugggaauuu

SEQ ID NO: 356567 - RNA, 61 nt, Homo Sapiens
auccuuucucguacagaauauagugcgugggacaguaaaggacacguaaaguagaagaauc

SEQ ID NO: 356568 - RNA, 61 nt, Homo Sapiens
gcggacuuuaaaaaaaauaaugugcuguaacacaguaaauauguacuuguagccuggauag

SEQ ID NO: 356569 - RNA, 61 nt, Homo Sapiens
ugaugugaccacacucuucuuaauuuuguucacaguaaaaacacuuuuuugaguuauuagg

SEQ ID NO: 356570 - RNA, 61 nt, Homo Sapiens
cgaacaguauucuuuuuugaugaauuuuuccacaguaaagcguacauaucuuaauuuugga

SEQ ID NO: 356571 - RNA, 61 nt, Homo Sapiens
guuauacuaguuuugagcuuagccaacuaauacaguaaacuaggaacugucaauaauugac

SEQ ID NO: 356572 - RNA, 64 nt, Homo Sapiens; identical to SEQ ID NO: 279953

SEQ ID NO: 356573 - RNA, 64 nt, Homo Sapiens; identical to SEQ ID NO: 279954

SEQ ID NO: 356574 - RNA, 64 nt, Homo Sapiens; identical to SEQ ID NO: 279955

SEQ ID NO: 356575 - RNA, 64 nt, Homo Sapiens; identical to SEQ ID NO: 279956

SEQ ID NO: 356576 - RNA, 64 nt, Homo Sapiens; identical to SEQ ID NO: 279957

SEQ ID NO: 356577 - RNA, 64 nt, Homo Sapiens; identical to SEQ ID NO: 279958

SEQ ID NO: 356578 - RNA, 64 nt, Homo Sapiens; identical to SEQ ID NO: 279959

SEQ ID NO: 356579 - RNA, 64 nt, Homo Sapiens; identical to SEQ ID NO: 279960

SEQ ID NO: 356580 - RNA, 64 nt, Homo Sapiens; identical to SEQ ID NO: 279961

SEQ ID NO: 356581 - RNA, 64 nt, Homo Sapiens; identical to SEQ ID NO: 279962

SEQ ID NO: 356582 - RNA, 64 nt, Homo Sapiens; identical to SEQ ID NO: 279963

SEQ ID NO: 356583 - RNA, 64 nt, Homo Sapiens; identical to SEQ ID NO: 279964

SEQ ID NO: 356584 - RNA, 64 nt, Homo Sapiens; identical to SEQ ID NO: 279965

SEQ ID NO: 356585 - RNA, 64 nt, Homo Sapiens; identical to SEQ ID NO: 279966

SEQ ID NO: 356586 - RNA, 64 nt, Homo Sapiens; identical to SEQ ID NO: 279967

SEQ ID NO: 356587 - RNA, 64 nt, Homo Sapiens; identical to SEQ ID NO: 279968

SEQ ID NO: 356588 - RNA, 64 nt, Homo Sapiens; identical to SEQ ID NO: 53771

SEQ ID NO: 356589 - RNA, 64 nt, Homo Sapiens; identical to SEQ ID NO: 53772

SEQ ID NO: 356590 - RNA, 64 nt, Homo Sapiens; identical to SEQ ID NO: 53773

SEQ ID NO: 356591 - RNA, 64 nt, Homo Sapiens; identical to SEQ ID NO: 53774

SEQ ID NO: 356592 - RNA, 64 nt, Homo Sapiens; identical to SEQ ID NO: 53775

SEQ ID NO: 356593 - RNA, 64 nt, Homo Sapiens; identical to SEQ ID NO: 53776

SEQ ID NO: 356594 - RNA, 64 nt, Homo Sapiens; identical to SEQ ID NO: 53777

SEQ ID NO: 356595 - RNA, 64 nt, Homo Sapiens; identical to SEQ ID NO: 53778

SEQ ID NO: 356596 - RNA, 64 nt, Homo Sapiens; identical to SEQ ID NO: 53779

SEQ ID NO: 356597 - RNA, 64 nt, Homo Sapiens; identical to SEQ ID NO: 53780

SEQ ID NO: 356598 - RNA, 64 nt, Homo Sapiens; identical to SEQ ID NO: 53781

SEQ ID NO: 356599 - RNA, 64 nt, Homo Sapiens; identical to SEQ ID NO: 53782

SEQ ID NO: 356600 - RNA, 64 nt, Homo Sapiens; identical to SEQ ID NO: 53783

SEQ ID NO: 356601 - RNA, 64 nt, Homo Sapiens; identical to SEQ ID NO: 53784

SEQ ID NO: 356602 - RNA, 64 nt, Homo Sapiens; identical to SEQ ID NO: 53785

SEQ ID NO: 356603 - RNA, 64 nt, Homo Sapiens; identical to SEQ ID NO: 53786

SEQ ID NO: 356604 - RNA, 64 nt, Homo Sapiens; identical to SEQ ID NO: 53787

SEQ ID NO: 356605 - RNA, 64 nt, Homo Sapiens; identical to SEQ ID NO: 53788

SEQ ID NO: 356606 - RNA, 64 nt, Homo Sapiens; identical to SEQ ID NO: 53789

SEQ ID NO: 356607 - RNA, 64 nt, Homo Sapiens; identical to SEQ ID NO: 53790

SEQ ID NO: 356608 - RNA, 64 nt, Homo Sapiens; identical to SEQ ID NO: 53791

SEQ ID NO: 356609 - RNA, 64 nt, Homo Sapiens; identical to SEQ ID NO: 53792

SEQ ID NO: 356610 - RNA, 64 nt, Homo Sapiens; identical to SEQ ID NO: 53793

SEQ ID NO: 356611 - RNA, 64 nt, Homo Sapiens; identical to SEQ ID NO: 53794

SEQ ID NO: 356612 - RNA, 64 nt, Homo Sapiens; identical to SEQ ID NO: 53795

SEQ ID NO: 356613 - RNA, 64 nt, Homo Sapiens; identical to SEQ ID NO: 53796

SEQ ID NO: 356614 - RNA, 64 nt, Homo Sapiens; identical to SEQ ID NO: 53797

SEQ ID NO: 356615 - RNA, 64 nt, Homo Sapiens; identical to SEQ ID NO: 53798

SEQ ID NO: 356616 - RNA, 64 nt, Homo Sapiens; identical to SEQ ID NO: 53799

SEQ ID NO: 356617 - RNA, 64 nt, Homo Sapiens; identical to SEQ ID NO: 53800

SEQ ID NO: 356618 - RNA, 64 nt, Homo Sapiens; identical to SEQ ID NO: 53801

SEQ ID NO: 356619 - RNA, 64 nt, Homo Sapiens; identical to SEQ ID NO: 53802

SEQ ID NO: 356620 - RNA, 64 nt, Homo Sapiens; identical to SEQ ID NO: 53803

SEQ ID NO: 356621 - RNA, 64 nt, Homo Sapiens; identical to SEQ ID NO: 53804

SEQ ID NO: 356622 - RNA, 64 nt, Homo Sapiens; identical to SEQ ID NO: 53805

SEQ ID NO: 356623 - RNA, 64 nt, Homo Sapiens; identical to SEQ ID NO: 53806

SEQ ID NO: 356624 - RNA, 64 nt, Homo Sapiens; identical to SEQ ID NO: 53807

SEQ ID NO: 356625 - RNA, 64 nt, Homo Sapiens; identical to SEQ ID NO: 53808

SEQ ID NO: 356626 - RNA, 64 nt, Homo Sapiens; identical to SEQ ID NO: 53809

SEQ ID NO: 356627 - RNA, 64 nt, Homo Sapiens; identical to SEQ ID NO: 53810

SEQ ID NO: 356628 - RNA, 64 nt, Homo Sapiens; identical to SEQ ID NO: 53811

SEQ ID NO: 356629 - RNA, 64 nt, Homo Sapiens; identical to SEQ ID NO: 53812

SEQ ID NO: 356630 - RNA, 64 nt, Homo Sapiens; identical to SEQ ID NO: 53813

SEQ ID NO: 356631 - RNA, 64 nt, Homo Sapiens; identical to SEQ ID NO: 53814

SEQ ID NO: 356632 - RNA, 64 nt, Homo Sapiens; identical to SEQ ID NO: 53815

SEQ ID NO: 356633 - RNA, 64 nt, Homo Sapiens; identical to SEQ ID NO: 296379

SEQ ID NO: 356634 - RNA, 64 nt, Homo Sapiens; identical to SEQ ID NO: 296380

SEQ ID NO: 356635 - RNA, 64 nt, Homo Sapiens; identical to SEQ ID NO: 296381

SEQ ID NO: 356636 - RNA, 64 nt, Homo Sapiens; identical to SEQ ID NO: 296382

SEQ ID NO: 356637 - RNA, 64 nt, Homo Sapiens; identical to SEQ ID NO: 296383

SEQ ID NO: 356638 - RNA, 64 nt, Homo Sapiens; identical to SEQ ID NO: 296384

SEQ ID NO: 356639 - RNA, 64 nt, Homo Sapiens; identical to SEQ ID NO: 296385

SEQ ID NO: 356640 - RNA, 64 nt, Homo Sapiens; identical to SEQ ID NO: 296386

SEQ ID NO: 356641 - RNA, 64 nt, Homo Sapiens; identical to SEQ ID NO: 296387

SEQ ID NO: 356642 - RNA, 64 nt, Homo Sapiens; identical to SEQ ID NO: 296388

SEQ ID NO: 356643 - RNA, 64 nt, Homo Sapiens; identical to SEQ ID NO: 296389

SEQ ID NO: 356644 - RNA, 64 nt, Homo Sapiens; identical to SEQ ID NO: 296390

SEQ ID NO: 356645 - RNA, 64 nt, Homo Sapiens; identical to SEQ ID NO: 296391

SEQ ID NO: 356646 - RNA, 64 nt, Homo Sapiens; identical to SEQ ID NO: 296392

SEQ ID NO: 356647 - RNA, 64 nt, Homo Sapiens; identical to SEQ ID NO: 296393

SEQ ID NO: 356648 - RNA, 64 nt, Homo Sapiens; identical to SEQ ID NO: 296394

SEQ ID NO: 356649 - RNA, 64 nt, Homo Sapiens; identical to SEQ ID NO: 296395

SEQ ID NO: 356650 - RNA, 64 nt, Homo Sapiens; identical to SEQ ID NO: 296396

SEQ ID NO: 356651 - RNA, 64 nt, Homo Sapiens; identical to SEQ ID NO: 296397

SEQ ID NO: 356652 - RNA, 64 nt, Homo Sapiens; identical to SEQ ID NO: 296398

SEQ ID NO: 356653 - RNA, 64 nt, Homo Sapiens; identical to SEQ ID NO: 296399

SEQ ID NO: 356654 - RNA, 64 nt, Homo Sapiens; identical to SEQ ID NO: 296400

SEQ ID NO: 356655 - RNA, 64 nt, Homo Sapiens; identical to SEQ ID NO: 296401

SEQ ID NO: 356656 - RNA, 64 nt, Homo Sapiens; identical to SEQ ID NO: 296402

SEQ ID NO: 356657 - RNA, 64 nt, Homo Sapiens; identical to SEQ ID NO: 296403

SEQ ID NO: 356658 - RNA, 64 nt, Homo Sapiens; identical to SEQ ID NO: 296404

SEQ ID NO: 356659 - RNA, 64 nt, Homo Sapiens; identical to SEQ ID NO: 296405

SEQ ID NO: 356660 - RNA, 64 nt, Homo Sapiens; identical to SEQ ID NO: 296406

SEQ ID NO: 356661 - RNA, 64 nt, Homo Sapiens; identical to SEQ ID NO: 296407

SEQ ID NO: 356662 - RNA, 64 nt, Homo Sapiens; identical to SEQ ID NO: 296408

SEQ ID NO: 356663 - RNA, 64 nt, Homo Sapiens; identical to SEQ ID NO: 296409

SEQ ID NO: 356664 - RNA, 64 nt, Homo Sapiens; identical to SEQ ID NO: 296410

SEQ ID NO: 356665 - RNA, 64 nt, Homo Sapiens; identical to SEQ ID NO: 296402

SEQ ID NO: 356666 - RNA, 64 nt, Homo Sapiens; identical to SEQ ID NO: 296403

SEQ ID NO: 356667 - RNA, 64 nt, Homo Sapiens; identical to SEQ ID NO: 296404

SEQ ID NO: 356668 - RNA, 64 nt, Homo Sapiens; identical to SEQ ID NO: 296414

SEQ ID NO: 356669 - RNA, 64 nt, Homo Sapiens; identical to SEQ ID NO: 296415

SEQ ID NO: 356670 - RNA, 64 nt, Homo Sapiens; identical to SEQ ID NO: 296416

SEQ ID NO: 356671 - RNA, 64 nt, Homo Sapiens; identical to SEQ ID NO: 296417

SEQ ID NO: 356672 - RNA, 64 nt, Homo Sapiens; identical to SEQ ID NO: 296418

SEQ ID NO: 356673 - RNA, 64 nt, Homo Sapiens; identical to SEQ ID NO: 296419

SEQ ID NO: 356674 - RNA, 64 nt, Homo Sapiens; identical to SEQ ID NO: 296420

SEQ ID NO: 356675 - RNA, 64 nt, Homo Sapiens; identical to SEQ ID NO: 296421

SEQ ID NO: 356676 - RNA, 64 nt, Homo Sapiens; identical to SEQ ID NO: 296422

SEQ ID NO: 356677 - RNA, 64 nt, Homo Sapiens; identical to SEQ ID NO: 296423

SEQ ID NO: 356678 - RNA, 64 nt, Homo Sapiens; identical to SEQ ID NO: 296424

SEQ ID NO: 356679 - RNA, 64 nt, Homo Sapiens; identical to SEQ ID NO: 296425

SEQ ID NO: 356680 - RNA, 64 nt, Homo Sapiens; identical to SEQ ID NO: 296426

SEQ ID NO: 356681 - RNA, 64 nt, Homo Sapiens; identical to SEQ ID NO: 296427

SEQ ID NO: 356682 - RNA, 64 nt, Homo Sapiens; identical to SEQ ID NO: 296428

SEQ ID NO: 356683 - RNA, 64 nt, Homo Sapiens; identical to SEQ ID NO: 296429

SEQ ID NO: 356684 - RNA, 64 nt, Homo Sapiens; identical to SEQ ID NO: 296430

SEQ ID NO: 356685 - RNA, 64 nt, Homo Sapiens; identical to SEQ ID NO: 296431

SEQ ID NO: 356686 - RNA, 63 nt, Homo Sapiens
aacuccugaccucaggugauccgcccaccucagccucccaaagugcugggaugacagguguga

SEQ ID NO: 356687 - RNA, 63 nt, Homo Sapiens
gccucucagguucaagugguucuccuuccucagccucccaaguagcugggauuacaggcaccu

SEQ ID NO: 356688 - RNA, 63 nt, Homo Sapiens
guaugguaggggguuugaagaauccccuguccaccucccaaauccaggcccggcccccucugg

SEQ ID NO: 356689 - RNA, 63 nt, Homo Sapiens
caaucuccugaccucgugauccacccaccucgaccucccaaagugcugagauuacaggcguga

SEQ ID NO: 356690 - RNA, 63 nt, Homo Sapiens
aacuccugaccucaagugaucugcccgccucggccucccaaagugcuggaaccacaggccuga

SEQ ID NO: 356691 - RNA, 63 nt, Homo Sapiens
ggaucucuuggccucaugaucagccugccucggccucccaaagugcugggauuacagguguga

SEQ ID NO: 356692 - RNA, 63 nt, Homo Sapiens
gccuccuggguucaagcaguucucuugccucagccucccaaguagcugggaugacaggcgcac

SEQ ID NO: 356693 - RNA, 63 nt, Homo Sapiens
aacuccugaccucaggugauccacccaccuuggccucccaaagugcugggauuacagguguga

SEQ ID NO: 356694 - RNA, 63 nt, Homo Sapiens
ucugccucccggguucaagccauucugccucagccucccaaguagcugggaguacaggcgucu

SEQ ID NO: 356695 - RNA, 63 nt, Homo Sapiens
cgauauccugaucucgugauccgccugccucugccucccaaagugcugggauuacagguguga

SEQ ID NO: 356696 - RNA, 63 nt, Homo Sapiens
aacuccuaaccucgggugauccacccaccuuggccucccaaaguguuaggauuacaggcauga

SEQ ID NO: 356697 - RNA, 63 nt, Homo Sapiens
ugaucucuugaccucgugauccguccaccucagccucccaaagugcugggauuacagguguga

SEQ ID NO: 356698 - RNA, 63 nt, Homo Sapiens
gacuccugaccucaggucauccuccugccucggccucccaaagugcugagacuacagguguga

SEQ ID NO: 356699 - RNA, 63 nt, Homo Sapiens
gaagaucucugccuacaugaaguccagccgcuuccucccaaaaccucuguacacaaggguggc

SEQ ID NO: 356700 - RNA, 63 nt, Homo Sapiens
ccucagcuacccacuuuccuucaugaacaucccccucccaacacuacccuucccugcacuaaa

SEQ ID NO: 356701 - RNA, 63 nt, Homo Sapiens
aacuccuggccucaggugauccucuugucucagccucccaaagugcugggauuacaggcauga

SEQ ID NO: 356702 - RNA, 63 nt, Homo Sapiens
gccucuuggguucaagcgauucuccugccucagccucccaaguagcugggauuacaggcauac

SEQ ID NO: 356703 - RNA, 63 nt, Homo Sapiens
aacuccugaccucaaguaaucugcccaccucggccucccaaagugcuaggauuacaggaguga

SEQ ID NO: 356704 - RNA, 63 nt, Homo Sapiens
gcccuccagguucaagugauucuccucccucagccucccaaguagcugggauuacaggcaccc

SEQ ID NO: 356705 - RNA, 63 nt, Homo Sapiens
aauuccagaccucaggugauccacccgccucggccucccaaagugcugggauuacaggugcga

SEQ ID NO: 356706 - RNA, 63 nt, Homo Sapiens
gccuccugggcucaagcaauccucccacuucagccucccaaauagcuggggcuaccaugguau

SEQ ID NO: 356707 - RNA, 63 nt, Homo Sapiens
aacuccuggccucaugugaucugcccaccucagccucccaaaguacagggauuagaguuguga

SEQ ID NO: 356708 - RNA, 63 nt, Homo Sapiens
ugcugggauuacaggcgugaccgcccgccucggccucccaaagaacuccugaccucaggugau

SEQ ID NO: 356709 - RNA, 63 nt, Homo Sapiens
agcugggauuacaggcacccucuccugccucagccucccaaguaccucccggguucaagugau

SEQ ID NO: 356710 - RNA, 63 nt, Homo Sapiens
uacugggauuuaggcaugagcugccugcuucagccucccaaagaacuacugagcucaagcaau

SEQ ID NO: 356711 - RNA, 63 nt, Homo Sapiens
uacacccucaaguagaccccugaucuucucccuccucccaaccauacccaauagguuuuuuuc

SEQ ID NO: 356712 - RNA, 63 nt, Homo Sapiens
ugcugggauuacuagacguaccacccacuuugaccucccaaagaacuucugaccucaggugau

SEQ ID NO: 356713 - RNA, 63 nt, Homo Sapiens
uguggggauuacaggugcgaccuccugccucagccucccaaagaacuccuggccucaaguggu

SEQ ID NO: 356714 - RNA, 63 nt, Homo Sapiens
ugcugggauuacaggugugaccacccgccucagccucccaaagaacuccuaaccucaagugau

SEQ ID NO: 356715 - RNA, 63 nt, Homo Sapiens
uucugggauuacaggugugacugcccaccucggccucccaaagcgaacuccugaccucguaau

SEQ ID NO: 356716 - RNA, 63 nt, Homo Sapiens
guuuccccuucacacuccugguucacccacccuccucccaauuccggccucugcucuccccac

SEQ ID NO: 356717 - RNA, 63 nt, Homo Sapiens
ugcugggauuacaggcgugacugccugccuuggccucccaaagcgaucucuugaccucgugau

SEQ ID NO: 356718 - RNA, 63 nt, Homo Sapiens
uccauuucugucacccuuuugcugugcugcuucccucccaaacaucacuccccacuucuuucu

SEQ ID NO: 356719 - RNA, 63 nt, Homo Sapiens
ugcugggauuacaggcgugaccgccugccucugccucccaaagcgaucuccugaccucgugau

SEQ ID NO: 356720 - RNA, 63 nt, Homo Sapiens
agcugggacuacaggcgccuucuccugccucacccucccaagugccucccagguugacaccau

SEQ ID NO: 356721 - RNA, 63 nt, Homo Sapiens
aacuccuggccucaagcaauccucucuccucagccucccaaagugcugggauuacaaguguga

SEQ ID NO: 356722 - RNA, 63 nt, Homo Sapiens
aacuccuggguucaagcaauccucccaccucggccucccaaagugcugggauugcaggcauga

SEQ ID NO: 356723 - RNA, 63 nt, Homo Sapiens
agguuguggaauuucuuucuucuccccuucuucccucccaaaagcuuagcuauguauaaagug

SEQ ID NO: 356724 - RNA, 63 nt, Homo Sapiens
auuaugaucugacuggaaaacaauccuguauccccucccaaagaaucaugggcuuuuuuuuug

SEQ ID NO: 356725 - RNA, 63 nt, Homo Sapiens
aacuccuaggcuuaagugauccucccgccuuagccucccaagugcuaggauuacaggcaucag

SEQ ID NO: 356726 - RNA, 63 nt, Homo Sapiens
gccucccagcuucaagcgauucuccuguaucagccucccaaguagcugggauuauaggcaugu

SEQ ID NO: 356727 - RNA, 63 nt, Homo Sapiens
gccucccggauucaagugauucuccugucucagccucccaaguagcugggauuacagugccug

SEQ ID NO: 356728 - RNA, 63 nt, Homo Sapiens
cgaacuccugaccucaugagccgcccgccuuggccucccaaagugcugggacgugacaggagu

SEQ ID NO: 356729 - RNA, 63 nt, Homo Sapiens
ugcugggauuacaggcuugacuacccaccuugaccucccaaagaacucuugagcucaagcagu

SEQ ID NO: 356730 - RNA, 63 nt, Homo Sapiens
agcugggacuauaggcaugcccucccacuucaaccucccaagugccuucugggcucaagcaau

SEQ ID NO: 356731 - RNA, 63 nt, Homo Sapiens
uggugagauuacaggcaugacccccugccuuggccucccaaacaacuccugggcucaagugau

SEQ ID NO: 356732 - RNA, 63 nt, Homo Sapiens
aacuggggccacaggugugccccgcugccucagccucccaaauuggcucacugaagucuugac

SEQ ID NO: 356733 - RNA, 63 nt, Homo Sapiens
ugcugggauuacaggugugaccgcccgccucagccucccaaagaacucuugacuucaagugau

SEQ ID NO: 356734 - RNA, 63 nt, Homo Sapiens
agcugggauuaaaggcacguucuugugccucagccucccaaguaccuccuggguucaagugau

SEQ ID NO: 356735 - RNA, 63 nt, Homo Sapiens
agcugagauuacaggcgugacugucugccucggccucccaaagaacuccugacuucaggugau

SEQ ID NO: 356736 - RNA, 63 nt, Homo Sapiens
agcugggacuaugggugcacucuccuaccucagccucccaaguaccuccugaguucaagccau

SEQ ID NO: 356737 - RNA, 63 nt, Homo Sapiens
ucccccuggguugaagcaauucucaugccucagccucccaaguagccaggacuauaggcaccu

SEQ ID NO: 356738 - RNA, 63 nt, Homo Sapiens
cgaucucuugaccuugggauccacccgccuuggccucccaaagugcugggauuacagguguga

SEQ ID NO: 356739 - RNA, 63 nt, Homo Sapiens
aaacccuuggcucaagcaauuugccugccucagccucccaaagugcugggauuacaggcguga

SEQ ID NO: 356740 - RNA, 63 nt, Homo Sapiens
accuccuggguucaugccauucuucugccucagccucccaaguagcugggacuacaggugccc

SEQ ID NO: 356741 - RNA, 63 nt, Homo Sapiens
cgaucuccugaccuugugauccaccugucucggccucccaaagugcugggauuacaggccuca

SEQ ID NO: 356742 - RNA, 63 nt, Homo Sapiens
aacuccugaccuccagugauccgccugccuugaccucccaaagugcugggauuacagacauga

SEQ ID NO: 356743 - RNA, 63 nt, Homo Sapiens
acuccuggacuuaacgccauccaccugccacagccucccaaagugcuaggaauacaggagugc

SEQ ID NO: 356744 - RNA, 63 nt, Homo Sapiens
cgccuccugggucaaaugauucuccugcuuuagccucccaaguagcugggacuacagguguac

SEQ ID NO: 356745 - RNA, 63 nt, Homo Sapiens
aacuccugagcucaagugauccucccgucucagccucccaaagggcugagauuacagguguga

SEQ ID NO: 356746 - RNA, 63 nt, Homo Sapiens
accuccccggcucaagugauccuccugccucagccucccaaguagcugggacuacaggcguuc

SEQ ID NO: 356747 - RNA, 63 nt, Homo Sapiens
aacuccuggacucaaaguauccucccgccucggccucccaaaguguugggauuauaggaguga

SEQ ID NO: 356748 - RNA, 63 nt, Homo Sapiens
gaacuccuggccuaggugauccacccgccucgaccucccaaagugcugggauuacaggcauga

SEQ ID NO: 356749 - RNA, 63 nt, Homo Sapiens
cuaccucuaccaugagcaauucuccugccucagccucccaaguagcuggaacuacaggcucau

SEQ ID NO: 356750 - RNA, 63 nt, Homo Sapiens
caaacuccugacuuugugauccacccgccucggccucccaaagugcugggauuacaggcauga

SEQ ID NO: 356751 - RNA, 63 nt, Homo Sapiens
ugcugggauuacaggugugaccacccgccucggccucccaaaacgaucuccugacgucgugau

SEQ ID NO: 356752 - RNA, 63 nt, Homo Sapiens
ugcugggauuacaggcgugaccacccaccucugccucccaaagaacuccugggcucaagcaau

SEQ ID NO: 356753 - RNA, 63 nt, Homo Sapiens
ugcugggauuacagaugugaccuccugccucggccucccaaagaccuccugggcucaagcaau

SEQ ID NO: 356754 - RNA, 63 nt, Homo Sapiens
agcugggaucacuggcacaaucucccaccucagccucccaaaugccuccugggcucaagcaau

SEQ ID NO: 356755 - RNA, 63 nt, Homo Sapiens
ggaagacagcucgagauccaaaccauugucuuaccucccaacucccucuccucccaaaccaaa

SEQ ID NO: 356756 - RNA, 63 nt, Homo Sapiens
caaaaaccauugucuuaccugccgccccccucuccucccaaacacaaauaaucucuuggaucu

SEQ ID NO: 356757 - RNA, 63 nt, Homo Sapiens
ugcugggauuacaggugugauccucccaccuugccucccaaagcgaacucuggguucaagaaa

SEQ ID NO: 356758 - RNA, 63 nt, Homo Sapiens
agcugggauuacaggcgugcucuugugccuuagccucccaagugccuucuggauucaagugau

SEQ ID NO: 356759 - RNA, 63 nt, Homo Sapiens
acccacuugauuauguauuuucaaaggcaucauccucccaacugguuucauuucagggcauag

SEQ ID NO: 356760 - RNA, 63 nt, Homo Sapiens
ugcugggauugcaggcaugaccacccgccucagccucccaaagugaucuccugaccucgugau

SEQ ID NO: 356761 - RNA, 63 nt, Homo Sapiens
ugcugggauuacaggcaugaccaccugccucagccucccaaagaacuccugaccucaggugau

SEQ ID NO: 356762 - RNA, 63 nt, Homo Sapiens
agcugggacuacaggugcauucuccugccucagccucccaagugccucccgaguucaagcaau

SEQ ID NO: 356763 - RNA, 63 nt, Homo Sapiens
aacuccugaccucaggugaucugcccaccuuggccucccaaagugcugggauuacaggcauga

SEQ ID NO: 356764 - RNA, 63 nt, Homo Sapiens
aacuccugaccucaacugauccgcccaccuuggccucccaagugcugggauuacaggcgcgag

SEQ ID NO: 356765 - RNA, 63 nt, Homo Sapiens
accuccuggguucaagcauuucuccugccucagccucccaaguagcugggauuacaggcagca

SEQ ID NO: 356766 - RNA, 63 nt, Homo Sapiens
aacuccugaccucaagugauccgcccuccccagccucccaaagugcugggauuacagguguga

SEQ ID NO: 356767 - RNA, 63 nt, Homo Sapiens
caguggcgcaaucucgggucacugcaagcucugccucccaaguucaugccauucuccugccuc

SEQ ID NO: 356768 - RNA, 63 nt, Homo Sapiens
gccucccaaguucaugccauucuccugccucagccucccaaguagcugggacuacaggcaccu

SEQ ID NO: 356769 - RNA, 63 nt, Homo Sapiens
ucuugaucugaccucgugauccgccgaccucggccucccaaagugcuggaauuacaggcguga

SEQ ID NO: 356770 - RNA, 63 nt, Homo Sapiens
ugccucccaguucaagcaauucuucugccucagccucccaaguagcugggauuacaggcaccc

SEQ ID NO: 356771 - RNA, 63 nt, Homo Sapiens
aacuucugaccucaagugaucugcccaccuuggccucccaaagugcugggauuacagguguaa

SEQ ID NO: 356772 - RNA, 63 nt, Homo Sapiens
accucccagguucaagcaauucuucugccucagccucccaaguagcugggauuacaggugccu

SEQ ID NO: 356773 - RNA, 63 nt, Homo Sapiens
aacuccugaccucaagugauccaccugccucagccucccaaagugcugggauuauagucguga

SEQ ID NO: 356774 - RNA, 63 nt, Homo Sapiens
ugaucucuugaccucgugaucugccugccucggccucccaaagugcuggcauuacaggcauga

SEQ ID NO: 356775 - RNA, 63 nt, Homo Sapiens
accucccggguucaagugauucucuggccucagccucccaaguagcugggacuacaggugugu

SEQ ID NO: 356776 - RNA, 63 nt, Homo Sapiens
aacuccugaccuccagugaucugcccaccucggccucccaaagugcugggauuacagguguga

SEQ ID NO: 356777 - RNA, 63 nt, Homo Sapiens
ugcugggauuacaggugugaccacccgucucggccucccaaagcaaucuccugaccuugugaa

SEQ ID NO: 356778 - RNA, 63 nt, Homo Sapiens
agcugggacuacaggcacccucuccuggcucagccucccaagugcuucccagguucacgccau

SEQ ID NO: 356779 - RNA, 63 nt, Homo Sapiens
uacugggauuacaggcuugacuucccacaccagccucccaaaaaacccuugagcucaagugau

SEQ ID NO: 356780 - RNA, 63 nt, Homo Sapiens
agcuaggacuacagacauguccucccaucucagccucccaaguaccuccuugacucaauugau

SEQ ID NO: 356781 - RNA, 63 nt, Homo Sapiens
ugcugggauuacaggcaugacugccagccuccgccucccaacguggccucgaacucaggugau

SEQ ID NO: 356782 - RNA, 63 nt, Homo Sapiens
agcugggacuacaggcauguucucaugccucagccucccaagcgcuuccuggguucaaacaau

SEQ ID NO: 356783 - RNA, 63 nt, Homo Sapiens
cgaucuccugaccucaugauccacccgccucagccucccaaaguguugggauuacaggcguga

SEQ ID NO: 356784 - RNA, 63 nt, Homo Sapiens
gccuccuggguucaagcgauucuccugccucugccucccaaguagcugggauuacaggcaccc

SEQ ID NO: 356785 - RNA, 63 nt, Homo Sapiens
accuuccugguucaagggauucuccugccucagccucccaaguagcugggauuacaggcaugc

SEQ ID NO: 356786 - RNA, 63 nt, Homo Sapiens
aacuucugaccucaggugaucugcccaccucggccucccaaagugcugggauuacaggcguga

SEQ ID NO: 356787 - RNA, 63 nt, Homo Sapiens
aacuccugggcucaagugauccuccugccuuggccucccaaaaugcugggauuacaggcauga

SEQ ID NO: 356788 - RNA, 63 nt, Homo Sapiens
gccucccggguucaagcaauucuccugccucagccucccaaguagcugggauuacaggugucu

SEQ ID NO: 356789 - RNA, 63 nt, Homo Sapiens
aacuccugaccucaggugauccacccgccucagccucccaaagugcugggauuacaggcaaaa

SEQ ID NO: 356790 - RNA, 63 nt, Homo Sapiens
cgaacuccugaccuugugaugcucccaccucggccucccaaagugcugggauuaaagcuguga

SEQ ID NO: 356791 - RNA, 63 nt, Homo Sapiens
cgaucuccugaccucaugauccucccgccucagccucccaaaaugcugggauuacaggcguga

SEQ ID NO: 356792 - RNA, 63 nt, Homo Sapiens
gccuccugggcucaacggauccuuccaccucagccucccaaguagcuuggacuauaggugcau

SEQ ID NO: 356793 - RNA, 63 nt, Homo Sapiens
aacuccugggcucaagccauccucccuccucagccucccaaaauucugggauuacaggcauaa

SEQ ID NO: 356794 - RNA, 63 nt, Homo Sapiens
uaaacucuugaccucauguuccacccgccacggccucccaaagugcugugauuaccgguguga

SEQ ID NO: 356795 - RNA, 63 nt, Homo Sapiens
aacuucugagcucaagagaugcacuccccucagccucccaaagugcugggauuacaggcggcc

SEQ ID NO: 356796 - RNA, 63 nt, Homo Sapiens
acugauguuuguuuuuuaaaggguaagaugcugccucccaaugggugaugccaucugacuggu

SEQ ID NO: 356797 - RNA, 63 nt, Homo Sapiens
accucccagguucaagugauucuccugucucagccucccaaguagcugggacuacaggcauga

SEQ ID NO: 356798 - RNA, 63 nt, Homo Sapiens
ggaccugagccagaugcacaccaucucugauggccucccaaaccaaugugccuguuucucuuc

SEQ ID NO: 356799 - RNA, 63 nt, Homo Sapiens
cacauccccugcuugagcccagcgcugcaugucccucccaagaaguccagaaugccugcaaau

SEQ ID NO: 356800 - RNA, 63 nt, Homo Sapiens
ugcugggauuacagggacgaccucucaucuuggccucccaaaggacuccugguuucaagugau

SEQ ID NO: 356801 - RNA, 63 nt, Homo Sapiens
ugcuaggauuacaggcgugauccgccgccucggccucccaaagucucgaacucgaccucguga

SEQ ID NO: 356802 - RNA, 63 nt, Homo Sapiens
ugcugggacuacaggcaugacuuccuaucucagccucccaaagaacuccuggucucgagugau

SEQ ID NO: 356803 - RNA, 63 nt, Homo Sapiens
aacuaagacuacaggcaugcccugcugucucagccucccaaguaacuccugggcucaagcaau

SEQ ID NO: 356804 - RNA, 63 nt, Homo Sapiens
ugcuggauuacaggcgugagcuuccggccucagccucccaaagaacuccugaccucaagugau

SEQ ID NO: 356805 - RNA, 63 nt, Homo Sapiens
agcugggauuacaccaccauccucccaggucagccucccaaguuuggcucauugcaaccucug

SEQ ID NO: 356806 - RNA, 63 nt, Homo Sapiens
agcuggauuacaggcauacaucuccugccucagccucccaaguaacucccagguucaagcuau

SEQ ID NO: 356807 - RNA, 63 nt, Homo Sapiens
gcugucuccaguucuaguucuuaucgcugcuguccucccaacacgcuacagggcaccuaucug

SEQ ID NO: 356808 - RNA, 63 nt, Homo Sapiens
uacugggauuacaggcaccuucuccugccucagccucccaauugccucccagguucaagcgau

SEQ ID NO: 356809 - RNA, 63 nt, Homo Sapiens
ugcugggauuacaggcgugaucaccugccucggccucccaaagaacuccugaccucaagugau

SEQ ID NO: 356810 - RNA, 63 nt, Homo Sapiens
agcugggauuacaggcauguucuccugucucagccucccaaguaccuccuggguucaagcaag

SEQ ID NO: 356811 - RNA, 63 nt, Homo Sapiens
uguucuguauuuagguaguuguuugacccacauccucccaauugcugaguggagcucagcugu

SEQ ID NO: 356812 - RNA, 63 nt, Homo Sapiens
ugcugggauuacaggugugaccacccaccucagccucccaaagacuuccugaccucagguuau

SEQ ID NO: 356813 - RNA, 63 nt, Homo Sapiens
agcugggguuacaggcgcccucucgugccucagccucccaaguaccuccuggguucaagugau

SEQ ID NO: 356814 - RNA, 63 nt, Homo Sapiens
ugcugggauuacaggcgugaccacccgccuuggccucccaaagcaaucuccugaccucgugau

SEQ ID NO: 356815 - RNA, 63 nt, Homo Sapiens
ucacuccauucuccugccucacugcaagcuccgccucccaagucaguggcgcgaucucagcuc

SEQ ID NO: 356816 - RNA, 63 nt, Homo Sapiens
ugcugagauuacaagugugaccacuugccucggccucccaaagaacuccugaccucaggugau

SEQ ID NO: 356817 - RNA, 63 nt, Homo Sapiens
agcuaggauuacaagugccuucuucugccucagccucccaaguaccuccuggguucaagcgau

SEQ ID NO: 356818 - RNA, 63 nt, Homo Sapiens
ugcugggaucacaggcgugaccacccaccccggccucccaaaaaacucccgaccucaggugau

SEQ ID NO: 356819 - RNA, 63 nt, Homo Sapiens
cucucccgggcuccagugauccucccgccucagccucccaaguagcugggauuauaggugugu

SEQ ID NO: 356820 - RNA, 63 nt, Homo Sapiens
aacucccagccucaagcgaugcucccaccuccaccucccaaagugcugggauuacaggcguga

SEQ ID NO: 356821 - RNA, 63 nt, Homo Sapiens
accucccagacucaagccauccucccaccucaaccucccaaguagcugggacuacaggcauau

SEQ ID NO: 356822 - RNA, 63 nt, Homo Sapiens
aaauucugggcuaaagcaauccuaccaccuuggccucccaaagugcugagauuacaggcauga

SEQ ID NO: 356823 - RNA, 63 nt, Homo Sapiens
gccucccagguucaagugauucuccugccucagccucccaaguagcugggauuacaggcgugc

SEQ ID NO: 356824 - RNA, 63 nt, Homo Sapiens
aacucccgaccucaggugauccgccagccucagccucccaaagugcugggauuacaggcguga

SEQ ID NO: 356825 - RNA, 63 nt, Homo Sapiens
aauuccugaccucaagugauccaccugccuuagccucccaaagugcugggauuacaggcauga

SEQ ID NO: 356826 - RNA, 63 nt, Homo Sapiens
cgaucucuugaccuuguguuccacccgccuuggccucccaaagugcuggaauuacaggcauga

SEQ ID NO: 356827 - RNA, 63 nt, Homo Sapiens
gacuccaggguucaggugauuauuuugccucagccucccaagcagcugggauuauagacaccc

SEQ ID NO: 356828 - RNA, 63 nt, Homo Sapiens
aacuccugaccucaggugauccgcccgccucggccucccaaagugcugggauuacagacguga

SEQ ID NO: 356829 - RNA, 63 nt, Homo Sapiens
ugcuaggauuacaggcauaaccgccuaccucagccucccaaagaacuccuggccucaagcgau

SEQ ID NO: 356830 - RNA, 63 nt, Homo Sapiens
agcugagacuacaagcacccucucuugcuucagccucccaaguuccuccuggauucaagcaau

SEQ ID NO: 356831 - RNA, 63 nt, Homo Sapiens
ugcugggauuacaggcuugaccacccgccucggccucccaaagcgaucuccugaccucgugau

SEQ ID NO: 356832 - RNA, 63 nt, Homo Sapiens
gcuggcaggccacugugcauugcacaugcguccccucccaagucacaacuucaguaaaaacac

SEQ ID NO: 356833 - RNA, 63 nt, Homo Sapiens
gauaggaaacaccugaagcucagggaacgauggccucccaauauaaugaguggcagcuggcgc

SEQ ID NO: 356834 - RNA, 63 nt, Homo Sapiens
uacuaggaguacaggcauagccaccuuccucggccucccaaagaacuccugaguucaagcaau

SEQ ID NO: 356835 - RNA, 63 nt, Homo Sapiens
agcugggaccacaagugugcccuuccaccucagccucccaaguacgucccccgcucagguggu

SEQ ID NO: 356836 - RNA, 63 nt, Homo Sapiens
accccaaacaaauggaagaguauuuaaaacucaccucccaauccguuagagagcugagacccu

SEQ ID NO: 356837 - RNA, 63 nt, Homo Sapiens
gggcuccucacuaucuagggcagcucugugccaccucccaagacaccuggaaucccacaacau

SEQ ID NO: 356838 - RNA, 63 nt, Homo Sapiens
ugcugggauuacaggcgugacugcccgccucggccucccaaagcgaucuccugaccuugugau

SEQ ID NO: 356839 - RNA, 63 nt, Homo Sapiens
uauugggauuacccgcgugaccgcccgccucggccucccaaagcgaucuccuaaccuggugau

SEQ ID NO: 356840 - RNA, 63 nt, Homo Sapiens
agcucggacuacaggcguccucuccugccucagccucccaagugccucucggguucacgccau

SEQ ID NO: 356841 - RNA, 63 nt, Homo Sapiens
ugcugggauuacaggcgugacugcccaccucagccucccaaagaauuccugaccucaggugau

SEQ ID NO: 356842 - RNA, 63 nt, Homo Sapiens
uggcaaaaauuagcuauacugcagaauuccauuccucccaagguaggauuaauucgaaaauag

SEQ ID NO: 356843 - RNA, 63 nt, Homo Sapiens
uuuuucuuauggcuguugaauucguaucuugaaccucccaacaguuauacagaauugaaagcc

SEQ ID NO: 356844 - RNA, 63 nt, Homo Sapiens
ugcugggauuacaggcgugacagcccgccucggccucccaaagaacuccugaccacagguaau

SEQ ID NO: 356845 - RNA, 63 nt, Homo Sapiens
ugcugggauuacaggcuugaccaccugccucagccucccaaaaucuugaacugaccucaugau

SEQ ID NO: 356846 - RNA, 63 nt, Homo Sapiens
ugcugugauuacaggugugaccacccgccucgaccucccaaagcgaucucuugaccucaugau

SEQ ID NO: 356847 - RNA, 63 nt, Homo Sapiens
ugcugugauuauaggccagagaucucaagccacccucccaaaaugcccaggucucaaacuccc

SEQ ID NO: 356848 - RNA, 63 nt, Homo Sapiens
agcuaggacuacaggcacauccuuuugcuucagccucccaagcaacuccugggcucaagagau

SEQ ID NO: 356849 - RNA, 63 nt, Homo Sapiens
ugcugggauuacaggcgugaccuucugccuuggccucccaaagaacuccugaccucagguggu

SEQ ID NO: 356850 - RNA, 63 nt, Homo Sapiens
ugcugggauuacaggagugacugcccgccucagccucccaaagcgaucuccugaccucgugau

SEQ ID NO: 356851 - RNA, 63 nt, Homo Sapiens
uuuuuuuuauuuugagcaauucuccugccucagccucccaaauagcugggauuacaggugcau

SEQ ID NO: 356852 - RNA, 63 nt, Homo Sapiens
aacuccugaccucagaugauccgccugccuuggccucccaaagugcugggauuacaggugugg

SEQ ID NO: 356853 - RNA, 63 nt, Homo Sapiens
aacuccugaccucaggugauacacccaucucggccucccaaagugcugggauuacaggcuuga

SEQ ID NO: 356854 - RNA, 63 nt, Homo Sapiens
acaggcuggccucaagugauccucuuaccuuggccucccaaacaccgggauuauaggcgugag

SEQ ID NO: 356855 - RNA, 63 nt, Homo Sapiens
ugcugggauuacaggcgugacuaccugccucggccucccaaagaacucccgacgucaggugau

SEQ ID NO: 356856 - RNA, 63 nt, Homo Sapiens
uucuaggauuacaggugugaccacccaccuuggccucccaaaguggacuccugaccucgugau

SEQ ID NO: 356857 - RNA, 63 nt, Homo Sapiens
ugcugggauuacaggcaugaccacccgccuuggccucccaaagugaacuccugaccucgugau

SEQ ID NO: 356858 - RNA, 63 nt, Homo Sapiens
aguugggauuacaggcaccuuucucugccucagccucccaaguugccucccggguucaagcaa

SEQ ID NO: 356859 - RNA, 63 nt, Homo Sapiens
cccuuauuuuuaaaauacuuggucagaucuuggccucccaaacaggaguccuucuacagaaua

SEQ ID NO: 356860 - RNA, 63 nt, Homo Sapiens
ugcuaggauuacagguaugacugcccgccuuggccucccaaagaacuccugagcucaggcaau

SEQ ID NO: 356861 - RNA, 63 nt, Homo Sapiens
gccucccaguuucaagugauucugcugucucagccucccaaguagcugggacuacaggcaugc

SEQ ID NO: 356862 - RNA, 63 nt, Homo Sapiens
ccaucucuugacauugugauccaccugccucggccucccaaagugcugggauuacaggcauga

SEQ ID NO: 356863 - RNA, 63 nt, Homo Sapiens
uccugggcuccagggauccacagucccccuuggccucccaaaguguugggauuacaugcauga

SEQ ID NO: 356864 - RNA, 63 nt, Homo Sapiens
ugaacuccugagcucaugauccacccgccucagccucccaaagugcugggauuacaggccccu

SEQ ID NO: 356865 - RNA, 63 nt, Homo Sapiens
cucacugccugggcucaagugaucuuacuccagccucccaagcagcugggacuacaccaccac

SEQ ID NO: 356866 - RNA, 63 nt, Homo Sapiens
uacuccucaguucacgcauuccucccaccuccaccucccaaacugcugggauuacagguguga

SEQ ID NO: 356867 - RNA, 63 nt, Homo Sapiens
uagaacaugagagacccccucccucaauuuccaccucccaagggaaguuuauguauuuuucua

SEQ ID NO: 356868 - RNA, 63 nt, Homo Sapiens
aacuccugagcucaagggauccucccgccucagccucccaaagugcugguguuacaggcauaa

SEQ ID NO: 356869 - RNA, 63 nt, Homo Sapiens
ugcugggauuacaggugugaccacucaccucggccucccaaagaacuccugaccucaagugau

SEQ ID NO: 356870 - RNA, 63 nt, Homo Sapiens
ugcugggauuacaggcaugagugcccaacucggccucccaaagaaccccuaggcucaaaugau

SEQ ID NO: 356871 - RNA, 63 nt, Homo Sapiens
accugggacuacaggcacgcccucacaccuuagccucccaagucaggcucaggcucaggugau

SEQ ID NO: 356872 - RNA, 63 nt, Homo Sapiens
uuugagucccuccaaagggcagcucagccuucuccucccaaggggugggaggggcccacagga

SEQ ID NO: 356873 - RNA, 63 nt, Homo Sapiens
ugcugggaugacaggcaugaccaccggccucggccucccaaagaacuccuggccucaagugau

SEQ ID NO: 356874 - RNA, 63 nt, Homo Sapiens
ugcugagauuacaggugugaccgcccgccucagccucccaaagaacuccugaccucaggugau

SEQ ID NO: 356875 - RNA, 63 nt, Homo Sapiens
agcugugauuacaggcgugcucuccugccucagccucccaaauaccuccuggguuccagcgau

SEQ ID NO: 356876 - RNA, 63 nt, Homo Sapiens
cccagcacgcugucauccccuuucuuguugaauccucccaacaaccaggcaccaccuggacac

SEQ ID NO: 356877 - RNA, 63 nt, Homo Sapiens
ccaacccccaccccguuuccaguauccuccagcccucccaaugcugaggucaggucugaggcc

SEQ ID NO: 356878 - RNA, 63 nt, Homo Sapiens
accucccagguucaagcaauucuccugccucagccucccaaguagcugggauuacaggcaccc

SEQ ID NO: 356879 - RNA, 63 nt, Homo Sapiens
aacuucugaccucaggugauccaccugccucagccucccaaauugcugggauuacaggcguga

SEQ ID NO: 356880 - RNA, 63 nt, Homo Sapiens
aagcauuccccuuuaagagcuuccacugcacccccucccaagggacacagcgguaggaauggu

SEQ ID NO: 356881 - RNA, 63 nt, Homo Sapiens
aacuccugaccucaggugauccaccugccuuggccucccaaagcacugggauuacaagcauga

SEQ ID NO: 356882 - RNA, 63 nt, Homo Sapiens
aacuccugacuucaggugauccacccaucucagccucccaaagugcugggauuacaggcguga

SEQ ID NO: 356883 - RNA, 63 nt, Homo Sapiens
caugucuucuuucagaaugggaauauaugugugccucccaacauuuacuguuaaaguguguua

SEQ ID NO: 356884 - RNA, 63 nt, Homo Sapiens
accuccuggguuccagugauucucaugccucauccucccaaguagcuggaacuacaggugugc

SEQ ID NO: 356885 - RNA, 63 nt, Homo Sapiens
ggucuucuggcuucuggauaucgcccaccuuggccucccaaagugcugggauuacagggauga

SEQ ID NO: 356886 - RNA, 63 nt, Homo Sapiens
ugcugggauuacaggcgugacuacccgccucggccucccaaagcgaucuccugaccucaugau

SEQ ID NO: 356887 - RNA, 63 nt, Homo Sapiens
ugcugggauuacaggcaugaccaccugccucagccucccaaagaauuccuggccucaggugau

SEQ ID NO: 356888 - RNA, 63 nt, Homo Sapiens
agcugggauuacuggcgcccucuccugccucagccucccaaguaccucccagguucaagcgau

SEQ ID NO: 356889 - RNA, 63 nt, Homo Sapiens
ugcuaggauuacuggcgugacugcccaccucggccucccaaagucucaaucugaccuugugau

SEQ ID NO: 356890 - RNA, 63 nt, Homo Sapiens
gugcugggauuauaggcgugccgcccgccuuggccucccaaaaugaucuccugaccucgugau

SEQ ID NO: 356891 - RNA, 63 nt, Homo Sapiens
uguugcaauuacaggcaugaccuccugccuuggccucccaaaaaacuccuggccucaaguggu

SEQ ID NO: 356892 - RNA, 63 nt, Homo Sapiens
ugcugauaguacaggcaugauuugaacuccuggccucccaagggcuuuguugcucaggcuggu

SEQ ID NO: 356893 - RNA, 63 nt, Homo Sapiens
gccucccugguucaagugauucuccuaucucagccucccaaguagcugggacuauaggcacac

SEQ ID NO: 356894 - RNA, 63 nt, Homo Sapiens
aacuccugaccucaggugauccaccugccucagccucccaaagugcugggauuacaggcguga

SEQ ID NO: 356895 - RNA, 63 nt, Homo Sapiens
caaacuucugaccucauaauccacccaccuuggccucccaaagugcuaggauuacaggcauga

SEQ ID NO: 356896 - RNA, 63 nt, Homo Sapiens
guucaugagaggucugcucucaugaccuaaucaccucccaaaggccccaccucccaauaccau

SEQ ID NO: 356897 - RNA, 63 nt, Homo Sapiens
cucucaugaccuaaucaccucccaaaggccccaccucccaauaccaucacauuagggguuagg

SEQ ID NO: 356898 - RNA, 63 nt, Homo Sapiens
ugcugggauuacaggcgugaccacccgccucggccucccaaagaaccucugaccucaggugau

SEQ ID NO: 356899 - RNA, 63 nt, Homo Sapiens
agcugggauuacaggugcccucuccugccucagccucccaaguaccucucagauucaagcaau

SEQ ID NO: 356900 - RNA, 63 nt, Homo Sapiens
ugcugggauuacaggcgugaccguccgccuuggccucccaaagcaaacaccugaccuugugau

SEQ ID NO: 356901 - RNA, 63 nt, Homo Sapiens
agcugggauuacaggcgcagaauucugacucagccucccaaguucugccucccaggaucaagc

SEQ ID NO: 356902 - RNA, 63 nt, Homo Sapiens
ugcuggaauuacuggcgugaucgcccgccucggccucccaaagcgaucuccugaccucgugau

SEQ ID NO: 356903 - RNA, 63 nt, Homo Sapiens
cauuaggauuauaggcgugagcuuccaccucagccucccaaagcugcagccugaaacuccuug

SEQ ID NO: 356904 - RNA, 63 nt, Homo Sapiens
uacugggauuacaggccugacuacccuccucggccucccaaagaacuccagaucucaggugau

SEQ ID NO: 356905 - RNA, 63 nt, Homo Sapiens
ucaagcgauucuccucucucacugcaaccuccgccucccaagucaguggcacgaucucggcuc

SEQ ID NO: 356906 - RNA, 63 nt, Homo Sapiens
ugucuagaaaggccauuucguuagacaccucauccucccaagcuaugcuggaaguaauugugc

SEQ ID NO: 356907 - RNA, 63 nt, Homo Sapiens
uguugggauuacaggcgugaccaccugccuaggccucccaaagcgaucuccugaccucgugau

SEQ ID NO: 356908 - RNA, 63 nt, Homo Sapiens
accuccuggguucaagggauucuccugccucagccucccaaguagcugggauuacaggcgccu

SEQ ID NO: 356909 - RNA, 63 nt, Homo Sapiens
aacuccugaccugaggcgaucugcccaccucggccucccaaagugcugggauuacaggcguga

SEQ ID NO: 356910 - RNA, 63 nt, Homo Sapiens
gccucccggguucgcaccauucuccugccucagccucccaauuagcuuggccuacagucaucu

SEQ ID NO: 356911 - RNA, 63 nt, Homo Sapiens
cgaucuccugaccucgugauccgcccaccucggccucccaaagugcugggauuacaggcauga

SEQ ID NO: 356912 - RNA, 63 nt, Homo Sapiens
caaacuccuaaccucgugauccgccugccucgaccucccaaagugcugggauuacaggcauga

SEQ ID NO: 356913 - RNA, 63 nt, Homo Sapiens
aaauugggcagcuaaauuuuucaguuccaugugccucccaaauaaaaaacagaaaauaaguag

SEQ ID NO: 356914 - RNA, 63 nt, Homo Sapiens
cgaucucuugaccucaugaucuacccgccuuggccucccaaagugcugagauuacaggcguga

SEQ ID NO: 356915 - RNA, 63 nt, Homo Sapiens
gacuccuggguucaagcaauccuccugccucagccucccaaguagcugagacuacaggcacga

SEQ ID NO: 356916 - RNA, 63 nt, Homo Sapiens
aacucuuggccucaaguaauccuccugccucagccucccaaaguguugggauugcagauauga

SEQ ID NO: 356917 - RNA, 63 nt, Homo Sapiens
ucaaccuggguucaagugauccucucaccucagccucccaaguaguugugccuccuaggcaca

SEQ ID NO: 356918 - RNA, 63 nt, Homo Sapiens
aacaccugggcucaacugauccgccugccucggccucccaaagugcugggauuacagguguga

SEQ ID NO: 356919 - RNA, 63 nt, Homo Sapiens
gccucccggguucaagugauucuccugccucagccucccaaguaggugggauuacaggcgccc

SEQ ID NO: 356920 - RNA, 63 nt, Homo Sapiens
cgaacuccugaccucgugauuggcccaccucagccucccaaagugcugguauuacagauguga

SEQ ID NO: 356921 - RNA, 63 nt, Homo Sapiens
ugcugggauuacaggcgugaccacccgccuccgccucccaaagaacuccugaccgcaagugau

SEQ ID NO: 356922 - RNA, 63 nt, Homo Sapiens
agcugggaauacaggcacgcuuuccugccucagccucccaaguaccuccuggguucaagugau

SEQ ID NO: 356923 - RNA, 63 nt, Homo Sapiens
gcugggauuacaggcgugagcugccugccucggccucccaaguaacuccugaccucaagugau

SEQ ID NO: 356924 - RNA, 63 nt, Homo Sapiens
agcugggauuacagucaggcucuccugccucagccucccaagugcccccuggguucaagcaau

SEQ ID NO: 356925 - RNA, 63 nt, Homo Sapiens
ugcugggauuacagaugugacugcccgccuuggccucccaaagaacuccugggcuuaagugau

SEQ ID NO: 356926 - RNA, 63 nt, Homo Sapiens
ugcugggauuacgggugugaccaccuuucucggccucccaaagaacuccugaccucaggugau

SEQ ID NO: 356927 - RNA, 63 nt, Homo Sapiens
agcugagauuacaggcgccuucuccugccucagccucccaaguaccuccuggguuccagcagu

SEQ ID NO: 356928 - RNA, 63 nt, Homo Sapiens
ugcuuggauuacagguguaaccgccugccucggccucccaaaguugaucuccugacuugugau

SEQ ID NO: 356929 - RNA, 63 nt, Homo Sapiens
uggugggaucacaggcgugaccgccugccuuggccucccaaagagcuccugaccucaggugau

SEQ ID NO: 356930 - RNA, 63 nt, Homo Sapiens
ugcugggauuacaggugugaccgcccacauuggccucccaaagaacuccugaccucagaugau

SEQ ID NO: 356931 - RNA, 63 nt, Homo Sapiens
agcugggauuacaggugcgcucuccugucucagccucccaagugccuccuagauucaagcaau

SEQ ID NO: 356932 - RNA, 63 nt, Homo Sapiens
ugcugggauuauaggcgugauccgcugucuuguccucccaaaggaacuccugaccucaaauga

SEQ ID NO: 356933 - RNA, 63 nt, Homo Sapiens
agcugggauuacaggugcccuuuccugccucagccucccaagugccucccagauucaagcgau

SEQ ID NO: 356934 - RNA, 63 nt, Homo Sapiens
aacuccuggcuucaagagauccacccaccucagccucccaaagcgcuaggauuacaaguauga

SEQ ID NO: 356935 - RNA, 63 nt, Homo Sapiens
cauguuaggagcgcuggaacguuuauucucuucccucccaauuauccacucuaauggagcaga

SEQ ID NO: 356936 - RNA, 63 nt, Homo Sapiens
aacuucugaccucagaugaucugcccgccucagccucccaaagugcugggauuacaggcauga

SEQ ID NO: 356937 - RNA, 63 nt, Homo Sapiens
aacucccgaccucagguaauccgcccgccucggccucccaaaaugcugggauuagagguguga

SEQ ID NO: 356938 - RNA, 63 nt, Homo Sapiens
gccuccuggguucaagugauucuccugccacagccucccaaguagcugggauuacaggugccu

SEQ ID NO: 356939 - RNA, 63 nt, Homo Sapiens
aacuccugaccucaguugauccgccugccucagccucccaaagugcugggcuuacaggccuga

SEQ ID NO: 356940 - RNA, 63 nt, Homo Sapiens
uccuccaggguucaagugauucucccaccucagccucccaaguagcugggacuacgggcacau

SEQ ID NO: 356941 - RNA, 63 nt, Homo Sapiens
aacuccugaccucaagcgauccacccaccuaggccucccaaagugcugggauuacaggcauga

SEQ ID NO: 356942 - RNA, 63 nt, Homo Sapiens
aacucccgaccucaggugauccgcccgccugggccucccaaagugcugggauuacaggcguga

SEQ ID NO: 356943 - RNA, 63 nt, Homo Sapiens
gccuccuggauuuaagugauucuccugccucagccucccaaguagcugggauuacaggugugc

SEQ ID NO: 356944 - RNA, 63 nt, Homo Sapiens
cgaacuccugaccucgugauccgccugccucagccucccaaagugcugggauuacagguguga

SEQ ID NO: 356945 - RNA, 63 nt, Homo Sapiens
gccuccuggguucaagcaauucucccaccucagccucccaaguagcugggauuacagacgugu

SEQ ID NO: 356946 - RNA, 63 nt, Homo Sapiens
aacuccugaccucaggugauccuccugccucggccucccaaagugcugggauuacaggcauga

SEQ ID NO: 356947 - RNA, 63 nt, Homo Sapiens
gccuccuggguucaggcaauuuuccugccucagccucccaaguagcugggauuacaggcaccc

SEQ ID NO: 356948 - RNA, 63 nt, Homo Sapiens
aacuccugaccucaggugauccuccugcauuggccucccaaagugcuggaauuccaggcauga

SEQ ID NO: 356949 - RNA, 63 nt, Homo Sapiens
acuccuggggcucaagugauccuccugccuuggccucccaaaaugcuggauuacaggcaugug

SEQ ID NO: 356950 - RNA, 63 nt, Homo Sapiens
auagcuucccacuggaaaguaaacaaaaccaucccucccaaccucaaagcuaggccacacucu

SEQ ID NO: 356951 - RNA, 63 nt, Homo Sapiens
gccucccugguucaagugauucuccugccucauccucccaagaagcugagauuacagaugacc

SEQ ID NO: 356952 - RNA, 63 nt, Homo Sapiens
aacuccugaccucaggugauccaccugccucagccucccaaagugcugagauuacaggcauga

SEQ ID NO: 356953 - RNA, 63 nt, Homo Sapiens
accucgcagguucaagcaauccucccacuucagccucccaagcaccugggauuacaagcauga

SEQ ID NO: 356954 - RNA, 63 nt, Homo Sapiens
ccaucucuugaccucgugauccacccgccucagccucccaaagugcugggauuaacagguaug

SEQ ID NO: 356955 - RNA, 63 nt, Homo Sapiens
gccucccagguucaagugcuucuccagccucagccucccaaguagcugagacuacaggcacac

SEQ ID NO: 356956 - RNA, 63 nt, Homo Sapiens
ugcugggauuacuggugugaccuccugccucagccucccaaagaacuccugaacucaagcaau

SEQ ID NO: 356957 - RNA, 63 nt, Homo Sapiens
agcugggacuacaggcauguccuuccacuucagccucccaaguacuuccugggcucaagugau

SEQ ID NO: 356958 - RNA, 63 nt, Homo Sapiens
ugcugggauuauaggcauguccacucgccucggccucccaaagaacuccugaccucaggugau

SEQ ID NO: 356959 - RNA, 63 nt, Homo Sapiens
agcugggauuacaggcguccucuccugccucagccucccaagugccuccuggguucaagcagu

SEQ ID NO: 356960 - RNA, 63 nt, Homo Sapiens
ugcuaggauuacaagugugaccaccugccucggccucccaaagaacuccugaccucaaaugac

SEQ ID NO: 356961 - RNA, 63 nt, Homo Sapiens
agcugggauuacagaaagccucuccugccucaaccucccaaguaucgcccaggcucaagugau

SEQ ID NO: 356962 - RNA, 63 nt, Homo Sapiens
aacucuugaccucaggugauccacccaccucagccucccaaagugcugggauuacaagcguga

SEQ ID NO: 356963 - RNA, 63 nt, Homo Sapiens
aacuccuggccucaagugauucuccugccucagccucccaaagugcugggauuacagguguga

SEQ ID NO: 356964 - RNA, 63 nt, Homo Sapiens
uccgccucccggguucacgccauucugcgucagccucccaaguagcugggacuacaggcaccu

SEQ ID NO: 356965 - RNA, 63 nt, Homo Sapiens
ugaucuccugaccgcauaauccacccaccucggccucccaaagugcugggauuacaggcguga

SEQ ID NO: 356966 - RNA, 63 nt, Homo Sapiens
aacucccagguucaagugagucucgugccucagccucccaaguagcugggauuacaggcaccc

SEQ ID NO: 356967 - RNA, 63 nt, Homo Sapiens
aacuccugaccucaggugcuccaccugccuuggccucccaaagugcugggauuacaggcguga

SEQ ID NO: 356968 - RNA, 63 nt, Homo Sapiens
aacuccuguccucagguaauccgcccaccucagccucccaaagugcugggauuacaggcguga

SEQ ID NO: 356969 - RNA, 63 nt, Homo Sapiens
accuccuggguucaagcgauucucccaccccagccucccaaguagcugggauuacaggugugu

SEQ ID NO: 356970 - RNA, 63 nt, Homo Sapiens
aacuccugggcucaagcgauccuccuggcucagccucccaaagugcugggauuacaggcguga

SEQ ID NO: 356971 - RNA, 63 nt, Homo Sapiens
ugcagggauuacaggcaugagcacccaccucagccucccaaagaacuccugaccucaggugau

SEQ ID NO: 356972 - RNA, 63 nt, Homo Sapiens
ugcugggauuacaggcaugaccacccgccucagccucccaaagaacuccugaccucaggugau

SEQ ID NO: 356973 - RNA, 63 nt, Homo Sapiens
ugcuggaauuacaggugugaccacccgccuuggccucccaaagaaugccugaccucaggugau

SEQ ID NO: 356974 - RNA, 63 nt, Homo Sapiens
agcugggauuacaggcacauucuccugccucagccucccaagugccuccuggguucaauccau

SEQ ID NO: 356975 - RNA, 63 nt, Homo Sapiens
ugcugggacuacaggugcauccuccugccuuggccucccaaagaacuccuagccuugauugau

SEQ ID NO: 356976 - RNA, 63 nt, Homo Sapiens
gccucccagguucaagcaauucuccugccucagccucccaaguagcugggacuacaggcacac

SEQ ID NO: 356977 - RNA, 63 nt, Homo Sapiens
ccaucucuugaccuugugauccacccaccucagccucccaaagugcugggauuacaggcauga

SEQ ID NO: 356978 - RNA, 63 nt, Homo Sapiens
aacuccugaccuaaagugaucugcccgccuuggccucccaaagugcugggauuacagacauga

SEQ ID NO: 356979 - RNA, 63 nt, Homo Sapiens
ugcugggauuacaggugugacugcccgccuuggccucccaaagaacucuugaccucaggugau

SEQ ID NO: 356980 - RNA, 63 nt, Homo Sapiens
ugcugggauuacaggugugaccgcccaccucggccucccaaagaacuccugaccucaggugau

SEQ ID NO: 356981 - RNA, 63 nt, Homo Sapiens
ugcugggauuacaggugugaccuccugccuuggccucccaaagaaccccugggcucaagcaag

SEQ ID NO: 356982 - RNA, 63 nt, Homo Sapiens
agcugggaccacaggugggcccuccugccucugccucccaaguaccucccaagcucaagcaau

SEQ ID NO: 356983 - RNA, 63 nt, Homo Sapiens
ucaagcaauccuccugccuccauguagccuggaccucccaagcgcaguggugugauuacagcu

SEQ ID NO: 356984 - RNA, 63 nt, Homo Sapiens
ugcuaggauuacaggcgugaccaccugccucggccucccaaagaacuccugaccucaggugau

SEQ ID NO: 356985 - RNA, 63 nt, Homo Sapiens
ugcugggauuacacgcgugaccgcccaccuuggccucccaaagaacuccugaccucaggugau

SEQ ID NO: 356986 - RNA, 63 nt, Homo Sapiens
aacuccuuggcucaagcaauccugcugccuuggccucccaaguauguaggacuacagguacuc

SEQ ID NO: 356987 - RNA, 63 nt, Homo Sapiens
aacuccugggcugaaacaauccucccgccuuggccucccaaagugcugggauuauaggcacaa

SEQ ID NO: 356988 - RNA, 63 nt, Homo Sapiens
gccucccguguucaagcaguucuccugccucagccucccaaauagcugggauuacaguugccu

SEQ ID NO: 356989 - RNA, 63 nt, Homo Sapiens
aacuccugaccucaagugauccacccgccuuggccucccaaagugcugggauaauagguguca

SEQ ID NO: 356990 - RNA, 63 nt, Homo Sapiens
gccuccugcguucaagugauuguccugucucagccucccaaguagcugggauuacaggcaccc

SEQ ID NO: 356991 - RNA, 63 nt, Homo Sapiens
aacuccuaaccucaggugauccacccgccucggccucccaaagugcugggauuacaggcccgg

SEQ ID NO: 356992 - RNA, 63 nt, Homo Sapiens
accuaccgaguucaagugauuuuccugccuuggccucccaaguagcugggauuacaggugugu

SEQ ID NO: 356993 - RNA, 63 nt, Homo Sapiens
aacuccugaccucaagugaucugcccaccucagccucccaaagugcugagauuacaggcauga

SEQ ID NO: 356994 - RNA, 63 nt, Homo Sapiens
aacuccugaccucaagugauauguucaccucagccucccaaagugcugggauuacaggcauga

SEQ ID NO: 356995 - RNA, 63 nt, Homo Sapiens
gccucccggguucaagcaauucuccugccucagccucccaaguagcugggauuacaggcgugu

SEQ ID NO: 356996 - RNA, 63 nt, Homo Sapiens
accucuuggguucaagugauucuugugccucagccucccaaguagcuggaauuacaggcacau

SEQ ID NO: 356997 - RNA, 63 nt, Homo Sapiens
aacuccugaccucaggugauccacccaccuuggccucccaaagugcugagauuauaggcauga

SEQ ID NO: 356998 - RNA, 63 nt, Homo Sapiens
gccucccggguucacgccauucuccugccucagccucccaaguagcugggacuacaggcaccc

SEQ ID NO: 356999 - RNA, 63 nt, Homo Sapiens
cgaucuccugaccucgugauccgcccgccucagccucccaaagugcugggauuacaggcguga

SEQ ID NO: 357000 - RNA, 63 nt, Homo Sapiens
gccucccggguucaugccauucuccugccucagccucccaaguagcugggacuacaggcgccu

SEQ ID NO: 357001 - RNA, 63 nt, Homo Sapiens
cgaucuccugaccucgugauccacccgccucggccucccaaagugcugggauuacaggcguga

SEQ ID NO: 357002 - RNA, 63 nt, Homo Sapiens
ugcugggauuacaggcgugaccaccagccucagccucccaaagugaucuccugaccuugugau

SEQ ID NO: 357003 - RNA, 63 nt, Homo Sapiens
agcugggauuacaggugugcucuccugcuucagccucccaaguaccuccuggguucaagugau

SEQ ID NO: 357004 - RNA, 63 nt, Homo Sapiens
ugcuggaaucacaggggugaccuccauccucggccucccaaagaacuccuggccuccagugau

SEQ ID NO: 357005 - RNA, 63 nt, Homo Sapiens
ugcugggauuacaggccugaucgcccgccgcguccucccaaagcgaucucuugaccucgugau

SEQ ID NO: 357006 - RNA, 63 nt, Homo Sapiens
uugcugggauuacaggugugcugcccgccucggccucccaaaaaacucccgaccucagaugau

SEQ ID NO: 357007 - RNA, 63 nt, Homo Sapiens
ugcugggauuacaggugugacugcccgccuuggccucccaaagccaucuccugaguuugugau

SEQ ID NO: 357008 - RNA, 63 nt, Homo Sapiens
ugcuaggauuccaggcgugaccgcccgccuuggccucccaaagccugaccucaggugauccac

SEQ ID NO: 357009 - RNA, 63 nt, Homo Sapiens
ugcugggauuauaggcgugaccgcccuccucggccucccaaagugaucuccugaccucgugau

SEQ ID NO: 357010 - RNA, 63 nt, Homo Sapiens
ugcugggauuacaggcgugaccaccugccuuggccucccaaagaacuccugaccucagguaau

SEQ ID NO: 357011 - RNA, 63 nt, Homo Sapiens
uguucguuuuacuuuuuuuuccacccaccuuggccucccaaauaacucuugaccucaaaugau

SEQ ID NO: 357012 - RNA, 63 nt, Homo Sapiens
ugcugggauuacaggugugacugccugccucggccucccaaagaacuccugaccucaggugau

SEQ ID NO: 357013 - RNA, 63 nt, Homo Sapiens
agcugggauuacaggcaugcucuccugccgcagccucccaagagccucccggauucaagcaau

SEQ ID NO: 357014 - RNA, 63 nt, Homo Sapiens
ugcuaggauuacaggcgugaccacccaucuccaccucccaaagaacuccugggcucaagugau

SEQ ID NO: 357015 - RNA, 63 nt, Homo Sapiens
uguugggauuauaggcgugaccaccugccuuggccucccaaagaacuccugaccucaagugau

SEQ ID NO: 357016 - RNA, 63 nt, Homo Sapiens
ugcuuggauuacaggcauaaccaccugccucagccucccaaagaacuccugaccucauaugau

SEQ ID NO: 357017 - RNA, 63 nt, Homo Sapiens
agcugggauuacaggcaccuuauccugccucagccucccaagugccuuccagguucaagcaau

SEQ ID NO: 357018 - RNA, 63 nt, Homo Sapiens
ugcugggauuacaggcaugaccacccaccucagccucccaaagaaauccugaccucaaaugau

SEQ ID NO: 357019 - RNA, 63 nt, Homo Sapiens
agcugggacuacaaggugccucuccuaccucagccucccaaaugcccccugggaucaagcgau

SEQ ID NO: 357020 - RNA, 63 nt, Homo Sapiens
ugcugggauuacaggcaugacccccugccucggccucccaaagcgauuuccugaccuugugau

SEQ ID NO: 357021 - RNA, 63 nt, Homo Sapiens
ugcugggauuacaggcaugaccacccgccucagccucccaaagaacucccgaccucaggugau

SEQ ID NO: 357022 - RNA, 63 nt, Homo Sapiens
ugcugggauuacagacgugacugcccgccucugccucccaaaggacuccugggcucaagcaau

SEQ ID NO: 357023 - RNA, 63 nt, Homo Sapiens
agcugggacuacaauugugaccucccauuucagccucccaaguaccugccagguugaagugag

SEQ ID NO: 357024 - RNA, 63 nt, Homo Sapiens
ugcugggauuacaggcaugaccacccaccuuggccucccaaagaacgccugaccucagaugau

SEQ ID NO: 357025 - RNA, 63 nt, Homo Sapiens
accugggacuacaggugugcucucgugcuucagccucccaagugccuccuggguucaagugau

SEQ ID NO: 357026 - RNA, 63 nt, Homo Sapiens
uguuaggauuaggggcaugaccgcccgccucagccucccaaagcgaacuccugaccucgugau

SEQ ID NO: 357027 - RNA, 63 nt, Homo Sapiens
agccaggauuacaggcacgcucuccugccucagccucccaagugccucccagguucaagcaau

SEQ ID NO: 357028 - RNA, 63 nt, Homo Sapiens
ugcugggauuacagccaugaccagccguauuggccucccaaggaauuccagggcucaagcgau

SEQ ID NO: 357029 - RNA, 63 nt, Homo Sapiens
cgggaaccucaagaucuccaagcuacauaugccccucccaaacguuacaaagauuuuuuaaaa

SEQ ID NO: 357030 - RNA, 63 nt, Homo Sapiens
ugcugggauuacaggggugaccacccgccucagccucccaaagaacuccugagcucaagugau

SEQ ID NO: 357031 - RNA, 63 nt, Homo Sapiens
uguugggauuacaggugugaccucccgccucagccucccaaagaacucuugggcucaagugau

SEQ ID NO: 357032 - RNA, 63 nt, Homo Sapiens
agcugggagccugggcaugcccuccugccucagccucccaaguaccucccaggcucaagcgau

SEQ ID NO: 357033 - RNA, 63 nt, Homo Sapiens
cguugggauuauaggcgugaccuccugccucagccucccaaagaacuccugggcucaagugau

SEQ ID NO: 357034 - RNA, 63 nt, Homo Sapiens
agcugggaugacagacuugcccucccaccucagccucccaagcacuucuuaggcucaggugau

SEQ ID NO: 357035 - RNA, 63 nt, Homo Sapiens
accuuccaggcuuaagcgauucucaugccucauccucccaaguaggugggauuacaggugccc

SEQ ID NO: 357036 - RNA, 63 nt, Homo Sapiens
aacuccugacaucaggugauccaccugccucggccucccaaagugcugggauuacagguguga

SEQ ID NO: 357037 - RNA, 63 nt, Homo Sapiens
gccucccggguucaagcgauucuccugccucagccucccaaguagcugggauuacaggcacgc

SEQ ID NO: 357038 - RNA, 63 nt, Homo Sapiens
aacucccgaccucaaguagucugccugccucaaccucccaaagugcugggauuacaggcguga

SEQ ID NO: 357039 - RNA, 63 nt, Homo Sapiens
gggcauuacccaccauuguaucuaacacugcauccucccaacuauccaucggacaagaccccg

SEQ ID NO: 357040 - RNA, 63 nt, Homo Sapiens
auauaacccccuaaggaaucgaaauuguaucagccucccaagcccagaaucccagaauucuag

SEQ ID NO: 357041 - RNA, 63 nt, Homo Sapiens
uguugggauuacaggcgugaccacccgccuaggccucccaaagugaacuccugaccucgugau

SEQ ID NO: 357042 - RNA, 63 nt, Homo Sapiens
agcuggaauuacagggacccucuccugucucagccucccaagugccucugggguucaagugau

SEQ ID NO: 357043 - RNA, 63 nt, Homo Sapiens
ugcuaggauuacaggcaugauugccugccugggccucccaaagcgaacuccugaccucgugau

SEQ ID NO: 357044 - RNA, 63 nt, Homo Sapiens
ugcugggauuacaggugugacugcccgccucggccucccaaagugaucuccugagcucgugau

SEQ ID NO: 357045 - RNA, 63 nt, Homo Sapiens
gggcagccaauuccuaucauucagaucuuccuuccucccaaguacucaccaaccccuuccacu

SEQ ID NO: 357046 - RNA, 63 nt, Homo Sapiens
ccucuccagauucaagugauccucccaucucagccucccaaguagcugggacuacaguugugc

SEQ ID NO: 357047 - RNA, 63 nt, Homo Sapiens
aacuccugggcuccaacgaucugcccaccuuggccucccaaagugcugagauuacaggcguga

SEQ ID NO: 357048 - RNA, 63 nt, Homo Sapiens
acuucuuggguucaagugauucuccugucucagccucccaaguagcugggauuacaggcauga

SEQ ID NO: 357049 - RNA, 63 nt, Homo Sapiens
aacuccugaccucaggugauccacccgccuuggccucccaaagugcugggauuacaggcguga

SEQ ID NO: 357050 - RNA, 63 nt, Homo Sapiens
gccuccuggguucaagugauucucccaccucagccucccaaguaggugggauuacagguacuc

SEQ ID NO: 357051 - RNA, 63 nt, Homo Sapiens
aacuccugaccucagauggucugcccaccuccgccucccaaagugcugggauuacaggcguga

SEQ ID NO: 357052 - RNA, 63 nt, Homo Sapiens
ugcugggauuauaggcaugaccuccugcuuuggccucccaaaaaaauccugggcucaagugau

SEQ ID NO: 357053 - RNA, 63 nt, Homo Sapiens
agcugggacuacaggcacagucucaugccucagccucccaaauucuuccucucucgcccaagu

SEQ ID NO: 357054 - RNA, 63 nt, Homo Sapiens
uguauguacuuccaguaucccucaggccaaagaccucccaagcaugggcuuggccaaaacagg

SEQ ID NO: 357055 - RNA, 63 nt, Homo Sapiens
ugcugagauuacaggugugaccuccugucuuggccucccaaagaacuccuagacucaagugau

SEQ ID NO: 357056 - RNA, 63 nt, Homo Sapiens
ugcugggauuacaggugugaccacccgccuuggccucccaaagugaacuccugaccucgugac

SEQ ID NO: 357057 - RNA, 63 nt, Homo Sapiens
gccuccugaguucaagcgauucuccugccucagccucccaaguagcugggacugcaggcgcgc

SEQ ID NO: 357058 - RNA, 63 nt, Homo Sapiens
acuccugacuucaggugauccacccgccuucagccucccaacgugcugggauuacagccguga

SEQ ID NO: 357059 - RNA, 63 nt, Homo Sapiens
gccucccagguugaagcgauucuccugccucagccucccaaguagcugggauuacaggcaugc

SEQ ID NO: 357060 - RNA, 63 nt, Homo Sapiens
cgaugaucugaccucgugaucugcccgccucggccucccaaagugcugggauuacaggccuga

SEQ ID NO: 357061 - RNA, 63 nt, Homo Sapiens
aacuccuggacucaaucgauccucccaccucugccucccaaguaacugggacuauagcaugcc

SEQ ID NO: 357062 - RNA, 63 nt, Homo Sapiens
aacuccuggacucaauugauccucccacuucugccucccaaguaacugggacuauagcaugcc

SEQ ID NO: 357063 - RNA, 63 nt, Homo Sapiens
gccucccguguucaagcgauucuccugccuuggccucccaaguagcugggacuacaggcgccu

SEQ ID NO: 357064 - RNA, 63 nt, Homo Sapiens
cgaucuccugaccucuugaucugcccaccuuggccucccaaagugcugggauuacaggcguga

SEQ ID NO: 357065 - RNA, 63 nt, Homo Sapiens
aacucuugaccucaagugauccacucgcuucggccucccaaagugcugggauuauaggcguga

SEQ ID NO: 357066 - RNA, 63 nt, Homo Sapiens
cgaacuccugaccucaugauccuccugccucggccucccaaagugcugggauuauaggcauga

SEQ ID NO: 357067 - RNA, 63 nt, Homo Sapiens
aacuccugaccucaagagauccacucgccuugcccucccaaagugcugggauuacaggcuuga

SEQ ID NO: 357068 - RNA, 63 nt, Homo Sapiens
gucaaaacuauagccauauccaaaucuuuucccccucccaagaguucucagugucuacaugua

SEQ ID NO: 357069 - RNA, 63 nt, Homo Sapiens
ugcugggauuacaggugugaucuccugccucagccucccaaaggccuccugacuucaagcaau

SEQ ID NO: 357070 - RNA, 63 nt, Homo Sapiens
ugcuaggauuacaggcaugaccacccgccucagccucccaaagaacuccugaccucaguugau

SEQ ID NO: 357071 - RNA, 63 nt, Homo Sapiens
uacugggauuacaggcgugacugcccgccuuggccucccaaagugaacuccugaccucgugau

SEQ ID NO: 357072 - RNA, 63 nt, Homo Sapiens
agggcugcugguuuccgcagaccaccggcaccgccucccaaaccccaugcccccucccugagc

SEQ ID NO: 357073 - RNA, 63 nt, Homo Sapiens
cugugcguuccugagggccacagccagcuccgcccucccaaggagggaaggcggagcugagga

SEQ ID NO: 357074 - RNA, 63 nt, Homo Sapiens
ccucccggguuccagcaaauucuccugccucagccucccaaguagcugggauugcaggcgccc

SEQ ID NO: 357075 - RNA, 63 nt, Homo Sapiens
aucuccugaccucaggugauccacccgccucggccucccaaagugcugggaugacaggcguga

SEQ ID NO: 357076 - RNA, 63 nt, Homo Sapiens
ugcugggauuacaggcuugaccaccugccucggccucccaaagaacuccugaccucaggugau

SEQ ID NO: 357077 - RNA, 63 nt, Homo Sapiens
agcugggauuacaggcaccuucuccugccucagccucccaagugccucccgggcucaagcgau

SEQ ID NO: 357078 - RNA, 64 nt, Homo Sapiens
cuauuggauagacuaggcaauucaucagcucaccugaaaucagccaggaggagcaaggacaaga

SEQ ID NO: 357079 - RNA, 64 nt, Homo Sapiens
ugacacgauuagacacuccuccccacaaaggcuuugaaaucauaaggauuuuccucaucucuuu

SEQ ID NO: 357080 - RNA, 64 nt, Homo Sapiens
ggcuugggaaucuagagcagucuuugucuaggucugaaaucaagggauuugggcaggauggaag

SEQ ID NO: 357081 - RNA, 64 nt, Homo Sapiens
cucugggccaaggaggguccugguauccagacugugaaaucagcaaaggcaugguaccucaguc

SEQ ID NO: 357082 - RNA, 64 nt, Homo Sapiens
caauaugauaaguuuugucauaugcauacagccaugaaaucaucagcauaagcaagguaaugaa

SEQ ID NO: 357083 - RNA, 64 nt, Homo Sapiens
ugaucugcuuucuuuaugaucaguuugcuacaaaugaaaucacauaauaugaaccuuuuuuggu

SEQ ID NO: 357084 - RNA, 64 nt, Homo Sapiens
caagcaucacagcuuuguguauaauugcaaaaguugaaaucaacaugaaugcccaaaauaguga

SEQ ID NO: 357085 - RNA, 64 nt, Homo Sapiens
cagcuacacgggaggccaaggcaggaggaucacuugaaaucaagaguucaagucuagccuagac

SEQ ID NO: 357086 - RNA, 64 nt, Homo Sapiens
ucauuccaugaugcauauuaguuggauuacauuuugaaaucaguaaacacuuguuaugaguuaa

SEQ ID NO: 357087 - RNA, 64 nt, Homo Sapiens
uaucugucucacaaauacaaagaguucccucaucugaaaucauggaacuggaguuucucuugug

SEQ ID NO: 357088 - RNA, 64 nt, Homo Sapiens
ugugaacuguugccuuauguuuaccuucuauuucugaaaucaguuagaauuuguaauuuaauac

SEQ ID NO: 357089 - RNA, 64 nt, Homo Sapiens
agcgaggcugauucaauugggacaccuuaugcucugaaaucauggucuugaguuuucuucucug

SEQ ID NO: 357090 - RNA, 64 nt, Homo Sapiens
uguauacaaaccagggagaguuauauucauuugaugaaaucauuacuuucaauucaugacugcu

SEQ ID NO: 357091 - RNA, 64 nt, Homo Sapiens
gguguuuaaaauaccuaugauuuucauguauauuugaaaucagauguagaaucauauaauuacc

SEQ ID NO: 357092 - RNA, 64 nt, Homo Sapiens
ggccuggcaaaauaaaacauuaauuggauauugaugaaaucauuguaguugucacacuaaaauu

SEQ ID NO: 357093 - RNA, 64 nt, Homo Sapiens
aaaaagaaaaaucaaaguaguucuaaauaaggugugaaaucaucaaaaauuugaaguauuagac

SEQ ID NO: 357094 - RNA, 64 nt, Homo Sapiens
uuugaauuucauaguaggacuauugugacagauuugaaaucaugcagcucauagcaaguuaaaa

SEQ ID NO: 357095 - RNA, 64 nt, Homo Sapiens
gcaagagugauugcagcuuucuaguuuacuguuuugaaaucaauugcuucuccaaggaaaccgc

SEQ ID NO: 357096 - RNA, 64 nt, Homo Sapiens
uccagcuccugauguuuucuucucggugcagaucugaaaucacacccagugaaaucagcauguu

SEQ ID NO: 357097 - RNA, 64 nt, Homo Sapiens
auguuucucggugcagaucuugccacauccccagugaaaucagcagccagccuucaccugggac

SEQ ID NO: 357098 - RNA, 64 nt, Homo Sapiens
cagacuuuucccuaccucugucauuagcaaugguugaaaucauguggcuuguguuugggcguca

SEQ ID NO: 357099 - RNA, 64 nt, Homo Sapiens
uuugugagcuguguaaucccucuggucaguauuaugaaaucauuugucagugguaauaaauaag

SEQ ID NO: 357100 - RNA, 64 nt, Homo Sapiens
cauacuuuacaagcaaguuaaauggagauaaaguugaaaucauagaagaugcaaaugaccuuuc

SEQ ID NO: 357101 - RNA, 64 nt, Homo Sapiens
gauguuuuuguuaauguuuccaaacaauguacuuugaaaucagaaucacuucuuaucguuuuca

SEQ ID NO: 357102 - RNA, 64 nt, Homo Sapiens
ggagggcucaagcaaaugccagaaauaacauuugugaaaucacuaguagaaacgaaauggaaac

SEQ ID NO: 357103 - RNA, 64 nt, Homo Sapiens
uaaauuagccacuuuaaacuaaaauuaccagcagugaaaucaaaacuguuagaaaaggccuuug

SEQ ID NO: 357104 - RNA, 64 nt, Homo Sapiens
gaaaugauacggaugguauucacugcacauaugaugaaaucaucagaauuguuaaaacuuuugc

SEQ ID NO: 357105 - RNA, 64 nt, Homo Sapiens
uauuguuuucucuguuuuucuucucuaacuucucugaaaucaucuccuauuaagggauagaaau

SEQ ID NO: 357106 - RNA, 64 nt, Homo Sapiens
uaagauaccuugagaaaaacuuuuaauuucuaucugaaaucaguguuucuauuuuuaaggugaa

SEQ ID NO: 357107 - RNA, 64 nt, Homo Sapiens
gauaccagcuccucuuuuaaauacaacaaggaggugaaaucagacaugcugucuguacaguucc

SEQ ID NO: 357108 - RNA, 64 nt, Homo Sapiens
uuacuauuugcagucaaacuuugauccuuguuuuugaaaucauuugucaauucggaaugaaaaa

SEQ ID NO: 357109 - RNA, 64 nt, Homo Sapiens
aaaagaacauuuguuuuuacauuaaauguuuauuugaaaucaaaugauuuuguacauaaaguuc

SEQ ID NO: 357110 - RNA, 64 nt, Homo Sapiens
aguaguuccuuaagaauaaucuaguuauauuuuuugaaaucacauauaauuagacuuuauaaua

SEQ ID NO: 357111 - RNA, 64 nt, Homo Sapiens
cuagugagcaaaacaaagaaggugcuugagucacugaaaucaaaguacucaggcacacagccca

SEQ ID NO: 357112 - RNA, 64 nt, Homo Sapiens
uaaaagaaaauauauacccaagucucuugcuaguugaaaucaaaaacaaacaaacaucagucuu

SEQ ID NO: 357113 - RNA, 64 nt, Homo Sapiens
uccaccugucucuauagguaugguacuuguucuuugaaaucauacauauuuuugaagcugucuu

SEQ ID NO: 357114 - RNA, 64 nt, Homo Sapiens
aggaauggcaucagaacaauagcuuggaauggcuugaaaucacaaaggaucugcaagaugaacu

SEQ ID NO: 357115 - RNA, 64 nt, Homo Sapiens
gccuauauaaugagaagcagcucucugaggguucugaaaucaauguggucccucucuugcccac

SEQ ID NO: 357116 - RNA, 64 nt, Homo Sapiens
aauguuuacggcgcuuaauugccuggaaaugaaaugaaaucaaauuuaucaguuuuuuuccccc

SEQ ID NO: 357117 - RNA, 64 nt, Homo Sapiens
aauuuucuuuagugcuuaaaauuaaguuuuaaaaugaaaucagacacugcagguuuguauauaa

SEQ ID NO: 357118 - RNA, 64 nt, Homo Sapiens
aaguucuuuuaaacagucuuuuuauuguggauugugaaaucaaaaucuggagaaaugcuuauaa

SEQ ID NO: 357119 - RNA, 64 nt, Homo Sapiens
cagcccuguuaggucuuuugaauucacaccuuauugaaaucaguguagaaguagaguuaccuaa

SEQ ID NO: 357120 - RNA, 64 nt, Homo Sapiens
ucacaguuuaaaacaucauuaaacauuauguaauuacaaugagaaagaaucuuacuuaaauuug

SEQ ID NO: 357121 - RNA, 64 nt, Homo Sapiens
guauaaaucuaaguuauuuggguacuuguaggaauacaaugaggagcuugaaugccaccuucug

SEQ ID NO: 357122 - RNA, 64 nt, Homo Sapiens
gcgacaagcagaugaagaaauuugugagagccgcuacaaugagaaccagaaaaugacauucugc

SEQ ID NO: 357123 - RNA, 64 nt, Homo Sapiens
uguggcugaagguuggcgacuugagcagcuccauuacaaugacaugaaccagguugccacuacu

SEQ ID NO: 357124 - RNA, 64 nt, Homo Sapiens
gcccucaugugcaguagagacucuccucuuguccuacaaugaaacaguuacaaaaauaaacgaa

SEQ ID NO: 357125 - RNA, 64 nt, Homo Sapiens
cacaaaucccauuaaauaaaaauuagaguugcucuacaaugacauaaaguugucacuauucuug

SEQ ID NO: 357126 - RNA, 64 nt, Homo Sapiens
uaaaauugcuaaaaucauggugauuuuuuuuucauacaaugaaucuggauucuccuagcauuca

SEQ ID NO: 357127 - RNA, 64 nt, Homo Sapiens
agcaaaauuguuccuuuuuucagguauucaguaauacaaugaaagcauuuuuacucaacuaccu

SEQ ID NO: 357128 - RNA, 64 nt, Homo Sapiens
acuaaaacugaacaagauguaaggguaguuguuuuacaaugaagaucugaucagaauuuaacua

SEQ ID NO: 357129 - RNA, 64 nt, Homo Sapiens
uauccuuccuuugacaauuacuuggccauuauuuuacaaugaugagaagauacuuuuaagacaa

SEQ ID NO: 357130 - RNA, 64 nt, Homo Sapiens
ucccccacucucaauaccuagagagugaaacccguacaaugagauaaagacuaaaaagagaaau

SEQ ID NO: 357131 - RNA, 64 nt, Homo Sapiens
cauuuuuauuaguuacuuauggaaaaucaucuauuacaaugauaaccuucaagugacuuccauu

SEQ ID NO: 357132 - RNA, 64 nt, Homo Sapiens
uuuguuucaagugaacuacacuauauuaacaauauacaaugaaauuguauguuuuuacuucuga

SEQ ID NO: 357133 - RNA, 64 nt, Homo Sapiens
auauauuaaagauuuuuaaauguaaugcaaguucuacaaugauauaaauaaucucauuuaacau

SEQ ID NO: 357134 - RNA, 64 nt, Homo Sapiens
ccuucugaaggcccaugcccuggcuuggcauguguacaaugaaaaguuuaggcaugcucagaau

SEQ ID NO: 357135 - RNA, 64 nt, Homo Sapiens
ccuuguagacucagaaaaagaagauccaauaaaauacaaugauuaccuagaagugcaagaaaug

SEQ ID NO: 357136 - RNA, 64 nt, Homo Sapiens
aauaauacauuuuuaaacaugucaacauugauaauacaaugaagauuuaccauaaaaaguauca

SEQ ID NO: 357137 - RNA, 64 nt, Homo Sapiens
gcgauuugaaugcacaguaaguggauaaucugaguacaaugaaauuucuuaaguuuuagaacau

SEQ ID NO: 357138 - RNA, 64 nt, Homo Sapiens
uuggccauuuacuguaaucacauuuuuauaucuguacaaugacacuuuuugcaguuguggggua

SEQ ID NO: 357139 - RNA, 64 nt, Homo Sapiens
uguaacacuguccaucuugcaucauugaaacuacuacaaugauacuaucauuuaauaauauuaa

SEQ ID NO: 357140 - RNA, 64 nt, Homo Sapiens
ggcuuucuguaacuuguuuuuguaaucuuuuguuuacaaugagguguacuuugauuuuauaacu

SEQ ID NO: 357141 - RNA, 64 nt, Homo Sapiens
aauguguauuuuaagaaagaacgggauguaaauuuacaaugacaaguaccacuuauuuaauaag

SEQ ID NO: 357142 - RNA, 64 nt, Homo Sapiens
auucugguaaaaauaggcaaaagugaccugaaucuacaaugaugucccaaaguaaccaaguaag

SEQ ID NO: 357143 - RNA, 64 nt, Homo Sapiens
acuucaagacugcuaauuguuucaucugaaagccuacaaugaaucauuguucaaccuugaaaaa

SEQ ID NO: 357144 - RNA, 64 nt, Homo Sapiens; identical to SEQ ID NO: 114926

SEQ ID NO: 357145 - RNA, 64 nt, Homo Sapiens; identical to SEQ ID NO: 114927

SEQ ID NO: 357146 - RNA, 64 nt, Homo Sapiens
gugccaugcggcugccugcaccccagacaauaaagggaccaaaaccacccaacccccacccugc

SEQ ID NO: 357147 - RNA, 64 nt, Homo Sapiens
acuaggaucauuccacaccccugcaccugaccaagggaccaaugaggcagaggcuugccccaag

SEQ ID NO: 357148 - RNA, 64 nt, Homo Sapiens
ugucaagcuggccguggaguagugugagggugcagggaccaagauucuuccauucccagacagc

SEQ ID NO: 357149 - RNA, 64 nt, Homo Sapiens
cugccuacccaccccuucccgugcacuuuaucuugggaccaaaauaucauaaggucuuauucuu

SEQ ID NO: 357150 - RNA, 64 nt, Homo Sapiens
cuuuguauaaccuaccugaaucagcccaggccucgggaccaacucacuucccagggcccaggcc

SEQ ID NO: 357151 - RNA, 64 nt, Homo Sapiens
caagaccuuguuuugcugucagaauggacgugcugggaccaacugagucaugagcugucuggga

SEQ ID NO: 357152 - RNA, 64 nt, Homo Sapiens
uuaacuuuuuggugcaucuaagguuggcacuguagggaccaagacauaagcacuggggacugcc

SEQ ID NO: 357153 - RNA, 64 nt, Homo Sapiens
ccugccucugcccaucagauccgugacagucucagggaccaaucgaaaggggguggagacagga

SEQ ID NO: 357154 - RNA, 64 nt, Homo Sapiens
gggggccacgcagccagccaauugagcugcaagagggaccaagagaugcugugccuugucaccc

SEQ ID NO: 357155 - RNA, 64 nt, Homo Sapiens
ccucccuggggacgugcccccaccucucugguucgggaccaauccaauccucucccccacggga

SEQ ID NO: 357156 - RNA, 64 nt, Homo Sapiens
accaagaagcacugggugaccagcuggcagacucgggaccaauacuacugacguccucccugau

SEQ ID NO: 357157 - RNA, 64 nt, Homo Sapiens
gcuggggcacggcgggauccuccacagagaggaggggaccaauucuggacagacagauguuggg

SEQ ID NO: 357158 - RNA, 64 nt, Homo Sapiens
auagauuagcguuugccagguggacgaaucuauauagagugaauuugaaaugcaaugucuaaaa

SEQ ID NO: 357159 - RNA, 64 nt, Homo Sapiens
auaugacccaggaaugccaccaaaaaguuaaacguagagugaccaaaacaguuuggcaguaccu

SEQ ID NO: 357160 - RNA, 64 nt, Homo Sapiens
auguuuuggucuugugaucacugucugucacaaguagagugaaagggguaagggggugggaggg

SEQ ID NO: 357161 - RNA, 63 nt, Homo Sapiens
aaaagcugugauacuauaguuaauaaauucccacuagagugacacugaagauuuaaacacaag

SEQ ID NO: 357162 - RNA, 64 nt, Homo Sapiens
acacaugcuacaaugaggcauagagugaaaacacuagagugaaaucauucauaaacacagagug

SEQ ID NO: 357163 - RNA, 64 nt, Homo Sapiens
acacuagagugaaaacacauauaaacacagaguguagagugaaaauagcucaggcuauucauuc

SEQ ID NO: 357164 - RNA, 64 nt, Homo Sapiens
cuguacagagucuuacuguagcuacgcuaaugguuaaccugauagaauuaacucguauuuuucu

SEQ ID NO: 357165 - RNA, 64 nt, Homo Sapiens
ccugauagaauuaacucguauuuuucuaugguuuuaaccugaugcuccacugucuccgucaugg

SEQ ID NO: 357166 - RNA, 64 nt, Homo Sapiens
gacauuaaauugacuuuuaagaaaaacaugucacuaaccugaagcucagccacacagugacuuu

SEQ ID NO: 357167 - RNA, 64 nt, Homo Sapiens
ucaacuguugugugaaugagccagacacauugcuuaaccugaguccgagauggacaaugguaua

SEQ ID NO: 357168 - RNA, 64 nt, Homo Sapiens
gaagcccccucugcuuuaauccacacaaggaacguaaccugaaguaaccugauguuaaccaauc

SEQ ID NO: 357169 - RNA, 64 nt, Homo Sapiens
cugcuuuaauccacacaaggaacguaaccugaaguaaccugauguuaaccaaucugcugugucu

SEQ ID NO: 357170 - RNA, 64 nt, Homo Sapiens
uccuuaauaaaauuuggauuaaauuugaaguauguaaccugaaaaugauuccauuccauucuag

SEQ ID NO: 357171 - RNA, 64 nt, Homo Sapiens
caguauaguuacugguaccaaguuaacuguaaaguaaccugacuuauuguguuuuaggugacau

SEQ ID NO: 357172 - RNA, 64 nt, Homo Sapiens
aggaaagaacuacauucuucagaauacagugaugaaaauucauuuugaaacucaaauauuuuca

SEQ ID NO: 357173 - RNA, 64 nt, Homo Sapiens
guugucuuuuacuaggacuguaaacuuuugugauaaaauucaaauaagauuuuauuucuuggua

SEQ ID NO: 357174 - RNA, 64 nt, Homo Sapiens
uaaaguugaaaaaccuucucuucagaaaagaagaaaaauucagaaaucaguagaucuuggcaau

SEQ ID NO: 357175 - RNA, 64 nt, Homo Sapiens
uuuccauugggauguuuucauuucaaaauuguucaaaauucaaaagacacagaacgauaaacag

SEQ ID NO: 357176 - RNA, 64 nt, Homo Sapiens
gcucaccaaacgaaggguaucagcuauuuuuuuuaaaauucaaaaagaauaucccuuuuauagu

SEQ ID NO: 357177 - RNA, 64 nt, Homo Sapiens
aaguauugcuaaguacuauaacauauuggccacuaaaauucauauugagauuaucuugguuucu

SEQ ID NO: 357178 - RNA, 64 nt, Homo Sapiens
uuuuacauuuugaagaaggggagcaaaucuaaaaaaaauucaguugaacuucugagaguuaaca

SEQ ID NO: 357179 - RNA, 64 nt, Homo Sapiens
uaauaaaucugaauucuauuaguuuaaaaauuguaaaauucaaguuaaaugacguguaugauau

SEQ ID NO: 357180 - RNA, 64 nt, Homo Sapiens
auuucaguuaguuaaauaccuguagccuaacuggaaaauucaggcuucaucauguaguuugaag

SEQ ID NO: 357181 - RNA, 64 nt, Homo Sapiens
gugucagagaacaaaagaaacagaaucaauauauaaaauucaaagacuaucugcagcuagugug

SEQ ID NO: 357182 - RNA, 64 nt, Homo Sapiens
gucagucagucucuguaguuaaaacuuuuucuuuaaaauucaauuaagguacuucucccucagg

SEQ ID NO: 357183 - RNA, 64 nt, Homo Sapiens
gucagucagucucuguaguuaaaacuuuuucuuuaaaauucaauuaaguuacaccagaauuuac

SEQ ID NO: 357184 - RNA, 64 nt, Homo Sapiens
cuucaauacaugaauggaaacuaguaguguaaauaaaauucacuacuggaguagcugggauuua

SEQ ID NO: 357185 - RNA, 64 nt, Homo Sapiens
aauugcuucuuaacucuuauuuuuauuuccaaaaaaaauucauuggguaauguauauacauauu

SEQ ID NO: 357186 - RNA, 64 nt, Homo Sapiens
ugaaaacugaauuuugacuucaaauaaaaauuuaaaaauucaaucugcuguguauuguauuuuu

SEQ ID NO: 357187 - RNA, 64 nt, Homo Sapiens
ugaaaaaggcaagauacaugaugcugucaugaagaaaauucagaucaagauuguacagugagug

SEQ ID NO: 357188 - RNA, 64 nt, Homo Sapiens
aacuaauauuaggcaguugaagggaucuaaucugaaaauucaguauugcaagugucuuuaaacu

SEQ ID NO: 357189 - RNA, 64 nt, Homo Sapiens
uagaaucauagggccucauuggaaaaauuuuuuuaaaauucaccuuuuaagaauuguuccuugg

SEQ ID NO: 357190 - RNA, 64 nt, Homo Sapiens
uccuuuauuuugugucuuggaaucaaacuauaagaaaauucaaguuagucaguaaaauguuaga

SEQ ID NO: 357191 - RNA, 64 nt, Homo Sapiens
uagcuuugcaaauacuaguuugaagaucaacagaaaaauucaaguaucauuauuuaacaacaag

SEQ ID NO: 357192 - RNA, 64 nt, Homo Sapiens
aguuaauuacugcuuugugugggaaagaaaaaugaaaauucauuauuaucccuuuuuaauauug

SEQ ID NO: 357193 - RNA, 64 nt, Homo Sapiens
uuuaagaucucugguuuaggggcagcauuuuuuaaaaauucaguaggcgggagccacugcacau

SEQ ID NO: 357194 - RNA, 64 nt, Homo Sapiens
gcauggacauuuagaagaaauuaauuuggagcacaaaauucaaaucccacucauucugaauuaa

SEQ ID NO: 357195 - RNA, 64 nt, Homo Sapiens
uuuuuuccaguuccucuuuucggagaugaggaguaaaauucaguuuuagaaauauucacaucuu

SEQ ID NO: 357196 - RNA, 64 nt, Homo Sapiens
caucacauuuuucuggaaaauaacacauaaaaugaaaauucacauuacauuaaugagugcaaaa

SEQ ID NO: 357197 - RNA, 64 nt, Homo Sapiens
uauaaguuuccaugcuuuuucaauuuaguucaauaaaauucaaaucaucucuagcacugccauc

SEQ ID NO: 357198 - RNA, 64 nt, Homo Sapiens
aaaacaaaagcaaguucuuuguuaggaauuggucaaaauucaucucuuucuuuaagcccaucaa

SEQ ID NO: 357199 - RNA, 64 nt, Homo Sapiens
uacggucucaccgaugcaguuuucauggacauagaaaauucaaauagaauauauaauauugaau

SEQ ID NO: 357200 - RNA, 64 nt, Homo Sapiens
guuuacauuguaacauucuauuguaaaaucaacuaaaauucagacuuuuagcaggacuuugugu

SEQ ID NO: 357201 - RNA, 64 nt, Homo Sapiens
ggaaaugacaacugcaaauguagacuauacuguaaaaauucaguuuguugcuuuaaagaaacaa

SEQ ID NO: 357202 - RNA, 64 nt, Homo Sapiens
uugaaaccacuccuuuucuccucuuggcuacauuaaaauucaguugacuacaaaugcuuucuau

SEQ ID NO: 357203 - RNA, 64 nt, Homo Sapiens
ucauucagucagucucuguugacuaaauacgacgaaaauucauacuuuaugcaggagauuucua

SEQ ID NO: 357204 - RNA, 64 nt, Homo Sapiens
uuccccuuauggauauuuaucucuuucauauucuaaaauucauuauuuggcuauuuauuaaccu

SEQ ID NO: 357205 - RNA, 64 nt, Homo Sapiens
ugcuauuaaacaaguugagagcaauuuuuaugucaaaauucaauuguucuuuagcugaaguuuu

SEQ ID NO: 357206 - RNA, 64 nt, Homo Sapiens
acuuaauugauccuacaagcuuacuacacauaggaaaauucauacuggagagaaacuacaaaug

SEQ ID NO: 357207 - RNA, 64 nt, Homo Sapiens
uuuuaaccuuccuuaacccuuaacuguagauaagaaaauucauacuggaaagaaacccuacaaa

SEQ ID NO: 357208 - RNA, 64 nt, Homo Sapiens
uuuucaccgauacucaauccuuaguacacauaagaaaauucauacuggggagaaaccccacaaa

SEQ ID NO: 357209 - RNA, 64 nt, Homo Sapiens
uuuuaaccaguccucacaccuuaugagacauaagaaaauucauaguaaagagaaacccuacaaa

SEQ ID NO: 357210 - RNA, 64 nt, Homo Sapiens
uuuuaacuaguucucgaacuuuacuaugcauaagaaaauucaaacuggagagaaacucuacaaa

SEQ ID NO: 357211 - RNA, 64 nt, Homo Sapiens
guaaaacuuacaauccucaaaacuucuuacaccuaaaauucaugcaggagagaaacaccacaaa

SEQ ID NO: 357212 - RNA, 64 nt, Homo Sapiens
auauauaauaccauauuuuuaauuucacaaauaaaaaauucaaaguuuuguacaaaauuauaug

SEQ ID NO: 357213 - RNA, 62 nt, Homo Sapiens
uuuuauggugucucauagccaaucccacaguguaaaaauucaggaauucaaugaaaaaaguc

SEQ ID NO: 357214 - RNA, 64 nt, Homo Sapiens
cuguaguccaagcucaggcauaauucagcauaagaaaauucacaccagagccaaaucuuacaaa

SEQ ID NO: 357215 - RNA, 64 nt, Homo Sapiens
cuucagucguaguguccaccuuacucaacaucagaaaauucacaaagagaugcccuguaagugu

SEQ ID NO: 357216 - RNA, 64 nt, Homo Sapiens
ucuaaauuuuacauguagaauuaaacgauuuaucaaaauucaucaauuuuaaacacuuuuauuu

SEQ ID NO: 357217 - RNA, 64 nt, Homo Sapiens
cagcaucuucucuauuggccacaacuccauuagaaaaauucagaaacucaauacaaagacaagu

SEQ ID NO: 357218 - RNA, 64 nt, Homo Sapiens
ugcuagaagccuacugguaguggugcagugugugaaaauucaggaggcguuuggagaaggucug

SEQ ID NO: 357219 - RNA, 64 nt, Homo Sapiens
ucuguaugucauggaucgugccacaaaaauagagaaaauucaggcuugagagaaacgugaaacg

SEQ ID NO: 357220 - RNA, 64 nt, Homo Sapiens
aagucucaucauucuguuggguaguggaagaauuaaaauucauaaauuugcaaaagccacaaca

SEQ ID NO: 357221 - RNA, 64 nt, Homo Sapiens
ugaaccaguuuuccaagaacauaagaaagggcaaaaaauucauuuaagacaauaugugaugaau

SEQ ID NO: 357222 - RNA, 64 nt, Homo Sapiens
auuuaauguaauuaaucuuuuuagcacucauuccaaaauucaguaccaaaucacauuaucuauu

SEQ ID NO: 357223 - RNA, 64 nt, Homo Sapiens
aauaaucuuaaggccagagaccagcaaucaguaaaaaauucagcgcuuagagguucaaauauca

SEQ ID NO: 357224 - RNA, 64 nt, Homo Sapiens
caccuguuuuauaugguuuaaaauucucuuuaacaaaauucagaaaauucaccugaaacguauu

SEQ ID NO: 357225 - RNA, 64 nt, Homo Sapiens
uauaugguuuaaaauucucuuuaacaaaauucagaaaauucaccugaaacguauuuugaccuaa

SEQ ID NO: 357226 - RNA, 64 nt, Homo Sapiens
acuaggugucagcaugugaauuuuggaaaacacaaaaauucagaacauagcaaauaccuuugaa

SEQ ID NO: 357227 - RNA, 64 nt, Homo Sapiens
agaacauagcaaauaccuuugaaguauaaaagauaaaauucauuuuuagugaacccuguaauuu

SEQ ID NO: 357228 - RNA, 64 nt, Homo Sapiens
aaaugauguugagugggagaauuugccaaaaacuaaaauucaaccaagaacaaacagaaacgag

SEQ ID NO: 357229 - RNA, 64 nt, Homo Sapiens
gcauccugauuauugaauguuuaaauuuuaauguaaaauucauacucuauuuuuuacuacauaa

SEQ ID NO: 357230 - RNA, 64 nt, Homo Sapiens
uguuuucaacuguaauugucuuaauggaaauguuaaaauucauaucugauuaacauuuuuaaua

SEQ ID NO: 357231 - RNA, 64 nt, Homo Sapiens
uuguccaaauagaugagagagcaaaucaugugagaaaauucagaauaccaucuguuucauagcc

SEQ ID NO: 357232 - RNA, 64 nt, Homo Sapiens
gcaggauagaccaguuacauccuuugaauucaauaaaauucacuuuucucaaauaggaauacua

SEQ ID NO: 357233 - RNA, 64 nt, Homo Sapiens
ugcacuuauguucucauucugccagaacucagaaaaaauucaaauaggcuugucagagccuaua

SEQ ID NO: 357234 - RNA, 64 nt, Homo Sapiens
cauguauauaccuuuuugugucaaaaggacauuuaaaauucaauuaggauuaauaaagauggca

SEQ ID NO: 357235 - RNA, 64 nt, Homo Sapiens
cuucuccaucuccuguguaaucaaggccagugcuaaaauucagaugcuguuaguaccuacauca

SEQ ID NO: 357236 - RNA, 64 nt, Homo Sapiens
ucucaaaaaagccaaucuuuguacucuugcagagaaaauucagacuaucauccucaaggacauu

SEQ ID NO: 357237 - RNA, 64 nt, Homo Sapiens
acuaucauccucaaggacauuacuagugacucagaaaauucaaacuucagaaaugaaauccaaa

SEQ ID NO: 357238 - RNA, 64 nt, Homo Sapiens
cuugugucaaaaugauauagcuuaguauaaaaauaaaauucaacguuuuggccaaaauguuugu

SEQ ID NO: 357239 - RNA, 64 nt, Homo Sapiens
acuacuguuacauuuuauuaauuuaaaaagcuagaaaauucauguaguuacuuuuuuuacauau

SEQ ID NO: 357240 - RNA, 64 nt, Homo Sapiens
aacccaugugauguccuccaaaauguguaggguaaaaauucacagggcuuccagaucacuuuuu

SEQ ID NO: 357241 - RNA, 64 nt, Homo Sapiens
uucuggaaacuuuaauguuuuaaaccucuuuuauaaaauucaaugacgacuacuagaauucuuu

SEQ ID NO: 357242 - RNA, 64 nt, Homo Sapiens
auagaauuacccuaugauucuggagguucgucacaaaauucaacgcugcuguuggaaaacgcua

SEQ ID NO: 357243 - RNA, 64 nt, Homo Sapiens
aaaagaacguugaaccaaauuggauguagaaaauaaaauucaagacauccacaaaaauaugcaa

SEQ ID NO: 357244 - RNA, 64 nt, Homo Sapiens
uugcugcagaaguaggcuaaaacucuucccagggaaaauucauguuuguaagacccauauuuuu

SEQ ID NO: 357245 - RNA, 64 nt, Homo Sapiens
uuucauguuucugauuccaguuauacaaagaaaaaaaauucagcgucuguuauuuuguuucuuu

SEQ ID NO: 357246 - RNA, 64 nt, Homo Sapiens
uuuaaaaauauugaacauacuuauaaccaauucuaaaauucagcauuuuuaaagcaguauuauu

SEQ ID NO: 357247 - RNA, 64 nt, Homo Sapiens
uccauauggagacuuacauacugaauuuaaaaugaaaauucaugcugagaguaucuaugucuuu

SEQ ID NO: 357248 - RNA, 64 nt, Homo Sapiens
ucaaauuggacucgauuuccuugugugcuguuuuaaaauucauugcgcugggggcuugugaugu

SEQ ID NO: 357249 - RNA, 64 nt, Homo Sapiens
ucaauuucaaggaaaaacauauaggcgagcaaauaaaauucaaauucuggauaguaggauuuua

SEQ ID NO: 357250 - RNA, 64 nt, Homo Sapiens
ucaagcauaaagcuucuguucuuugggagaaaauaaaauucaacuuauaggaggaaaaaaauca

SEQ ID NO: 357251 - RNA, 64 nt, Homo Sapiens
uguuuggugucugccuuuuucauuuaaucuugggaaaauucagguggcgcgcuuuuuuaauaau

SEQ ID NO: 357252 - RNA, 64 nt, Homo Sapiens
cauuuaggaaugugaccuuuuaaguggugcuuagaaaauucaagcuaggaaauucuugaaaaua

SEQ ID NO: 357253 - RNA, 64 nt, Homo Sapiens
uuauacaucuugggaguacagacagcuuuacuuuaaaauucaaguccuucuucuaguuuuaugc

SEQ ID NO: 357254 - RNA, 64 nt, Homo Sapiens
uuaauaguagaugugguucccagaaaauauaaucaaaauucaaagauuuuuuuuguuucuguaa

SEQ ID NO: 357255 - RNA, 64 nt, Homo Sapiens
uuaaaauaugaauuuaaaaaauuuuuguaaaaauaaaauucacaaaauuguuuugaaaaacauu

SEQ ID NO: 357256 - RNA, 64 nt, Homo Sapiens
cugggguuggcccagaaggaggcacaucagucccaaaauucaucacuuaacccagcguccagga

SEQ ID NO: 357257 - RNA, 64 nt, Homo Sapiens
ucgaccucuguuaaguggagggauuugugagauaaaaauucaaaauguuggccugaggccugag

SEQ ID NO: 357258 - RNA, 64 nt, Homo Sapiens
uccugcugggccuuuuuucaaggcaauaggacacaaaauucacacaauauuuucccuauaacaa

SEQ ID NO: 357259 - RNA, 64 nt, Homo Sapiens
uucuugucagauacuacaaaugcaaaggcauuuaaaaauucaauuuuaaguagguugaaguuuu

SEQ ID NO: 357260 - RNA, 64 nt, Homo Sapiens
gcuuaaauuucccaucagugauugaaaauucacaaaaauucacacagauuuugcuuucugugga

SEQ ID NO: 357261 - RNA, 64 nt, Homo Sapiens
aaaauucacagcuuaaauuuuuucuguggaauugaaaauucacaggaugugauacagauuuugc

SEQ ID NO: 357262 - RNA, 64 nt, Homo Sapiens
gguggauuacaagguguccuuguaugccuucgggaaaauucaaaagggcagguuagagacagua

SEQ ID NO: 357263 - RNA, 64 nt, Homo Sapiens
gaguuucacccuuaagcugugcagaaagauuuggaaaauucacagacaagcuaggaaagaggag

SEQ ID NO: 357264 - RNA, 64 nt, Homo Sapiens
cuccccgacuaguggaugggagagucccauugcuaaaauucagcuacucagauaaauucagaau

SEQ ID NO: 357265 - RNA, 64 nt, Homo Sapiens
ucaguauucuuuuaucauaaauuuuuagcauuuaaaaauucacugauguacauuaagccaauaa

SEQ ID NO: 357266 - RNA, 64 nt, Homo Sapiens
guaucaugaaacccuaagggacguuggggaggggaaaauucacuagugucccaauuuuuuccaa

SEQ ID NO: 357267 - RNA, 64 nt, Homo Sapiens
gauuguuuaaaggucugauguucugauaacauggaaaauucaaggucucgaugcuguuaacaac

SEQ ID NO: 357268 - RNA, 64 nt, Homo Sapiens
cagaaaaauuccguuugguacucgguuaucuuuuaaaauucacauucuucuaaaauauugggca

SEQ ID NO: 357269 - RNA, 64 nt, Homo Sapiens
uauuacugaauuagcguuuauuauguguuuugcuaaaauucaggccacccucagucgcauagac

SEQ ID NO: 357270 - RNA, 64 nt, Homo Sapiens
caguuccauuuucucucuugugaaaaacaucuuuaaaauucaaauuuccauauguuacugaauc

SEQ ID NO: 357271 - RNA, 64 nt, Homo Sapiens
ugaagagaaaaagaaaaacaaggucuacuuuaaaaaaauucaaaacuuaaauaaagaaagugug

SEQ ID NO: 357272 - RNA, 64 nt, Homo Sapiens
cuugcucuguuuugcuuuuccauauagcucgagcaaaauucaaaaagaacuaaauaugcaauau

SEQ ID NO: 357273 - RNA, 64 nt, Homo Sapiens
agaugcccuguugguuucacagauaacauaaauaaaaauucaaccacagauuuauacaaggguu

SEQ ID NO: 357274 - RNA, 64 nt, Homo Sapiens
cuucagcaggaaagaaaaucucauuacacaucagaaaauucacacuggagagaaaccuuaugaa

SEQ ID NO: 357275 - RNA, 64 nt, Homo Sapiens
cuuuagucagaaaucaaaccucacugaacaugagaaaauucauacuggagagaaaccuuaucau

SEQ ID NO: 357276 - RNA, 64 nt, Homo Sapiens
uuucagucagagacaaaaucuucuugagcaugaaaaaauucauacuggagagaaaccauucaaa

SEQ ID NO: 357277 - RNA, 64 nt, Homo Sapiens
uaagaauuuucuaggaucuuucaaaaaugauuauaaaauucaugugaaauagaaguguaugaau

SEQ ID NO: 357278 - RNA, 64 nt, Homo Sapiens
cuggagagaaacacuacaaauuauuacacauaagaaaauucauguuuuaaacaguccucaaucu

SEQ ID NO: 357279 - RNA, 64 nt, Homo Sapiens
cuggagagaaaaucuacaaacuaguaaacauaagaaaauucauauccuucagcugauucucagu

SEQ ID NO: 357280 - RNA, 64 nt, Homo Sapiens
uaaucaccccuuagauuucagaaaugguacaauaaaaauucauguugcuuauuugccaccauaa

SEQ ID NO: 357281 - RNA, 64 nt, Homo Sapiens
uuacauuaaagugacaugaauaauaguguauuggaaaauucauucguucagcagauuuuacacu

SEQ ID NO: 357282 - RNA, 64 nt, Homo Sapiens
ccuuguaauucauaguggagguaauuaaaaggucaaaauucacauuggucaaaauucacaccuu

SEQ ID NO: 357283 - RNA, 64 nt, Homo Sapiens
ccuuguaauuaaaaggucaacaagaccguuggucaaaauucacauauaaguguaaugagugugg

SEQ ID NO: 357284 - RNA, 64 nt, Homo Sapiens
uugaagagaaaccauacagauuaaaacacauaagaaaauucacauuucaguuguaaaucaaacc

SEQ ID NO: 357285 - RNA, 64 nt, Homo Sapiens
ccaugcauuccaguuaacacauuuaaacauauagaaaauucacuucuucuuucaaguccuuccc

SEQ ID NO: 357286 - RNA, 64 nt, Homo Sapiens
uuuuuagcuaauuaccaaggucucugccuaugcaaaaauucaucuuucggugauugugggcggc

SEQ ID NO: 357287 - RNA, 64 nt, Homo Sapiens
uaugccauuggguuuuuguguguaugugauuuucaaaauucaugacuugaagugcaaggacaga

SEQ ID NO: 357288 - RNA, 64 nt, Homo Sapiens
acuguggugugauuggcuaaacaaucucgcauuaaaaauucaaauguaaauugaauucacauga

SEQ ID NO: 357289 - RNA, 64 nt, Homo Sapiens
aaugugauguuuuaguaauguagauuggaagaauaaaauucaagaaucugucucugggaaagac

SEQ ID NO: 357290 - RNA, 64 nt, Homo Sapiens
uuuaccuugaaguucaaucucuuguccgcaucugaaaauucacuucauaauccuuagaaguuag

SEQ ID NO: 357291 - RNA, 64 nt, Homo Sapiens
ggacagacagccaaagcuucagagauacaguccacagguggacaaagggauccccagccagaga

SEQ ID NO: 357292 - RNA, 64 nt, Homo Sapiens
cccaaaagacagacaucucugcuagcuggacagccagguggacccccuaaguuagauuacuaga

SEQ ID NO: 357293 - RNA, 64 nt, Homo Sapiens
aagacuaccuguuugaaaaauggagagcaugcaucagguggaagugaugaccucguggccugug

SEQ ID NO: 357294 - RNA, 64 nt, Homo Sapiens
ccuccaucgcucuggcccugaguuugccuucugccagguggaugccuuucuccugucuuugcag

SEQ ID NO: 357295 - RNA, 64 nt, Homo Sapiens
gucagcucauucuugccuuacuccaaugauggcccagguggaaaaguagcagcuguaucgggcu

SEQ ID NO: 357296 - RNA, 64 nt, Homo Sapiens
gugauacugagaaaauacaugaacagaaacugcccagguggaacagcacguaaccuagugagug

SEQ ID NO: 357297 - RNA, 64 nt, Homo Sapiens
guuccagccaaccugcucuuuccugaguucaaagcagguggagacuggcugguuaccaucuuug

SEQ ID NO: 357298 - RNA, 64 nt, Homo Sapiens
caucgucucccgcaaugggcagagagagcagagacagguggaccaacagacagcuggccccugg

SEQ ID NO: 357299 - RNA, 64 nt, Homo Sapiens
acccggaacgcuucuccucgauggcuaccgcgugcagguggagaccucaccagcgucaccaacc

SEQ ID NO: 357300 - RNA, 64 nt, Homo Sapiens
cugcauggcuggaaggccggucgccaagcacaaucagguggagggcggcgcuccuaugaggcca

SEQ ID NO: 357301 - RNA, 64 nt, Homo Sapiens
ugggcccaggcccuguucacguuccugacuugagcagguggauuguggaguagaacgagccaga

SEQ ID NO: 357302 - RNA, 64 nt, Homo Sapiens
guccuggggacggcagaggagcuggccuccugcccagguggaggucucuggccauugcagagcu

SEQ ID NO: 357303 - RNA, 64 nt, Homo Sapiens
gaagguucugggugcccgcacaacugugccuccucagguggaugcccggguaaagugggggccu

SEQ ID NO: 357304 - RNA, 64 nt, Homo Sapiens
ugaguuuuauauucaaacuuuucuuuagucauuccagguggaucagguggauacagaacuucca

SEQ ID NO: 357305 - RNA, 64 nt, Homo Sapiens
cagaacuuccauucuuuaguuaccaguuuuaacacagguggauaguaacagauaucauuacauu

SEQ ID NO: 357306 - RNA, 64 nt, Homo Sapiens
accugaggucaggaguuugauugggaggccgaggcagguggaucacaccuguaaucccagcauu

SEQ ID NO: 357307 - RNA, 64 nt, Homo Sapiens
acgcagccuuuucuaggcagacggccaguagucacagguggaaagaugauuuuguagaauaugc

SEQ ID NO: 357308 - RNA, 64 nt, Homo Sapiens
gcccaguccuuggugucagggagcccccaggccgcagguggagggugauaaaauauguucucug

SEQ ID NO: 357309 - RNA, 64 nt, Homo Sapiens
gaagaagaaacgggugagaacugcuaagugaugacagguggagccccagcaggggccacucuau

SEQ ID NO: 357310 - RNA, 64 nt, Homo Sapiens
accugaggucgggaguucgauugggaggcagaggcagguggaucacgccuguaaucccagcgcu

SEQ ID NO: 357311 - RNA, 64 nt, Homo Sapiens
ggggaacugccucagugagauuuaucugagcccacagguggaaaacuuccaggugccccaccua

SEQ ID NO: 357312 - RNA, 64 nt, Homo Sapiens
uuuccggcagcccggaaccugggaugagaaacgacagguggaagguuguccagagacaccuaca

SEQ ID NO: 357313 - RNA, 64 nt, Homo Sapiens
auccaccuccauuucagcauguggcucgcguggacagguggacggacgcuguggccgcauggaa

SEQ ID NO: 357314 - RNA, 64 nt, Homo Sapiens
cugcgcacagcuucucccgggcaacgguggcaggcagguggagggccugugcagcagaacagag

SEQ ID NO: 357315 - RNA, 64 nt, Homo Sapiens
gccgcaugucacugucagaguuggagucaggccucagguggagacugucuuaccugcgcucagc

SEQ ID NO: 357316 - RNA, 64 nt, Homo Sapiens
ccccgcagggacgcggcggcggggagcccccagccagguggagaguccucgagaugaagacggg

SEQ ID NO: 357317 - RNA, 64 nt, Homo Sapiens
ccgcccuccggggcuggacgucgggcuggggggucagguggacgugggaggcggcggcggcggc

SEQ ID NO: 357318 - RNA, 64 nt, Homo Sapiens
ggccgcuucccgcaggcauccgucuucccuuccgcagguggaggcgugcggcuccaacaggcau

SEQ ID NO: 357319 - RNA, 64 nt, Homo Sapiens
cacgggccagcagccgcgaagcaggaaccugcuccagguggacaagguacacauugggcggccu

SEQ ID NO: 357320 - RNA, 64 nt, Homo Sapiens
ugaccggcuuuggggaggcagcaucucccugccacagguggagcgcugaggaugccuccgcugg

SEQ ID NO: 357321 - RNA, 64 nt, Homo Sapiens
ugccugccuugcccucacuggaauccaggucccccagguggagcuguggaggccccagccgugg

SEQ ID NO: 357322 - RNA, 64 nt, Homo Sapiens
ugguugggccgcggcugccaguuucacagccccucagguggagcugagguggcugcaggagcuc

SEQ ID NO: 357323 - RNA, 64 nt, Homo Sapiens
ucccgagugggcggggcagcgggagaccuccauucagguggaggcuggggcagggcagguggag

SEQ ID NO: 357324 - RNA, 64 nt, Homo Sapiens
ggagaccuccauucaggugguaacuggggcagggcagguggagggcuggggcuggaugcuuggg

SEQ ID NO: 357325 - RNA, 64 nt, Homo Sapiens
ccuggguccccgaggaggaggcaggggugggaggcagguggacuuauacuuauuuauuucagga

SEQ ID NO: 357326 - RNA, 64 nt, Homo Sapiens
aaagcaccuugacacaaggagacagguggcuguucagguggacccuccuuucucuuggcugagu

SEQ ID NO: 357327 - RNA, 64 nt, Homo Sapiens
aguacagugcugccugcccuacuagcucaucuuucagguggaaaacagugacccagccaugggc

SEQ ID NO: 357328 - RNA, 64 nt, Homo Sapiens; identical to SEQ ID NO: 50374

SEQ ID NO: 357329 - RNA, 64 nt, Homo Sapiens; identical to SEQ ID NO: 50375

SEQ ID NO: 357330 - RNA, 64 nt, Homo Sapiens; identical to SEQ ID NO: 50376

SEQ ID NO: 357331 - RNA, 64 nt, Homo Sapiens; identical to SEQ ID NO: 50377

SEQ ID NO: 357332 - RNA, 64 nt, Homo Sapiens; identical to SEQ ID NO: 50378

SEQ ID NO: 357333 - RNA, 64 nt, Homo Sapiens; identical to SEQ ID NO: 50379

SEQ ID NO: 357334 - RNA, 64 nt, Homo Sapiens; identical to SEQ ID NO: 50380

SEQ ID NO: 357335 - RNA, 64 nt, Homo Sapiens; identical to SEQ ID NO: 50381

SEQ ID NO: 357336 - RNA, 64 nt, Homo Sapiens; identical to SEQ ID NO: 50382

SEQ ID NO: 357337 - RNA, 64 nt, Homo Sapiens; identical to SEQ ID NO: 50383

SEQ ID NO: 357338 - RNA, 64 nt, Homo Sapiens; identical to SEQ ID NO: 50384

SEQ ID NO: 357339 - RNA, 64 nt, Homo Sapiens; identical to SEQ ID NO: 50385

SEQ ID NO: 357340 - RNA, 64 nt, Homo Sapiens; identical to SEQ ID NO: 50386

SEQ ID NO: 357341 - RNA, 64 nt, Homo Sapiens; identical to SEQ ID NO: 50387

SEQ ID NO: 357342 - RNA, 64 nt, Homo Sapiens; identical to SEQ ID NO: 50388

SEQ ID NO: 357343 - RNA, 64 nt, Homo Sapiens; identical to SEQ ID NO: 50389

SEQ ID NO: 357344 - RNA, 64 nt, Homo Sapiens; identical to SEQ ID NO: 50390

SEQ ID NO: 357345 - RNA, 64 nt, Homo Sapiens; identical to SEQ ID NO: 50391

SEQ ID NO: 357346 - RNA, 64 nt, Homo Sapiens; identical to SEQ ID NO: 50392

SEQ ID NO: 357347 - RNA, 64 nt, Homo Sapiens; identical to SEQ ID NO: 50393

SEQ ID NO: 357348 - RNA, 64 nt, Homo Sapiens; identical to SEQ ID NO: 50394

SEQ ID NO: 357349 - RNA, 64 nt, Homo Sapiens; identical to SEQ ID NO: 50395

SEQ ID NO: 357350 - RNA, 64 nt, Homo Sapiens; identical to SEQ ID NO: 50396

SEQ ID NO: 357351 - RNA, 64 nt, Homo Sapiens; identical to SEQ ID NO: 50397

SEQ ID NO: 357352 - RNA, 64 nt, Homo Sapiens; identical to SEQ ID NO: 50398

SEQ ID NO: 357353 - RNA, 64 nt, Homo Sapiens; identical to SEQ ID NO: 50399

SEQ ID NO: 357354 - RNA, 64 nt, Homo Sapiens; identical to SEQ ID NO: 50400

SEQ ID NO: 357355 - RNA, 64 nt, Homo Sapiens; identical to SEQ ID NO: 50401

SEQ ID NO: 357356 - RNA, 64 nt, Homo Sapiens; identical to SEQ ID NO: 50402

SEQ ID NO: 357357 - RNA, 64 nt, Homo Sapiens
guaauuuuacuuuaaauuauguaucuuuauuuucauauuguacauuguagauucuaacauuuau

SEQ ID NO: 357358 - RNA, 64 nt, Homo Sapiens
aucacuugucuucuagaggucuucucacgaucccauauuguauuuguucagaauuacuuuugcu

SEQ ID NO: 357359 - RNA, 64 nt, Homo Sapiens
uauuguuaaaugcaaaaaggaauguauuuauuuuauauuguauaagcaaauguccauuugugua

SEQ ID NO: 357360 - RNA, 64 nt, Homo Sapiens
uugugguuucucaguagagaagcuauaugggacuauauuguagaaauacuguguaucuaucauu

SEQ ID NO: 357361 - RNA, 64 nt, Homo Sapiens
uauuggaaguaauaucaaacgauauguuuaauaaauauuguacuuauguaacaaaacaacugaa

SEQ ID NO: 357362 - RNA, 64 nt, Homo Sapiens
uuguugcacacuauguaacauuuguggcugcagaauauuguaauucuucauacucugcauauaa

SEQ ID NO: 357363 - RNA, 64 nt, Homo Sapiens
agaugguacuugaauucuuuuaacaguucuguuaauauuguacaguuuaacacauuuucuugag

SEQ ID NO: 357364 - RNA, 64 nt, Homo Sapiens
uuuucaaauuguuaucaauuaguguuuuggaauaauauuguacccauuuuauacacccucaggc

SEQ ID NO: 357365 - RNA, 64 nt, Homo Sapiens
guuaaacuguauuucugaugacggauucucuuuaauauuguacaagaaaaagguuauacguacc

SEQ ID NO: 357366 - RNA, 64 nt, Homo Sapiens
uuuuuuaagucuucuugaaggcuuuucuaauuggauauuguauuguacaaauguuuaaaauaug

SEQ ID NO: 357367 - RNA, 64 nt, Homo Sapiens
aaaagacugaaacaaugcaugaucgacucuaucaauauuguauauaugguaaaauaauagaaau

SEQ ID NO: 357368 - RNA, 64 nt, Homo Sapiens
guaguauacuugguaagauaaaacacuugaauuuauauuguaugccaucauucgaaucauccuu

SEQ ID NO: 357369 - RNA, 64 nt, Homo Sapiens
caaaaugaagaauauguagauaauggacugggauauauuguauuucucauguuaaagccucuuc

SEQ ID NO: 357370 - RNA, 64 nt, Homo Sapiens
aauguguuucauucuaguaagaaaaccucaaaggauauuguaggauauaaaucuuacuugaaaa

SEQ ID NO: 357371 - RNA, 64 nt, Homo Sapiens
agucuuguuaaaaugauggaccuccucuaagaccauauuguaaguuuauuaacuaauguaaugu

SEQ ID NO: 357372 - RNA, 64 nt, Homo Sapiens
ucaugcuguuuaugugugaccacuauauauaagaauauuguaugguaaugugugcguaucaugu

SEQ ID NO: 357373 - RNA, 64 nt, Homo Sapiens
uucucagauaagaaaaauguagggagauaugauuauauuguauuauguuaucaggaguauuuug

SEQ ID NO: 357374 - RNA, 64 nt, Homo Sapiens
ucuauucuuugcagcucaagugacaggucacaucauauuguaauccagugcuugucaaauuugc

SEQ ID NO: 357375 - RNA, 51 nt, Homo Sapiens; identical to SEQ ID NO: 75575

SEQ ID NO: 357376 - RNA, 64 nt, Homo Sapiens
cugagggcaaagaaaguccuuagauaaagagagaauauuguaugggccaucaaccauuuacuuu

SEQ ID NO: 357377 - RNA, 64 nt, Homo Sapiens
gcuauuuucauguuugaagcaauacuuuacuaaaauauuguaugaaaguaguaauaaagaauaa

SEQ ID NO: 357378 - RNA, 64 nt, Homo Sapiens
cccaagaagaaauugauuuagauuuucuuccaagauauuguauuauaaagccauaguuuucuug

SEQ ID NO: 357379 - RNA, 64 nt, Homo Sapiens
aaucucacuagccgcagcuuguaaccucaaggagauauuguauggcagaaacaguagaaccugu

SEQ ID NO: 357380 - RNA, 64 nt, Homo Sapiens
auuaucaaaaguauugguuagucaguguuagaggauauuguaguuaccacauaguacuuauuca

SEQ ID NO: 357381 - RNA, 64 nt, Homo Sapiens
auuuccauguuaaugaucuacaacauuaagggccauauuguaaguaggaacaaauaaagacaaa

SEQ ID NO: 357382 - RNA, 64 nt, Homo Sapiens
auagaauuucgaagagacaucaacuucucugucuauauuguaauaaacucaagcccucaaggcc

SEQ ID NO: 357383 - RNA, 64 nt, Homo Sapiens
aauuauuugcaucuuucaguugaaagcuuacgcuauauuguaugaaugacauauaauuuauaua

SEQ ID NO: 357384 - RNA, 64 nt, Homo Sapiens
auuuagacugaugauacuaauaauauuuuaauauauauuguaaacaaugauuuuuuuagcauuu

SEQ ID NO: 357385 - RNA, 64 nt, Homo Sapiens
auguaaauaauaaaagccauucagcauugaugcuauauuguauuauugcacauaaucaugcuau

SEQ ID NO: 357386 - RNA, 64 nt, Homo Sapiens
uggguguaggacucuaguguagggcugcuuuaucauauuguacuguauccagcaccacuugcag

SEQ ID NO: 357387 - RNA, 64 nt, Homo Sapiens
ugugcacaauguacauuaaauuuuuauuuuuuaaauauuguauuauuugaauuuugauuuucua

SEQ ID NO: 357388 - RNA, 64 nt, Homo Sapiens
acuuuugacaaugcucauuagugauuuucucaaaauauuguaaauacagcuuaauaguuuaugc

SEQ ID NO: 357389 - RNA, 64 nt, Homo Sapiens
ccuagcacuuugggaggccauaacauaaaauccaauauuguaauaauaaaggacaggcuggugc

SEQ ID NO: 357390 - RNA, 64 nt, Homo Sapiens
uacuggacucaggaacuuuucugcuagugcuguaauauuguaaagaugaguuguagacacugau

SEQ ID NO: 357391 - RNA, 64 nt, Homo Sapiens
cacaguauucaguuuucucaccucuugcuauuguauauuguagauuuuuuucauucauguguua

SEQ ID NO: 357392 - RNA, 64 nt, Homo Sapiens
aauauaacaaaaaugaauuuuguuugauagauuuauauuguaaccuuuuucuaguucuugaaua

SEQ ID NO: 357393 - RNA, 64 nt, Homo Sapiens
guauagaaaccuccauuuuuauuguagauauuuaauauuguacauaaaaauaaggaaccaugac

SEQ ID NO: 357394 - RNA, 64 nt, Homo Sapiens
gcuuggcagaaaagaaaauaauaauggccagaaaauauuguauucauuaucgcauuaucuuggc

SEQ ID NO: 357395 - RNA, 64 nt, Homo Sapiens
uaucuguagucguuuaauguacaucaaaaugcccauauuguaucuaagucagguacaaauguac

SEQ ID NO: 357396 - RNA, 64 nt, Homo Sapiens
gccuuauagaaucuaagcugaccuuuucagccauauauuguacaaacgugggugcuuguguuug

SEQ ID NO: 357397 - RNA, 64 nt, Homo Sapiens
cauugacaaauaccaagaauuuuugcguauguuuauauuguauuguucuaaauaauggguagcc

SEQ ID NO: 357398 - RNA, 64 nt, Homo Sapiens
auacaucacagccuucucaaacagcucaagcaauauauuguauauugccauaucgucuggugaa

SEQ ID NO: 357399 - RNA, 64 nt, Homo Sapiens
agguuuuuccccaucuccuguagagcgaauuuacauauuguauuggguaaguguucacuacuuu

SEQ ID NO: 357400 - RNA, 64 nt, Homo Sapiens
ucugugcuggggaacaaagcuuuugcaguaccuuauauuguaguuaaaauuuuauuuaacauau

SEQ ID NO: 357401 - RNA, 64 nt, Homo Sapiens
ucuauuacacuggagcuguuuuauagauaagucaauauuguaucaggcaagauaaaccaauguc

SEQ ID NO: 357402 - RNA, 64 nt, Homo Sapiens
uaacauuuccuacguauuuuauuuuacauagaucauauuguauauaguuaguaucuuuauuaau

SEQ ID NO: 357403 - RNA, 64 nt, Homo Sapiens
uaguguuucuguucaaauagagaccugaauucaaauauuguaguuuagguucaaacagaguaug

SEQ ID NO: 357404 - RNA, 64 nt, Homo Sapiens
augcagaggaguuuucaagaggcuaucuggugugauauuguaauaggcugaaugcaaaagcaga

SEQ ID NO: 357405 - RNA, 64 nt, Homo Sapiens
ugugauaaaaauaggugagagaucauaugaucuaauauuguauugauggaaguauagguaguau

SEQ ID NO: 357406 - RNA, 64 nt, Homo Sapiens
uuuuugacagugaacauggucuaaaaaagggaagauauuguagaagauuucacacacacacgcg

SEQ ID NO: 357407 - RNA, 64 nt, Homo Sapiens
aauuuugucaaagauguacuuauugaaagguggaauauuguaaaugccuuuuuaagcuguuuca

SEQ ID NO: 357408 - RNA, 64 nt, Homo Sapiens
cauauacuuuggcuguauugaaguaggcauuuuaauauuguaaagaacaugauuugaugcuaua

SEQ ID NO: 357409 - RNA, 64 nt, Homo Sapiens
aguugaaacucuuauuagaaacuuucaguuggugauauuguauucuagaagauauaaaugagag

SEQ ID NO: 357410 - RNA, 64 nt, Homo Sapiens
aaucucagaaguaguuugcugcuaauauauacauauauuguauaaaaagguauauuuugguuuu

SEQ ID NO: 357411 - RNA, 64 nt, Homo Sapiens
gccuuaauuuguacugucugcggcauuuuuuauaauauuguauauagugacugacaaauauugu

SEQ ID NO: 357412 - RNA, 64 nt, Homo Sapiens
cauuuuuuauaauauuguauauagugacugacaaauauuguauuacuguacauagagagacagg

SEQ ID NO: 357413 - RNA, 64 nt, Homo Sapiens
gauuucauuauuauuacccauacuguugccacucauauuguaagucaguuuuuucauugcuggu

SEQ ID NO: 357414 - RNA, 64 nt, Homo Sapiens
uugcuuuacaggaguuugucauguauugacuuuaauauuguauuuugguaauaaauuuuuuguu

SEQ ID NO: 357415 - RNA, 64 nt, Homo Sapiens
augccuuucuauuucaauuguugguugcuauuccauauuguaggucacuuauuuauaagcccuc

SEQ ID NO: 357416 - RNA, 64 nt, Homo Sapiens
gauuucagacucucuuaugaaaacauagauguauauauuguauaagaauauuauuuucacauug

SEQ ID NO: 357417 - RNA, 64 nt, Homo Sapiens
cuguaaauuuauucagcugccauaauauucucuaauauuguauaaguaagaugagcaauugcaa

SEQ ID NO: 357418 - RNA, 64 nt, Homo Sapiens
gaugcuucugugaauuugaagaaaaaugaugaacauauuguaauuuuuaaaaaauuagagugaa

SEQ ID NO: 357419 - RNA, 64 nt, Homo Sapiens
uuauuuauggcuaccuauguguuuguaagcagguauauuguauauuaguguauuaguaauacua

SEQ ID NO: 357420 - RNA, 64 nt, Homo Sapiens
uuaguacuauuccuguuguaaaguuagauuuugcauauuguaucuaucaaaauauguuuggguu

SEQ ID NO: 357421 - RNA, 64 nt, Homo Sapiens
gugcagauaacaaaacugcucccuuuacuuaauuauauuguaguucuauauaaaguuacuuuuc

SEQ ID NO: 357422 - RNA, 64 nt, Homo Sapiens
aaccuaaaacgcagagaagugaguguugcaguguauauuguaaccaaaacguguuaucaauaua

SEQ ID NO: 357423 - RNA, 64 nt, Homo Sapiens
aaggcagaaaccaagaacugucugcaggcaaauaagcacccagcacccauccuggcugccggug

SEQ ID NO: 357424 - RNA, 64 nt, Homo Sapiens
aaaccaagaacugucugcaggcaaauaagcacccagcacccauccuggcugccggugccccgua

SEQ ID NO: 357425 - RNA, 64 nt, Homo Sapiens
ugagcagggaacucagugugacaccgccagguccagcacccaugggggcgggggagaggcucac

SEQ ID NO: 357426 - RNA, 64 nt, Homo Sapiens
ccuaggaucagggaccagaggauccuaucuucucagcacccagcccaccccuuccuguagcaua

SEQ ID NO: 357427 - RNA, 64 nt, Homo Sapiens
gacaaugcaaaaauggucuucaaagcacauaaaaagcacccagggugagaaagccccaucccgg

SEQ ID NO: 357428 - RNA, 64 nt, Homo Sapiens
uuaaguugcuuaagagaggaaaaaggagggaaguagcacccaaagaugaauuaguugcugucac

SEQ ID NO: 357429 - RNA, 64 nt, Homo Sapiens
uugucuccucagguagugauagucuugcuucugcagcacccacugacaaaucccacuggccuac

SEQ ID NO: 357430 - RNA, 64 nt, Homo Sapiens
ggguaccaggcaggcucccuuccuggggaaaagaagcacccagaccccgcgccccgcugaucuu

SEQ ID NO: 357431 - RNA, 64 nt, Homo Sapiens
ucucagacguuccauacccccacaugccaauuucagcacccaacugagauccgaggagcuccug

SEQ ID NO: 357432 - RNA, 64 nt, Homo Sapiens
gcaauacucuguggaggucugguggggcugggggagcacccaggcggaucugcaagcaccucgg

SEQ ID NO: 357433 - RNA, 64 nt, Homo Sapiens
ggggagcacccaggcggaucugcaagcaccucggagcacccaccgcugggucugcggccuaagg

SEQ ID NO: 357434 - RNA, 64 nt, Homo Sapiens
gcccaccugugcucaggaugcagcccugggauccagcacccauggaagcuucugcugggauggu

SEQ ID NO: 357435 - RNA, 64 nt, Homo Sapiens
gggagcucugcucugagcuugccacacugcugagagcacccacuguccugaccagagucucagu

SEQ ID NO: 357436 - RNA, 64 nt, Homo Sapiens
gggcaugagguggucaccaggauugagcuuccucagcacccaguggguaauacuugcuuccacu

SEQ ID NO: 357437 - RNA, 64 nt, Homo Sapiens
cuccugccucagccucccuaguagcugggacuacagcacccaccaccacacccagcuaauuuuu

SEQ ID NO: 357438 - RNA, 64 nt, Homo Sapiens
aggggcagaaccugaguugagguccugcucccucagcacccaaaaaacccaagggaggaguccu

SEQ ID NO: 357439 - RNA, 64 nt, Homo Sapiens
ccucagcugcucucuuagguaaagcccccucaggagcacccaguugugucgcuucucacuccuc

SEQ ID NO: 357440 - RNA, 64 nt, Homo Sapiens
ggcuccaccagcccagcucucagcaccaucaggcagcacccauggcacaugagcacccacccca

SEQ ID NO: 357441 - RNA, 64 nt, Homo Sapiens
ccacagcaccaucaggcagcggacuuggcacaugagcacccacccaggucuccacugccaagca

SEQ ID NO: 357442 - RNA, 64 nt, Homo Sapiens
uguguuucacucaccccuuaggagggcccugcaaagcacccaaguccagcccaggcacggaaug

SEQ ID NO: 357443 - RNA, 64 nt, Homo Sapiens
accacagaaaagagaaaggacccguggggccaggagcacccaaggccaacugaccaucuaccug

SEQ ID NO: 357444 - RNA, 64 nt, Homo Sapiens
gccaagcaguuuucugggacaacagaaugacucagaccaagauggauaggaugguuagggcuuu

SEQ ID NO: 357445 - RNA, 64 nt, Homo Sapiens
ugggugggucccacacuugugaccucaguuuuaggaccaagaucuguguugguuucuuagauug

SEQ ID NO: 357446 - RNA, 64 nt, Homo Sapiens
aggaagaagaccaaggcccaacagaauuaaaaaggaccaagaaguggcuuggcucuugacgugg

SEQ ID NO: 357447 - RNA, 64 nt, Homo Sapiens
caucaugccccagguaacuuaagaaguggaagaagaccaagaccugcagaaauugaaaaguacc

SEQ ID NO: 357448 - RNA, 64 nt, Homo Sapiens
aggaggggggaaggcuggguggagagggaagcaagaccaagauggcagcagcaacaggcuggag

SEQ ID NO: 357449 - RNA, 64 nt, Homo Sapiens
ccugaggacacaucuuggcaguccaucaucagcugaccaagacacuuagccuccugugcugcgu

SEQ ID NO: 357450 - RNA, 64 nt, Homo Sapiens
gcgccgagccgccgggacucaccccaccgacccagaccaagaccgccgcgggucucccggccca

SEQ ID NO: 357451 - RNA, 64 nt, Homo Sapiens
auacauuuauuauuugcuaaucaugccauuuccagaccaagaaagaaaucugaaaggagugugc

SEQ ID NO: 357452 - RNA, 54 nt, Homo Sapiens
cagaagaugaugaauugugaucaggaccaagaucccugugguaaacacucugau

SEQ ID NO: 357453 - RNA, 64 nt, Homo Sapiens
ugcucuccuucugagucaggacauguguacaggagaccaagaacaaugaguauuagaaaaaaag

SEQ ID NO: 357454 - RNA, 64 nt, Homo Sapiens
gcucagugaaggucccgcagaagaccaagagagugaccaagaagucaucuccuaugugaugcug

SEQ ID NO: 357455 - RNA, 64 nt, Homo Sapiens
gugaccaagaaggcucaguguaugugaugcugaagaccaagagaucccaggacuguucaucucc

SEQ ID NO: 357456 - RNA, 64 nt, Homo Sapiens
uuuuuuaucuagagaccagcauguucuccccaaagaccaagauauucugccaaaauaucaggac

SEQ ID NO: 357457 - RNA, 64 nt, Homo Sapiens
cuccaacgaccagaauauucuacccaaaugucaggaccaagauuuucuaccaaaauaucaggua

SEQ ID NO: 357458 - RNA, 64 nt, Homo Sapiens
ggacuaucaucaauauguuguaccuaaaauccaggaccaagacuccccuagagaacagguagaa

SEQ ID NO: 357459 - RNA, 64 nt, Homo Sapiens
gguuguauacauuucugcagcucaugccagcugagaccaagagugagagguggguggcgggcac

SEQ ID NO: 357460 - RNA, 64 nt, Homo Sapiens
aacuuuuuggugcaucuaauguuggcacuguagggaccaagauuuaagcacuggggacugccag

SEQ ID NO: 357461 - RNA, 64 nt, Homo Sapiens
agaaccaagcggugccagccacgagacgucaccaagaaaacaugcaacucaaacgacggaaaaa

SEQ ID NO: 357462 - RNA, 64 nt, Homo Sapiens
ucaaacgacggaaaaaaaaagggaaugggaaaaaagaaaacagauccugggagggggcgggaaa

SEQ ID NO: 357463 - RNA, 64 nt, Homo Sapiens
gguuaugggagggcaugagggaacacuucuuaugagaaaacauuuauaaacaaaagaaacauuu

SEQ ID NO: 357464 - RNA, 64 nt, Homo Sapiens
uugcagaugacuugcuuacuguauuugcauuguuagaaaacaguuuguagacaaugauucuuuu

SEQ ID NO: 357465 - RNA, 64 nt, Homo Sapiens
aaacuacuagacaaaaaagugagaggauagauuuagaaaacaucagugaugcucagauaaacuu

SEQ ID NO: 357466 - RNA, 64 nt, Homo Sapiens
ccauacaucugcuacuuugggaggcccuuuacauagaaaacagcauucuuuuugccaaauauga

SEQ ID NO: 357467 - RNA, 64 nt, Homo Sapiens
aucuguuauaauuuaauauucaaaucuggaauuaagaaaacauauuuucuaguauccucuaagg

SEQ ID NO: 357468 - RNA, 64 nt, Homo Sapiens
ucucuccugaucagugccauucccacgguuucaaagaaaacagcuacaaggaaugcuuaccuga

SEQ ID NO: 357469 - RNA, 64 nt, Homo Sapiens
aaucugcaucucagccugagucgcuuccaguuuuagaaaacagaaccuucaauacacgucaagg

SEQ ID NO: 357470 - RNA, 64 nt, Homo Sapiens
cccaucaggcuuguguuaagucguuuauauugugagaaaacagcuaggccagaagacacuuuau

SEQ ID NO: 357471 - RNA, 64 nt, Homo Sapiens
aagugcuguaaauauguaauuaaauaugguuuucagaaaacaucuguaaauguaauaaaaugua

SEQ ID NO: 357472 - RNA, 64 nt, Homo Sapiens
agccugcaaagguaaagacacccuuugacagaugagaaaacagaaaauguaggauuuguuauuc

SEQ ID NO: 357473 - RNA, 64 nt, Homo Sapiens
ucaacagccuuuuuagaaauacacuuuuagaucaagaaaacacugcauugaguuaaugaaacag

SEQ ID NO: 357474 - RNA, 64 nt, Homo Sapiens
caaauuauacuugcacuaugcacugauaaguuagagaaaacacccuagaaaacaggaugccugu

SEQ ID NO: 357475 - RNA, 64 nt, Homo Sapiens
augccugucacugauaaguuagauauuauuuccuagaaaacaggcaguuuuuccuauaucauuu

SEQ ID NO: 357476 - RNA, 64 nt, Homo Sapiens
aaaagaaaaauauauauucauucuuuggugcuguagaaaacaaaucuccuuuuccuauuugaau

SEQ ID NO: 357477 - RNA, 64 nt, Homo Sapiens
gcugcauauacagguaccauaauaaggaugguauagaaaacaacugugccacaugcaaguuuug

SEQ ID NO: 357478 - RNA, 64 nt, Homo Sapiens
uucuaaaaaugcuuuuauucgcuucugaaggugcagaaaacaauagguuacaaggaguguugua

SEQ ID NO: 357479 - RNA, 64 nt, Homo Sapiens
ugcagagccagguuuugcugaccuggggagcuguagaaaacacuacuggucauaggcucuaguc

SEQ ID NO: 357480 - RNA, 64 nt, Homo Sapiens
gcaugugcaaagcaagcaaggaacauuugggguaagaaaacaaacaugaggcaaaagaaaaaau

SEQ ID NO: 357481 - RNA, 64 nt, Homo Sapiens
aaacaugaggcaaaagaaaaaauacauguuuuuaagaaaacauugagcagagaacugcagccag

SEQ ID NO: 357482 - RNA, 64 nt, Homo Sapiens
cucagcagacauucacucuggcugcugggacaucagaaaacaaagucuucaucucucucuccag

SEQ ID NO: 357483 - RNA, 64 nt, Homo Sapiens
uaacuggccgccccacuuuccggcauaacuuuuuagaaaacagaaaugcccuugaugguggaaa

SEQ ID NO: 357484 - RNA, 64 nt, Homo Sapiens
uuagaaaacagaaaugcccuugaugguggaaaaaagaaaacaaccacccccccacugcccaaaa

SEQ ID NO: 357485 - RNA, 64 nt, Homo Sapiens
gugacgaggaagguucuguuuugaguauagccagagaaaacaaggauggagaaaaaucuaggac

SEQ ID NO: 357486 - RNA, 64 nt, Homo Sapiens
gugacgaggaagauucuguuuuggguauagccagagaaaacaaggauggagaaaaaucuaggac

SEQ ID NO: 357487 - RNA, 64 nt, Homo Sapiens
uauuaauggcauguaauauucugagcacgggcaaagaaaacacacaaaagauuauguauuggca

SEQ ID NO: 357488 - RNA, 64 nt, Homo Sapiens
cugggaaggcaacaccuguggauaaaacauuagaagaaaacauauauuuuauuuucauacuuuu

SEQ ID NO: 357489 - RNA, 64 nt, Homo Sapiens
cauguacuuagugacuugacugagaaguuaggguagaaaacaaaaagggaguggauucugggag

SEQ ID NO: 357490 - RNA, 64 nt, Homo Sapiens
aaugcuuucauaguuucagauaugguaguuaugaagaaaacaaugucauuugcugcuauuauug

SEQ ID NO: 357491 - RNA, 64 nt, Homo Sapiens
cguguaaggugaugugcacauaucaagaagucagagaaaacacuuuccuggauaaaaaagaaaa

SEQ ID NO: 357492 - RNA, 64 nt, Homo Sapiens
ucuuuuuucuagaaaacacuuuccuggauaaaaaagaaaacauuccagaugcaugauccagcug

SEQ ID NO: 357493 - RNA, 64 nt, Homo Sapiens
ucaucugauuuaguuagcauauacagaauuuuaaagaaaacauuuccuagaaauucuuaaauau

SEQ ID NO: 357494 - RNA, 64 nt, Homo Sapiens
uauuuuuuauuugauuccuauuccccuucagugaagaaaacauuucuauugggauauaaaagcc

SEQ ID NO: 357495 - RNA, 64 nt, Homo Sapiens
auaaaaagauacccauugccugauacaaacuuuaagaaaacaggugcuaucuguuauagacuag

SEQ ID NO: 357496 - RNA, 64 nt, Homo Sapiens
acuggacagaaacaggaaugagagggaccuuuaaagaaaacaaaucugcacccgggugggggac

SEQ ID NO: 357497 - RNA, 64 nt, Homo Sapiens
uaucaaagaucuaauaauacuugacacgaggcacagaaaacaaaggccgagcugccgaauucag

SEQ ID NO: 357498 - RNA, 64 nt, Homo Sapiens
uucaaagacaacaugcuuuggaaacauauguccuagaaaacauaaaauuaaaaaaaaacacuau

SEQ ID NO: 357499 - RNA, 64 nt, Homo Sapiens
aaaaaucccauuuacaagcauugcaccuuuaagaagaaaacaaauaugacaguaugguagcuau

SEQ ID NO: 357500 - RNA, 64 nt, Homo Sapiens
aaaaccucuaugcaaucugaaacaaacagaaaacagaaaacaaacaaaaaaucugaccaaaaca

SEQ ID NO: 357501 - RNA, 64 nt, Homo Sapiens
aaacaaaaaaaccucuaugccaaaacaaacaaacagaaaacagagauguuucaaaaaaucugac

SEQ ID NO: 357502 - RNA, 64 nt, Homo Sapiens
gcuuagaugacuucugcaggauuuauauucagauagaaaacaucaaauauuuucaggggagagg

SEQ ID NO: 357503 - RNA, 64 nt, Homo Sapiens
uuucacccuguugggguaaauguuuuaaagagugagaaaacauaaauugagaaagggugauaaa

SEQ ID NO: 357504 - RNA, 64 nt, Homo Sapiens
uaaagggggaauauauggggcuguaugucuuauaagaaaacauguaguuuguuaauugauuaaa

SEQ ID NO: 357505 - RNA, 64 nt, Homo Sapiens
aagggagagaauccaagccugacacacaacaucaagaaaacagccacacacacacacaaaugca

SEQ ID NO: 357506 - RNA, 64 nt, Homo Sapiens
ucaacuuuaaaauauaguuuaaucaauuuucagcagaaaacauguaggagguuuguaaaagaag

SEQ ID NO: 357507 - RNA, 64 nt, Homo Sapiens
aaguaggauacuuacaauccugcaugguggauccagaaaacaaauuuuugaagaccaaauguga

SEQ ID NO: 357508 - RNA, 64 nt, Homo Sapiens
augugggaaaugauuuaauuuaggcucuguuuuaagaaaacaauuggugcugaauauguccuug

SEQ ID NO: 357509 - RNA, 64 nt, Homo Sapiens
gaagacaauucauguuugacauaaguggccuuuaagaaaacaugcaaaacaaauaggcuuuucc

SEQ ID NO: 357510 - RNA, 64 nt, Homo Sapiens
uauuuuauauucagcauaaaggagaauaaauuccagaaaacacauauucugaaaauggaguguu

SEQ ID NO: 357511 - RNA, 64 nt, Homo Sapiens
uauuaccuuuguagcagccacaucagaaagcagaagaaaacaguauuucugaaggcauuguuug

SEQ ID NO: 357512 - RNA, 64 nt, Homo Sapiens
uaaaccucacucacacauuuuauagaucagaaucagaaaacaggcuuuugagaccacccauuuu

SEQ ID NO: 357513 - RNA, 64 nt, Homo Sapiens
cuuccauagauuuuuaaggaaaauuuaaaaagaaagaaaacagucucugcugccauaaucacac

SEQ ID NO: 357514 - RNA, 64 nt, Homo Sapiens
uggacuuaagaguuucugcuguuuaguuauccugagaaaacaucuauauaggugauuuuaccag

SEQ ID NO: 357515 - RNA, 64 nt, Homo Sapiens
aggaaagaggaacccuggguuccagcuagaggggagaaaacaccaucacucucauaauaugcuu

SEQ ID NO: 357516 - RNA, 64 nt, Homo Sapiens
uugauguguuggugauaggcuuucaauguaaaacagaaaacauauucucuguauucucauauaa

SEQ ID NO: 357517 - RNA, 64 nt, Homo Sapiens
agaacuaucauaaaauuuacuaaaaacuacggguagaaaacauaaaucuuuuacgcagaagaaa

SEQ ID NO: 357518 - RNA, 64 nt, Homo Sapiens
uuacuuucuaauuaaaauuuacaaagacauuaaaagaaaacaaucauucaaaacagucucagua

SEQ ID NO: 357519 - RNA, 64 nt, Homo Sapiens
guaauugcuacucagcaaauuggaaaacuaaugaagaaaacacucauaauuacauuaccagugu

SEQ ID NO: 357520 - RNA, 64 nt, Homo Sapiens
uugauaugcuucaauuuugugagcuauguuuuagagaaaacaauguuuucuacuauuccuuucu

SEQ ID NO: 357521 - RNA, 64 nt, Homo Sapiens
cacaugcuuuuggugcuuauuguaauucaacugaagaaaacacaacucuagguuuauagaguga

SEQ ID NO: 357522 - RNA, 64 nt, Homo Sapiens
aaggaauuauuuacugauugguuuuaaagagagcagaaaacacccaaguguagaaugucuacug

SEQ ID NO: 357523 - RNA, 64 nt, Homo Sapiens
ugauuuaaaguauacuuaaauuaggauuucuuaaagaaaacauagggagaaaacuuuacaugca

SEQ ID NO: 357524 - RNA, 64 nt, Homo Sapiens
auucugaauaucuucaaauuuugcucaaguugauagaaaacaaaaaggugcaaagcgaaacugg

SEQ ID NO: 357525 - RNA, 64 nt, Homo Sapiens
ucuuccugauugacaacaguugauuuaauuaacaagaaaacauuaaauauuagcuguaugaaua

SEQ ID NO: 357526 - RNA, 64 nt, Homo Sapiens
aacguggcaucauuugggaauaguuuuaagaggaagaaaacagauaugucucuaggacauuuua

SEQ ID NO: 357527 - RNA, 64 nt, Homo Sapiens
uugagauacuuaaagaaauuaaaaagauuucuccagaaaacacuaucaaguauaaugauguagu

SEQ ID NO: 357528 - RNA, 64 nt, Homo Sapiens
uauggugaggucacuuuaauuguguaucugagugagaaaacaaggauguguugaugaaauaaaa

SEQ ID NO: 357529 - RNA, 64 nt, Homo Sapiens
ccuacgugaucauguggccaaacuauuaccacccagaaaacagucaacuaagcuuuuaaaaauc

SEQ ID NO: 357530 - RNA, 64 nt, Homo Sapiens
cuaaauguaguugucacacuguucaaucuguguaagaaaacaaaaaacugucauaauggugaau

SEQ ID NO: 357531 - RNA, 64 nt, Homo Sapiens
augaggagacauucugucuuaugucuagaaaguaagaaaacaaugugauggcaaggugcuuguu

SEQ ID NO: 357532 - RNA, 64 nt, Homo Sapiens
uuggaauugguuaaccuuaugucacauuuuucuuagaaaacauuaaauagccucccuuuagaau

SEQ ID NO: 357533 - RNA, 64 nt, Homo Sapiens
auauaacacacagagaauuauuugagugaauaggagaaaacaauuauuggauuuugugauuaua

SEQ ID NO: 357534 - RNA, 64 nt, Homo Sapiens
acuuuaucauuuuguuauagagacaugacuaggaagaaaacaugaccccuuuggcuaucuacug

SEQ ID NO: 357535 - RNA, 64 nt, Homo Sapiens
ugcauuaugaaguuccccucccaguucacaggccagaaaacauaccaguacucacccagggacu

SEQ ID NO: 357536 - RNA, 64 nt, Homo Sapiens
gaagagacauaccccugggcaagcagagggcuacagaaaacaggagcgcucagccuauggguuu

SEQ ID NO: 357537 - RNA, 64 nt, Homo Sapiens
auggaaagauauauaaauauuugcuacacagccuagaaaacaagaggccuuguccaagaagaac

SEQ ID NO: 357538 - RNA, 64 nt, Homo Sapiens
cuuuggugauauuuauuauacccaaaaugcauuuagaaaacaguucuaagagaaugaauuaucc

SEQ ID NO: 357539 - RNA, 64 nt, Homo Sapiens
cauauauauugaaaugcaaacuuucauauuuuuaagaaaacacccauugaucaaauauuucaac

SEQ ID NO: 357540 - RNA, 64 nt, Homo Sapiens
ucuggaggcagcagugcuggggguggagagagccagaaaacagagauccgagggcagcagugcu

SEQ ID NO: 357541 - RNA, 64 nt, Homo Sapiens
gauccgagggcagcagugcugcgaggagagagccagaaaacauagcuaaauuaauuggaguggg

SEQ ID NO: 357542 - RNA, 64 nt, Homo Sapiens
ccauuugaagagaagaccacuuuuuuuccuagugagaaaacaacuaauuccagagauggaacau

SEQ ID NO: 357543 - RNA, 64 nt, Homo Sapiens
cugggaggauagcgcucauucaguacuugauagaagaaaacaguuucagugcuuaccgaugaug

SEQ ID NO: 357544 - RNA, 64 nt, Homo Sapiens
ugaauugacgcaauauaaaaugcgcugcccccugagaaaacacucagccacagacagcucccga

SEQ ID NO: 357545 - RNA, 64 nt, Homo Sapiens
ugaaaaguagcauauucucuuaugaaauagcaugagaaaacacagggcauuucuaggacaguaa

SEQ ID NO: 357546 - RNA, 64 nt, Homo Sapiens
uucuaggacaguaaaacguuaaaguacuggauuaagaaaacaacaacaggcugggcgcaguggc

SEQ ID NO: 357547 - RNA, 64 nt, Homo Sapiens
ucuauaaguccaggguuaauugugcauuauuaugagaaaacaguaguagucauuuagcaguaga

SEQ ID NO: 357548 - RNA, 64 nt, Homo Sapiens
uuugagaguagucauuuagcuuugaacaugaaaaagaaaacaacaggaaagaaauguaauuuuc

SEQ ID NO: 357549 - RNA, 64 nt, Homo Sapiens
uggagacccccacucugucuauuugagggagaagagaaaacagaacacgaugaaaacagccugu

SEQ ID NO: 357550 - RNA, 64 nt, Homo Sapiens
gauacuacuggaacuuccccaguuuggacuuuuaagaaaacaugaauugucacauacauuuuac

SEQ ID NO: 357551 - RNA, 64 nt, Homo Sapiens
caagcugggauuugaacccagauuagaacugcacagaaaacagcacaaguuuguggcagaacug

SEQ ID NO: 357552 - RNA, 64 nt, Homo Sapiens
gaaauaaagcaguuacaaauggagacagcuaagaagaaaacaaaaauuauacaaagagaauugg

SEQ ID NO: 357553 - RNA, 64 nt, Homo Sapiens
guuugacuacuuuguucuuugguuaagauccaaaagaaaacagaaaacaauuccacgaggccaa

SEQ ID NO: 357554 - RNA, 64 nt, Homo Sapiens
uacuuuguucuuugguuaagauccaaaagaaaacagaaaacaauuccacgaggccaaucuaaag

SEQ ID NO: 357555 - RNA, 64 nt, Homo Sapiens
aaaagcugcaagggugcaaagggccugugccagaagaaaacacacacagggaaaccgcuuuuuu

SEQ ID NO: 357556 - RNA, 64 nt, Homo Sapiens
acauccagaaaacuuuaacauucuucaaagaaauagaaaacacaauccuaaaauuuauauggga

SEQ ID NO: 357557 - RNA, 64 nt, Homo Sapiens
uaaaucuaagaccucaaacuaugaaacagcuaaaagaaaacaucggggaaucucuccaggacau

SEQ ID NO: 357558 - RNA, 64 nt, Homo Sapiens
uucuuuguucuuucagugaagagaaaggaaguacagaaaacaugcagaaagcacagaaaggaaa

SEQ ID NO: 357559 - RNA, 64 nt, Homo Sapiens
cauauuauacaauauuucaauugugaauucacauagaaaacauuaaauuauaauguuugacuau

SEQ ID NO: 357560 - RNA, 64 nt, Homo Sapiens
gaguucccucuguauagccucugggacaagaaaaagaaaacacaagaauguauacacuggaaga

SEQ ID NO: 357561 - RNA, 64 nt, Homo Sapiens
ccgugaucaagguagcuuaagagagauggucaggagaaaacacuguuuuuguuuuuuuuguugu

SEQ ID NO: 357562 - RNA, 64 nt, Homo Sapiens
cuagacguucaaguuugcaaaucaguuuuuagcaagaaaacauuuuugcuauacaaacauuuug

SEQ ID NO: 357563 - RNA, 64 nt, Homo Sapiens
aauuuuauaugcagagagaaaaaguuaccgagacagaaaacaaaucuaagggaaaggaauauua

SEQ ID NO: 357564 - RNA, 64 nt, Homo Sapiens
acagugugcuacauuuacaaaaaauuucuccuuaagaaaacagaauauucaaaaacagcacuuu

SEQ ID NO: 357565 - RNA, 64 nt, Homo Sapiens
gagagacugaauuguuaguaggucuaaacaucaaagaaaacauuuuuauuaguuacuuauggaa

SEQ ID NO: 357566 - RNA, 64 nt, Homo Sapiens
agugaugaaucaaaauuagaaauuaagaguuuuaagaaaacauguggccuuuuauuaauaacac

SEQ ID NO: 357567 - RNA, 64 nt, Homo Sapiens
aagagcccaacucuacuaaaaauacaaaaagaaaagaaaacagccaagcuuggugguaugugcc

SEQ ID NO: 357568 - RNA, 64 nt, Homo Sapiens
aaaaaauaaccccaaaaugauuuuuuuuuagaacagaaaacaacauaagcauggagaacaguga

SEQ ID NO: 357569 - RNA, 64 nt, Homo Sapiens
aaaaaaacacacacacacacaacuguccucuuucagaaaacagauuaauugugaauugauaaua

SEQ ID NO: 357570 - RNA, 64 nt, Homo Sapiens
uuuuuuuuuuuuuucugguguuggagucuuauuuagaaaacaggauaaaugacgcuguuaucaa

SEQ ID NO: 357571 - RNA, 64 nt, Homo Sapiens
aauauaaaagguauagguuuuuuuuuuuuuuuaaagaaaacaauaaacuuucaaagagaaaacc

SEQ ID NO: 357572 - RNA, 64 nt, Homo Sapiens
guuuguucacuuucaaagaggaugaauuuucagcagaaaacauuuuccccuuaugauugggaaa

SEQ ID NO: 357573 - RNA, 64 nt, Homo Sapiens
uuuccuuggaaggucaacucagucaaaucuugacagaaaacauuuuugugguuuaucuaaggaa

SEQ ID NO: 357574 - RNA, 64 nt, Homo Sapiens
gaggcauacucugauuuuuauuuuuuuuuuugguagaaaacaaauugcagaaauaaaucuuuuu

SEQ ID NO: 357575 - RNA, 64 nt, Homo Sapiens
cuuauuuuaaaaaagaaaaaaaacacaaauaagcagaaaacauacaauauauucaaagaaaaga

SEQ ID NO: 357576 - RNA, 64 nt, Homo Sapiens
aauaagcagaaaacauacuuuauauucaaagaaaagaaaacacaaauaauaaaauauugugcaa

SEQ ID NO: 357577 - RNA, 64 nt, Homo Sapiens
aauggcaaugacuuauauucaucaugagauguaaagaaaacaauuguguuuaauauugaagugg

SEQ ID NO: 357578 - RNA, 64 nt, Homo Sapiens
cuaauucugauugugucgugauacucugaauuuuagaaaacaaaugcuacuuuuaaaaucccag

SEQ ID NO: 357579 - RNA, 64 nt, Homo Sapiens
cuuccugcaccaacaccaauuugcuguuaacacuagaaaacacauuuauuuccaggucacagaa

SEQ ID NO: 357580 - RNA, 64 nt, Homo Sapiens
auagcccccuacccuuuuccgcuugcuuuuagagagaaaacaauuugugguuuuuauuuugaac

SEQ ID NO: 357581 - RNA, 64 nt, Homo Sapiens
uaaagcaguauuaaaauuugauuguuucacaaacagaaaacaugugguuauaaauguaauacga

SEQ ID NO: 357582 - RNA, 64 nt, Homo Sapiens
uaaaaugaucauuaggacauuaccuuuuugaaaaagaaaacacuugucuuucuuuuuggacauu

SEQ ID NO: 357583 - RNA, 64 nt, Homo Sapiens
uacugaggugugcuucaagggagcauuauagggcagaaaacaaauuaaaaugaaauguuguugu

SEQ ID NO: 357584 - RNA, 64 nt, Homo Sapiens
gggcggguggauagcuuuuuguucuaucuuguacagaaaacaguaauggaaucacucauguuca

SEQ ID NO: 357585 - RNA, 64 nt, Homo Sapiens
uuuuuuuaaagccucauucuuguaacaaaaagaaagaaaacaacggugauuggaaauuuuuagc

SEQ ID NO: 357586 - RNA, 64 nt, Homo Sapiens
gauuuuauaauauuuaacccgcucuguauugaccagaaaacaauauuauuuuuauuuucucccu

SEQ ID NO: 357587 - RNA, 64 nt, Homo Sapiens
cuguccuacuaaucaaagcuuguaucuugcauucagaaaacaaauagagaaacagauucaugcu

SEQ ID NO: 357588 - RNA, 64 nt, Homo Sapiens
aaacuuauacaggaaaaaugaauaguaggaaacaagaaaacauuagaguuaguagaucaaacag

SEQ ID NO: 357589 - RNA, 64 nt, Homo Sapiens
gcuuaauucuagauacuuuugagacaacaccuucagaaaacacauaauuuaaucuuugccaucc

SEQ ID NO: 357590 - RNA, 64 nt, Homo Sapiens
gacuuaccauuccagcugcaugggaaagcaaagcagaaaacagugccccaaauggaaaaaagau

SEQ ID NO: 357591 - RNA, 64 nt, Homo Sapiens
ucuuaaaacagugugugccagaguacgugcuuugagaaaacauuuaacuuuccuucccuccauu

SEQ ID NO: 357592 - RNA, 64 nt, Homo Sapiens
acgaacucugguugggguacaagugggagaaauuagaaaacaaacagaagccagaggauggacu

SEQ ID NO: 357593 - RNA, 64 nt, Homo Sapiens
uaugcuguuaauuguguaagaaagaaaggaaauuagaaaacauauuugcauaaauaaaagcuag

SEQ ID NO: 357594 - RNA, 64 nt, Homo Sapiens
ugaaaaaaaacaaaaguaaaguuauaaaaggaaaagaaaacagaggcuuuaaauuaaaucaucu

SEQ ID NO: 357595 - RNA, 64 nt, Homo Sapiens
aagaagugaucuuuagcuaauaaagaaagagaauagaaaacacgcaugagauauucagaaaaua

SEQ ID NO: 357596 - RNA, 64 nt, Homo Sapiens
aaacugauuuuagcucauguauauuuuauaugaaagaaaacacccuuaugaauugaugacuaua

SEQ ID NO: 357597 - RNA, 64 nt, Homo Sapiens
cuugaauuuucauucaucuucacucagguuggcaagaaaacauaucggugucauucugagugaa

SEQ ID NO: 357598 - RNA, 64 nt, Homo Sapiens
ugcccccagaaggggccaguccaaaccaaaaagaagaaaacagacuuugggggaggguggauau

SEQ ID NO: 357599 - RNA, 64 nt, Homo Sapiens
caggugcagugucaguuucaaaucaaauuaucuaagaaaacaagaaaacaaaggcagcagacua

SEQ ID NO: 357600 - RNA, 64 nt, Homo Sapiens
gugucaguuucaaaucaaauuaucuaagaaaacaagaaaacaaaggcagcagacuauugguaca

SEQ ID NO: 357601 - RNA, 64 nt, Homo Sapiens
ucuucuauuuugaagacuauuuauuguaauaauuagaaaacaugaaauagggaacuccagacug

SEQ ID NO: 357602 - RNA, 64 nt, Homo Sapiens
caguaccuucuuauuacaaguuaauuuucuacauagaaaacauguaauucuccuuuuaauguau

SEQ ID NO: 357603 - RNA, 64 nt, Homo Sapiens
gaaaagcuuguauauacuuugcuaaauuaaaaacagaaaacaaauuacucaucacauccccgau

SEQ ID NO: 357604 - RNA, 64 nt, Homo Sapiens
ucugaaagugguagaaggucacaguuguaggggcagaaaacaacacuuguaaugguguuaggga

SEQ ID NO: 357605 - RNA, 64 nt, Homo Sapiens
acuugaggucucaucaauuacaaaaguucaagagagaaaacagcccuauggacuguuuacuauc

SEQ ID NO: 357606 - RNA, 64 nt, Homo Sapiens
accaaagcugauuggaaacacauguaaauugcagagaaaacaaagaauagauagaugguguuug

SEQ ID NO: 357607 - RNA, 64 nt, Homo Sapiens
gcaugcgcuuguuggcaaaaucuccucaaaggaaagaaaacaggccccgggacuccagaauuuc

SEQ ID NO: 357608 - RNA, 64 nt, Homo Sapiens
uuaucacuugguuuucuggaaaguagcuuacccuagaaaacagcugcaaaugccagaaagauga

SEQ ID NO: 357609 - RNA, 64 nt, Homo Sapiens
gguuuucagugaacaagcgcugagcaccagcagcagaaaacaacaacaaaaaaacaccucguuu

SEQ ID NO: 357610 - RNA, 64 nt, Homo Sapiens
ucuccccugccccacugcuggaacagaggcuccaagaaaacagggaccuuauuauucauuacug

SEQ ID NO: 357611 - RNA, 64 nt, Homo Sapiens
ccuuauucagaaacuuuucgaguacuuauacuuuagaaaacaguagacaguaguagccauaaaa

SEQ ID NO: 357612 - RNA, 64 nt, Homo Sapiens
ggguacuugcuuuuggcagguaacgccaugcaauagaaaacagucacuggacuuuacagaaaga

SEQ ID NO: 357613 - RNA, 64 nt, Homo Sapiens
ggccacacuuucugggaaauuuaaacugaguagcagaaaacagaaucuauccuugaugaugugu

SEQ ID NO: 357614 - RNA, 64 nt, Homo Sapiens
uuucugguuuauaaucuccugaaacuugguucccagaaaacacaaaaacuuaucugagucacuu

SEQ ID NO: 357615 - RNA, 64 nt, Homo Sapiens
gacuguggcucuugccuuaucaagaccauuucacagaaaacauugauuucuuaaugcuauuugc

SEQ ID NO: 357616 - RNA, 64 nt, Homo Sapiens
uggcaggauucuaaagagagccugguuuguuaaaagaaaacacugucaugcugucaguucccaa

SEQ ID NO: 357617 - RNA, 64 nt, Homo Sapiens
caggauguacaaagaacucucaaaccggauaguaagaaaacaaacagcccaagugaaaagcagg

SEQ ID NO: 357618 - RNA, 64 nt, Homo Sapiens
guuaucauuuuuuccuguuuggaaguuaaagggaagaaaacacuauuaacuuggaugaguuuug

SEQ ID NO: 357619 - RNA, 64 nt, Homo Sapiens
accaaaaguuauuaaaauugaagauagaguaaaaagaaaacaaaauguaagguauaucauucua

SEQ ID NO: 357620 - RNA, 64 nt, Homo Sapiens; identical to SEQ ID NO: 276116

SEQ ID NO: 357621 - RNA, 64 nt, Homo Sapiens; identical to SEQ ID NO: 276117

SEQ ID NO: 357622 - RNA, 64 nt, Homo Sapiens; identical to SEQ ID NO: 276118

SEQ ID NO: 357623 - RNA, 64 nt, Homo Sapiens; identical to SEQ ID NO: 276119

SEQ ID NO: 357624 - RNA, 64 nt, Homo Sapiens; identical to SEQ ID NO: 276120

SEQ ID NO: 357625 - RNA, 64 nt, Homo Sapiens; identical to SEQ ID NO: 276121

SEQ ID NO: 357626 - RNA, 64 nt, Homo Sapiens; identical to SEQ ID NO: 276122

SEQ ID NO: 357627 - RNA, 64 nt, Homo Sapiens; identical to SEQ ID NO: 276123

SEQ ID NO: 357628 - RNA, 64 nt, Homo Sapiens; identical to SEQ ID NO: 276124

SEQ ID NO: 357629 - RNA, 64 nt, Homo Sapiens; identical to SEQ ID NO: 276125

SEQ ID NO: 357630 - RNA, 64 nt, Homo Sapiens; identical to SEQ ID NO: 276126

SEQ ID NO: 357631 - RNA, 64 nt, Homo Sapiens; identical to SEQ ID NO: 276127

SEQ ID NO: 357632 - RNA, 64 nt, Homo Sapiens; identical to SEQ ID NO: 276128

SEQ ID NO: 357633 - RNA, 64 nt, Homo Sapiens; identical to SEQ ID NO: 276129

SEQ ID NO: 357634 - RNA, 64 nt, Homo Sapiens; identical to SEQ ID NO: 276130

SEQ ID NO: 357635 - RNA, 64 nt, Homo Sapiens; identical to SEQ ID NO: 276131

SEQ ID NO: 357636 - RNA, 64 nt, Homo Sapiens; identical to SEQ ID NO: 276132

SEQ ID NO: 357637 - RNA, 64 nt, Homo Sapiens; identical to SEQ ID NO: 276133

SEQ ID NO: 357638 - RNA, 64 nt, Homo Sapiens; identical to SEQ ID NO: 276134

SEQ ID NO: 357639 - RNA, 64 nt, Homo Sapiens; identical to SEQ ID NO: 276135

SEQ ID NO: 357640 - RNA, 64 nt, Homo Sapiens; identical to SEQ ID NO: 276136

SEQ ID NO: 357641 - RNA, 64 nt, Homo Sapiens; identical to SEQ ID NO: 276137

SEQ ID NO: 357642 - RNA, 64 nt, Homo Sapiens; identical to SEQ ID NO: 276138

SEQ ID NO: 357643 - RNA, 64 nt, Homo Sapiens; identical to SEQ ID NO: 276139

SEQ ID NO: 357644 - RNA, 64 nt, Homo Sapiens; identical to SEQ ID NO: 276140

SEQ ID NO: 357645 - RNA, 64 nt, Homo Sapiens; identical to SEQ ID NO: 276141

SEQ ID NO: 357646 - RNA, 64 nt, Homo Sapiens; identical to SEQ ID NO: 276142

SEQ ID NO: 357647 - RNA, 64 nt, Homo Sapiens; identical to SEQ ID NO: 276143

SEQ ID NO: 357648 - RNA, 64 nt, Homo Sapiens; identical to SEQ ID NO: 276144

SEQ ID NO: 357649 - RNA, 64 nt, Homo Sapiens; identical to SEQ ID NO: 276145

SEQ ID NO: 357650 - RNA, 64 nt, Homo Sapiens; identical to SEQ ID NO: 276146

SEQ ID NO: 357651 - RNA, 64 nt, Homo Sapiens; identical to SEQ ID NO: 276147

SEQ ID NO: 357652 - RNA, 64 nt, Homo Sapiens; identical to SEQ ID NO: 276148

SEQ ID NO: 357653 - RNA, 64 nt, Homo Sapiens
cuuagccauugaaaugucaaauugaugugcccuagaucaacagaucaacaauaccuuuuuuuuc

SEQ ID NO: 357654 - RNA, 64 nt, Homo Sapiens
uugaaaugucaaauugaugugcccuagaucaacagaucaacaauaccuuuuuuuucaguguuaa

SEQ ID NO: 357655 - RNA, 64 nt, Homo Sapiens; identical to SEQ ID NO: 59819

SEQ ID NO: 357656 - RNA, 64 nt, Homo Sapiens; identical to SEQ ID NO: 59820

SEQ ID NO: 357657 - RNA, 64 nt, Homo Sapiens; identical to SEQ ID NO: 59821

SEQ ID NO: 357658 - RNA, 64 nt, Homo Sapiens; identical to SEQ ID NO: 59822

SEQ ID NO: 357659 - RNA, 64 nt, Homo Sapiens; identical to SEQ ID NO: 59823

SEQ ID NO: 357660 - RNA, 64 nt, Homo Sapiens; identical to SEQ ID NO: 59824

SEQ ID NO: 357661 - RNA, 64 nt, Homo Sapiens; identical to SEQ ID NO: 59825

SEQ ID NO: 357662 - RNA, 64 nt, Homo Sapiens; identical to SEQ ID NO: 59826

SEQ ID NO: 357663 - RNA, 64 nt, Homo Sapiens; identical to SEQ ID NO: 59827

SEQ ID NO: 357664 - RNA, 64 nt, Homo Sapiens; identical to SEQ ID NO: 59828

SEQ ID NO: 357665 - RNA, 64 nt, Homo Sapiens; identical to SEQ ID NO: 59829

SEQ ID NO: 357666 - RNA, 64 nt, Homo Sapiens; identical to SEQ ID NO: 59830

SEQ ID NO: 357667 - RNA, 64 nt, Homo Sapiens; identical to SEQ ID NO: 59831

SEQ ID NO: 357668 - RNA, 64 nt, Homo Sapiens; identical to SEQ ID NO: 59832

SEQ ID NO: 357669 - RNA, 64 nt, Homo Sapiens; identical to SEQ ID NO: 59833

SEQ ID NO: 357670 - RNA, 64 nt, Homo Sapiens; identical to SEQ ID NO: 59834

SEQ ID NO: 357671 - RNA, 64 nt, Homo Sapiens; identical to SEQ ID NO: 59835

SEQ ID NO: 357672 - RNA, 64 nt, Homo Sapiens; identical to SEQ ID NO: 59836

SEQ ID NO: 357673 - RNA, 64 nt, Homo Sapiens; identical to SEQ ID NO: 59837

SEQ ID NO: 357674 - RNA, 64 nt, Homo Sapiens; identical to SEQ ID NO: 59838

SEQ ID NO: 357675 - RNA, 64 nt, Homo Sapiens; identical to SEQ ID NO: 59839

SEQ ID NO: 357676 - RNA, 64 nt, Homo Sapiens; identical to SEQ ID NO: 59840

SEQ ID NO: 357677 - RNA, 64 nt, Homo Sapiens; identical to SEQ ID NO: 59841

SEQ ID NO: 357678 - RNA, 64 nt, Homo Sapiens; identical to SEQ ID NO: 59842

SEQ ID NO: 357679 - RNA, 64 nt, Homo Sapiens; identical to SEQ ID NO: 59843

SEQ ID NO: 357680 - RNA, 64 nt, Homo Sapiens; identical to SEQ ID NO: 59844

SEQ ID NO: 357681 - RNA, 64 nt, Homo Sapiens; identical to SEQ ID NO: 59845

SEQ ID NO: 357682 - RNA, 64 nt, Homo Sapiens; identical to SEQ ID NO: 59846

SEQ ID NO: 357683 - RNA, 64 nt, Homo Sapiens; identical to SEQ ID NO: 59847

SEQ ID NO: 357684 - RNA, 64 nt, Homo Sapiens; identical to SEQ ID NO: 59848

SEQ ID NO: 357685 - RNA, 64 nt, Homo Sapiens; identical to SEQ ID NO: 59849

SEQ ID NO: 357686 - RNA, 64 nt, Homo Sapiens; identical to SEQ ID NO: 59850

SEQ ID NO: 357687 - RNA, 64 nt, Homo Sapiens; identical to SEQ ID NO: 59851

SEQ ID NO: 357688 - RNA, 64 nt, Homo Sapiens; identical to SEQ ID NO: 59852

SEQ ID NO: 357689 - RNA, 64 nt, Homo Sapiens; identical to SEQ ID NO: 59853

SEQ ID NO: 357690 - RNA, 64 nt, Homo Sapiens; identical to SEQ ID NO: 59854

SEQ ID NO: 357691 - RNA, 64 nt, Homo Sapiens; identical to SEQ ID NO: 59855

SEQ ID NO: 357692 - RNA, 64 nt, Homo Sapiens; identical to SEQ ID NO: 59856

SEQ ID NO: 357693 - RNA, 64 nt, Homo Sapiens; identical to SEQ ID NO: 59857

SEQ ID NO: 357694 - RNA, 64 nt, Homo Sapiens; identical to SEQ ID NO: 59858

SEQ ID NO: 357695 - RNA, 64 nt, Homo Sapiens; identical to SEQ ID NO: 59859

SEQ ID NO: 357696 - RNA, 64 nt, Homo Sapiens; identical to SEQ ID NO: 59860

SEQ ID NO: 357697 - RNA, 64 nt, Homo Sapiens; identical to SEQ ID NO: 59861

SEQ ID NO: 357698 - RNA, 64 nt, Homo Sapiens; identical to SEQ ID NO: 59862

SEQ ID NO: 357699 - RNA, 64 nt, Homo Sapiens; identical to SEQ ID NO: 59863

SEQ ID NO: 357700 - RNA, 64 nt, Homo Sapiens; identical to SEQ ID NO: 59864

SEQ ID NO: 357701 - RNA, 64 nt, Homo Sapiens; identical to SEQ ID NO: 59865

SEQ ID NO: 357702 - RNA, 64 nt, Homo Sapiens; identical to SEQ ID NO: 59866

SEQ ID NO: 357703 - RNA, 64 nt, Homo Sapiens; identical to SEQ ID NO: 59867

SEQ ID NO: 357704 - RNA, 64 nt, Homo Sapiens; identical to SEQ ID NO: 59868

SEQ ID NO: 357705 - RNA, 64 nt, Homo Sapiens; identical to SEQ ID NO: 59869

SEQ ID NO: 357706 - RNA, 64 nt, Homo Sapiens; identical to SEQ ID NO: 59870

SEQ ID NO: 357707 - RNA, 64 nt, Homo Sapiens; identical to SEQ ID NO: 59871

SEQ ID NO: 357708 - RNA, 64 nt, Homo Sapiens; identical to SEQ ID NO: 59872

SEQ ID NO: 357709 - RNA, 64 nt, Homo Sapiens; identical to SEQ ID NO: 59873

SEQ ID NO: 357710 - RNA, 64 nt, Homo Sapiens; identical to SEQ ID NO: 59874

SEQ ID NO: 357711 - RNA, 64 nt, Homo Sapiens; identical to SEQ ID NO: 59875

SEQ ID NO: 357712 - RNA, 64 nt, Homo Sapiens; identical to SEQ ID NO: 150215

SEQ ID NO: 357713 - RNA, 64 nt, Homo Sapiens; identical to SEQ ID NO: 150216

SEQ ID NO: 357714 - RNA, 64 nt, Homo Sapiens; identical to SEQ ID NO: 150217

SEQ ID NO: 357715 - RNA, 64 nt, Homo Sapiens; identical to SEQ ID NO: 150218

SEQ ID NO: 357716 - RNA, 64 nt, Homo Sapiens; identical to SEQ ID NO: 150219

SEQ ID NO: 357717 - RNA, 64 nt, Homo Sapiens; identical to SEQ ID NO: 150220

SEQ ID NO: 357718 - RNA, 64 nt, Homo Sapiens; identical to SEQ ID NO: 150221

SEQ ID NO: 357719 - RNA, 64 nt, Homo Sapiens; identical to SEQ ID NO: 150222

SEQ ID NO: 357720 - RNA, 64 nt, Homo Sapiens; identical to SEQ ID NO: 150223

SEQ ID NO: 357721 - RNA, 64 nt, Homo Sapiens; identical to SEQ ID NO: 150224

SEQ ID NO: 357722 - RNA, 64 nt, Homo Sapiens; identical to SEQ ID NO: 150225

SEQ ID NO: 357723 - RNA, 64 nt, Homo Sapiens; identical to SEQ ID NO: 150226

SEQ ID NO: 357724 - RNA, 64 nt, Homo Sapiens; identical to SEQ ID NO: 150227

SEQ ID NO: 357725 - RNA, 64 nt, Homo Sapiens; identical to SEQ ID NO: 150228

SEQ ID NO: 357726 - RNA, 64 nt, Homo Sapiens; identical to SEQ ID NO: 150229

SEQ ID NO: 357727 - RNA, 64 nt, Homo Sapiens; identical to SEQ ID NO: 150230

SEQ ID NO: 357728 - RNA, 64 nt, Homo Sapiens; identical to SEQ ID NO: 150231

SEQ ID NO: 357729 - RNA, 64 nt, Homo Sapiens; identical to SEQ ID NO: 150232

SEQ ID NO: 357730 - RNA, 64 nt, Homo Sapiens; identical to SEQ ID NO: 150233

SEQ ID NO: 357731 - RNA, 64 nt, Homo Sapiens; identical to SEQ ID NO: 150234

SEQ ID NO: 357732 - RNA, 64 nt, Homo Sapiens; identical to SEQ ID NO: 150235

SEQ ID NO: 357733 - RNA, 64 nt, Homo Sapiens; identical to SEQ ID NO: 150236

SEQ ID NO: 357734 - RNA, 64 nt, Homo Sapiens; identical to SEQ ID NO: 150237

SEQ ID NO: 357735 - RNA, 64 nt, Homo Sapiens; identical to SEQ ID NO: 150238

SEQ ID NO: 357736 - RNA, 64 nt, Homo Sapiens; identical to SEQ ID NO: 150239

SEQ ID NO: 357737 - RNA, 64 nt, Homo Sapiens; identical to SEQ ID NO: 150240

SEQ ID NO: 357738 - RNA, 64 nt, Homo Sapiens; identical to SEQ ID NO: 150241

SEQ ID NO: 357739 - RNA, 64 nt, Homo Sapiens; identical to SEQ ID NO: 150242

SEQ ID NO: 357740 - RNA, 64 nt, Homo Sapiens; identical to SEQ ID NO: 150243

SEQ ID NO: 357741 - RNA, 64 nt, Homo Sapiens; identical to SEQ ID NO: 150244

SEQ ID NO: 357742 - RNA, 64 nt, Homo Sapiens; identical to SEQ ID NO: 150245

SEQ ID NO: 357743 - RNA, 64 nt, Homo Sapiens; identical to SEQ ID NO: 150246

SEQ ID NO: 357744 - RNA, 64 nt, Homo Sapiens; identical to SEQ ID NO: 150247

SEQ ID NO: 357745 - RNA, 64 nt, Homo Sapiens; identical to SEQ ID NO: 150248

SEQ ID NO: 357746 - RNA, 60 nt, Homo Sapiens
gcucaugcugacugugaugagaaauugcagcaccucuaucucgcagguaauggaguaguu

SEQ ID NO: 357747 - RNA, 60 nt, Homo Sapiens
cuuuggaaugacugcuccacuccacacucacaccucuauucacagaccagcaucuccucu

SEQ ID NO: 357748 - RNA, 60 nt, Homo Sapiens
cgucagccuucaggacugaucugccauuuucaccucuaaauccccaugucugaccauuag

SEQ ID NO: 357749 - RNA, 60 nt, Homo Sapiens
gcugccugaaacagccauguccaaguucuucaccucuauccaaagaacuugauuugcaug

SEQ ID NO: 357750 - RNA, 60 nt, Homo Sapiens
cuugacaugugcaauugugagggacaugcucaccucuagccuuaaggggggcagggagug

SEQ ID NO: 357751 - RNA, 64 nt, Homo Sapiens; identical to SEQ ID NO: 216718

SEQ ID NO: 357752 - RNA, 64 nt, Homo Sapiens; identical to SEQ ID NO: 216719

SEQ ID NO: 357753 - RNA, 64 nt, Homo Sapiens; identical to SEQ ID NO: 216720

SEQ ID NO: 357754 - RNA, 64 nt, Homo Sapiens; identical to SEQ ID NO: 216721

SEQ ID NO: 357755 - RNA, 64 nt, Homo Sapiens; identical to SEQ ID NO: 216722

SEQ ID NO: 357756 - RNA, 64 nt, Homo Sapiens; identical to SEQ ID NO: 216723

SEQ ID NO: 357757 - RNA, 64 nt, Homo Sapiens; identical to SEQ ID NO: 216724

SEQ ID NO: 357758 - RNA, 64 nt, Homo Sapiens; identical to SEQ ID NO: 216725

SEQ ID NO: 357759 - RNA, 64 nt, Homo Sapiens; identical to SEQ ID NO: 216726

SEQ ID NO: 357760 - RNA, 64 nt, Homo Sapiens; identical to SEQ ID NO: 216727

SEQ ID NO: 357761 - RNA, 64 nt, Homo Sapiens; identical to SEQ ID NO: 216728

SEQ ID NO: 357762 - RNA, 64 nt, Homo Sapiens; identical to SEQ ID NO: 216729

SEQ ID NO: 357763 - RNA, 64 nt, Homo Sapiens; identical to SEQ ID NO: 216730

SEQ ID NO: 357764 - RNA, 64 nt, Homo Sapiens; identical to SEQ ID NO: 216731

SEQ ID NO: 357765 - RNA, 64 nt, Homo Sapiens; identical to SEQ ID NO: 216732

SEQ ID NO: 357766 - RNA, 64 nt, Homo Sapiens; identical to SEQ ID NO: 216733

SEQ ID NO: 357767 - RNA, 64 nt, Homo Sapiens; identical to SEQ ID NO: 216734

SEQ ID NO: 357768 - RNA, 64 nt, Homo Sapiens; identical to SEQ ID NO: 216735

SEQ ID NO: 357769 - RNA, 64 nt, Homo Sapiens; identical to SEQ ID NO: 216736

SEQ ID NO: 357770 - RNA, 64 nt, Homo Sapiens; identical to SEQ ID NO: 216737

SEQ ID NO: 357771 - RNA, 64 nt, Homo Sapiens; identical to SEQ ID NO: 216738

SEQ ID NO: 357772 - RNA, 64 nt, Homo Sapiens; identical to SEQ ID NO: 216739

SEQ ID NO: 357773 - RNA, 64 nt, Homo Sapiens; identical to SEQ ID NO: 216740

SEQ ID NO: 357774 - RNA, 64 nt, Homo Sapiens; identical to SEQ ID NO: 216741

SEQ ID NO: 357775 - RNA, 64 nt, Homo Sapiens; identical to SEQ ID NO: 216742

SEQ ID NO: 357776 - RNA, 64 nt, Homo Sapiens; identical to SEQ ID NO: 216743

SEQ ID NO: 357777 - RNA, 64 nt, Homo Sapiens; identical to SEQ ID NO: 216744

SEQ ID NO: 357778 - RNA, 64 nt, Homo Sapiens; identical to SEQ ID NO: 216745

SEQ ID NO: 357779 - RNA, 64 nt, Homo Sapiens; identical to SEQ ID NO: 216746

SEQ ID NO: 357780 - RNA, 64 nt, Homo Sapiens; identical to SEQ ID NO: 216747

SEQ ID NO: 357781 - RNA, 64 nt, Homo Sapiens; identical to SEQ ID NO: 216748

SEQ ID NO: 357782 - RNA, 64 nt, Homo Sapiens; identical to SEQ ID NO: 216749

SEQ ID NO: 357783 - RNA, 64 nt, Homo Sapiens; identical to SEQ ID NO: 216750

SEQ ID NO: 357784 - RNA, 64 nt, Homo Sapiens; identical to SEQ ID NO: 216751

SEQ ID NO: 357785 - RNA, 64 nt, Homo Sapiens; identical to SEQ ID NO: 216752

SEQ ID NO: 357786 - RNA, 64 nt, Homo Sapiens; identical to SEQ ID NO: 216753

SEQ ID NO: 357787 - RNA, 64 nt, Homo Sapiens; identical to SEQ ID NO: 216754

SEQ ID NO: 357788 - RNA, 64 nt, Homo Sapiens; identical to SEQ ID NO: 216755

SEQ ID NO: 357789 - RNA, 64 nt, Homo Sapiens; identical to SEQ ID NO: 216756

SEQ ID NO: 357790 - RNA, 64 nt, Homo Sapiens; identical to SEQ ID NO: 216757

SEQ ID NO: 357791 - RNA, 64 nt, Homo Sapiens; identical to SEQ ID NO: 216758

SEQ ID NO: 357792 - RNA, 64 nt, Homo Sapiens; identical to SEQ ID NO: 216759

SEQ ID NO: 357793 - RNA, 64 nt, Homo Sapiens; identical to SEQ ID NO: 216760

SEQ ID NO: 357794 - RNA, 64 nt, Homo Sapiens; identical to SEQ ID NO: 216761

SEQ ID NO: 357795 - RNA, 64 nt, Homo Sapiens; identical to SEQ ID NO: 216762

SEQ ID NO: 357796 - RNA, 64 nt, Homo Sapiens; identical to SEQ ID NO: 216763

SEQ ID NO: 357797 - RNA, 64 nt, Homo Sapiens; identical to SEQ ID NO: 216764

SEQ ID NO: 357798 - RNA, 64 nt, Homo Sapiens; identical to SEQ ID NO: 216765

SEQ ID NO: 357799 - RNA, 64 nt, Homo Sapiens; identical to SEQ ID NO: 216766

SEQ ID NO: 357800 - RNA, 64 nt, Homo Sapiens; identical to SEQ ID NO: 216767

SEQ ID NO: 357801 - RNA, 64 nt, Homo Sapiens; identical to SEQ ID NO: 216768

SEQ ID NO: 357802 - RNA, 64 nt, Homo Sapiens; identical to SEQ ID NO: 216769

SEQ ID NO: 357803 - RNA, 64 nt, Homo Sapiens; identical to SEQ ID NO: 216770

SEQ ID NO: 357804 - RNA, 64 nt, Homo Sapiens; identical to SEQ ID NO: 216771

SEQ ID NO: 357805 - RNA, 64 nt, Homo Sapiens; identical to SEQ ID NO: 216772

SEQ ID NO: 357806 - RNA, 64 nt, Homo Sapiens; identical to SEQ ID NO: 216773

SEQ ID NO: 357807 - RNA, 55 nt, Homo Sapiens; identical to SEQ ID NO: 216774

SEQ ID NO: 357808 - RNA, 64 nt, Homo Sapiens; identical to SEQ ID NO: 216775

SEQ ID NO: 357809 - RNA, 64 nt, Homo Sapiens; identical to SEQ ID NO: 216776

SEQ ID NO: 357810 - RNA, 64 nt, Homo Sapiens; identical to SEQ ID NO: 216777

SEQ ID NO: 357811 - RNA, 64 nt, Homo Sapiens; identical to SEQ ID NO: 216778

SEQ ID NO: 357812 - RNA, 64 nt, Homo Sapiens; identical to SEQ ID NO: 216779

SEQ ID NO: 357813 - RNA, 64 nt, Homo Sapiens; identical to SEQ ID NO: 216780

SEQ ID NO: 357814 - RNA, 64 nt, Homo Sapiens; identical to SEQ ID NO: 216781

SEQ ID NO: 357815 - RNA, 64 nt, Homo Sapiens; identical to SEQ ID NO: 216782

SEQ ID NO: 357816 - RNA, 64 nt, Homo Sapiens; identical to SEQ ID NO: 216783

SEQ ID NO: 357817 - RNA, 64 nt, Homo Sapiens; identical to SEQ ID NO: 216784

SEQ ID NO: 357818 - RNA, 64 nt, Homo Sapiens; identical to SEQ ID NO: 216785

SEQ ID NO: 357819 - RNA, 64 nt, Homo Sapiens; identical to SEQ ID NO: 216786

SEQ ID NO: 357820 - RNA, 64 nt, Homo Sapiens; identical to SEQ ID NO: 216787

SEQ ID NO: 357821 - RNA, 64 nt, Homo Sapiens; identical to SEQ ID NO: 216788

SEQ ID NO: 357822 - RNA, 64 nt, Homo Sapiens; identical to SEQ ID NO: 216789

SEQ ID NO: 357823 - RNA, 64 nt, Homo Sapiens; identical to SEQ ID NO: 216790

SEQ ID NO: 357824 - RNA, 64 nt, Homo Sapiens; identical to SEQ ID NO: 216791

SEQ ID NO: 357825 - RNA, 64 nt, Homo Sapiens; identical to SEQ ID NO: 216792

SEQ ID NO: 357826 - RNA, 64 nt, Homo Sapiens; identical to SEQ ID NO: 216793

SEQ ID NO: 357827 - RNA, 64 nt, Homo Sapiens; identical to SEQ ID NO: 216794

SEQ ID NO: 357828 - RNA, 64 nt, Homo Sapiens; identical to SEQ ID NO: 216795

SEQ ID NO: 357829 - RNA, 64 nt, Homo Sapiens; identical to SEQ ID NO: 216796

SEQ ID NO: 357830 - RNA, 58 nt, Homo Sapiens; identical to SEQ ID NO: 216797

SEQ ID NO: 357831 - RNA, 64 nt, Homo Sapiens; identical to SEQ ID NO: 216798

SEQ ID NO: 357832 - RNA, 64 nt, Homo Sapiens; identical to SEQ ID NO: 216799

SEQ ID NO: 357833 - RNA, 64 nt, Homo Sapiens; identical to SEQ ID NO: 216800

SEQ ID NO: 357834 - RNA, 64 nt, Homo Sapiens; identical to SEQ ID NO: 216801

SEQ ID NO: 357835 - RNA, 64 nt, Homo Sapiens; identical to SEQ ID NO: 216802

SEQ ID NO: 357836 - RNA, 64 nt, Homo Sapiens; identical to SEQ ID NO: 216803

SEQ ID NO: 357837 - RNA, 64 nt, Homo Sapiens; identical to SEQ ID NO: 216804

SEQ ID NO: 357838 - RNA, 64 nt, Homo Sapiens; identical to SEQ ID NO: 216805

SEQ ID NO: 357839 - RNA, 64 nt, Homo Sapiens; identical to SEQ ID NO: 216806

SEQ ID NO: 357840 - RNA, 64 nt, Homo Sapiens; identical to SEQ ID NO: 216807

SEQ ID NO: 357841 - RNA, 64 nt, Homo Sapiens; identical to SEQ ID NO: 216808

SEQ ID NO: 357842 - RNA, 64 nt, Homo Sapiens; identical to SEQ ID NO: 216809

SEQ ID NO: 357843 - RNA, 64 nt, Homo Sapiens; identical to SEQ ID NO: 216810

SEQ ID NO: 357844 - RNA, 64 nt, Homo Sapiens; identical to SEQ ID NO: 216811

SEQ ID NO: 357845 - RNA, 64 nt, Homo Sapiens; identical to SEQ ID NO: 216812

SEQ ID NO: 357846 - RNA, 64 nt, Homo Sapiens; identical to SEQ ID NO: 216813

SEQ ID NO: 357847 - RNA, 64 nt, Homo Sapiens; identical to SEQ ID NO: 216814

SEQ ID NO: 357848 - RNA, 64 nt, Homo Sapiens; identical to SEQ ID NO: 216815

SEQ ID NO: 357849 - RNA, 64 nt, Homo Sapiens; identical to SEQ ID NO: 216816

SEQ ID NO: 357850 - RNA, 64 nt, Homo Sapiens; identical to SEQ ID NO: 216817

SEQ ID NO: 357851 - RNA, 64 nt, Homo Sapiens; identical to SEQ ID NO: 216818

SEQ ID NO: 357852 - RNA, 64 nt, Homo Sapiens; identical to SEQ ID NO: 216819

SEQ ID NO: 357853 - RNA, 64 nt, Homo Sapiens; identical to SEQ ID NO: 216820

SEQ ID NO: 357854 - RNA, 64 nt, Homo Sapiens; identical to SEQ ID NO: 216821

SEQ ID NO: 357855 - RNA, 64 nt, Homo Sapiens; identical to SEQ ID NO: 216822

SEQ ID NO: 357856 - RNA, 64 nt, Homo Sapiens; identical to SEQ ID NO: 216823

SEQ ID NO: 357857 - RNA, 64 nt, Homo Sapiens; identical to SEQ ID NO: 216824

SEQ ID NO: 357858 - RNA, 64 nt, Homo Sapiens; identical to SEQ ID NO: 216825

SEQ ID NO: 357859 - RNA, 64 nt, Homo Sapiens; identical to SEQ ID NO: 216826

SEQ ID NO: 357860 - RNA, 64 nt, Homo Sapiens; identical to SEQ ID NO: 216827

SEQ ID NO: 357861 - RNA, 64 nt, Homo Sapiens; identical to SEQ ID NO: 216828

SEQ ID NO: 357862 - RNA, 64 nt, Homo Sapiens; identical to SEQ ID NO: 216829

SEQ ID NO: 357863 - RNA, 64 nt, Homo Sapiens; identical to SEQ ID NO: 216830

SEQ ID NO: 357864 - RNA, 64 nt, Homo Sapiens; identical to SEQ ID NO: 216831

SEQ ID NO: 357865 - RNA, 64 nt, Homo Sapiens; identical to SEQ ID NO: 216832

SEQ ID NO: 357866 - RNA, 64 nt, Homo Sapiens; identical to SEQ ID NO: 216833

SEQ ID NO: 357867 - RNA, 64 nt, Homo Sapiens; identical to SEQ ID NO: 216834

SEQ ID NO: 357868 - RNA, 64 nt, Homo Sapiens; identical to SEQ ID NO: 216835

SEQ ID NO: 357869 - RNA, 64 nt, Homo Sapiens; identical to SEQ ID NO: 216836

SEQ ID NO: 357870 - RNA, 64 nt, Homo Sapiens; identical to SEQ ID NO: 216837

SEQ ID NO: 357871 - RNA, 64 nt, Homo Sapiens; identical to SEQ ID NO: 216838

SEQ ID NO: 357872 - RNA, 64 nt, Homo Sapiens; identical to SEQ ID NO: 216839

SEQ ID NO: 357873 - RNA, 64 nt, Homo Sapiens; identical to SEQ ID NO: 216840

SEQ ID NO: 357874 - RNA, 64 nt, Homo Sapiens; identical to SEQ ID NO: 216841

SEQ ID NO: 357875 - RNA, 64 nt, Homo Sapiens; identical to SEQ ID NO: 216842

SEQ ID NO: 357876 - RNA, 64 nt, Homo Sapiens; identical to SEQ ID NO: 216843

SEQ ID NO: 357877 - RNA, 64 nt, Homo Sapiens; identical to SEQ ID NO: 216844

SEQ ID NO: 357878 - RNA, 64 nt, Homo Sapiens; identical to SEQ ID NO: 216845

SEQ ID NO: 357879 - RNA, 64 nt, Homo Sapiens; identical to SEQ ID NO: 216846

SEQ ID NO: 357880 - RNA, 64 nt, Homo Sapiens; identical to SEQ ID NO: 216847

SEQ ID NO: 357881 - RNA, 64 nt, Homo Sapiens; identical to SEQ ID NO: 216848

SEQ ID NO: 357882 - RNA, 64 nt, Homo Sapiens; identical to SEQ ID NO: 216849

SEQ ID NO: 357883 - RNA, 64 nt, Homo Sapiens; identical to SEQ ID NO: 216850

SEQ ID NO: 357884 - RNA, 64 nt, Homo Sapiens; identical to SEQ ID NO: 216851

SEQ ID NO: 357885 - RNA, 64 nt, Homo Sapiens; identical to SEQ ID NO: 216852

SEQ ID NO: 357886 - RNA, 64 nt, Homo Sapiens; identical to SEQ ID NO: 216853

SEQ ID NO: 357887 - RNA, 64 nt, Homo Sapiens; identical to SEQ ID NO: 216854

SEQ ID NO: 357888 - RNA, 64 nt, Homo Sapiens; identical to SEQ ID NO: 216855

SEQ ID NO: 357889 - RNA, 64 nt, Homo Sapiens; identical to SEQ ID NO: 216856

SEQ ID NO: 357890 - RNA, 64 nt, Homo Sapiens; identical to SEQ ID NO: 216857

SEQ ID NO: 357891 - RNA, 64 nt, Homo Sapiens; identical to SEQ ID NO: 216858

SEQ ID NO: 357892 - RNA, 64 nt, Homo Sapiens; identical to SEQ ID NO: 216859

SEQ ID NO: 357893 - RNA, 64 nt, Homo Sapiens; identical to SEQ ID NO: 216860

SEQ ID NO: 357894 - RNA, 64 nt, Homo Sapiens; identical to SEQ ID NO: 216861

SEQ ID NO: 357895 - RNA, 64 nt, Homo Sapiens; identical to SEQ ID NO: 216862

SEQ ID NO: 357896 - RNA, 64 nt, Homo Sapiens; identical to SEQ ID NO: 216863

SEQ ID NO: 357897 - RNA, 64 nt, Homo Sapiens; identical to SEQ ID NO: 216864

SEQ ID NO: 357898 - RNA, 64 nt, Homo Sapiens; identical to SEQ ID NO: 216865

SEQ ID NO: 357899 - RNA, 64 nt, Homo Sapiens; identical to SEQ ID NO: 216866

SEQ ID NO: 357900 - RNA, 64 nt, Homo Sapiens; identical to SEQ ID NO: 216867

SEQ ID NO: 357901 - RNA, 64 nt, Homo Sapiens; identical to SEQ ID NO: 216868

SEQ ID NO: 357902 - RNA, 64 nt, Homo Sapiens; identical to SEQ ID NO: 216869

SEQ ID NO: 357903 - RNA, 64 nt, Homo Sapiens; identical to SEQ ID NO: 216870

SEQ ID NO: 357904 - RNA, 64 nt, Homo Sapiens; identical to SEQ ID NO: 216871

SEQ ID NO: 357905 - RNA, 64 nt, Homo Sapiens; identical to SEQ ID NO: 216872

SEQ ID NO: 357906 - RNA, 64 nt, Homo Sapiens; identical to SEQ ID NO: 216873

SEQ ID NO: 357907 - RNA, 64 nt, Homo Sapiens; identical to SEQ ID NO: 216874

SEQ ID NO: 357908 - RNA, 64 nt, Homo Sapiens; identical to SEQ ID NO: 216875

SEQ ID NO: 357909 - RNA, 64 nt, Homo Sapiens; identical to SEQ ID NO: 216876

SEQ ID NO: 357910 - RNA, 64 nt, Homo Sapiens; identical to SEQ ID NO: 216877

SEQ ID NO: 357911 - RNA, 64 nt, Homo Sapiens; identical to SEQ ID NO: 216878

SEQ ID NO: 357912 - RNA, 64 nt, Homo Sapiens; identical to SEQ ID NO: 216879

SEQ ID NO: 357913 - RNA, 64 nt, Homo Sapiens; identical to SEQ ID NO: 216880

SEQ ID NO: 357914 - RNA, 64 nt, Homo Sapiens; identical to SEQ ID NO: 216881

SEQ ID NO: 357915 - RNA, 64 nt, Homo Sapiens; identical to SEQ ID NO: 216882

SEQ ID NO: 357916 - RNA, 64 nt, Homo Sapiens; identical to SEQ ID NO: 216883

SEQ ID NO: 357917 - RNA, 64 nt, Homo Sapiens; identical to SEQ ID NO: 216884

SEQ ID NO: 357918 - RNA, 64 nt, Homo Sapiens; identical to SEQ ID NO: 216885

SEQ ID NO: 357919 - RNA, 64 nt, Homo Sapiens; identical to SEQ ID NO: 216886

SEQ ID NO: 357920 - RNA, 64 nt, Homo Sapiens; identical to SEQ ID NO: 216887

SEQ ID NO: 357921 - RNA, 64 nt, Homo Sapiens; identical to SEQ ID NO: 216888

SEQ ID NO: 357922 - RNA, 64 nt, Homo Sapiens; identical to SEQ ID NO: 216889

SEQ ID NO: 357923 - RNA, 64 nt, Homo Sapiens; identical to SEQ ID NO: 216890

SEQ ID NO: 357924 - RNA, 64 nt, Homo Sapiens; identical to SEQ ID NO: 216891

SEQ ID NO: 357925 - RNA, 64 nt, Homo Sapiens; identical to SEQ ID NO: 216892

SEQ ID NO: 357926 - RNA, 64 nt, Homo Sapiens; identical to SEQ ID NO: 216893

SEQ ID NO: 357927 - RNA, 64 nt, Homo Sapiens; identical to SEQ ID NO: 216894

SEQ ID NO: 357928 - RNA, 64 nt, Homo Sapiens; identical to SEQ ID NO: 216895

SEQ ID NO: 357929 - RNA, 64 nt, Homo Sapiens; identical to SEQ ID NO: 216896

SEQ ID NO: 357930 - RNA, 64 nt, Homo Sapiens; identical to SEQ ID NO: 216897

SEQ ID NO: 357931 - RNA, 64 nt, Homo Sapiens; identical to SEQ ID NO: 216898

SEQ ID NO: 357932 - RNA, 64 nt, Homo Sapiens; identical to SEQ ID NO: 216899

SEQ ID NO: 357933 - RNA, 64 nt, Homo Sapiens; identical to SEQ ID NO: 216900

SEQ ID NO: 357934 - RNA, 64 nt, Homo Sapiens; identical to SEQ ID NO: 216901

SEQ ID NO: 357935 - RNA, 64 nt, Homo Sapiens; identical to SEQ ID NO: 216902

SEQ ID NO: 357936 - RNA, 64 nt, Homo Sapiens; identical to SEQ ID NO: 216903

SEQ ID NO: 357937 - RNA, 64 nt, Homo Sapiens; identical to SEQ ID NO: 216904

SEQ ID NO: 357938 - RNA, 64 nt, Homo Sapiens; identical to SEQ ID NO: 216905

SEQ ID NO: 357939 - RNA, 64 nt, Homo Sapiens; identical to SEQ ID NO: 216906

SEQ ID NO: 357940 - RNA, 64 nt, Homo Sapiens; identical to SEQ ID NO: 216907

SEQ ID NO: 357941 - RNA, 64 nt, Homo Sapiens; identical to SEQ ID NO: 216908

SEQ ID NO: 357942 - RNA, 64 nt, Homo Sapiens; identical to SEQ ID NO: 216909

SEQ ID NO: 357943 - RNA, 64 nt, Homo Sapiens; identical to SEQ ID NO: 216910

SEQ ID NO: 357944 - RNA, 64 nt, Homo Sapiens; identical to SEQ ID NO: 216911

SEQ ID NO: 357945 - RNA, 64 nt, Homo Sapiens; identical to SEQ ID NO: 216912

SEQ ID NO: 357946 - RNA, 64 nt, Homo Sapiens; identical to SEQ ID NO: 216913

SEQ ID NO: 357947 - RNA, 64 nt, Homo Sapiens; identical to SEQ ID NO: 216914

SEQ ID NO: 357948 - RNA, 64 nt, Homo Sapiens; identical to SEQ ID NO: 216915

SEQ ID NO: 357949 - RNA, 64 nt, Homo Sapiens; identical to SEQ ID NO: 216916

SEQ ID NO: 357950 - RNA, 64 nt, Homo Sapiens; identical to SEQ ID NO: 216917

SEQ ID NO: 357951 - RNA, 64 nt, Homo Sapiens; identical to SEQ ID NO: 216918

SEQ ID NO: 357952 - RNA, 64 nt, Homo Sapiens; identical to SEQ ID NO: 216919

SEQ ID NO: 357953 - RNA, 64 nt, Homo Sapiens; identical to SEQ ID NO: 216920

SEQ ID NO: 357954 - RNA, 64 nt, Homo Sapiens; identical to SEQ ID NO: 216921

SEQ ID NO: 357955 - RNA, 64 nt, Homo Sapiens; identical to SEQ ID NO: 216913

SEQ ID NO: 357956 - RNA, 64 nt, Homo Sapiens; identical to SEQ ID NO: 216923

SEQ ID NO: 357957 - RNA, 64 nt, Homo Sapiens
aaaggcaaagggaaggguaaagucggaccagugucaaggaaaguuuguuuuauugagguggaaa

SEQ ID NO: 357958 - RNA, 64 nt, Homo Sapiens
uaccaagggcaggggaagggggauauagaggucacaaggaaauaaaaaucaucuuucaucuuua

SEQ ID NO: 357959 - RNA, 64 nt, Homo Sapiens
auaaauuuugccgucagcuucuucauaacguuuucaaggaaauucuaggcaaucauuccuguca

SEQ ID NO: 357960 - RNA, 64 nt, Homo Sapiens
uuccgcuuccuuuguuugccaaauacuagaaacacaaggaaaugcaaguuacgcuaaauggcag

SEQ ID NO: 357961 - RNA, 64 nt, Homo Sapiens
ggcacagcgaaauccuggugcaagcaaagggagacaaggaaacgagcagaaguccugguaguua

SEQ ID NO: 357962 - RNA, 64 nt, Homo Sapiens
cccagguucuuaaaacacgaaaccgggaaaaagccaaggaaaagaacuuucuagcagucaccau

SEQ ID NO: 357963 - RNA, 64 nt, Homo Sapiens
guugcuaguuuauaaugucuuacuaaugcagaaacaaggaaaaaagcaaaauuggccugaauau

SEQ ID NO: 357964 - RNA, 64 nt, Homo Sapiens
auauuuauaauuaggcuuuauuaucuuccuaaaucaaggaaaggaaaucauccccagaccauuu

SEQ ID NO: 357965 - RNA, 64 nt, Homo Sapiens
ggaaaauaccaaaugaacguacaguacaacauuucaaggaaaugaauauauuguuagaccaggu

SEQ ID NO: 357966 - RNA, 64 nt, Homo Sapiens
uuugcuuagaauagaauggaacaaguuuaaauuucaaggaaauaugaaggcacuuccuuuuuuu

SEQ ID NO: 357967 - RNA, 64 nt, Homo Sapiens
agugucuuuuacguuguuaugcacuuuguuuuuccaaggaaaucgacuccuuuauauucguacu

SEQ ID NO: 357968 - RNA, 54 nt, Homo Sapiens
cuuccccaguccaaggagcacaaccaaggaaagugccugcccacuauggacuga

SEQ ID NO: 357969 - RNA, 64 nt, Homo Sapiens
acgugguuuuagagucuaccuaauauguuaaggacaaggaaaccucugagucuaccuaauaugu

SEQ ID NO: 357970 - RNA, 64 nt, Homo Sapiens
aggaaaccucugagucuaccuaauauguuaaggacaaggaaaccucuggacagugguauauugg

SEQ ID NO: 357971 - RNA, 64 nt, Homo Sapiens
caacucuaggauuucuuuuuagguaaacccuuuucaaggaaaaaccuuccucuucacuggcucg

SEQ ID NO: 357972 - RNA, 64 nt, Homo Sapiens
cugcaggggccacaggcacacauagugauaaagacaaggaaacgugcugugucucauggguuuc

SEQ ID NO: 357973 - RNA, 64 nt, Homo Sapiens
acuguuuauaaaauucaguuuuuguaggguuuuccaaggaaaaaucaccuugguugaauguuuc

SEQ ID NO: 357974 - RNA, 64 nt, Homo Sapiens
uuuuaaucacuuuuuaaaauauaaggaccgaaugcaaggaaaccaaaguuuauuaauaauuuuu

SEQ ID NO: 357975 - RNA, 64 nt, Homo Sapiens
uuugaaaucaucggagucagccaggagcugucaccaaggaaacgcuaccucucugucccuugcu

SEQ ID NO: 357976 - RNA, 64 nt, Homo Sapiens
uauuguuuucugacaguuuuucuguuuuguuuggcaaggaaaggggagaagggaauccuccucc

SEQ ID NO: 357977 - RNA, 64 nt, Homo Sapiens
cuuacagaaccuuuaaacacagcaaaaacuuuuucaaggaaaaugguuuucacacuauuucagc

SEQ ID NO: 357978 - RNA, 64 nt, Homo Sapiens
caucuggccagggguagcuuauucaaaucaauuucaaggaaaaauuaauaggcgagcaaauaaa

SEQ ID NO: 357979 - RNA, 64 nt, Homo Sapiens
auuuugggauauuaaaaguuaacagaacacugaacaaggaaagaauggcauagaucuaucuuua

SEQ ID NO: 357980 - RNA, 64 nt, Homo Sapiens
ccugaagauucuuucuucugaaagccaagcaccacaaggaaaaaaaaaauuauuaauagcucag

SEQ ID NO: 357981 - RNA, 64 nt, Homo Sapiens
gaggaaucacccaaaugaguaucauagagcugaacaaggaaacuuggacaccaaggaaacagau

SEQ ID NO: 357982 - RNA, 64 nt, Homo Sapiens
gauaucauagagcugaacaagaaaaccuggacaccaaggaaacacugauaugcuguauuuaaug

SEQ ID NO: 357983 - RNA, 64 nt, Homo Sapiens
uaagauuucgagcagaauuuaucuaaauguguuucaaggaaacacaaucgcugaaccaaaacgu

SEQ ID NO: 357984 - RNA, 64 nt, Homo Sapiens
aaugacuccauuuaaaaauaucacagggugggggcaaggaaauuagcugagauucaucucagga

SEQ ID NO: 357985 - RNA, 64 nt, Homo Sapiens
ggaaaaaaaggagaaaaaacgcaucuuuuuaaaacaaggaaaagccgcugcauaacaacacagu

SEQ ID NO: 357986 - RNA, 64 nt, Homo Sapiens
auaauuacuccuccuuaaaggaucugggauaaagcaaggaaauaauucaaaaacugagagugga

SEQ ID NO: 357987 - RNA, 64 nt, Homo Sapiens
ccagaguaccccgcauucccaugaauagagccuccaaggaaagggaggaugggguguccuuugu

SEQ ID NO: 357988 - RNA, 64 nt, Homo Sapiens
guaucuuucagagaaaaaaaaaguuagauguagccaaggaaaguagugaucacgggaaggacug

SEQ ID NO: 357989 - RNA, 64 nt, Homo Sapiens
uuaagagcuaacaagagaagagaguccaguuuucuggaaauaugucuuuaaguauuuuagacau

SEQ ID NO: 357990 - RNA, 64 nt, Homo Sapiens
cagccaggaguaagaaaagaugguuagugauauuuggaaauaccuggauauuugcuagaggaaa

SEQ ID NO: 357991 - RNA, 64 nt, Homo Sapiens
ucaggaccaucucaggcauccaggcauggcaaaguggaaauaauucauuuuggccugcaaaccu

SEQ ID NO: 357992 - RNA, 64 nt, Homo Sapiens
agcaaagguuucuugggguuauuaaccaguaguguggaaauacuaguuuuauguggccaaggaa

SEQ ID NO: 357993 - RNA, 64 nt, Homo Sapiens
aguugugguacggucuaaaagcagucuuguuuccuggaaauaaaaaguugggauauuaacuugu

SEQ ID NO: 357994 - RNA, 64 nt, Homo Sapiens
auggaaaacuccauuguguguugcuggacuguuuuggaaauauuugguuaaauguguguuaauu

SEQ ID NO: 357995 - RNA, 64 nt, Homo Sapiens
uccuccauagcagaaguuguuggcccuuuccugauggaaauauugucaaguuaagacacuaacu

SEQ ID NO: 357996 - RNA, 64 nt, Homo Sapiens
gcacuugacuuuaugaaaggucauaggauuauuuuggaaauauaccuucacaaccuucaugauu

SEQ ID NO: 357997 - RNA, 64 nt, Homo Sapiens
uuauacuugagacauugcaccuaccccggaaggcuggaaauacagaaacagcauggaauugcaa

SEQ ID NO: 357998 - RNA, 64 nt, Homo Sapiens
uauugcuugauuaaauuuggcauuuaaauagugguggaaauauuuuauauaauuuucauuuuuu

SEQ ID NO: 357999 - RNA, 64 nt, Homo Sapiens
uaucuuagaauauuuucaaaaguuacuaugaaaauggaaauaauaugcuagucauaacuguacu

SEQ ID NO: 358000 - RNA, 64 nt, Homo Sapiens
ccuagauaaaaauucagucuacuguagaauaauguggaaauaacggaaguugacucucuuuuuc

SEQ ID NO: 358001 - RNA, 64 nt, Homo Sapiens
uaaugugauguuucucuuccuuggcuauuuucuuuggaaauaaauuguguacauggcgcugcau

SEQ ID NO: 358002 - RNA, 64 nt, Homo Sapiens
cgcggggagcggccgcuucacguuaggcucgccauggaaauacggacggugcaucagcaugccg

SEQ ID NO: 358003 - RNA, 64 nt, Homo Sapiens
guucugaugggucccaaaagcaauuuuacaauuauggaaauauaaacagacuuuagcuuacagu

SEQ ID NO: 358004 - RNA, 64 nt, Homo Sapiens
cagaugauuaaacagacuuucuacauaggcaaauuggaaauacacacuaucuaucugccuuuac

SEQ ID NO: 358005 - RNA, 64 nt, Homo Sapiens
agacaugaaauguacuagaggagcccuuuuccaauggaaauauuauauaccacauuuuuuguua

SEQ ID NO: 358006 - RNA, 64 nt, Homo Sapiens
caauggaaauauuauauaccacauuuuuuguuaauggaaauaaaugucuucauucccauguuuu

SEQ ID NO: 358007 - RNA, 64 nt, Homo Sapiens
auuucuacccugaagaacuaaugacagcaaucauuggaaauacugauuaugacuggaaacaguu

SEQ ID NO: 358008 - RNA, 64 nt, Homo Sapiens
cgugauaggcugcaugcaagaggcauacagaaaauggaaauaguauuucgcuguccugaaacuu

SEQ ID NO: 358009 - RNA, 64 nt, Homo Sapiens
uuaagauaggaaugcuagugucucuuuaauuaauuggaaauagauggaggcuaaaaaugaaggu

SEQ ID NO: 358010 - RNA, 64 nt, Homo Sapiens
uguguauguuaaaauagaaaauuuugaggaaaaauggaaauaggguggaaaaguacucgguaaa

SEQ ID NO: 358011 - RNA, 64 nt, Homo Sapiens
caggcaguucagauuuaaagcaccauccaaaccuuggaaauacgacagggugugguagaauuca

SEQ ID NO: 358012 - RNA, 64 nt, Homo Sapiens
aggaaacagauuuugggcaggacauuccaugcacuggaaauagcaugaacaaaugcaugaaaau

SEQ ID NO: 358013 - RNA, 64 nt, Homo Sapiens
ugcccaaagucauguuaccaguuggugacagagcuggaaauacguagagaucuauacccuuaaa

SEQ ID NO: 358014 - RNA, 64 nt, Homo Sapiens
augaagaaaaagucaaggaaggaggugauacaauuggaaauauucccaucaaaugguuaaucuu

SEQ ID NO: 358015 - RNA, 64 nt, Homo Sapiens
auuuguaaauauaugaaagaacaauauuuacaaguggaaauaaauaacuugguuuuaaauguug

SEQ ID NO: 358016 - RNA, 64 nt, Homo Sapiens
uaguuuuuuaaauuuuuaauuuauacacguguauuggaaauaucuuagugaaugucuggcauga

SEQ ID NO: 358017 - RNA, 64 nt, Homo Sapiens
cuuuaaagauuguuucuguucaccagguuuagcuuggaaauaaccacauaaauuucuggagaac

SEQ ID NO: 358018 - RNA, 64 nt, Homo Sapiens
uuugcauguaacccaaaauuccugucucaacuaauggaaauauaaguguagugcaggaaacagc

SEQ ID NO: 358019 - RNA, 64 nt, Homo Sapiens
ugggcgucuuguaccuggcugccguaagauaaacuggaaauauuugugggagaauaggagucca

SEQ ID NO: 358020 - RNA, 64 nt, Homo Sapiens
aaauuuuuuuuaguucuaaucauugaugauagcuuggaaauaaauaauuaugccauggcauuug

SEQ ID NO: 358021 - RNA, 64 nt, Homo Sapiens
uaugcauucugacauuacauauuuuuuaagacuauggaaauaauuuaaagauuuaagcucuggu

SEQ ID NO: 358022 - RNA, 64 nt, Homo Sapiens
ugaucauagaaggugcuuuuuaaaaaaaaaucaguggaaauaaaaugcaugaucucagagugau

SEQ ID NO: 358023 - RNA, 64 nt, Homo Sapiens
gucugguuuuuguaaauguuuuacuaaggaaaacuggaaauacugaaggggacugcguuaacgg

SEQ ID NO: 358024 - RNA, 64 nt, Homo Sapiens
guaggaaagaauuuguaucauauaagugaacaacuggaaauaaaaaaugaaguauuucauguaa

SEQ ID NO: 358025 - RNA, 64 nt, Homo Sapiens
ccuaccucuuccguuggaaaugauuuuucauauguggaaauauauuuugauuuauggcuguucc

SEQ ID NO: 358026 - RNA, 64 nt, Homo Sapiens
ugauuuaaaaacauauauuacuuguaagcauuucuggaaauauucauugcuagauuuaaaggga

SEQ ID NO: 358027 - RNA, 64 nt, Homo Sapiens
ccuugaaaauaguuuuugauaccuauuagguaaauggaaauaauuauaacuuuuaaauggaaaa

SEQ ID NO: 358028 - RNA, 64 nt, Homo Sapiens
uuugagguaauuuugcaaaugugguuuuuuuacuuggaaauaacugcacauuuauauauaggau

SEQ ID NO: 358029 - RNA, 64 nt, Homo Sapiens
caugaaaccuagcuccucuacacacaaauuccuauggaaauaccuuuguguacagugucuuaca

SEQ ID NO: 358030 - RNA, 64 nt, Homo Sapiens
aguuugauguuugcuagccgaugugaccucuagauggaaauaaaacaaacuuguauguaucugu

SEQ ID NO: 358031 - RNA, 64 nt, Homo Sapiens
acuuugcuucuuuaugaaaguaaccuagugaaccuggaaauacaaguaacauauuuuucuccca

SEQ ID NO: 358032 - RNA, 64 nt, Homo Sapiens
gaguuggcaugaaaguggcuaagauuuucuauuauggaaauaaaaacacuaaagguggaaauaa

SEQ ID NO: 358033 - RNA, 64 nt, Homo Sapiens
agauuuucuauuauggaaaugggaacacuaaagguggaaauaaauguggucaucuauucuagca

SEQ ID NO: 358034 - RNA, 64 nt, Homo Sapiens
acaaaaaguaaaccaaacaaaacgaaugaaaaacuggaaauaauucguuuccauaucuuuccau

SEQ ID NO: 358035 - RNA, 64 nt, Homo Sapiens
uuguacuaacucagcauguaacaaccaauuuacauggaaauaaaucgaaauaugauaacuauua

SEQ ID NO: 358036 - RNA, 64 nt, Homo Sapiens
augguuaagacaccaguaacaaaaacacaugauuuggaaauacuuuggcuuuuucauauaccua

SEQ ID NO: 358037 - RNA, 64 nt, Homo Sapiens
guauaaucuguauuugaaaucauuuugcaaucuauggaaauagaguagcaauugcuauuucuaa

SEQ ID NO: 358038 - RNA, 64 nt, Homo Sapiens
auaggcagauuuccuuugguuaauauuuuucuaauggaaauaaaggaacaaaauguuauauaga

SEQ ID NO: 358039 - RNA, 64 nt, Homo Sapiens
auguaauagggagaguugaaaucugaagcuauuauggaaauaccagugugaguuugaugaaaau

SEQ ID NO: 358040 - RNA, 64 nt, Homo Sapiens
gucugcuaaauggauauauuguguguguugcuguuggaaauagccccaccccauccucccaauc

SEQ ID NO: 358041 - RNA, 64 nt, Homo Sapiens
cuggacuguuguaaccuuagguuguaaucugauuuggaaauaaguacaucuuuaaaaguugcua

SEQ ID NO: 358042 - RNA, 64 nt, Homo Sapiens
gggagauauuacaauaaagcugccagugauguucuggaaauaaucuugcauacaaguuucuagu

SEQ ID NO: 358043 - RNA, 64 nt, Homo Sapiens
uacaacuaauaggacacaugcuacauaaguucucuggaaauaucaaauuuguaauguguugcuu

SEQ ID NO: 358044 - RNA, 64 nt, Homo Sapiens
uuccuggaaaaugcauuuaaugaucuaucuguauuggaaauaugguuauucacuguguuuuuga

SEQ ID NO: 358045 - RNA, 64 nt, Homo Sapiens
augaaaucuucauugucaaaaccuuuaauaaaaguggaaauauuuugaaaugcccuuuuucuug

SEQ ID NO: 358046 - RNA, 64 nt, Homo Sapiens
aaaaauguauaauaacucaguuuuucuugguuuauggaaauaucuauauuaaugugaaaauaau

SEQ ID NO: 358047 - RNA, 64 nt, Homo Sapiens
ugugccuuugagccuauacuauacuguguauguguggaaauaaaaauguauuguacuuuuggag

SEQ ID NO: 358048 - RNA, 64 nt, Homo Sapiens
ugguggaccuauuacccuauggguaagaaauaaauggaaauaugacaucggauguuucagcaac

SEQ ID NO: 358049 - RNA, 64 nt, Homo Sapiens
ccacucagugugauaauugugucuacagcuaaaauggaaauaguuuuaucuguacaguugugca

SEQ ID NO: 358050 - RNA, 64 nt, Homo Sapiens
auccugcauaauagcuauuguuuucauuuccuguuggaaauauucaaauauuuuaauauuucug

SEQ ID NO: 358051 - RNA, 64 nt, Homo Sapiens
uuccaacucuccuaagaggcuuugcuuuucaaaauggaaauaaagaaaaucugcccugcuagaa

SEQ ID NO: 358052 - RNA, 64 nt, Homo Sapiens
uuguauucuaaaaacucacuuauggaagaagguauggaaauacuauuuccaucauggaaggugg

SEQ ID NO: 358053 - RNA, 64 nt, Homo Sapiens
uauccauugguaauaauguuuuuuguuaaaggaauggaaauauauuuuaacaucuuaaaguugc

SEQ ID NO: 358054 - RNA, 64 nt, Homo Sapiens
acucaagguuguaaaaccccccaguauuuuuuuauggaaauaaugggguaggggagacacuuua

SEQ ID NO: 358055 - RNA, 64 nt, Homo Sapiens
ucaugcuuuuaaaaagauguuuuaguucuauggauggaaauauuaaaucgggagaaaaauccau

SEQ ID NO: 358056 - RNA, 64 nt, Homo Sapiens
aauguaugaaaauuuacauuugaucauccggcauuggaaauaguuugaacuauuuccaaaaauc

SEQ ID NO: 358057 - RNA, 64 nt, Homo Sapiens
gaggcaaggucuguagugcuucuuuaacuaccuuuggaaauacuguacaauguuagaauaauuu

SEQ ID NO: 358058 - RNA, 64 nt, Homo Sapiens
aguauguguauauuuaauaggggaagguaguuuauggaaauauuuuuaauggaauaguuuuccc

SEQ ID NO: 358059 - RNA, 64 nt, Homo Sapiens
uccugaugggcccacaaguuuuucuauauuuaacuggaaauaugcuuugauuuuguguuauuaa

SEQ ID NO: 358060 - RNA, 64 nt, Homo Sapiens
gguugaaggucacagaaguagugguuugcuuugauggaaauagcuacagcugugucccuuccug

SEQ ID NO: 358061 - RNA, 64 nt, Homo Sapiens
aaggcuaaacacuauguaaaugugaauggaaacuuggaaauacucguuuuuauaaacuacaaaa

SEQ ID NO: 358062 - RNA, 64 nt, Homo Sapiens
uguggugggggaguggguauuacaugcauugcugaagagucauccugguguuccucauuccucc

SEQ ID NO: 358063 - RNA, 64 nt, Homo Sapiens
uuuuaucauauuuccaccaucacuucaggguuuuaagagucagugcucaccugggcggagcugg

SEQ ID NO: 358064 - RNA, 64 nt, Homo Sapiens
uggugcuuuaaauuaagucuguuuacuaugaaacaagagucauuuuuagaggauuuuaacaggu

SEQ ID NO: 358065 - RNA, 64 nt, Homo Sapiens
ccaaaaggagaugagggaacaggauagguuucagaagagucaaaugcuucuaaugucucaaggu

SEQ ID NO: 358066 - RNA, 64 nt, Homo Sapiens
uugcuauauggucaaagguuaauuuguuagcaucaagagucaagauaaaagagagaagagaggu

SEQ ID NO: 358067 - RNA, 64 nt, Homo Sapiens
uacucacccgcuauuagaguauacucaccuguggaagagucagccaucuguugacacagcuuuu

SEQ ID NO: 358068 - RNA, 64 nt, Homo Sapiens
cuggaguggagaugauuguccacgugggcguaguggggagcaccccagcccgacccugacacug

SEQ ID NO: 358069 - RNA, 64 nt, Homo Sapiens
ucaggcccucccuaggccuguuggggacggagauggggagcaggccggacccugccccuccaag

SEQ ID NO: 358070 - RNA, 64 nt, Homo Sapiens
guucuccucaaagccucacaugaauaccccgaguggggagcaggugcuuuuagggauuauuuuu

SEQ ID NO: 358071 - RNA, 64 nt, Homo Sapiens
uaccuuacuuucagggacagcagugaggaggcuuggggagcacccuugucuguaucagauuugg

SEQ ID NO: 358072 - RNA, 64 nt, Homo Sapiens
gugccugggagggccgaaccacuggugagggcguggggagcaggggguggcagagggcacccgg

SEQ ID NO: 358073 - RNA, 64 nt, Homo Sapiens
cggggcugcggggugagaggaagaaagcaaacccggggagcaggcggcugccgcacccgcgcac

SEQ ID NO: 358074 - RNA, 64 nt, Homo Sapiens
guccacagccuuguccagaguuccuguguagcacggggagcaaugauggagggagccccugaga

SEQ ID NO: 358075 - RNA, 64 nt, Homo Sapiens
agauggggauggaggaggaaggcugauauccucuggggagcacaucaccugaaggugccaagga

SEQ ID NO: 358076 - RNA, 64 nt, Homo Sapiens
caggaaauuccacagcugccggcaggcaggagagggggagcaaaccccguguguccucaucugc

SEQ ID NO: 358077 - RNA, 64 nt, Homo Sapiens
uugguccaugugccuucaggucggguggcgggauggggagcagcgguggggcagggaugguguu

SEQ ID NO: 358078 - RNA, 64 nt, Homo Sapiens
uguuucagacugggcaugaaggggcgcuggguuaggggagcaccguggaguggagccucaucga

SEQ ID NO: 358079 - RNA, 64 nt, Homo Sapiens
augggcaggugagggcaggacccacccacccuugggggagcauggcauguguggccacuguacc

SEQ ID NO: 358080 - RNA, 64 nt, Homo Sapiens
gcagugcugugucugcugcccagcaacauuggagggggagcagguggaggcucauugaggcaag

SEQ ID NO: 358081 - RNA, 64 nt, Homo Sapiens
agaaaagcaggaagaauuuacagucaagcucuuaggggagcagaagcccagcccacccacauac

SEQ ID NO: 358082 - RNA, 64 nt, Homo Sapiens
gaggggaugagcgguaccuucucuucccucuuguggggagcaagagagaaacagcagccuuugu

SEQ ID NO: 358083 - RNA, 64 nt, Homo Sapiens
gcugaggggcgaagaggacagguugaccugccuuggggagcaggcaaauggagccagcggcugu

SEQ ID NO: 358084 - RNA, 64 nt, Homo Sapiens
ccacucuaagugauuccuccagggugggaagcacggggagcaauggaaucagauggcucauucu

SEQ ID NO: 358085 - RNA, 64 nt, Homo Sapiens
aggaaucccuugggucagcuccuauccucuggacggggagcaucaugggaaaaagagguccgag

SEQ ID NO: 358086 - RNA, 64 nt, Homo Sapiens
uuucagggugaaauucaggccuucuucagaugauggggagcacuaugccuguuaccaggugcug

SEQ ID NO: 358087 - RNA, 64 nt, Homo Sapiens
acuugggcucacaggcugguguacgagggaggaaggggagcaaggcgcccaggggcgggcgggg

SEQ ID NO: 358088 - RNA, 64 nt, Homo Sapiens
caaauguccaucuuucucagacggggcucugucuggggagcacccacaggcugccuuugggguc

SEQ ID NO: 358089 - RNA, 64 nt, Homo Sapiens
cacugcgcgccucucccaggucucagcucuggguggggagcaguggccgcuaccgacagcgcau

SEQ ID NO: 358090 - RNA, 64 nt, Homo Sapiens
cccguggcaggaggagggcuccaugagagaaggaggggagcaggcccgaggcuacagcagaccc

SEQ ID NO: 358091 - RNA, 64 nt, Homo Sapiens
ucgugccuugucauuuuauuugccuacugaguagggggagcaaaaugcaaacucaccgcuccaa

SEQ ID NO: 358092 - RNA, 64 nt, Homo Sapiens
uccucgccuccguccggcugccacagggcccugcggggagcacacagaggagcggggcaggcag

SEQ ID NO: 358093 - RNA, 64 nt, Homo Sapiens
uggacaugggccuccugaggggggagaggaaugaggggagcagcgaagcaccugaggccaagca

SEQ ID NO: 358094 - RNA, 64 nt, Homo Sapiens
guucugggagcucugcaaaaagcuggagccaguuggggagcacgaagagaauccaggcuggcag

SEQ ID NO: 358095 - RNA, 64 nt, Homo Sapiens
ucucaggccucuuguccucuggaggugccuggguggggagcaggcgcuccucugucuugucagu

SEQ ID NO: 358096 - RNA, 62 nt, Homo Sapiens
uaggaggagcucucaauuuuauguauucuuucugccuuuaauuuucuuguuuguuugagcuu

SEQ ID NO: 358097 - RNA, 62 nt, Homo Sapiens
uuggucucccuggaggggacuuccacaccuccugccuuuaggccauggguggaaagugcuca

SEQ ID NO: 358098 - RNA, 62 nt, Homo Sapiens
ccugacagcugcugcacuagcagcucugccugugccuuuauccccagacaacuccgucaccc

SEQ ID NO: 358099 - RNA, 62 nt, Homo Sapiens
agaucuaacuaugggaugggcacuucuagaugugccuuuaaaaccccugccuccaguugcac

SEQ ID NO: 358100 - RNA, 62 nt, Homo Sapiens
gcucccaaccagcuguuaggaccccacccuuuugccuuuauugucgacgugacucaccagac

SEQ ID NO: 358101 - RNA, 62 nt, Homo Sapiens
cuuuuccuguuuuuauuuugguauuaagucguugccuuuauuuguaaagcuguuauaaauau

SEQ ID NO: 358102 - RNA, 62 nt, Homo Sapiens
ugugagcuuccaguagguaagaaaccuuuucaugccuuuagauuugggucaguugauaaaag

SEQ ID NO: 358103 - RNA, 62 nt, Homo Sapiens
uuuuugugaaccaauuuuaauguucucuauuuugccuuuaaaauguguucaaggaccacaug

SEQ ID NO: 358104 - RNA, 62 nt, Homo Sapiens
aagacuuccacucgaugaugcuucuauaauuuugccuuuaacagaaacuuucaaaagggaag

SEQ ID NO: 358105 - RNA, 62 nt, Homo Sapiens
gugccuagguuuuggagaguuugccuguucuaugccuuuagucaggaauggcugcaccuuuu

SEQ ID NO: 358106 - RNA, 62 nt, Homo Sapiens
gaaaagccauacaaaugagaagaauguggcaaugccuuuaaucaguccucacaccuuucuac

SEQ ID NO: 358107 - RNA, 62 nt, Homo Sapiens
aagaaacccuacaaauguaaaaaacguggcaaugccuuuaacugguccucacaccuugcuac

SEQ ID NO: 358108 - RNA, 62 nt, Homo Sapiens
acuuucuagguauggaguuugauggacagggcugccuuuaaugagugugaaggucacuaagu

SEQ ID NO: 358109 - RNA, 62 nt, Homo Sapiens
uggaaaaaaauaucuauuuuggcagguuucugugccuuuauuucccucuucugaaaaaaagu

SEQ ID NO: 358110 - RNA, 62 nt, Homo Sapiens
aaucuguuccguuuuuuuccacaagucguuauugccuuuaaacaaaugaaacaagccgucuu

SEQ ID NO: 358111 - RNA, 62 nt, Homo Sapiens
cuaagaaauguauauguuaacaaauucacugcugccuuuacauacagauuuauugugagaca

SEQ ID NO: 358112 - RNA, 62 nt, Homo Sapiens
auuaaauaauauaacgugaagaacuguauuuuugccuuuaaaugaucuugguguucaaaaca

SEQ ID NO: 358113 - RNA, 62 nt, Homo Sapiens
gcuuugcgcaucucagaugccagucuuaucugugccuuuacugcugagcuggugccuggccc

SEQ ID NO: 358114 - RNA, 62 nt, Homo Sapiens
uuuuauauguagcauucacuucccucuuacugugccuuuagccuuuucauguuucugucuca

SEQ ID NO: 358115 - RNA, 62 nt, Homo Sapiens
aauguauaaucauuuaucacuaaauugcacauugccuuuauuuauuugugcucuguuuuugg

SEQ ID NO: 358116 - RNA, 62 nt, Homo Sapiens
gauacagugugaaaauuugcuaaagugauuuuugccuuuaaaggaggugauucagaaccuuu

SEQ ID NO: 358117 - RNA, 62 nt, Homo Sapiens
auuaccucacugugggcuggugaagggaaaagugccuuuaaauucagugaaugcagaacaaa

SEQ ID NO: 358118 - RNA, 62 nt, Homo Sapiens
cacuuaacaagccuaaccuucuguaauaaaauugccuuuaauaauagaauaaguacaugcug

SEQ ID NO: 358119 - RNA, 62 nt, Homo Sapiens
uaaaaagccuccuuuaucugauuuugguauuuugccuuuaaaaucaccuacaccagagagcc

SEQ ID NO: 358120 - RNA, 62 nt, Homo Sapiens
uagcuggucuccuuggguggaucacaugcacaugccuuuauaggaucaugagagagauauuu

SEQ ID NO: 358121 - RNA, 62 nt, Homo Sapiens
ucccaggaugacucuuuauggagggggcuggcugccuuuaugaagcucuggagugugccuag

SEQ ID NO: 358122 - RNA, 62 nt, Homo Sapiens
agagguauccaaagcuuuuaccaggucuuaauugccuuuagcgaacugcaaacucuaauagc

SEQ ID NO: 358123 - RNA, 62 nt, Homo Sapiens
aauuuuuuuauuuuuuaaagucagaaugauagugccuuuaaagucaacuucaacuugcauuc

SEQ ID NO: 358124 - RNA, 62 nt, Homo Sapiens
aaaugggaguacccaugguuaggauauagcuaugccuuuaugguuaagauuagaauauauga

SEQ ID NO: 358125 - RNA, 62 nt, Homo Sapiens
gauuaauagccuaaauaaagagaaaagccugaugccuuuaaaaaaaaugaaacacuuuggau

SEQ ID NO: 358126 - RNA, 62 nt, Homo Sapiens
ggauuuaucugcaguguucagggagauaauucugccuuuaauugucuaaaacaaaaacaaaa

SEQ ID NO: 358127 - RNA, 62 nt, Homo Sapiens
uuuucuccuuuuuucucuugcugcccacauugugccuuuauuuuaugagccccaguuuucug

SEQ ID NO: 358128 - RNA, 62 nt, Homo Sapiens
ucucuuuguuucuguuucuugcucucucucccugccuuuaaaugaaacaagucuagucuucu

SEQ ID NO: 358129 - RNA, 62 nt, Homo Sapiens
uugugagaaagggaugguggagugagagccuuugccuuuagggguguguauucacauagucc

SEQ ID NO: 358130 - RNA, 62 nt, Homo Sapiens
aucaccuacaccagagagcuauuuugguauuuugccuuuaaauaaaaagccuccuccauaug

SEQ ID NO: 358131 - RNA, 62 nt, Homo Sapiens
aauagaauaaguacaugcugcuguaauaaaauugccuuuaaucacuuaacaagccuaaccuu

SEQ ID NO: 358132 - RNA, 64 nt, Homo Sapiens
ggcucccuacccuuccauuaagaaucuaccaagcauuagcaaggcugaaaguggucuaagaggu

SEQ ID NO: 358133 - RNA, 64 nt, Homo Sapiens
acuuagcagagugcuauugacuauagauucacauauuagcaacaaaaucccguaauucuuuugg

SEQ ID NO: 358134 - RNA, 64 nt, Homo Sapiens
caaauccagcaauguauaaaaaguccuuaaaauaauuagcaaauuaucaugaauguagaaauaa

SEQ ID NO: 358135 - RNA, 64 nt, Homo Sapiens
uacuauuuuguuuuuuugucuuaagucauuacuuauuagcaaguuguugauguuuuuugaagca

SEQ ID NO: 358136 - RNA, 64 nt, Homo Sapiens
uguacuaagaaacgaaacaaccaccuuccuuuugauuagcaauuuuguuauuaaacuaucaucu

SEQ ID NO: 358137 - RNA, 64 nt, Homo Sapiens
cagaaaacuggcugcugggucuuuuuugggggggauuagcaaaguuuuuguagucuuugcuuga

SEQ ID NO: 358138 - RNA, 64 nt, Homo Sapiens
uacaggagaagugacauacuuuauauauguuuauauuagcaaggucuguuuuuaauaccauaua

SEQ ID NO: 358139 - RNA, 64 nt, Homo Sapiens
auuaaauccuugaccuugugcauuauagcauuccauuagcaagaguuguacccccuccccaguc

SEQ ID NO: 358140 - RNA, 64 nt, Homo Sapiens
auaauguuuguauaugcaaaacugauucuuguauauuagcaauucugggugggggugacucuuc

SEQ ID NO: 358141 - RNA, 64 nt, Homo Sapiens
caguguauauacaagaagccuuggcgcgugugcaauuagcaaugaaaucacuuucauuuccgga

SEQ ID NO: 358142 - RNA, 64 nt, Homo Sapiens
uuuuaagaaguauuuaaaaaacacacagaagcuaauuagcaagucacuugucuugugugucuga

SEQ ID NO: 358143 - RNA, 64 nt, Homo Sapiens
ugauccaaaaugggaggccucauacuuaagacauauuagcaaguauuauugccgucauuauuua

SEQ ID NO: 358144 - RNA, 64 nt, Homo Sapiens
ccacauuauuucuuaaucugaacaugaaggcuccauuagcaacacuaaaacuugaucauuaaca

SEQ ID NO: 358145 - RNA, 64 nt, Homo Sapiens
uuugcuuuguacgucugccaagaaucuuccaguuauuagcaaacucagacgaauguaccgccag

SEQ ID NO: 358146 - RNA, 64 nt, Homo Sapiens
gggucuuacuaucauuguagugugauuucuuuguauuagcaaagacaaaaacgcuaacauugaa

SEQ ID NO: 358147 - RNA, 64 nt, Homo Sapiens
aucaauaauucaauuuugugucuuuucucaauuuauuagcaaacacaagacauuuuauguauua

SEQ ID NO: 358148 - RNA, 64 nt, Homo Sapiens
uaauucauuguuagguaaacgguauuugcucuccauuagcaaaauccaugugacuaguguauau

SEQ ID NO: 358149 - RNA, 64 nt, Homo Sapiens
cgaaaggauggguaaccuucagucuacauuaaaaauuagcaacccaguuuugaucuacagggcc

SEQ ID NO: 358150 - RNA, 64 nt, Homo Sapiens
auauuucauuuaucccuguagaaauacauguacuauuagcaaucuuaggauauauacuugaaug

SEQ ID NO: 358151 - RNA, 64 nt, Homo Sapiens
gagagcccagggauguccuauucuucagcagcccauuagcaacucucgauuugaggacauucau

SEQ ID NO: 358152 - RNA, 64 nt, Homo Sapiens
cuaauauaaaugggagguuuuacugucaaguccaauuagcaaaacgugguaauaauuuuuuugu

SEQ ID NO: 358153 - RNA, 64 nt, Homo Sapiens
ugguaccauguaacagaaugagagcuaauuccaaauuagcaacuucauccugcuuucuauuuua

SEQ ID NO: 358154 - RNA, 64 nt, Homo Sapiens
ugacccuggcccagcucuacgggucucugcccagcacaggaagcccagccugagcccccaccag

SEQ ID NO: 358155 - RNA, 64 nt, Homo Sapiens
gguguggagaccugcccucgaaccugcaggcucccacaggaagaagucggcugccuggccgggg

SEQ ID NO: 358156 - RNA, 64 nt, Homo Sapiens
acuccuuuuccuuuuggaucauagcuuaacaaggcacaggaagggaagggaucuugacuaagau

SEQ ID NO: 358157 - RNA, 64 nt, Homo Sapiens
ucugaacauuguuaauggccugugacaugaugagcacaggaacaggcaugaagauauugccaua

SEQ ID NO: 358158 - RNA, 64 nt, Homo Sapiens
acaugucaaucuuggucaucuucuccaccacugucacaggaagggacagaguuaucaaggcaca

SEQ ID NO: 358159 - RNA, 64 nt, Homo Sapiens
accugccaagcuuggucaucuacuucaccacugucacaggaagagacagaguuaucgaggcaca

SEQ ID NO: 358160 - RNA, 64 nt, Homo Sapiens
acuugccaagcuuggucaucuacuucaccaccgucacaggaagcgacagaguuaucgaggcaca

SEQ ID NO: 358161 - RNA, 64 nt, Homo Sapiens
aggcuuccuugguuuccauguagaauauucucagcacaggaaugguggcagcagcaggagcuac

SEQ ID NO: 358162 - RNA, 64 nt, Homo Sapiens
ugacacauaguaggcacacaucucccucguacagcacaggaacccauccgcagccugggaaccu

SEQ ID NO: 358163 - RNA, 64 nt, Homo Sapiens
cccacagccagcucuuggcuccaagaugagcacccacaggaagccgacccaggccugaggggcc

SEQ ID NO: 358164 - RNA, 64 nt, Homo Sapiens
ugagauucuugucugcccucauaucacgcugccccacaggaaugcugcugggaaaagcagggcc

SEQ ID NO: 358165 - RNA, 64 nt, Homo Sapiens
gauacauaaucucaugggacuucagugggaguuacacaggaauguugaagaaucauucuucuuu

SEQ ID NO: 358166 - RNA, 64 nt, Homo Sapiens
uggguuaucugcaucucaaaagaaaaugcuuacccacaggaacuguuaacucagggguucuuaa

SEQ ID NO: 358167 - RNA, 64 nt, Homo Sapiens
ucagaucuugugagacuuacuaucacgagaauagcacaggaaagacuggcccccaugauucaau

SEQ ID NO: 358168 - RNA, 64 nt, Homo Sapiens
ucagaucucaugagacuuacuaucaugagaauagcacaggaaagacuggccccccugauucgau

SEQ ID NO: 358169 - RNA, 64 nt, Homo Sapiens
cggugauucuugcccuuaauuaugggaauguauucacaggaagagcuuaguggaauucuuaaau

SEQ ID NO: 358170 - RNA, 64 nt, Homo Sapiens
aucaacaagauagugaucuccugcagaagaaauucacaggaaaacauucuuuuuaagcuugaaa

SEQ ID NO: 358171 - RNA, 64 nt, Homo Sapiens
ccuuccagacauacgaaacacaaaccacaacugacacaggaaaccaacacccaaagcauggacu

SEQ ID NO: 358172 - RNA, 64 nt, Homo Sapiens
aaaccaacacccaaagcauggacuaaccccaacgcacaggaaaagguagcuuaccugacacaag

SEQ ID NO: 358173 - RNA, 56 nt, Homo Sapiens
gguauguccuggugaauuagucucagcacaggaauugaggugggucaggugaagga

SEQ ID NO: 358174 - RNA, 64 nt, Homo Sapiens
aaggcaaaucaagaagacaucaggaaaucagaugcacaggaaauaaaggaaagcugugcuuugu

SEQ ID NO: 358175 - RNA, 64 nt, Homo Sapiens
ucaucucauccugugggauucugcaaucauaaaacacaggaaaggggaauucugugauggcaaa

SEQ ID NO: 358176 - RNA, 64 nt, Homo Sapiens
ggauggauagaaaaaaagcacuuacauuggggcacacaggaaaucccagugucuagcaaugguu

SEQ ID NO: 358177 - RNA, 64 nt, Homo Sapiens
ccuuuacuuuacagcuucccuuuauaauuuguuacacaggaauaguuaaaugcauuuguuuguu

SEQ ID NO: 358178 - RNA, 64 nt, Homo Sapiens
agaggacugccuaguagcaaagguuauuccuggacacaggaaagacgggcauuacagggaccaa

SEQ ID NO: 358179 - RNA, 64 nt, Homo Sapiens
agguaggacagcugcuccccaagccuccugaggacacaggaagagacggaaggagcaccuugac

SEQ ID NO: 358180 - RNA, 64 nt, Homo Sapiens
gccuggugugaaaugaucuauggccuguuucuuacacaggaagcccccugaaccuccuguacau

SEQ ID NO: 358181 - RNA, 64 nt, Homo Sapiens
uccccgacugugccacgugguaggacacauaggacacaggaauuccuggguccuugcccaugac

SEQ ID NO: 358182 - RNA, 64 nt, Homo Sapiens
ugcccaugacugugccaugugguaggacacaggacacaggaauuccuggaaagugguggcuuca

SEQ ID NO: 358183 - RNA, 64 nt, Homo Sapiens
gacugguaauggaaaaaaugugaauguaacugugcacaggaaauggaggggggagcagguuuua

SEQ ID NO: 358184 - RNA, 64 nt, Homo Sapiens
gcagcgaaaccugcacccucugacccacugaccacacaggaaaauauagccugaugucccacau

SEQ ID NO: 358185 - RNA, 64 nt, Homo Sapiens
agaaaagugugcgcuccauuaaaauuaauauaggcacaggaaagcacagagauuagggggacuu

SEQ ID NO: 358186 - RNA, 64 nt, Homo Sapiens
ugccucuacuugacuuggaauuggcugaagacuacacaggaaugcaucguucccacuccccauc

SEQ ID NO: 358187 - RNA, 64 nt, Homo Sapiens
ccggucccucugcuggggaugcaccaaugaaccccacaggaagggggaaggaaggagggaauuu

SEQ ID NO: 358188 - RNA, 64 nt, Homo Sapiens
aaaaagaaaagaaagcaagaacagaaaacgaagccacaggaagggaaguagacauuguaugcuu

SEQ ID NO: 358189 - RNA, 64 nt, Homo Sapiens
acucugagcuugugcccagaaauuaccccaagaccacaggaacccuucaagaagcucccaucac

SEQ ID NO: 358190 - RNA, 64 nt, Homo Sapiens
acaucuagcuuaugugaagaaacacugacaggagcacaggaaaaauuaaccauacagugugauc

SEQ ID NO: 358191 - RNA, 64 nt, Homo Sapiens
caugugcuacaaaggagcuucuaaggcccuggcacacaggaacaauuacaugagaugccuuagg

SEQ ID NO: 358192 - RNA, 64 nt, Homo Sapiens
agaaaaagaaaucuguugaaaagaagaacguaagcacaggaaagccaugauguacccuccgaga

SEQ ID NO: 358193 - RNA, 64 nt, Homo Sapiens
gagaaaugguugaugucagagcucuguagaaacacacaggaacauuucagaaagauaggagaua

SEQ ID NO: 358194 - RNA, 64 nt, Homo Sapiens
gcuaccauaacgauauggaaucagaucuuauuagcacaggaaugcuucaugucccucauccagc

SEQ ID NO: 358195 - RNA, 64 nt, Homo Sapiens; identical to SEQ ID NO: 171556

SEQ ID NO: 358196 - RNA, 64 nt, Homo Sapiens; identical to SEQ ID NO: 171557

SEQ ID NO: 358197 - RNA, 64 nt, Homo Sapiens; identical to SEQ ID NO: 171558

SEQ ID NO: 358198 - RNA, 64 nt, Homo Sapiens; identical to SEQ ID NO: 171559

SEQ ID NO: 358199 - RNA, 64 nt, Homo Sapiens; identical to SEQ ID NO: 171560

SEQ ID NO: 358200 - RNA, 64 nt, Homo Sapiens; identical to SEQ ID NO: 171561

SEQ ID NO: 358201 - RNA, 64 nt, Homo Sapiens; identical to SEQ ID NO: 171562

SEQ ID NO: 358202 - RNA, 64 nt, Homo Sapiens; identical to SEQ ID NO: 171563

SEQ ID NO: 358203 - RNA, 64 nt, Homo Sapiens; identical to SEQ ID NO: 171564

SEQ ID NO: 358204 - RNA, 64 nt, Homo Sapiens; identical to SEQ ID NO: 171565

SEQ ID NO: 358205 - RNA, 64 nt, Homo Sapiens; identical to SEQ ID NO: 171566

SEQ ID NO: 358206 - RNA, 64 nt, Homo Sapiens; identical to SEQ ID NO: 171567

SEQ ID NO: 358207 - RNA, 64 nt, Homo Sapiens; identical to SEQ ID NO: 171568

SEQ ID NO: 358208 - RNA, 64 nt, Homo Sapiens; identical to SEQ ID NO: 171569

SEQ ID NO: 358209 - RNA, 64 nt, Homo Sapiens; identical to SEQ ID NO: 171570

SEQ ID NO: 358210 - RNA, 64 nt, Homo Sapiens; identical to SEQ ID NO: 171571

SEQ ID NO: 358211 - RNA, 64 nt, Homo Sapiens; identical to SEQ ID NO: 171572

SEQ ID NO: 358212 - RNA, 64 nt, Homo Sapiens; identical to SEQ ID NO: 171573

SEQ ID NO: 358213 - RNA, 64 nt, Homo Sapiens; identical to SEQ ID NO: 171574

SEQ ID NO: 358214 - RNA, 64 nt, Homo Sapiens; identical to SEQ ID NO: 171575

SEQ ID NO: 358215 - RNA, 64 nt, Homo Sapiens; identical to SEQ ID NO: 171576

SEQ ID NO: 358216 - RNA, 64 nt, Homo Sapiens; identical to SEQ ID NO: 171577

SEQ ID NO: 358217 - RNA, 64 nt, Homo Sapiens; identical to SEQ ID NO: 171578

SEQ ID NO: 358218 - RNA, 64 nt, Homo Sapiens; identical to SEQ ID NO: 171579

SEQ ID NO: 358219 - RNA, 64 nt, Homo Sapiens; identical to SEQ ID NO: 171580

SEQ ID NO: 358220 - RNA, 64 nt, Homo Sapiens; identical to SEQ ID NO: 171581

SEQ ID NO: 358221 - RNA, 64 nt, Homo Sapiens; identical to SEQ ID NO: 171582

SEQ ID NO: 358222 - RNA, 64 nt, Homo Sapiens; identical to SEQ ID NO: 171583

SEQ ID NO: 358223 - RNA, 64 nt, Homo Sapiens; identical to SEQ ID NO: 171584

SEQ ID NO: 358224 - RNA, 64 nt, Homo Sapiens; identical to SEQ ID NO: 171585

SEQ ID NO: 358225 - RNA, 64 nt, Homo Sapiens; identical to SEQ ID NO: 171586

SEQ ID NO: 358226 - RNA, 64 nt, Homo Sapiens; identical to SEQ ID NO: 171587

SEQ ID NO: 358227 - RNA, 64 nt, Homo Sapiens; identical to SEQ ID NO: 171588

SEQ ID NO: 358228 - RNA, 64 nt, Homo Sapiens; identical to SEQ ID NO: 171589

SEQ ID NO: 358229 - RNA, 64 nt, Homo Sapiens; identical to SEQ ID NO: 171590

SEQ ID NO: 358230 - RNA, 64 nt, Homo Sapiens; identical to SEQ ID NO: 171591

SEQ ID NO: 358231 - RNA, 64 nt, Homo Sapiens; identical to SEQ ID NO: 171592

SEQ ID NO: 358232 - RNA, 64 nt, Homo Sapiens; identical to SEQ ID NO: 171593

SEQ ID NO: 358233 - RNA, 64 nt, Homo Sapiens; identical to SEQ ID NO: 171594

SEQ ID NO: 358234 - RNA, 64 nt, Homo Sapiens; identical to SEQ ID NO: 171595

SEQ ID NO: 358235 - RNA, 64 nt, Homo Sapiens; identical to SEQ ID NO: 171596

SEQ ID NO: 358236 - RNA, 64 nt, Homo Sapiens; identical to SEQ ID NO: 171597

SEQ ID NO: 358237 - RNA, 64 nt, Homo Sapiens; identical to SEQ ID NO: 171598

SEQ ID NO: 358238 - RNA, 64 nt, Homo Sapiens; identical to SEQ ID NO: 171599

SEQ ID NO: 358239 - RNA, 64 nt, Homo Sapiens; identical to SEQ ID NO: 171600

SEQ ID NO: 358240 - RNA, 64 nt, Homo Sapiens; identical to SEQ ID NO: 171601

SEQ ID NO: 358241 - RNA, 64 nt, Homo Sapiens; identical to SEQ ID NO: 171602

SEQ ID NO: 358242 - RNA, 64 nt, Homo Sapiens; identical to SEQ ID NO: 171603

SEQ ID NO: 358243 - RNA, 64 nt, Homo Sapiens; identical to SEQ ID NO: 171604

SEQ ID NO: 358244 - RNA, 64 nt, Homo Sapiens; identical to SEQ ID NO: 171605

SEQ ID NO: 358245 - RNA, 64 nt, Homo Sapiens; identical to SEQ ID NO: 171606

SEQ ID NO: 358246 - RNA, 64 nt, Homo Sapiens; identical to SEQ ID NO: 171607

SEQ ID NO: 358247 - RNA, 64 nt, Homo Sapiens; identical to SEQ ID NO: 171608

SEQ ID NO: 358248 - RNA, 64 nt, Homo Sapiens; identical to SEQ ID NO: 171609

SEQ ID NO: 358249 - RNA, 64 nt, Homo Sapiens; identical to SEQ ID NO: 171610

SEQ ID NO: 358250 - RNA, 64 nt, Homo Sapiens; identical to SEQ ID NO: 171611

SEQ ID NO: 358251 - RNA, 64 nt, Homo Sapiens; identical to SEQ ID NO: 171612

SEQ ID NO: 358252 - RNA, 64 nt, Homo Sapiens; identical to SEQ ID NO: 171613

SEQ ID NO: 358253 - RNA, 64 nt, Homo Sapiens; identical to SEQ ID NO: 171614

SEQ ID NO: 358254 - RNA, 64 nt, Homo Sapiens; identical to SEQ ID NO: 171615

SEQ ID NO: 358255 - RNA, 64 nt, Homo Sapiens; identical to SEQ ID NO: 171616

SEQ ID NO: 358256 - RNA, 64 nt, Homo Sapiens; identical to SEQ ID NO: 171617

SEQ ID NO: 358257 - RNA, 64 nt, Homo Sapiens; identical to SEQ ID NO: 171618

SEQ ID NO: 358258 - RNA, 64 nt, Homo Sapiens; identical to SEQ ID NO: 171619

SEQ ID NO: 358259 - RNA, 64 nt, Homo Sapiens; identical to SEQ ID NO: 171620

SEQ ID NO: 358260 - RNA, 64 nt, Homo Sapiens; identical to SEQ ID NO: 171621

SEQ ID NO: 358261 - RNA, 64 nt, Homo Sapiens; identical to SEQ ID NO: 171622

SEQ ID NO: 358262 - RNA, 64 nt, Homo Sapiens; identical to SEQ ID NO: 171623

SEQ ID NO: 358263 - RNA, 64 nt, Homo Sapiens; identical to SEQ ID NO: 171624

SEQ ID NO: 358264 - RNA, 64 nt, Homo Sapiens; identical to SEQ ID NO: 171625

SEQ ID NO: 358265 - RNA, 64 nt, Homo Sapiens; identical to SEQ ID NO: 171626

SEQ ID NO: 358266 - RNA, 64 nt, Homo Sapiens; identical to SEQ ID NO: 171627

SEQ ID NO: 358267 - RNA, 64 nt, Homo Sapiens; identical to SEQ ID NO: 171628

SEQ ID NO: 358268 - RNA, 64 nt, Homo Sapiens
aaacuguuauugcauuauaggggcuaagaaaguagcccucaaauuuguauuuuaaagauugaga

SEQ ID NO: 358269 - RNA, 64 nt, Homo Sapiens
guuuuucugggccuuguuuugguucuucccuccugcccucaauuuggaagguaucauccgugug

SEQ ID NO: 358270 - RNA, 64 nt, Homo Sapiens
cuuucccuggucuuuuagucuaguccuuuggcaagcccucaaccucagauuaauccuauuuauu

SEQ ID NO: 358271 - RNA, 64 nt, Homo Sapiens
aucacuacaagugucucacuucagccuuagaaaagcccucaauguaaaccuuauguuuguuacu

SEQ ID NO: 358272 - RNA, 64 nt, Homo Sapiens
ccguucggccccgccccccgcacugaacacacccgcccucaaccccgcacccuccgcacucacc

SEQ ID NO: 358273 - RNA, 64 nt, Homo Sapiens
uucaccauguuggccaggcuggucuccaacuccugcccucaagugauccgccucggucccauuu

SEQ ID NO: 358274 - RNA, 64 nt, Homo Sapiens
guggguuuaaguaugcuacugcuugccuccugauuaucuguacuuaaguuauagcuuuguuuuu

SEQ ID NO: 358275 - RNA, 64 nt, Homo Sapiens
gaaaaaaauuacauaucaguuucuugcuuuuucauaucuguaaacuguuucucucagcuuugcc

SEQ ID NO: 358276 - RNA, 64 nt, Homo Sapiens
aauugcagauuuaaaagguacuguacaaccauuauaucuguaaauaacuuagcaccuuuuuguc

SEQ ID NO: 358277 - RNA, 64 nt, Homo Sapiens
cuuaucagucauaauuauauauacuguggaacaguaucuguaguuacugcaaauuacuguacag

SEQ ID NO: 358278 - RNA, 64 nt, Homo Sapiens
ugaaacuauccaaugacauauuauaguaaaugaguaucuguaaccucccacugcaucagaagca

SEQ ID NO: 358279 - RNA, 64 nt, Homo Sapiens
cuuuuauuuuuuaaaugacuuuuuuauuuccuuguaucuguaguuuuucaucuccuaaaagugg

SEQ ID NO: 358280 - RNA, 64 nt, Homo Sapiens
uggaagaaauuuaggaagcggacuuguugucuauuaucuguaggugguuagccuuaguuucuca

SEQ ID NO: 358281 - RNA, 64 nt, Homo Sapiens
caauugguauaugaaauauauagguguuauuacauaucuguagacuuaaaauaugugcuuuagg

SEQ ID NO: 358282 - RNA, 64 nt, Homo Sapiens
cacugcuacaaucagcucaccuuuauuuucaugauaucuguaaugacugguagccaccauagga

SEQ ID NO: 358283 - RNA, 64 nt, Homo Sapiens
auucaccagucacuucauaugucuugaacaucuguaucuguaaacaugaaucaccgugugugua

SEQ ID NO: 358284 - RNA, 64 nt, Homo Sapiens
uugcaaauauuaugcuauauguaauaccuaacuguaucuguaguguauauguaauauauuuaug

SEQ ID NO: 358285 - RNA, 64 nt, Homo Sapiens
aagaaaaugcauuuuaaacauauauauuacagcuuaucuguaaguauauagcuacauacgcaug

SEQ ID NO: 358286 - RNA, 64 nt, Homo Sapiens
uuguuuaacugaaaaaaaugcauuguugcagaguuaucuguacucuauuagggaagcaguuugc

SEQ ID NO: 358287 - RNA, 64 nt, Homo Sapiens
ugcuuuugugugugugucaguccaaaaugucaacuaucuguagcguauaaaauaguuuuaguag

SEQ ID NO: 358288 - RNA, 64 nt, Homo Sapiens
gggaucuugaguaaugaggccaacauuguuucuuuaucuguaguuucagauguuuaucaguucc

SEQ ID NO: 358289 - RNA, 64 nt, Homo Sapiens
uaaauaaaacaauguaauuacauuaaaauggaccuaucuguaagagguacuaaaaacacuggau

SEQ ID NO: 358290 - RNA, 64 nt, Homo Sapiens
guaagacuuuaagaagcgaacaaaaaguaauguauaucuguaauauauaaucaaaugauucauu

SEQ ID NO: 358291 - RNA, 64 nt, Homo Sapiens
agacaaaaacuguuuuuauuuauauaaaaaaaccuaucuguauuuuguaaaaucaaauuacaua

SEQ ID NO: 358292 - RNA, 64 nt, Homo Sapiens
uauugcaguuuuuaugauuuuuguaagauugauguaucuguaaaauuguuaaaguuuuuauaug

SEQ ID NO: 358293 - RNA, 64 nt, Homo Sapiens
ccugguauauucaagcacuggcuuuguuuuaugguaucuguacuguaccuagugaguggaguuu

SEQ ID NO: 358294 - RNA, 64 nt, Homo Sapiens
uugaauggcuauggcguuagugaagugugcacaauaucuguauucaccacaauaauaaaucggg

SEQ ID NO: 358295 - RNA, 64 nt, Homo Sapiens
uaaaauauuuucauacagcauaauuuugacacuauaucuguauaauuaaugaaauaucuguauu

SEQ ID NO: 358296 - RNA, 64 nt, Homo Sapiens
uaauuuugacacuauaucuguuuaauuaaugaaauaucuguauuauaauaauauauguuuaccu

SEQ ID NO: 358297 - RNA, 64 nt, Homo Sapiens
agcuguaauaucauuuuauauauuuuuauaauuuuaucuguauaccauauuuuucuguguggag

SEQ ID NO: 358298 - RNA, 64 nt, Homo Sapiens
acuauuacaguauugcuauuaaaaguuacuaauauaucuguaacaaagccauauuuuuuucugu

SEQ ID NO: 358299 - RNA, 64 nt, Homo Sapiens
cuaguauauuuguuucacugucauaaauuguacauaucuguaagugcauuuuugaaguauaaag

SEQ ID NO: 358300 - RNA, 64 nt, Homo Sapiens
ggaaauauguuccuggaaaauguuuuugaugaucuaucuguauugaaacagaaguuauucacug

SEQ ID NO: 358301 - RNA, 64 nt, Homo Sapiens
aagauaacugacucacaacaacuuguuuacauuuuaucuguaauccauguguggacauccuggg

SEQ ID NO: 358302 - RNA, 64 nt, Homo Sapiens
ucucugggugacaugauaccaguugggacaauuuuaucuguaacgguaugacuuauugacaacc

SEQ ID NO: 358303 - RNA, 64 nt, Homo Sapiens
ugcuucugggagacacccaaagggugaagcuauuuaucuguaguaaacuauuuaucuguguuuu

SEQ ID NO: 358304 - RNA, 64 nt, Homo Sapiens
aggcacaaaaggguuuaaacugauucauaauaaauaucuguacuucuucgaucuucaccuuuug

SEQ ID NO: 358305 - RNA, 64 nt, Homo Sapiens
uguuuauauguaaauguuuguaaguauaugggccuaucuguaaguggauaagucuguaugugug

SEQ ID NO: 358306 - RNA, 64 nt, Homo Sapiens
gugaaaacagacauuccagugccacccaaauauauaucuguaacgugcccaagaaauccuagcu

SEQ ID NO: 358307 - RNA, 64 nt, Homo Sapiens
aacuuuggaauguacucugucauuauauaccauuuaucuguauuauaacucuguggcauuauug

SEQ ID NO: 358308 - RNA, 64 nt, Homo Sapiens
uccuggggcauuaaaaaaaauggaauauggggguuaucuguacacaaaaaaaaaguuccaggug

SEQ ID NO: 358309 - RNA, 64 nt, Homo Sapiens
aaugacuauucuccagguuguugcacuaccgcuguaucuguacauaauucuaacuuggcaccug

SEQ ID NO: 358310 - RNA, 64 nt, Homo Sapiens
cagaugugugccuccagauggcaguauacuacacuaucuguaaaauauauuugcaaagccaggc

SEQ ID NO: 358311 - RNA, 64 nt, Homo Sapiens; identical to SEQ ID NO: 271341

SEQ ID NO: 358312 - RNA, 64 nt, Homo Sapiens; identical to SEQ ID NO: 271342

SEQ ID NO: 358313 - RNA, 64 nt, Homo Sapiens; identical to SEQ ID NO: 271343

SEQ ID NO: 358314 - RNA, 64 nt, Homo Sapiens; identical to SEQ ID NO: 271344

SEQ ID NO: 358315 - RNA, 64 nt, Homo Sapiens; identical to SEQ ID NO: 271345

SEQ ID NO: 358316 - RNA, 64 nt, Homo Sapiens; identical to SEQ ID NO: 271346

SEQ ID NO: 358317 - RNA, 64 nt, Homo Sapiens; identical to SEQ ID NO: 271347

SEQ ID NO: 358318 - RNA, 64 nt, Homo Sapiens; identical to SEQ ID NO: 271348

SEQ ID NO: 358319 - RNA, 64 nt, Homo Sapiens; identical to SEQ ID NO: 271349

SEQ ID NO: 358320 - RNA, 64 nt, Homo Sapiens; identical to SEQ ID NO: 271350

SEQ ID NO: 358321 - RNA, 64 nt, Homo Sapiens; identical to SEQ ID NO: 271351

SEQ ID NO: 358322 - RNA, 64 nt, Homo Sapiens; identical to SEQ ID NO: 271352

SEQ ID NO: 358323 - RNA, 64 nt, Homo Sapiens; identical to SEQ ID NO: 271353

SEQ ID NO: 358324 - RNA, 64 nt, Homo Sapiens; identical to SEQ ID NO: 271354

SEQ ID NO: 358325 - RNA, 64 nt, Homo Sapiens; identical to SEQ ID NO: 271355

SEQ ID NO: 358326 - RNA, 64 nt, Homo Sapiens; identical to SEQ ID NO: 271356

SEQ ID NO: 358327 - RNA, 64 nt, Homo Sapiens; identical to SEQ ID NO: 271357

SEQ ID NO: 358328 - RNA, 52 nt, Homo Sapiens; identical to SEQ ID NO: 271358

SEQ ID NO: 358329 - RNA, 64 nt, Homo Sapiens; identical to SEQ ID NO: 271359

SEQ ID NO: 358330 - RNA, 64 nt, Homo Sapiens; identical to SEQ ID NO: 271360

SEQ ID NO: 358331 - RNA, 64 nt, Homo Sapiens; identical to SEQ ID NO: 271361

SEQ ID NO: 358332 - RNA, 64 nt, Homo Sapiens; identical to SEQ ID NO: 271362

SEQ ID NO: 358333 - RNA, 64 nt, Homo Sapiens; identical to SEQ ID NO: 271363

SEQ ID NO: 358334 - RNA, 64 nt, Homo Sapiens; identical to SEQ ID NO: 271364

SEQ ID NO: 358335 - RNA, 64 nt, Homo Sapiens; identical to SEQ ID NO: 271365

SEQ ID NO: 358336 - RNA, 64 nt, Homo Sapiens; identical to SEQ ID NO: 271366

SEQ ID NO: 358337 - RNA, 64 nt, Homo Sapiens; identical to SEQ ID NO: 271367

SEQ ID NO: 358338 - RNA, 64 nt, Homo Sapiens; identical to SEQ ID NO: 271368

SEQ ID NO: 358339 - RNA, 64 nt, Homo Sapiens; identical to SEQ ID NO: 271369

SEQ ID NO: 358340 - RNA, 64 nt, Homo Sapiens; identical to SEQ ID NO: 271370

SEQ ID NO: 358341 - RNA, 64 nt, Homo Sapiens; identical to SEQ ID NO: 271371

SEQ ID NO: 358342 - RNA, 64 nt, Homo Sapiens; identical to SEQ ID NO: 271372

SEQ ID NO: 358343 - RNA, 64 nt, Homo Sapiens; identical to SEQ ID NO: 271373

SEQ ID NO: 358344 - RNA, 64 nt, Homo Sapiens; identical to SEQ ID NO: 271374

SEQ ID NO: 358345 - RNA, 64 nt, Homo Sapiens; identical to SEQ ID NO: 271375

SEQ ID NO: 358346 - RNA, 64 nt, Homo Sapiens; identical to SEQ ID NO: 271376

SEQ ID NO: 358347 - RNA, 64 nt, Homo Sapiens; identical to SEQ ID NO: 271377

SEQ ID NO: 358348 - RNA, 64 nt, Homo Sapiens; identical to SEQ ID NO: 271378

SEQ ID NO: 358349 - RNA, 64 nt, Homo Sapiens; identical to SEQ ID NO: 271379

SEQ ID NO: 358350 - RNA, 64 nt, Homo Sapiens; identical to SEQ ID NO: 271380

SEQ ID NO: 358351 - RNA, 64 nt, Homo Sapiens; identical to SEQ ID NO: 271381

SEQ ID NO: 358352 - RNA, 64 nt, Homo Sapiens; identical to SEQ ID NO: 271382

SEQ ID NO: 358353 - RNA, 64 nt, Homo Sapiens; identical to SEQ ID NO: 271383

SEQ ID NO: 358354 - RNA, 64 nt, Homo Sapiens; identical to SEQ ID NO: 271384

SEQ ID NO: 358355 - RNA, 64 nt, Homo Sapiens; identical to SEQ ID NO: 271385

SEQ ID NO: 358356 - RNA, 64 nt, Homo Sapiens; identical to SEQ ID NO: 271386

SEQ ID NO: 358357 - RNA, 64 nt, Homo Sapiens; identical to SEQ ID NO: 271387

SEQ ID NO: 358358 - RNA, 64 nt, Homo Sapiens; identical to SEQ ID NO: 271388

SEQ ID NO: 358359 - RNA, 64 nt, Homo Sapiens; identical to SEQ ID NO: 271389

SEQ ID NO: 358360 - RNA, 64 nt, Homo Sapiens; identical to SEQ ID NO: 271390

SEQ ID NO: 358361 - RNA, 64 nt, Homo Sapiens; identical to SEQ ID NO: 271391

SEQ ID NO: 358362 - RNA, 64 nt, Homo Sapiens; identical to SEQ ID NO: 271392

SEQ ID NO: 358363 - RNA, 64 nt, Homo Sapiens; identical to SEQ ID NO: 271393

SEQ ID NO: 358364 - RNA, 64 nt, Homo Sapiens; identical to SEQ ID NO: 271394

SEQ ID NO: 358365 - RNA, 64 nt, Homo Sapiens; identical to SEQ ID NO: 271395

SEQ ID NO: 358366 - RNA, 64 nt, Homo Sapiens; identical to SEQ ID NO: 271396

SEQ ID NO: 358367 - RNA, 64 nt, Homo Sapiens; identical to SEQ ID NO: 271397

SEQ ID NO: 358368 - RNA, 64 nt, Homo Sapiens; identical to SEQ ID NO: 271398

SEQ ID NO: 358369 - RNA, 64 nt, Homo Sapiens; identical to SEQ ID NO: 271399

SEQ ID NO: 358370 - RNA, 64 nt, Homo Sapiens; identical to SEQ ID NO: 271400

SEQ ID NO: 358371 - RNA, 64 nt, Homo Sapiens; identical to SEQ ID NO: 271401

SEQ ID NO: 358372 - RNA, 64 nt, Homo Sapiens; identical to SEQ ID NO: 271402

SEQ ID NO: 358373 - RNA, 64 nt, Homo Sapiens; identical to SEQ ID NO: 271403

SEQ ID NO: 358374 - RNA, 64 nt, Homo Sapiens; identical to SEQ ID NO: 271404

SEQ ID NO: 358375 - RNA, 64 nt, Homo Sapiens; identical to SEQ ID NO: 271405

SEQ ID NO: 358376 - RNA, 64 nt, Homo Sapiens; identical to SEQ ID NO: 271406

SEQ ID NO: 358377 - RNA, 64 nt, Homo Sapiens; identical to SEQ ID NO: 271407

SEQ ID NO: 358378 - RNA, 64 nt, Homo Sapiens; identical to SEQ ID NO: 271408

SEQ ID NO: 358379 - RNA, 64 nt, Homo Sapiens; identical to SEQ ID NO: 271409

SEQ ID NO: 358380 - RNA, 64 nt, Homo Sapiens; identical to SEQ ID NO: 271410

SEQ ID NO: 358381 - RNA, 64 nt, Homo Sapiens; identical to SEQ ID NO: 271411

SEQ ID NO: 358382 - RNA, 64 nt, Homo Sapiens; identical to SEQ ID NO: 271412

SEQ ID NO: 358383 - RNA, 64 nt, Homo Sapiens; identical to SEQ ID NO: 271413

SEQ ID NO: 358384 - RNA, 64 nt, Homo Sapiens; identical to SEQ ID NO: 271414

SEQ ID NO: 358385 - RNA, 64 nt, Homo Sapiens; identical to SEQ ID NO: 271415

SEQ ID NO: 358386 - RNA, 64 nt, Homo Sapiens; identical to SEQ ID NO: 271416

SEQ ID NO: 358387 - RNA, 64 nt, Homo Sapiens; identical to SEQ ID NO: 271417

SEQ ID NO: 358388 - RNA, 64 nt, Homo Sapiens; identical to SEQ ID NO: 271418

SEQ ID NO: 358389 - RNA, 64 nt, Homo Sapiens; identical to SEQ ID NO: 271419

SEQ ID NO: 358390 - RNA, 64 nt, Homo Sapiens; identical to SEQ ID NO: 271420

SEQ ID NO: 358391 - RNA, 64 nt, Homo Sapiens; identical to SEQ ID NO: 271421

SEQ ID NO: 358392 - RNA, 64 nt, Homo Sapiens; identical to SEQ ID NO: 271422

SEQ ID NO: 358393 - RNA, 64 nt, Homo Sapiens; identical to SEQ ID NO: 271423

SEQ ID NO: 358394 - RNA, 64 nt, Homo Sapiens; identical to SEQ ID NO: 271424

SEQ ID NO: 358395 - RNA, 64 nt, Homo Sapiens; identical to SEQ ID NO: 271425

SEQ ID NO: 358396 - RNA, 64 nt, Homo Sapiens; identical to SEQ ID NO: 271426

SEQ ID NO: 358397 - RNA, 64 nt, Homo Sapiens; identical to SEQ ID NO: 271427

SEQ ID NO: 358398 - RNA, 64 nt, Homo Sapiens; identical to SEQ ID NO: 271428

SEQ ID NO: 358399 - RNA, 64 nt, Homo Sapiens; identical to SEQ ID NO: 271429

SEQ ID NO: 358400 - RNA, 64 nt, Homo Sapiens; identical to SEQ ID NO: 271430

SEQ ID NO: 358401 - RNA, 64 nt, Homo Sapiens; identical to SEQ ID NO: 271431

SEQ ID NO: 358402 - RNA, 64 nt, Homo Sapiens; identical to SEQ ID NO: 271432

SEQ ID NO: 358403 - RNA, 64 nt, Homo Sapiens; identical to SEQ ID NO: 271433

SEQ ID NO: 358404 - RNA, 64 nt, Homo Sapiens; identical to SEQ ID NO: 271434

SEQ ID NO: 358405 - RNA, 64 nt, Homo Sapiens; identical to SEQ ID NO: 271435

SEQ ID NO: 358406 - RNA, 64 nt, Homo Sapiens; identical to SEQ ID NO: 271436

SEQ ID NO: 358407 - RNA, 64 nt, Homo Sapiens; identical to SEQ ID NO: 271437

SEQ ID NO: 358408 - RNA, 64 nt, Homo Sapiens; identical to SEQ ID NO: 271438

SEQ ID NO: 358409 - RNA, 64 nt, Homo Sapiens; identical to SEQ ID NO: 271439

SEQ ID NO: 358410 - RNA, 64 nt, Homo Sapiens; identical to SEQ ID NO: 271440

SEQ ID NO: 358411 - RNA, 64 nt, Homo Sapiens; identical to SEQ ID NO: 271441

SEQ ID NO: 358412 - RNA, 64 nt, Homo Sapiens; identical to SEQ ID NO: 271442

SEQ ID NO: 358413 - RNA, 64 nt, Homo Sapiens; identical to SEQ ID NO: 271443

SEQ ID NO: 358414 - RNA, 64 nt, Homo Sapiens; identical to SEQ ID NO: 271444

SEQ ID NO: 358415 - RNA, 64 nt, Homo Sapiens; identical to SEQ ID NO: 271445

SEQ ID NO: 358416 - RNA, 64 nt, Homo Sapiens; identical to SEQ ID NO: 271446

SEQ ID NO: 358417 - RNA, 64 nt, Homo Sapiens; identical to SEQ ID NO: 271447

SEQ ID NO: 358418 - RNA, 64 nt, Homo Sapiens; identical to SEQ ID NO: 271448

SEQ ID NO: 358419 - RNA, 64 nt, Homo Sapiens; identical to SEQ ID NO: 271449

SEQ ID NO: 358420 - RNA, 64 nt, Homo Sapiens; identical to SEQ ID NO: 271450

SEQ ID NO: 358421 - RNA, 64 nt, Homo Sapiens; identical to SEQ ID NO: 271451

SEQ ID NO: 358422 - RNA, 64 nt, Homo Sapiens; identical to SEQ ID NO: 271452

SEQ ID NO: 358423 - RNA, 64 nt, Homo Sapiens; identical to SEQ ID NO: 271453

SEQ ID NO: 358424 - RNA, 64 nt, Homo Sapiens; identical to SEQ ID NO: 271454

SEQ ID NO: 358425 - RNA, 64 nt, Homo Sapiens; identical to SEQ ID NO: 271455

SEQ ID NO: 358426 - RNA, 64 nt, Homo Sapiens; identical to SEQ ID NO: 271456

SEQ ID NO: 358427 - RNA, 64 nt, Homo Sapiens; identical to SEQ ID NO: 271457

SEQ ID NO: 358428 - RNA, 64 nt, Homo Sapiens; identical to SEQ ID NO: 271458

SEQ ID NO: 358429 - RNA, 64 nt, Homo Sapiens; identical to SEQ ID NO: 271459

SEQ ID NO: 358430 - RNA, 64 nt, Homo Sapiens; identical to SEQ ID NO: 271460

SEQ ID NO: 358431 - RNA, 64 nt, Homo Sapiens; identical to SEQ ID NO: 271461

SEQ ID NO: 358432 - RNA, 64 nt, Homo Sapiens; identical to SEQ ID NO: 271462

SEQ ID NO: 358433 - RNA, 64 nt, Homo Sapiens; identical to SEQ ID NO: 271463

SEQ ID NO: 358434 - RNA, 64 nt, Homo Sapiens; identical to SEQ ID NO: 271464

SEQ ID NO: 358435 - RNA, 64 nt, Homo Sapiens; identical to SEQ ID NO: 271465

SEQ ID NO: 358436 - RNA, 64 nt, Homo Sapiens; identical to SEQ ID NO: 271466

SEQ ID NO: 358437 - RNA, 64 nt, Homo Sapiens; identical to SEQ ID NO: 271467

SEQ ID NO: 358438 - RNA, 64 nt, Homo Sapiens; identical to SEQ ID NO: 271468

SEQ ID NO: 358439 - RNA, 64 nt, Homo Sapiens; identical to SEQ ID NO: 271469

SEQ ID NO: 358440 - RNA, 64 nt, Homo Sapiens; identical to SEQ ID NO: 271470

SEQ ID NO: 358441 - RNA, 64 nt, Homo Sapiens; identical to SEQ ID NO: 271471

SEQ ID NO: 358442 - RNA, 64 nt, Homo Sapiens; identical to SEQ ID NO: 271472

SEQ ID NO: 358443 - RNA, 64 nt, Homo Sapiens; identical to SEQ ID NO: 271473

SEQ ID NO: 358444 - RNA, 64 nt, Homo Sapiens; identical to SEQ ID NO: 271474

SEQ ID NO: 358445 - RNA, 64 nt, Homo Sapiens; identical to SEQ ID NO: 271475

SEQ ID NO: 358446 - RNA, 64 nt, Homo Sapiens; identical to SEQ ID NO: 271476

SEQ ID NO: 358447 - RNA, 64 nt, Homo Sapiens; identical to SEQ ID NO: 271477

SEQ ID NO: 358448 - RNA, 64 nt, Homo Sapiens; identical to SEQ ID NO: 271478

SEQ ID NO: 358449 - RNA, 64 nt, Homo Sapiens; identical to SEQ ID NO: 271479

SEQ ID NO: 358450 - RNA, 64 nt, Homo Sapiens; identical to SEQ ID NO: 271480

SEQ ID NO: 358451 - RNA, 64 nt, Homo Sapiens; identical to SEQ ID NO: 271481

SEQ ID NO: 358452 - RNA, 64 nt, Homo Sapiens; identical to SEQ ID NO: 271482

SEQ ID NO: 358453 - RNA, 64 nt, Homo Sapiens; identical to SEQ ID NO: 271483

SEQ ID NO: 358454 - RNA, 64 nt, Homo Sapiens; identical to SEQ ID NO: 271484

SEQ ID NO: 358455 - RNA, 64 nt, Homo Sapiens; identical to SEQ ID NO: 271485

SEQ ID NO: 358456 - RNA, 64 nt, Homo Sapiens; identical to SEQ ID NO: 271486

SEQ ID NO: 358457 - RNA, 64 nt, Homo Sapiens; identical to SEQ ID NO: 271487

SEQ ID NO: 358458 - RNA, 64 nt, Homo Sapiens; identical to SEQ ID NO: 271488

SEQ ID NO: 358459 - RNA, 64 nt, Homo Sapiens; identical to SEQ ID NO: 271489

SEQ ID NO: 358460 - RNA, 64 nt, Homo Sapiens; identical to SEQ ID NO: 271490

SEQ ID NO: 358461 - RNA, 64 nt, Homo Sapiens; identical to SEQ ID NO: 271491

SEQ ID NO: 358462 - RNA, 64 nt, Homo Sapiens; identical to SEQ ID NO: 271492

SEQ ID NO: 358463 - RNA, 64 nt, Homo Sapiens; identical to SEQ ID NO: 271493

SEQ ID NO: 358464 - RNA, 64 nt, Homo Sapiens; identical to SEQ ID NO: 271494

SEQ ID NO: 358465 - RNA, 64 nt, Homo Sapiens; identical to SEQ ID NO: 271495

SEQ ID NO: 358466 - RNA, 64 nt, Homo Sapiens; identical to SEQ ID NO: 271496

SEQ ID NO: 358467 - RNA, 64 nt, Homo Sapiens; identical to SEQ ID NO: 271497

SEQ ID NO: 358468 - RNA, 64 nt, Homo Sapiens; identical to SEQ ID NO: 271498

SEQ ID NO: 358469 - RNA, 64 nt, Homo Sapiens; identical to SEQ ID NO: 271499

SEQ ID NO: 358470 - RNA, 64 nt, Homo Sapiens; identical to SEQ ID NO: 271500

SEQ ID NO: 358471 - RNA, 64 nt, Homo Sapiens; identical to SEQ ID NO: 271501

SEQ ID NO: 358472 - RNA, 64 nt, Homo Sapiens; identical to SEQ ID NO: 271502

SEQ ID NO: 358473 - RNA, 64 nt, Homo Sapiens; identical to SEQ ID NO: 271503

SEQ ID NO: 358474 - RNA, 64 nt, Homo Sapiens; identical to SEQ ID NO: 271504

SEQ ID NO: 358475 - RNA, 64 nt, Homo Sapiens; identical to SEQ ID NO: 271505

SEQ ID NO: 358476 - RNA, 64 nt, Homo Sapiens; identical to SEQ ID NO: 271506

SEQ ID NO: 358477 - RNA, 64 nt, Homo Sapiens; identical to SEQ ID NO: 271507

SEQ ID NO: 358478 - RNA, 64 nt, Homo Sapiens; identical to SEQ ID NO: 271508

SEQ ID NO: 358479 - RNA, 64 nt, Homo Sapiens; identical to SEQ ID NO: 271509

SEQ ID NO: 358480 - RNA, 64 nt, Homo Sapiens; identical to SEQ ID NO: 271510

SEQ ID NO: 358481 - RNA, 64 nt, Homo Sapiens; identical to SEQ ID NO: 271511

SEQ ID NO: 358482 - RNA, 64 nt, Homo Sapiens; identical to SEQ ID NO: 271512

SEQ ID NO: 358483 - RNA, 64 nt, Homo Sapiens; identical to SEQ ID NO: 271513

SEQ ID NO: 358484 - RNA, 64 nt, Homo Sapiens; identical to SEQ ID NO: 271514

SEQ ID NO: 358485 - RNA, 64 nt, Homo Sapiens; identical to SEQ ID NO: 271515

SEQ ID NO: 358486 - RNA, 64 nt, Homo Sapiens; identical to SEQ ID NO: 271516

SEQ ID NO: 358487 - RNA, 64 nt, Homo Sapiens; identical to SEQ ID NO: 271517

SEQ ID NO: 358488 - RNA, 64 nt, Homo Sapiens; identical to SEQ ID NO: 271518

SEQ ID NO: 358489 - RNA, 64 nt, Homo Sapiens; identical to SEQ ID NO: 271519

SEQ ID NO: 358490 - RNA, 64 nt, Homo Sapiens; identical to SEQ ID NO: 271520

SEQ ID NO: 358491 - RNA, 64 nt, Homo Sapiens; identical to SEQ ID NO: 271521

SEQ ID NO: 358492 - RNA, 64 nt, Homo Sapiens; identical to SEQ ID NO: 271522

SEQ ID NO: 358493 - RNA, 64 nt, Homo Sapiens; identical to SEQ ID NO: 271523

SEQ ID NO: 358494 - RNA, 64 nt, Homo Sapiens; identical to SEQ ID NO: 271524

SEQ ID NO: 358495 - RNA, 64 nt, Homo Sapiens; identical to SEQ ID NO: 271525

SEQ ID NO: 358496 - RNA, 64 nt, Homo Sapiens; identical to SEQ ID NO: 271526

SEQ ID NO: 358497 - RNA, 64 nt, Homo Sapiens; identical to SEQ ID NO: 271527

SEQ ID NO: 358498 - RNA, 64 nt, Homo Sapiens; identical to SEQ ID NO: 271528

SEQ ID NO: 358499 - RNA, 64 nt, Homo Sapiens; identical to SEQ ID NO: 271529

SEQ ID NO: 358500 - RNA, 64 nt, Homo Sapiens; identical to SEQ ID NO: 271530

SEQ ID NO: 358501 - RNA, 64 nt, Homo Sapiens; identical to SEQ ID NO: 271531

SEQ ID NO: 358502 - RNA, 64 nt, Homo Sapiens; identical to SEQ ID NO: 271532

SEQ ID NO: 358503 - RNA, 64 nt, Homo Sapiens; identical to SEQ ID NO: 271533

SEQ ID NO: 358504 - RNA, 64 nt, Homo Sapiens; identical to SEQ ID NO: 271534

SEQ ID NO: 358505 - RNA, 64 nt, Homo Sapiens; identical to SEQ ID NO: 271535

SEQ ID NO: 358506 - RNA, 64 nt, Homo Sapiens; identical to SEQ ID NO: 271536

SEQ ID NO: 358507 - RNA, 64 nt, Homo Sapiens; identical to SEQ ID NO: 271537

SEQ ID NO: 358508 - RNA, 64 nt, Homo Sapiens; identical to SEQ ID NO: 271538

SEQ ID NO: 358509 - RNA, 64 nt, Homo Sapiens; identical to SEQ ID NO: 271539

SEQ ID NO: 358510 - RNA, 64 nt, Homo Sapiens; identical to SEQ ID NO: 271540

SEQ ID NO: 358511 - RNA, 64 nt, Homo Sapiens; identical to SEQ ID NO: 271541

SEQ ID NO: 358512 - RNA, 64 nt, Homo Sapiens; identical to SEQ ID NO: 271542

SEQ ID NO: 358513 - RNA, 64 nt, Homo Sapiens; identical to SEQ ID NO: 271543

SEQ ID NO: 358514 - RNA, 64 nt, Homo Sapiens; identical to SEQ ID NO: 271544

SEQ ID NO: 358515 - RNA, 64 nt, Homo Sapiens; identical to SEQ ID NO: 271545

SEQ ID NO: 358516 - RNA, 64 nt, Homo Sapiens; identical to SEQ ID NO: 271546

SEQ ID NO: 358517 - RNA, 64 nt, Homo Sapiens; identical to SEQ ID NO: 271547

SEQ ID NO: 358518 - RNA, 64 nt, Homo Sapiens; identical to SEQ ID NO: 271548

SEQ ID NO: 358519 - RNA, 64 nt, Homo Sapiens; identical to SEQ ID NO: 271549

SEQ ID NO: 358520 - RNA, 64 nt, Homo Sapiens; identical to SEQ ID NO: 271550

SEQ ID NO: 358521 - RNA, 64 nt, Homo Sapiens; identical to SEQ ID NO: 271551

SEQ ID NO: 358522 - RNA, 64 nt, Homo Sapiens; identical to SEQ ID NO: 271552

SEQ ID NO: 358523 - RNA, 64 nt, Homo Sapiens; identical to SEQ ID NO: 271553

SEQ ID NO: 358524 - RNA, 64 nt, Homo Sapiens; identical to SEQ ID NO: 271554

SEQ ID NO: 358525 - RNA, 64 nt, Homo Sapiens; identical to SEQ ID NO: 271555

SEQ ID NO: 358526 - RNA, 64 nt, Homo Sapiens; identical to SEQ ID NO: 271556

SEQ ID NO: 358527 - RNA, 64 nt, Homo Sapiens; identical to SEQ ID NO: 271557

SEQ ID NO: 358528 - RNA, 64 nt, Homo Sapiens; identical to SEQ ID NO: 271558

SEQ ID NO: 358529 - RNA, 64 nt, Homo Sapiens; identical to SEQ ID NO: 271559

SEQ ID NO: 358530 - RNA, 64 nt, Homo Sapiens; identical to SEQ ID NO: 271560

SEQ ID NO: 358531 - RNA, 64 nt, Homo Sapiens; identical to SEQ ID NO: 271561

SEQ ID NO: 358532 - RNA, 64 nt, Homo Sapiens; identical to SEQ ID NO: 271562

SEQ ID NO: 358533 - RNA, 64 nt, Homo Sapiens; identical to SEQ ID NO: 271563

SEQ ID NO: 358534 - RNA, 64 nt, Homo Sapiens; identical to SEQ ID NO: 271564

SEQ ID NO: 358535 - RNA, 64 nt, Homo Sapiens; identical to SEQ ID NO: 271565

SEQ ID NO: 358536 - RNA, 64 nt, Homo Sapiens; identical to SEQ ID NO: 271566

SEQ ID NO: 358537 - RNA, 64 nt, Homo Sapiens; identical to SEQ ID NO: 271567

SEQ ID NO: 358538 - RNA, 52 nt, Homo Sapiens; identical to SEQ ID NO: 271358

SEQ ID NO: 358539 - RNA, 64 nt, Homo Sapiens; identical to SEQ ID NO: 271569

SEQ ID NO: 358540 - RNA, 64 nt, Homo Sapiens; identical to SEQ ID NO: 271570

SEQ ID NO: 358541 - RNA, 64 nt, Homo Sapiens; identical to SEQ ID NO: 73772

SEQ ID NO: 358542 - RNA, 64 nt, Homo Sapiens; identical to SEQ ID NO: 73773

SEQ ID NO: 358543 - RNA, 64 nt, Homo Sapiens; identical to SEQ ID NO: 73774

SEQ ID NO: 358544 - RNA, 64 nt, Homo Sapiens; identical to SEQ ID NO: 73775

SEQ ID NO: 358545 - RNA, 64 nt, Homo Sapiens; identical to SEQ ID NO: 73776

SEQ ID NO: 358546 - RNA, 64 nt, Homo Sapiens; identical to SEQ ID NO: 73777

SEQ ID NO: 358547 - RNA, 64 nt, Homo Sapiens; identical to SEQ ID NO: 73778

SEQ ID NO: 358548 - RNA, 64 nt, Homo Sapiens; identical to SEQ ID NO: 73779

SEQ ID NO: 358549 - RNA, 64 nt, Homo Sapiens; identical to SEQ ID NO: 73780

SEQ ID NO: 358550 - RNA, 64 nt, Homo Sapiens; identical to SEQ ID NO: 73781

SEQ ID NO: 358551 - RNA, 64 nt, Homo Sapiens; identical to SEQ ID NO: 73782

SEQ ID NO: 358552 - RNA, 64 nt, Homo Sapiens; identical to SEQ ID NO: 73783

SEQ ID NO: 358553 - RNA, 64 nt, Homo Sapiens; identical to SEQ ID NO: 73784

SEQ ID NO: 358554 - RNA, 64 nt, Homo Sapiens; identical to SEQ ID NO: 73785

SEQ ID NO: 358555 - RNA, 64 nt, Homo Sapiens; identical to SEQ ID NO: 73786

SEQ ID NO: 358556 - RNA, 64 nt, Homo Sapiens; identical to SEQ ID NO: 73787

SEQ ID NO: 358557 - RNA, 64 nt, Homo Sapiens; identical to SEQ ID NO: 73788

SEQ ID NO: 358558 - RNA, 64 nt, Homo Sapiens; identical to SEQ ID NO: 73789

SEQ ID NO: 358559 - RNA, 64 nt, Homo Sapiens; identical to SEQ ID NO: 73790

SEQ ID NO: 358560 - RNA, 64 nt, Homo Sapiens; identical to SEQ ID NO: 73791

SEQ ID NO: 358561 - RNA, 64 nt, Homo Sapiens; identical to SEQ ID NO: 73792

SEQ ID NO: 358562 - RNA, 64 nt, Homo Sapiens; identical to SEQ ID NO: 73793

SEQ ID NO: 358563 - RNA, 64 nt, Homo Sapiens; identical to SEQ ID NO: 73794

SEQ ID NO: 358564 - RNA, 64 nt, Homo Sapiens; identical to SEQ ID NO: 73795

SEQ ID NO: 358565 - RNA, 64 nt, Homo Sapiens; identical to SEQ ID NO: 73796

SEQ ID NO: 358566 - RNA, 64 nt, Homo Sapiens; identical to SEQ ID NO: 73797

SEQ ID NO: 358567 - RNA, 64 nt, Homo Sapiens; identical to SEQ ID NO: 73798

SEQ ID NO: 358568 - RNA, 64 nt, Homo Sapiens; identical to SEQ ID NO: 73799

SEQ ID NO: 358569 - RNA, 64 nt, Homo Sapiens; identical to SEQ ID NO: 73800

SEQ ID NO: 358570 - RNA, 64 nt, Homo Sapiens; identical to SEQ ID NO: 73801

SEQ ID NO: 358571 - RNA, 64 nt, Homo Sapiens; identical to SEQ ID NO: 73802

SEQ ID NO: 358572 - RNA, 64 nt, Homo Sapiens; identical to SEQ ID NO: 73803

SEQ ID NO: 358573 - RNA, 64 nt, Homo Sapiens; identical to SEQ ID NO: 73804

SEQ ID NO: 358574 - RNA, 64 nt, Homo Sapiens; identical to SEQ ID NO: 73805

SEQ ID NO: 358575 - RNA, 64 nt, Homo Sapiens; identical to SEQ ID NO: 73806

SEQ ID NO: 358576 - RNA, 64 nt, Homo Sapiens; identical to SEQ ID NO: 73807

SEQ ID NO: 358577 - RNA, 64 nt, Homo Sapiens; identical to SEQ ID NO: 73808

SEQ ID NO: 358578 - RNA, 64 nt, Homo Sapiens; identical to SEQ ID NO: 73809

SEQ ID NO: 358579 - RNA, 64 nt, Homo Sapiens; identical to SEQ ID NO: 73810

SEQ ID NO: 358580 - RNA, 64 nt, Homo Sapiens; identical to SEQ ID NO: 73811

SEQ ID NO: 358581 - RNA, 64 nt, Homo Sapiens; identical to SEQ ID NO: 73812

SEQ ID NO: 358582 - RNA, 64 nt, Homo Sapiens; identical to SEQ ID NO: 73813

SEQ ID NO: 358583 - RNA, 64 nt, Homo Sapiens; identical to SEQ ID NO: 73814

SEQ ID NO: 358584 - RNA, 64 nt, Homo Sapiens; identical to SEQ ID NO: 73815

SEQ ID NO: 358585 - RNA, 64 nt, Homo Sapiens; identical to SEQ ID NO: 73816

SEQ ID NO: 358586 - RNA, 64 nt, Homo Sapiens; identical to SEQ ID NO: 73817

SEQ ID NO: 358587 - RNA, 64 nt, Homo Sapiens; identical to SEQ ID NO: 73818

SEQ ID NO: 358588 - RNA, 64 nt, Homo Sapiens; identical to SEQ ID NO: 73819

SEQ ID NO: 358589 - RNA, 64 nt, Homo Sapiens; identical to SEQ ID NO: 73820

SEQ ID NO: 358590 - RNA, 64 nt, Homo Sapiens; identical to SEQ ID NO: 73821

SEQ ID NO: 358591 - RNA, 64 nt, Homo Sapiens; identical to SEQ ID NO: 73822

SEQ ID NO: 358592 - RNA, 64 nt, Homo Sapiens; identical to SEQ ID NO: 73823

SEQ ID NO: 358593 - RNA, 64 nt, Homo Sapiens; identical to SEQ ID NO: 73824

SEQ ID NO: 358594 - RNA, 64 nt, Homo Sapiens; identical to SEQ ID NO: 73825

SEQ ID NO: 358595 - RNA, 64 nt, Homo Sapiens; identical to SEQ ID NO: 73826

SEQ ID NO: 358596 - RNA, 64 nt, Homo Sapiens; identical to SEQ ID NO: 73827

SEQ ID NO: 358597 - RNA, 64 nt, Homo Sapiens; identical to SEQ ID NO: 73828

SEQ ID NO: 358598 - RNA, 64 nt, Homo Sapiens; identical to SEQ ID NO: 73829

SEQ ID NO: 358599 - RNA, 64 nt, Homo Sapiens; identical to SEQ ID NO: 73830

SEQ ID NO: 358600 - RNA, 64 nt, Homo Sapiens
ucaaaaugguggcaguucuuuugaugaagauagcaacggaaaacuauguuuacaggcuuccugu

SEQ ID NO: 358601 - RNA, 64 nt, Homo Sapiens
cuuaacugaaucuaaaagaaugaacaugaauaccaacggaaaacggagaauucuggaguuguua

SEQ ID NO: 358602 - RNA, 64 nt, Homo Sapiens
cugaaagacuuuugccuaaauaagcggaauguaaaacggaaauauaccaauuuaugaauucuug

SEQ ID NO: 358603 - RNA, 64 nt, Homo Sapiens
ccacucuuuguguagauauuaaauugacuguauuaacggaaauaugaaugucaaucuggaaaau

SEQ ID NO: 358604 - RNA, 64 nt, Homo Sapiens
cuggaauuuacccauagaagggaggagcuuaaaacucaaccacuaaugaggggaaagagccugg

SEQ ID NO: 358605 - RNA, 64 nt, Homo Sapiens
cuuuuucuuuuuccuuuucuuaaaccuucccccacucaaccaaucccuuuguucaguggacggu

SEQ ID NO: 358606 - RNA, 64 nt, Homo Sapiens
ugcucccgccacgcaccgguccuagagggugggccucaaccacccccccacagggcuggccucc

SEQ ID NO: 358607 - RNA, 64 nt, Homo Sapiens
ggguggccuugugacuguucucuccaaugacuuccucaaccaauccagauuccgaaacucccau

SEQ ID NO: 358608 - RNA, 64 nt, Homo Sapiens
cccuucugagcuguuaacaacaguuucaguuauacucaaccaugccaagcguaauuuuagccag

SEQ ID NO: 358609 - RNA, 64 nt, Homo Sapiens
ucuuuguaagacaaaacugauaaaagcuuuucaacucaaccacuuuaaaaacaaaaacagggaa

SEQ ID NO: 358610 - RNA, 64 nt, Homo Sapiens
auaagcugacuguucucucuugagaaccuguggccucaaccagccaccaagcugauguggccca

SEQ ID NO: 358611 - RNA, 64 nt, Homo Sapiens
acacagaauuaggcccuaaugagagccuuagacccucaaccaugcccccuucguuggcaucaca

SEQ ID NO: 358612 - RNA, 64 nt, Homo Sapiens
uugucagcccacuccucagguggggcacuaugcucucaaccaguguccacacccuacacagacu

SEQ ID NO: 358613 - RNA, 64 nt, Homo Sapiens
ucuaccagaagaggcuccuucccagggcagccagcucaaccacucaucugcuccgggaagccag

SEQ ID NO: 358614 - RNA, 64 nt, Homo Sapiens
guauuucuuaaauguauuugccugccuuucugaacucaaccaaucccccgcugcuucgaguugu

SEQ ID NO: 358615 - RNA, 64 nt, Homo Sapiens
ugucaaccagaaaauguuuaggucuucagcuaagcucaaccaauauuccuuuccauugauccca

SEQ ID NO: 358616 - RNA, 64 nt, Homo Sapiens
acuuuuuagugguuggauuucaucccuuacuggucucaaccaaaauauuccuguuggaaucaug

SEQ ID NO: 358617 - RNA, 64 nt, Homo Sapiens
auauuucuaaucagcgauaauuucuaccuauguucucaaccaacuuagccaguuuguuuuucag

SEQ ID NO: 358618 - RNA, 64 nt, Homo Sapiens
uauauucaugagcucucaauugaagacugauacacucaaccaucaaaguauguuuuaaaugcuu

SEQ ID NO: 358619 - RNA, 64 nt, Homo Sapiens
guauugucucuuuaagucuuuaggaagccagugucucaaccauauucuuuaauuagggcuggaa

SEQ ID NO: 358620 - RNA, 64 nt, Homo Sapiens
agcuucgaguagagaaaggcaagucuacuggcgccucaaccagcagucuacuucuucaagggca

SEQ ID NO: 358621 - RNA, 64 nt, Homo Sapiens
agguguuccucuuuaagguacucucuauuggccucucaaccaaaagaaccuaaccuggaugcag

SEQ ID NO: 358622 - RNA, 64 nt, Homo Sapiens
cgguccuuucucaacguuccaucaucaaauuuaucucaaccauugagcgaagcacauuacauau

SEQ ID NO: 358623 - RNA, 64 nt, Homo Sapiens
auuuguugaaugaacaaaugagcacaaacaggcacucaaccacucaguguuuagaacagugucc

SEQ ID NO: 358624 - RNA, 64 nt, Homo Sapiens
gggacagguucuaucaugggugucaugggugacacgaggacacacaggacacagggacagguuc

SEQ ID NO: 358625 - RNA, 64 nt, Homo Sapiens
guggucaccacugucaguuacaaaaauaaagucacgaggacauacaccuagccaggagggguag

SEQ ID NO: 358626 - RNA, 64 nt, Homo Sapiens
uuaagagucucauauggcuaagauggagaaacagguacuggacuuuucccuccugcaugaaaca

SEQ ID NO: 358627 - RNA, 64 nt, Homo Sapiens
agggagacuaagguggccggaacucgcggucacaguacuggagagagacacacagaucuaaguc

SEQ ID NO: 358628 - RNA, 64 nt, Homo Sapiens
guccugaaguagaugguugagauaugaguucuucguacuggaaaagcccuuccguaguuuguuu

SEQ ID NO: 358629 - RNA, 64 nt, Homo Sapiens
cuuacuacugggucauccuuggucuaugugcucuguacuggaggcucuguucugccucuuauca

SEQ ID NO: 358630 - RNA, 64 nt, Homo Sapiens
uuuguacugacaaccuccuuggcuuauuuggggguggagcaauuguuuuauuccccaguuucag

SEQ ID NO: 358631 - RNA, 64 nt, Homo Sapiens
ccagacaggaaagcuuuagaaaacuugagugaaauggagcaagcuugaaggaguuagaaucuuc

SEQ ID NO: 358632 - RNA, 64 nt, Homo Sapiens
gauauuuugggcaugugggcauaguagagugauauggagcaagaaggcagagaaagggacaaug

SEQ ID NO: 358633 - RNA, 64 nt, Homo Sapiens
ugguagguacuuuuugugaaggagaucagaaaaauggagcaaaguucuguuuccuguaccagua

SEQ ID NO: 358634 - RNA, 64 nt, Homo Sapiens
uggggcgggggguggguaaaguaaacggcggcacuggagcaagcgcaggccacguacccaugac

SEQ ID NO: 358635 - RNA, 64 nt, Homo Sapiens
cuuacaauuugccuuuagauuuucccccagucccuggagcaaacuuaggugggcaugaaauuug

SEQ ID NO: 358636 - RNA, 64 nt, Homo Sapiens
ccugugagcaagauaagaauugaaaauucaguuuuggagcaaguuuucccuaucaugcugcuuc

SEQ ID NO: 358637 - RNA, 64 nt, Homo Sapiens
uggagggugcagaggggcugggguggugggagccuggagcaagggcagguuauuuggggugagu

SEQ ID NO: 358638 - RNA, 64 nt, Homo Sapiens
ggagaggcugcuggagcuugagaggagaggaugcuggagcaagaaggaagagguugcuggagca

SEQ ID NO: 358639 - RNA, 64 nt, Homo Sapiens
ggagaggaugcuggagcaagcaggaagagguugcuggagcaagaugagucgccugaaccaagag

SEQ ID NO: 358640 - RNA, 64 nt, Homo Sapiens
ggagagguugcuggagcugcagaggagagguugcuggagcaagagacgagagguuguuggagca

SEQ ID NO: 358641 - RNA, 64 nt, Homo Sapiens
ggagagguugcuggagcaagagacgagagguuguuggagcaagauugcugagauuguuggaaca

SEQ ID NO: 358642 - RNA, 64 nt, Homo Sapiens
ggagaggcuacuggagcugcagaggagagguugcuggagcaagagaggagagguugcuggagca

SEQ ID NO: 358643 - RNA, 64 nt, Homo Sapiens
ggagagguugcuggagcaagagaggagagguugcuggagcaagagaggagaaguugcuggagca

SEQ ID NO: 358644 - RNA, 64 nt, Homo Sapiens
ggagagguugcuggagcaagagaggagaaguugcuggagcaagauugcucagguuguuggagca

SEQ ID NO: 358645 - RNA, 64 nt, Homo Sapiens
ggagaaguugcuggagcaagguugcucagguuguuggagcaagaugaaccaagagcaggaagag

SEQ ID NO: 358646 - RNA, 64 nt, Homo Sapiens
gcuuggcccccauggggaagacacggauggaagguggagcaaaggaaaauacaugaaauugaga

SEQ ID NO: 358647 - RNA, 64 nt, Homo Sapiens
uaugauccagcuuuggucauacccaaggggaagguggagcaagaaaugaaaaggaaccugaauc

SEQ ID NO: 358648 - RNA, 64 nt, Homo Sapiens; identical to SEQ ID NO: 124377

SEQ ID NO: 358649 - RNA, 64 nt, Homo Sapiens; identical to SEQ ID NO: 124378

SEQ ID NO: 358650 - RNA, 64 nt, Homo Sapiens; identical to SEQ ID NO: 124379

SEQ ID NO: 358651 - RNA, 64 nt, Homo Sapiens; identical to SEQ ID NO: 124380

SEQ ID NO: 358652 - RNA, 64 nt, Homo Sapiens; identical to SEQ ID NO: 124381

SEQ ID NO: 358653 - RNA, 64 nt, Homo Sapiens; identical to SEQ ID NO: 124382

SEQ ID NO: 358654 - RNA, 64 nt, Homo Sapiens; identical to SEQ ID NO: 124383

SEQ ID NO: 358655 - RNA, 64 nt, Homo Sapiens; identical to SEQ ID NO: 124384

SEQ ID NO: 358656 - RNA, 64 nt, Homo Sapiens; identical to SEQ ID NO: 165778

SEQ ID NO: 358657 - RNA, 64 nt, Homo Sapiens; identical to SEQ ID NO: 165779

SEQ ID NO: 358658 - RNA, 64 nt, Homo Sapiens; identical to SEQ ID NO: 165780

SEQ ID NO: 358659 - RNA, 64 nt, Homo Sapiens; identical to SEQ ID NO: 165781

SEQ ID NO: 358660 - RNA, 64 nt, Homo Sapiens; identical to SEQ ID NO: 165782

SEQ ID NO: 358661 - RNA, 64 nt, Homo Sapiens; identical to SEQ ID NO: 165783

SEQ ID NO: 358662 - RNA, 64 nt, Homo Sapiens; identical to SEQ ID NO: 165784

SEQ ID NO: 358663 - RNA, 64 nt, Homo Sapiens; identical to SEQ ID NO: 165785

SEQ ID NO: 358664 - RNA, 64 nt, Homo Sapiens; identical to SEQ ID NO: 165786

SEQ ID NO: 358665 - RNA, 64 nt, Homo Sapiens; identical to SEQ ID NO: 165787

SEQ ID NO: 358666 - RNA, 64 nt, Homo Sapiens; identical to SEQ ID NO: 165788

SEQ ID NO: 358667 - RNA, 64 nt, Homo Sapiens; identical to SEQ ID NO: 165789

SEQ ID NO: 358668 - RNA, 64 nt, Homo Sapiens; identical to SEQ ID NO: 165790

SEQ ID NO: 358669 - RNA, 64 nt, Homo Sapiens; identical to SEQ ID NO: 165791

SEQ ID NO: 358670 - RNA, 64 nt, Homo Sapiens; identical to SEQ ID NO: 165792

SEQ ID NO: 358671 - RNA, 64 nt, Homo Sapiens; identical to SEQ ID NO: 165793

SEQ ID NO: 358672 - RNA, 64 nt, Homo Sapiens; identical to SEQ ID NO: 165794

SEQ ID NO: 358673 - RNA, 64 nt, Homo Sapiens; identical to SEQ ID NO: 165795

SEQ ID NO: 358674 - RNA, 64 nt, Homo Sapiens; identical to SEQ ID NO: 165796

SEQ ID NO: 358675 - RNA, 64 nt, Homo Sapiens; identical to SEQ ID NO: 165797

SEQ ID NO: 358676 - RNA, 64 nt, Homo Sapiens; identical to SEQ ID NO: 165798

SEQ ID NO: 358677 - RNA, 64 nt, Homo Sapiens; identical to SEQ ID NO: 165799

SEQ ID NO: 358678 - RNA, 64 nt, Homo Sapiens
ugggggugucucacucucugucuuuauagccggcgguagccaccgggguggcucugucagaguu

SEQ ID NO: 358679 - RNA, 64 nt, Homo Sapiens
ggaacugcccucccccuuagcucacagugccugcgguagccacucuaggucguuggccuuccuu

SEQ ID NO: 358680 - RNA, 64 nt, Homo Sapiens; identical to SEQ ID NO: 107033

SEQ ID NO: 358681 - RNA, 64 nt, Homo Sapiens; identical to SEQ ID NO: 107034

SEQ ID NO: 358682 - RNA, 64 nt, Homo Sapiens; identical to SEQ ID NO: 107035

SEQ ID NO: 358683 - RNA, 64 nt, Homo Sapiens; identical to SEQ ID NO: 107036

SEQ ID NO: 358684 - RNA, 64 nt, Homo Sapiens; identical to SEQ ID NO: 107037

SEQ ID NO: 358685 - RNA, 64 nt, Homo Sapiens; identical to SEQ ID NO: 107038

SEQ ID NO: 358686 - RNA, 64 nt, Homo Sapiens; identical to SEQ ID NO: 107039

SEQ ID NO: 358687 - RNA, 64 nt, Homo Sapiens; identical to SEQ ID NO: 107040

SEQ ID NO: 358688 - RNA, 64 nt, Homo Sapiens; identical to SEQ ID NO: 107041

SEQ ID NO: 358689 - RNA, 64 nt, Homo Sapiens; identical to SEQ ID NO: 107042

SEQ ID NO: 358690 - RNA, 64 nt, Homo Sapiens; identical to SEQ ID NO: 107043

SEQ ID NO: 358691 - RNA, 64 nt, Homo Sapiens; identical to SEQ ID NO: 107044

SEQ ID NO: 358692 - RNA, 64 nt, Homo Sapiens; identical to SEQ ID NO: 107045

SEQ ID NO: 358693 - RNA, 64 nt, Homo Sapiens; identical to SEQ ID NO: 107046

SEQ ID NO: 358694 - RNA, 64 nt, Homo Sapiens; identical to SEQ ID NO: 107047

SEQ ID NO: 358695 - RNA, 64 nt, Homo Sapiens; identical to SEQ ID NO: 107048

SEQ ID NO: 358696 - RNA, 64 nt, Homo Sapiens; identical to SEQ ID NO: 107049

SEQ ID NO: 358697 - RNA, 64 nt, Homo Sapiens; identical to SEQ ID NO: 107050

SEQ ID NO: 358698 - RNA, 64 nt, Homo Sapiens; identical to SEQ ID NO: 107051

SEQ ID NO: 358699 - RNA, 64 nt, Homo Sapiens; identical to SEQ ID NO: 107052

SEQ ID NO: 358700 - RNA, 64 nt, Homo Sapiens; identical to SEQ ID NO: 107053

SEQ ID NO: 358701 - RNA, 64 nt, Homo Sapiens; identical to SEQ ID NO: 107054

SEQ ID NO: 358702 - RNA, 64 nt, Homo Sapiens; identical to SEQ ID NO: 107055

SEQ ID NO: 358703 - RNA, 64 nt, Homo Sapiens; identical to SEQ ID NO: 107056

SEQ ID NO: 358704 - RNA, 64 nt, Homo Sapiens; identical to SEQ ID NO: 107057

SEQ ID NO: 358705 - RNA, 64 nt, Homo Sapiens; identical to SEQ ID NO: 107058

SEQ ID NO: 358706 - RNA, 64 nt, Homo Sapiens; identical to SEQ ID NO: 107059

SEQ ID NO: 358707 - RNA, 64 nt, Homo Sapiens; identical to SEQ ID NO: 107060

SEQ ID NO: 358708 - RNA, 64 nt, Homo Sapiens; identical to SEQ ID NO: 107061

SEQ ID NO: 358709 - RNA, 64 nt, Homo Sapiens; identical to SEQ ID NO: 107062

SEQ ID NO: 358710 - RNA, 64 nt, Homo Sapiens; identical to SEQ ID NO: 107063

SEQ ID NO: 358711 - RNA, 64 nt, Homo Sapiens; identical to SEQ ID NO: 107064

SEQ ID NO: 358712 - RNA, 64 nt, Homo Sapiens; identical to SEQ ID NO: 107065

SEQ ID NO: 358713 - RNA, 64 nt, Homo Sapiens; identical to SEQ ID NO: 107066

SEQ ID NO: 358714 - RNA, 64 nt, Homo Sapiens; identical to SEQ ID NO: 107067

SEQ ID NO: 358715 - RNA, 64 nt, Homo Sapiens; identical to SEQ ID NO: 107068

SEQ ID NO: 358716 - RNA, 64 nt, Homo Sapiens; identical to SEQ ID NO: 107069

SEQ ID NO: 358717 - RNA, 64 nt, Homo Sapiens; identical to SEQ ID NO: 107070

SEQ ID NO: 358718 - RNA, 64 nt, Homo Sapiens; identical to SEQ ID NO: 107071

SEQ ID NO: 358719 - RNA, 64 nt, Homo Sapiens; identical to SEQ ID NO: 107072

SEQ ID NO: 358720 - RNA, 64 nt, Homo Sapiens; identical to SEQ ID NO: 107073

SEQ ID NO: 358721 - RNA, 62 nt, Homo Sapiens; identical to SEQ ID NO: 107074

SEQ ID NO: 358722 - RNA, 64 nt, Homo Sapiens; identical to SEQ ID NO: 107075

SEQ ID NO: 358723 - RNA, 64 nt, Homo Sapiens; identical to SEQ ID NO: 107076

SEQ ID NO: 358724 - RNA, 64 nt, Homo Sapiens; identical to SEQ ID NO: 107077

SEQ ID NO: 358725 - RNA, 64 nt, Homo Sapiens; identical to SEQ ID NO: 107078

SEQ ID NO: 358726 - RNA, 64 nt, Homo Sapiens; identical to SEQ ID NO: 107079

SEQ ID NO: 358727 - RNA, 64 nt, Homo Sapiens; identical to SEQ ID NO: 107080

SEQ ID NO: 358728 - RNA, 64 nt, Homo Sapiens; identical to SEQ ID NO: 107081

SEQ ID NO: 358729 - RNA, 64 nt, Homo Sapiens; identical to SEQ ID NO: 107082

SEQ ID NO: 358730 - RNA, 64 nt, Homo Sapiens; identical to SEQ ID NO: 107083

SEQ ID NO: 358731 - RNA, 64 nt, Homo Sapiens; identical to SEQ ID NO: 107084

SEQ ID NO: 358732 - RNA, 64 nt, Homo Sapiens; identical to SEQ ID NO: 107085

SEQ ID NO: 358733 - RNA, 64 nt, Homo Sapiens; identical to SEQ ID NO: 107086

SEQ ID NO: 358734 - RNA, 64 nt, Homo Sapiens; identical to SEQ ID NO: 107087

SEQ ID NO: 358735 - RNA, 64 nt, Homo Sapiens; identical to SEQ ID NO: 107088

SEQ ID NO: 358736 - RNA, 64 nt, Homo Sapiens; identical to SEQ ID NO: 107089

SEQ ID NO: 358737 - RNA, 64 nt, Homo Sapiens; identical to SEQ ID NO: 107090

SEQ ID NO: 358738 - RNA, 64 nt, Homo Sapiens; identical to SEQ ID NO: 107091

SEQ ID NO: 358739 - RNA, 64 nt, Homo Sapiens; identical to SEQ ID NO: 107092

SEQ ID NO: 358740 - RNA, 64 nt, Homo Sapiens; identical to SEQ ID NO: 107093

SEQ ID NO: 358741 - RNA, 64 nt, Homo Sapiens; identical to SEQ ID NO: 107094

SEQ ID NO: 358742 - RNA, 64 nt, Homo Sapiens; identical to SEQ ID NO: 107095

SEQ ID NO: 358743 - RNA, 64 nt, Homo Sapiens; identical to SEQ ID NO: 107096

SEQ ID NO: 358744 - RNA, 64 nt, Homo Sapiens; identical to SEQ ID NO: 107097

SEQ ID NO: 358745 - RNA, 64 nt, Homo Sapiens; identical to SEQ ID NO: 107098

SEQ ID NO: 358746 - RNA, 64 nt, Homo Sapiens; identical to SEQ ID NO: 107099

SEQ ID NO: 358747 - RNA, 64 nt, Homo Sapiens; identical to SEQ ID NO: 107100

SEQ ID NO: 358748 - RNA, 64 nt, Homo Sapiens; identical to SEQ ID NO: 107101

SEQ ID NO: 358749 - RNA, 64 nt, Homo Sapiens; identical to SEQ ID NO: 107102

SEQ ID NO: 358750 - RNA, 64 nt, Homo Sapiens; identical to SEQ ID NO: 107103

SEQ ID NO: 358751 - RNA, 64 nt, Homo Sapiens; identical to SEQ ID NO: 107104

SEQ ID NO: 358752 - RNA, 64 nt, Homo Sapiens; identical to SEQ ID NO: 107105

SEQ ID NO: 358753 - RNA, 64 nt, Homo Sapiens; identical to SEQ ID NO: 107106

SEQ ID NO: 358754 - RNA, 64 nt, Homo Sapiens; identical to SEQ ID NO: 107107

SEQ ID NO: 358755 - RNA, 64 nt, Homo Sapiens; identical to SEQ ID NO: 107108

SEQ ID NO: 358756 - RNA, 64 nt, Homo Sapiens; identical to SEQ ID NO: 107109

SEQ ID NO: 358757 - RNA, 64 nt, Homo Sapiens; identical to SEQ ID NO: 107110

SEQ ID NO: 358758 - RNA, 64 nt, Homo Sapiens; identical to SEQ ID NO: 107111

SEQ ID NO: 358759 - RNA, 64 nt, Homo Sapiens; identical to SEQ ID NO: 107112

SEQ ID NO: 358760 - RNA, 64 nt, Homo Sapiens; identical to SEQ ID NO: 107113

SEQ ID NO: 358761 - RNA, 64 nt, Homo Sapiens; identical to SEQ ID NO: 107114

SEQ ID NO: 358762 - RNA, 64 nt, Homo Sapiens; identical to SEQ ID NO: 107115

SEQ ID NO: 358763 - RNA, 64 nt, Homo Sapiens; identical to SEQ ID NO: 107116

SEQ ID NO: 358764 - RNA, 64 nt, Homo Sapiens; identical to SEQ ID NO: 107117

SEQ ID NO: 358765 - RNA, 64 nt, Homo Sapiens; identical to SEQ ID NO: 107118

SEQ ID NO: 358766 - RNA, 64 nt, Homo Sapiens; identical to SEQ ID NO: 107119

SEQ ID NO: 358767 - RNA, 64 nt, Homo Sapiens; identical to SEQ ID NO: 107120

SEQ ID NO: 358768 - RNA, 64 nt, Homo Sapiens; identical to SEQ ID NO: 107121

SEQ ID NO: 358769 - RNA, 64 nt, Homo Sapiens; identical to SEQ ID NO: 107122

SEQ ID NO: 358770 - RNA, 64 nt, Homo Sapiens; identical to SEQ ID NO: 107123

SEQ ID NO: 358771 - RNA, 64 nt, Homo Sapiens; identical to SEQ ID NO: 107124

SEQ ID NO: 358772 - RNA, 64 nt, Homo Sapiens; identical to SEQ ID NO: 107125

SEQ ID NO: 358773 - RNA, 64 nt, Homo Sapiens; identical to SEQ ID NO: 107126

SEQ ID NO: 358774 - RNA, 64 nt, Homo Sapiens; identical to SEQ ID NO: 107127

SEQ ID NO: 358775 - RNA, 64 nt, Homo Sapiens; identical to SEQ ID NO: 107128

SEQ ID NO: 358776 - RNA, 64 nt, Homo Sapiens; identical to SEQ ID NO: 107129

SEQ ID NO: 358777 - RNA, 64 nt, Homo Sapiens; identical to SEQ ID NO: 107130

SEQ ID NO: 358778 - RNA, 64 nt, Homo Sapiens; identical to SEQ ID NO: 107131

SEQ ID NO: 358779 - RNA, 64 nt, Homo Sapiens; identical to SEQ ID NO: 107132

SEQ ID NO: 358780 - RNA, 64 nt, Homo Sapiens; identical to SEQ ID NO: 107133

SEQ ID NO: 358781 - RNA, 64 nt, Homo Sapiens; identical to SEQ ID NO: 107134

SEQ ID NO: 358782 - RNA, 64 nt, Homo Sapiens; identical to SEQ ID NO: 107135

SEQ ID NO: 358783 - RNA, 64 nt, Homo Sapiens; identical to SEQ ID NO: 107136

SEQ ID NO: 358784 - RNA, 64 nt, Homo Sapiens; identical to SEQ ID NO: 107137

SEQ ID NO: 358785 - RNA, 64 nt, Homo Sapiens; identical to SEQ ID NO: 107138

SEQ ID NO: 358786 - RNA, 64 nt, Homo Sapiens; identical to SEQ ID NO: 107139

SEQ ID NO: 358787 - RNA, 64 nt, Homo Sapiens; identical to SEQ ID NO: 107140

SEQ ID NO: 358788 - RNA, 64 nt, Homo Sapiens; identical to SEQ ID NO: 107141

SEQ ID NO: 358789 - RNA, 64 nt, Homo Sapiens; identical to SEQ ID NO: 107142

SEQ ID NO: 358790 - RNA, 64 nt, Homo Sapiens; identical to SEQ ID NO: 107143

SEQ ID NO: 358791 - RNA, 64 nt, Homo Sapiens; identical to SEQ ID NO: 107144

SEQ ID NO: 358792 - RNA, 64 nt, Homo Sapiens; identical to SEQ ID NO: 107145

SEQ ID NO: 358793 - RNA, 64 nt, Homo Sapiens; identical to SEQ ID NO: 107146

SEQ ID NO: 358794 - RNA, 64 nt, Homo Sapiens; identical to SEQ ID NO: 107147

SEQ ID NO: 358795 - RNA, 64 nt, Homo Sapiens; identical to SEQ ID NO: 107148

SEQ ID NO: 358796 - RNA, 64 nt, Homo Sapiens; identical to SEQ ID NO: 107149

SEQ ID NO: 358797 - RNA, 64 nt, Homo Sapiens; identical to SEQ ID NO: 107150

SEQ ID NO: 358798 - RNA, 64 nt, Homo Sapiens; identical to SEQ ID NO: 107151

SEQ ID NO: 358799 - RNA, 64 nt, Homo Sapiens; identical to SEQ ID NO: 107152

SEQ ID NO: 358800 - RNA, 64 nt, Homo Sapiens; identical to SEQ ID NO: 107153

SEQ ID NO: 358801 - RNA, 64 nt, Homo Sapiens; identical to SEQ ID NO: 107154

SEQ ID NO: 358802 - RNA, 64 nt, Homo Sapiens; identical to SEQ ID NO: 107155

SEQ ID NO: 358803 - RNA, 64 nt, Homo Sapiens; identical to SEQ ID NO: 107156

SEQ ID NO: 358804 - RNA, 64 nt, Homo Sapiens; identical to SEQ ID NO: 107157

SEQ ID NO: 358805 - RNA, 64 nt, Homo Sapiens; identical to SEQ ID NO: 107158

SEQ ID NO: 358806 - RNA, 64 nt, Homo Sapiens; identical to SEQ ID NO: 107159

SEQ ID NO: 358807 - RNA, 64 nt, Homo Sapiens; identical to SEQ ID NO: 107160

SEQ ID NO: 358808 - RNA, 64 nt, Homo Sapiens; identical to SEQ ID NO: 107161

SEQ ID NO: 358809 - RNA, 64 nt, Homo Sapiens; identical to SEQ ID NO: 107162

SEQ ID NO: 358810 - RNA, 64 nt, Homo Sapiens; identical to SEQ ID NO: 107163

SEQ ID NO: 358811 - RNA, 64 nt, Homo Sapiens; identical to SEQ ID NO: 107164

SEQ ID NO: 358812 - RNA, 64 nt, Homo Sapiens; identical to SEQ ID NO: 107165

SEQ ID NO: 358813 - RNA, 64 nt, Homo Sapiens; identical to SEQ ID NO: 107166

SEQ ID NO: 358814 - RNA, 64 nt, Homo Sapiens; identical to SEQ ID NO: 107167

SEQ ID NO: 358815 - RNA, 64 nt, Homo Sapiens; identical to SEQ ID NO: 107168

SEQ ID NO: 358816 - RNA, 64 nt, Homo Sapiens; identical to SEQ ID NO: 107169

SEQ ID NO: 358817 - RNA, 64 nt, Homo Sapiens; identical to SEQ ID NO: 107170

SEQ ID NO: 358818 - RNA, 64 nt, Homo Sapiens; identical to SEQ ID NO: 107171

SEQ ID NO: 358819 - RNA, 64 nt, Homo Sapiens; identical to SEQ ID NO: 107172

SEQ ID NO: 358820 - RNA, 64 nt, Homo Sapiens; identical to SEQ ID NO: 107173

SEQ ID NO: 358821 - RNA, 64 nt, Homo Sapiens; identical to SEQ ID NO: 107174

SEQ ID NO: 358822 - RNA, 64 nt, Homo Sapiens; identical to SEQ ID NO: 107175

SEQ ID NO: 358823 - RNA, 64 nt, Homo Sapiens; identical to SEQ ID NO: 107176

SEQ ID NO: 358824 - RNA, 64 nt, Homo Sapiens; identical to SEQ ID NO: 107177

SEQ ID NO: 358825 - RNA, 64 nt, Homo Sapiens; identical to SEQ ID NO: 107178

SEQ ID NO: 358826 - RNA, 64 nt, Homo Sapiens; identical to SEQ ID NO: 107179

SEQ ID NO: 358827 - RNA, 64 nt, Homo Sapiens; identical to SEQ ID NO: 107180

SEQ ID NO: 358828 - RNA, 64 nt, Homo Sapiens; identical to SEQ ID NO: 107181

SEQ ID NO: 358829 - RNA, 64 nt, Homo Sapiens; identical to SEQ ID NO: 107182

SEQ ID NO: 358830 - RNA, 64 nt, Homo Sapiens; identical to SEQ ID NO: 107183

SEQ ID NO: 358831 - RNA, 64 nt, Homo Sapiens; identical to SEQ ID NO: 107184

SEQ ID NO: 358832 - RNA, 64 nt, Homo Sapiens; identical to SEQ ID NO: 107185

SEQ ID NO: 358833 - RNA, 64 nt, Homo Sapiens; identical to SEQ ID NO: 107186

SEQ ID NO: 358834 - RNA, 64 nt, Homo Sapiens; identical to SEQ ID NO: 107187

SEQ ID NO: 358835 - RNA, 64 nt, Homo Sapiens; identical to SEQ ID NO: 107188

SEQ ID NO: 358836 - RNA, 64 nt, Homo Sapiens; identical to SEQ ID NO: 107189

SEQ ID NO: 358837 - RNA, 64 nt, Homo Sapiens; identical to SEQ ID NO: 107190

SEQ ID NO: 358838 - RNA, 64 nt, Homo Sapiens; identical to SEQ ID NO: 107191

SEQ ID NO: 358839 - RNA, 64 nt, Homo Sapiens; identical to SEQ ID NO: 107192

SEQ ID NO: 358840 - RNA, 64 nt, Homo Sapiens; identical to SEQ ID NO: 107193

SEQ ID NO: 358841 - RNA, 64 nt, Homo Sapiens; identical to SEQ ID NO: 107194

SEQ ID NO: 358842 - RNA, 64 nt, Homo Sapiens; identical to SEQ ID NO: 107195

SEQ ID NO: 358843 - RNA, 64 nt, Homo Sapiens; identical to SEQ ID NO: 107196

SEQ ID NO: 358844 - RNA, 64 nt, Homo Sapiens; identical to SEQ ID NO: 107197

SEQ ID NO: 358845 - RNA, 64 nt, Homo Sapiens; identical to SEQ ID NO: 107198

SEQ ID NO: 358846 - RNA, 64 nt, Homo Sapiens; identical to SEQ ID NO: 107199

SEQ ID NO: 358847 - RNA, 64 nt, Homo Sapiens; identical to SEQ ID NO: 107200

SEQ ID NO: 358848 - RNA, 64 nt, Homo Sapiens; identical to SEQ ID NO: 107201

SEQ ID NO: 358849 - RNA, 64 nt, Homo Sapiens; identical to SEQ ID NO: 107202

SEQ ID NO: 358850 - RNA, 64 nt, Homo Sapiens; identical to SEQ ID NO: 107203

SEQ ID NO: 358851 - RNA, 64 nt, Homo Sapiens; identical to SEQ ID NO: 107204

SEQ ID NO: 358852 - RNA, 64 nt, Homo Sapiens; identical to SEQ ID NO: 107205

SEQ ID NO: 358853 - RNA, 64 nt, Homo Sapiens; identical to SEQ ID NO: 107206

SEQ ID NO: 358854 - RNA, 64 nt, Homo Sapiens; identical to SEQ ID NO: 107207

SEQ ID NO: 358855 - RNA, 64 nt, Homo Sapiens; identical to SEQ ID NO: 107208

SEQ ID NO: 358856 - RNA, 64 nt, Homo Sapiens; identical to SEQ ID NO: 107209

SEQ ID NO: 358857 - RNA, 64 nt, Homo Sapiens; identical to SEQ ID NO: 107210

SEQ ID NO: 358858 - RNA, 64 nt, Homo Sapiens; identical to SEQ ID NO: 107211

SEQ ID NO: 358859 - RNA, 64 nt, Homo Sapiens; identical to SEQ ID NO: 107212

SEQ ID NO: 358860 - RNA, 64 nt, Homo Sapiens; identical to SEQ ID NO: 107213

SEQ ID NO: 358861 - RNA, 64 nt, Homo Sapiens; identical to SEQ ID NO: 107214

SEQ ID NO: 358862 - RNA, 64 nt, Homo Sapiens; identical to SEQ ID NO: 107215

SEQ ID NO: 358863 - RNA, 64 nt, Homo Sapiens; identical to SEQ ID NO: 107216

SEQ ID NO: 358864 - RNA, 64 nt, Homo Sapiens; identical to SEQ ID NO: 107217

SEQ ID NO: 358865 - RNA, 64 nt, Homo Sapiens; identical to SEQ ID NO: 107218

SEQ ID NO: 358866 - RNA, 64 nt, Homo Sapiens; identical to SEQ ID NO: 107219

SEQ ID NO: 358867 - RNA, 64 nt, Homo Sapiens; identical to SEQ ID NO: 107220

SEQ ID NO: 358868 - RNA, 64 nt, Homo Sapiens; identical to SEQ ID NO: 107221

SEQ ID NO: 358869 - RNA, 64 nt, Homo Sapiens; identical to SEQ ID NO: 107222

SEQ ID NO: 358870 - RNA, 64 nt, Homo Sapiens; identical to SEQ ID NO: 107223

SEQ ID NO: 358871 - RNA, 64 nt, Homo Sapiens; identical to SEQ ID NO: 107224

SEQ ID NO: 358872 - RNA, 64 nt, Homo Sapiens; identical to SEQ ID NO: 107225

SEQ ID NO: 358873 - RNA, 64 nt, Homo Sapiens; identical to SEQ ID NO: 107226

SEQ ID NO: 358874 - RNA, 64 nt, Homo Sapiens; identical to SEQ ID NO: 107227

SEQ ID NO: 358875 - RNA, 64 nt, Homo Sapiens; identical to SEQ ID NO: 107228

SEQ ID NO: 358876 - RNA, 64 nt, Homo Sapiens; identical to SEQ ID NO: 107229

SEQ ID NO: 358877 - RNA, 64 nt, Homo Sapiens; identical to SEQ ID NO: 107230

SEQ ID NO: 358878 - RNA, 64 nt, Homo Sapiens; identical to SEQ ID NO: 107231

SEQ ID NO: 358879 - RNA, 64 nt, Homo Sapiens; identical to SEQ ID NO: 107232

SEQ ID NO: 358880 - RNA, 64 nt, Homo Sapiens; identical to SEQ ID NO: 107233

SEQ ID NO: 358881 - RNA, 64 nt, Homo Sapiens; identical to SEQ ID NO: 107234

SEQ ID NO: 358882 - RNA, 64 nt, Homo Sapiens; identical to SEQ ID NO: 107235

SEQ ID NO: 358883 - RNA, 64 nt, Homo Sapiens; identical to SEQ ID NO: 107236

SEQ ID NO: 358884 - RNA, 64 nt, Homo Sapiens; identical to SEQ ID NO: 107237

SEQ ID NO: 358885 - RNA, 64 nt, Homo Sapiens; identical to SEQ ID NO: 107238

SEQ ID NO: 358886 - RNA, 64 nt, Homo Sapiens; identical to SEQ ID NO: 107239

SEQ ID NO: 358887 - RNA, 64 nt, Homo Sapiens; identical to SEQ ID NO: 107240

SEQ ID NO: 358888 - RNA, 64 nt, Homo Sapiens; identical to SEQ ID NO: 107241

SEQ ID NO: 358889 - RNA, 64 nt, Homo Sapiens; identical to SEQ ID NO: 107242

SEQ ID NO: 358890 - RNA, 64 nt, Homo Sapiens; identical to SEQ ID NO: 107243

SEQ ID NO: 358891 - RNA, 64 nt, Homo Sapiens; identical to SEQ ID NO: 107244

SEQ ID NO: 358892 - RNA, 64 nt, Homo Sapiens; identical to SEQ ID NO: 107245

SEQ ID NO: 358893 - RNA, 64 nt, Homo Sapiens; identical to SEQ ID NO: 107246

SEQ ID NO: 358894 - RNA, 64 nt, Homo Sapiens; identical to SEQ ID NO: 107247

SEQ ID NO: 358895 - RNA, 64 nt, Homo Sapiens; identical to SEQ ID NO: 107248

SEQ ID NO: 358896 - RNA, 64 nt, Homo Sapiens; identical to SEQ ID NO: 107249

SEQ ID NO: 358897 - RNA, 64 nt, Homo Sapiens; identical to SEQ ID NO: 107250

SEQ ID NO: 358898 - RNA, 64 nt, Homo Sapiens; identical to SEQ ID NO: 107251

SEQ ID NO: 358899 - RNA, 64 nt, Homo Sapiens; identical to SEQ ID NO: 107252

SEQ ID NO: 358900 - RNA, 64 nt, Homo Sapiens; identical to SEQ ID NO: 107253

SEQ ID NO: 358901 - RNA, 64 nt, Homo Sapiens; identical to SEQ ID NO: 107254

SEQ ID NO: 358902 - RNA, 64 nt, Homo Sapiens; identical to SEQ ID NO: 107255

SEQ ID NO: 358903 - RNA, 64 nt, Homo Sapiens; identical to SEQ ID NO: 107256

SEQ ID NO: 358904 - RNA, 64 nt, Homo Sapiens; identical to SEQ ID NO: 107257

SEQ ID NO: 358905 - RNA, 64 nt, Homo Sapiens; identical to SEQ ID NO: 107258

SEQ ID NO: 358906 - RNA, 64 nt, Homo Sapiens; identical to SEQ ID NO: 107259

SEQ ID NO: 358907 - RNA, 64 nt, Homo Sapiens; identical to SEQ ID NO: 107260

SEQ ID NO: 358908 - RNA, 64 nt, Homo Sapiens; identical to SEQ ID NO: 107261

SEQ ID NO: 358909 - RNA, 64 nt, Homo Sapiens; identical to SEQ ID NO: 107262

SEQ ID NO: 358910 - RNA, 64 nt, Homo Sapiens; identical to SEQ ID NO: 107263

SEQ ID NO: 358911 - RNA, 64 nt, Homo Sapiens; identical to SEQ ID NO: 107264

SEQ ID NO: 358912 - RNA, 64 nt, Homo Sapiens; identical to SEQ ID NO: 107265

SEQ ID NO: 358913 - RNA, 64 nt, Homo Sapiens; identical to SEQ ID NO: 107266

SEQ ID NO: 358914 - RNA, 64 nt, Homo Sapiens; identical to SEQ ID NO: 107267

SEQ ID NO: 358915 - RNA, 64 nt, Homo Sapiens; identical to SEQ ID NO: 107268

SEQ ID NO: 358916 - RNA, 64 nt, Homo Sapiens; identical to SEQ ID NO: 107269

SEQ ID NO: 358917 - RNA, 64 nt, Homo Sapiens; identical to SEQ ID NO: 107270

SEQ ID NO: 358918 - RNA, 64 nt, Homo Sapiens; identical to SEQ ID NO: 107271

SEQ ID NO: 358919 - RNA, 64 nt, Homo Sapiens; identical to SEQ ID NO: 107272

SEQ ID NO: 358920 - RNA, 64 nt, Homo Sapiens; identical to SEQ ID NO: 107273

SEQ ID NO: 358921 - RNA, 64 nt, Homo Sapiens; identical to SEQ ID NO: 107274

SEQ ID NO: 358922 - RNA, 64 nt, Homo Sapiens; identical to SEQ ID NO: 107275

SEQ ID NO: 358923 - RNA, 64 nt, Homo Sapiens; identical to SEQ ID NO: 107276

SEQ ID NO: 358924 - RNA, 64 nt, Homo Sapiens; identical to SEQ ID NO: 107277

SEQ ID NO: 358925 - RNA, 64 nt, Homo Sapiens; identical to SEQ ID NO: 107278

SEQ ID NO: 358926 - RNA, 64 nt, Homo Sapiens; identical to SEQ ID NO: 107279

SEQ ID NO: 358927 - RNA, 64 nt, Homo Sapiens; identical to SEQ ID NO: 107280

SEQ ID NO: 358928 - RNA, 64 nt, Homo Sapiens; identical to SEQ ID NO: 107281

SEQ ID NO: 358929 - RNA, 64 nt, Homo Sapiens; identical to SEQ ID NO: 107282

SEQ ID NO: 358930 - RNA, 64 nt, Homo Sapiens; identical to SEQ ID NO: 107283

SEQ ID NO: 358931 - RNA, 64 nt, Homo Sapiens; identical to SEQ ID NO: 107284

SEQ ID NO: 358932 - RNA, 64 nt, Homo Sapiens; identical to SEQ ID NO: 107285

SEQ ID NO: 358933 - RNA, 64 nt, Homo Sapiens; identical to SEQ ID NO: 107286

SEQ ID NO: 358934 - RNA, 64 nt, Homo Sapiens; identical to SEQ ID NO: 107287

SEQ ID NO: 358935 - RNA, 64 nt, Homo Sapiens; identical to SEQ ID NO: 107288

SEQ ID NO: 358936 - RNA, 64 nt, Homo Sapiens; identical to SEQ ID NO: 107289

SEQ ID NO: 358937 - RNA, 64 nt, Homo Sapiens; identical to SEQ ID NO: 107290

SEQ ID NO: 358938 - RNA, 64 nt, Homo Sapiens; identical to SEQ ID NO: 107291

SEQ ID NO: 358939 - RNA, 64 nt, Homo Sapiens; identical to SEQ ID NO: 107292

SEQ ID NO: 358940 - RNA, 64 nt, Homo Sapiens; identical to SEQ ID NO: 107293

SEQ ID NO: 358941 - RNA, 64 nt, Homo Sapiens; identical to SEQ ID NO: 107294

SEQ ID NO: 358942 - RNA, 64 nt, Homo Sapiens; identical to SEQ ID NO: 107295

SEQ ID NO: 358943 - RNA, 64 nt, Homo Sapiens; identical to SEQ ID NO: 107296

SEQ ID NO: 358944 - RNA, 64 nt, Homo Sapiens; identical to SEQ ID NO: 107297

SEQ ID NO: 358945 - RNA, 64 nt, Homo Sapiens; identical to SEQ ID NO: 107298

SEQ ID NO: 358946 - RNA, 64 nt, Homo Sapiens; identical to SEQ ID NO: 107299

SEQ ID NO: 358947 - RNA, 64 nt, Homo Sapiens; identical to SEQ ID NO: 107300

SEQ ID NO: 358948 - RNA, 64 nt, Homo Sapiens; identical to SEQ ID NO: 107301

SEQ ID NO: 358949 - RNA, 64 nt, Homo Sapiens; identical to SEQ ID NO: 107302

SEQ ID NO: 358950 - RNA, 64 nt, Homo Sapiens; identical to SEQ ID NO: 107303

SEQ ID NO: 358951 - RNA, 64 nt, Homo Sapiens; identical to SEQ ID NO: 107304

SEQ ID NO: 358952 - RNA, 64 nt, Homo Sapiens; identical to SEQ ID NO: 107305

SEQ ID NO: 358953 - RNA, 64 nt, Homo Sapiens; identical to SEQ ID NO: 107306

SEQ ID NO: 358954 - RNA, 64 nt, Homo Sapiens; identical to SEQ ID NO: 107307

SEQ ID NO: 358955 - RNA, 64 nt, Homo Sapiens; identical to SEQ ID NO: 107308

SEQ ID NO: 358956 - RNA, 64 nt, Homo Sapiens; identical to SEQ ID NO: 107309

SEQ ID NO: 358957 - RNA, 64 nt, Homo Sapiens; identical to SEQ ID NO: 107310

SEQ ID NO: 358958 - RNA, 64 nt, Homo Sapiens; identical to SEQ ID NO: 107311

SEQ ID NO: 358959 - RNA, 64 nt, Homo Sapiens; identical to SEQ ID NO: 107312

SEQ ID NO: 358960 - RNA, 64 nt, Homo Sapiens; identical to SEQ ID NO: 107313

SEQ ID NO: 358961 - RNA, 64 nt, Homo Sapiens; identical to SEQ ID NO: 107314

SEQ ID NO: 358962 - RNA, 64 nt, Homo Sapiens; identical to SEQ ID NO: 107315

SEQ ID NO: 358963 - RNA, 64 nt, Homo Sapiens; identical to SEQ ID NO: 107316

SEQ ID NO: 358964 - RNA, 64 nt, Homo Sapiens; identical to SEQ ID NO: 107317

SEQ ID NO: 358965 - RNA, 64 nt, Homo Sapiens; identical to SEQ ID NO: 107318

SEQ ID NO: 358966 - RNA, 64 nt, Homo Sapiens; identical to SEQ ID NO: 107319

SEQ ID NO: 358967 - RNA, 64 nt, Homo Sapiens; identical to SEQ ID NO: 107320

SEQ ID NO: 358968 - RNA, 64 nt, Homo Sapiens; identical to SEQ ID NO: 107321

SEQ ID NO: 358969 - RNA, 64 nt, Homo Sapiens; identical to SEQ ID NO: 107322

SEQ ID NO: 358970 - RNA, 64 nt, Homo Sapiens; identical to SEQ ID NO: 107323

SEQ ID NO: 358971 - RNA, 64 nt, Homo Sapiens; identical to SEQ ID NO: 107324

SEQ ID NO: 358972 - RNA, 64 nt, Homo Sapiens; identical to SEQ ID NO: 107325

SEQ ID NO: 358973 - RNA, 64 nt, Homo Sapiens; identical to SEQ ID NO: 107326

SEQ ID NO: 358974 - RNA, 64 nt, Homo Sapiens; identical to SEQ ID NO: 107327

SEQ ID NO: 358975 - RNA, 64 nt, Homo Sapiens; identical to SEQ ID NO: 107328

SEQ ID NO: 358976 - RNA, 64 nt, Homo Sapiens; identical to SEQ ID NO: 107329

SEQ ID NO: 358977 - RNA, 64 nt, Homo Sapiens; identical to SEQ ID NO: 107330

SEQ ID NO: 358978 - RNA, 64 nt, Homo Sapiens; identical to SEQ ID NO: 107331

SEQ ID NO: 358979 - RNA, 64 nt, Homo Sapiens; identical to SEQ ID NO: 107332

SEQ ID NO: 358980 - RNA, 64 nt, Homo Sapiens; identical to SEQ ID NO: 107333

SEQ ID NO: 358981 - RNA, 64 nt, Homo Sapiens; identical to SEQ ID NO: 107334

SEQ ID NO: 358982 - RNA, 64 nt, Homo Sapiens; identical to SEQ ID NO: 107335

SEQ ID NO: 358983 - RNA, 64 nt, Homo Sapiens; identical to SEQ ID NO: 107336

SEQ ID NO: 358984 - RNA, 64 nt, Homo Sapiens; identical to SEQ ID NO: 107337

SEQ ID NO: 358985 - RNA, 64 nt, Homo Sapiens; identical to SEQ ID NO: 107338

SEQ ID NO: 358986 - RNA, 64 nt, Homo Sapiens; identical to SEQ ID NO: 107339

SEQ ID NO: 358987 - RNA, 64 nt, Homo Sapiens; identical to SEQ ID NO: 107340

SEQ ID NO: 358988 - RNA, 64 nt, Homo Sapiens; identical to SEQ ID NO: 107341

SEQ ID NO: 358989 - RNA, 64 nt, Homo Sapiens; identical to SEQ ID NO: 107342

SEQ ID NO: 358990 - RNA, 64 nt, Homo Sapiens; identical to SEQ ID NO: 107343

SEQ ID NO: 358991 - RNA, 64 nt, Homo Sapiens; identical to SEQ ID NO: 107344

SEQ ID NO: 358992 - RNA, 64 nt, Homo Sapiens; identical to SEQ ID NO: 107345

SEQ ID NO: 358993 - RNA, 64 nt, Homo Sapiens; identical to SEQ ID NO: 107346

SEQ ID NO: 358994 - RNA, 64 nt, Homo Sapiens; identical to SEQ ID NO: 107347

SEQ ID NO: 358995 - RNA, 64 nt, Homo Sapiens; identical to SEQ ID NO: 107348

SEQ ID NO: 358996 - RNA, 64 nt, Homo Sapiens; identical to SEQ ID NO: 107349

SEQ ID NO: 358997 - RNA, 64 nt, Homo Sapiens; identical to SEQ ID NO: 107350

SEQ ID NO: 358998 - RNA, 64 nt, Homo Sapiens; identical to SEQ ID NO: 107351

SEQ ID NO: 358999 - RNA, 64 nt, Homo Sapiens; identical to SEQ ID NO: 107352

SEQ ID NO: 359000 - RNA, 64 nt, Homo Sapiens; identical to SEQ ID NO: 107353

SEQ ID NO: 359001 - RNA, 64 nt, Homo Sapiens; identical to SEQ ID NO: 107354

SEQ ID NO: 359002 - RNA, 64 nt, Homo Sapiens; identical to SEQ ID NO: 107355

SEQ ID NO: 359003 - RNA, 64 nt, Homo Sapiens; identical to SEQ ID NO: 107356

SEQ ID NO: 359004 - RNA, 64 nt, Homo Sapiens; identical to SEQ ID NO: 107357

SEQ ID NO: 359005 - RNA, 64 nt, Homo Sapiens; identical to SEQ ID NO: 107358

SEQ ID NO: 359006 - RNA, 64 nt, Homo Sapiens; identical to SEQ ID NO: 107359

SEQ ID NO: 359007 - RNA, 64 nt, Homo Sapiens; identical to SEQ ID NO: 107360

SEQ ID NO: 359008 - RNA, 64 nt, Homo Sapiens; identical to SEQ ID NO: 107361

SEQ ID NO: 359009 - RNA, 64 nt, Homo Sapiens; identical to SEQ ID NO: 107362

SEQ ID NO: 359010 - RNA, 64 nt, Homo Sapiens; identical to SEQ ID NO: 107363

SEQ ID NO: 359011 - RNA, 64 nt, Homo Sapiens; identical to SEQ ID NO: 107364

SEQ ID NO: 359012 - RNA, 64 nt, Homo Sapiens; identical to SEQ ID NO: 107365

SEQ ID NO: 359013 - RNA, 64 nt, Homo Sapiens; identical to SEQ ID NO: 107366

SEQ ID NO: 359014 - RNA, 64 nt, Homo Sapiens; identical to SEQ ID NO: 107367

SEQ ID NO: 359015 - RNA, 64 nt, Homo Sapiens; identical to SEQ ID NO: 107368

SEQ ID NO: 359016 - RNA, 64 nt, Homo Sapiens; identical to SEQ ID NO: 107369

SEQ ID NO: 359017 - RNA, 64 nt, Homo Sapiens; identical to SEQ ID NO: 107370

SEQ ID NO: 359018 - RNA, 64 nt, Homo Sapiens; identical to SEQ ID NO: 107371

SEQ ID NO: 359019 - RNA, 64 nt, Homo Sapiens; identical to SEQ ID NO: 107372

SEQ ID NO: 359020 - RNA, 64 nt, Homo Sapiens; identical to SEQ ID NO: 107373

SEQ ID NO: 359021 - RNA, 64 nt, Homo Sapiens; identical to SEQ ID NO: 107374

SEQ ID NO: 359022 - RNA, 64 nt, Homo Sapiens; identical to SEQ ID NO: 107375

SEQ ID NO: 359023 - RNA, 64 nt, Homo Sapiens; identical to SEQ ID NO: 107376

SEQ ID NO: 359024 - RNA, 64 nt, Homo Sapiens; identical to SEQ ID NO: 107377

SEQ ID NO: 359025 - RNA, 64 nt, Homo Sapiens; identical to SEQ ID NO: 107378

SEQ ID NO: 359026 - RNA, 64 nt, Homo Sapiens; identical to SEQ ID NO: 107379

SEQ ID NO: 359027 - RNA, 64 nt, Homo Sapiens; identical to SEQ ID NO: 107380

SEQ ID NO: 359028 - RNA, 64 nt, Homo Sapiens; identical to SEQ ID NO: 107381

SEQ ID NO: 359029 - RNA, 64 nt, Homo Sapiens; identical to SEQ ID NO: 107382

SEQ ID NO: 359030 - RNA, 64 nt, Homo Sapiens; identical to SEQ ID NO: 107383

SEQ ID NO: 359031 - RNA, 64 nt, Homo Sapiens; identical to SEQ ID NO: 107384

SEQ ID NO: 359032 - RNA, 64 nt, Homo Sapiens; identical to SEQ ID NO: 107385

SEQ ID NO: 359033 - RNA, 64 nt, Homo Sapiens; identical to SEQ ID NO: 107386

SEQ ID NO: 359034 - RNA, 64 nt, Homo Sapiens; identical to SEQ ID NO: 107387

SEQ ID NO: 359035 - RNA, 64 nt, Homo Sapiens; identical to SEQ ID NO: 107388

SEQ ID NO: 359036 - RNA, 64 nt, Homo Sapiens; identical to SEQ ID NO: 107389

SEQ ID NO: 359037 - RNA, 64 nt, Homo Sapiens; identical to SEQ ID NO: 107390

SEQ ID NO: 359038 - RNA, 64 nt, Homo Sapiens; identical to SEQ ID NO: 107391

SEQ ID NO: 359039 - RNA, 64 nt, Homo Sapiens; identical to SEQ ID NO: 107392

SEQ ID NO: 359040 - RNA, 64 nt, Homo Sapiens; identical to SEQ ID NO: 107393

SEQ ID NO: 359041 - RNA, 64 nt, Homo Sapiens; identical to SEQ ID NO: 107394

SEQ ID NO: 359042 - RNA, 64 nt, Homo Sapiens; identical to SEQ ID NO: 107395

SEQ ID NO: 359043 - RNA, 64 nt, Homo Sapiens; identical to SEQ ID NO: 107396

SEQ ID NO: 359044 - RNA, 64 nt, Homo Sapiens; identical to SEQ ID NO: 107397

SEQ ID NO: 359045 - RNA, 64 nt, Homo Sapiens; identical to SEQ ID NO: 107398

SEQ ID NO: 359046 - RNA, 64 nt, Homo Sapiens; identical to SEQ ID NO: 107399

SEQ ID NO: 359047 - RNA, 64 nt, Homo Sapiens; identical to SEQ ID NO: 107400

SEQ ID NO: 359048 - RNA, 64 nt, Homo Sapiens; identical to SEQ ID NO: 107401

SEQ ID NO: 359049 - RNA, 64 nt, Homo Sapiens; identical to SEQ ID NO: 107402

SEQ ID NO: 359050 - RNA, 64 nt, Homo Sapiens; identical to SEQ ID NO: 107403

SEQ ID NO: 359051 - RNA, 64 nt, Homo Sapiens; identical to SEQ ID NO: 107404

SEQ ID NO: 359052 - RNA, 64 nt, Homo Sapiens; identical to SEQ ID NO: 107405

SEQ ID NO: 359053 - RNA, 64 nt, Homo Sapiens; identical to SEQ ID NO: 107406

SEQ ID NO: 359054 - RNA, 64 nt, Homo Sapiens; identical to SEQ ID NO: 107407

SEQ ID NO: 359055 - RNA, 64 nt, Homo Sapiens; identical to SEQ ID NO: 107408

SEQ ID NO: 359056 - RNA, 64 nt, Homo Sapiens; identical to SEQ ID NO: 107409

SEQ ID NO: 359057 - RNA, 64 nt, Homo Sapiens; identical to SEQ ID NO: 107410

SEQ ID NO: 359058 - RNA, 64 nt, Homo Sapiens; identical to SEQ ID NO: 107411

SEQ ID NO: 359059 - RNA, 64 nt, Homo Sapiens; identical to SEQ ID NO: 107412

SEQ ID NO: 359060 - RNA, 64 nt, Homo Sapiens; identical to SEQ ID NO: 107413

SEQ ID NO: 359061 - RNA, 64 nt, Homo Sapiens; identical to SEQ ID NO: 107414

SEQ ID NO: 359062 - RNA, 64 nt, Homo Sapiens; identical to SEQ ID NO: 107415

SEQ ID NO: 359063 - RNA, 64 nt, Homo Sapiens; identical to SEQ ID NO: 107416

SEQ ID NO: 359064 - RNA, 64 nt, Homo Sapiens; identical to SEQ ID NO: 107417

SEQ ID NO: 359065 - RNA, 64 nt, Homo Sapiens; identical to SEQ ID NO: 107418

SEQ ID NO: 359066 - RNA, 64 nt, Homo Sapiens; identical to SEQ ID NO: 107419

SEQ ID NO: 359067 - RNA, 64 nt, Homo Sapiens; identical to SEQ ID NO: 107420

SEQ ID NO: 359068 - RNA, 64 nt, Homo Sapiens; identical to SEQ ID NO: 107421

SEQ ID NO: 359069 - RNA, 64 nt, Homo Sapiens; identical to SEQ ID NO: 107422

SEQ ID NO: 359070 - RNA, 64 nt, Homo Sapiens; identical to SEQ ID NO: 107423

SEQ ID NO: 359071 - RNA, 64 nt, Homo Sapiens; identical to SEQ ID NO: 107424

SEQ ID NO: 359072 - RNA, 64 nt, Homo Sapiens; identical to SEQ ID NO: 107425

SEQ ID NO: 359073 - RNA, 64 nt, Homo Sapiens; identical to SEQ ID NO: 107426

SEQ ID NO: 359074 - RNA, 64 nt, Homo Sapiens; identical to SEQ ID NO: 107427

SEQ ID NO: 359075 - RNA, 64 nt, Homo Sapiens; identical to SEQ ID NO: 107428

SEQ ID NO: 359076 - RNA, 64 nt, Homo Sapiens; identical to SEQ ID NO: 107429

SEQ ID NO: 359077 - RNA, 64 nt, Homo Sapiens; identical to SEQ ID NO: 107430

SEQ ID NO: 359078 - RNA, 64 nt, Homo Sapiens; identical to SEQ ID NO: 107431

SEQ ID NO: 359079 - RNA, 64 nt, Homo Sapiens; identical to SEQ ID NO: 107432

SEQ ID NO: 359080 - RNA, 64 nt, Homo Sapiens; identical to SEQ ID NO: 107433

SEQ ID NO: 359081 - RNA, 64 nt, Homo Sapiens; identical to SEQ ID NO: 107434

SEQ ID NO: 359082 - RNA, 64 nt, Homo Sapiens; identical to SEQ ID NO: 107435

SEQ ID NO: 359083 - RNA, 64 nt, Homo Sapiens; identical to SEQ ID NO: 107436

SEQ ID NO: 359084 - RNA, 64 nt, Homo Sapiens; identical to SEQ ID NO: 107437

SEQ ID NO: 359085 - RNA, 64 nt, Homo Sapiens; identical to SEQ ID NO: 107438

SEQ ID NO: 359086 - RNA, 64 nt, Homo Sapiens; identical to SEQ ID NO: 107439

SEQ ID NO: 359087 - RNA, 64 nt, Homo Sapiens; identical to SEQ ID NO: 107440

SEQ ID NO: 359088 - RNA, 64 nt, Homo Sapiens; identical to SEQ ID NO: 107441

SEQ ID NO: 359089 - RNA, 64 nt, Homo Sapiens; identical to SEQ ID NO: 107442

SEQ ID NO: 359090 - RNA, 64 nt, Homo Sapiens; identical to SEQ ID NO: 107443

SEQ ID NO: 359091 - RNA, 64 nt, Homo Sapiens; identical to SEQ ID NO: 107444

SEQ ID NO: 359092 - RNA, 64 nt, Homo Sapiens; identical to SEQ ID NO: 107445

SEQ ID NO: 359093 - RNA, 64 nt, Homo Sapiens; identical to SEQ ID NO: 107446

SEQ ID NO: 359094 - RNA, 64 nt, Homo Sapiens; identical to SEQ ID NO: 107447

SEQ ID NO: 359095 - RNA, 64 nt, Homo Sapiens; identical to SEQ ID NO: 107448

SEQ ID NO: 359096 - RNA, 64 nt, Homo Sapiens; identical to SEQ ID NO: 107449

SEQ ID NO: 359097 - RNA, 64 nt, Homo Sapiens; identical to SEQ ID NO: 107450

SEQ ID NO: 359098 - RNA, 64 nt, Homo Sapiens; identical to SEQ ID NO: 107451

SEQ ID NO: 359099 - RNA, 64 nt, Homo Sapiens; identical to SEQ ID NO: 107452

SEQ ID NO: 359100 - RNA, 64 nt, Homo Sapiens; identical to SEQ ID NO: 107453

SEQ ID NO: 359101 - RNA, 64 nt, Homo Sapiens; identical to SEQ ID NO: 107454

SEQ ID NO: 359102 - RNA, 64 nt, Homo Sapiens; identical to SEQ ID NO: 107455

SEQ ID NO: 359103 - RNA, 64 nt, Homo Sapiens; identical to SEQ ID NO: 107456

SEQ ID NO: 359104 - RNA, 64 nt, Homo Sapiens; identical to SEQ ID NO: 107457

SEQ ID NO: 359105 - RNA, 64 nt, Homo Sapiens; identical to SEQ ID NO: 107458

SEQ ID NO: 359106 - RNA, 64 nt, Homo Sapiens; identical to SEQ ID NO: 107459

SEQ ID NO: 359107 - RNA, 64 nt, Homo Sapiens; identical to SEQ ID NO: 107460

SEQ ID NO: 359108 - RNA, 64 nt, Homo Sapiens; identical to SEQ ID NO: 107461

SEQ ID NO: 359109 - RNA, 64 nt, Homo Sapiens; identical to SEQ ID NO: 107462

SEQ ID NO: 359110 - RNA, 64 nt, Homo Sapiens; identical to SEQ ID NO: 107463

SEQ ID NO: 359111 - RNA, 64 nt, Homo Sapiens; identical to SEQ ID NO: 107464

SEQ ID NO: 359112 - RNA, 64 nt, Homo Sapiens; identical to SEQ ID NO: 107465

SEQ ID NO: 359113 - RNA, 64 nt, Homo Sapiens; identical to SEQ ID NO: 107466

SEQ ID NO: 359114 - RNA, 64 nt, Homo Sapiens; identical to SEQ ID NO: 107467

SEQ ID NO: 359115 - RNA, 64 nt, Homo Sapiens; identical to SEQ ID NO: 107468

SEQ ID NO: 359116 - RNA, 64 nt, Homo Sapiens; identical to SEQ ID NO: 107469

SEQ ID NO: 359117 - RNA, 64 nt, Homo Sapiens; identical to SEQ ID NO: 107470

SEQ ID NO: 359118 - RNA, 64 nt, Homo Sapiens; identical to SEQ ID NO: 107471

SEQ ID NO: 359119 - RNA, 64 nt, Homo Sapiens; identical to SEQ ID NO: 107472

SEQ ID NO: 359120 - RNA, 64 nt, Homo Sapiens; identical to SEQ ID NO: 107473

SEQ ID NO: 359121 - RNA, 64 nt, Homo Sapiens; identical to SEQ ID NO: 107474

SEQ ID NO: 359122 - RNA, 64 nt, Homo Sapiens; identical to SEQ ID NO: 107475

SEQ ID NO: 359123 - RNA, 64 nt, Homo Sapiens; identical to SEQ ID NO: 107476

SEQ ID NO: 359124 - RNA, 64 nt, Homo Sapiens; identical to SEQ ID NO: 107477

SEQ ID NO: 359125 - RNA, 64 nt, Homo Sapiens; identical to SEQ ID NO: 107478

SEQ ID NO: 359126 - RNA, 64 nt, Homo Sapiens; identical to SEQ ID NO: 107479

SEQ ID NO: 359127 - RNA, 64 nt, Homo Sapiens; identical to SEQ ID NO: 107480

SEQ ID NO: 359128 - RNA, 64 nt, Homo Sapiens; identical to SEQ ID NO: 107481

SEQ ID NO: 359129 - RNA, 64 nt, Homo Sapiens; identical to SEQ ID NO: 107482

SEQ ID NO: 359130 - RNA, 64 nt, Homo Sapiens; identical to SEQ ID NO: 107483

SEQ ID NO: 359131 - RNA, 64 nt, Homo Sapiens; identical to SEQ ID NO: 107484

SEQ ID NO: 359132 - RNA, 64 nt, Homo Sapiens; identical to SEQ ID NO: 107485

SEQ ID NO: 359133 - RNA, 64 nt, Homo Sapiens; identical to SEQ ID NO: 107486

SEQ ID NO: 359134 - RNA, 64 nt, Homo Sapiens; identical to SEQ ID NO: 107487

SEQ ID NO: 359135 - RNA, 64 nt, Homo Sapiens; identical to SEQ ID NO: 107488

SEQ ID NO: 359136 - RNA, 64 nt, Homo Sapiens; identical to SEQ ID NO: 107489

SEQ ID NO: 359137 - RNA, 64 nt, Homo Sapiens; identical to SEQ ID NO: 107490

SEQ ID NO: 359138 - RNA, 64 nt, Homo Sapiens; identical to SEQ ID NO: 107491

SEQ ID NO: 359139 - RNA, 64 nt, Homo Sapiens; identical to SEQ ID NO: 107492

SEQ ID NO: 359140 - RNA, 64 nt, Homo Sapiens; identical to SEQ ID NO: 107493

SEQ ID NO: 359141 - RNA, 64 nt, Homo Sapiens; identical to SEQ ID NO: 107494

SEQ ID NO: 359142 - RNA, 64 nt, Homo Sapiens; identical to SEQ ID NO: 107495

SEQ ID NO: 359143 - RNA, 64 nt, Homo Sapiens; identical to SEQ ID NO: 107496

SEQ ID NO: 359144 - RNA, 64 nt, Homo Sapiens; identical to SEQ ID NO: 107497

SEQ ID NO: 359145 - RNA, 64 nt, Homo Sapiens; identical to SEQ ID NO: 107498

SEQ ID NO: 359146 - RNA, 64 nt, Homo Sapiens; identical to SEQ ID NO: 107499

SEQ ID NO: 359147 - RNA, 64 nt, Homo Sapiens; identical to SEQ ID NO: 107500

SEQ ID NO: 359148 - RNA, 64 nt, Homo Sapiens; identical to SEQ ID NO: 107501

SEQ ID NO: 359149 - RNA, 64 nt, Homo Sapiens; identical to SEQ ID NO: 107502

SEQ ID NO: 359150 - RNA, 64 nt, Homo Sapiens; identical to SEQ ID NO: 107503

SEQ ID NO: 359151 - RNA, 64 nt, Homo Sapiens; identical to SEQ ID NO: 107504

SEQ ID NO: 359152 - RNA, 64 nt, Homo Sapiens; identical to SEQ ID NO: 107505

SEQ ID NO: 359153 - RNA, 64 nt, Homo Sapiens; identical to SEQ ID NO: 107506

SEQ ID NO: 359154 - RNA, 64 nt, Homo Sapiens; identical to SEQ ID NO: 107507

SEQ ID NO: 359155 - RNA, 64 nt, Homo Sapiens; identical to SEQ ID NO: 107508

SEQ ID NO: 359156 - RNA, 64 nt, Homo Sapiens; identical to SEQ ID NO: 107509

SEQ ID NO: 359157 - RNA, 64 nt, Homo Sapiens; identical to SEQ ID NO: 107510

SEQ ID NO: 359158 - RNA, 64 nt, Homo Sapiens; identical to SEQ ID NO: 107511

SEQ ID NO: 359159 - RNA, 64 nt, Homo Sapiens; identical to SEQ ID NO: 107512

SEQ ID NO: 359160 - RNA, 64 nt, Homo Sapiens; identical to SEQ ID NO: 107513

SEQ ID NO: 359161 - RNA, 64 nt, Homo Sapiens; identical to SEQ ID NO: 107514

SEQ ID NO: 359162 - RNA, 64 nt, Homo Sapiens; identical to SEQ ID NO: 107515

SEQ ID NO: 359163 - RNA, 64 nt, Homo Sapiens; identical to SEQ ID NO: 107516

SEQ ID NO: 359164 - RNA, 64 nt, Homo Sapiens; identical to SEQ ID NO: 107517

SEQ ID NO: 359165 - RNA, 64 nt, Homo Sapiens; identical to SEQ ID NO: 107518

SEQ ID NO: 359166 - RNA, 64 nt, Homo Sapiens; identical to SEQ ID NO: 107519

SEQ ID NO: 359167 - RNA, 64 nt, Homo Sapiens; identical to SEQ ID NO: 107520

SEQ ID NO: 359168 - RNA, 64 nt, Homo Sapiens; identical to SEQ ID NO: 107521

SEQ ID NO: 359169 - RNA, 64 nt, Homo Sapiens; identical to SEQ ID NO: 107522

SEQ ID NO: 359170 - RNA, 64 nt, Homo Sapiens; identical to SEQ ID NO: 107523

SEQ ID NO: 359171 - RNA, 64 nt, Homo Sapiens; identical to SEQ ID NO: 107524

SEQ ID NO: 359172 - RNA, 64 nt, Homo Sapiens; identical to SEQ ID NO: 107525

SEQ ID NO: 359173 - RNA, 64 nt, Homo Sapiens; identical to SEQ ID NO: 107526

SEQ ID NO: 359174 - RNA, 64 nt, Homo Sapiens; identical to SEQ ID NO: 107527

SEQ ID NO: 359175 - RNA, 64 nt, Homo Sapiens; identical to SEQ ID NO: 107528

SEQ ID NO: 359176 - RNA, 64 nt, Homo Sapiens; identical to SEQ ID NO: 107529

SEQ ID NO: 359177 - RNA, 64 nt, Homo Sapiens; identical to SEQ ID NO: 107530

SEQ ID NO: 359178 - RNA, 64 nt, Homo Sapiens; identical to SEQ ID NO: 107531

SEQ ID NO: 359179 - RNA, 64 nt, Homo Sapiens; identical to SEQ ID NO: 107532

SEQ ID NO: 359180 - RNA, 64 nt, Homo Sapiens; identical to SEQ ID NO: 107533

SEQ ID NO: 359181 - RNA, 64 nt, Homo Sapiens; identical to SEQ ID NO: 107534

SEQ ID NO: 359182 - RNA, 64 nt, Homo Sapiens; identical to SEQ ID NO: 107535

SEQ ID NO: 359183 - RNA, 64 nt, Homo Sapiens; identical to SEQ ID NO: 107536

SEQ ID NO: 359184 - RNA, 64 nt, Homo Sapiens; identical to SEQ ID NO: 107537

SEQ ID NO: 359185 - RNA, 64 nt, Homo Sapiens; identical to SEQ ID NO: 107538

SEQ ID NO: 359186 - RNA, 64 nt, Homo Sapiens; identical to SEQ ID NO: 107539

SEQ ID NO: 359187 - RNA, 64 nt, Homo Sapiens; identical to SEQ ID NO: 107540

SEQ ID NO: 359188 - RNA, 64 nt, Homo Sapiens; identical to SEQ ID NO: 107541

SEQ ID NO: 359189 - RNA, 64 nt, Homo Sapiens; identical to SEQ ID NO: 107542

SEQ ID NO: 359190 - RNA, 64 nt, Homo Sapiens; identical to SEQ ID NO: 107543

SEQ ID NO: 359191 - RNA, 64 nt, Homo Sapiens; identical to SEQ ID NO: 107544

SEQ ID NO: 359192 - RNA, 64 nt, Homo Sapiens; identical to SEQ ID NO: 107545

SEQ ID NO: 359193 - RNA, 64 nt, Homo Sapiens; identical to SEQ ID NO: 107546

SEQ ID NO: 359194 - RNA, 64 nt, Homo Sapiens; identical to SEQ ID NO: 107547

SEQ ID NO: 359195 - RNA, 64 nt, Homo Sapiens; identical to SEQ ID NO: 107548

SEQ ID NO: 359196 - RNA, 64 nt, Homo Sapiens; identical to SEQ ID NO: 107549

SEQ ID NO: 359197 - RNA, 64 nt, Homo Sapiens; identical to SEQ ID NO: 107550

SEQ ID NO: 359198 - RNA, 64 nt, Homo Sapiens; identical to SEQ ID NO: 107551

SEQ ID NO: 359199 - RNA, 64 nt, Homo Sapiens; identical to SEQ ID NO: 107552

SEQ ID NO: 359200 - RNA, 64 nt, Homo Sapiens; identical to SEQ ID NO: 107553

SEQ ID NO: 359201 - RNA, 64 nt, Homo Sapiens; identical to SEQ ID NO: 107554

SEQ ID NO: 359202 - RNA, 64 nt, Homo Sapiens; identical to SEQ ID NO: 107555

SEQ ID NO: 359203 - RNA, 64 nt, Homo Sapiens; identical to SEQ ID NO: 107556

SEQ ID NO: 359204 - RNA, 64 nt, Homo Sapiens; identical to SEQ ID NO: 107557

SEQ ID NO: 359205 - RNA, 64 nt, Homo Sapiens; identical to SEQ ID NO: 107558

SEQ ID NO: 359206 - RNA, 64 nt, Homo Sapiens; identical to SEQ ID NO: 107559

SEQ ID NO: 359207 - RNA, 64 nt, Homo Sapiens; identical to SEQ ID NO: 107560

SEQ ID NO: 359208 - RNA, 64 nt, Homo Sapiens; identical to SEQ ID NO: 107561

SEQ ID NO: 359209 - RNA, 64 nt, Homo Sapiens; identical to SEQ ID NO: 107562

SEQ ID NO: 359210 - RNA, 64 nt, Homo Sapiens; identical to SEQ ID NO: 107563

SEQ ID NO: 359211 - RNA, 64 nt, Homo Sapiens; identical to SEQ ID NO: 107564

SEQ ID NO: 359212 - RNA, 64 nt, Homo Sapiens; identical to SEQ ID NO: 107565

SEQ ID NO: 359213 - RNA, 64 nt, Homo Sapiens; identical to SEQ ID NO: 107566

SEQ ID NO: 359214 - RNA, 64 nt, Homo Sapiens; identical to SEQ ID NO: 107567

SEQ ID NO: 359215 - RNA, 64 nt, Homo Sapiens; identical to SEQ ID NO: 107568

SEQ ID NO: 359216 - RNA, 64 nt, Homo Sapiens; identical to SEQ ID NO: 107569

SEQ ID NO: 359217 - RNA, 64 nt, Homo Sapiens; identical to SEQ ID NO: 107570

SEQ ID NO: 359218 - RNA, 64 nt, Homo Sapiens; identical to SEQ ID NO: 107571

SEQ ID NO: 359219 - RNA, 64 nt, Homo Sapiens; identical to SEQ ID NO: 107572

SEQ ID NO: 359220 - RNA, 64 nt, Homo Sapiens; identical to SEQ ID NO: 107573

SEQ ID NO: 359221 - RNA, 64 nt, Homo Sapiens; identical to SEQ ID NO: 107574

SEQ ID NO: 359222 - RNA, 64 nt, Homo Sapiens; identical to SEQ ID NO: 107575

SEQ ID NO: 359223 - RNA, 64 nt, Homo Sapiens; identical to SEQ ID NO: 107576

SEQ ID NO: 359224 - RNA, 64 nt, Homo Sapiens; identical to SEQ ID NO: 107577

SEQ ID NO: 359225 - RNA, 64 nt, Homo Sapiens; identical to SEQ ID NO: 107578

SEQ ID NO: 359226 - RNA, 64 nt, Homo Sapiens; identical to SEQ ID NO: 107579

SEQ ID NO: 359227 - RNA, 64 nt, Homo Sapiens; identical to SEQ ID NO: 107580

SEQ ID NO: 359228 - RNA, 64 nt, Homo Sapiens; identical to SEQ ID NO: 107581

SEQ ID NO: 359229 - RNA, 64 nt, Homo Sapiens; identical to SEQ ID NO: 107582

SEQ ID NO: 359230 - RNA, 64 nt, Homo Sapiens; identical to SEQ ID NO: 107583

SEQ ID NO: 359231 - RNA, 64 nt, Homo Sapiens; identical to SEQ ID NO: 107584

SEQ ID NO: 359232 - RNA, 64 nt, Homo Sapiens; identical to SEQ ID NO: 107585

SEQ ID NO: 359233 - RNA, 64 nt, Homo Sapiens; identical to SEQ ID NO: 107586

SEQ ID NO: 359234 - RNA, 64 nt, Homo Sapiens; identical to SEQ ID NO: 107587

SEQ ID NO: 359235 - RNA, 64 nt, Homo Sapiens; identical to SEQ ID NO: 107588

SEQ ID NO: 359236 - RNA, 64 nt, Homo Sapiens; identical to SEQ ID NO: 107589

SEQ ID NO: 359237 - RNA, 64 nt, Homo Sapiens; identical to SEQ ID NO: 107590

SEQ ID NO: 359238 - RNA, 64 nt, Homo Sapiens; identical to SEQ ID NO: 107591

SEQ ID NO: 359239 - RNA, 64 nt, Homo Sapiens; identical to SEQ ID NO: 107592

SEQ ID NO: 359240 - RNA, 64 nt, Homo Sapiens; identical to SEQ ID NO: 107593

SEQ ID NO: 359241 - RNA, 64 nt, Homo Sapiens; identical to SEQ ID NO: 107594

SEQ ID NO: 359242 - RNA, 64 nt, Homo Sapiens; identical to SEQ ID NO: 107595

SEQ ID NO: 359243 - RNA, 64 nt, Homo Sapiens; identical to SEQ ID NO: 107596

SEQ ID NO: 359244 - RNA, 64 nt, Homo Sapiens; identical to SEQ ID NO: 107597

SEQ ID NO: 359245 - RNA, 64 nt, Homo Sapiens; identical to SEQ ID NO: 107598

SEQ ID NO: 359246 - RNA, 64 nt, Homo Sapiens; identical to SEQ ID NO: 107599

SEQ ID NO: 359247 - RNA, 64 nt, Homo Sapiens; identical to SEQ ID NO: 107600

SEQ ID NO: 359248 - RNA, 64 nt, Homo Sapiens; identical to SEQ ID NO: 107601

SEQ ID NO: 359249 - RNA, 64 nt, Homo Sapiens; identical to SEQ ID NO: 107602

SEQ ID NO: 359250 - RNA, 64 nt, Homo Sapiens; identical to SEQ ID NO: 107603

SEQ ID NO: 359251 - RNA, 64 nt, Homo Sapiens; identical to SEQ ID NO: 107604

SEQ ID NO: 359252 - RNA, 64 nt, Homo Sapiens; identical to SEQ ID NO: 107605

SEQ ID NO: 359253 - RNA, 64 nt, Homo Sapiens; identical to SEQ ID NO: 107606

SEQ ID NO: 359254 - RNA, 64 nt, Homo Sapiens; identical to SEQ ID NO: 107607

SEQ ID NO: 359255 - RNA, 64 nt, Homo Sapiens; identical to SEQ ID NO: 107608

SEQ ID NO: 359256 - RNA, 64 nt, Homo Sapiens; identical to SEQ ID NO: 107609

SEQ ID NO: 359257 - RNA, 64 nt, Homo Sapiens; identical to SEQ ID NO: 107610

SEQ ID NO: 359258 - RNA, 64 nt, Homo Sapiens; identical to SEQ ID NO: 107611

SEQ ID NO: 359259 - RNA, 64 nt, Homo Sapiens; identical to SEQ ID NO: 107612

SEQ ID NO: 359260 - RNA, 64 nt, Homo Sapiens; identical to SEQ ID NO: 107613

SEQ ID NO: 359261 - RNA, 64 nt, Homo Sapiens; identical to SEQ ID NO: 107614

SEQ ID NO: 359262 - RNA, 64 nt, Homo Sapiens; identical to SEQ ID NO: 107615

SEQ ID NO: 359263 - RNA, 64 nt, Homo Sapiens; identical to SEQ ID NO: 107616

SEQ ID NO: 359264 - RNA, 64 nt, Homo Sapiens; identical to SEQ ID NO: 107617

SEQ ID NO: 359265 - RNA, 64 nt, Homo Sapiens; identical to SEQ ID NO: 107618

SEQ ID NO: 359266 - RNA, 64 nt, Homo Sapiens; identical to SEQ ID NO: 107619

SEQ ID NO: 359267 - RNA, 64 nt, Homo Sapiens; identical to SEQ ID NO: 107620

SEQ ID NO: 359268 - RNA, 64 nt, Homo Sapiens; identical to SEQ ID NO: 107621

SEQ ID NO: 359269 - RNA, 64 nt, Homo Sapiens; identical to SEQ ID NO: 107622

SEQ ID NO: 359270 - RNA, 64 nt, Homo Sapiens; identical to SEQ ID NO: 107623

SEQ ID NO: 359271 - RNA, 64 nt, Homo Sapiens; identical to SEQ ID NO: 107624

SEQ ID NO: 359272 - RNA, 64 nt, Homo Sapiens; identical to SEQ ID NO: 107625

SEQ ID NO: 359273 - RNA, 64 nt, Homo Sapiens; identical to SEQ ID NO: 107626

SEQ ID NO: 359274 - RNA, 64 nt, Homo Sapiens; identical to SEQ ID NO: 107627

SEQ ID NO: 359275 - RNA, 64 nt, Homo Sapiens; identical to SEQ ID NO: 107628

SEQ ID NO: 359276 - RNA, 64 nt, Homo Sapiens; identical to SEQ ID NO: 107629

SEQ ID NO: 359277 - RNA, 64 nt, Homo Sapiens; identical to SEQ ID NO: 107630

SEQ ID NO: 359278 - RNA, 64 nt, Homo Sapiens; identical to SEQ ID NO: 107631

SEQ ID NO: 359279 - RNA, 64 nt, Homo Sapiens; identical to SEQ ID NO: 107632

SEQ ID NO: 359280 - RNA, 64 nt, Homo Sapiens; identical to SEQ ID NO: 107633

SEQ ID NO: 359281 - RNA, 64 nt, Homo Sapiens; identical to SEQ ID NO: 107634

SEQ ID NO: 359282 - RNA, 64 nt, Homo Sapiens; identical to SEQ ID NO: 107635

SEQ ID NO: 359283 - RNA, 64 nt, Homo Sapiens; identical to SEQ ID NO: 107636

SEQ ID NO: 359284 - RNA, 64 nt, Homo Sapiens; identical to SEQ ID NO: 107637

SEQ ID NO: 359285 - RNA, 64 nt, Homo Sapiens; identical to SEQ ID NO: 107638

SEQ ID NO: 359286 - RNA, 64 nt, Homo Sapiens; identical to SEQ ID NO: 107639

SEQ ID NO: 359287 - RNA, 64 nt, Homo Sapiens; identical to SEQ ID NO: 107640

SEQ ID NO: 359288 - RNA, 64 nt, Homo Sapiens; identical to SEQ ID NO: 107641

SEQ ID NO: 359289 - RNA, 64 nt, Homo Sapiens; identical to SEQ ID NO: 107642

SEQ ID NO: 359290 - RNA, 64 nt, Homo Sapiens; identical to SEQ ID NO: 107643

SEQ ID NO: 359291 - RNA, 64 nt, Homo Sapiens; identical to SEQ ID NO: 107644

SEQ ID NO: 359292 - RNA, 64 nt, Homo Sapiens; identical to SEQ ID NO: 107645

SEQ ID NO: 359293 - RNA, 64 nt, Homo Sapiens; identical to SEQ ID NO: 107646

SEQ ID NO: 359294 - RNA, 64 nt, Homo Sapiens; identical to SEQ ID NO: 107647

SEQ ID NO: 359295 - RNA, 64 nt, Homo Sapiens; identical to SEQ ID NO: 107648

SEQ ID NO: 359296 - RNA, 64 nt, Homo Sapiens; identical to SEQ ID NO: 107649

SEQ ID NO: 359297 - RNA, 64 nt, Homo Sapiens; identical to SEQ ID NO: 107650

SEQ ID NO: 359298 - RNA, 64 nt, Homo Sapiens; identical to SEQ ID NO: 107651

SEQ ID NO: 359299 - RNA, 64 nt, Homo Sapiens; identical to SEQ ID NO: 107652

SEQ ID NO: 359300 - RNA, 64 nt, Homo Sapiens; identical to SEQ ID NO: 107653

SEQ ID NO: 359301 - RNA, 64 nt, Homo Sapiens; identical to SEQ ID NO: 107654

SEQ ID NO: 359302 - RNA, 64 nt, Homo Sapiens; identical to SEQ ID NO: 107655

SEQ ID NO: 359303 - RNA, 64 nt, Homo Sapiens; identical to SEQ ID NO: 107656

SEQ ID NO: 359304 - RNA, 64 nt, Homo Sapiens; identical to SEQ ID NO: 107657

SEQ ID NO: 359305 - RNA, 64 nt, Homo Sapiens; identical to SEQ ID NO: 107658

SEQ ID NO: 359306 - RNA, 64 nt, Homo Sapiens; identical to SEQ ID NO: 107659

SEQ ID NO: 359307 - RNA, 64 nt, Homo Sapiens; identical to SEQ ID NO: 107660

SEQ ID NO: 359308 - RNA, 64 nt, Homo Sapiens; identical to SEQ ID NO: 107661

SEQ ID NO: 359309 - RNA, 64 nt, Homo Sapiens; identical to SEQ ID NO: 107662

SEQ ID NO: 359310 - RNA, 64 nt, Homo Sapiens; identical to SEQ ID NO: 107663

SEQ ID NO: 359311 - RNA, 64 nt, Homo Sapiens; identical to SEQ ID NO: 107664

SEQ ID NO: 359312 - RNA, 64 nt, Homo Sapiens; identical to SEQ ID NO: 107665

SEQ ID NO: 359313 - RNA, 64 nt, Homo Sapiens; identical to SEQ ID NO: 107666

SEQ ID NO: 359314 - RNA, 64 nt, Homo Sapiens; identical to SEQ ID NO: 107667

SEQ ID NO: 359315 - RNA, 64 nt, Homo Sapiens; identical to SEQ ID NO: 107668

SEQ ID NO: 359316 - RNA, 64 nt, Homo Sapiens; identical to SEQ ID NO: 107669

SEQ ID NO: 359317 - RNA, 64 nt, Homo Sapiens; identical to SEQ ID NO: 107670

SEQ ID NO: 359318 - RNA, 64 nt, Homo Sapiens; identical to SEQ ID NO: 107671

SEQ ID NO: 359319 - RNA, 64 nt, Homo Sapiens; identical to SEQ ID NO: 107672

SEQ ID NO: 359320 - RNA, 64 nt, Homo Sapiens; identical to SEQ ID NO: 107673

SEQ ID NO: 359321 - RNA, 64 nt, Homo Sapiens; identical to SEQ ID NO: 107674

SEQ ID NO: 359322 - RNA, 64 nt, Homo Sapiens; identical to SEQ ID NO: 107675

SEQ ID NO: 359323 - RNA, 64 nt, Homo Sapiens; identical to SEQ ID NO: 107676

SEQ ID NO: 359324 - RNA, 64 nt, Homo Sapiens; identical to SEQ ID NO: 107677

SEQ ID NO: 359325 - RNA, 64 nt, Homo Sapiens; identical to SEQ ID NO: 107678

SEQ ID NO: 359326 - RNA, 64 nt, Homo Sapiens; identical to SEQ ID NO: 107679

SEQ ID NO: 359327 - RNA, 64 nt, Homo Sapiens; identical to SEQ ID NO: 107680

SEQ ID NO: 359328 - RNA, 64 nt, Homo Sapiens; identical to SEQ ID NO: 107681

SEQ ID NO: 359329 - RNA, 64 nt, Homo Sapiens; identical to SEQ ID NO: 107682

SEQ ID NO: 359330 - RNA, 64 nt, Homo Sapiens; identical to SEQ ID NO: 107683

SEQ ID NO: 359331 - RNA, 64 nt, Homo Sapiens; identical to SEQ ID NO: 107684

SEQ ID NO: 359332 - RNA, 64 nt, Homo Sapiens; identical to SEQ ID NO: 107685

SEQ ID NO: 359333 - RNA, 64 nt, Homo Sapiens; identical to SEQ ID NO: 107686

SEQ ID NO: 359334 - RNA, 64 nt, Homo Sapiens; identical to SEQ ID NO: 107687

SEQ ID NO: 359335 - RNA, 64 nt, Homo Sapiens; identical to SEQ ID NO: 107688

SEQ ID NO: 359336 - RNA, 64 nt, Homo Sapiens; identical to SEQ ID NO: 107689

SEQ ID NO: 359337 - RNA, 64 nt, Homo Sapiens; identical to SEQ ID NO: 107690

SEQ ID NO: 359338 - RNA, 64 nt, Homo Sapiens; identical to SEQ ID NO: 107691

SEQ ID NO: 359339 - RNA, 64 nt, Homo Sapiens; identical to SEQ ID NO: 107692

SEQ ID NO: 359340 - RNA, 64 nt, Homo Sapiens; identical to SEQ ID NO: 107693

SEQ ID NO: 359341 - RNA, 64 nt, Homo Sapiens; identical to SEQ ID NO: 107694

SEQ ID NO: 359342 - RNA, 64 nt, Homo Sapiens; identical to SEQ ID NO: 107695

SEQ ID NO: 359343 - RNA, 64 nt, Homo Sapiens; identical to SEQ ID NO: 328239

SEQ ID NO: 359344 - RNA, 64 nt, Homo Sapiens; identical to SEQ ID NO: 328240

SEQ ID NO: 359345 - RNA, 64 nt, Homo Sapiens; identical to SEQ ID NO: 328241

SEQ ID NO: 359346 - RNA, 64 nt, Homo Sapiens; identical to SEQ ID NO: 328242

SEQ ID NO: 359347 - RNA, 64 nt, Homo Sapiens; identical to SEQ ID NO: 328243

SEQ ID NO: 359348 - RNA, 64 nt, Homo Sapiens; identical to SEQ ID NO: 328244

SEQ ID NO: 359349 - RNA, 64 nt, Homo Sapiens; identical to SEQ ID NO: 328245

SEQ ID NO: 359350 - RNA, 64 nt, Homo Sapiens; identical to SEQ ID NO: 328246

SEQ ID NO: 359351 - RNA, 64 nt, Homo Sapiens; identical to SEQ ID NO: 328247

SEQ ID NO: 359352 - RNA, 64 nt, Homo Sapiens; identical to SEQ ID NO: 328248

SEQ ID NO: 359353 - RNA, 64 nt, Homo Sapiens; identical to SEQ ID NO: 328249

SEQ ID NO: 359354 - RNA, 64 nt, Homo Sapiens; identical to SEQ ID NO: 328250

SEQ ID NO: 359355 - RNA, 64 nt, Homo Sapiens; identical to SEQ ID NO: 328251

SEQ ID NO: 359356 - RNA, 64 nt, Homo Sapiens; identical to SEQ ID NO: 328252

SEQ ID NO: 359357 - RNA, 64 nt, Homo Sapiens; identical to SEQ ID NO: 328253

SEQ ID NO: 359358 - RNA, 64 nt, Homo Sapiens; identical to SEQ ID NO: 328254

SEQ ID NO: 359359 - RNA, 64 nt, Homo Sapiens; identical to SEQ ID NO: 328255

SEQ ID NO: 359360 - RNA, 64 nt, Homo Sapiens; identical to SEQ ID NO: 328256

SEQ ID NO: 359361 - RNA, 64 nt, Homo Sapiens; identical to SEQ ID NO: 328257

SEQ ID NO: 359362 - RNA, 64 nt, Homo Sapiens; identical to SEQ ID NO: 328258

SEQ ID NO: 359363 - RNA, 64 nt, Homo Sapiens; identical to SEQ ID NO: 328259

SEQ ID NO: 359364 - RNA, 64 nt, Homo Sapiens; identical to SEQ ID NO: 328260

SEQ ID NO: 359365 - RNA, 64 nt, Homo Sapiens; identical to SEQ ID NO: 328261

SEQ ID NO: 359366 - RNA, 64 nt, Homo Sapiens; identical to SEQ ID NO: 328262

SEQ ID NO: 359367 - RNA, 64 nt, Homo Sapiens; identical to SEQ ID NO: 328263

SEQ ID NO: 359368 - RNA, 64 nt, Homo Sapiens; identical to SEQ ID NO: 328264

SEQ ID NO: 359369 - RNA, 64 nt, Homo Sapiens; identical to SEQ ID NO: 328265

SEQ ID NO: 359370 - RNA, 64 nt, Homo Sapiens; identical to SEQ ID NO: 328266

SEQ ID NO: 359371 - RNA, 64 nt, Homo Sapiens; identical to SEQ ID NO: 328267

SEQ ID NO: 359372 - RNA, 64 nt, Homo Sapiens; identical to SEQ ID NO: 328268

SEQ ID NO: 359373 - RNA, 64 nt, Homo Sapiens; identical to SEQ ID NO: 328269

SEQ ID NO: 359374 - RNA, 64 nt, Homo Sapiens; identical to SEQ ID NO: 328270

SEQ ID NO: 359375 - RNA, 64 nt, Homo Sapiens; identical to SEQ ID NO: 328271

SEQ ID NO: 359376 - RNA, 64 nt, Homo Sapiens; identical to SEQ ID NO: 328272

SEQ ID NO: 359377 - RNA, 64 nt, Homo Sapiens; identical to SEQ ID NO: 328273

SEQ ID NO: 359378 - RNA, 64 nt, Homo Sapiens; identical to SEQ ID NO: 328274

SEQ ID NO: 359379 - RNA, 64 nt, Homo Sapiens; identical to SEQ ID NO: 328275

SEQ ID NO: 359380 - RNA, 64 nt, Homo Sapiens; identical to SEQ ID NO: 328276

SEQ ID NO: 359381 - RNA, 64 nt, Homo Sapiens; identical to SEQ ID NO: 328277

SEQ ID NO: 359382 - RNA, 64 nt, Homo Sapiens; identical to SEQ ID NO: 328278

SEQ ID NO: 359383 - RNA, 64 nt, Homo Sapiens; identical to SEQ ID NO: 328279

SEQ ID NO: 359384 - RNA, 64 nt, Homo Sapiens; identical to SEQ ID NO: 328280

SEQ ID NO: 359385 - RNA, 64 nt, Homo Sapiens; identical to SEQ ID NO: 328281

SEQ ID NO: 359386 - RNA, 64 nt, Homo Sapiens; identical to SEQ ID NO: 328282

SEQ ID NO: 359387 - RNA, 64 nt, Homo Sapiens; identical to SEQ ID NO: 328283

SEQ ID NO: 359388 - RNA, 64 nt, Homo Sapiens; identical to SEQ ID NO: 328284

SEQ ID NO: 359389 - RNA, 64 nt, Homo Sapiens; identical to SEQ ID NO: 328285

SEQ ID NO: 359390 - RNA, 64 nt, Homo Sapiens; identical to SEQ ID NO: 328286

SEQ ID NO: 359391 - RNA, 64 nt, Homo Sapiens; identical to SEQ ID NO: 328287

SEQ ID NO: 359392 - RNA, 64 nt, Homo Sapiens; identical to SEQ ID NO: 328288

SEQ ID NO: 359393 - RNA, 64 nt, Homo Sapiens; identical to SEQ ID NO: 328289

SEQ ID NO: 359394 - RNA, 64 nt, Homo Sapiens; identical to SEQ ID NO: 328290

SEQ ID NO: 359395 - RNA, 64 nt, Homo Sapiens
aaguguuucuuauuauuauuuuauauugaguugaauauugaacucuaacaguuuucuacauaca

SEQ ID NO: 359396 - RNA, 64 nt, Homo Sapiens
uucauuacaagucuuucacagaaguuuggugguaauauugaaagaacuagcauugggcagaaug

SEQ ID NO: 359397 - RNA, 64 nt, Homo Sapiens
cacaggaaccugugguuuuaacaaaccaauacacauauugaagaagucauuuuaauucagugaa

SEQ ID NO: 359398 - RNA, 64 nt, Homo Sapiens
guggauacucuuaggcgugaauguaaaugccuuaauauugaagguccugguuagaagcaugaua

SEQ ID NO: 359399 - RNA, 64 nt, Homo Sapiens
uuuuaauuucuacacacccauagugcacacuuguauauugaaaagauagggaagagagaaacau

SEQ ID NO: 359400 - RNA, 64 nt, Homo Sapiens
aguugggaaaaguguuauuauuuggcaugcuuaaauauugaauaaguauucuucaucagcauuu

SEQ ID NO: 359401 - RNA, 64 nt, Homo Sapiens
agaauuaugagaccuacugaugucccugauacagauauugaaaccaucugaaaagaaagcuaaa

SEQ ID NO: 359402 - RNA, 64 nt, Homo Sapiens
cacauuuuauucacauagauacuauguccuugacauauugaaaugauucuuuucugaaaguauu

SEQ ID NO: 359403 - RNA, 64 nt, Homo Sapiens
gauggaacugacugauaaaguguggugggccaaaauauugaaaucauuacauguuucaaagugg

SEQ ID NO: 359404 - RNA, 64 nt, Homo Sapiens
cagcaucauuaaacaguuaucagaauuagguaguauauugaagacuggugagaaguugcauaaa

SEQ ID NO: 359405 - RNA, 64 nt, Homo Sapiens
uuguauuuuuaacuguugcugcacuauaguauuuauauugaagcaaauguucaucuaguguuag

SEQ ID NO: 359406 - RNA, 64 nt, Homo Sapiens
gaagaggcugacaauaagguagaccuuguauaccauauugaaagcaaucaaaugauaaacuuua

SEQ ID NO: 359407 - RNA, 64 nt, Homo Sapiens
aaguucacauuacagaaaaggccaagcaggaauuauauugaaauaaacaucaaaucagaaucua

SEQ ID NO: 359408 - RNA, 64 nt, Homo Sapiens
gcuuggaaaagagguacccacuuaauuuugguagauauugaauguuuuuacugcuuuaauucua

SEQ ID NO: 359409 - RNA, 64 nt, Homo Sapiens
uauauuaaaaaagagcuugcuuacuacaagaaaaauauugaaauauugaaaauauugaaaauau

SEQ ID NO: 359410 - RNA, 64 nt, Homo Sapiens
aaaagagcuugcuuacuacaagaaaaauauugaaauauugaaaauauugaaaauauuauuauug

SEQ ID NO: 359411 - RNA, 64 nt, Homo Sapiens
ugcuuacuacaagaaaaauauugaaauauugaaaauauugaaaauauuauuauugaaaauaaaa

SEQ ID NO: 359412 - RNA, 64 nt, Homo Sapiens
uuucauauuuuacggcuuuauugaaaacauugauauauugaauauucauaaauuuuaauuuaac

SEQ ID NO: 359413 - RNA, 64 nt, Homo Sapiens
aaggagaaaggagauugguaaggaagugugauacauauugaaucaggugucaagguaccauuug

SEQ ID NO: 359414 - RNA, 64 nt, Homo Sapiens
uuauuguuccaauucacaggaauguauugagcuuauauugaaaugccauaugagguuauauuga

SEQ ID NO: 359415 - RNA, 64 nt, Homo Sapiens
guauugagcuuauauugaaaagccauaugagguuauauugaaauggaaaacaaaaaugauauaa

SEQ ID NO: 359416 - RNA, 64 nt, Homo Sapiens
uguuuuauagaaaguuuuuucugcuaauaaaauuauauugaaacugugaauuuugauguaauaa

SEQ ID NO: 359417 - RNA, 64 nt, Homo Sapiens
aaagccacugugcuuguguucuuaucauagcucuauauugaaugauucagggucucuugauaga

SEQ ID NO: 359418 - RNA, 64 nt, Homo Sapiens
aaagugaugugccauuuguuaauauacaagagaaauauugaaaauauauugaaaagagcaauuu

SEQ ID NO: 359419 - RNA, 64 nt, Homo Sapiens
ccauuuguuaauauacaagagaaauauugaaaauauauugaaaagagcaauuuuaaauuauuuu

SEQ ID NO: 359420 - RNA, 64 nt, Homo Sapiens
acacuucuacagaacaacggagaggagauuuuaaauauugaaugucaggcucuuguuuugguuc

SEQ ID NO: 359421 - RNA, 64 nt, Homo Sapiens
cauuuucacugaauaugguauauaauagguaauuauauugaaugaaggcugagaagguuguuuu

SEQ ID NO: 359422 - RNA, 64 nt, Homo Sapiens
cuccuucagccauuagaagccaaacaacuacuugauauugaaauauuuuuaggcacauuuguga

SEQ ID NO: 359423 - RNA, 64 nt, Homo Sapiens
cugacagaaauaugaaugucaacacauaaaaucuauauugaaaagcuacaguuugcauacagug

SEQ ID NO: 359424 - RNA, 64 nt, Homo Sapiens
uuucuuaggacauguagcaaacugaaguucagauauauugaaacuacuguuuuaaagguagaga

SEQ ID NO: 359425 - RNA, 64 nt, Homo Sapiens
aacauagaucucaguuuugguuauaugaccugguauauugaacagaaaguaaacuagucuaguu

SEQ ID NO: 359426 - RNA, 64 nt, Homo Sapiens
uugaagccauugcugugaauuacgugagggaaagauauugaagaggaguuggacacuccgagag

SEQ ID NO: 359427 - RNA, 64 nt, Homo Sapiens
guauauacccgaaagaaaggaaaaggaagccaguauauugaagagguaucugcacccccauguu

SEQ ID NO: 359428 - RNA, 64 nt, Homo Sapiens
uuagaaauugcauguuaguuuuugcaauuuggggauauugaaaauauauauuagcuauuaguau

SEQ ID NO: 359429 - RNA, 64 nt, Homo Sapiens
gaagcaagaauauugucacacuaggguaaaguggauauugaaauccaaacuggaaaucagaaca

SEQ ID NO: 359430 - RNA, 64 nt, Homo Sapiens
auagugcucuugcuuuggauaagcaugguaacuuauauugaaauacucuuuggcauggguaaau

SEQ ID NO: 359431 - RNA, 64 nt, Homo Sapiens
gcugcaaguacuuuguaaucuaauuaagugcccaauauugaaagugacuuacauggguuugcug

SEQ ID NO: 359432 - RNA, 64 nt, Homo Sapiens
uucacucucuucccauuaaacuugaacuguggcuauauugaacuguuuuggaggggagggggua

SEQ ID NO: 359433 - RNA, 64 nt, Homo Sapiens
uugaucuguuggaggcuaaaaguagguauaaaugauauugaauguuggguauagugauacucug

SEQ ID NO: 359434 - RNA, 64 nt, Homo Sapiens
auugacaaauuguguacaaaguacagaaaauugaauauugaaaagaauugucccaaaaguaccu

SEQ ID NO: 359435 - RNA, 64 nt, Homo Sapiens
accauugacaaaaacacuauuaauuuacagcaaaauauugaauaaugugagaaacaauucuuuu

SEQ ID NO: 359436 - RNA, 64 nt, Homo Sapiens
gcucagaagccgcgucccuuaacagguguggagaauauugaauguguagagaugccugauucca

SEQ ID NO: 359437 - RNA, 64 nt, Homo Sapiens
uuuuaauauuaaaaauauuucuugaaauaagaaaauauugaacagugagacuucucucacuggc

SEQ ID NO: 359438 - RNA, 64 nt, Homo Sapiens
auuauaaaauaggcaaacaccaaaaugguauuaaauauugaacuccugaccuuuucgacacuua

SEQ ID NO: 359439 - RNA, 64 nt, Homo Sapiens
ucugaaauuuaaaauguuaaagaaaaacauuucuauauugaaauauauauaauuuauaaugaaa

SEQ ID NO: 359440 - RNA, 64 nt, Homo Sapiens
aauauuuuagauauauugguuucauauugaguacauauugaaauaaaguuaaguaucucaauuu

SEQ ID NO: 359441 - RNA, 64 nt, Homo Sapiens
ugaauuuaagccucaagagcacaucuugccaaaaauauugaaccugugcuacaguaagauauac

SEQ ID NO: 359442 - RNA, 64 nt, Homo Sapiens
uuuauuuuugaaguuuuugugcuuacaaaaagaaauauugaauugauagcaaaaucaagagaug

SEQ ID NO: 359443 - RNA, 64 nt, Homo Sapiens
gcaaacauuugaaggagggagccugccuaacaaaauauugaaaguggcaugacucuugacucuu

SEQ ID NO: 359444 - RNA, 64 nt, Homo Sapiens
aauauuuauuacauucugacaauaaguagagaaaaucaucaauauucugaaccauuuauuguug

SEQ ID NO: 359445 - RNA, 64 nt, Homo Sapiens
uuacaaauuuucugauugaaucaggugacaacccaucaucaaaaaauuuaaaauauaaauccau

SEQ ID NO: 359446 - RNA, 64 nt, Homo Sapiens
cuaauuuguguagauuuuuggaaaagcuuuccauaucaucaaaaagaugaauguuugaugcuau

SEQ ID NO: 359447 - RNA, 64 nt, Homo Sapiens
ugagaucauaaguguuaaugugauaaccuaguaaaucaucaaaauugauucaccuucagggggc

SEQ ID NO: 359448 - RNA, 64 nt, Homo Sapiens
uauaaagcugugauuauaucaaaaauccagauaaaucaucaaauauaucagauuaagaccaggg

SEQ ID NO: 359449 - RNA, 64 nt, Homo Sapiens
aauauucucacaauauagguuuuggggcuuccauaucaucaaaagacugaaaaauuauaauuuu

SEQ ID NO: 359450 - RNA, 64 nt, Homo Sapiens
cccagagauaguggaaacugaaauuaggaaggaaaucaucaauaacucagugggcugacccauc

SEQ ID NO: 359451 - RNA, 64 nt, Homo Sapiens
cuucucccuaaagguaaccacuauucugaguccaaucaucaagguuuugcuuuucuuuuuagcu

SEQ ID NO: 359452 - RNA, 64 nt, Homo Sapiens
guuuaauauugggaaaauuugugaauuuaaaaguaucaucaagggguggauucuuuuccuuaua

SEQ ID NO: 359453 - RNA, 64 nt, Homo Sapiens
cugugcugccuguugcugaaggacagacauguucaucaucaaggucaagaagaaaugaaagaag

SEQ ID NO: 359454 - RNA, 64 nt, Homo Sapiens
aaauaaugacauaaaaucauauucuauaaaacacaucaucaauauuauguuucuaaauuuugug

SEQ ID NO: 359455 - RNA, 64 nt, Homo Sapiens
auuuaaugauuaaaauagcaugaugaugauagucaucaucaagaauuucuuuucuaucucaucu

SEQ ID NO: 359456 - RNA, 64 nt, Homo Sapiens
aaauagugacauaaaaucauauucuauaaaacacaucaucaauauuauguuucuaaauuuugug

SEQ ID NO: 359457 - RNA, 64 nt, Homo Sapiens
auuuaaugauuaaaauagcaugaugaugaucgucaucaucaagaauuucuuuucuuucucaucu

SEQ ID NO: 359458 - RNA, 64 nt, Homo Sapiens
agcugccaguuuugaauaaugaauaucauauuguaucaucaaugcugauauuuaacugaguugg

SEQ ID NO: 359459 - RNA, 64 nt, Homo Sapiens
ucccuucugucauuuucauugauuuaauuuguguaucaucaauaaaauuguauguuaaugcugg

SEQ ID NO: 359460 - RNA, 64 nt, Homo Sapiens
cauagccccugcuuggaggcccuucucugauggggugacauaaucccuuccuccugggaaacac

SEQ ID NO: 359461 - RNA, 64 nt, Homo Sapiens
cuuggcccuucaagugggcugaagcccuuggaaagugacauaggaaguccccagaucuugcccu

SEQ ID NO: 359462 - RNA, 64 nt, Homo Sapiens
ucaacauggcugcuuugcugcuuccuucuccaaagugacauauggagggaacuuuagcacuucc

SEQ ID NO: 359463 - RNA, 64 nt, Homo Sapiens
gcaguucucuuauuuggucgacuuuugugaaugugugacauaaacagauguaaugcaugucaca

SEQ ID NO: 359464 - RNA, 64 nt, Homo Sapiens
ucuccugguuuuguagacccagaagauugaaugagugacauaaaucuuuaguucggggcaagcc

SEQ ID NO: 359465 - RNA, 64 nt, Homo Sapiens
uuggcagguauguguguaaucucagaauacacaggugacauagauaugauaugacaacugguaa

SEQ ID NO: 359466 - RNA, 64 nt, Homo Sapiens
caccucucucuauuuuauuugccaggggcacgaugugacauaucugcagucccagcacaguggg

SEQ ID NO: 359467 - RNA, 64 nt, Homo Sapiens
uaccuacugugugccaggggcuggugggacaguggugacauagucucugcccucauagaguuga

SEQ ID NO: 359468 - RNA, 64 nt, Homo Sapiens
gucaugcugaggugugacacgguaccaaucuuuugugacauauucugugagccugucaguagug

SEQ ID NO: 359469 - RNA, 64 nt, Homo Sapiens
uagagcgcagaguuccugaucacacaauuggauagugacauagcggaagugacuugcucaaggu

SEQ ID NO: 359470 - RNA, 64 nt, Homo Sapiens
acuugaagaccaaagacuuuagacugaggaagcugugacauaggcuacagagaaggagggaauc

SEQ ID NO: 359471 - RNA, 64 nt, Homo Sapiens
cuaaauaaaaaaaugaauauugauaaauugcugcgugacauauaguuuucacaacaaaagcuuu

SEQ ID NO: 359472 - RNA, 64 nt, Homo Sapiens
aacaucuguagcagcugguuaucauuguuaauuagugacauagugguaugacacauuuucugug

SEQ ID NO: 359473 - RNA, 64 nt, Homo Sapiens
caaaaaaaucuaguggauagaaaaaaguacuucugugacauauaguuuaaauauacuaccuaag

SEQ ID NO: 359474 - RNA, 64 nt, Homo Sapiens
ucauacaucggcacugaauucauuuacaggaaaugugacauaacaaaugagaaccuuaaauuua

SEQ ID NO: 359475 - RNA, 64 nt, Homo Sapiens
gaugggcuaaggugaggccucaaaggagaugcaggugacauacacgcaccaaaggggaaacauu

SEQ ID NO: 359476 - RNA, 64 nt, Homo Sapiens
cuccguagucacaguuucagcuuauucucaaauagugacauauugaguggagcaggugggaccu

SEQ ID NO: 359477 - RNA, 64 nt, Homo Sapiens
auugcuugagcccaggaauuugagaccagccuaggugacauagugagaccccaucucuacaaaa

SEQ ID NO: 359478 - RNA, 64 nt, Homo Sapiens
cuuguuaccuaaauaaagaauugauaaaaacagugugacauauuacuauuugguaugauucagu

SEQ ID NO: 359479 - RNA, 64 nt, Homo Sapiens
uagaaauaccauuuuauaauuuuacuauuccagggugacauaaugcauuuaaauuugggauuug

SEQ ID NO: 359480 - RNA, 64 nt, Homo Sapiens
ccacucuaugagaaggaagauuacugaaaagcaugugacauauugcuacaaagauuuuuuuucc

SEQ ID NO: 359481 - RNA, 64 nt, Homo Sapiens
aacuccuaauuguucuuugacacguaguaauucugugacauacuuuuuuuuucuuauagcaaua

SEQ ID NO: 359482 - RNA, 64 nt, Homo Sapiens
gaauuuuguuuggacuucuuuuacucaugaucuugugacauauuaugucuucaugcaaggggaa

SEQ ID NO: 359483 - RNA, 64 nt, Homo Sapiens
auuauuauuaccuuccuuuucaaauuaaauguuugugacauaguauguuacuucauuuucuuau

SEQ ID NO: 359484 - RNA, 64 nt, Homo Sapiens
ucccuuucccauuguugcuguuucaaacuuucaugugacauauuagcucauuuuauucuagguc

SEQ ID NO: 359485 - RNA, 64 nt, Homo Sapiens
uauuuaacccagaauacuuuuuaucucauauuuugugacauaauccuuacauauauuugcauac

SEQ ID NO: 359486 - RNA, 64 nt, Homo Sapiens
uauuguuuaucuggguuaggcccuucuuguuucagugacauaugaugggucuccuugcuucaau

SEQ ID NO: 359487 - RNA, 64 nt, Homo Sapiens
ugucauuauaccaguguugucauauuggcuuuaugugacauaacauauucauucauuuaguugu

SEQ ID NO: 359488 - RNA, 64 nt, Homo Sapiens
aauaauagaguuuauuguauuuuaucuagcacuugugacauaccugucauauuaagaaaaaaag

SEQ ID NO: 359489 - RNA, 64 nt, Homo Sapiens
ugagaaagguuuugugaguaaacccuacuggacagugacauaaaaggcaauggaauuuucuaua

SEQ ID NO: 359490 - RNA, 64 nt, Homo Sapiens
ugugacaaaugggaaaaaaaauccaaauaauaaagugacauauugguguucagcaauauaaacc

SEQ ID NO: 359491 - RNA, 64 nt, Homo Sapiens
gugagccaugaucacaccacugcacuccagccaggugacauagcgagauccugucuaaaaaaau

SEQ ID NO: 359492 - RNA, 64 nt, Homo Sapiens
uucccuucccucccccuucauugaguuaauacaagugacauagcguccuagaggacacugucag

SEQ ID NO: 359493 - RNA, 64 nt, Homo Sapiens
uuauuuacugccuauuucauacagucaucaguuugugacauacaugugcuacaauauaggaggc

SEQ ID NO: 359494 - RNA, 64 nt, Homo Sapiens
uuaauuuguacaaaaagaacacacuaaauuaaaugugacauaaaccucaguuuugagguuaugc

SEQ ID NO: 359495 - RNA, 64 nt, Homo Sapiens
auuggaaauccauuuuuguugaucuauguacaaagugacauacaucuauguaucucuggaguga

SEQ ID NO: 359496 - RNA, 64 nt, Homo Sapiens
auguuaauguuuuguaauguccuuuuaaugaguggugacauaaaagggcugcuuuguuguccug

SEQ ID NO: 359497 - RNA, 64 nt, Homo Sapiens
augcaaaaauaagucagauuuuaaggcaaauaaagugacauaaggugcuuuauauuuuauuuug

SEQ ID NO: 359498 - RNA, 64 nt, Homo Sapiens
ugauucagaaauuuucauucagguauuuguaauagugacauauauauguauauacauaucaccu

SEQ ID NO: 359499 - RNA, 64 nt, Homo Sapiens
uuaccaguagaccuuuaaugacaguauguauauagugacauagcuaauuugugauccaacaugu

SEQ ID NO: 359500 - RNA, 64 nt, Homo Sapiens
auugguucuacagaaucguggugcucuccugguggugacauaacuuccaauggugccuugcuug

SEQ ID NO: 359501 - RNA, 64 nt, Homo Sapiens
aauuauaaaauggugcauaauuugcuauguaaaugugacauauuauuagcugugccuucauuau

SEQ ID NO: 359502 - RNA, 64 nt, Homo Sapiens
aguauuauaauugguuaaguuaaaguuguucaaugugacauaauauuucaaagaagcaauuaug

SEQ ID NO: 359503 - RNA, 64 nt, Homo Sapiens
aaaugugaacuggaaaacgcuucggucaguuuuagugacauagccugugaugaugggucuggug

SEQ ID NO: 359504 - RNA, 64 nt, Homo Sapiens
guaauaaaugaaugucacuucuggauauagcuaggugacauauacauacuuacauguguguaua

SEQ ID NO: 359505 - RNA, 53 nt, Homo Sapiens
gcacagacugggagaacuaacaagugacauaacagaagaaaaauaucauucaa

SEQ ID NO: 359506 - RNA, 64 nt, Homo Sapiens
uuccaugccuuggagaaugaaucauuuuuagauugugacauaaaucuuguaaaaaccugucagu

SEQ ID NO: 359507 - RNA, 64 nt, Homo Sapiens
gacuuuauauacauuuuguuaaauauaguuccuagugacauagaaacgaugcguaguuuucauu

SEQ ID NO: 359508 - RNA, 64 nt, Homo Sapiens
guaugguaaauguguguuuuaaacuuccuaucaagugacauacuucauuugauuuuuuguuuaa

SEQ ID NO: 359509 - RNA, 64 nt, Homo Sapiens
uauuuuuuuagcagugaaaaugaauauaaaaaaggugacauaggucaaguuuuccauaaauucu

SEQ ID NO: 359510 - RNA, 64 nt, Homo Sapiens
uucuuuagugaacuuguuuaauuccucagugggugugacauauuucaugggaauauucaaauau

SEQ ID NO: 359511 - RNA, 64 nt, Homo Sapiens
aaguaaaucauacuuuagaaucucuucagggaaugugacauacaaaguuuguaagacaugaagu

SEQ ID NO: 359512 - RNA, 64 nt, Homo Sapiens
guguuauuuucugacugcuggauucuguaguaaggugacauagcuaugacauuuguuaaaaaua

SEQ ID NO: 359513 - RNA, 64 nt, Homo Sapiens
aguccauuaucugggaugcaugaauacuucgacugugacauacaaaccccugcaucuacuauga

SEQ ID NO: 359514 - RNA, 64 nt, Homo Sapiens
uuccagugacuuguugauguuuuaugaaacuaaugugacauaaugaaaaaaucaaagaccauga

SEQ ID NO: 359515 - RNA, 64 nt, Homo Sapiens
guaguuggccuuauaaguaguccuuucaauuauagugacauagaaauuuucuuaauuuauucuu

SEQ ID NO: 359516 - RNA, 64 nt, Homo Sapiens
guuaaccacaguggccuuuucaguauugacuccagugacauaaacaggaaauugacaguggcug

SEQ ID NO: 359517 - RNA, 64 nt, Homo Sapiens
aagaccaaggauuauguauaaaguagaucaugcagugacauacacugaaacaauccuugugaug

SEQ ID NO: 359518 - RNA, 64 nt, Homo Sapiens
uuuuuuuuuuaauauguggaaaauguguccagaugugacauagucaguuuucauaugcucugug

SEQ ID NO: 359519 - RNA, 64 nt, Homo Sapiens
gugcccuuccaccuauuuuugcagaaauaacagugugacauaaaaggaacaacaaauaacaaua

SEQ ID NO: 359520 - RNA, 64 nt, Homo Sapiens
uacuucaaaaaugucucugaaacauucuguaaaggugacauaaacuaacaaaagccaauugaug

SEQ ID NO: 359521 - RNA, 64 nt, Homo Sapiens
uauccagugaacaggauguuuugcuuuagcagcagugacauaaaauuccauguuagauaagcau

SEQ ID NO: 359522 - RNA, 64 nt, Homo Sapiens
gagguucugaaugauuuuauugcuaauuaucacagugacauagacuagaacagaaauuagaagc

SEQ ID NO: 359523 - RNA, 64 nt, Homo Sapiens
ccucccccacggugccugugccccaggcuaugaagugacauagggccccacauggacagccauu

SEQ ID NO: 359524 - RNA, 64 nt, Homo Sapiens
auccacuagucccaagggcuggaaguuugaaauagugacauaucaccaggcuggaaagggacca

SEQ ID NO: 359525 - RNA, 64 nt, Homo Sapiens
cuucccagagacugguauugcccacguggaguaggugacauaugcuguggugacuggaauggga

SEQ ID NO: 359526 - RNA, 64 nt, Homo Sapiens
ccuaauaccaaaucugacuccaaaauuguggggugugacauacaagugacugaacacuuccugg

SEQ ID NO: 359527 - RNA, 64 nt, Homo Sapiens
uauuaaagugaaauuuagcaauaguuaauauuaggugacauaaauaaaacaucccagacuagug

SEQ ID NO: 359528 - RNA, 64 nt, Homo Sapiens
uuccacacuccgugacuccgcaguuuguccuggagugacauacacauccaccauggaaagggaa

SEQ ID NO: 359529 - RNA, 64 nt, Homo Sapiens
uugcucaacuucugcuauucauauggucugauuagugacauaaguagcagccguuuuucaacuu

SEQ ID NO: 359530 - RNA, 64 nt, Homo Sapiens
aacugaccuauaagaguguuaaggaccuaauagagugacauauauaaauuaagcauaaaauaug

SEQ ID NO: 359531 - RNA, 64 nt, Homo Sapiens
cuuaagaucuauaauuuuggcauuuaugucauuugugacauagucugaaaauagagacauuguu

SEQ ID NO: 359532 - RNA, 64 nt, Homo Sapiens
acugaugaaugaguaaaaguagggaaacuaaggagugacauagauuauaaagccauauuuuuuu

SEQ ID NO: 359533 - RNA, 64 nt, Homo Sapiens
auuuuccuuucuguauuaauuauaccaguguuaagugacauagauaagaacuuugcacacuuca

SEQ ID NO: 359534 - RNA, 64 nt, Homo Sapiens
uagauaauuaagauuauuaaacccucauuuaaaugugacauaaaauacagcuuuaagcacauaa

SEQ ID NO: 359535 - RNA, 64 nt, Homo Sapiens
gggcaccuuuuaacucuaaaacuagugauacucagugacauagacuuugucuuauaaacauuuu

SEQ ID NO: 359536 - RNA, 64 nt, Homo Sapiens
guagaucgaucuuuaugcuguuauuacaggagaagugacauacuuuauauauguuuauauuagc

SEQ ID NO: 359537 - RNA, 64 nt, Homo Sapiens
ucuaauaaacaaggacuauugcugauaguaggcugugacauacugucuugugaaaugguuuccu

SEQ ID NO: 359538 - RNA, 64 nt, Homo Sapiens
ugaacugggcgaaugucuuauuuaauuaccgugagugacauagccucauguucuguggggguca

SEQ ID NO: 359539 - RNA, 64 nt, Homo Sapiens
aaaauacagcuggcaggcauggagauuuugcuaugugacauaacagcucacucaguuuagauau

SEQ ID NO: 359540 - RNA, 64 nt, Homo Sapiens
cugggaacuuguuucccuuagugcagaaacucaugugacauaggaccuuaccacauaacacgua

SEQ ID NO: 359541 - RNA, 64 nt, Homo Sapiens
ggaccagaagaggcacuagcucaaggagagggcggugacauauugacccccauugguuuggaaa

SEQ ID NO: 359542 - RNA, 64 nt, Homo Sapiens
cgauauuaaaaugauauuaaggucauuaaaucuugugacauauuaaaauguaaaugacuaauuu

SEQ ID NO: 359543 - RNA, 64 nt, Homo Sapiens
ugaacauggaaagaaaauuuaauaacuuuuuaaagugacauaauuuacaugcaauauguuuauc

SEQ ID NO: 359544 - RNA, 64 nt, Homo Sapiens
guaucugguaauuaaauaggccucagauucagcagugacauaacaaggacauaauguaagauaa

SEQ ID NO: 359545 - RNA, 64 nt, Homo Sapiens
caaagcucucugucaauuacguucacagagaaaagugacauaccgucccucauccuaacuuuca

SEQ ID NO: 359546 - RNA, 64 nt, Homo Sapiens
aaaaaaaaaaacuaaacuacaguaaauaaaauaagugacauaaacuuuagucccugucaagguu

SEQ ID NO: 359547 - RNA, 64 nt, Homo Sapiens
uauguaaauauuguuacuauuggaaucucucaaugugacauacuuuuccauuccuuggucaugc

SEQ ID NO: 359548 - RNA, 64 nt, Homo Sapiens
cccucccccaccguugucucugacucaggagccugugacauaccagauguauaacuaggagcuu

SEQ ID NO: 359549 - RNA, 64 nt, Homo Sapiens
uuucacugggggucagcuauaacuaaaaacucaagugacauauuucaguuaccaaaguggccag

SEQ ID NO: 359550 - RNA, 64 nt, Homo Sapiens
cuacgauacgcuacuauaaagagaagacgaaauagugacauaauauauucuauuuuuauacucu

SEQ ID NO: 359551 - RNA, 64 nt, Homo Sapiens
agcuuugaggaggcaggagauuccgugggucccugugacauauugcauuaagaucguggcacuu

SEQ ID NO: 359552 - RNA, 64 nt, Homo Sapiens
ggaagacaacagauucagaauuccuuaaggagaugugacauauguugagggagaagguggagac

SEQ ID NO: 359553 - RNA, 64 nt, Homo Sapiens
gagacuccaucucaaaaaaagcaauucagccugggugacauagagagauagugauagugccacu

SEQ ID NO: 359554 - RNA, 64 nt, Homo Sapiens
aaacuguaaauugugaacacuggaaagcaccauugugacauagaguaaacaucuuaguaauaua

SEQ ID NO: 359555 - RNA, 64 nt, Homo Sapiens
ucacuuaguccuuuaucauccuuaaaacaauucugugacauacauauuaucucauuuuacacaa

SEQ ID NO: 359556 - RNA, 64 nt, Homo Sapiens
uggaguugcacagaaucauggaauuuuguguugagugacauaauagguauggaaauaugagggg

SEQ ID NO: 359557 - RNA, 64 nt, Homo Sapiens
auuccuugagcccuggaguuugaguccagccugggugacauagcaagacccugucuuaaaagaa

SEQ ID NO: 359558 - RNA, 64 nt, Homo Sapiens
ugaccuuaguaucaacccccagcugggaaguggggugacauagcgacuggguauucuaaugagg

SEQ ID NO: 359559 - RNA, 64 nt, Homo Sapiens
cagcugcugacggcaccucacagaacucauaagagugacauaguguuuuaugcuuguuccugag

SEQ ID NO: 359560 - RNA, 64 nt, Homo Sapiens
uaacuguaaaguaaccugacuuauuguguuuuaggugacauaguguuauuagaguguuaaugga

SEQ ID NO: 359561 - RNA, 64 nt, Homo Sapiens
cuccugugggucuugaguugacuggguuuaucuggugacauagugcuggacauuggauucuagc

SEQ ID NO: 359562 - RNA, 64 nt, Homo Sapiens
ucacacuguuuucuuaccuuuguauuaacuauucgugacauaguacuaucuuaauacuguauac

SEQ ID NO: 359563 - RNA, 64 nt, Homo Sapiens
auaaauaauccuaaaugguuaguagaagugaucagugacauacuuaaauuuauuugucuauacu

SEQ ID NO: 359564 - RNA, 64 nt, Homo Sapiens
auauuuucucuauuuuccccuggccuauagauuagugacauaaaaguggaauuggcuuuggauc

SEQ ID NO: 359565 - RNA, 64 nt, Homo Sapiens
uauacguuuuugugcaaaaaguuaagaaaagcuggugacauauucuuuuauuuaaguuuuuuaa

SEQ ID NO: 359566 - RNA, 64 nt, Homo Sapiens
auuacuuuuuuggggacggguguacauaucaguggugacauauuuuuacagaaacuaauuguga

SEQ ID NO: 359567 - RNA, 64 nt, Homo Sapiens
uagcagcccacggagauccuuuaaucagcccucugugacauagguuugggaacacugcaagccc

SEQ ID NO: 359568 - RNA, 64 nt, Homo Sapiens
cuuaucuaauucucagaucagcuugucuuucuaagugacauauucagagcuaugggugcuacag

SEQ ID NO: 359569 - RNA, 64 nt, Homo Sapiens
ugcugaagagacaggcauugggccugggagcucagugacauaaaacgagaaccgucuuuacccg

SEQ ID NO: 359570 - RNA, 64 nt, Homo Sapiens
cuuuaauuuuaaaaaauuguucucguuaagaucagugacauauucugcugagacgauuuggaag

SEQ ID NO: 359571 - RNA, 64 nt, Homo Sapiens
cacuucauauuuguauagaauccucuaaucccuugugacauagacuugacagggauuguaugcc

SEQ ID NO: 359572 - RNA, 64 nt, Homo Sapiens
aaacucaaugaaaucagcaaacugggaauuucuggugacauagaccucaccagugcuucauaua

SEQ ID NO: 359573 - RNA, 64 nt, Homo Sapiens
caaguccuguuuauaagucuagucauucugcaacgugacauaucccccaaaaugaaguuaccuu

SEQ ID NO: 359574 - RNA, 64 nt, Homo Sapiens
uauuccuaguuccauaccuuucuacuuacugaaugugacauauuuucuacuccaaucaggcuaa

SEQ ID NO: 359575 - RNA, 64 nt, Homo Sapiens
gugcagagguguaccagggacuuuugggcuaauagugacauaguuggacauucucguuaauauu

SEQ ID NO: 359576 - RNA, 64 nt, Homo Sapiens
gcugcucuuuuuagcuggcuuuuuauuaggcucagugacauaaaaaggauccagguaaaugggu

SEQ ID NO: 359577 - RNA, 64 nt, Homo Sapiens
caggacauggucagggagaggacccugugaguuggugacauauauguggcagagaugguagugu

SEQ ID NO: 359578 - RNA, 64 nt, Homo Sapiens
ucaggcuauucauucauaaaucucaacagauauagugacauagcuuuacaaauucucauuucca

SEQ ID NO: 359579 - RNA, 64 nt, Homo Sapiens
gcaaccccagcccaagcucugccucaaagaccgagugacauaagccauucccacccuccuaggu

SEQ ID NO: 359580 - RNA, 64 nt, Homo Sapiens
ugucaauauaaguuagaagcgacaaauuacgugugugacauaucuuauggaauaguaaaauaug

SEQ ID NO: 359581 - RNA, 64 nt, Homo Sapiens
ccugcauauuugucagugccuuuauguagagagugugacauagaguccagccaccccccagcac

SEQ ID NO: 359582 - RNA, 64 nt, Homo Sapiens
cagggucuugcucuguuguccaggcuggagggcagugacauaaucauagcucacuguacccuug

SEQ ID NO: 359583 - RNA, 64 nt, Homo Sapiens
uccuuaguacaugcucuguccagcuuuccccagggugacauacagaaggggcaacaucuacccg

SEQ ID NO: 359584 - RNA, 64 nt, Homo Sapiens
aacacagccucuaagaaacaaggcagcuguuagugugacauagcuuccagcuccucuguuaucu

SEQ ID NO: 359585 - RNA, 64 nt, Homo Sapiens
gguauuuugucuuucaaacuacaaauggaauguggugacauaaacuagacauggggugcccuca

SEQ ID NO: 359586 - RNA, 64 nt, Homo Sapiens
guaaugauguaacagugcaagauuuuuuuuuuaagugacauaauuguccaguuauaagcguauu

SEQ ID NO: 359587 - RNA, 64 nt, Homo Sapiens
aaauggaaauaagaggauaugugccagguuuucagugacauaccgugauuuuuagcuaaguggu

SEQ ID NO: 359588 - RNA, 64 nt, Homo Sapiens
cauauuauggaacagugugaugguuagauaaauugugacauaccaaugcccauuaauagggaac

SEQ ID NO: 359589 - RNA, 64 nt, Homo Sapiens
gagguugaauugaguauauaaacuuucuggguuugugacauacaccgucucacaacucacaaga

SEQ ID NO: 359590 - RNA, 64 nt, Homo Sapiens
uuuucccaauuccacacagcaggugauuucccgugugacauauuuucuucauagucccuaauau

SEQ ID NO: 359591 - RNA, 64 nt, Homo Sapiens
auacucuugaugugaauauaguuuaccaaaauuagugacauaaugaguggaauuacuagguaag

SEQ ID NO: 359592 - RNA, 64 nt, Homo Sapiens
uucaucuccugauccauuguggaaagaucguacagugacauaagaaguuaacuuuuggaugaua

SEQ ID NO: 359593 - RNA, 64 nt, Homo Sapiens
aucauuuuugcuuuacauuuucaucaauaaaauagugacauaaauugugauucuauaaaacaca

SEQ ID NO: 359594 - RNA, 64 nt, Homo Sapiens
acagaacacauggucuucaauauguagauucugugugacauagauuugaacauaauugcuggac

SEQ ID NO: 359595 - RNA, 64 nt, Homo Sapiens
ggacugaguucuugacaacagaauguggucagaagugacauaugccaacacggggucugggugg

SEQ ID NO: 359596 - RNA, 64 nt, Homo Sapiens
ugucuucauuucaccucuguguuuaaagcacugugugacauagcuccuuagagauauaaccuau

SEQ ID NO: 359597 - RNA, 64 nt, Homo Sapiens
accacuguauguguacuaugaucccaacaggcuugugacauagauuucauauuaucccuguugu

SEQ ID NO: 359598 - RNA, 64 nt, Homo Sapiens
uuuccuuuugaguauaacuagugaacucauaguggugacauaccuacaaguguguuugucuuua

SEQ ID NO: 359599 - RNA, 64 nt, Homo Sapiens
cacagaacuuuauuuucguaguaccacaaaccgagugacauaaaacuagggcugccacagcaau

SEQ ID NO: 359600 - RNA, 64 nt, Homo Sapiens
cuuagaggacugaccucuacaguucauauuugcagugacauaaaaggcaaagaggagcuggcau

SEQ ID NO: 359601 - RNA, 64 nt, Homo Sapiens
gagaccuccuacuugagcugcaucguguaguuuugugacauaaggguggggaacagaaccuccg

SEQ ID NO: 359602 - RNA, 64 nt, Homo Sapiens
auaaacacuaaugcagucaauuugaacaaaagaagugacauacacaauauaaaucauaugucuu

SEQ ID NO: 359603 - RNA, 64 nt, Homo Sapiens
uccccugggaagugaggggacgaagccuuagagggugacauagcuagaaaguggagaagcucac

SEQ ID NO: 359604 - RNA, 64 nt, Homo Sapiens
cuuuauuuggcuuuauuuuaagacuuugguaugugugacauauguauuagaaaggcaaaaugua

SEQ ID NO: 359605 - RNA, 64 nt, Homo Sapiens
gccaaggguaaacaagccugugaaacaguguuuggugacauaauuguauguacuuccaguaucc

SEQ ID NO: 359606 - RNA, 64 nt, Homo Sapiens
ucuguggugaaccaagugaagguggugacuucuggugacauaguaauaaagugaagacucagaa

SEQ ID NO: 359607 - RNA, 64 nt, Homo Sapiens
uuuauuuccugggccuguuucucauuggcuuugagugacauauuuucuaguucugauucuguca

SEQ ID NO: 359608 - RNA, 64 nt, Homo Sapiens
uaucuauacauccguaucuuagucuuaaucauuugugacauaugugggaggguuacauuuuuua

SEQ ID NO: 359609 - RNA, 64 nt, Homo Sapiens
uuuuauguuuuuucuuaacuguuauauuaugauugugacauagauuauacuacuacuaauuuuu

SEQ ID NO: 359610 - RNA, 64 nt, Homo Sapiens
ucugcuagguuuuauugaugcagccaccacuuaagugacauaaauauuauagaaagguacugug

SEQ ID NO: 359611 - RNA, 64 nt, Homo Sapiens
cauuuagcuucagguugucuuguuucuguauauagugacauagcauucugcugccaucuuagcu

SEQ ID NO: 359612 - RNA, 64 nt, Homo Sapiens
uucagauugggaaauccauuccauuuugugaauugugacauaauaauagcaguggaaaaaguau

SEQ ID NO: 359613 - RNA, 64 nt, Homo Sapiens
ccagaaacagacaaacauugggucacuauauuaagugacauaaggagucauggauggaacuaga

SEQ ID NO: 359614 - RNA, 64 nt, Homo Sapiens
guggccuauaaauuuaaucagagaccuuguguaugugacauauaagaccacauuugauucaacu

SEQ ID NO: 359615 - RNA, 64 nt, Homo Sapiens
cacccaaagagccaguugcuaacuugcaggccacgugacauaaccugaccaggaagccaacguu

SEQ ID NO: 359616 - RNA, 64 nt, Homo Sapiens
aauagcagugguaaaaguauccauuuugugaauugugacauaaucucaaauugggaaauccauu

SEQ ID NO: 359617 - RNA, 64 nt, Homo Sapiens
gcugacugcaaaaacuggguccacuaaaagaauugugacauaaccucuccugccuagguccugc

SEQ ID NO: 359618 - RNA, 64 nt, Homo Sapiens
uuuccacgcuucccucaguucaccaaaguuaccaaaauguaaaauaaaauaagacuggcucagg

SEQ ID NO: 359619 - RNA, 64 nt, Homo Sapiens
ucaaaaucuuuccaaauguucugguaucuuugaaaaauguaaauaguuuauuuauagagaaccc

SEQ ID NO: 359620 - RNA, 64 nt, Homo Sapiens
uaaguuuccugaguuauuaguaagauugcucccuaaauguaaccagggauuuucccauuauguu

SEQ ID NO: 359621 - RNA, 64 nt, Homo Sapiens
auccaccuuguuuuuuuauugucuacaaaccauuaaauguaaauauuguuuuuagagucaguca

SEQ ID NO: 359622 - RNA, 64 nt, Homo Sapiens
uuaaacugaaauaugucaugugaaauuauuuuaaaaauguaaaaacaaaacuuucugcuaacaa

SEQ ID NO: 359623 - RNA, 64 nt, Homo Sapiens
caugcauuaggcuuuggaaauuuaauguuaguugaaauguaaaaugugaaaacuuuagaucauu

SEQ ID NO: 359624 - RNA, 64 nt, Homo Sapiens
uuaaauuuaguucaucuuucuuuaaaagaacauuaaauguaaccauuuugucagauccauguau

SEQ ID NO: 359625 - RNA, 64 nt, Homo Sapiens
gauauuugauaauuauauuuguauuucaccaccuaaauguaauguugauuccucaagaaugaaa

SEQ ID NO: 359626 - RNA, 64 nt, Homo Sapiens
uauuauuuuugguuaucaugauagaauaaauaauaaauguaaacgguuugggacagcaccuggu

SEQ ID NO: 359627 - RNA, 64 nt, Homo Sapiens
acuuucacugaauacaaauaggcucauuuacuugaaauguaaaaguuuuuuuuuuuuuaaugaa

SEQ ID NO: 359628 - RNA, 64 nt, Homo Sapiens
auguacacaagugacuagguauacuuuuguaaauaaauguaaauuguuuuuacugaugauguag

SEQ ID NO: 359629 - RNA, 64 nt, Homo Sapiens
ugaagcagcugcuuuaagaaugaacaacuguuggaaauguaacucauuugaguauuacaauuuu

SEQ ID NO: 359630 - RNA, 64 nt, Homo Sapiens
gucaugugcccuguucccuaagugggagaugagcaaauguaaauuuugauguuuugaaauguau

SEQ ID NO: 359631 - RNA, 64 nt, Homo Sapiens
uuguuaaaguaagcaccacacaauuacaggggauaaauguaagcaaaagaaagcaugaccaacc

SEQ ID NO: 359632 - RNA, 64 nt, Homo Sapiens
auuugccacaauguaaagcaaaguuuguuuucuaaaauguaaauaauuauguugacuaaauaca

SEQ ID NO: 359633 - RNA, 64 nt, Homo Sapiens
guuacauguauauuacuugguuuucagcucuuaaaaauguaaauaaugacacagaacuuuguac

SEQ ID NO: 359634 - RNA, 64 nt, Homo Sapiens
aguugggauuuuauaguuaacagaucaauaauuuaaauguaacuagacucuaaauuggcuucua

SEQ ID NO: 359635 - RNA, 64 nt, Homo Sapiens
cuucuucaucuuuaacuugaauuucugagugaugaaauguaacauacagacagguaaaaguucc

SEQ ID NO: 359636 - RNA, 64 nt, Homo Sapiens
uauaaacuucagucaauaucaauuuucacguuugaaauguaaaaauuggaaaugggcaguucug

SEQ ID NO: 359637 - RNA, 64 nt, Homo Sapiens
uggaucuaguuuaauuuuuuuuuuuuuuuagaggaaauguaacuggcagcuguccuuugacauu

SEQ ID NO: 359638 - RNA, 64 nt, Homo Sapiens
gaacugauuaauauguaaugcuaccugcuaauuaaaauguaaaaucaaguaaagaaaacauuuu

SEQ ID NO: 359639 - RNA, 64 nt, Homo Sapiens
cuaaaauggcucuggauaacauuuuuggguuaaaaaauguaauuuaaagccaccauagaaagua

SEQ ID NO: 359640 - RNA, 64 nt, Homo Sapiens
auuugugauuuauugagaauaaaaauccauuuugaaauguaaaauuuuuaugaucugauucagu

SEQ ID NO: 359641 - RNA, 64 nt, Homo Sapiens
gaauuuguaaguuggcagaucuuccuaaguugcaaaauguaaugaugagcuugguggagaagaa

SEQ ID NO: 359642 - RNA, 64 nt, Homo Sapiens
cuuauacaauuaugaagauuuaauauuacagauaaaauguaaacuguuucuuuaaaauuggggc

SEQ ID NO: 359643 - RNA, 64 nt, Homo Sapiens
uugauggcuaacuuacaaagauucucuauguaucaaauguaacuuacugcgacuaaacuuaauu

SEQ ID NO: 359644 - RNA, 64 nt, Homo Sapiens
uaccucuuauucacagcuuacacuuaugcaugccaaauguaaggccaugaaaaucaguauuuca

SEQ ID NO: 359645 - RNA, 64 nt, Homo Sapiens
uauuucaaauaacuuaaaaaaugcuuuacuacuaaaauguaaaaaauuaaugugcucaccucgg

SEQ ID NO: 359646 - RNA, 64 nt, Homo Sapiens
ggaagggacacauaucaaacugaaacaaaauuagaaauguaauuauguucuaagugccuccaag

SEQ ID NO: 359647 - RNA, 64 nt, Homo Sapiens
uucuaugcuuguaacugucuucuagcagugagccaaauguaaaauagugaauaaagucauuauu

SEQ ID NO: 359648 - RNA, 64 nt, Homo Sapiens
gauauuaaaucugugauuccucuuguaaauauauaaauguaaauaguugaaagccauggcuuga

SEQ ID NO: 359649 - RNA, 64 nt, Homo Sapiens
auugcaaugaaugugaauuagcuaauuuaugagaaaauguaauauccauauguuuguuuauauu

SEQ ID NO: 359650 - RNA, 62 nt, Homo Sapiens
auaagaaaauucauacuugagagaaauccuacaaauguaaagaauguggcaaaccuuuggau

SEQ ID NO: 359651 - RNA, 64 nt, Homo Sapiens
gcagaagaaaauuauuacuggagauaaacccugcaaauguaaagaguguaacaaaaccuuuaaa

SEQ ID NO: 359652 - RNA, 64 nt, Homo Sapiens
aauauaagaauucauccuagauauaaaaccauagaaauguaaaagaugugacaaaaccuuuaag

SEQ ID NO: 359653 - RNA, 64 nt, Homo Sapiens
aacuagcaauguucauacuuaauaaaaacauuauaaauguaauuucuguugaaagacuucagaa

SEQ ID NO: 359654 - RNA, 64 nt, Homo Sapiens
aggcuaaauguugcuuguaggcuacauuaaacucaaauguaauaguuuaucuuauacuccuggu

SEQ ID NO: 359655 - RNA, 64 nt, Homo Sapiens
gguaaauuucuuauuaaaucaaucuugaaauagaaaauguaauaacuuucuuaccauuaacauu

SEQ ID NO: 359656 - RNA, 64 nt, Homo Sapiens
uauauaauguacauaaauguuacauuuguaaagaaaauguaaaaauguaacuauagcauaugaa

SEQ ID NO: 359657 - RNA, 64 nt, Homo Sapiens
guacauaaauguuacauuuguaaagaaaauguaaaaauguaacuauagcauaugaauugcuuaa

SEQ ID NO: 359658 - RNA, 64 nt, Homo Sapiens
ggauauaaauaugguguccugcuuuuuuuguagaaaauguaauuugaggaugaauuuucugcuu

SEQ ID NO: 359659 - RNA, 64 nt, Homo Sapiens
uugcccugaaaaaauuucuugcauaugaauuguaaaauguaaauacauuuuuauaaccaauguu

SEQ ID NO: 359660 - RNA, 64 nt, Homo Sapiens
ugugcuccucucauuuuuauuggguagcccaucaaaauguaagcuguaucuucugcagacacug

SEQ ID NO: 359661 - RNA, 64 nt, Homo Sapiens
augaggugaaacaauuauugaaucaagaauauucaaauguaauuaaaacugcuaaauuuuucuu

SEQ ID NO: 359662 - RNA, 64 nt, Homo Sapiens
uauuaaagccuuauauauaaguuuauguagaaacaaauguaauaggcacauauauuuauagucu

SEQ ID NO: 359663 - RNA, 64 nt, Homo Sapiens
gguucagacgggguuucugguggggucuguucugaaauguaaagugcucugguggaggugggca

SEQ ID NO: 359664 - RNA, 64 nt, Homo Sapiens
auugaaacaagauugcuucaauaugcaaacauaaaaauguaaaucauaaucuauucaucuauuu

SEQ ID NO: 359665 - RNA, 64 nt, Homo Sapiens
ucuaaauacuccaggugugucacaaaaaaagaugaaauguaauuuuauaugagcuauguacugc

SEQ ID NO: 359666 - RNA, 64 nt, Homo Sapiens
gccaaacccacucuguuggucaguagagcuaaauaaauguaauacuccgcccuuguaagguguu

SEQ ID NO: 359667 - RNA, 64 nt, Homo Sapiens
gcacaugagaaugcuagcaggguuuuuuaaaaggaaauguaaaauccaaaauaaagcauaaaaa

SEQ ID NO: 359668 - RNA, 64 nt, Homo Sapiens
gaaaauaagcaaagaccacacauuuuuuacuacaaaauguaaaggauaaauguaaauccugcau

SEQ ID NO: 359669 - RNA, 64 nt, Homo Sapiens
gaccacacauuuuuuacuacaaaauguaaaggauaaauguaaauccugcauaacuaaaaucaca

SEQ ID NO: 359670 - RNA, 64 nt, Homo Sapiens
aaaagaaauacuuucugacagucaccugagccuuaaauguaaguauuacaugacaugcauucug

SEQ ID NO: 359671 - RNA, 64 nt, Homo Sapiens
guauuggucuggucaguauugccuggcugacgugaaauguaaacuaguaggcguguuauugauc

SEQ ID NO: 359672 - RNA, 64 nt, Homo Sapiens
guugguuuauuguucuauaaaaaagcccaggucuaaauguaaugaaauggaaugcaaguuuuuc

SEQ ID NO: 359673 - RNA, 64 nt, Homo Sapiens
acuguguucacaaccguaguguccuguuugcaucaaauguaaaguaagugauuauaauuaagcu

SEQ ID NO: 359674 - RNA, 64 nt, Homo Sapiens
uacugcuauauuaauguuuuaaccauaacugagcaaauguaaauacucuggacuuuauuuugcu

SEQ ID NO: 359675 - RNA, 64 nt, Homo Sapiens
ucuaagguuuaacaccaaaaagaaucuuguuuuaaaauguaauuguuuguguguguuuuuaaug

SEQ ID NO: 359676 - RNA, 64 nt, Homo Sapiens
uguucauagaaaaggaacauaaaucuaauguuucaaauguaaauuccuucccucaucagugaaa

SEQ ID NO: 359677 - RNA, 64 nt, Homo Sapiens
aacagaaacacauaguauuugcacuuuguacuuuaaauguaaauucacuuuguagaaaugagcu

SEQ ID NO: 359678 - RNA, 64 nt, Homo Sapiens
cagucacagugccugggaggggcccauccuuccaaaauguaaauccagucgcggugugaccgag

SEQ ID NO: 359679 - RNA, 64 nt, Homo Sapiens
auuuggaugaaguuuuucuuuaaaugucuuuuuaaaauguaaauuuaauaaguagccuauuuuu

SEQ ID NO: 359680 - RNA, 64 nt, Homo Sapiens
ggccucuacagaguuuuauguuacagaauuuacgaaauguaaaucaugauacaguaagguguaa

SEQ ID NO: 359681 - RNA, 64 nt, Homo Sapiens
uaagacaccaacagaaaugaacuauacaauuaugaaauguaauguguuaccucuauuuuuuguu

SEQ ID NO: 359682 - RNA, 64 nt, Homo Sapiens
auauuaaugcaguauugcaacuacagauuuugaaaaauguaauagggguuccagauaauauuuu

SEQ ID NO: 359683 - RNA, 64 nt, Homo Sapiens
uuuuuagugacaaagaagaauuauucucaaaauuaaauguaauuugucuuagaagaacuuaucu

SEQ ID NO: 359684 - RNA, 64 nt, Homo Sapiens
augaggcagagaauaaagugcccccgaaaaauugaaauguaaagacuauauuugaacgacauuc

SEQ ID NO: 359685 - RNA, 64 nt, Homo Sapiens
auguaagaguauuuauacuggaaagaaacccuacaaauguaaaaaacguggcaaugccuuuaac

SEQ ID NO: 359686 - RNA, 64 nt, Homo Sapiens
acaccagaaaauuuauauuggagaaaagcacuguaaauguaaugcauuugugaaaacauuuuuu

SEQ ID NO: 359687 - RNA, 64 nt, Homo Sapiens
uuaugacacuuucuaugaaagaauaaggacauuaaaauguaagaugcaugaugaaaaccugagu

SEQ ID NO: 359688 - RNA, 64 nt, Homo Sapiens
gggggacuagagcuccuucuggccauguuauaugaaauguaauucuuauuuuauaaauaaugug

SEQ ID NO: 359689 - RNA, 64 nt, Homo Sapiens
aaauguaauucuuauuuuauaaauaaugugauguaaauguaacuggugcccccuccccgaugug

SEQ ID NO: 359690 - RNA, 64 nt, Homo Sapiens
cuacaaaaacagaauaauuuugaaguuuuagaauaaauguaauauauuuacuauaauucuaaau

SEQ ID NO: 359691 - RNA, 64 nt, Homo Sapiens
aguuucuaaugugguauuuuaaauaaaguaucauaaauguaauaaguaaauauuuauuuaggaa

SEQ ID NO: 359692 - RNA, 64 nt, Homo Sapiens
uaaucaaauaacuagacauauaucagaaacuuuaaaauguaaaaguuguacacuuucaacauuu

SEQ ID NO: 359693 - RNA, 64 nt, Homo Sapiens
gugugcuccucuuuuggauuuacagaaaugugucaaauguaaaucuuucaaagccauuuaaaaa

SEQ ID NO: 359694 - RNA, 64 nt, Homo Sapiens
acaucagagaauccauacuagagagaagcccuacaaauguaaagaaugugaaaagucuuucagu

SEQ ID NO: 359695 - RNA, 64 nt, Homo Sapiens
uuaguaucaaauucacgccaugcaaaaagauuauaaauguaauaagcauguaugugugugagga

SEQ ID NO: 359696 - RNA, 64 nt, Homo Sapiens
gcagggauaucagugggcaugaucauaugugggaaaauguaaaaacuuagaagguaggagauca

SEQ ID NO: 359697 - RNA, 64 nt, Homo Sapiens
gauuauguggaauuguaguggagcuucuuuuuccaaauguaaugagaggcccugugucuaccag

SEQ ID NO: 359698 - RNA, 64 nt, Homo Sapiens
aaaauauucauauauuaucaaaauucuguuuuguaaauguaagaaagcauaguuauuuuacaaa

SEQ ID NO: 359699 - RNA, 64 nt, Homo Sapiens
uugggugccauuaaauagggaaaaaacauguaaaaaauguaaaauggagaccaauugcacuagg

SEQ ID NO: 359700 - RNA, 64 nt, Homo Sapiens
uugggcauuuuucucucuguucccucucuuuugaaaauguaaaauaaaaccaaaaauagacaac

SEQ ID NO: 359701 - RNA, 64 nt, Homo Sapiens
cuuugaacuuccaaguaugucuagucaccuuuuaaaauguaaacauuuucagaaaaaugaggau

SEQ ID NO: 359702 - RNA, 64 nt, Homo Sapiens
ccuauauaguaucccugugaccaaugagcauaauaaauguaaaaguuguuucugguuuuguuug

SEQ ID NO: 359703 - RNA, 64 nt, Homo Sapiens
auuaagcuaaaaugcaaaugugaaaagaaguaauaaauguaacugcuagaacacacauuuuuaa

SEQ ID NO: 359704 - RNA, 64 nt, Homo Sapiens
acuaauguacugcugccuucugcauacguuaaauaaauguaaauuuaauaaugaguguguaaac

SEQ ID NO: 359705 - RNA, 64 nt, Homo Sapiens
guaaguaauuaagcauaugacaucuuagaggaaaaaauguaaagaucuuguuuauuguugaugc

SEQ ID NO: 359706 - RNA, 64 nt, Homo Sapiens
uaaauacacucaccuaaauugaaagcuaagaaggaaauguaaauauaauauauauuuauauuug

SEQ ID NO: 359707 - RNA, 64 nt, Homo Sapiens
gcaaaaaacaaaaaguacacagaaauauuuauuaaaauguaauacaguuuauugaacuuucuag

SEQ ID NO: 359708 - RNA, 64 nt, Homo Sapiens
uggaauuaaauauuagccuuucuagggucaggggaaauguaaucuuaacuuuaaaaauguauau

SEQ ID NO: 359709 - RNA, 64 nt, Homo Sapiens
aacacuguuaagacuuaaaaauguucauuguagaaaauguaauauuaaauuacaaaagugauag

SEQ ID NO: 359710 - RNA, 64 nt, Homo Sapiens
gaaaaaaagagguagcuuuuagauugcaaacuggaaauguaaaacucaugaaauuuaagcaaua

SEQ ID NO: 359711 - RNA, 64 nt, Homo Sapiens
caguuauauuacuuuugaggcuggugaaaaauuuaaauguaacuuugugggaacacugauucau

SEQ ID NO: 359712 - RNA, 64 nt, Homo Sapiens
uguaacuuugugggaacacugauucauauuuagaaaauguaaaugucuguagcacuuucuugca

SEQ ID NO: 359713 - RNA, 64 nt, Homo Sapiens
auuccauuuauucuguuuagaagaaaauguuuuaaaauguaagagaauuguuauccuuuauauu

SEQ ID NO: 359714 - RNA, 64 nt, Homo Sapiens
uaugauuugaauuguuauccauaugaagacguagaaauguaaaauguaaaauaauuuuagugca

SEQ ID NO: 359715 - RNA, 64 nt, Homo Sapiens
agaacaucuauacauauggugaucuaaauguacaaaauguaaaauguauaagucaucucacuuu

SEQ ID NO: 359716 - RNA, 64 nt, Homo Sapiens
guauaaaaaguuuauuuugcuauugugaaaaacuaaauguaaaggaaaucaccuacuuucaugc

SEQ ID NO: 359717 - RNA, 64 nt, Homo Sapiens
acuugggauuguuuuguggguuuuuguuuguuuuaaauguaaauugagaaucuuuuauaagaaa

SEQ ID NO: 359718 - RNA, 64 nt, Homo Sapiens
cuugauaauuuguuguugagagcuguucauucuaaaauguaaugaaauucagucuaguucugcu

SEQ ID NO: 359719 - RNA, 64 nt, Homo Sapiens
uucuuuugcaagacaccuguuuaucaucuuguuuaaauguaaauguccccuuaugcuuuugaaa

SEQ ID NO: 359720 - RNA, 64 nt, Homo Sapiens
cuuugaaauguauaaaaaguucauuuacaguucuaaauguaauguuuuuaagccuucuaucuuu

SEQ ID NO: 359721 - RNA, 64 nt, Homo Sapiens
uuguggcaaaggaaacuauacuuuucauuuuuaaaaauguaaauagaaaaguuuuuaacgguuu

SEQ ID NO: 359722 - RNA, 64 nt, Homo Sapiens
aucauaagucuaaauaaaugaaaauguaaaacaaaaauguaauguuaaaccucucuucuaccuu

SEQ ID NO: 359723 - RNA, 64 nt, Homo Sapiens
caaaaauguaaugaucauaaucucuucuaccuuaaaauguaaaauaaaauugcacuuuuaaacc

SEQ ID NO: 359724 - RNA, 64 nt, Homo Sapiens
uugguuuuauuuuuggcuuaauccaucugucaggaaauguaacuguuccuucuauuguuuucuu

SEQ ID NO: 359725 - RNA, 64 nt, Homo Sapiens
accccugaucccaggacauaaccugaucaauguuaaauguaagcaggcacagccucuccucuuu

SEQ ID NO: 359726 - RNA, 64 nt, Homo Sapiens
uauguauaccugccaagauaacccaaaucucucaaaauguaaauuguaauauuguguauacaaa

SEQ ID NO: 359727 - RNA, 64 nt, Homo Sapiens
auggugguuuggccauuaauccccauauuuuagaaaauguaaaacagguggccugcugaggcug

SEQ ID NO: 359728 - RNA, 64 nt, Homo Sapiens
aaaaaaauuugguucucaagugaacaaacauauaaaauguaaacaaucccuacaauccagauaa

SEQ ID NO: 359729 - RNA, 64 nt, Homo Sapiens
auguugauaggugaccacuguugguauuuacauuaaauguaaagaaauguguacugaucucauu

SEQ ID NO: 359730 - RNA, 64 nt, Homo Sapiens
uuaaagaaauauucaaaagauaaagagaauauuuaaauguaauacauugugauaaugcuguauu

SEQ ID NO: 359731 - RNA, 64 nt, Homo Sapiens
ugccuuccuucaaucccauauccaggauuuacaaaaauguaacccucugcuucuguacaaaauc

SEQ ID NO: 359732 - RNA, 64 nt, Homo Sapiens
ugcucaugaagguuuugaauaaacuaagagcagaaaauguaaaaaaaucuucucauuuuauuga

SEQ ID NO: 359733 - RNA, 64 nt, Homo Sapiens
ucaguuuggagcuuuuaggcaaguuuucauuucaaaauguaauuaaaaauauuuuacugcagcc

SEQ ID NO: 359734 - RNA, 64 nt, Homo Sapiens
acuguguuugugcuguaagaguacaaagaacuugaaauguaaaucaaaauggcauacaucuuuu

SEQ ID NO: 359735 - RNA, 64 nt, Homo Sapiens
accauguuuagcuugcagcuaaacaacccucuaaaaauguaaaauguuuaguuuguuuuuuuuc

SEQ ID NO: 359736 - RNA, 64 nt, Homo Sapiens
gcuguacauuucugggaaguucagaaccuuuuuuaaauguaaaaagcaugcuuguauguauauu

SEQ ID NO: 359737 - RNA, 64 nt, Homo Sapiens
auugauaugauuuuguaaaauaacaaaaaaggaaaaauguaauagacuuccauguccugguuau

SEQ ID NO: 359738 - RNA, 64 nt, Homo Sapiens
uuuuccagugugccaacuccaaagucaacauuaaaaauguaaauggaccuguguaaauaucaca

SEQ ID NO: 359739 - RNA, 64 nt, Homo Sapiens
guccuuuaauaaguaaagaaaauaauauguuuaaaaauguaaauguuuuacaaauuugaaacuu

SEQ ID NO: 359740 - RNA, 64 nt, Homo Sapiens
auguuauuuuauucauuguuggucagcguuguuuaaauguaaucaaauguaaaugguuucaaau

SEQ ID NO: 359741 - RNA, 64 nt, Homo Sapiens
gguuucaaauggucagcguucccuuacaaacauuaaauguaaauucuguacuaagugucaacag

SEQ ID NO: 359742 - RNA, 64 nt, Homo Sapiens
auuacaugacuauuggugaguuaaucaguuucugaaauguaagcauuccuaucuuauuguucgu

SEQ ID NO: 359743 - RNA, 64 nt, Homo Sapiens
auuccuuauuuaagacauguaucagaagguuucgaaauguaaauaaccagaucaaauuaauaca

SEQ ID NO: 359744 - RNA, 64 nt, Homo Sapiens
auaaaacccugucgaugguuuuaagguuaaggccaaauguaacaaauguaaacaaauuuguuuu

SEQ ID NO: 359745 - RNA, 64 nt, Homo Sapiens
aaauuuguuuuuuaagguuacccauuuaaauaugaaauguaaacuuacucaggguuuaaaaugu

SEQ ID NO: 359746 - RNA, 64 nt, Homo Sapiens
uguagucaauguuccaccagaggagcggacagugaaauguaauaucccucucuagagcagguau

SEQ ID NO: 359747 - RNA, 64 nt, Homo Sapiens
gugucaaacuuaaggagauucaagaccuggcagaaaauguaagaggauuuuugcugcuuuuggg

SEQ ID NO: 359748 - RNA, 64 nt, Homo Sapiens
gauuuaauggaauuguaauuuuaaacauuuaauuaaauguaauuugggggauauuuugaacuuu

SEQ ID NO: 359749 - RNA, 64 nt, Homo Sapiens
uugggggauauuuugaacuuuaauauuagugaucaaauguaaauguuuugaggauauuuuucuu

SEQ ID NO: 359750 - RNA, 64 nt, Homo Sapiens
uauauauauuuguacugauguuggccuuacaaucaaauguaagucucauuuuuacuuuugaacg

SEQ ID NO: 359751 - RNA, 64 nt, Homo Sapiens
cacaacaggaagcaaagcaaaagcacauuuacugaaauguaaaaugaacaagaaucuauauucc

SEQ ID NO: 359752 - RNA, 64 nt, Homo Sapiens
gauuuuugaccuuauauaugcuuugagaaaacagaaauguaaaggggguugggggaagauauua

SEQ ID NO: 359753 - RNA, 64 nt, Homo Sapiens
aguaaucuucugucccuuuaagcaagagacugcaaaauguaaacucaugaaauugucuuaaaaa

SEQ ID NO: 359754 - RNA, 64 nt, Homo Sapiens
gauuauuucaagcuagucauugagguauaugacaaaauguaaauaacaaaaaacugaaaucuac

SEQ ID NO: 359755 - RNA, 64 nt, Homo Sapiens
gggagcucauggugccgcuggggacuuuuuagagaaauguaaagagaauagcuauucagugucu

SEQ ID NO: 359756 - RNA, 50 nt, Homo Sapiens
auacuagagaaaaacuuuaaaaauguaaaacauggagcagauuuuuuacu

SEQ ID NO: 359757 - RNA, 64 nt, Homo Sapiens
uuaauaucagcauuuuucauggaaguuuaaugccaaauguaaaacacaugaaaauuuuuaaaaa

SEQ ID NO: 359758 - RNA, 64 nt, Homo Sapiens
aauucauuuuaguuauaauaaauuuaauauuuguaaauguaacauaguuucagugugauuucua

SEQ ID NO: 359759 - RNA, 64 nt, Homo Sapiens
cucugccucggccauucaaaagucuaauaacaaaaaauguaaaccuaauuuggcaguuuguuag

SEQ ID NO: 359760 - RNA, 64 nt, Homo Sapiens
aacuaaaauuagaaauguccccucacugcagaucaaauguaaagcuuccaguuaaggagcuaaa

SEQ ID NO: 359761 - RNA, 64 nt, Homo Sapiens
aaagagauguuaagcaagugguuguuuuagauccaaauguaaaggcagguuugggaagguguuu

SEQ ID NO: 359762 - RNA, 64 nt, Homo Sapiens
auaaaguuuaucagauauuuucauauuuaaagccaaauguaaauagaggucuguaaagaaaaau

SEQ ID NO: 359763 - RNA, 64 nt, Homo Sapiens
uuauguaauuaugugaacuuugguauaaaacuguaaauguaauaaaauguaaaugcugccuuua

SEQ ID NO: 359764 - RNA, 64 nt, Homo Sapiens
gcugccuuuaugguauaaaacuguaaaaacagaaaaauguaaauagagauaagggaaggggaga

SEQ ID NO: 359765 - RNA, 64 nt, Homo Sapiens
cauuuaucauuuuuuaggucuucauuaaauuuuaaaauguaauaucuguuucccacccccuaca

SEQ ID NO: 359766 - RNA, 64 nt, Homo Sapiens
cuuaucuugauuucuuucauuagaaacuaucccuaaauguaaagaucuuuugccuucaaauuug

SEQ ID NO: 359767 - RNA, 64 nt, Homo Sapiens
aacauucagauuuaauuacuguaaguaaaauuuaaaauguaaauacaucaguucauguucugua

SEQ ID NO: 359768 - RNA, 64 nt, Homo Sapiens
aacucaugguguggcuaaucuacauuuaucaauaaaauguaaauuaucugaaaggacagaauau

SEQ ID NO: 359769 - RNA, 64 nt, Homo Sapiens
auaaggguaauggucugucagcaguguugaaggcaaauguaaacggaaaaauuuguagcggaug

SEQ ID NO: 359770 - RNA, 64 nt, Homo Sapiens
aucuucacucaccauuaugagaaaauccacugggaaauguaaaauuuuucccuauugacuguca

SEQ ID NO: 359771 - RNA, 64 nt, Homo Sapiens
aaggcuuucuggggaucacagaaaauagacgagaaaauguaaauaacaguuggaggaauccaug

SEQ ID NO: 359772 - RNA, 64 nt, Homo Sapiens
aaucagcucacaggcaucaaagagauguggggagaaauguaaacccuacaugcugucauugaac

SEQ ID NO: 359773 - RNA, 64 nt, Homo Sapiens
acacauaagaauacacucuggagaaagaccuuauaaauguaagacaugugggaaaggcuuuuau

SEQ ID NO: 359774 - RNA, 64 nt, Homo Sapiens
acacguaagaaugcacucuguagaaagaccuuauaaauguaagauaugugggaaaggcuuuuau

SEQ ID NO: 359775 - RNA, 64 nt, Homo Sapiens
ucacacaugaauguguaguggagagaaccuugguaaauguaaagagugugggagagccuuuagu

SEQ ID NO: 359776 - RNA, 64 nt, Homo Sapiens
ucauuugaaaacuucuaauacagcaaaauccuauaaauguaaguacuucaaaaagccucaugca

SEQ ID NO: 359777 - RNA, 64 nt, Homo Sapiens
aacaacugauaccagccgcugcaaaaucaugccaaaauguaaagaccaucgagacuaggaagaa

SEQ ID NO: 359778 - RNA, 64 nt, Homo Sapiens
cagcaucaaauucucacauaacaauauuagcuuuaaauguaaaugggcuaaaugcuccaauuaa

SEQ ID NO: 359779 - RNA, 64 nt, Homo Sapiens
ugaccacauaguuggaaguaaagcacuccucagcaaauguaaaggaacaaaaauuauaacaaac

SEQ ID NO: 359780 - RNA, 64 nt, Homo Sapiens
ggaugcaaggcugguucaacauacgcaaaucaauaaauguaauccagcauauaaacagaaccaa

SEQ ID NO: 359781 - RNA, 64 nt, Homo Sapiens
aucgaaaguuuuucaauuuuugaauagaaacuauaaauguaaaucaugugaagaaagugcacgc

SEQ ID NO: 359782 - RNA, 64 nt, Homo Sapiens
auuguggcaacgccuucauugagagaaaccuuauaaauguaagggcacaugagaaugcacacug

SEQ ID NO: 359783 - RNA, 64 nt, Homo Sapiens
aaugugggaaagccuuuuaugagagaaacccuacaaauguaaggacaugaaaggacucauacug

SEQ ID NO: 359784 - RNA, 64 nt, Homo Sapiens
aaugugggaaacccuucauugagagaaacccuacaaauguaaggacaugaaaaggcucauacug

SEQ ID NO: 359785 - RNA, 64 nt, Homo Sapiens
ccugugggaaagccuucagucagggauagucuacaaauguaaggacauaaaagaacacacagug

SEQ ID NO: 359786 - RNA, 64 nt, Homo Sapiens
aaugugggaaacccuucagugagagaagccauauaaauguaagaguauaagugucaggaauaug

SEQ ID NO: 359787 - RNA, 64 nt, Homo Sapiens
gugggaaagccuuuagugaugggagaaaaucuauaaauguaaauacaugaaaggacucacacua

SEQ ID NO: 359788 - RNA, 64 nt, Homo Sapiens
uaugugggaaaggcuuugaugagauggaccucauaaauguaagaacacaugauaaggcacacua

SEQ ID NO: 359789 - RNA, 64 nt, Homo Sapiens
ugugugggaaagcauuuuucgagauggaccuuauaaauguaaguacacauggcagugcagcaug

SEQ ID NO: 359790 - RNA, 64 nt, Homo Sapiens
ugcgauaugguagagcgcuugaaagucacaggauaaauguaagaagaucagggaagaucaauac

SEQ ID NO: 359791 - RNA, 64 nt, Homo Sapiens
ugcaugaugaaaaucuaagugaguaaggacauuaaaauguaacauuaugaccuuuucuuuggaa

SEQ ID NO: 359792 - RNA, 64 nt, Homo Sapiens
aauuugaaaaaaaaguuuucgagaaaaacccugcaaauguaauaacaucagggaauucagauug

SEQ ID NO: 359793 - RNA, 64 nt, Homo Sapiens
aauguggcaaagcauuuaacgagagaaacccuacaaauguaaagacaaaagauaauucauacua

SEQ ID NO: 359794 - RNA, 64 nt, Homo Sapiens
ccacaauuaguguauuaagucauacaaaauuuuuaaauguaauuaauuuuuacaaaauuuagug

SEQ ID NO: 359795 - RNA, 64 nt, Homo Sapiens
uuaaauuguuauugauuacauuuuaguuauuuuaaaauguaaaacaagcaacccaguuuuauac

SEQ ID NO: 359796 - RNA, 64 nt, Homo Sapiens
ugcaugcuuaagcuuuuaccugaugaaaccauacaaauguaacgcuaggcaucaaaaacuuuuu

SEQ ID NO: 359797 - RNA, 64 nt, Homo Sapiens
aauguggcaaggucuucugggugagaaaccuaacaaauguaaugucuucaaagaauucuugcug

SEQ ID NO: 359798 - RNA, 64 nt, Homo Sapiens
auuuuaucgcuucuguuuucacaaauauauuuuaaaauguaaauauaaccccccaaaaaaucac

SEQ ID NO: 359799 - RNA, 64 nt, Homo Sapiens
gcucuuuuauaaccccccaaagaaugcaauuuuaaaauguaaagauuuaaugcauagccucuuc

SEQ ID NO: 359800 - RNA, 64 nt, Homo Sapiens
uauguaauaugcugagguggcgaccucaguggagaaauguaaagacugaauugaauuuuaagcu

SEQ ID NO: 359801 - RNA, 64 nt, Homo Sapiens
guauuuaaaauaugcuuccacauuucaaaauauaaaauguaacaugacaagagauuuugcguuu

SEQ ID NO: 359802 - RNA, 64 nt, Homo Sapiens
uaauuauaagcgauuccccuuuuaugcauauuaaaaauguaaugauaaaggaugucagagaaac

SEQ ID NO: 359803 - RNA, 64 nt, Homo Sapiens
aaaaaaaacuggcugaauggcuuugguauuaauaaaauguaaaauaagcacaggccauuuuuca

SEQ ID NO: 359804 - RNA, 64 nt, Homo Sapiens
aaaaguauaaguaacaugcuuuguugcagccaaaaaauguaaucugcuuuuuuaugacagaauu

SEQ ID NO: 359805 - RNA, 64 nt, Homo Sapiens
cgcccaggugucagcucuccguuuaaagaaugaaaaauguaacucaugaugaucugugaaaccu

SEQ ID NO: 359806 - RNA, 64 nt, Homo Sapiens
uugucuuuucacucuaucucaaaaaaaguguugcaaauguaaaacauugccaucuucucacaaa

SEQ ID NO: 359807 - RNA, 64 nt, Homo Sapiens
cuaaaugucacaaaaaauuauacuuccuuaaaguaaauguaaugauuucuucuuuuccuauuga

SEQ ID NO: 359808 - RNA, 64 nt, Homo Sapiens
uaacaacaagaauaucaggaaggaacuuuucaagaaauguaauuauaaaucuacaucaaacaga

SEQ ID NO: 359809 - RNA, 64 nt, Homo Sapiens
uagacuaaacaaaucacaaauuguucaguucuuaaaauguaauuaugucacacacacaaaaaau

SEQ ID NO: 359810 - RNA, 64 nt, Homo Sapiens
auuuccccuaaucuuuucugaaucuucugaaaccaaauguaacuauguuuuaucguccagugac

SEQ ID NO: 359811 - RNA, 64 nt, Homo Sapiens
uuuuugaaaucaguaaacacuguguauuguuguaaaauguaaaggucacuuuucacauccuuga

SEQ ID NO: 359812 - RNA, 64 nt, Homo Sapiens
gagauauucugcagcugauagagcagcauuuuaaaaauguaacagguggaaaauuacacugugc

SEQ ID NO: 359813 - RNA, 64 nt, Homo Sapiens
ugugauuggcuaaacaaucucgcauuaaaaauucaaauguaaauugaauucacaugaaaaauca

SEQ ID NO: 359814 - RNA, 64 nt, Homo Sapiens
auuuugacaaggcccaaaguccccaaaaguccaaaaauguaauaaugcauuuauucacaagcaa

SEQ ID NO: 359815 - RNA, 64 nt, Homo Sapiens
uuagcuucuaaaugaaauaaacugcauagaaaucaaauguaagucaagugacacaaaaaugauu

SEQ ID NO: 359816 - RNA, 64 nt, Homo Sapiens
aaggccaaaggccucuguauuuaaacacuaauuuaaauguaauaguuuaaauagauauucuaua

SEQ ID NO: 359817 - RNA, 64 nt, Homo Sapiens
cuauuuuguagaggcucaguauucauuuguuuaaaaauguaaaguguaagugaaaaaaaaucac

SEQ ID NO: 359818 - RNA, 64 nt, Homo Sapiens
uaacaaccugaauugagucauuugagugguacuuaaauguaaagacuugcuuuuauguccacuu

SEQ ID NO: 359819 - RNA, 64 nt, Homo Sapiens; identical to SEQ ID NO: 359808

SEQ ID NO: 359820 - RNA, 64 nt, Homo Sapiens
uagacuaaacaaaucacaaauuguucaguucuuaaaauguaauuaugucacacacacaaaaaaa

SEQ ID NO: 359821 - RNA, 64 nt, Homo Sapiens
uaugccuguacuaaggagcacauucaggcagcacugacaauaguaccucaugagucuaccugag

SEQ ID NO: 359822 - RNA, 64 nt, Homo Sapiens
gcugccuuacccgccauacaccaggugcaggugcugacaauacugcaguuccaucagguccccc

SEQ ID NO: 359823 - RNA, 64 nt, Homo Sapiens
guaacaucaagugaucagaacuaaguuacugggaugacaauaauugcuauuugaaauauaugcu

SEQ ID NO: 359824 - RNA, 64 nt, Homo Sapiens
aauauauaugcuaaaguauaaagaguaauaauaaugacaauaaacaaaccccugugugccuacc

SEQ ID NO: 359825 - RNA, 64 nt, Homo Sapiens
ucacauacucuucaagaucauuucuuuacacccuugacaauauaguauacaaaccagggagagu

SEQ ID NO: 359826 - RNA, 64 nt, Homo Sapiens
gaaauaagguguuauuucugagucucgugaacagugacaauacaccaacaguuccaagccagau

SEQ ID NO: 359827 - RNA, 64 nt, Homo Sapiens
acgccuauaaagauugugcaguaagaauuuuuauugacaauaauuaaaauuuuuuuugacaauu

SEQ ID NO: 359828 - RNA, 64 nt, Homo Sapiens
aaggaauguuuccuuuauaaaucacagaagaaaaugacaauaucuguuggauauuugauauaau

SEQ ID NO: 359829 - RNA, 64 nt, Homo Sapiens
uaugugagaauuuucuccuaagucaugcagguaaugacaauauacuguaaauaccacaugugag

SEQ ID NO: 359830 - RNA, 64 nt, Homo Sapiens
guaaucaggcaaaugaguucaacuggauuucuuuugacaauacuguugguaccuauuacuuggg

SEQ ID NO: 359831 - RNA, 64 nt, Homo Sapiens
aauaaauguuugguuucuugugugcuguacagagugacaauagauucguaugugugaauaucug

SEQ ID NO: 359832 - RNA, 64 nt, Homo Sapiens
gggccacggggaggccccccuuuauuuauagaaaugacaauagaagaagagggggaggggaagc

SEQ ID NO: 359833 - RNA, 64 nt, Homo Sapiens
aggagagaaaaaagaaauugguuaugaauaaaagugacaauaaaacaugagauauaaaucaagc

SEQ ID NO: 359834 - RNA, 64 nt, Homo Sapiens
agaguguguguguguguguguguguguaacacuuugacaauacuaaacucucauaagcauuuaa

SEQ ID NO: 359835 - RNA, 64 nt, Homo Sapiens
uaacacuuuuguuagcucuuugaccauaaaauaaugacaauaagcuguuucuauguauuuguuu

SEQ ID NO: 359836 - RNA, 64 nt, Homo Sapiens
uuuaauuuuaaacugaacaauaaucaucuuuuccugacaauaaauaucaaucucuaucaucauc

SEQ ID NO: 359837 - RNA, 64 nt, Homo Sapiens
agugaguguccuguucccagugcccgguuauuuaugauuaaauuacugaagugucuaaaaagaa

SEQ ID NO: 359838 - RNA, 64 nt, Homo Sapiens
ucauaccuaaggauguugugaggcgugagugagaugauuaaagcguuccagagagugcgcucuu

SEQ ID NO: 359839 - RNA, 64 nt, Homo Sapiens
uuuuaauaccaaaagaguucuuuugaaauggaacugauuaaaagggcagagggucuguugccag

SEQ ID NO: 359840 - RNA, 64 nt, Homo Sapiens
gggguugcggagaaaucaaguuuaaaauuccuucugauuaaaaaaauauaguggaauacaauug

SEQ ID NO: 359841 - RNA, 64 nt, Homo Sapiens
aaugucauuacuuucucuuuguuauuauaaugugugauuaaaugcuuuuuuaaauugcuaaggg

SEQ ID NO: 359842 - RNA, 64 nt, Homo Sapiens
uuuacuuuuucuucccuucuucccuauugaaccuugauuaaaauguaugaauacaauacuugga

SEQ ID NO: 359843 - RNA, 64 nt, Homo Sapiens
guauacuuuaguagacauuugugacacaacugugugauuaaaaguaauuuguguguuuuuagcu

SEQ ID NO: 359844 - RNA, 64 nt, Homo Sapiens
aaccaccuauuuuugacauggcuaaaaaugagcuugauuaaauccaacuaacgcaaccaagugu

SEQ ID NO: 359845 - RNA, 64 nt, Homo Sapiens
ucagcagugguauugagguuaguaccuucccagcugauuaaaguuggauugacccuccauuugc

SEQ ID NO: 359846 - RNA, 64 nt, Homo Sapiens
ucauguauguagaagaucuuucccacccugcccaugauuaaacagcuuuguuuuaugcuacucc

SEQ ID NO: 359847 - RNA, 50 nt, Homo Sapiens
ccgcucgucugugugggugaugauuaaagcauucucauugcacaguucug

SEQ ID NO: 359848 - RNA, 64 nt, Homo Sapiens
ugaauccauguuauuguauuguaaauaauuuagaugauuaaaauggauuguuuaaaaaguuuua

SEQ ID NO: 359849 - RNA, 64 nt, Homo Sapiens
uaaaaaguaaccguaaccuccaaaacuaucauguugauuaaaaaaaauuuuaguaauaaauucc

SEQ ID NO: 359850 - RNA, 64 nt, Homo Sapiens
aggggagcaagggaauuugacaggacaggaugauugauuaaaagauauuuagaaguaaaguuga

SEQ ID NO: 359851 - RNA, 64 nt, Homo Sapiens
ggaauaaagaaagagcagcugaaucaauacucauugauuaaaauaaaaauagaaaggaaaacuu

SEQ ID NO: 359852 - RNA, 64 nt, Homo Sapiens
auagucaagaaauucugcaagacuuuuucccagcugauuaaaaguucauuugcauacaguuauu

SEQ ID NO: 359853 - RNA, 64 nt, Homo Sapiens
aauguaauaaauuuauugccuuuacaguguagaaugauuaaaucaugugauguuuugauauaug

SEQ ID NO: 359854 - RNA, 64 nt, Homo Sapiens
ccuucaacacuucucauucaacacgucaacucgaugauuaaaaugcuucaaguauuuguucaug

SEQ ID NO: 359855 - RNA, 64 nt, Homo Sapiens
caauaguccagguacuuaagacaauuacaauacaugauuaaaugaugcaaaaagguagaguaac

SEQ ID NO: 359856 - RNA, 64 nt, Homo Sapiens
acuuccauuucuaaaaguucuuacauaucaaaauugauuaaaacagccuacagucuauuuauga

SEQ ID NO: 359857 - RNA, 64 nt, Homo Sapiens
uacuuuccuuauuggcaacuuauggacucgcuagugauuaaacgaggcaaugacugugagcgag

SEQ ID NO: 359858 - RNA, 64 nt, Homo Sapiens
auuggccuuaauauaccuaaaucuccaaaaacagugauuaaagcaagagaauuauuacaagggc

SEQ ID NO: 359859 - RNA, 64 nt, Homo Sapiens
guggugacccacugaaaauuaauaaugguacuuaugauuaaaaacgcauuuaauacuaacugca

SEQ ID NO: 359860 - RNA, 64 nt, Homo Sapiens
uucuuggguucaaccuuugaaucaauuuuaccacugauuaaauaaaugacucaaagacaucugu

SEQ ID NO: 359861 - RNA, 64 nt, Homo Sapiens
uggggaguuacuuacauguucaucugcugucuugugauuaaaaucaucucuguagugaccacgu

SEQ ID NO: 359862 - RNA, 64 nt, Homo Sapiens
caugcaauggugucuguguaauuauuuugcucuuugauuaaaaaaaagacccccagcaauaaaa

SEQ ID NO: 359863 - RNA, 64 nt, Homo Sapiens
uuuauaguuuaucagaaaaguuagauccaagugcugauuaaauuaguauuacaaagauauguca

SEQ ID NO: 359864 - RNA, 64 nt, Homo Sapiens
aguaaguaaaaggcuaccuaacaaagauaagcuuugauuaaaguucacuuuuuacacauugggc

SEQ ID NO: 359865 - RNA, 64 nt, Homo Sapiens
guggcagcuucccaaguauucgauuucauucaugugauuaaaacaaguugccauauuucaaagc

SEQ ID NO: 359866 - RNA, 64 nt, Homo Sapiens
uguuugguuuguuuuaaauucugugaaaguggcuugauuaaaagacuccuuuuaaauggaagcc

SEQ ID NO: 359867 - RNA, 64 nt, Homo Sapiens
uucagacuaaauauaggacagaaagaguaguuguugauuaaauuauuuucuuuugugauuauaa

SEQ ID NO: 359868 - RNA, 64 nt, Homo Sapiens
gauaaaaccccauaucuguugaaauggccagucgugauuaaaguuuggcugguuuucucucacu

SEQ ID NO: 359869 - RNA, 64 nt, Homo Sapiens
cagucaaauauccuuccuaaguuauuuaauugcuugauuaaacuuugguauuauugccauaguu

SEQ ID NO: 359870 - RNA, 64 nt, Homo Sapiens
uuacaaauuuguucaguucaauuccuaagacuccugauuaaauaaccuagguuauauauuagcc

SEQ ID NO: 359871 - RNA, 64 nt, Homo Sapiens
aaacaugaaagagauguucucauuuuucuuuuucugauuaaacgucugaugcauaucauuuuuc

SEQ ID NO: 359872 - RNA, 64 nt, Homo Sapiens
uaaauuaaauguuucuuauuucacuuaacucauuugauuaaacuguauucuaaaacauuugggg

SEQ ID NO: 359873 - RNA, 64 nt, Homo Sapiens
accuguuacaucucugccuucucuuaaaggcaguugauuaaagacaguuuuaaagggagccaug

SEQ ID NO: 359874 - RNA, 64 nt, Homo Sapiens
caaauaccugucuuagggaagcuugcacauggauugauuaaaagcccuuaaaaugucuaguaaa

SEQ ID NO: 359875 - RNA, 64 nt, Homo Sapiens
uaucucaagaaacaagaugauuguaacauguccaugauuaaacuauuggcagauuauugcugug

SEQ ID NO: 359876 - RNA, 64 nt, Homo Sapiens
uguuuaccagaguguguauuuuacauaauguucuugauuaaaaagacuuguuuguaaauuaucc

SEQ ID NO: 359877 - RNA, 64 nt, Homo Sapiens
ccaaguauuuuauuacuaccaauuuuacuggaacugauuaaaggguggggaagcuuucaaauau

SEQ ID NO: 359878 - RNA, 64 nt, Homo Sapiens
gugaguuccauuaauaaacaaauuuauuaaaaacugauuaaaaaugaggcuaaacuggauuagc

SEQ ID NO: 359879 - RNA, 64 nt, Homo Sapiens
gaauuuuuuuuuuccuuuuuugcuuugcuuuuuuugauuaaaaauuuuuuuccucuuucgaaug

SEQ ID NO: 359880 - RNA, 64 nt, Homo Sapiens
aauuuuuuuugaaaaaaacaauaaauauucuuccugauuaaaaaguuguggacaaaaagccaaa

SEQ ID NO: 359881 - RNA, 64 nt, Homo Sapiens
caacuuuccaauguaguaucguuuaacaccugugugauuaaagauuuagguaaauuuauauuga

SEQ ID NO: 359882 - RNA, 64 nt, Homo Sapiens
aauaucuucaggaauauuuuacagagauuaguaaugauuaaauugacuacuucccuugcuaauc

SEQ ID NO: 359883 - RNA, 64 nt, Homo Sapiens
gcucaaaacagcagcgucgucauugaagucugcuugauuaaaccauaauaucuuuguaauaauu

SEQ ID NO: 359884 - RNA, 64 nt, Homo Sapiens
cgauacucaucuugcacggccagaacuguuugguugauuaaaauacaucagcucuuaaaaacuc

SEQ ID NO: 359885 - RNA, 64 nt, Homo Sapiens
auguuuauuugcugacugaauuaagauuuaagaaugauuaaaaauaagcuuuuacuuuuuaaaa

SEQ ID NO: 359886 - RNA, 64 nt, Homo Sapiens
uauagugaugaaauaacaaaauuaauaugccuaaugauuaaaauuuuuaaaaacuguaugugac

SEQ ID NO: 359887 - RNA, 64 nt, Homo Sapiens
caagguauuuuucgggccaguugcugaaugggaaugauuaaaaauacauagagcauuuucacua

SEQ ID NO: 359888 - RNA, 64 nt, Homo Sapiens
ucuuuagaaagcuauugcuuuuagaagcaacacuugauuaaacaccugaauugggcuuuuuaac

SEQ ID NO: 359889 - RNA, 64 nt, Homo Sapiens
gaaaaaaggcuccaguuuguaagacauauaagguugauuaaagguuuucaaaaaguuaaaaaaa

SEQ ID NO: 359890 - RNA, 64 nt, Homo Sapiens
gaauacaaaggguauacucuguuggaugcaccagaaacuggaaacugggaccaguggcagagau

SEQ ID NO: 359891 - RNA, 64 nt, Homo Sapiens
acccagaugcccaugagcaagagaguggacaaguaaacuggaauauucacauaauagaacauua

SEQ ID NO: 359892 - RNA, 64 nt, Homo Sapiens
ugugauguggauggggccccagauggaagguuugaaacuggauucucgauuuuuagcaaaaaag

SEQ ID NO: 359893 - RNA, 64 nt, Homo Sapiens
gaaacucgcaucgccaauagucucuauggaagucaaacuggagguccuguugucgcagagcauu

SEQ ID NO: 359894 - RNA, 64 nt, Homo Sapiens
agugccuauaacaagacagagaccucuggucagcaaacuggaacucaguaaacuggagaaauag

SEQ ID NO: 359895 - RNA, 64 nt, Homo Sapiens
acagagaccucuggucagcaaacuggaacucaguaaacuggagaaauaguaucgaugggagguu

SEQ ID NO: 359896 - RNA, 64 nt, Homo Sapiens
cagguggauacccgcuuccauggucuugcacuauaaacuggaauggauuucucaaugcgggacc

SEQ ID NO: 359897 - RNA, 64 nt, Homo Sapiens
aaagcuaauuuuuuuuacaugucaauauuggcacaaacuggaaugaaagaauaguuugauucag

SEQ ID NO: 359898 - RNA, 64 nt, Homo Sapiens
gcuccagggcgggaggcaagcccccuugccuuucaaacuggaaaccccagagaaaacggugccc

SEQ ID NO: 359899 - RNA, 64 nt, Homo Sapiens
uuguauaacucuaaacgcccaugauaguagcuucaaacuggaaauagcgaaauaaaauaacuca

SEQ ID NO: 359900 - RNA, 64 nt, Homo Sapiens
uuccuucauaaauauuuaucuuuuguuuguguuaaaacuggagaguguuuaaaaauuuccuuuu

SEQ ID NO: 359901 - RNA, 64 nt, Homo Sapiens
cuuuuaaauguggaaaggcuuuuaaaauauuuuaaaacuggaccuguauuauccugaauacacu

SEQ ID NO: 359902 - RNA, 64 nt, Homo Sapiens
cugauuuugagaauuuaaagcagauuaccuuuuaaaacuggaccaacuaaguaauugguauuua

SEQ ID NO: 359903 - RNA, 64 nt, Homo Sapiens
guggacaggauucgauuaaguauucccucuugucaaacuggaagcuaggggaaaaagagggauu

SEQ ID NO: 359904 - RNA, 64 nt, Homo Sapiens
aguuagggcagucaguaaagugagcuuuagaaagaaacuggaauuuuaacuucauuuuguaucu

SEQ ID NO: 359905 - RNA, 64 nt, Homo Sapiens
aauauuucagaggcuccauucacagcuuucagauaaacuggaguguucagauggacuguuuuaa

SEQ ID NO: 359906 - RNA, 64 nt, Homo Sapiens
cccuuuacugccacagcugcucaccuugucuggcaaacuggagggaccucagaaacuggacucc

SEQ ID NO: 359907 - RNA, 64 nt, Homo Sapiens
gcucaccuugucuggcaaacuggagggaccucagaaacuggacuccugcauguccuugggggcg

SEQ ID NO: 359908 - RNA, 64 nt, Homo Sapiens
uuagaauagucagcuauccugagcaaaaggaaucaaacuggaggaaucauauuaccugacuucc

SEQ ID NO: 359909 - RNA, 64 nt, Homo Sapiens
gaaaagauaaugucuuuaauaaauggugcugggaaaacuggauauccauaugcagaagaaugaa

SEQ ID NO: 359910 - RNA, 64 nt, Homo Sapiens
aaacuuuagucaauaucucguugagggagcagagaaacuggaaaagauuuuuuuccccuagauu

SEQ ID NO: 359911 - RNA, 64 nt, Homo Sapiens
agaaauaagccuuaggugcuaggcuuaagaggauaaacuggagcacagggcucaacugaauaag

SEQ ID NO: 359912 - RNA, 64 nt, Homo Sapiens
cagggcaacugaacagauugcacaugggauagccaaacuggacuuucuuuguuuccucuuuaaa

SEQ ID NO: 359913 - RNA, 64 nt, Homo Sapiens
aauugugcaaccaccagaaaaacacuacuguggcaaacuggagaagugccaauuuaauucuaac

SEQ ID NO: 359914 - RNA, 64 nt, Homo Sapiens
aagaacaguucuauccuggugccuuacgaauaaaaaacuggauucugguuuacagcagcuuuac

SEQ ID NO: 359915 - RNA, 64 nt, Homo Sapiens
cggcaacuucuaccgagagccauggcucaacaccaaacuggacaguagacaucaugaucccucc

SEQ ID NO: 359916 - RNA, 64 nt, Homo Sapiens
ucuccugauaaggagaacacggauagauguuuaaaaacuggaggucagacccagugaaaacuaa

SEQ ID NO: 359917 - RNA, 64 nt, Homo Sapiens
uccucccaucacuguuuuuuaaucaagacuuuuaaaacuggauuaaaguguuuucuuuuuuuua

SEQ ID NO: 359918 - RNA, 64 nt, Homo Sapiens
uggccacagccaguaaaucaggccagagugucucaaacuggacaagaaaugugcugcauugccg

SEQ ID NO: 359919 - RNA, 64 nt, Homo Sapiens
gucuccuucuagcuuuuaggcagccuacucuuggaaacuggaggaaacugcccugagaauuauu

SEQ ID NO: 359920 - RNA, 64 nt, Homo Sapiens
uuaaaauuuauuauuuugaucuugaauuauuuauaaacuggaaagugguuugauuauugugagu

SEQ ID NO: 359921 - RNA, 64 nt, Homo Sapiens
caaacaaacaaacaaacaacguaucuuacugacuaaacuggaauggaaaucuuauaauuagugu

SEQ ID NO: 359922 - RNA, 64 nt, Homo Sapiens
aaccuuggcuaaauggagcagcgaaaucaacgagaaacuggacuuuuuaaacccucuucagagc

SEQ ID NO: 359923 - RNA, 64 nt, Homo Sapiens
caucccuuuuuucuuuguuguuuuuguugaaaacaaacuggaaacuuguuucuuuuuuuguaua

SEQ ID NO: 359924 - RNA, 64 nt, Homo Sapiens
gugaagaaaucaagccugugucauguaucgccguaaacuggaccaaacaucauccacgccauga

SEQ ID NO: 359925 - RNA, 64 nt, Homo Sapiens
aagauuugcugguagaagucaagaggagcagagaaaacuggaaggaaaggugagacccucuccc

SEQ ID NO: 359926 - RNA, 64 nt, Homo Sapiens
aaauagugaaaauaccaaauacugaugaggauacaaacuggauauuuuauacauugcugacagg

SEQ ID NO: 359927 - RNA, 64 nt, Homo Sapiens
aaauauucauaggagcuuuauuuguaauagccccaaacuggaaacaacccagauguccuacaac

SEQ ID NO: 359928 - RNA, 64 nt, Homo Sapiens
uugccuucuugaacuuccugagucacacagaaagcaacuguacacaguagaauucuguggcgca

SEQ ID NO: 359929 - RNA, 64 nt, Homo Sapiens
ucaguucauucaccugauuacuuugguugcagcacaacuguauauauuguauaaccgaaauuga

SEQ ID NO: 359930 - RNA, 64 nt, Homo Sapiens
aaaaauacaaaaauuagcugggcguggcggugcgcaacuguagucccagcuacucgggaggcug

SEQ ID NO: 359931 - RNA, 64 nt, Homo Sapiens
uggcaaguguagguugcagugagcugagauugagcaacuguacuccagcuuggcgacagagcaa

SEQ ID NO: 359932 - RNA, 64 nt, Homo Sapiens
gagucaacuagaggcaagggaguugagagagcugcaacuguaaagggcaagaacaggcagaggu

SEQ ID NO: 359933 - RNA, 64 nt, Homo Sapiens
ccacgguuauugggugaaauuugagauuguaggccaacuguauuuucaagcuucugaacuuagg

SEQ ID NO: 359934 - RNA, 64 nt, Homo Sapiens
uuuauuaaggaagccaggcaacacuggaaauguucaacuguagugcuucguugaauuuuuuuug

SEQ ID NO: 359935 - RNA, 64 nt, Homo Sapiens
agaaaaauuuaugcuuuguaugaguuaaauuagacaacuguaagccucaauacugauucacaau

SEQ ID NO: 359936 - RNA, 64 nt, Homo Sapiens
aauaaauauacauuuaguggcuugggcuauggucuccaaagauccuucaaaaauacaucaagcc

SEQ ID NO: 359937 - RNA, 64 nt, Homo Sapiens
acugauuucuucacaauccuucucaaauuacaauuccaaagagccgccacucaacagucagaug

SEQ ID NO: 359938 - RNA, 64 nt, Homo Sapiens
auuuuuaaaaugaaauuuaauggaaauguaaucauccaaagauccaauuauaggaaaacauagu

SEQ ID NO: 359939 - RNA, 64 nt, Homo Sapiens
ccaguauuugcugcuauuuugcagcauaauuauuuccaaagaccaugauuccuuuuuauuugua

SEQ ID NO: 359940 - RNA, 64 nt, Homo Sapiens
aagucuuuaauuuaauuuuuguuuuuugccuaaauccaaagaaaaagggcugccgggccaggcg

SEQ ID NO: 359941 - RNA, 64 nt, Homo Sapiens
uuuaguuccuacuuuagccacugguuucucagaauccaaagaucacauauucuaguguaacacu

SEQ ID NO: 359942 - RNA, 64 nt, Homo Sapiens
agaagggcacauuuaucuaggggcauuucagguuuccaaagaaaggaauguaugccugggaaag

SEQ ID NO: 359943 - RNA, 64 nt, Homo Sapiens
aaaagccuuuauugacuaauugauuuaaccucaguccaaagaacagucucuauacuugcccuca

SEQ ID NO: 359944 - RNA, 64 nt, Homo Sapiens
uaagauuugcuaauguucuacauuaagugccuucuccaaagacaucccucuuugccucauaugu

SEQ ID NO: 359945 - RNA, 64 nt, Homo Sapiens
gaaguuuuaaaaaaaaaguuguggaaaggaaaguuccaaagaggugguuucugaggaagucaga

SEQ ID NO: 359946 - RNA, 64 nt, Homo Sapiens
gucuaaagucaaucauccgagauggguuuuccauuccaaagaaaggcaauaugguuccuuccuu

SEQ ID NO: 359947 - RNA, 64 nt, Homo Sapiens
guucaagggaaaugaucagucauugcauuguuauuccaaagagcagccaacaguggccuccccc

SEQ ID NO: 359948 - RNA, 64 nt, Homo Sapiens
acaagcuguguugaaauacauaugauugauuuuuuccaaagaugucaguauaaggaaacguaau

SEQ ID NO: 359949 - RNA, 64 nt, Homo Sapiens
agcauguuucacucaaugguaauguauuuuuuucuccaaagaaccaauauacuugaaaaaaaug

SEQ ID NO: 359950 - RNA, 64 nt, Homo Sapiens
uucugaaauuucuuuucuugcaugaaauuaguauuccaaagagaaguuuuguuaaaucuagaaa

SEQ ID NO: 359951 - RNA, 64 nt, Homo Sapiens
ccaaaauacaaacacaauauccacuuccaugaucuccaaagaaacaaauuggcaauuuaacgag

SEQ ID NO: 359952 - RNA, 64 nt, Homo Sapiens
cagaauuucugaugauuuggguucuuuuccauaguccaaagaaacagaucagcucuucagguau

SEQ ID NO: 359953 - RNA, 64 nt, Homo Sapiens
aggucccagaacaaggaagucacuuuucaguggauccaaagaaucuacuccuuaaaccuggaga

SEQ ID NO: 359954 - RNA, 64 nt, Homo Sapiens
ggaacacugacaucaauuuuacggccugcccagucgaccccaaaugaaaacccagacugucucc

SEQ ID NO: 359955 - RNA, 64 nt, Homo Sapiens
accucuucuggagauggaagcaaagccaaggcagcgaccccaggcgaagcucauucccaacgug

SEQ ID NO: 359956 - RNA, 64 nt, Homo Sapiens
uccugccugcccccacuguggcuggcaaacuugacgaccccaacucuugccucugcugaugggg

SEQ ID NO: 359957 - RNA, 64 nt, Homo Sapiens
ucacucuuucgugaauguucugucgccccauccccgaccccaccuccuuggcccugcugguccc

SEQ ID NO: 359958 - RNA, 64 nt, Homo Sapiens
aucugaagcacaaggcccacccucaccuaucugucgaccccauuuccuaccaccuuuguggccg

SEQ ID NO: 359959 - RNA, 64 nt, Homo Sapiens
aucugucgaccccauuuccuaccaccuuuguggccgaccccaagcaccccagagauaugaggca

SEQ ID NO: 359960 - RNA, 64 nt, Homo Sapiens
agagagcuauggagucaaggcauguuuaagaugggagguagagcaugccaauauugauggcaac

SEQ ID NO: 359961 - RNA, 64 nt, Homo Sapiens
augggaguacccagugggggagcagcuguacaaugagguagacuccuagagguuaauuaucauc

SEQ ID NO: 359962 - RNA, 64 nt, Homo Sapiens
ggcaguggagcuggggagauguggucggauuagggagguagaaucaauaagacucagugaagaa

SEQ ID NO: 359963 - RNA, 64 nt, Homo Sapiens
ggaggccgaggugggagggucuucugagcccagggagguagaggcuucagugagcugagaucgc

SEQ ID NO: 359964 - RNA, 64 nt, Homo Sapiens
uagccacgagcugauaauuaagagguagaggggagagguagaggggagagguagagaugagaca

SEQ ID NO: 359965 - RNA, 64 nt, Homo Sapiens
ggagagguagagguagccacuagagaugagacaagagguagagggcaggggucagggggagagg

SEQ ID NO: 359966 - RNA, 64 nt, Homo Sapiens
ugagacaagagguagaggggaggggucagggggagagguagagacugcaaaaugacccagaggc

SEQ ID NO: 359967 - RNA, 64 nt, Homo Sapiens
ggcuuaugccuguaaucccagcacuuugcaggccgagguagacagauggcuugagcucaggagu

SEQ ID NO: 359968 - RNA, 64 nt, Homo Sapiens
aggaggcugaggcaggagaaucguuugaacccaggagguagagguugcagugagcugagauugc

SEQ ID NO: 359969 - RNA, 64 nt, Homo Sapiens
uacuaauacaaggguuaaagccccauaagccaaggagguagaauuuuaaaacuaggacuuuucc

SEQ ID NO: 359970 - RNA, 64 nt, Homo Sapiens
gaaauuuuuuuaauucaugugugauguucugguggagguagacugaugauagauuaacaauaaa

SEQ ID NO: 359971 - RNA, 64 nt, Homo Sapiens
uacuucaaauucaacaggccuuaauuagaagugagagguagaagcagucuguuuucuuccaugu

SEQ ID NO: 359972 - RNA, 64 nt, Homo Sapiens
uuuguuguguguuuuauaaaguggaggguggagagagguagacugauguucacuuuugcaauuu

SEQ ID NO: 359973 - RNA, 64 nt, Homo Sapiens
cagucagugucacuucaggagaugaagaaaaggagagguagauaagacaaaagcaagaggauca

SEQ ID NO: 359974 - RNA, 64 nt, Homo Sapiens
cagucagugucacuucaggagaugaagaaaaggagagguagauaauuuagaaaaaggaacaccu

SEQ ID NO: 359975 - RNA, 64 nt, Homo Sapiens; identical to SEQ ID NO: 206430

SEQ ID NO: 359976 - RNA, 64 nt, Homo Sapiens; identical to SEQ ID NO: 206431

SEQ ID NO: 359977 - RNA, 64 nt, Homo Sapiens; identical to SEQ ID NO: 206432

SEQ ID NO: 359978 - RNA, 64 nt, Homo Sapiens; identical to SEQ ID NO: 206433

SEQ ID NO: 359979 - RNA, 64 nt, Homo Sapiens; identical to SEQ ID NO: 206434

SEQ ID NO: 359980 - RNA, 64 nt, Homo Sapiens; identical to SEQ ID NO: 206435

SEQ ID NO: 359981 - RNA, 64 nt, Homo Sapiens; identical to SEQ ID NO: 206436

SEQ ID NO: 359982 - RNA, 64 nt, Homo Sapiens; identical to SEQ ID NO: 206437

SEQ ID NO: 359983 - RNA, 64 nt, Homo Sapiens; identical to SEQ ID NO: 206438

SEQ ID NO: 359984 - RNA, 64 nt, Homo Sapiens; identical to SEQ ID NO: 206439

SEQ ID NO: 359985 - RNA, 64 nt, Homo Sapiens; identical to SEQ ID NO: 206440

SEQ ID NO: 359986 - RNA, 64 nt, Homo Sapiens; identical to SEQ ID NO: 206441

SEQ ID NO: 359987 - RNA, 64 nt, Homo Sapiens; identical to SEQ ID NO: 206442

SEQ ID NO: 359988 - RNA, 64 nt, Homo Sapiens; identical to SEQ ID NO: 206443

SEQ ID NO: 359989 - RNA, 64 nt, Homo Sapiens; identical to SEQ ID NO: 206444

SEQ ID NO: 359990 - RNA, 64 nt, Homo Sapiens; identical to SEQ ID NO: 206445

SEQ ID NO: 359991 - RNA, 64 nt, Homo Sapiens; identical to SEQ ID NO: 206446

SEQ ID NO: 359992 - RNA, 64 nt, Homo Sapiens; identical to SEQ ID NO: 206447

SEQ ID NO: 359993 - RNA, 64 nt, Homo Sapiens; identical to SEQ ID NO: 206448

SEQ ID NO: 359994 - RNA, 64 nt, Homo Sapiens; identical to SEQ ID NO: 206449

SEQ ID NO: 359995 - RNA, 64 nt, Homo Sapiens; identical to SEQ ID NO: 206450

SEQ ID NO: 359996 - RNA, 64 nt, Homo Sapiens; identical to SEQ ID NO: 206451

SEQ ID NO: 359997 - RNA, 64 nt, Homo Sapiens; identical to SEQ ID NO: 206452

SEQ ID NO: 359998 - RNA, 64 nt, Homo Sapiens; identical to SEQ ID NO: 206453

SEQ ID NO: 359999 - RNA, 64 nt, Homo Sapiens; identical to SEQ ID NO: 206454

SEQ ID NO: 360000 - RNA, 64 nt, Homo Sapiens; identical to SEQ ID NO: 206455

SEQ ID NO: 360001 - RNA, 64 nt, Homo Sapiens; identical to SEQ ID NO: 206456

SEQ ID NO: 360002 - RNA, 64 nt, Homo Sapiens; identical to SEQ ID NO: 206457

SEQ ID NO: 360003 - RNA, 64 nt, Homo Sapiens; identical to SEQ ID NO: 206458

SEQ ID NO: 360004 - RNA, 64 nt, Homo Sapiens; identical to SEQ ID NO: 206459

SEQ ID NO: 360005 - RNA, 64 nt, Homo Sapiens; identical to SEQ ID NO: 206460

SEQ ID NO: 360006 - RNA, 64 nt, Homo Sapiens; identical to SEQ ID NO: 206461

SEQ ID NO: 360007 - RNA, 64 nt, Homo Sapiens; identical to SEQ ID NO: 206462

SEQ ID NO: 360008 - RNA, 64 nt, Homo Sapiens; identical to SEQ ID NO: 206463

SEQ ID NO: 360009 - RNA, 64 nt, Homo Sapiens; identical to SEQ ID NO: 206464

SEQ ID NO: 360010 - RNA, 64 nt, Homo Sapiens; identical to SEQ ID NO: 206465

SEQ ID NO: 360011 - RNA, 64 nt, Homo Sapiens; identical to SEQ ID NO: 206466

SEQ ID NO: 360012 - RNA, 64 nt, Homo Sapiens; identical to SEQ ID NO: 206467

SEQ ID NO: 360013 - RNA, 64 nt, Homo Sapiens; identical to SEQ ID NO: 206468

SEQ ID NO: 360014 - RNA, 64 nt, Homo Sapiens; identical to SEQ ID NO: 206469

SEQ ID NO: 360015 - RNA, 64 nt, Homo Sapiens; identical to SEQ ID NO: 206470

SEQ ID NO: 360016 - RNA, 64 nt, Homo Sapiens; identical to SEQ ID NO: 206471

SEQ ID NO: 360017 - RNA, 64 nt, Homo Sapiens; identical to SEQ ID NO: 206472

SEQ ID NO: 360018 - RNA, 64 nt, Homo Sapiens; identical to SEQ ID NO: 206473

SEQ ID NO: 360019 - RNA, 64 nt, Homo Sapiens; identical to SEQ ID NO: 206474

SEQ ID NO: 360020 - RNA, 64 nt, Homo Sapiens; identical to SEQ ID NO: 206475

SEQ ID NO: 360021 - RNA, 64 nt, Homo Sapiens; identical to SEQ ID NO: 206476

SEQ ID NO: 360022 - RNA, 64 nt, Homo Sapiens; identical to SEQ ID NO: 206477

SEQ ID NO: 360023 - RNA, 64 nt, Homo Sapiens; identical to SEQ ID NO: 206478

SEQ ID NO: 360024 - RNA, 64 nt, Homo Sapiens; identical to SEQ ID NO: 206479

SEQ ID NO: 360025 - RNA, 64 nt, Homo Sapiens; identical to SEQ ID NO: 206480

SEQ ID NO: 360026 - RNA, 64 nt, Homo Sapiens; identical to SEQ ID NO: 206481

SEQ ID NO: 360027 - RNA, 64 nt, Homo Sapiens; identical to SEQ ID NO: 206482

SEQ ID NO: 360028 - RNA, 64 nt, Homo Sapiens; identical to SEQ ID NO: 206483

SEQ ID NO: 360029 - RNA, 64 nt, Homo Sapiens; identical to SEQ ID NO: 206484

SEQ ID NO: 360030 - RNA, 64 nt, Homo Sapiens; identical to SEQ ID NO: 206485

SEQ ID NO: 360031 - RNA, 64 nt, Homo Sapiens; identical to SEQ ID NO: 206486

SEQ ID NO: 360032 - RNA, 64 nt, Homo Sapiens; identical to SEQ ID NO: 206487

SEQ ID NO: 360033 - RNA, 64 nt, Homo Sapiens; identical to SEQ ID NO: 206488

SEQ ID NO: 360034 - RNA, 55 nt, Homo Sapiens; identical to SEQ ID NO: 206489

SEQ ID NO: 360035 - RNA, 64 nt, Homo Sapiens; identical to SEQ ID NO: 206490

SEQ ID NO: 360036 - RNA, 64 nt, Homo Sapiens; identical to SEQ ID NO: 206491

SEQ ID NO: 360037 - RNA, 64 nt, Homo Sapiens; identical to SEQ ID NO: 206492

SEQ ID NO: 360038 - RNA, 64 nt, Homo Sapiens; identical to SEQ ID NO: 206493

SEQ ID NO: 360039 - RNA, 64 nt, Homo Sapiens; identical to SEQ ID NO: 206494

SEQ ID NO: 360040 - RNA, 64 nt, Homo Sapiens; identical to SEQ ID NO: 206495

SEQ ID NO: 360041 - RNA, 64 nt, Homo Sapiens; identical to SEQ ID NO: 206496

SEQ ID NO: 360042 - RNA, 64 nt, Homo Sapiens
aagaacacuuucccuuuaaaggaaacaaaagugaauaccauauuguuuuuacugucauaguguu

SEQ ID NO: 360043 - RNA, 64 nt, Homo Sapiens
uugccuguccugcuuaguuuuuacuugcuggaugauaccauaauguaucaaggagcguccaugg

SEQ ID NO: 360044 - RNA, 64 nt, Homo Sapiens
uuuacaaaugucacaccuaauaaucuuuuauaauauaccauauuucauuaaaguuuuguuagag

SEQ ID NO: 360045 - RNA, 64 nt, Homo Sapiens
acacuuaauacaauguaaaugcuauguaguuguuauaccauacugguuagugaauaauuacaug

SEQ ID NO: 360046 - RNA, 64 nt, Homo Sapiens
agccuguuaguccuauucaguuucauaugaaagcaccuacaauuucuucuuuucucccaauuau

SEQ ID NO: 360047 - RNA, 64 nt, Homo Sapiens
aaccucuucaaaguacccuuggggguacagaauaaccuacaaacuccacuuucuuuaagaauca

SEQ ID NO: 360048 - RNA, 64 nt, Homo Sapiens
gccagggauuaggaauuaagaucgugcacaaaaguuuccuuaaaauuccuggauggcugcagau

SEQ ID NO: 360049 - RNA, 64 nt, Homo Sapiens
gacauucaacuguaguauccauauguugcuuaaauuuccuuaugagccccaugauggaaagacu

SEQ ID NO: 360050 - RNA, 64 nt, Homo Sapiens
aauuccagcaugugacuuugggcaaacaaccucguuuccuuacacuuuagcuccagccacuugu

SEQ ID NO: 360051 - RNA, 64 nt, Homo Sapiens
cuaaagaaugaucuguuguugugcuuguaugguguuuccuuagcugaaucauaaaaugaaguug

SEQ ID NO: 360052 - RNA, 64 nt, Homo Sapiens
cacaaugucagaccaaauuguuuauauccucccuuuuccuuaagcugauccagccacuggauau

SEQ ID NO: 360053 - RNA, 64 nt, Homo Sapiens
ccaagggacccagugacaguauuuaggacugaacuuuccuuagcucaaauguuguacccuugcc

SEQ ID NO: 360054 - RNA, 64 nt, Homo Sapiens
aguaacuggaguucuccugcagcauugguagugcuuuccuuaucguuugcaaaauauguuugaa

SEQ ID NO: 360055 - RNA, 64 nt, Homo Sapiens
ugacuucucauuuuguaucacauacacucgugcuuuuccuuaucucaguccaacacuguguuua

SEQ ID NO: 360056 - RNA, 64 nt, Homo Sapiens
ugucaaauuagauuacacuacuucuacaagcuuguuuccuuauugacuugaacaagucacuuaa

SEQ ID NO: 360057 - RNA, 64 nt, Homo Sapiens
uguaagaaacaaugcuucaaccuaauuuuggauuuuuccuuaaguaaagcaaacuauagggguc

SEQ ID NO: 360058 - RNA, 64 nt, Homo Sapiens
cucagcuucuacccccuccugccuuuccuuccucuuuccuuacuuccuucccuucccucggcuu

SEQ ID NO: 360059 - RNA, 64 nt, Homo Sapiens
aggacucagcugagaaaggacaacuggguuccgcuuuccuuaacccuacacccuuuagcuggau

SEQ ID NO: 360060 - RNA, 64 nt, Homo Sapiens
gugaacuuuccaagguuauuucugaauguaacaauuuccuuaaaaaugacuuauccaauuucug

SEQ ID NO: 360061 - RNA, 64 nt, Homo Sapiens
aacuuuagucuccagaacuaaacaagucccuaaguuuccuuauuuuaauuuacugugacuagau

SEQ ID NO: 360062 - RNA, 64 nt, Homo Sapiens
cagaauuucuaaaaguuuaacuauguagaauauauuuccuuauucugaguguuucacaccuuau

SEQ ID NO: 360063 - RNA, 64 nt, Homo Sapiens
cuugauugugggauacuauuaauauguuagagaauuuccuuacuuauuuuaauguuucuugggg

SEQ ID NO: 360064 - RNA, 64 nt, Homo Sapiens
aaagggagcuaacauuaauuaugcauguacuauauuuccuuaauaugagagauaauuuuuuaau

SEQ ID NO: 360065 - RNA, 64 nt, Homo Sapiens
uaucuauuuggagauucagugcauaacuaaguauuuuccuuaauacuaaagauuuuaaauaaua

SEQ ID NO: 360066 - RNA, 64 nt, Homo Sapiens
acagcuagagaaaacaucucugauuaauguuuccuuuccuuacauuuaugcagguuaggggauc

SEQ ID NO: 360067 - RNA, 64 nt, Homo Sapiens
aggaaaacugaaacccaguccaaaagcuuacauuuuuccuuaaaagcaacucuucaagauguug

SEQ ID NO: 360068 - RNA, 64 nt, Homo Sapiens
ucuuaaugucucaguuuuugaguuaagguuaggauuuccuuaguacaggucuaaauuacaauga

SEQ ID NO: 360069 - RNA, 64 nt, Homo Sapiens
uuuuauuagguacguaacuacugguaguagaugauuuccuuaauacacuuauacugacuuucau

SEQ ID NO: 360070 - RNA, 64 nt, Homo Sapiens
aguaaaggguacauaugcauuacauaugcaaagcuuuccuuaacguagcuuauucuucuauauc

SEQ ID NO: 360071 - RNA, 64 nt, Homo Sapiens
acuuuucuuucuccacccacaaagaugaaaauguuuuccuuaucaggggcuggaggaagaugua

SEQ ID NO: 360072 - RNA, 64 nt, Homo Sapiens
gacuuuuuguuugccuuaccccuuuuuuuccagauuuccuuauuuuuguguauaacugcaaugg

SEQ ID NO: 360073 - RNA, 64 nt, Homo Sapiens
ucuagccagucacuuccuuuuuagagaaaaucuauuuccuuaccucacacguaggccaguuaac

SEQ ID NO: 360074 - RNA, 64 nt, Homo Sapiens
ucuaauauauaucugggagacaaauuggacucgauuuccuuauaugcuguuuuaaaauucauuu

SEQ ID NO: 360075 - RNA, 64 nt, Homo Sapiens
auauaaacuuuauauacuaucauauuauuauaaauuuccuuauuauaccccacuauauaaaagu

SEQ ID NO: 360076 - RNA, 64 nt, Homo Sapiens
uugaaaacaucuuucugagauuauggugcuuuuauuuccuuaacauaggucauuuaauauuggu

SEQ ID NO: 360077 - RNA, 64 nt, Homo Sapiens
gagacaguuugggcucucccgaauggaauugcccuuuccuuaagagugcuaagaaagugcauua

SEQ ID NO: 360078 - RNA, 64 nt, Homo Sapiens
uguuacccagaugguucugguaagagagggaacauuuccuuagaggggguugggaggaagcaug

SEQ ID NO: 360079 - RNA, 64 nt, Homo Sapiens
agucauccagaugcuucuggauguggaaggagcauuuccuuagaaguggguggagaggaagcau

SEQ ID NO: 360080 - RNA, 64 nt, Homo Sapiens
uuuuaccguguagguuguauacuuacauuuuuucuuuccuuaauuuauacaugauccuuuuucc

SEQ ID NO: 360081 - RNA, 64 nt, Homo Sapiens
cauuuuuucuuuccuuaauuuauacaugauccuuuuuccuuaauuuauacaugauccaggcaca

SEQ ID NO: 360082 - RNA, 64 nt, Homo Sapiens
uuaucucagcuuuuaacuucaauuugaagaucauuuuccuuaaauuaaaccuguugguuaugaa

SEQ ID NO: 360083 - RNA, 64 nt, Homo Sapiens
agaagguuuucguagagaaugagcuggcauuuauuuuccuuacgcuguaaacaggguacgugaa

SEQ ID NO: 360084 - RNA, 64 nt, Homo Sapiens
gcagaauuaauuguuauuauuuuccuaggcgcaauuuccuuaaacguacaguuuaaauucaagg

SEQ ID NO: 360085 - RNA, 64 nt, Homo Sapiens
uguguguguguauguguguguguguguguguguguuuccuuauugucauuccauuauauaucca

SEQ ID NO: 360086 - RNA, 64 nt, Homo Sapiens
cuuguucugcauuuuauuuuacaagaaccuuugcuuuccuuagauuccaaaagucacaauuugu

SEQ ID NO: 360087 - RNA, 64 nt, Homo Sapiens
acauaugaguauauagaaagaacugucauuucuuuuuccuuaaauauguauauccagugcaauc

SEQ ID NO: 360088 - RNA, 64 nt, Homo Sapiens
gagaaaagccaaauuagaaaauccuauguccuaguuuccuuaccaaggauaauuaaauauauca

SEQ ID NO: 360089 - RNA, 64 nt, Homo Sapiens
gagaauagauggcuaacaagagguuagaaauacuuuuccuuaauuuuaauccacaguauguuac

SEQ ID NO: 360090 - RNA, 64 nt, Homo Sapiens
aagauuuauucuauucuuacuguuguguauuuuguuuccuuauagccauuaaagaaagcacuaa

SEQ ID NO: 360091 - RNA, 64 nt, Homo Sapiens
aaacaaacaaaaauccuuugcccucagaagugcauuuccuuauucuuuaguguaauuguaauuu

SEQ ID NO: 360092 - RNA, 64 nt, Homo Sapiens
cuugggccucacacuagcucaggaagaauccagauuuccuuaugcugguaaagagcaggaccag

SEQ ID NO: 360093 - RNA, 64 nt, Homo Sapiens
ucuuuguaauugugcagauaagcagauaugaagauuuccuuauuccaauucuguguuugcuuuu

SEQ ID NO: 360094 - RNA, 64 nt, Homo Sapiens
guucuuaaugcagccacuauaacuugauaagucauugcacuauuuaaaaaguuuuaguaauauc

SEQ ID NO: 360095 - RNA, 64 nt, Homo Sapiens
uauacacagucuguuucuucuauuccuagacauauugcacuacuuuuucagugguucuuggucc

SEQ ID NO: 360096 - RNA, 64 nt, Homo Sapiens
gaguaggaagaguuaauuguagaaaauguuuuauuugcacuacugauuauuuuuauauuugaaa

SEQ ID NO: 360097 - RNA, 64 nt, Homo Sapiens
gaagguaaagagagaaucaguggaguucuccugcuugcacuagagugcuuuccuuaucaguaac

SEQ ID NO: 360098 - RNA, 64 nt, Homo Sapiens
cuggacuauauaacuuaaaagaaguaaaacguaauugcacuacuguuuuccagacuggaaaaaa

SEQ ID NO: 360099 - RNA, 64 nt, Homo Sapiens
aagggcaaaaacggauugaaaugaacauagcguuuugcacuaaugauaagauaaccugagaggu

SEQ ID NO: 360100 - RNA, 64 nt, Homo Sapiens
gggguaugauguuugggucagcagagagggaacuuugcacuauuggcugucaacauucaaagca

SEQ ID NO: 360101 - RNA, 64 nt, Homo Sapiens
auggccucugacgugaccauagcaguguuucuacuugcacuagcggaaauucagcuuuugcaga

SEQ ID NO: 360102 - RNA, 64 nt, Homo Sapiens
uguuaucaguagugccuuuaaauaucugagcucuuugcacuaccauuuuauucuuauucaaaga

SEQ ID NO: 360103 - RNA, 64 nt, Homo Sapiens
auauuuccaggcugcauuugguuacuuuucauauuugcacuaagaaguaacuuuaaauuaugcc

SEQ ID NO: 360104 - RNA, 64 nt, Homo Sapiens; identical to SEQ ID NO: 93499

SEQ ID NO: 360105 - RNA, 64 nt, Homo Sapiens; identical to SEQ ID NO: 93500

SEQ ID NO: 360106 - RNA, 64 nt, Homo Sapiens; identical to SEQ ID NO: 93501

SEQ ID NO: 360107 - RNA, 64 nt, Homo Sapiens; identical to SEQ ID NO: 93502

SEQ ID NO: 360108 - RNA, 64 nt, Homo Sapiens; identical to SEQ ID NO: 93503

SEQ ID NO: 360109 - RNA, 64 nt, Homo Sapiens; identical to SEQ ID NO: 93504

SEQ ID NO: 360110 - RNA, 64 nt, Homo Sapiens; identical to SEQ ID NO: 93505

SEQ ID NO: 360111 - RNA, 64 nt, Homo Sapiens; identical to SEQ ID NO: 93506

SEQ ID NO: 360112 - RNA, 64 nt, Homo Sapiens; identical to SEQ ID NO: 93507

SEQ ID NO: 360113 - RNA, 64 nt, Homo Sapiens; identical to SEQ ID NO: 93508

SEQ ID NO: 360114 - RNA, 64 nt, Homo Sapiens; identical to SEQ ID NO: 93509

SEQ ID NO: 360115 - RNA, 64 nt, Homo Sapiens; identical to SEQ ID NO: 93510

SEQ ID NO: 360116 - RNA, 64 nt, Homo Sapiens; identical to SEQ ID NO: 93511

SEQ ID NO: 360117 - RNA, 64 nt, Homo Sapiens; identical to SEQ ID NO: 93512

SEQ ID NO: 360118 - RNA, 64 nt, Homo Sapiens; identical to SEQ ID NO: 93513

SEQ ID NO: 360119 - RNA, 64 nt, Homo Sapiens; identical to SEQ ID NO: 93514

SEQ ID NO: 360120 - RNA, 64 nt, Homo Sapiens; identical to SEQ ID NO: 93515

SEQ ID NO: 360121 - RNA, 64 nt, Homo Sapiens; identical to SEQ ID NO: 93516

SEQ ID NO: 360122 - RNA, 64 nt, Homo Sapiens; identical to SEQ ID NO: 93517

SEQ ID NO: 360123 - RNA, 64 nt, Homo Sapiens; identical to SEQ ID NO: 93518

SEQ ID NO: 360124 - RNA, 64 nt, Homo Sapiens; identical to SEQ ID NO: 93519

SEQ ID NO: 360125 - RNA, 64 nt, Homo Sapiens; identical to SEQ ID NO: 93520

SEQ ID NO: 360126 - RNA, 64 nt, Homo Sapiens; identical to SEQ ID NO: 93521

SEQ ID NO: 360127 - RNA, 64 nt, Homo Sapiens; identical to SEQ ID NO: 93522

SEQ ID NO: 360128 - RNA, 64 nt, Homo Sapiens; identical to SEQ ID NO: 93523

SEQ ID NO: 360129 - RNA, 64 nt, Homo Sapiens; identical to SEQ ID NO: 93524

SEQ ID NO: 360130 - RNA, 64 nt, Homo Sapiens; identical to SEQ ID NO: 93525

SEQ ID NO: 360131 - RNA, 64 nt, Homo Sapiens; identical to SEQ ID NO: 93526

SEQ ID NO: 360132 - RNA, 64 nt, Homo Sapiens; identical to SEQ ID NO: 93527

SEQ ID NO: 360133 - RNA, 64 nt, Homo Sapiens; identical to SEQ ID NO: 93528

SEQ ID NO: 360134 - RNA, 64 nt, Homo Sapiens; identical to SEQ ID NO: 93529

SEQ ID NO: 360135 - RNA, 64 nt, Homo Sapiens; identical to SEQ ID NO: 93530

SEQ ID NO: 360136 - RNA, 64 nt, Homo Sapiens; identical to SEQ ID NO: 93531

SEQ ID NO: 360137 - RNA, 64 nt, Homo Sapiens; identical to SEQ ID NO: 93532

SEQ ID NO: 360138 - RNA, 64 nt, Homo Sapiens; identical to SEQ ID NO: 93533

SEQ ID NO: 360139 - RNA, 64 nt, Homo Sapiens; identical to SEQ ID NO: 93534

SEQ ID NO: 360140 - RNA, 64 nt, Homo Sapiens; identical to SEQ ID NO: 93535

SEQ ID NO: 360141 - RNA, 64 nt, Homo Sapiens; identical to SEQ ID NO: 93536

SEQ ID NO: 360142 - RNA, 64 nt, Homo Sapiens; identical to SEQ ID NO: 93537

SEQ ID NO: 360143 - RNA, 64 nt, Homo Sapiens; identical to SEQ ID NO: 93538

SEQ ID NO: 360144 - RNA, 64 nt, Homo Sapiens; identical to SEQ ID NO: 93539

SEQ ID NO: 360145 - RNA, 64 nt, Homo Sapiens; identical to SEQ ID NO: 93540

SEQ ID NO: 360146 - RNA, 64 nt, Homo Sapiens; identical to SEQ ID NO: 93541

SEQ ID NO: 360147 - RNA, 64 nt, Homo Sapiens; identical to SEQ ID NO: 93542

SEQ ID NO: 360148 - RNA, 64 nt, Homo Sapiens; identical to SEQ ID NO: 93543

SEQ ID NO: 360149 - RNA, 64 nt, Homo Sapiens; identical to SEQ ID NO: 93544

SEQ ID NO: 360150 - RNA, 64 nt, Homo Sapiens; identical to SEQ ID NO: 93545

SEQ ID NO: 360151 - RNA, 64 nt, Homo Sapiens; identical to SEQ ID NO: 93546

SEQ ID NO: 360152 - RNA, 64 nt, Homo Sapiens; identical to SEQ ID NO: 93547

SEQ ID NO: 360153 - RNA, 64 nt, Homo Sapiens; identical to SEQ ID NO: 93548

SEQ ID NO: 360154 - RNA, 64 nt, Homo Sapiens; identical to SEQ ID NO: 93549

SEQ ID NO: 360155 - RNA, 64 nt, Homo Sapiens; identical to SEQ ID NO: 93550

SEQ ID NO: 360156 - RNA, 64 nt, Homo Sapiens; identical to SEQ ID NO: 93551

SEQ ID NO: 360157 - RNA, 64 nt, Homo Sapiens; identical to SEQ ID NO: 93552

SEQ ID NO: 360158 - RNA, 64 nt, Homo Sapiens; identical to SEQ ID NO: 93553

SEQ ID NO: 360159 - RNA, 64 nt, Homo Sapiens; identical to SEQ ID NO: 93554

SEQ ID NO: 360160 - RNA, 64 nt, Homo Sapiens; identical to SEQ ID NO: 93555

SEQ ID NO: 360161 - RNA, 64 nt, Homo Sapiens; identical to SEQ ID NO: 93556

SEQ ID NO: 360162 - RNA, 64 nt, Homo Sapiens; identical to SEQ ID NO: 93557

SEQ ID NO: 360163 - RNA, 64 nt, Homo Sapiens; identical to SEQ ID NO: 93558

SEQ ID NO: 360164 - RNA, 64 nt, Homo Sapiens; identical to SEQ ID NO: 93559

SEQ ID NO: 360165 - RNA, 64 nt, Homo Sapiens; identical to SEQ ID NO: 93560

SEQ ID NO: 360166 - RNA, 64 nt, Homo Sapiens; identical to SEQ ID NO: 93561

SEQ ID NO: 360167 - RNA, 64 nt, Homo Sapiens; identical to SEQ ID NO: 93562

SEQ ID NO: 360168 - RNA, 64 nt, Homo Sapiens; identical to SEQ ID NO: 93563

SEQ ID NO: 360169 - RNA, 64 nt, Homo Sapiens; identical to SEQ ID NO: 93564

SEQ ID NO: 360170 - RNA, 64 nt, Homo Sapiens; identical to SEQ ID NO: 93565

SEQ ID NO: 360171 - RNA, 64 nt, Homo Sapiens; identical to SEQ ID NO: 93566

SEQ ID NO: 360172 - RNA, 64 nt, Homo Sapiens; identical to SEQ ID NO: 93567

SEQ ID NO: 360173 - RNA, 64 nt, Homo Sapiens; identical to SEQ ID NO: 93568

SEQ ID NO: 360174 - RNA, 64 nt, Homo Sapiens; identical to SEQ ID NO: 93569

SEQ ID NO: 360175 - RNA, 64 nt, Homo Sapiens; identical to SEQ ID NO: 93570

SEQ ID NO: 360176 - RNA, 64 nt, Homo Sapiens; identical to SEQ ID NO: 93571

SEQ ID NO: 360177 - RNA, 64 nt, Homo Sapiens; identical to SEQ ID NO: 93572

SEQ ID NO: 360178 - RNA, 64 nt, Homo Sapiens; identical to SEQ ID NO: 93573

SEQ ID NO: 360179 - RNA, 64 nt, Homo Sapiens; identical to SEQ ID NO: 93574

SEQ ID NO: 360180 - RNA, 64 nt, Homo Sapiens; identical to SEQ ID NO: 93575

SEQ ID NO: 360181 - RNA, 64 nt, Homo Sapiens; identical to SEQ ID NO: 93576

SEQ ID NO: 360182 - RNA, 64 nt, Homo Sapiens; identical to SEQ ID NO: 93577

SEQ ID NO: 360183 - RNA, 64 nt, Homo Sapiens; identical to SEQ ID NO: 93578

SEQ ID NO: 360184 - RNA, 64 nt, Homo Sapiens; identical to SEQ ID NO: 93579

SEQ ID NO: 360185 - RNA, 64 nt, Homo Sapiens; identical to SEQ ID NO: 93580

SEQ ID NO: 360186 - RNA, 64 nt, Homo Sapiens; identical to SEQ ID NO: 93581

SEQ ID NO: 360187 - RNA, 64 nt, Homo Sapiens; identical to SEQ ID NO: 93582

SEQ ID NO: 360188 - RNA, 64 nt, Homo Sapiens; identical to SEQ ID NO: 220348

SEQ ID NO: 360189 - RNA, 64 nt, Homo Sapiens; identical to SEQ ID NO: 220349

SEQ ID NO: 360190 - RNA, 64 nt, Homo Sapiens; identical to SEQ ID NO: 220350

SEQ ID NO: 360191 - RNA, 64 nt, Homo Sapiens; identical to SEQ ID NO: 220351

SEQ ID NO: 360192 - RNA, 64 nt, Homo Sapiens; identical to SEQ ID NO: 220352

SEQ ID NO: 360193 - RNA, 64 nt, Homo Sapiens; identical to SEQ ID NO: 220353

SEQ ID NO: 360194 - RNA, 64 nt, Homo Sapiens; identical to SEQ ID NO: 220354

SEQ ID NO: 360195 - RNA, 64 nt, Homo Sapiens; identical to SEQ ID NO: 220355

SEQ ID NO: 360196 - RNA, 64 nt, Homo Sapiens; identical to SEQ ID NO: 360046

SEQ ID NO: 360197 - RNA, 64 nt, Homo Sapiens; identical to SEQ ID NO: 360047

SEQ ID NO: 360198 - RNA, 64 nt, Homo Sapiens
ggaacuuuuaauugacaugagaugcuaaagucagacauuggaauuggaagaacuauaaagugug

SEQ ID NO: 360199 - RNA, 64 nt, Homo Sapiens
cucaaaguaccauuaugguuuccauaugguaauuacauuggaaaguucugcaauaagauucuag

SEQ ID NO: 360200 - RNA, 64 nt, Homo Sapiens
cuggccaaauacugaauaaacaguugaaggaaagacauuggaaaaagcuuuugaggauaauguu

SEQ ID NO: 360201 - RNA, 64 nt, Homo Sapiens
uugguuaauuuuguuuuggccagagaugaauuuuacauuggaagaauaacaaaauaagauuugu

SEQ ID NO: 360202 - RNA, 64 nt, Homo Sapiens
uucuccaagagaugaagcggugaaguugggauuuacauuggaagugcuguagacuucuuuaugu

SEQ ID NO: 360203 - RNA, 64 nt, Homo Sapiens
ccagccugacauuagacagaauacccuuuguaauacauuggaaauuuuuacucaugccuuuuug

SEQ ID NO: 360204 - RNA, 64 nt, Homo Sapiens
uuaaacaaaguggcucugggauaacagucuuuucacauuggauuuugugcaaacuuuucauucc

SEQ ID NO: 360205 - RNA, 64 nt, Homo Sapiens
uaaacggugacucucauucucaaauguucccaguacauuggaccaauauugcauucugagcuag

SEQ ID NO: 360206 - RNA, 64 nt, Homo Sapiens
auuauugagagcccuagaaaaaucaccgaugcaaacauuggaaguucuugggggaaaauaccac

SEQ ID NO: 360207 - RNA, 64 nt, Homo Sapiens
aucucaacaugucuccuacugaaauguuugcugaacauuggagaaccuugguuggaagggaaua

SEQ ID NO: 360208 - RNA, 64 nt, Homo Sapiens
ggccaaaagcuguugauuuucuuaaguugacgguugucaauauaucgaacuguucccaaguuag

SEQ ID NO: 360209 - RNA, 64 nt, Homo Sapiens
agcuuaaacuuaugucaaaaugucugcagcaguuugucaauaaaguuuaguccuuuuuuaauca

SEQ ID NO: 360210 - RNA, 64 nt, Homo Sapiens
uuugcuuuuugagauguugagugacauuuuagaaugucaauaaagguuuacauacguuugugug

SEQ ID NO: 360211 - RNA, 64 nt, Homo Sapiens
uggcccggacaugucuugcuauuuguaaucuaguugucaauaaauuauuuguuacuguauccuc

SEQ ID NO: 360212 - RNA, 64 nt, Homo Sapiens
ucgaguauggguauuaugcaaaauugcuaaguaaugucaauaaaaaguuugacuuuuguccagu

SEQ ID NO: 360213 - RNA, 64 nt, Homo Sapiens
auuuuaaaggaccaauaaaccaaagaucaaggaaugucaauaacuugcccuucgccauuguuuc

SEQ ID NO: 360214 - RNA, 64 nt, Homo Sapiens
uuuauuuuuaacucuggauuaauauuaaaaucacugucaauauuugagccauuuauaccuuuga

SEQ ID NO: 360215 - RNA, 64 nt, Homo Sapiens
gagccauuuauaccuuugaauacagggugcuccuugucaauacuugaaauugaccuaguucaga

SEQ ID NO: 360216 - RNA, 64 nt, Homo Sapiens
agaauguauaucuuuuuugcuucaugacaagaauugucaauauaccuuauuuuugaugcuuuua

SEQ ID NO: 360217 - RNA, 64 nt, Homo Sapiens
uugguggguuuaaaacuuugaaaaguaauggcuuugucaauauaaagcauuauuuguuucuaau

SEQ ID NO: 360218 - RNA, 64 nt, Homo Sapiens
cuaacacacuauauacuuccaagaaguaugucaaugucaauauuuugucaauaaagauuuauca

SEQ ID NO: 360219 - RNA, 64 nt, Homo Sapiens
uauacuuccaagaaguaugucaaugucaauauuuugucaauaaagauuuaucaauaugcccuca

SEQ ID NO: 360220 - RNA, 64 nt, Homo Sapiens
acuccuggcacauuuaacugugucuguggcccugugucaauaugugaaugcauugucuuacuca

SEQ ID NO: 360221 - RNA, 64 nt, Homo Sapiens
cuuuaccaagauaagauccugcuagugacugaggugucaauagcagauuaauagacccucaaau

SEQ ID NO: 360222 - RNA, 64 nt, Homo Sapiens
agaaaaaucaagguauuuggaugugcagaugaaaugucaauauauaaugaauuaucacccagac

SEQ ID NO: 360223 - RNA, 64 nt, Homo Sapiens
aaugguggccaccuggguccagugcuuccuuaccugucaauaacggagaggauggugcauuucc

SEQ ID NO: 360224 - RNA, 64 nt, Homo Sapiens
uaauguacauugcuuuguagucugcucuauauauugucaauauguucccauauuaaauauuuug

SEQ ID NO: 360225 - RNA, 64 nt, Homo Sapiens
gccaauuucugggccuucuggguuuuuucuacacugucaauaauuaucgcuuuaauugguguua

SEQ ID NO: 360226 - RNA, 64 nt, Homo Sapiens
acuuugugaccccuaguuuaggacccacuucagcugucaauauguuuguaacucaggugacuga

SEQ ID NO: 360227 - RNA, 64 nt, Homo Sapiens
caguguuuuauaggaguacuaacauuuauugcucugucaauaaugaaaggcucgauguaauaua

SEQ ID NO: 360228 - RNA, 64 nt, Homo Sapiens
gauagaccugguauacagucacugaacuaguagaugucaauaauuauuauuuuuaaaaauuuuu

SEQ ID NO: 360229 - RNA, 64 nt, Homo Sapiens
agagaugaagucucacuguguugcccagccugggugucaauaauuauuuuuuaaaaaaaauuuu

SEQ ID NO: 360230 - RNA, 64 nt, Homo Sapiens
acaagcucaaagugacagaaaaguuuucauucucugucaauaugaucacaucucgagucuuauc

SEQ ID NO: 360231 - RNA, 64 nt, Homo Sapiens
guugccuaagaauaaaaauuguuucacuggaaagugucaauagauuugcucuauguucuuuacu

SEQ ID NO: 360232 - RNA, 64 nt, Homo Sapiens
cauggcuuggggagcagaguauaggauggauugcaguccccagucaccucuucugccagccucc

SEQ ID NO: 360233 - RNA, 64 nt, Homo Sapiens
aagagguggggaccaaaaccaugcauuccuaagaaguccccaggucaugcugcuguugcuggac

SEQ ID NO: 360234 - RNA, 64 nt, Homo Sapiens
gucagggagccccuggugugccagcucuaggagcaguccccaggggcugccccugaggcuuggc

SEQ ID NO: 360235 - RNA, 55 nt, Homo Sapiens
caggcucuguccccugccauuguccaguccccagcagggcccccuggguguguaa

SEQ ID NO: 360236 - RNA, 64 nt, Homo Sapiens
cacccgcaccaaaggggaaaauaugcaccuggggaguccccacacugggggucgaggguccugc

SEQ ID NO: 360237 - RNA, 64 nt, Homo Sapiens
cuaccuucgaaucccauguauacccacccuacugaguccccauuuaucagagcagcaacccuuc

SEQ ID NO: 360238 - RNA, 64 nt, Homo Sapiens
cuuucaaaguugacauauggugggguuaccucacaguccccacccauggagaugaccaugaugc

SEQ ID NO: 360239 - RNA, 64 nt, Homo Sapiens
uuuuauuuuuuaaaaaccaucagagaaaaaaaaaaguccccacaaguaaaauggcugagcauug

SEQ ID NO: 360240 - RNA, 64 nt, Homo Sapiens
agacugacucucucauggcuacuaacaagugucgaguccccaaggcugggggccgagccuggga

SEQ ID NO: 360241 - RNA, 64 nt, Homo Sapiens
cuacugaggcagaccugcaacagaaguggcauucaguccccagcagacaugggugagcucaccc

SEQ ID NO: 360242 - RNA, 64 nt, Homo Sapiens
ccagagggcuucaccagugugggauccaccugucaguccccagcgacucucaugacacucauuc

SEQ ID NO: 360243 - RNA, 64 nt, Homo Sapiens
ucccugcccucauggaccugaccacucaacaaacaguccccaccacaccuaucuccuuaggcaa

SEQ ID NO: 360244 - RNA, 64 nt, Homo Sapiens
aaggcuucugagaccacaaauucccuacacuagaaguccccacagagcucccagagagacugcc

SEQ ID NO: 360245 - RNA, 64 nt, Homo Sapiens
aaccaaguugggggugguuucacugaagucuucaaguccccagcccuccccuagguaaagauca

SEQ ID NO: 360246 - RNA, 64 nt, Homo Sapiens
gcugugacccuggacaaagagcuuuaaccugcugaguccccauuuucucaucugugaaauggag

SEQ ID NO: 360247 - RNA, 64 nt, Homo Sapiens
guucuuuugauaugcaguuuccagcccuccaaugaguccccagcacagaucucaggcuuguggc

SEQ ID NO: 360248 - RNA, 64 nt, Homo Sapiens
ugcccaccucccacugcccccucagcacacacacaguccccaggcggccuaggggccaaggcug

SEQ ID NO: 360249 - RNA, 64 nt, Homo Sapiens
gugcuccuguaccccagccccacucagcacugacaguccccagcuccuaguagugagcugggag

SEQ ID NO: 360250 - RNA, 64 nt, Homo Sapiens
cugcucuggagggcggcgcucaccucugggucgcaguccccacgaucagccagcagcugugaga

SEQ ID NO: 360251 - RNA, 64 nt, Homo Sapiens
cuugcaggaggguggguguggugcagagagaggcaguccccaugauaggcccauugguccuggg

SEQ ID NO: 360252 - RNA, 64 nt, Homo Sapiens
ccugggcuuggcucuuggcuuguccccaguccccaguccccagcgaggagagccacugggcccc

SEQ ID NO: 360253 - RNA, 64 nt, Homo Sapiens
ccccagcccugggcuuggcugggccccuguccccaguccccaguuggaugggaggagagccacu

SEQ ID NO: 360254 - RNA, 64 nt, Homo Sapiens
guuagaguaguuacuuaugaacugauccagaaauaguccccauaacuaacuacacuuggaucuu

SEQ ID NO: 360255 - RNA, 64 nt, Homo Sapiens
aguagcuuccugaaagucuccuuuaaaccuucccaguccccaucggugcuuaccaaagccauag

SEQ ID NO: 360256 - RNA, 64 nt, Homo Sapiens
ccacuggcggagccagccuguggauccaagagacaguccccaccugggcuucacggcauccuug

SEQ ID NO: 360257 - RNA, 64 nt, Homo Sapiens
ccggcucggguggggucacacgguccugcccuagaguccccaucuggcccuggagcugcagaag

SEQ ID NO: 360258 - RNA, 64 nt, Homo Sapiens
uucccacugagacacgccgcccccacagaggcacaguccccagccaccucugcaacugcagccc

SEQ ID NO: 360259 - RNA, 64 nt, Homo Sapiens
cacucacugaucuacagccccuguucggcgucagaguccccacuagacccaguggaagggguua

SEQ ID NO: 360260 - RNA, 64 nt, Homo Sapiens
aaacccaaucaugagguccuaaaauccaaucccaaguccccaggcccagggaaucccaaauuug

SEQ ID NO: 360261 - RNA, 64 nt, Homo Sapiens
agcaucuccugacacccgagugacaaagagacagaguccccacuucuuagaggcccuggacacc

SEQ ID NO: 360262 - RNA, 64 nt, Homo Sapiens
uauccaugagcagugggaaaaggcuaauguaagcaguccccaccgggaguuccccccugcuacc

SEQ ID NO: 360263 - RNA, 64 nt, Homo Sapiens
ggcuagcaugcguggcucccuggguauuucugucaguccccauggcaagcagugauuuaguaaa

SEQ ID NO: 360264 - RNA, 64 nt, Homo Sapiens
gauucuugguucuuugagcucguuucagaggcugaguccccacaucagcuuuaguucuuggacu

SEQ ID NO: 360265 - RNA, 64 nt, Homo Sapiens
gcaccagguaagaggccaaagccccugggguaacaguccccaccgcuacccgagguaaaacaau

SEQ ID NO: 360266 - RNA, 64 nt, Homo Sapiens
uccuuacuuauuuuaaaaaggcuuccucucuguuaguccccaaaaacaauucagcaagucaggg

SEQ ID NO: 360267 - RNA, 64 nt, Homo Sapiens
ccccuugucuucuaccuucuguuuuuggguugagaguccccaacggugaagggcacggguccuu

SEQ ID NO: 360268 - RNA, 64 nt, Homo Sapiens; identical to SEQ ID NO: 49593

SEQ ID NO: 360269 - RNA, 64 nt, Homo Sapiens; identical to SEQ ID NO: 49594

SEQ ID NO: 360270 - RNA, 64 nt, Homo Sapiens; identical to SEQ ID NO: 49595

SEQ ID NO: 360271 - RNA, 64 nt, Homo Sapiens; identical to SEQ ID NO: 49596

SEQ ID NO: 360272 - RNA, 64 nt, Homo Sapiens; identical to SEQ ID NO: 49597

SEQ ID NO: 360273 - RNA, 64 nt, Homo Sapiens; identical to SEQ ID NO: 49598

SEQ ID NO: 360274 - RNA, 64 nt, Homo Sapiens; identical to SEQ ID NO: 49599

SEQ ID NO: 360275 - RNA, 64 nt, Homo Sapiens; identical to SEQ ID NO: 49600

SEQ ID NO: 360276 - RNA, 64 nt, Homo Sapiens; identical to SEQ ID NO: 49601

SEQ ID NO: 360277 - RNA, 64 nt, Homo Sapiens; identical to SEQ ID NO: 49602

SEQ ID NO: 360278 - RNA, 64 nt, Homo Sapiens; identical to SEQ ID NO: 49603

SEQ ID NO: 360279 - RNA, 64 nt, Homo Sapiens; identical to SEQ ID NO: 49604

SEQ ID NO: 360280 - RNA, 64 nt, Homo Sapiens; identical to SEQ ID NO: 49605

SEQ ID NO: 360281 - RNA, 64 nt, Homo Sapiens; identical to SEQ ID NO: 49606

SEQ ID NO: 360282 - RNA, 64 nt, Homo Sapiens; identical to SEQ ID NO: 49607

SEQ ID NO: 360283 - RNA, 64 nt, Homo Sapiens; identical to SEQ ID NO: 49608

SEQ ID NO: 360284 - RNA, 64 nt, Homo Sapiens; identical to SEQ ID NO: 49609

SEQ ID NO: 360285 - RNA, 64 nt, Homo Sapiens; identical to SEQ ID NO: 49610

SEQ ID NO: 360286 - RNA, 64 nt, Homo Sapiens; identical to SEQ ID NO: 49611

SEQ ID NO: 360287 - RNA, 64 nt, Homo Sapiens; identical to SEQ ID NO: 49612

SEQ ID NO: 360288 - RNA, 64 nt, Homo Sapiens; identical to SEQ ID NO: 49613

SEQ ID NO: 360289 - RNA, 64 nt, Homo Sapiens; identical to SEQ ID NO: 49614

SEQ ID NO: 360290 - RNA, 64 nt, Homo Sapiens; identical to SEQ ID NO: 49615

SEQ ID NO: 360291 - RNA, 64 nt, Homo Sapiens; identical to SEQ ID NO: 49616

SEQ ID NO: 360292 - RNA, 64 nt, Homo Sapiens; identical to SEQ ID NO: 49617

SEQ ID NO: 360293 - RNA, 64 nt, Homo Sapiens; identical to SEQ ID NO: 49618

SEQ ID NO: 360294 - RNA, 64 nt, Homo Sapiens; identical to SEQ ID NO: 49619

SEQ ID NO: 360295 - RNA, 64 nt, Homo Sapiens; identical to SEQ ID NO: 49620

SEQ ID NO: 360296 - RNA, 64 nt, Homo Sapiens; identical to SEQ ID NO: 49621

SEQ ID NO: 360297 - RNA, 64 nt, Homo Sapiens; identical to SEQ ID NO: 49622

SEQ ID NO: 360298 - RNA, 64 nt, Homo Sapiens; identical to SEQ ID NO: 49623

SEQ ID NO: 360299 - RNA, 64 nt, Homo Sapiens; identical to SEQ ID NO: 49624

SEQ ID NO: 360300 - RNA, 64 nt, Homo Sapiens; identical to SEQ ID NO: 49625

SEQ ID NO: 360301 - RNA, 64 nt, Homo Sapiens; identical to SEQ ID NO: 49626

SEQ ID NO: 360302 - RNA, 64 nt, Homo Sapiens; identical to SEQ ID NO: 49627

SEQ ID NO: 360303 - RNA, 64 nt, Homo Sapiens; identical to SEQ ID NO: 49628

SEQ ID NO: 360304 - RNA, 64 nt, Homo Sapiens; identical to SEQ ID NO: 49629

SEQ ID NO: 360305 - RNA, 64 nt, Homo Sapiens; identical to SEQ ID NO: 49630

SEQ ID NO: 360306 - RNA, 64 nt, Homo Sapiens; identical to SEQ ID NO: 49631

SEQ ID NO: 360307 - RNA, 64 nt, Homo Sapiens; identical to SEQ ID NO: 49632

SEQ ID NO: 360308 - RNA, 64 nt, Homo Sapiens; identical to SEQ ID NO: 49633

SEQ ID NO: 360309 - RNA, 64 nt, Homo Sapiens; identical to SEQ ID NO: 49634

SEQ ID NO: 360310 - RNA, 64 nt, Homo Sapiens; identical to SEQ ID NO: 49635

SEQ ID NO: 360311 - RNA, 64 nt, Homo Sapiens; identical to SEQ ID NO: 49636

SEQ ID NO: 360312 - RNA, 64 nt, Homo Sapiens; identical to SEQ ID NO: 49637

SEQ ID NO: 360313 - RNA, 64 nt, Homo Sapiens; identical to SEQ ID NO: 49638

SEQ ID NO: 360314 - RNA, 64 nt, Homo Sapiens; identical to SEQ ID NO: 49639

SEQ ID NO: 360315 - RNA, 64 nt, Homo Sapiens; identical to SEQ ID NO: 49640

SEQ ID NO: 360316 - RNA, 64 nt, Homo Sapiens; identical to SEQ ID NO: 49641

SEQ ID NO: 360317 - RNA, 64 nt, Homo Sapiens; identical to SEQ ID NO: 49642

SEQ ID NO: 360318 - RNA, 64 nt, Homo Sapiens; identical to SEQ ID NO: 49643

SEQ ID NO: 360319 - RNA, 64 nt, Homo Sapiens; identical to SEQ ID NO: 49644

SEQ ID NO: 360320 - RNA, 64 nt, Homo Sapiens; identical to SEQ ID NO: 49645

SEQ ID NO: 360321 - RNA, 64 nt, Homo Sapiens; identical to SEQ ID NO: 49646

SEQ ID NO: 360322 - RNA, 64 nt, Homo Sapiens; identical to SEQ ID NO: 49647

SEQ ID NO: 360323 - RNA, 64 nt, Homo Sapiens; identical to SEQ ID NO: 49648

SEQ ID NO: 360324 - RNA, 64 nt, Homo Sapiens; identical to SEQ ID NO: 49649

SEQ ID NO: 360325 - RNA, 64 nt, Homo Sapiens; identical to SEQ ID NO: 49650

SEQ ID NO: 360326 - RNA, 64 nt, Homo Sapiens; identical to SEQ ID NO: 49651

SEQ ID NO: 360327 - RNA, 64 nt, Homo Sapiens; identical to SEQ ID NO: 49652

SEQ ID NO: 360328 - RNA, 64 nt, Homo Sapiens; identical to SEQ ID NO: 49653

SEQ ID NO: 360329 - RNA, 64 nt, Homo Sapiens; identical to SEQ ID NO: 49654

SEQ ID NO: 360330 - RNA, 64 nt, Homo Sapiens; identical to SEQ ID NO: 49655

SEQ ID NO: 360331 - RNA, 64 nt, Homo Sapiens; identical to SEQ ID NO: 49656

SEQ ID NO: 360332 - RNA, 64 nt, Homo Sapiens; identical to SEQ ID NO: 49657

SEQ ID NO: 360333 - RNA, 64 nt, Homo Sapiens; identical to SEQ ID NO: 49658

SEQ ID NO: 360334 - RNA, 64 nt, Homo Sapiens; identical to SEQ ID NO: 49659

SEQ ID NO: 360335 - RNA, 64 nt, Homo Sapiens; identical to SEQ ID NO: 49660

SEQ ID NO: 360336 - RNA, 64 nt, Homo Sapiens; identical to SEQ ID NO: 49661

SEQ ID NO: 360337 - RNA, 64 nt, Homo Sapiens; identical to SEQ ID NO: 49662

SEQ ID NO: 360338 - RNA, 64 nt, Homo Sapiens; identical to SEQ ID NO: 49663

SEQ ID NO: 360339 - RNA, 64 nt, Homo Sapiens; identical to SEQ ID NO: 49664

SEQ ID NO: 360340 - RNA, 64 nt, Homo Sapiens; identical to SEQ ID NO: 49665

SEQ ID NO: 360341 - RNA, 64 nt, Homo Sapiens; identical to SEQ ID NO: 49666

SEQ ID NO: 360342 - RNA, 64 nt, Homo Sapiens; identical to SEQ ID NO: 49667

SEQ ID NO: 360343 - RNA, 64 nt, Homo Sapiens; identical to SEQ ID NO: 49668

SEQ ID NO: 360344 - RNA, 64 nt, Homo Sapiens; identical to SEQ ID NO: 49669

SEQ ID NO: 360345 - RNA, 64 nt, Homo Sapiens; identical to SEQ ID NO: 49670

SEQ ID NO: 360346 - RNA, 64 nt, Homo Sapiens; identical to SEQ ID NO: 49671

SEQ ID NO: 360347 - RNA, 64 nt, Homo Sapiens; identical to SEQ ID NO: 49672

SEQ ID NO: 360348 - RNA, 64 nt, Homo Sapiens; identical to SEQ ID NO: 49673

SEQ ID NO: 360349 - RNA, 64 nt, Homo Sapiens; identical to SEQ ID NO: 49674

SEQ ID NO: 360350 - RNA, 64 nt, Homo Sapiens; identical to SEQ ID NO: 49675

SEQ ID NO: 360351 - RNA, 64 nt, Homo Sapiens; identical to SEQ ID NO: 49676

SEQ ID NO: 360352 - RNA, 64 nt, Homo Sapiens; identical to SEQ ID NO: 49677

SEQ ID NO: 360353 - RNA, 64 nt, Homo Sapiens; identical to SEQ ID NO: 49678

SEQ ID NO: 360354 - RNA, 64 nt, Homo Sapiens; identical to SEQ ID NO: 49679

SEQ ID NO: 360355 - RNA, 64 nt, Homo Sapiens; identical to SEQ ID NO: 49680

SEQ ID NO: 360356 - RNA, 64 nt, Homo Sapiens; identical to SEQ ID NO: 49681

SEQ ID NO: 360357 - RNA, 64 nt, Homo Sapiens; identical to SEQ ID NO: 49682

SEQ ID NO: 360358 - RNA, 64 nt, Homo Sapiens; identical to SEQ ID NO: 49683

SEQ ID NO: 360359 - RNA, 64 nt, Homo Sapiens; identical to SEQ ID NO: 49684

SEQ ID NO: 360360 - RNA, 64 nt, Homo Sapiens; identical to SEQ ID NO: 49685

SEQ ID NO: 360361 - RNA, 64 nt, Homo Sapiens; identical to SEQ ID NO: 49686

SEQ ID NO: 360362 - RNA, 64 nt, Homo Sapiens; identical to SEQ ID NO: 49687

SEQ ID NO: 360363 - RNA, 64 nt, Homo Sapiens; identical to SEQ ID NO: 49688

SEQ ID NO: 360364 - RNA, 64 nt, Homo Sapiens; identical to SEQ ID NO: 49689

SEQ ID NO: 360365 - RNA, 64 nt, Homo Sapiens; identical to SEQ ID NO: 49690

SEQ ID NO: 360366 - RNA, 64 nt, Homo Sapiens; identical to SEQ ID NO: 49691

SEQ ID NO: 360367 - RNA, 64 nt, Homo Sapiens; identical to SEQ ID NO: 49692

SEQ ID NO: 360368 - RNA, 64 nt, Homo Sapiens; identical to SEQ ID NO: 49693

SEQ ID NO: 360369 - RNA, 64 nt, Homo Sapiens; identical to SEQ ID NO: 49694

SEQ ID NO: 360370 - RNA, 64 nt, Homo Sapiens; identical to SEQ ID NO: 49695

SEQ ID NO: 360371 - RNA, 64 nt, Homo Sapiens; identical to SEQ ID NO: 49696

SEQ ID NO: 360372 - RNA, 64 nt, Homo Sapiens; identical to SEQ ID NO: 49697

SEQ ID NO: 360373 - RNA, 64 nt, Homo Sapiens; identical to SEQ ID NO: 49698

SEQ ID NO: 360374 - RNA, 64 nt, Homo Sapiens; identical to SEQ ID NO: 49699

SEQ ID NO: 360375 - RNA, 64 nt, Homo Sapiens; identical to SEQ ID NO: 49700

SEQ ID NO: 360376 - RNA, 64 nt, Homo Sapiens; identical to SEQ ID NO: 49701

SEQ ID NO: 360377 - RNA, 64 nt, Homo Sapiens; identical to SEQ ID NO: 49702

SEQ ID NO: 360378 - RNA, 64 nt, Homo Sapiens; identical to SEQ ID NO: 49703

SEQ ID NO: 360379 - RNA, 64 nt, Homo Sapiens; identical to SEQ ID NO: 243529

SEQ ID NO: 360380 - RNA, 64 nt, Homo Sapiens; identical to SEQ ID NO: 243530

SEQ ID NO: 360381 - RNA, 64 nt, Homo Sapiens; identical to SEQ ID NO: 243531

SEQ ID NO: 360382 - RNA, 64 nt, Homo Sapiens; identical to SEQ ID NO: 243532

SEQ ID NO: 360383 - RNA, 64 nt, Homo Sapiens; identical to SEQ ID NO: 243533

SEQ ID NO: 360384 - RNA, 64 nt, Homo Sapiens; identical to SEQ ID NO: 243534

SEQ ID NO: 360385 - RNA, 64 nt, Homo Sapiens; identical to SEQ ID NO: 243535

SEQ ID NO: 360386 - RNA, 64 nt, Homo Sapiens; identical to SEQ ID NO: 243536

SEQ ID NO: 360387 - RNA, 64 nt, Homo Sapiens; identical to SEQ ID NO: 245168

SEQ ID NO: 360388 - RNA, 64 nt, Homo Sapiens; identical to SEQ ID NO: 245169

SEQ ID NO: 360389 - RNA, 64 nt, Homo Sapiens; identical to SEQ ID NO: 245170

SEQ ID NO: 360390 - RNA, 64 nt, Homo Sapiens; identical to SEQ ID NO: 245171

SEQ ID NO: 360391 - RNA, 64 nt, Homo Sapiens; identical to SEQ ID NO: 245172

SEQ ID NO: 360392 - RNA, 55 nt, Homo Sapiens; identical to SEQ ID NO: 245173

SEQ ID NO: 360393 - RNA, 64 nt, Homo Sapiens; identical to SEQ ID NO: 245174

SEQ ID NO: 360394 - RNA, 64 nt, Homo Sapiens; identical to SEQ ID NO: 245175

SEQ ID NO: 360395 - RNA, 64 nt, Homo Sapiens; identical to SEQ ID NO: 245176

SEQ ID NO: 360396 - RNA, 64 nt, Homo Sapiens; identical to SEQ ID NO: 245177

SEQ ID NO: 360397 - RNA, 64 nt, Homo Sapiens; identical to SEQ ID NO: 245178

SEQ ID NO: 360398 - RNA, 64 nt, Homo Sapiens; identical to SEQ ID NO: 245179

SEQ ID NO: 360399 - RNA, 64 nt, Homo Sapiens; identical to SEQ ID NO: 245180

SEQ ID NO: 360400 - RNA, 64 nt, Homo Sapiens; identical to SEQ ID NO: 245181

SEQ ID NO: 360401 - RNA, 64 nt, Homo Sapiens; identical to SEQ ID NO: 245182

SEQ ID NO: 360402 - RNA, 64 nt, Homo Sapiens; identical to SEQ ID NO: 245183

SEQ ID NO: 360403 - RNA, 64 nt, Homo Sapiens; identical to SEQ ID NO: 245184

SEQ ID NO: 360404 - RNA, 64 nt, Homo Sapiens; identical to SEQ ID NO: 245185

SEQ ID NO: 360405 - RNA, 64 nt, Homo Sapiens; identical to SEQ ID NO: 245186

SEQ ID NO: 360406 - RNA, 64 nt, Homo Sapiens; identical to SEQ ID NO: 245187

SEQ ID NO: 360407 - RNA, 64 nt, Homo Sapiens; identical to SEQ ID NO: 245188

SEQ ID NO: 360408 - RNA, 62 nt, Homo Sapiens; identical to SEQ ID NO: 245189

SEQ ID NO: 360409 - RNA, 64 nt, Homo Sapiens; identical to SEQ ID NO: 245190

SEQ ID NO: 360410 - RNA, 64 nt, Homo Sapiens; identical to SEQ ID NO: 245191

SEQ ID NO: 360411 - RNA, 64 nt, Homo Sapiens; identical to SEQ ID NO: 245192

SEQ ID NO: 360412 - RNA, 64 nt, Homo Sapiens; identical to SEQ ID NO: 245193

SEQ ID NO: 360413 - RNA, 64 nt, Homo Sapiens; identical to SEQ ID NO: 245194

SEQ ID NO: 360414 - RNA, 64 nt, Homo Sapiens; identical to SEQ ID NO: 245195

SEQ ID NO: 360415 - RNA, 64 nt, Homo Sapiens; identical to SEQ ID NO: 245196

SEQ ID NO: 360416 - RNA, 64 nt, Homo Sapiens; identical to SEQ ID NO: 245197

SEQ ID NO: 360417 - RNA, 64 nt, Homo Sapiens; identical to SEQ ID NO: 245198

SEQ ID NO: 360418 - RNA, 64 nt, Homo Sapiens; identical to SEQ ID NO: 245199

SEQ ID NO: 360419 - RNA, 64 nt, Homo Sapiens; identical to SEQ ID NO: 245200

SEQ ID NO: 360420 - RNA, 64 nt, Homo Sapiens; identical to SEQ ID NO: 245201

SEQ ID NO: 360421 - RNA, 64 nt, Homo Sapiens; identical to SEQ ID NO: 245202

SEQ ID NO: 360422 - RNA, 64 nt, Homo Sapiens; identical to SEQ ID NO: 245203

SEQ ID NO: 360423 - RNA, 64 nt, Homo Sapiens; identical to SEQ ID NO: 245204

SEQ ID NO: 360424 - RNA, 64 nt, Homo Sapiens; identical to SEQ ID NO: 245205

SEQ ID NO: 360425 - RNA, 64 nt, Homo Sapiens; identical to SEQ ID NO: 245206

SEQ ID NO: 360426 - RNA, 64 nt, Homo Sapiens; identical to SEQ ID NO: 245207

SEQ ID NO: 360427 - RNA, 64 nt, Homo Sapiens; identical to SEQ ID NO: 245208

SEQ ID NO: 360428 - RNA, 64 nt, Homo Sapiens; identical to SEQ ID NO: 245209

SEQ ID NO: 360429 - RNA, 64 nt, Homo Sapiens; identical to SEQ ID NO: 245210

SEQ ID NO: 360430 - RNA, 64 nt, Homo Sapiens; identical to SEQ ID NO: 245211

SEQ ID NO: 360431 - RNA, 64 nt, Homo Sapiens; identical to SEQ ID NO: 147960

SEQ ID NO: 360432 - RNA, 64 nt, Homo Sapiens; identical to SEQ ID NO: 147961

SEQ ID NO: 360433 - RNA, 64 nt, Homo Sapiens; identical to SEQ ID NO: 147962

SEQ ID NO: 360434 - RNA, 64 nt, Homo Sapiens; identical to SEQ ID NO: 147963

SEQ ID NO: 360435 - RNA, 62 nt, Homo Sapiens
cccacucuuccccgccucaccaugcccaggcagccacagaaagggguuaggcuucaugccuu

SEQ ID NO: 360436 - RNA, 62 nt, Homo Sapiens
augggguuaggcuucaugccgggcugguccaggccacagaggcgaaguuggagaaccugaca

SEQ ID NO: 360437 - RNA, 62 nt, Homo Sapiens
caagugacgacaaagauucuguuucaaauauagccacagaaauaaaggagggaccaauaucu

SEQ ID NO: 360438 - RNA, 62 nt, Homo Sapiens
caagugacgagaaagauucuguuucaaauauagccacagaaauaaagaagggacaacaaucu

SEQ ID NO: 360439 - RNA, 62 nt, Homo Sapiens
caacugacgaggaagacucuguuucgaauauagccacagaaauaaaggauggagaaaaaucu

SEQ ID NO: 360440 - RNA, 62 nt, Homo Sapiens
caacugaugagaaagauucuguuucgaacauagccacagaaauaaaggauggagaaaaaucu

SEQ ID NO: 360441 - RNA, 62 nt, Homo Sapiens
cuaagauucuguauccucuggaguucagccuagccacagagugccacagagucugagauucu

SEQ ID NO: 360442 - RNA, 62 nt, Homo Sapiens
cugagauucugaguucagccaaugucagccuagccacagaguuuucaaagccacagcauaag

SEQ ID NO: 360443 - RNA, 62 nt, Homo Sapiens
uaagugaccucagguaacauacagaguugaaagccacagaguaagccacagaguugaaagcc

SEQ ID NO: 360444 - RNA, 62 nt, Homo Sapiens
ugaaagccacagaguuaaguacagaguugaaagccacagagucgccaucuuacacgaaagcc

SEQ ID NO: 360445 - RNA, 62 nt, Homo Sapiens
ugaaagccacagaguugaaaucuuacacgaaagccacagaguuccauggcccuauaccgcca

SEQ ID NO: 360446 - RNA, 62 nt, Homo Sapiens
caccucuuuuacaguuagaaacaccagccgaggccacagaaucccaucccuuuccugaguca

SEQ ID NO: 360447 - RNA, 62 nt, Homo Sapiens
cauugucucaauucaaauccauagauuucgaagccacagagucucucccuggagcagcagac

SEQ ID NO: 360448 - RNA, 62 nt, Homo Sapiens
caccucaggauauucuuuuccugaauacccuggccacagagccagaauggagcuuagugcua

SEQ ID NO: 360449 - RNA, 62 nt, Homo Sapiens
uaucaaaaauggugacaucagaguauugagaagccacagaaaauaauuuacaaaaaucaaau

SEQ ID NO: 360450 - RNA, 62 nt, Homo Sapiens
gaagagacaguagucugcauacaucgcugcaggccacagagcagcuuggguuggaagagaga

SEQ ID NO: 360451 - RNA, 62 nt, Homo Sapiens
uacuagugaaucacccacaaggaaaagccacugccacagaggaggcggguccccuugugcgg

SEQ ID NO: 360452 - RNA, 62 nt, Homo Sapiens
gaaucaccccucugccccugcagcuggaaugugccacagaggccccaccugaaggguggaug

SEQ ID NO: 360453 - RNA, 62 nt, Homo Sapiens
acugggccagucaacggggggcuccugcccaggccacagagaaccugaguucccgggagcug

SEQ ID NO: 360454 - RNA, 62 nt, Homo Sapiens
aagaaagcauuugaucugacggugacuucugggccacagaucuugggagguguuaacucaaa

SEQ ID NO: 360455 - RNA, 62 nt, Homo Sapiens
gcucaagaauccagcccuaauucuuaauauccgccacagaagaaagcaagcacaacuaaacc

SEQ ID NO: 360456 - RNA, 62 nt, Homo Sapiens
cacaccauuacauacacagacagccccuccccgccacagagacacagacacacaaucacacg

SEQ ID NO: 360457 - RNA, 62 nt, Homo Sapiens
cacaccauuacacacacauauacgcccuuccggccacagaaacacagacacgcaaucgcaga

SEQ ID NO: 360458 - RNA, 62 nt, Homo Sapiens
cacaccauuacauacacagacacacccuccccgccacagagacacagacacaaaaucacaca

SEQ ID NO: 360459 - RNA, 62 nt, Homo Sapiens
caccauuacauacacagacacacacccuccccgccacagagacacagacacaaaaucacaca

SEQ ID NO: 360460 - RNA, 62 nt, Homo Sapiens
gagacacggucacugauucacacccagucccugccacagaccgucucagacacgcacagugg

SEQ ID NO: 360461 - RNA, 62 nt, Homo Sapiens
ugggccugcugcaugauucacacccagucccugccacagaccgucucagacacgcacagugg

SEQ ID NO: 360462 - RNA, 62 nt, Homo Sapiens; identical to SEQ ID NO: 360461

SEQ ID NO: 360463 - RNA, 62 nt, Homo Sapiens
gaaccuuugaggccuguaaacaugggcuuugggccacagaauccuuuagaucccuuccccuc

SEQ ID NO: 360464 - RNA, 62 nt, Homo Sapiens
gggggaugauugaauuguucugggggaguguggccacagaccguacuucaguuuggaucuau

SEQ ID NO: 360465 - RNA, 60 nt, Homo Sapiens; identical to SEQ ID NO: 315780

SEQ ID NO: 360466 - RNA, 62 nt, Homo Sapiens
cucugugcagccucacagggcuuugccacggagccacagagagaugcuggguccccgaggcc

SEQ ID NO: 360467 - RNA, 62 nt, Homo Sapiens
ccugccccgaguggacucugggcagguuccaagccacagacgccccccagugccuuggcgag

SEQ ID NO: 360468 - RNA, 62 nt, Homo Sapiens
cucaccgugccugaguggcagcggcugguggugccacagagcgccacucucugcccugccau

SEQ ID NO: 360469 - RNA, 62 nt, Homo Sapiens
gcugcccccaccacacacacgggacagcacaggccacagaggcaggaagccaggcaaggaga

SEQ ID NO: 360470 - RNA, 62 nt, Homo Sapiens
cccuuccuuacuuguuggggcccauccccagggccacagaucagauucucugagcacuuucc

SEQ ID NO: 360471 - RNA, 62 nt, Homo Sapiens
cacagguagccccgacccucucaggcauuccagccacagaacaucaaagugagcgaguacug

SEQ ID NO: 360472 - RNA, 62 nt, Homo Sapiens
gcaccuccgguuggaggcacccaggcuugccagccacagagcgccccaaagucaccgucauc

SEQ ID NO: 360473 - RNA, 64 nt, Homo Sapiens
gauuuuucuucaggaacuucucaagauacguagaacaccucagaacuaauugauaauugaagua

SEQ ID NO: 360474 - RNA, 64 nt, Homo Sapiens
gauuauaauagaaaaagaaaaacuuaaaaacucaacaccucacaugauuaaaggccauuuuuaa

SEQ ID NO: 360475 - RNA, 64 nt, Homo Sapiens
caucuauuuugaugcagcauuugauaaugauaaaacaccucacaccucacucuuuauagugcac

SEQ ID NO: 360476 - RNA, 64 nt, Homo Sapiens
uuugaugcagcauuugauaaugauaaaacaccucacaccucacucuuuauagugcacaaaauga

SEQ ID NO: 360477 - RNA, 64 nt, Homo Sapiens
agaacccacgcacaugcacaccacaacacacaacacaccucaccucacaccacagcacaccuca

SEQ ID NO: 360478 - RNA, 64 nt, Homo Sapiens
acaacacacaacacaccucaccucacaccacagcacaccucaccacaccacaccgcacugcacc

SEQ ID NO: 360479 - RNA, 64 nt, Homo Sapiens
caccauaccucaccacaucucaccacaccacagcacaccucaccacacaacacaccacacccca

SEQ ID NO: 360480 - RNA, 64 nt, Homo Sapiens
uaccucgccacaucucaccacaccacaccacaccacaccucacugcccacacacggcgcaggcu

SEQ ID NO: 360481 - RNA, 64 nt, Homo Sapiens
cuuagacucuggccucaaaaaaccaacccugcugacaccucaauacuaagggggccucagagga

SEQ ID NO: 360482 - RNA, 64 nt, Homo Sapiens
ccuucugaagcagcccauugcgucaggcugaccaacaccucagacagaaccauggaagccagga

SEQ ID NO: 360483 - RNA, 64 nt, Homo Sapiens
uugacauauugaaaaaguauaugaacauaaugaaacaccucauuuauuugauaauucacuaaug

SEQ ID NO: 360484 - RNA, 64 nt, Homo Sapiens
caaaguacucaggcacacagcccacugacaagagacaccucauccauuaacugcuguuuuguac

SEQ ID NO: 360485 - RNA, 64 nt, Homo Sapiens
gagcugagauugcgccacugaaccugggaggcagagcuugcaguugaggcaggagaauggcaug

SEQ ID NO: 360486 - RNA, 64 nt, Homo Sapiens
cucuccggagcaucucagcaugcagcagacgcagagcuugcauugcgggagcucgcccugcgcc

SEQ ID NO: 360487 - RNA, 64 nt, Homo Sapiens
gagccgagauagugucacugaauccgggaggcggagcuugcaggugaggcaggagaauggcgug

SEQ ID NO: 360488 - RNA, 64 nt, Homo Sapiens
agggcauguguauguacaguccaguguuuaucuuagcuugcaucgauuugauaagggccacauc

SEQ ID NO: 360489 - RNA, 64 nt, Homo Sapiens
uuugugaaggcuaacugaagauuagcuccuuuaaagcuugcaucucuccuucucauuguuucua

SEQ ID NO: 360490 - RNA, 64 nt, Homo Sapiens
uccagcaagcaaagauuuuuuugcagggaagccaagcuugcaguagcuccagaaccuauugagc

SEQ ID NO: 360491 - RNA, 64 nt, Homo Sapiens
gaagccaagcuugcaguuccuccagaaccuauugagcuugcagggagcgacaugguaaaugagc

SEQ ID NO: 360492 - RNA, 64 nt, Homo Sapiens
ugaggcaggagaauggugugaaccugggagguggagcuugcagugagcagagcuugcagugaga

SEQ ID NO: 360493 - RNA, 64 nt, Homo Sapiens
ugugaaccugggagguggagcuugcagugagcagagcuugcagugagacgagcuugugccacug

SEQ ID NO: 360494 - RNA, 64 nt, Homo Sapiens
ggagcaagcuaguagaaauagcucaggguuggccagcuugcagaaaauagccuggggugucugg

SEQ ID NO: 360495 - RNA, 51 nt, Homo Sapiens
gguuucuucagugccuuacagagcuugcaucugcaugucuuccgguccuga

SEQ ID NO: 360496 - RNA, 64 nt, Homo Sapiens
gagccgagauugcgccacugaacccaggaggcggagcuugcaguuaagaauauucacaacauug

SEQ ID NO: 360497 - RNA, 64 nt, Homo Sapiens
uuuugaaaauuugaauaagggggaagucaccuaaagcuugcaugaggggauggggccuuuucca

SEQ ID NO: 360498 - RNA, 64 nt, Homo Sapiens
aagugacuuauauuccaaagugauucuauuuuuuagcuugcaaaaggacuagaucaccuuaguu

SEQ ID NO: 360499 - RNA, 64 nt, Homo Sapiens
uguuuaagaaaauaauggcccuaaggaauucugcagcuugcagagcagaaacuauagcugagga

SEQ ID NO: 360500 - RNA, 64 nt, Homo Sapiens
uauucuguuaaauguauagucaugaauguauuacagcuugcagcacuuuaugucuugcuuugga

SEQ ID NO: 360501 - RNA, 64 nt, Homo Sapiens
uuuaugucuugcuuuggacaaauugaacaugugaagcuugcaacgugcauauauaucuuacccu

SEQ ID NO: 360502 - RNA, 64 nt, Homo Sapiens
caccacaccucuacggcuggggagaucaggcccagccccauaaaggagaaucuacgcugguccu

SEQ ID NO: 360503 - RNA, 64 nt, Homo Sapiens
auaggguagcguuuuguuguuguuguuuuuucaugccccauacuacugaauaaacuaguucugu

SEQ ID NO: 360504 - RNA, 64 nt, Homo Sapiens
uucuuggugcccucuucggcagccaagggugaaggccccauagaggagaggauccaaaggagca

SEQ ID NO: 360505 - RNA, 64 nt, Homo Sapiens
gaacuugauuuuuauuuguuacagguuuccaauggccccauaggaauaagcaauaauguagacu

SEQ ID NO: 360506 - RNA, 64 nt, Homo Sapiens
gaacauguuaaaaaaaaaaauaacauuuagcccugccccauauggugacuaugggcgcacugcc

SEQ ID NO: 360507 - RNA, 64 nt, Homo Sapiens
ugugaauucugcaacuagcccugcuguugccauagccccauaugagacccugagacuccagaau

SEQ ID NO: 360508 - RNA, 64 nt, Homo Sapiens
acuuucaaccuugugguuggagucuuaauguucugccccauaaguauuuucauauuuauaaagg

SEQ ID NO: 360509 - RNA, 64 nt, Homo Sapiens
caucagcccuguagagugaggaaucgacauaguagccccauaagcuuagcugguaaaugaauuu

SEQ ID NO: 360510 - RNA, 64 nt, Homo Sapiens
gaaacccugcgugucuguuguuugucugucgguggccccauaugagugcuucccacuuaccuga

SEQ ID NO: 360511 - RNA, 64 nt, Homo Sapiens
cgucacagaagcaaaccgugccuucuggcucugcgccccauauucccagcaucauagacaucca

SEQ ID NO: 360512 - RNA, 64 nt, Homo Sapiens
acuuguaaaaauuaaaaguuaugguacuauguuagccccauaauuuuuuuuuuccuuuuaaaac

SEQ ID NO: 360513 - RNA, 64 nt, Homo Sapiens
ucauggcccgaggacaagggcuguaagacagggagccccauaggccaucaucauccuuauccca

SEQ ID NO: 360514 - RNA, 64 nt, Homo Sapiens
gcauaggaacaguaaagccaggcugaaaaugaaggccccauagugauguugauuuggaaacaug

SEQ ID NO: 360515 - RNA, 64 nt, Homo Sapiens
gagccuggacugaaaguaucguggauuccugcaggccccauacuuuauagacuguauuuaucua

SEQ ID NO: 360516 - RNA, 64 nt, Homo Sapiens
caauuuuuacauuucuaauagaaauauaaugugagccccauauauaggacagagcuguccaaua

SEQ ID NO: 360517 - RNA, 64 nt, Homo Sapiens
cccuaacuggacaaaugagguauacguaacccaagccccauaacaaguggauuuaaaauauaua

SEQ ID NO: 360518 - RNA, 64 nt, Homo Sapiens
aacucuauccaaaacauuuuuggagcauuuuaaagccccauacacagaaguauacgaaagcaca

SEQ ID NO: 360519 - RNA, 64 nt, Homo Sapiens
agcggauggaccagauuccucuggcuaacguauggccccauaggucacugggucauacagagag

SEQ ID NO: 360520 - RNA, 64 nt, Homo Sapiens
gcagggggcuggaaggcaccaggccucaggaggagccccauagucccgccugcagccuguaacc

SEQ ID NO: 360521 - RNA, 64 nt, Homo Sapiens
aagagguguccugcugcuguuaccagccaugugggccccauaggggcacugcgccugcugcccu

SEQ ID NO: 360522 - RNA, 64 nt, Homo Sapiens
aucccugaccauaagccugagccccucccucccagccccauauucacacacaucccagccccug

SEQ ID NO: 360523 - RNA, 64 nt, Homo Sapiens
cacagaacaccuggacaccgugcuaugucugggugccccauagugucacugcuguggcgagucu

SEQ ID NO: 360524 - RNA, 64 nt, Homo Sapiens
gcucaggaggcagcaucugggacacggcagaucagccccauaguuccaucgugcccugaggccu

SEQ ID NO: 360525 - RNA, 64 nt, Homo Sapiens
uccauaucugcaauguguaccaaaguuauaucaugccccauaaugcuacugucaaguguuacaa

SEQ ID NO: 360526 - RNA, 64 nt, Homo Sapiens
auaguugggaaccucauuagaaaugaccucagcugccccauaucuacguuccuuucagcaguug

SEQ ID NO: 360527 - RNA, 64 nt, Homo Sapiens
uauaaaugugaaauuauauucucucacaccaagggccccauaguaaaaagaauaggcuacaguu

SEQ ID NO: 360528 - RNA, 64 nt, Homo Sapiens
ugcuucuuucaguauuauccgcuagaaaucuugugccccauaugaaagcauuaagcuuuaaagu

SEQ ID NO: 360529 - RNA, 64 nt, Homo Sapiens
agaagucccgggaagguaaauggcucuugcgaaugccccauagcuuuauucaaagcugagucag

SEQ ID NO: 360530 - RNA, 64 nt, Homo Sapiens
aaugcugacgacuaagcaccagccuccacucccugccccauagugaguaucccuccucugugug

SEQ ID NO: 360531 - RNA, 64 nt, Homo Sapiens
augaugucguggccuccauucucguuucuaugcagccccauaguccaaggacacccaguccaca

SEQ ID NO: 360532 - RNA, 64 nt, Homo Sapiens
aagaauuggaagccugcuuaaaaaauguaguugagccccauaauuuuacaaaugggcgaacuuu

SEQ ID NO: 360533 - RNA, 64 nt, Homo Sapiens
aacaaauugcauuugugggauguuagaagagguggccccauauugccaaauuuuagauuuaccu

SEQ ID NO: 360534 - RNA, 64 nt, Homo Sapiens
uaaaggaucaggaugauggucacuugaguuuauugccccauaacggcuggcacuuuacucauug

SEQ ID NO: 360535 - RNA, 64 nt, Homo Sapiens
ucuggauguuucaagccaaggcucggcuauucccgccccauaguaaauuuccuuuucccuggaa

SEQ ID NO: 360536 - RNA, 64 nt, Homo Sapiens
uggaggcugggccaggaggcagccuccgaaccaugccccauauaacgcuugggugcgugggagg

SEQ ID NO: 360537 - RNA, 64 nt, Homo Sapiens
acuucucccugccucguuccuuauauucacagaagccccauaguuucacuggguugcgguuauu

SEQ ID NO: 360538 - RNA, 64 nt, Homo Sapiens
gcugagcaggcggguguccccguccucccucacugccccauaugugucccuccuaaagcugcau

SEQ ID NO: 360539 - RNA, 64 nt, Homo Sapiens
uguuuguauuuucugcauauucucuggcaaccuugccccauacuuacuuauuuagcauagucga

SEQ ID NO: 360540 - RNA, 64 nt, Homo Sapiens
uuuuuccuuucuacacauaggguguuccugaaaagccccauagugauugagucuucaaaaccac

SEQ ID NO: 360541 - RNA, 64 nt, Homo Sapiens
caaacauaagcuagcuagucucccccacucccuugccccauaacgccagaaaggacagaaucuc

SEQ ID NO: 360542 - RNA, 64 nt, Homo Sapiens
ggccucuuuugggcccucucggggcgcggccccugccccauacucugcccggcguaggcccuga

SEQ ID NO: 360543 - RNA, 64 nt, Homo Sapiens
cuaaacacauuuagcugcuuuuuuaacaaacucagccccauacuugagucccuuguuguuggga

SEQ ID NO: 360544 - RNA, 64 nt, Homo Sapiens
gccccauggccccucuccacaccucaaaacuccugccccauaacguccuccgcauccacuuucc

SEQ ID NO: 360545 - RNA, 64 nt, Homo Sapiens
aaaaguuaaaacaaaacauggaugucugggucccgccccauagagaaugacuuaauuggcaugg

SEQ ID NO: 360546 - RNA, 64 nt, Homo Sapiens
aguggccccucuuugcuggcuggcugccucugcugccccauaccccacacacucaucagccuga

SEQ ID NO: 360547 - RNA, 56 nt, Homo Sapiens
cagagccccagggcagacagggaagggccccauagggccugcaggaccaccuguag

SEQ ID NO: 360548 - RNA, 64 nt, Homo Sapiens
cacacugccugccugauaccuggggcccaagagagccccauaugauuuaggccaucacauaugg

SEQ ID NO: 360549 - RNA, 64 nt, Homo Sapiens
ugggccgggggcagcacggcgcguccaugccaaggccccauaccuugcuggagguggaggaagg

SEQ ID NO: 360550 - RNA, 64 nt, Homo Sapiens
augucauauugaggcccaaacugacaguggcggugccccauaggaauggcaauuagagaaagga

SEQ ID NO: 360551 - RNA, 64 nt, Homo Sapiens
aaaagaacucauucauaggauagaccuccuaaaugccccauauuugcugucagacgauuguucu

SEQ ID NO: 360552 - RNA, 64 nt, Homo Sapiens
ccuuuccccucaccuuaaaggagacuaccccuuugccccauauugucaaccuaauuuucucucg

SEQ ID NO: 360553 - RNA, 64 nt, Homo Sapiens
cacgucuguugccgcacacauuccucucagcuccgccccauacccgucacuacagccucaccuc

SEQ ID NO: 360554 - RNA, 64 nt, Homo Sapiens
cccugagugccucccuugccucacucugauccuggccccauaauguccucaguggaaggugaug

SEQ ID NO: 360555 - RNA, 64 nt, Homo Sapiens
ggcuggcggcuuccuccgaccgggcuuggagcuggccccauaaggaccaaugccgcgguggaaa

SEQ ID NO: 360556 - RNA, 64 nt, Homo Sapiens
gcuuuucuaccuguaacaugcaaccaaaaggagugccccauaugacaggcaaucaaggccugag

SEQ ID NO: 360557 - RNA, 64 nt, Homo Sapiens
augaagucucaggguauauggugcauaaaggcaagccccauauacuauguauuuuaacucauua

SEQ ID NO: 360558 - RNA, 64 nt, Homo Sapiens
gguccauccuccuaggaugaaggaguauagggaggccccauauaugauccuagccaggcaccuu

SEQ ID NO: 360559 - RNA, 64 nt, Homo Sapiens
uuagaaaauguaaaaaugguggccugcugaggcugccccauauucaagacaggauacuacaggu

SEQ ID NO: 360560 - RNA, 64 nt, Homo Sapiens
acagagcuuuuaacuggugcgcccccuacaaggggccccauacgccugaaugugugccuuaaag

SEQ ID NO: 360561 - RNA, 64 nt, Homo Sapiens
aaguugaauuguuuucugccuacaccguucaucagccccauaacccaggaaggaacaggcauug

SEQ ID NO: 360562 - RNA, 64 nt, Homo Sapiens
cuacacguuagauuugccguaccaaucucugaaugccccauaauuauuauuuccaguguuuggg

SEQ ID NO: 360563 - RNA, 64 nt, Homo Sapiens
auguaugaaaaugguguacuguauacuuuaacaugccccauacuuuguauuggagaguacaaua

SEQ ID NO: 360564 - RNA, 64 nt, Homo Sapiens
gauaguguaugcauauguauauguacauagggaagccccauauguauauaguauguuguacacu

SEQ ID NO: 360565 - RNA, 64 nt, Homo Sapiens
ucuuuaaaucucuuuaaugagugaauccaugcaagccccauaaaacaguuccuagcaugcagaa

SEQ ID NO: 360566 - RNA, 64 nt, Homo Sapiens
ucgugcauuuaugaugcuaaaacagaucccuucugccccauauuccgucuuggcaaaauagugg

SEQ ID NO: 360567 - RNA, 64 nt, Homo Sapiens
cacauguaauaaauaaaacaauaugagcauaauugccccauaaagaacucauguccugaauuaa

SEQ ID NO: 360568 - RNA, 64 nt, Homo Sapiens
ccucaggagucaucccagaaggaaccauuaugcggccccauaggguacacgugguguugggacu

SEQ ID NO: 360569 - RNA, 64 nt, Homo Sapiens
cauccugauugcugauagugucuaaacgguccuugccccauagcguccugugacuugguaacau

SEQ ID NO: 360570 - RNA, 64 nt, Homo Sapiens
uguucuaguuagaaaggguuugaaacauuuggaagccccauaauaggguccacgcccauguacc

SEQ ID NO: 360571 - RNA, 64 nt, Homo Sapiens
gaggccaagccccggaccauccacagccccccacgccccauaggagccgccgccucugcaugua

SEQ ID NO: 360572 - RNA, 64 nt, Homo Sapiens
uaaauucauauuuagccauaguauaugauagauugccccauaacauaguuuuucaucaagaguu

SEQ ID NO: 360573 - RNA, 64 nt, Homo Sapiens
ggccccacccagacuuaacagggcacguggacaugccccauaggagggcaaugagucugguggg

SEQ ID NO: 360574 - RNA, 64 nt, Homo Sapiens
uugggaaauuaucugccuuauacuccuccagugagccccauauucuguuuauucuguuucaccc

SEQ ID NO: 360575 - RNA, 64 nt, Homo Sapiens
uaacaauacacgugaugaugggcaccacacauuugccccauagaaugagguauauuuuauucug

SEQ ID NO: 360576 - RNA, 64 nt, Homo Sapiens
auuaugaaccuuuuugcaacuguuaguuccaucagccccauaaaugcagaggaugagaggaagg

SEQ ID NO: 360577 - RNA, 64 nt, Homo Sapiens
gccucugagccuccccugugccuugggcccugaagccccauauguaguauagagcaaagguggc

SEQ ID NO: 360578 - RNA, 62 nt, Homo Sapiens
ccuuuuccucaccccaguagauccaaccuccagccccauauagggugaaccucuugauaagc

SEQ ID NO: 360579 - RNA, 64 nt, Homo Sapiens
caaagauccccuucagcccccugccagagucacugccccauaaucaccaugucagaagggaccc

SEQ ID NO: 360580 - RNA, 64 nt, Homo Sapiens
uaauccauucuugacauucaguuaguccagaucugccccauaauuugcuuuaguaaagucacuu

SEQ ID NO: 360581 - RNA, 64 nt, Homo Sapiens
acacacacaugagcaggguguuaccgggugauaggccccauaagcccagcauccuaggcucagc

SEQ ID NO: 360582 - RNA, 64 nt, Homo Sapiens
ugguauuggcauuugaggucggaaacccucuacugccccauaagccaggaaaagugaaaagaga

SEQ ID NO: 360583 - RNA, 64 nt, Homo Sapiens
gccuggacuuggggagaaugacuuucccuuuuuugccccauaagggcuagcauaagcugaggua

SEQ ID NO: 360584 - RNA, 64 nt, Homo Sapiens
gccaaaaagaacacccaucguauaaggaaauccagccccauagaaaacaaucugcccaccgacc

SEQ ID NO: 360585 - RNA, 64 nt, Homo Sapiens
gguccagcccugaugauuggccccaccuccugcugccccauaacccucucuucauuucggcuuu

SEQ ID NO: 360586 - RNA, 64 nt, Homo Sapiens
ucacuggaugcagaaguacccauucaucacaccugccccauagcccccacucugcuguacugau

SEQ ID NO: 360587 - RNA, 64 nt, Homo Sapiens
gagcaaaauugugaucuuuccuaggaguuugaaugccccauauuuguguccucgccagcucuuu

SEQ ID NO: 360588 - RNA, 64 nt, Homo Sapiens
uagguggcaccugccaauagcuuugucaaucacagccccauaggaacgucuggaauugcuuggg

SEQ ID NO: 360589 - RNA, 64 nt, Homo Sapiens
uuccacgcuucaggaaguuguuagugucucacuggccccauaaauaugugagaguugugaaauu

SEQ ID NO: 360590 - RNA, 64 nt, Homo Sapiens
caccucucuugcccaaggugcccacucugcgggagccccauagcaagggguggggaugcaggac

SEQ ID NO: 360591 - RNA, 64 nt, Homo Sapiens
acucuugauuuuuccuguccuugacccauuaagagccccauagaugaucuuugcccucuggguc

SEQ ID NO: 360592 - RNA, 64 nt, Homo Sapiens
gagugucauguuagcugaguugcacaucacuccagccccauaaacagucaucccccgugguguc

SEQ ID NO: 360593 - RNA, 64 nt, Homo Sapiens
ggugcgggcacuggacccccgagcccagucccgggccccauaguggguuggaggucuggacagg

SEQ ID NO: 360594 - RNA, 64 nt, Homo Sapiens
gggcagcccuggaggaacaauguucccuguaacugccccauagugccagaagcguugcugagug

SEQ ID NO: 360595 - RNA, 64 nt, Homo Sapiens
agcaguagcuuuugaaacucguacucuacagauugccccauaagccacaaauuuugugaguuua

SEQ ID NO: 360596 - RNA, 64 nt, Homo Sapiens
gaugaugcucagcuguggggcgggccucuaagaugccccauacuuugggggucucagaaaugga

SEQ ID NO: 360597 - RNA, 64 nt, Homo Sapiens
caugugccaaaucccuggcaggcagauggcuccugccccauauucuugccgugucuuggaaaag

SEQ ID NO: 360598 - RNA, 64 nt, Homo Sapiens
cucuggaacugugcguucugcugggugggcaguggccccauagcuccuggcccugccccuaggu

SEQ ID NO: 360599 - RNA, 64 nt, Homo Sapiens
ccccaauacuguaaagcagauauucccagggggugccccauauuacagcaugaauugggucccu

SEQ ID NO: 360600 - RNA, 64 nt, Homo Sapiens
uucucucucuccuugccccccucccgcccuccccgccccauaccuuuucuuccccuggauuuuc

SEQ ID NO: 360601 - RNA, 64 nt, Homo Sapiens
uugucauucuuagcccccuacuguggcccccauagccccauaacccagagagggagcuggacuu

SEQ ID NO: 360602 - RNA, 64 nt, Homo Sapiens
cggaaggaggaacgcugcacccagagagggugcugccccauaccuagcucauaagacccucauu

SEQ ID NO: 360603 - RNA, 64 nt, Homo Sapiens
gaaggaacugaggccuggguugagcuguucuucugccccauacuugagcaagggcagggguccc

SEQ ID NO: 360604 - RNA, 64 nt, Homo Sapiens
aaauuguaauuuuauacugcugugaaucccccuggccccauaauuuaauguuuuuaaggauggu

SEQ ID NO: 360605 - RNA, 64 nt, Homo Sapiens
gaagucuaaaugccuguagacacccggugguguggccccauagcgacuuccaagaguuacuguc

SEQ ID NO: 360606 - RNA, 64 nt, Homo Sapiens
aaauucuccuugaagaccuucucccuuuuauguggccccauauuuuauguugcuuuaucuuuga

SEQ ID NO: 360607 - RNA, 64 nt, Homo Sapiens
gagagcuuucacacagugagaaauagagcaggcugccccauaaauggguaacauauuccuaauc

SEQ ID NO: 360608 - RNA, 64 nt, Homo Sapiens
agaaacuuccaaggaugacccaaccuuugccuuugccccauauauuggggaaaacccauacacc

SEQ ID NO: 360609 - RNA, 64 nt, Homo Sapiens
cacuccuauaccacccuuguaacccaguagacuugccccauaugccccaacucauagcaccuaa

SEQ ID NO: 360610 - RNA, 64 nt, Homo Sapiens
caguauuugccaaauuacauuguuuuuucccuuugccccauaauaauauucaaauuauagaaca

SEQ ID NO: 360611 - RNA, 64 nt, Homo Sapiens
aggagcugacacguccucuccuggucgcgcucuucagucccacggcuccccgcccacccucugc

SEQ ID NO: 360612 - RNA, 64 nt, Homo Sapiens
gguccacgauguacaaagucgccauccguucucccagucccaagcugcuuucgaagacucugcu

SEQ ID NO: 360613 - RNA, 64 nt, Homo Sapiens
uuugauauuucuuauauacuuuuggaauauguuacagucccacaaagaaauggauuguuggugc

SEQ ID NO: 360614 - RNA, 64 nt, Homo Sapiens
aaauggauuguuggugcuuuuugcuguuuacaugcagucccaaguucaugaauuugugaugucu

SEQ ID NO: 360615 - RNA, 64 nt, Homo Sapiens
ucgccccucugugccuaugccuuaccagcugggucagucccaucuuggggcuggcgggcggcgg

SEQ ID NO: 360616 - RNA, 64 nt, Homo Sapiens
agcaaccgccccuuccccaaagauucauggagaccagucccagucccugaacgccuccgcaggc

SEQ ID NO: 360617 - RNA, 64 nt, Homo Sapiens
cuccugugagcaccgagaagaacugggcgacucccagucccaccugugcugugacagucccacg

SEQ ID NO: 360618 - RNA, 64 nt, Homo Sapiens
aacugggcgacucccagucccaccugugcugugacagucccacguggcuaugacagacuguuua

SEQ ID NO: 360619 - RNA, 64 nt, Homo Sapiens
aggcagggcccaguccaggggccccaggccuccccagucccagugugcgagccccacuuggaca

SEQ ID NO: 360620 - RNA, 64 nt, Homo Sapiens
ugaggacaugccucccaccaaauguccccugcuccagucccacuccugucaccccacgcucugc

SEQ ID NO: 360621 - RNA, 64 nt, Homo Sapiens
ucccucucucucccaggucccagccccuuuuccccagucccagacaauuccauucaaucuuugg

SEQ ID NO: 360622 - RNA, 64 nt, Homo Sapiens
ccaggaaagguuuuccuuauuuugugugcuuucccagucccauuccucagcuucuucacaggca

SEQ ID NO: 360623 - RNA, 64 nt, Homo Sapiens
gccccagccgcuuggcgaugccagccaagcucugcagucccagcggugggaccuagggaggcau

SEQ ID NO: 360624 - RNA, 64 nt, Homo Sapiens
ugaggcgagaagggcugcuucccugaagcucccacagucccaucugcuucaggcccccgccuug

SEQ ID NO: 360625 - RNA, 64 nt, Homo Sapiens
cuguggccaggccuuacaucacacugugcagacccagucccacaggacccuguccugcaguccc

SEQ ID NO: 360626 - RNA, 64 nt, Homo Sapiens
cugugcagacccagucccacaggacccuguccugcagucccacacuccuggcagggccaccugc

SEQ ID NO: 360627 - RNA, 64 nt, Homo Sapiens
cacccacucaugcuguuccugaggccgcccucuccagucccaggagccgugucuagaguuccug

SEQ ID NO: 360628 - RNA, 64 nt, Homo Sapiens
gcaccgugguggaggaagucacccagcuguuucucagucccagaggccgguggcugguuuugaa

SEQ ID NO: 360629 - RNA, 64 nt, Homo Sapiens
ugacuucguaccugcucaggagcccccacugucccagucccacucaggcccaucucuggcuggc

SEQ ID NO: 360630 - RNA, 64 nt, Homo Sapiens
uucacggaagccaggaaucaaacugccuggguuccagucccagcucugccaguuaugcccagcu

SEQ ID NO: 360631 - RNA, 64 nt, Homo Sapiens
augccauugagacuaguaacgggcguucugggcacagucccacugugcacagguuugagaggac

SEQ ID NO: 360632 - RNA, 64 nt, Homo Sapiens
uaggugguccccaacagugccuagggguacaguacagucccauuacacuagagcagggcucuau

SEQ ID NO: 360633 - RNA, 64 nt, Homo Sapiens
gagcacugcccuaggagcccggaccccacgagcucagucccagcucugccucugacucgcugug

SEQ ID NO: 360634 - RNA, 64 nt, Homo Sapiens
uuggccauggcuuuccugcaagaccacugacgagcagucccauggugauaaagggcagcccggc

SEQ ID NO: 360635 - RNA, 64 nt, Homo Sapiens
cucagaacccaggauaggaacagaaucccagaggcagucccagcagggguggagggcagucccu

SEQ ID NO: 360636 - RNA, 64 nt, Homo Sapiens
agggccccuagccagggacauucucuuccagccacagucccaugcuccaaccuccggggcgacc

SEQ ID NO: 360637 - RNA, 64 nt, Homo Sapiens
ccccacccuccugcccugugcccagguguugggacagucccacccucccugcuauuuauauccc

SEQ ID NO: 360638 - RNA, 64 nt, Homo Sapiens
uucugccuccucugaggaaucuggcccugucugacagucccagaccccccguucucuccucuuu

SEQ ID NO: 360639 - RNA, 64 nt, Homo Sapiens; identical to SEQ ID NO: 55647

SEQ ID NO: 360640 - RNA, 64 nt, Homo Sapiens; identical to SEQ ID NO: 55648

SEQ ID NO: 360641 - RNA, 64 nt, Homo Sapiens; identical to SEQ ID NO: 55649

SEQ ID NO: 360642 - RNA, 64 nt, Homo Sapiens; identical to SEQ ID NO: 55650

SEQ ID NO: 360643 - RNA, 64 nt, Homo Sapiens; identical to SEQ ID NO: 55651

SEQ ID NO: 360644 - RNA, 64 nt, Homo Sapiens; identical to SEQ ID NO: 55652

SEQ ID NO: 360645 - RNA, 64 nt, Homo Sapiens; identical to SEQ ID NO: 55653

SEQ ID NO: 360646 - RNA, 64 nt, Homo Sapiens; identical to SEQ ID NO: 55654

SEQ ID NO: 360647 - RNA, 64 nt, Homo Sapiens; identical to SEQ ID NO: 55655

SEQ ID NO: 360648 - RNA, 64 nt, Homo Sapiens; identical to SEQ ID NO: 55656

SEQ ID NO: 360649 - RNA, 64 nt, Homo Sapiens; identical to SEQ ID NO: 55657

SEQ ID NO: 360650 - RNA, 64 nt, Homo Sapiens; identical to SEQ ID NO: 55658

SEQ ID NO: 360651 - RNA, 64 nt, Homo Sapiens; identical to SEQ ID NO: 55659

SEQ ID NO: 360652 - RNA, 64 nt, Homo Sapiens; identical to SEQ ID NO: 55660

SEQ ID NO: 360653 - RNA, 64 nt, Homo Sapiens; identical to SEQ ID NO: 55661

SEQ ID NO: 360654 - RNA, 64 nt, Homo Sapiens; identical to SEQ ID NO: 55662

SEQ ID NO: 360655 - RNA, 64 nt, Homo Sapiens; identical to SEQ ID NO: 55663

SEQ ID NO: 360656 - RNA, 64 nt, Homo Sapiens; identical to SEQ ID NO: 55664

SEQ ID NO: 360657 - RNA, 64 nt, Homo Sapiens; identical to SEQ ID NO: 55665

SEQ ID NO: 360658 - RNA, 64 nt, Homo Sapiens; identical to SEQ ID NO: 55666

SEQ ID NO: 360659 - RNA, 64 nt, Homo Sapiens
auuguucagugggucaucuagugaucuuagcuuccuugcuuacaauuaaguaccauuagcuaca

SEQ ID NO: 360660 - RNA, 64 nt, Homo Sapiens
cauguuguuauaaaacauucgauuuuaguaacaucuugcuuaguguauguuacugacccauaug

SEQ ID NO: 360661 - RNA, 64 nt, Homo Sapiens
gaauauuuauacuauaaaaugcaguaacauucuacuugcuuauuacauuuaaauccuuguguaa

SEQ ID NO: 360662 - RNA, 64 nt, Homo Sapiens
gacccaucccuguggcaucgucagcagaauacugcuugcuuacaaucuuuauuaugcauucuua

SEQ ID NO: 360663 - RNA, 64 nt, Homo Sapiens
cgaccuuugcagauacccauaaccuauguugagccuugcuuaccagcaaagaauauuuuuaaug

SEQ ID NO: 360664 - RNA, 64 nt, Homo Sapiens
agucugcaaaagaagcacaauucuauugcuuugucuugcuuauagucauuaaaucauuacuuuu

SEQ ID NO: 360665 - RNA, 64 nt, Homo Sapiens
cgaaagauggcaaguguacaaccaaaccaauccacuugcuuacagaaagaauguuuaguguagu

SEQ ID NO: 360666 - RNA, 64 nt, Homo Sapiens
aagagauaaagauacccucucauggaauaaacaccuugcuuagaauucauauaacaaagaagua

SEQ ID NO: 360667 - RNA, 64 nt, Homo Sapiens
agugucucucucucuuagcgacacacuccuuggucuugcuuaccaacuggaggacacuagguag

SEQ ID NO: 360668 - RNA, 64 nt, Homo Sapiens
ugcauuucuggcagggaaggcugagucugggccacuugcuuaauaggaagcgcugucugugcgg

SEQ ID NO: 360669 - RNA, 64 nt, Homo Sapiens
gcccaagguagaugagagacgagcccaugggaaccuugcuuagccauucuccuggcugcuggga

SEQ ID NO: 360670 - RNA, 64 nt, Homo Sapiens
cuuccucacaccacgaaucugaacaugccucucucuugcuuacaaaugucuaagguccccacug

SEQ ID NO: 360671 - RNA, 64 nt, Homo Sapiens
uaagguccccacugccugcuggagagaaaacacacuugcuuagcccacaauucuccauuucacu

SEQ ID NO: 360672 - RNA, 64 nt, Homo Sapiens
uaggauugcagcaacacgcucggcugcccaaacccaaggcgaagaccuugccagaguucaucaa

SEQ ID NO: 360673 - RNA, 64 nt, Homo Sapiens
aagcacgaacgaaugucgagccuaucgcuccagccaaggcgaagcggccccaccccugcucgcc

SEQ ID NO: 360674 - RNA, 64 nt, Homo Sapiens
cgcugagauucuuccaucuauucuccccauaucccaaggcgaagcauucuuguuagcuuugcuu

SEQ ID NO: 360675 - RNA, 64 nt, Homo Sapiens
ugcaacuguuguugaaugauacuuugacagcuagcaaggcgacauccauuuggggaugaagucu

SEQ ID NO: 360676 - RNA, 64 nt, Homo Sapiens
ggauaauuccaacacaagacguucguccugacuacaaggcgagugaccugcuucacaaguuaca

SEQ ID NO: 360677 - RNA, 64 nt, Homo Sapiens
cacuuuacaaacaaauaaacauuguuuguacucacaaggcgauaauagcuugauuuauuugguu

SEQ ID NO: 360678 - RNA, 64 nt, Homo Sapiens
ugccuacaaauuacucugucgagaaaauguagaucaaggcgagccagccaagagagauuagaga

SEQ ID NO: 360679 - RNA, 64 nt, Homo Sapiens
uaagcaaaaucagaaguauagcuuuggcaaugcccaaggcgauaauacuguguaccucauggau

SEQ ID NO: 360680 - RNA, 64 nt, Homo Sapiens
cuguccagugugcaagcaaaaaguuguuccuucucaaggcgauucagacucugacacagacagu

SEQ ID NO: 360681 - RNA, 64 nt, Homo Sapiens
uuccccacuaauaaagugccagucucugccagaccaaggcgagugugcugguccuguugauccc

SEQ ID NO: 360682 - RNA, 64 nt, Homo Sapiens
ugcccgcucagcucagcaaggucgaaccagcaggcaaggcgaggccagggggagggggucaggu

SEQ ID NO: 360683 - RNA, 64 nt, Homo Sapiens
ggcucacaccuguaaucccagcacuuugggaggccaaggcgagcggaucaugaggucagaagau

SEQ ID NO: 360684 - RNA, 64 nt, Homo Sapiens
aagagacagccuccuuggcaacuuguaggacacccaaggcgacuucuuggcauuuucggaggaa

SEQ ID NO: 360685 - RNA, 64 nt, Homo Sapiens
ugaagaggacgcaggcuuccggugggggcucucacaaggcgacuuugccccucagggucacagg

SEQ ID NO: 360686 - RNA, 64 nt, Homo Sapiens
augagggcagcuaaacccauagaaggaguuggaccaaggcgaauuacgaguccuggucccagca

SEQ ID NO: 360687 - RNA, 64 nt, Homo Sapiens
ugggcugcugcccgaagguuccgccuggggugagcaaggcgaccgagaggcccgugccaugaga

SEQ ID NO: 360688 - RNA, 64 nt, Homo Sapiens
cggcugucugcgaccacagcuguugacagggagccaaggcgaggucccgcucccacccccaccu

SEQ ID NO: 360689 - RNA, 64 nt, Homo Sapiens
ccggcuggaccaggcacugccacugcucaccgcccaaggcgacgggccccucgccccugccugg

SEQ ID NO: 360690 - RNA, 64 nt, Homo Sapiens
ccggugaggcccagcucuacggcuggagggugcccaaggcgaggcagggucaggcccugccaga

SEQ ID NO: 360691 - RNA, 64 nt, Homo Sapiens
cccuuugugcuguaugacuggagccugagcugcccaaggcgaugcagacaguguggaacagagu

SEQ ID NO: 360692 - RNA, 64 nt, Homo Sapiens
ucagauuccauacugagaucggugucugugcugacaaggcgacuggucuucuggggaccccaga

SEQ ID NO: 360693 - RNA, 64 nt, Homo Sapiens
acaggccuggcaggggcccacuggugcccagcaccaaggcgagcuccgggcucagaccaacucc

SEQ ID NO: 360694 - RNA, 64 nt, Homo Sapiens
cugcaaaccacuggcucguuuccgugcccaaauccaaggcgaaguuuucuagaggguucuuggg

SEQ ID NO: 360695 - RNA, 64 nt, Homo Sapiens
ccugaggucgggaguuggagacccgccuggcuaacaaggcgaaauccugucuguacuaaaaaua

SEQ ID NO: 360696 - RNA, 64 nt, Homo Sapiens
uggcuggccuuccacuuggcuacacagggauguacaaggcgaucccaucuugauaagaccacca

SEQ ID NO: 360697 - RNA, 64 nt, Homo Sapiens
cuugaggucaggaguucaagaccagccuggccaacaaggcgaaacccugucucuacuaaaaaua

SEQ ID NO: 360698 - RNA, 64 nt, Homo Sapiens
auuccccuucccaaccccgaggggcuugcagggacaaggcgaccgacugcgcugagcugcuuau

SEQ ID NO: 360699 - RNA, 64 nt, Homo Sapiens
acgguguguggguggccccucaagcugguguguucaaggcgagguaaaauccauaacugauuuc

SEQ ID NO: 360700 - RNA, 64 nt, Homo Sapiens
cacaaggagaccuggacacaacagacacacaucacaaggcgaacacaaauggacacacauaccu

SEQ ID NO: 360701 - RNA, 64 nt, Homo Sapiens
aggcugaguggacagucaggagagaggcgagaggcaaggcgaagccugugucccuguuucaguu

SEQ ID NO: 360702 - RNA, 64 nt, Homo Sapiens
ucauguaacuuccuugggaaauuucugaauaucccaaggcgagggcugccagaacuugacuagc

SEQ ID NO: 360703 - RNA, 64 nt, Homo Sapiens
aagccuuuuugaaaaauaacgaucauuuuuguaccaaggcgagcauccuuguuuucuagcuuug

SEQ ID NO: 360704 - RNA, 64 nt, Homo Sapiens
gggagggucagagggaggccugucugggcccugccaaggcgacauugggaagugaccauuugga

SEQ ID NO: 360705 - RNA, 64 nt, Homo Sapiens
gaccucaacagacugccccgggcucugggugggccaaggcgaaggcuucccaucaccacaggaa

SEQ ID NO: 360706 - RNA, 64 nt, Homo Sapiens
ccgagaucgugccacuguacuccagccugggcaacaaggcgagacuccaucucaauaauaauaa

SEQ ID NO: 360707 - RNA, 64 nt, Homo Sapiens
uccgggaccccagcccucaggauuccugaugcuccaaggcgacugaugggcgcuggaugaagug

SEQ ID NO: 360708 - RNA, 64 nt, Homo Sapiens
ggaguuaccccuaaaacaaaccuaagccuccccacaaggcgaggcgaggauugcacccgcccgu

SEQ ID NO: 360709 - RNA, 64 nt, Homo Sapiens
gaggacgggagcugccuagcuacaguuuucuugccaaggcgagguguuuugugaaucugugcug

SEQ ID NO: 360710 - RNA, 64 nt, Homo Sapiens
agaucaaagaaaaaucccccucuuacauacacuucaaggcgagcuucaacuuacucucuugagu

SEQ ID NO: 360711 - RNA, 64 nt, Homo Sapiens
cuucagcucaggaguucgagaucauucuggccaacaaggcgaaacccugucucuaccaaaaaua

SEQ ID NO: 360712 - RNA, 64 nt, Homo Sapiens
caucagacugguauuaauguuuugaaguggcagacaaggcgaagaaccuuuucuccuguguauc

SEQ ID NO: 360713 - RNA, 64 nt, Homo Sapiens
cauccagggcugccaggagauucagagcucaaaacaaggcgagcuugaguucugcacuccagau

SEQ ID NO: 360714 - RNA, 64 nt, Homo Sapiens
auaugagaguuuuaacuagaaacugaaaauguguuacaagaaaaucugggcauuaaauuauaca

SEQ ID NO: 360715 - RNA, 64 nt, Homo Sapiens
ccuuggauauuucuguguuguaggaauuugaauuuacaagaaugcaaauuuuuaaaauugaaau

SEQ ID NO: 360716 - RNA, 64 nt, Homo Sapiens
cuagcagugcaucagccaguaaaacaaacacauuuacaagaaaaauguuuuaaagaugccaggg

SEQ ID NO: 360717 - RNA, 64 nt, Homo Sapiens
aauucauaaugaauauauuugccuauauucucccuacaagaauauuuuugcuccagaaagacau

SEQ ID NO: 360718 - RNA, 64 nt, Homo Sapiens
auccacaggguagauuucuuucuagauguggaaguacaagaaaaucuuuuuuaguuauuuguuu

SEQ ID NO: 360719 - RNA, 64 nt, Homo Sapiens
cuaagguaccaauagcucuuucauagacuugugcuacaagaagguuaaaagaccaguuuuauuu

SEQ ID NO: 360720 - RNA, 64 nt, Homo Sapiens
agucagccuucucucccccauuggggcauuuuucuacaagaagcugccgugaggacaguugaau

SEQ ID NO: 360721 - RNA, 64 nt, Homo Sapiens
ugcaaagucccucuuacccccugucugccaaagauacaagaauacuugaaccaggcuagaacag

SEQ ID NO: 360722 - RNA, 64 nt, Homo Sapiens
agagacaugcuuguguuuuggaauuucacacccuuacaagaauaccacauuuugaaacccagaa

SEQ ID NO: 360723 - RNA, 64 nt, Homo Sapiens
uccaucuuuucaaagauacaacaaaagcagaaguuacaagaauauugcggagagguuggaaagc

SEQ ID NO: 360724 - RNA, 64 nt, Homo Sapiens
ugguuaagacugcugaggccaagugcuauuuuguuacaagaaaggaagaacuuggcuauuuucu

SEQ ID NO: 360725 - RNA, 64 nt, Homo Sapiens
aaucaaguaugaaaaucugcacaaaugcaauguuuacaagaacugguugauucugggaggcauc

SEQ ID NO: 360726 - RNA, 64 nt, Homo Sapiens; identical to SEQ ID NO: 193740

SEQ ID NO: 360727 - RNA, 64 nt, Homo Sapiens; identical to SEQ ID NO: 193741

SEQ ID NO: 360728 - RNA, 64 nt, Homo Sapiens; identical to SEQ ID NO: 193742

SEQ ID NO: 360729 - RNA, 64 nt, Homo Sapiens; identical to SEQ ID NO: 193743

SEQ ID NO: 360730 - RNA, 64 nt, Homo Sapiens; identical to SEQ ID NO: 193744

SEQ ID NO: 360731 - RNA, 64 nt, Homo Sapiens; identical to SEQ ID NO: 193745

SEQ ID NO: 360732 - RNA, 64 nt, Homo Sapiens; identical to SEQ ID NO: 180822

SEQ ID NO: 360733 - RNA, 64 nt, Homo Sapiens; identical to SEQ ID NO: 180823

SEQ ID NO: 360734 - RNA, 64 nt, Homo Sapiens; identical to SEQ ID NO: 180824

SEQ ID NO: 360735 - RNA, 64 nt, Homo Sapiens; identical to SEQ ID NO: 180825

SEQ ID NO: 360736 - RNA, 64 nt, Homo Sapiens; identical to SEQ ID NO: 180826

SEQ ID NO: 360737 - RNA, 64 nt, Homo Sapiens; identical to SEQ ID NO: 180827

SEQ ID NO: 360738 - RNA, 64 nt, Homo Sapiens; identical to SEQ ID NO: 180828

SEQ ID NO: 360739 - RNA, 60 nt, Homo Sapiens; identical to SEQ ID NO: 180829

SEQ ID NO: 360740 - RNA, 64 nt, Homo Sapiens; identical to SEQ ID NO: 180830

SEQ ID NO: 360741 - RNA, 64 nt, Homo Sapiens; identical to SEQ ID NO: 180831

SEQ ID NO: 360742 - RNA, 64 nt, Homo Sapiens; identical to SEQ ID NO: 180832

SEQ ID NO: 360743 - RNA, 64 nt, Homo Sapiens; identical to SEQ ID NO: 180833

SEQ ID NO: 360744 - RNA, 64 nt, Homo Sapiens; identical to SEQ ID NO: 180834

SEQ ID NO: 360745 - RNA, 64 nt, Homo Sapiens; identical to SEQ ID NO: 180835

SEQ ID NO: 360746 - RNA, 64 nt, Homo Sapiens; identical to SEQ ID NO: 180836

SEQ ID NO: 360747 - RNA, 64 nt, Homo Sapiens
cacccccugcccugcacgucaugggagggggcuugaagccaaagaaaaauaacccuuugguuuu

SEQ ID NO: 360748 - RNA, 64 nt, Homo Sapiens
acaucugccuuaaaaccaaagagggcuuccucuagaagccaagggaaaggggugcuuuuauaga

SEQ ID NO: 360749 - RNA, 64 nt, Homo Sapiens
acccugggugggcucugugcagucacuggagguugaagccaaguggggugcugggaggagggag

SEQ ID NO: 360750 - RNA, 64 nt, Homo Sapiens
uucuauguaugaauaugcuuucaaauaagaucaggaagccaauuauauguguguuuuucaguau

SEQ ID NO: 360751 - RNA, 64 nt, Homo Sapiens
uuuuuaaucaaaaacuuauagcauacagccuucagaagccaacaggccuguuuuugucgguaag

SEQ ID NO: 360752 - RNA, 64 nt, Homo Sapiens
guugcugucagagaugggcucauaucugcuuggggaagccaauggggcacaauccuucccaauu

SEQ ID NO: 360753 - RNA, 64 nt, Homo Sapiens
accccagaggaaccagugggauugaaaaccagcagaagccaagacaggaugcacagcugaauug

SEQ ID NO: 360754 - RNA, 64 nt, Homo Sapiens
uugucacaauuccucaaucuugagcaaagauguggaagccaaaaaaagcuagcuguagguaaug

SEQ ID NO: 360755 - RNA, 64 nt, Homo Sapiens
auuuauuacaaauguauuuuuaagaacaguaauugaagccaauuguuucugacaagaauuaggg

SEQ ID NO: 360756 - RNA, 64 nt, Homo Sapiens
gcugcuucccuuguaaauaguuguucucugguaagaagccaaauauuuaagcucacuucuuccc

SEQ ID NO: 360757 - RNA, 64 nt, Homo Sapiens
uaacggugccuuuucuuaggguccaggcaggaaugaagccaauaauuuauugcuuuccauucug

SEQ ID NO: 360758 - RNA, 64 nt, Homo Sapiens
cauucagaaacugcaggagacaagaugaauuugagaagccaaauggaauuuuuaauggaaacca

SEQ ID NO: 360759 - RNA, 64 nt, Homo Sapiens
gacugugcuuguccauuauuuuacacaugcccuagaagccaaaacugaaagccacuggauccug

SEQ ID NO: 360760 - RNA, 64 nt, Homo Sapiens
guccuuugcuacccagggcugcccccaggcccaugaagccaauaggagagcguguggcacuggc

SEQ ID NO: 360761 - RNA, 64 nt, Homo Sapiens
uacucaauauuuaauauucuacucgagcuuuauggaagccaaaucaugugcaugugugugugug

SEQ ID NO: 360762 - RNA, 64 nt, Homo Sapiens
uuugccuuuugcacacgcaccuggaaaagacacagaagccaaccugagaaccccuggugcuauu

SEQ ID NO: 360763 - RNA, 64 nt, Homo Sapiens
gauguuucggacugaccuaaaaacuaauugucgagaagccaagggugaggaggcaggaagcacc

SEQ ID NO: 360764 - RNA, 64 nt, Homo Sapiens
guucacguuucauguaauccucaagaaauaaaaggaagccaaagaguguauuuuuuuaaaaguu

SEQ ID NO: 360765 - RNA, 64 nt, Homo Sapiens
ccgguggggcugguucuguaauugugugugaugugaagccaauucagacaggcaaauaaaagug

SEQ ID NO: 360766 - RNA, 64 nt, Homo Sapiens
ugcuuuaguucuagaaucacugauuuguugguugcacuuucauuaugccucuagccccuuacug

SEQ ID NO: 360767 - RNA, 64 nt, Homo Sapiens
ugauugugcagaaaacuugcgcauuuggaauuuacacuuucauauuagucucauuuaagagaug

SEQ ID NO: 360768 - RNA, 64 nt, Homo Sapiens
ucaugcuuuuuuauguaggagauagaggguccuccacuuucagcgcucaguuaaggaaugagaa

SEQ ID NO: 360769 - RNA, 64 nt, Homo Sapiens
uuacacuugcauguucuacucauugguuguguaucacuuucacuccucccccccccccccgcac

SEQ ID NO: 360770 - RNA, 64 nt, Homo Sapiens
augaaucuaaaccuuuacagauuacaagauauagcacuuucaaaucaaccucuauacuacacau

SEQ ID NO: 360771 - RNA, 64 nt, Homo Sapiens
caucucugggaaaugauaggauacaguaaaaucccacuuucauguuuuaagugacuagaaauau

SEQ ID NO: 360772 - RNA, 64 nt, Homo Sapiens
uagaaacccuccagaaauuuccacugcuguucuucacuuucaucuugucugcuaucaaaccacu

SEQ ID NO: 360773 - RNA, 64 nt, Homo Sapiens
gugcaugggaucguugauguuuaucagaacuguucacuuucagaaaugauuuuuuaaagcauuu

SEQ ID NO: 360774 - RNA, 64 nt, Homo Sapiens
uugcuuaauaaauaucugcuuguguuuguaauuucacuuucaucgcugaguuuaaaaguugacc

SEQ ID NO: 360775 - RNA, 64 nt, Homo Sapiens
uuauaccaacgugaaaagugauuucaucuuaaagcacuuucauucuuuaaaaaaauacauaaaa

SEQ ID NO: 360776 - RNA, 64 nt, Homo Sapiens
gccuguggcugcacaggcucucuaaccgaaaccucacuuucagagagauguggguccuuugucu

SEQ ID NO: 360777 - RNA, 64 nt, Homo Sapiens
uguuuauacuucuugauugguuucuugccauuuucacuuucagugauggugggugugcaguaga

SEQ ID NO: 360778 - RNA, 64 nt, Homo Sapiens
guccuguccucuggaucacaugauauauuagggacacuuucacaaaaacaagagauauacauug

SEQ ID NO: 360779 - RNA, 64 nt, Homo Sapiens
cggggcuuugccagagcguguaaugguuggaaaacacuuucaucaagccaugcuggugggccau

SEQ ID NO: 360780 - RNA, 64 nt, Homo Sapiens
agguuugugucucaucuccccccacuuucacugccacuuucauccuccucuuccucuccuuuac

SEQ ID NO: 360781 - RNA, 64 nt, Homo Sapiens
gccacuuucaucagguuuguccucuccuuuaccccacuuucacuucuguccaccuccuccucuu

SEQ ID NO: 360782 - RNA, 64 nt, Homo Sapiens
cucacguccucauccuuggacugggcccggggaccacuuucauagucacacgacggaauggaua

SEQ ID NO: 360783 - RNA, 64 nt, Homo Sapiens
cuugaaaaugacaaaacccuggcaggagaacagccacuuucagaggaaaagaagaaacaacaaa

SEQ ID NO: 360784 - RNA, 64 nt, Homo Sapiens
gacaccuagucuagagucaccaaggucacagugccacuuucacgggauagcaggcucuugggac

SEQ ID NO: 360785 - RNA, 64 nt, Homo Sapiens
cuuuuacuuugugguucucuaaaaaccauguacacacuuucacucuauuguaaccacacagggc

SEQ ID NO: 360786 - RNA, 64 nt, Homo Sapiens; identical to SEQ ID NO: 79249

SEQ ID NO: 360787 - RNA, 64 nt, Homo Sapiens; identical to SEQ ID NO: 79250

SEQ ID NO: 360788 - RNA, 64 nt, Homo Sapiens; identical to SEQ ID NO: 79251

SEQ ID NO: 360789 - RNA, 64 nt, Homo Sapiens; identical to SEQ ID NO: 79252

SEQ ID NO: 360790 - RNA, 64 nt, Homo Sapiens; identical to SEQ ID NO: 79253

SEQ ID NO: 360791 - RNA, 64 nt, Homo Sapiens; identical to SEQ ID NO: 79254

SEQ ID NO: 360792 - RNA, 64 nt, Homo Sapiens; identical to SEQ ID NO: 79255

SEQ ID NO: 360793 - RNA, 64 nt, Homo Sapiens; identical to SEQ ID NO: 79256

SEQ ID NO: 360794 - RNA, 64 nt, Homo Sapiens; identical to SEQ ID NO: 79257

SEQ ID NO: 360795 - RNA, 64 nt, Homo Sapiens; identical to SEQ ID NO: 79258

SEQ ID NO: 360796 - RNA, 64 nt, Homo Sapiens; identical to SEQ ID NO: 79259

SEQ ID NO: 360797 - RNA, 64 nt, Homo Sapiens; identical to SEQ ID NO: 79260

SEQ ID NO: 360798 - RNA, 64 nt, Homo Sapiens; identical to SEQ ID NO: 79261

SEQ ID NO: 360799 - RNA, 64 nt, Homo Sapiens; identical to SEQ ID NO: 79262

SEQ ID NO: 360800 - RNA, 64 nt, Homo Sapiens; identical to SEQ ID NO: 79263

SEQ ID NO: 360801 - RNA, 64 nt, Homo Sapiens; identical to SEQ ID NO: 79264

SEQ ID NO: 360802 - RNA, 64 nt, Homo Sapiens; identical to SEQ ID NO: 79265

SEQ ID NO: 360803 - RNA, 64 nt, Homo Sapiens; identical to SEQ ID NO: 79266

SEQ ID NO: 360804 - RNA, 64 nt, Homo Sapiens; identical to SEQ ID NO: 79267

SEQ ID NO: 360805 - RNA, 64 nt, Homo Sapiens; identical to SEQ ID NO: 79268

SEQ ID NO: 360806 - RNA, 64 nt, Homo Sapiens; identical to SEQ ID NO: 79269

SEQ ID NO: 360807 - RNA, 64 nt, Homo Sapiens; identical to SEQ ID NO: 79270

SEQ ID NO: 360808 - RNA, 64 nt, Homo Sapiens; identical to SEQ ID NO: 79271

SEQ ID NO: 360809 - RNA, 64 nt, Homo Sapiens; identical to SEQ ID NO: 79272

SEQ ID NO: 360810 - RNA, 64 nt, Homo Sapiens; identical to SEQ ID NO: 79273

SEQ ID NO: 360811 - RNA, 64 nt, Homo Sapiens; identical to SEQ ID NO: 79274

SEQ ID NO: 360812 - RNA, 64 nt, Homo Sapiens; identical to SEQ ID NO: 79275

SEQ ID NO: 360813 - RNA, 64 nt, Homo Sapiens; identical to SEQ ID NO: 79276

SEQ ID NO: 360814 - RNA, 64 nt, Homo Sapiens; identical to SEQ ID NO: 79277

SEQ ID NO: 360815 - RNA, 64 nt, Homo Sapiens; identical to SEQ ID NO: 79278

SEQ ID NO: 360816 - RNA, 64 nt, Homo Sapiens; identical to SEQ ID NO: 79279

SEQ ID NO: 360817 - RNA, 64 nt, Homo Sapiens; identical to SEQ ID NO: 79280

SEQ ID NO: 360818 - RNA, 64 nt, Homo Sapiens; identical to SEQ ID NO: 79281

SEQ ID NO: 360819 - RNA, 64 nt, Homo Sapiens; identical to SEQ ID NO: 79282

SEQ ID NO: 360820 - RNA, 64 nt, Homo Sapiens; identical to SEQ ID NO: 79283

SEQ ID NO: 360821 - RNA, 64 nt, Homo Sapiens; identical to SEQ ID NO: 79284

SEQ ID NO: 360822 - RNA, 64 nt, Homo Sapiens; identical to SEQ ID NO: 79285

SEQ ID NO: 360823 - RNA, 64 nt, Homo Sapiens; identical to SEQ ID NO: 79286

SEQ ID NO: 360824 - RNA, 64 nt, Homo Sapiens; identical to SEQ ID NO: 79287

SEQ ID NO: 360825 - RNA, 64 nt, Homo Sapiens; identical to SEQ ID NO: 79288

SEQ ID NO: 360826 - RNA, 64 nt, Homo Sapiens; identical to SEQ ID NO: 79289

SEQ ID NO: 360827 - RNA, 64 nt, Homo Sapiens; identical to SEQ ID NO: 79290

SEQ ID NO: 360828 - RNA, 64 nt, Homo Sapiens; identical to SEQ ID NO: 245916

SEQ ID NO: 360829 - RNA, 64 nt, Homo Sapiens; identical to SEQ ID NO: 245917

SEQ ID NO: 360830 - RNA, 64 nt, Homo Sapiens; identical to SEQ ID NO: 245918

SEQ ID NO: 360831 - RNA, 64 nt, Homo Sapiens; identical to SEQ ID NO: 245919

SEQ ID NO: 360832 - RNA, 64 nt, Homo Sapiens; identical to SEQ ID NO: 245920

SEQ ID NO: 360833 - RNA, 64 nt, Homo Sapiens; identical to SEQ ID NO: 245921

SEQ ID NO: 360834 - RNA, 64 nt, Homo Sapiens; identical to SEQ ID NO: 245922

SEQ ID NO: 360835 - RNA, 64 nt, Homo Sapiens; identical to SEQ ID NO: 245923

SEQ ID NO: 360836 - RNA, 64 nt, Homo Sapiens; identical to SEQ ID NO: 245924

SEQ ID NO: 360837 - RNA, 64 nt, Homo Sapiens; identical to SEQ ID NO: 245925

SEQ ID NO: 360838 - RNA, 64 nt, Homo Sapiens; identical to SEQ ID NO: 245926

SEQ ID NO: 360839 - RNA, 64 nt, Homo Sapiens; identical to SEQ ID NO: 245927

SEQ ID NO: 360840 - RNA, 64 nt, Homo Sapiens; identical to SEQ ID NO: 245928

SEQ ID NO: 360841 - RNA, 64 nt, Homo Sapiens; identical to SEQ ID NO: 245929

SEQ ID NO: 360842 - RNA, 64 nt, Homo Sapiens; identical to SEQ ID NO: 245930

SEQ ID NO: 360843 - RNA, 64 nt, Homo Sapiens; identical to SEQ ID NO: 245931

SEQ ID NO: 360844 - RNA, 64 nt, Homo Sapiens; identical to SEQ ID NO: 245932

SEQ ID NO: 360845 - RNA, 64 nt, Homo Sapiens; identical to SEQ ID NO: 245933

SEQ ID NO: 360846 - RNA, 64 nt, Homo Sapiens; identical to SEQ ID NO: 245934

SEQ ID NO: 360847 - RNA, 64 nt, Homo Sapiens; identical to SEQ ID NO: 245935

SEQ ID NO: 360848 - RNA, 64 nt, Homo Sapiens; identical to SEQ ID NO: 245936

SEQ ID NO: 360849 - RNA, 64 nt, Homo Sapiens; identical to SEQ ID NO: 313160

SEQ ID NO: 360850 - RNA, 64 nt, Homo Sapiens; identical to SEQ ID NO: 313161

SEQ ID NO: 360851 - RNA, 64 nt, Homo Sapiens; identical to SEQ ID NO: 313162

SEQ ID NO: 360852 - RNA, 64 nt, Homo Sapiens; identical to SEQ ID NO: 313163

SEQ ID NO: 360853 - RNA, 64 nt, Homo Sapiens; identical to SEQ ID NO: 313164

SEQ ID NO: 360854 - RNA, 64 nt, Homo Sapiens; identical to SEQ ID NO: 313165

SEQ ID NO: 360855 - RNA, 64 nt, Homo Sapiens; identical to SEQ ID NO: 313166

SEQ ID NO: 360856 - RNA, 64 nt, Homo Sapiens; identical to SEQ ID NO: 313167

SEQ ID NO: 360857 - RNA, 64 nt, Homo Sapiens; identical to SEQ ID NO: 313168

SEQ ID NO: 360858 - RNA, 64 nt, Homo Sapiens; identical to SEQ ID NO: 313169

SEQ ID NO: 360859 - RNA, 64 nt, Homo Sapiens; identical to SEQ ID NO: 313170

SEQ ID NO: 360860 - RNA, 64 nt, Homo Sapiens; identical to SEQ ID NO: 313171

SEQ ID NO: 360861 - RNA, 64 nt, Homo Sapiens; identical to SEQ ID NO: 81987

SEQ ID NO: 360862 - RNA, 64 nt, Homo Sapiens; identical to SEQ ID NO: 81988

SEQ ID NO: 360863 - RNA, 64 nt, Homo Sapiens; identical to SEQ ID NO: 81989

SEQ ID NO: 360864 - RNA, 64 nt, Homo Sapiens; identical to SEQ ID NO: 81990

SEQ ID NO: 360865 - RNA, 64 nt, Homo Sapiens; identical to SEQ ID NO: 81991

SEQ ID NO: 360866 - RNA, 64 nt, Homo Sapiens; identical to SEQ ID NO: 81992

SEQ ID NO: 360867 - RNA, 64 nt, Homo Sapiens; identical to SEQ ID NO: 81993

SEQ ID NO: 360868 - RNA, 64 nt, Homo Sapiens; identical to SEQ ID NO: 81994

SEQ ID NO: 360869 - RNA, 64 nt, Homo Sapiens; identical to SEQ ID NO: 81995

SEQ ID NO: 360870 - RNA, 64 nt, Homo Sapiens; identical to SEQ ID NO: 81996

SEQ ID NO: 360871 - RNA, 64 nt, Homo Sapiens; identical to SEQ ID NO: 81997

SEQ ID NO: 360872 - RNA, 64 nt, Homo Sapiens; identical to SEQ ID NO: 81998

SEQ ID NO: 360873 - RNA, 64 nt, Homo Sapiens; identical to SEQ ID NO: 81999

SEQ ID NO: 360874 - RNA, 64 nt, Homo Sapiens; identical to SEQ ID NO: 82000

SEQ ID NO: 360875 - RNA, 64 nt, Homo Sapiens; identical to SEQ ID NO: 82001

SEQ ID NO: 360876 - RNA, 64 nt, Homo Sapiens; identical to SEQ ID NO: 82002

SEQ ID NO: 360877 - RNA, 64 nt, Homo Sapiens; identical to SEQ ID NO: 82003

SEQ ID NO: 360878 - RNA, 64 nt, Homo Sapiens; identical to SEQ ID NO: 82004

SEQ ID NO: 360879 - RNA, 64 nt, Homo Sapiens; identical to SEQ ID NO: 82005

SEQ ID NO: 360880 - RNA, 64 nt, Homo Sapiens; identical to SEQ ID NO: 82006

SEQ ID NO: 360881 - RNA, 64 nt, Homo Sapiens; identical to SEQ ID NO: 82007

SEQ ID NO: 360882 - RNA, 64 nt, Homo Sapiens; identical to SEQ ID NO: 82008

SEQ ID NO: 360883 - RNA, 58 nt, Homo Sapiens; identical to SEQ ID NO: 82009

SEQ ID NO: 360884 - RNA, 64 nt, Homo Sapiens; identical to SEQ ID NO: 82010

SEQ ID NO: 360885 - RNA, 64 nt, Homo Sapiens; identical to SEQ ID NO: 82011

SEQ ID NO: 360886 - RNA, 64 nt, Homo Sapiens; identical to SEQ ID NO: 82012

SEQ ID NO: 360887 - RNA, 64 nt, Homo Sapiens; identical to SEQ ID NO: 82013

SEQ ID NO: 360888 - RNA, 64 nt, Homo Sapiens; identical to SEQ ID NO: 82014

SEQ ID NO: 360889 - RNA, 64 nt, Homo Sapiens; identical to SEQ ID NO: 82015

SEQ ID NO: 360890 - RNA, 64 nt, Homo Sapiens; identical to SEQ ID NO: 82016

SEQ ID NO: 360891 - RNA, 64 nt, Homo Sapiens; identical to SEQ ID NO: 122997

SEQ ID NO: 360892 - RNA, 64 nt, Homo Sapiens; identical to SEQ ID NO: 122998

SEQ ID NO: 360893 - RNA, 64 nt, Homo Sapiens; identical to SEQ ID NO: 122999

SEQ ID NO: 360894 - RNA, 64 nt, Homo Sapiens; identical to SEQ ID NO: 123000

SEQ ID NO: 360895 - RNA, 64 nt, Homo Sapiens; identical to SEQ ID NO: 123001

SEQ ID NO: 360896 - RNA, 64 nt, Homo Sapiens; identical to SEQ ID NO: 123002

SEQ ID NO: 360897 - RNA, 64 nt, Homo Sapiens; identical to SEQ ID NO: 123003

SEQ ID NO: 360898 - RNA, 64 nt, Homo Sapiens; identical to SEQ ID NO: 123004

SEQ ID NO: 360899 - RNA, 64 nt, Homo Sapiens; identical to SEQ ID NO: 123005

SEQ ID NO: 360900 - RNA, 64 nt, Homo Sapiens; identical to SEQ ID NO: 123006

SEQ ID NO: 360901 - RNA, 64 nt, Homo Sapiens; identical to SEQ ID NO: 123007

SEQ ID NO: 360902 - RNA, 64 nt, Homo Sapiens; identical to SEQ ID NO: 123008

SEQ ID NO: 360903 - RNA, 64 nt, Homo Sapiens; identical to SEQ ID NO: 123009

SEQ ID NO: 360904 - RNA, 64 nt, Homo Sapiens; identical to SEQ ID NO: 123010

SEQ ID NO: 360905 - RNA, 64 nt, Homo Sapiens
gggucagaugaugccccccaaaacccugauuuccacacacuaagacuaaauuauguaucaaggc

SEQ ID NO: 360906 - RNA, 64 nt, Homo Sapiens
guauuuucuccagcucugacauuguuuuccaaagacacacuaaacugcauugcacaguucaaaa

SEQ ID NO: 360907 - RNA, 64 nt, Homo Sapiens
ucagaagacaguguguugccacacacacacacacacacacuauuacacacacacacacacacac

SEQ ID NO: 360908 - RNA, 64 nt, Homo Sapiens
auaaagauagaaaucugacauugagaacuuuuacacacacuaagaaaauuuguccuugucuagg

SEQ ID NO: 360909 - RNA, 64 nt, Homo Sapiens
uauauauauauauauacacaacaugcacuacauaacacacuauauguauacuauauaugcccac

SEQ ID NO: 360910 - RNA, 64 nt, Homo Sapiens
uacauauaguguauauacacacacacacacacacacacacuauaguuauauuccaccauaacac

SEQ ID NO: 360911 - RNA, 64 nt, Homo Sapiens
ccaacaccaccacuacaaaagccaccaccaccaacaccgccacaccccaauacacagaaccacc

SEQ ID NO: 360912 - RNA, 64 nt, Homo Sapiens
accaccaacaccgccacaccccaauacacagaaccaccgccaccaaauauaacccucccuuccc

SEQ ID NO: 360913 - RNA, 64 nt, Homo Sapiens
acgcacaccuccaaccuggguuccagccaaagaacaccgccaacccgccagaacggccuuuugc

SEQ ID NO: 360914 - RNA, 64 nt, Homo Sapiens
ggggucugcgauggcacgccagugccuaccuguccaccgccacccagcccucggagugcugcca

SEQ ID NO: 360915 - RNA, 64 nt, Homo Sapiens
aagggaacacauugagacuagaagggacaauuaaagagacaaccucugaguaggcugacccuga

SEQ ID NO: 360916 - RNA, 64 nt, Homo Sapiens
gcaugucaaaaaauguacauuaucagagcagucuagagacaauuaguagcacauugguaauagg

SEQ ID NO: 360917 - RNA, 64 nt, Homo Sapiens
gaaauuucuaccaagcguuuucauggaugcuaugagagacaauccugaagcugcuguacauauu

SEQ ID NO: 360918 - RNA, 64 nt, Homo Sapiens
ggcgaccuuggcuaucagacuugaaauauucacgagagacaauaaacgcugaaaggccagugcc

SEQ ID NO: 360919 - RNA, 64 nt, Homo Sapiens
uugcccagagggcacgggcuuucccaccucucaaagagacaaggaagccaccuguaagcagaag

SEQ ID NO: 360920 - RNA, 64 nt, Homo Sapiens
aagacuggaguuuuuccagcuggggugggaguggagagacaacaggaacaacgcugcaccaaag

SEQ ID NO: 360921 - RNA, 64 nt, Homo Sapiens
uguguguguguguguguguaugagagagagagagagagacaacagagacagagagaggcagaga

SEQ ID NO: 360922 - RNA, 64 nt, Homo Sapiens
agagagaggcagagaggcauagagagacagagagagagacaagaaacagagauagacagaaaau

SEQ ID NO: 360923 - RNA, 64 nt, Homo Sapiens
ugauaaaacagaauuuaaaccaacaaagaucaaaagagacaaggccauuauauaaugguaaaug

SEQ ID NO: 360924 - RNA, 64 nt, Homo Sapiens
ugaggccagcaucuuccuguuaccaaagcugggcagagacaaaaccaaaaaagagaauuuuaga

SEQ ID NO: 360925 - RNA, 64 nt, Homo Sapiens
aagcauguauauaagagcacguuguaaacuugaaagagacaaaggcacaaauguggcuguugau

SEQ ID NO: 360926 - RNA, 64 nt, Homo Sapiens
cccuagacuaggacuccagugcccuccucucccaagagacaaaggccauugcauugaaggaggu

SEQ ID NO: 360927 - RNA, 64 nt, Homo Sapiens
augaggagaggaaucagaaaccccacuuuggcauagagacaagcagcacuguuccaguccaggg

SEQ ID NO: 360928 - RNA, 64 nt, Homo Sapiens
cuacagaaaugauauaaaaacuauagucauaagaagagacaaucaaaaauaaucagccauaaaa

SEQ ID NO: 360929 - RNA, 64 nt, Homo Sapiens
uuuuuccaccauuguaucucuuuuuucucacuacagagacaauaugaaccaggauuuaaaccgg

SEQ ID NO: 360930 - RNA, 64 nt, Homo Sapiens
aagauaagauuugauuauuuuagcuuucuuuggaagagacaaacccccuguguuucuuuggugg

SEQ ID NO: 360931 - RNA, 64 nt, Homo Sapiens
auccugugaaaaauguacagaggcuaucugagauacugguaauccugaagauuuuugcacacuc

SEQ ID NO: 360932 - RNA, 64 nt, Homo Sapiens
augcuuagaagucuuacucagcagugucugaguuacugguaaagaaaaaugauuucucuggauu

SEQ ID NO: 360933 - RNA, 64 nt, Homo Sapiens
gcuuagagccauuuaucugaacacuaaaauacuuacugguaacuaaauuaauauaauagaaaga

SEQ ID NO: 360934 - RNA, 64 nt, Homo Sapiens
gucgaucuugauacuauauuuggaacaaaugugaacugguaaagcuauuguuuaaugcaaaaua

SEQ ID NO: 360935 - RNA, 64 nt, Homo Sapiens
agagccaagcugcacaauuuaauauauucaagaguggggggaggaagcagaggucuucagggcu

SEQ ID NO: 360936 - RNA, 64 nt, Homo Sapiens
cccagcugcacuuuaacccuagaagguggggaccuggggggagggacagggcaggcgggcccau

SEQ ID NO: 360937 - RNA, 64 nt, Homo Sapiens
ccuucagcuagggaaagcaguugcgggcaggggguggggggagauuauauucacuccugccaag

SEQ ID NO: 360938 - RNA, 64 nt, Homo Sapiens
ugagccuccuacuucugggauugcagaucagggguggggggagaauguugcauguuguuuucug

SEQ ID NO: 360939 - RNA, 64 nt, Homo Sapiens
gaggcuggaauggagaaucugaaugguauuuguauggggggaggcuuaaagcaguugguagaag

SEQ ID NO: 360940 - RNA, 64 nt, Homo Sapiens
ggcaguuagcccucugugcucauugaacugcaguuggggggauuguucacccucagcucugaca

SEQ ID NO: 360941 - RNA, 64 nt, Homo Sapiens
cugcacugccgcccccauuuuugugccacuugcuuggggggaugugcaaacccacccugccccu

SEQ ID NO: 360942 - RNA, 64 nt, Homo Sapiens
uggggggaugugcaaacccacccugccccuuggauggggggaccggugcuucggcuuggccuac

SEQ ID NO: 360943 - RNA, 64 nt, Homo Sapiens
cggcaggaauaagggaaaguuugguggggggagguggggggaaaugugccucuagcucuggaga

SEQ ID NO: 360944 - RNA, 64 nt, Homo Sapiens
uggggggaaacggcaggaaugcucuggagauugguggggggagguucaugccccugugccucua

SEQ ID NO: 360945 - RNA, 64 nt, Homo Sapiens
gguggguggggccucccacugccuccuguguguuuggggggaaggguggggggagggagaugga

SEQ ID NO: 360946 - RNA, 64 nt, Homo Sapiens
gagauggagccuccuguguggaauguuuucaggguggggggaggaguccugcuccuagggcugu

SEQ ID NO: 360947 - RNA, 64 nt, Homo Sapiens
agcaggcccguguccagucauaccuagagauuuguggggggauacugaaccucuagacugaagu

SEQ ID NO: 360948 - RNA, 64 nt, Homo Sapiens
gagaccauugggaaauaauuaauagauauuuuucuggggggaaaucacaagucacugagguguu

SEQ ID NO: 360949 - RNA, 64 nt, Homo Sapiens
cgagguaggucacugucauuuuuguuuuaagaguuggggggaguaucuauaguaaacuugaaua

SEQ ID NO: 360950 - RNA, 64 nt, Homo Sapiens
uaauacaaucaguguucccaaggcugugcagggguggggggacaugcugucaggauggucugag

SEQ ID NO: 360951 - RNA, 64 nt, Homo Sapiens
guggacaaaccccgcaaaucgccagaguagggguuggggggagucauucuaggauugucugaag

SEQ ID NO: 360952 - RNA, 64 nt, Homo Sapiens
ggucaaaggacucuuauguccugcauuaaaaugguggggggacucucagagccucaguuuaccc

SEQ ID NO: 360953 - RNA, 64 nt, Homo Sapiens
agccuauacguuucuguggaguaaauauugggauuggggggaaagagggagcaacggcccauag

SEQ ID NO: 360954 - RNA, 64 nt, Homo Sapiens
auuuuucuauaaucacuugggguuuguacauuuuuggggggagagacacagauuuuuacacuaa

SEQ ID NO: 360955 - RNA, 64 nt, Homo Sapiens
ccauugcaaucacuucuggaggugcuggggcugcuggggggaguuaucaugauggugcugauug

SEQ ID NO: 360956 - RNA, 64 nt, Homo Sapiens
aaacaucaaucguguguccugauuugggagugauuggggggauggggugggagaggguuaguug

SEQ ID NO: 360957 - RNA, 64 nt, Homo Sapiens
auuuaucuuuguaaaucuuuuugagucugggggguggggggaaggggggcuucauuaauuauuu

SEQ ID NO: 360958 - RNA, 64 nt, Homo Sapiens
gucagaggaguacgcaguuguaugcaguuaugguuggggggaauguuugugagggucuugaacu

SEQ ID NO: 360959 - RNA, 52 nt, Homo Sapiens
gccuggagcaggccucaugauguggggggacucgacccccugacauggggca

SEQ ID NO: 360960 - RNA, 64 nt, Homo Sapiens
ugacauggggcagcccauagcaggccuugugcaguggggggacucgacccccugacauggggcu

SEQ ID NO: 360961 - RNA, 64 nt, Homo Sapiens
uuuuuguucuuguuguacccaagacgguuggggauggggggauuaggauuucuuguauugguga

SEQ ID NO: 360962 - RNA, 64 nt, Homo Sapiens
aaauagccaccuugauuuuccacagauuaucaacuggggggaccuuguuuuuccaguuccagga

SEQ ID NO: 360963 - RNA, 64 nt, Homo Sapiens
gggcucuguggggugggacaguggggggaaucuauggggggaggauuaggguuugggggggggg

SEQ ID NO: 360964 - RNA, 64 nt, Homo Sapiens
cuauggggggagggggcucuuuuggggggggggguggggggaauguagagggguagaauuaggg

SEQ ID NO: 360965 - RNA, 64 nt, Homo Sapiens
augauccaaccccuggccucugcuucccagcauuuggggggaacggggggaggaggaggcuuau

SEQ ID NO: 360966 - RNA, 64 nt, Homo Sapiens
aggaggcuuauugcuucccacuccagagaaaugguggggggaggcugugagaauaaguccuaau

SEQ ID NO: 360967 - RNA, 64 nt, Homo Sapiens
auugugaaggccuucuucccgggcuguucugagcuggggggaucgccgguuacugggugugcag

SEQ ID NO: 360968 - RNA, 64 nt, Homo Sapiens
agugauauggugaagggaaggccuucuggauccauggggggagauccaagccagaguuuuuaaa

SEQ ID NO: 360969 - RNA, 64 nt, Homo Sapiens
uuguguuguuguugcugcuggaugaagaaggggguggggggaguauuuucacaaucuuggggcu

SEQ ID NO: 360970 - RNA, 64 nt, Homo Sapiens
cgcgggaaggguaggaaaauuucugggguuuggguggggggagagguuuuaaggagcaggaugg

SEQ ID NO: 360971 - RNA, 64 nt, Homo Sapiens
gaaagcggagacccgagcaggggggaguggggaguggggggaagggagaagggggggagcauuc

SEQ ID NO: 360972 - RNA, 64 nt, Homo Sapiens
auuuauggacauguaggucuaguugcauuuucacuggggggaggggggaaggugaauuauggua

SEQ ID NO: 360973 - RNA, 64 nt, Homo Sapiens
ggcagaauccacuguagccuuccgcccugguauuuggggggaugaccagcccaggcguugggug

SEQ ID NO: 360974 - RNA, 64 nt, Homo Sapiens
uggagggagcaaaacacugacccaaaacuagaguuggggggaaccggauugcauccaucacaau

SEQ ID NO: 360975 - RNA, 64 nt, Homo Sapiens
ucuaggaagcuucagcuuaggguguggagcuuguuggggggaugguaaugagcagaucucugug

SEQ ID NO: 360976 - RNA, 64 nt, Homo Sapiens
gccuugucucuaguagugugggagagccuggggguggggggacuaccuccagugucagggucca

SEQ ID NO: 360977 - RNA, 64 nt, Homo Sapiens
uucugccucucccugggucuacccccaucugagcuggggggaugaagaugguggccacagacug

SEQ ID NO: 360978 - RNA, 64 nt, Homo Sapiens
uuaccaccccucagagugcuacagcuaaaguugguggggggaccaaaccgaagguuguuaaaau

SEQ ID NO: 360979 - RNA, 64 nt, Homo Sapiens
ccgaagguuguuaaaauacauccuccucacaaacuggggggaaacccuagggaccaagacugaa

SEQ ID NO: 360980 - RNA, 64 nt, Homo Sapiens
gagagaaaauccacaaauucggugauggcagggauggggggagaucagaggaaccccagggucu

SEQ ID NO: 360981 - RNA, 64 nt, Homo Sapiens
guagacgugggggcgcugggccgaggcccugggcuggggggaggcauggggccuggggcccgau

SEQ ID NO: 360982 - RNA, 64 nt, Homo Sapiens
agaggggccgcuggagaauguuggggacugaggguggggggaguuggucaagccuuauucugua

SEQ ID NO: 360983 - RNA, 64 nt, Homo Sapiens
ggaagggggugcccugaaaccaugggcaggcggguggggggaugagcugcuccuaggacuggcc

SEQ ID NO: 360984 - RNA, 64 nt, Homo Sapiens
gcguggaaauagggauucuggguggggggauggguggggggagguugcaaagccauguuugcac

SEQ ID NO: 360985 - RNA, 64 nt, Homo Sapiens
gguggggggagggcguggaaccauguuugcacgguggggggaugcugggcacuucuuugcaaag

SEQ ID NO: 360986 - RNA, 64 nt, Homo Sapiens
ugugugugcacgugugugugggcggcuguaguuguggggggaugaacaccaugcugguuauuuu

SEQ ID NO: 360987 - RNA, 64 nt, Homo Sapiens
uuacaacaccaugcugguuaauucuagcccccacuggggggauggucacaggucaccaugggga

SEQ ID NO: 360988 - RNA, 64 nt, Homo Sapiens
gacauguuugggucuuuuauuugguuuuuauuuuuggggggaauccugaugauuuuuauuuuug

SEQ ID NO: 360989 - RNA, 64 nt, Homo Sapiens
ggagggaugcaacucgcccuaauuuugguugggguggggggagaguuuauuccaaagagugugg

SEQ ID NO: 360990 - RNA, 64 nt, Homo Sapiens
cuguuugaacuggaaggucugggguuccgggggguggggggaggcuagacucaaugccggggcc

SEQ ID NO: 360991 - RNA, 64 nt, Homo Sapiens
gggucucagguuccagcaagucaggcuagggaccuggggggaggagacccauggacuucaccca

SEQ ID NO: 360992 - RNA, 64 nt, Homo Sapiens
uaaaagggagggauaaauauugauggggaaaggguggggggaaugggaggggggagggguggga

SEQ ID NO: 360993 - RNA, 64 nt, Homo Sapiens
ggggaggggugggaugauggccauagugacaauguggggggagguguuuccauggacacaaucu

SEQ ID NO: 360994 - RNA, 64 nt, Homo Sapiens
gaauugagagggagacaacuggggcagugguggcuggggggaugugauuaccuugggaggggaa

SEQ ID NO: 360995 - RNA, 64 nt, Homo Sapiens
aaauucucaguugucaaaaaagaacgaacagcuguggggggaaaugggagaaguaaagucagaa

SEQ ID NO: 360996 - RNA, 64 nt, Homo Sapiens
agggauuagguguucaggcccauguuuugccacccccugugagcuaagcagacaauucaacugc

SEQ ID NO: 360997 - RNA, 64 nt, Homo Sapiens
acugggugaggauaacacaaaaugggacuggagucccugugaaguggagagagcagguguguua

SEQ ID NO: 360998 - RNA, 64 nt, Homo Sapiens
cccucuaucacccuuauuaccaagccuugugguucccugugauuuuagauaaugucugauauuu

SEQ ID NO: 360999 - RNA, 64 nt, Homo Sapiens
aucacucccagccauugauuuuggugacccacuucccugugaugaucuucugaucuaguuucuc

SEQ ID NO: 361000 - RNA, 64 nt, Homo Sapiens
cuagguguggucccauaggagcagccuuagcauccccugugaacuuaucaaaaaugcaaauucu

SEQ ID NO: 361001 - RNA, 64 nt, Homo Sapiens
aaagcuccuuaaaguucugggcagcuaaaagcaucccugugagcaaaaaugccaggcagaaaac

SEQ ID NO: 361002 - RNA, 64 nt, Homo Sapiens
ggaguguuauauuacuaugcacacacacacaaaacccugugacuaacacacacaccacacacac

SEQ ID NO: 361003 - RNA, 64 nt, Homo Sapiens
accugguagucuuagcagggucugaugccuugaccccugugauguuuuuugaaaaaucagcagu

SEQ ID NO: 361004 - RNA, 64 nt, Homo Sapiens
uuauuuugcuuuaaaucucugguaguuuuuccaccccugugacacaauccuaauagacaguguc

SEQ ID NO: 361005 - RNA, 64 nt, Homo Sapiens
auauucuuucuguaaagucaaacaggauuccauccccugugaaauaacacaaaauuucacucuc

SEQ ID NO: 361006 - RNA, 64 nt, Homo Sapiens
guuuggccugccccagugacagugggacgggcugcccugugaguguccaccuggagggaucccc

SEQ ID NO: 361007 - RNA, 64 nt, Homo Sapiens
ucauucuuggaccucuccuggcugagcucugauucccugugagcacgaugcugaugcaauaguc

SEQ ID NO: 361008 - RNA, 64 nt, Homo Sapiens
cgaccaccuuggccucccaaucuugaacuccugacccugugauccaccauguuggccaggcugg

SEQ ID NO: 361009 - RNA, 64 nt, Homo Sapiens
ggcauagcucauaaacuaccggaaggccaucugacccugugacaauugacccgacuccacucca

SEQ ID NO: 361010 - RNA, 64 nt, Homo Sapiens
uuauuaaaugcccagccccuucugacccaugcugcccugugaguacuacaguccucccaucuca

SEQ ID NO: 361011 - RNA, 64 nt, Homo Sapiens
uuccaggcugggagagccuuccaggggugggacacccugugauggggcccugccuccuuuguga

SEQ ID NO: 361012 - RNA, 64 nt, Homo Sapiens
aaacugcucaguauuccuaucaugcucuguugugcccugugacacucagucaugccagucugga

SEQ ID NO: 361013 - RNA, 64 nt, Homo Sapiens
gauucacugccuugucauuauaaucucuuuacuccccugugagucauugcuuuucuuguuaaga

SEQ ID NO: 361014 - RNA, 64 nt, Homo Sapiens
ugguucccccaagccagcucgacacaaagaugaagugugccagcuuguuucugugucccuacca

SEQ ID NO: 361015 - RNA, 64 nt, Homo Sapiens
augccuggcuaauuuuuguacugggauuagaggcgugugccaccugccucagccucccgaguag

SEQ ID NO: 361016 - RNA, 64 nt, Homo Sapiens
acacucaacuaauuuuuguacugggauuacaggcgugugccacuugccucggccuccugaguag

SEQ ID NO: 361017 - RNA, 64 nt, Homo Sapiens
acauuaauuuuuuuuuuaaaauuuuggggugguggugugccaagauauuaacucaaaaguugag

SEQ ID NO: 361018 - RNA, 64 nt, Homo Sapiens
cagacugucaucacaugcaugcauaaaccggcaugugugccaaugcacacgagugugccacuca

SEQ ID NO: 361019 - RNA, 64 nt, Homo Sapiens
augcauaaaccggcaugugugccaaugcacacgagugugccacucaccaccauuccuuggccag

SEQ ID NO: 361020 - RNA, 64 nt, Homo Sapiens
cacaacagugaaaaguugagcgucauuuuucuuagugugccaagaguucgauguuggcguuucc

SEQ ID NO: 361021 - RNA, 64 nt, Homo Sapiens
uucgauguuggcguuuccguuguauuuucuugcagugugccauucuguuagacauuagcauuuu

SEQ ID NO: 361022 - RNA, 64 nt, Homo Sapiens
ucacaacggugaaacuugagcgucauuuuucuuagugugccaagaguucgauguuaguguuucc

SEQ ID NO: 361023 - RNA, 64 nt, Homo Sapiens
uucgauguuaguguuuccauuguauuuucuuacagugugccauucuguuagauacuauccuuau

SEQ ID NO: 361024 - RNA, 64 nt, Homo Sapiens
cuguuagauauuagcguuuuuguauuuuguuacagugugccauuuucgauguuaguguuucugu

SEQ ID NO: 361025 - RNA, 64 nt, Homo Sapiens
aguucgauguuaguguuucucgucauuuuucuuagugugccaagcacaacagugaaaaguugag

SEQ ID NO: 361026 - RNA, 64 nt, Homo Sapiens
cuguuagacauuagcguuuuuguauuuucuugcagugugccauuuucgauguuggcguuuccgc

SEQ ID NO: 361027 - RNA, 64 nt, Homo Sapiens
aguucgauguuggcguuucccgucauuuuucuuagugugccaagcacaacagugaaaaguugag

SEQ ID NO: 361028 - RNA, 64 nt, Homo Sapiens
cccggcuuuucucugccuuucuaccgaccaugugaccccgcaccagcccugcccccaccugccc

SEQ ID NO: 361029 - RNA, 64 nt, Homo Sapiens
cccccaaccugucccacccccgugcccccuccuuaccccgcaggacgggccuacaggggggucu

SEQ ID NO: 361030 - RNA, 64 nt, Homo Sapiens
agcuaaagcagcguguaaaucaacccaaauaccgcgaaugcaucaaaaauacucuuauacagug

SEQ ID NO: 361031 - RNA, 64 nt, Homo Sapiens
uguaaaucccuaagucaaguucacaugucggagucgaaugcauugggagaagccacgucguguu

SEQ ID NO: 361032 - RNA, 64 nt, Homo Sapiens; identical to SEQ ID NO: 88665

SEQ ID NO: 361033 - RNA, 64 nt, Homo Sapiens; identical to SEQ ID NO: 88666

SEQ ID NO: 361034 - RNA, 64 nt, Homo Sapiens; identical to SEQ ID NO: 88667

SEQ ID NO: 361035 - RNA, 64 nt, Homo Sapiens; identical to SEQ ID NO: 88668

SEQ ID NO: 361036 - RNA, 64 nt, Homo Sapiens; identical to SEQ ID NO: 88669

SEQ ID NO: 361037 - RNA, 64 nt, Homo Sapiens; identical to SEQ ID NO: 88670

SEQ ID NO: 361038 - RNA, 64 nt, Homo Sapiens; identical to SEQ ID NO: 88671

SEQ ID NO: 361039 - RNA, 64 nt, Homo Sapiens; identical to SEQ ID NO: 88672

SEQ ID NO: 361040 - RNA, 64 nt, Homo Sapiens; identical to SEQ ID NO: 88673

SEQ ID NO: 361041 - RNA, 64 nt, Homo Sapiens; identical to SEQ ID NO: 88674

SEQ ID NO: 361042 - RNA, 64 nt, Homo Sapiens; identical to SEQ ID NO: 88675

SEQ ID NO: 361043 - RNA, 64 nt, Homo Sapiens; identical to SEQ ID NO: 88676

SEQ ID NO: 361044 - RNA, 64 nt, Homo Sapiens; identical to SEQ ID NO: 88677

SEQ ID NO: 361045 - RNA, 64 nt, Homo Sapiens; identical to SEQ ID NO: 88678

SEQ ID NO: 361046 - RNA, 64 nt, Homo Sapiens; identical to SEQ ID NO: 88679

SEQ ID NO: 361047 - RNA, 64 nt, Homo Sapiens; identical to SEQ ID NO: 88680

SEQ ID NO: 361048 - RNA, 64 nt, Homo Sapiens; identical to SEQ ID NO: 88681

SEQ ID NO: 361049 - RNA, 64 nt, Homo Sapiens; identical to SEQ ID NO: 88682

SEQ ID NO: 361050 - RNA, 64 nt, Homo Sapiens; identical to SEQ ID NO: 88683

SEQ ID NO: 361051 - RNA, 64 nt, Homo Sapiens; identical to SEQ ID NO: 88684

SEQ ID NO: 361052 - RNA, 64 nt, Homo Sapiens; identical to SEQ ID NO: 88685

SEQ ID NO: 361053 - RNA, 64 nt, Homo Sapiens; identical to SEQ ID NO: 88686

SEQ ID NO: 361054 - RNA, 64 nt, Homo Sapiens; identical to SEQ ID NO: 88687

SEQ ID NO: 361055 - RNA, 64 nt, Homo Sapiens; identical to SEQ ID NO: 88688

SEQ ID NO: 361056 - RNA, 64 nt, Homo Sapiens; identical to SEQ ID NO: 88689

SEQ ID NO: 361057 - RNA, 64 nt, Homo Sapiens; identical to SEQ ID NO: 88690

SEQ ID NO: 361058 - RNA, 64 nt, Homo Sapiens; identical to SEQ ID NO: 88691

SEQ ID NO: 361059 - RNA, 50 nt, Homo Sapiens; identical to SEQ ID NO: 88692

SEQ ID NO: 361060 - RNA, 64 nt, Homo Sapiens; identical to SEQ ID NO: 88693

SEQ ID NO: 361061 - RNA, 64 nt, Homo Sapiens; identical to SEQ ID NO: 88694

SEQ ID NO: 361062 - RNA, 64 nt, Homo Sapiens; identical to SEQ ID NO: 88695

SEQ ID NO: 361063 - RNA, 64 nt, Homo Sapiens; identical to SEQ ID NO: 88696

SEQ ID NO: 361064 - RNA, 64 nt, Homo Sapiens; identical to SEQ ID NO: 88697

SEQ ID NO: 361065 - RNA, 64 nt, Homo Sapiens; identical to SEQ ID NO: 88698

SEQ ID NO: 361066 - RNA, 64 nt, Homo Sapiens; identical to SEQ ID NO: 88699

SEQ ID NO: 361067 - RNA, 64 nt, Homo Sapiens; identical to SEQ ID NO: 88700

SEQ ID NO: 361068 - RNA, 64 nt, Homo Sapiens; identical to SEQ ID NO: 88701

SEQ ID NO: 361069 - RNA, 64 nt, Homo Sapiens; identical to SEQ ID NO: 88702

SEQ ID NO: 361070 - RNA, 64 nt, Homo Sapiens; identical to SEQ ID NO: 88703

SEQ ID NO: 361071 - RNA, 64 nt, Homo Sapiens; identical to SEQ ID NO: 88704

SEQ ID NO: 361072 - RNA, 64 nt, Homo Sapiens; identical to SEQ ID NO: 88705

SEQ ID NO: 361073 - RNA, 64 nt, Homo Sapiens; identical to SEQ ID NO: 88706

SEQ ID NO: 361074 - RNA, 64 nt, Homo Sapiens; identical to SEQ ID NO: 88707

SEQ ID NO: 361075 - RNA, 64 nt, Homo Sapiens; identical to SEQ ID NO: 88708

SEQ ID NO: 361076 - RNA, 64 nt, Homo Sapiens; identical to SEQ ID NO: 88709

SEQ ID NO: 361077 - RNA, 64 nt, Homo Sapiens; identical to SEQ ID NO: 88710

SEQ ID NO: 361078 - RNA, 64 nt, Homo Sapiens; identical to SEQ ID NO: 88711

SEQ ID NO: 361079 - RNA, 64 nt, Homo Sapiens; identical to SEQ ID NO: 88712

SEQ ID NO: 361080 - RNA, 64 nt, Homo Sapiens; identical to SEQ ID NO: 88713

SEQ ID NO: 361081 - RNA, 64 nt, Homo Sapiens; identical to SEQ ID NO: 88714

SEQ ID NO: 361082 - RNA, 64 nt, Homo Sapiens; identical to SEQ ID NO: 88715

SEQ ID NO: 361083 - RNA, 64 nt, Homo Sapiens; identical to SEQ ID NO: 88716

SEQ ID NO: 361084 - RNA, 64 nt, Homo Sapiens; identical to SEQ ID NO: 88717

SEQ ID NO: 361085 - RNA, 64 nt, Homo Sapiens; identical to SEQ ID NO: 88718

SEQ ID NO: 361086 - RNA, 64 nt, Homo Sapiens; identical to SEQ ID NO: 88719

SEQ ID NO: 361087 - RNA, 64 nt, Homo Sapiens; identical to SEQ ID NO: 88720

SEQ ID NO: 361088 - RNA, 64 nt, Homo Sapiens; identical to SEQ ID NO: 88721

SEQ ID NO: 361089 - RNA, 64 nt, Homo Sapiens; identical to SEQ ID NO: 88722

SEQ ID NO: 361090 - RNA, 64 nt, Homo Sapiens; identical to SEQ ID NO: 88723

SEQ ID NO: 361091 - RNA, 64 nt, Homo Sapiens; identical to SEQ ID NO: 88724

SEQ ID NO: 361092 - RNA, 64 nt, Homo Sapiens; identical to SEQ ID NO: 88725

SEQ ID NO: 361093 - RNA, 64 nt, Homo Sapiens; identical to SEQ ID NO: 88726

SEQ ID NO: 361094 - RNA, 64 nt, Homo Sapiens; identical to SEQ ID NO: 88727

SEQ ID NO: 361095 - RNA, 64 nt, Homo Sapiens; identical to SEQ ID NO: 88728

SEQ ID NO: 361096 - RNA, 64 nt, Homo Sapiens; identical to SEQ ID NO: 88729

SEQ ID NO: 361097 - RNA, 64 nt, Homo Sapiens; identical to SEQ ID NO: 88730

SEQ ID NO: 361098 - RNA, 64 nt, Homo Sapiens; identical to SEQ ID NO: 88731

SEQ ID NO: 361099 - RNA, 64 nt, Homo Sapiens; identical to SEQ ID NO: 88732

SEQ ID NO: 361100 - RNA, 64 nt, Homo Sapiens; identical to SEQ ID NO: 88733

SEQ ID NO: 361101 - RNA, 64 nt, Homo Sapiens; identical to SEQ ID NO: 88734

SEQ ID NO: 361102 - RNA, 64 nt, Homo Sapiens; identical to SEQ ID NO: 88735

SEQ ID NO: 361103 - RNA, 64 nt, Homo Sapiens; identical to SEQ ID NO: 88736

SEQ ID NO: 361104 - RNA, 64 nt, Homo Sapiens; identical to SEQ ID NO: 88737

SEQ ID NO: 361105 - RNA, 64 nt, Homo Sapiens; identical to SEQ ID NO: 88738

SEQ ID NO: 361106 - RNA, 64 nt, Homo Sapiens; identical to SEQ ID NO: 88739

SEQ ID NO: 361107 - RNA, 64 nt, Homo Sapiens; identical to SEQ ID NO: 88740

SEQ ID NO: 361108 - RNA, 64 nt, Homo Sapiens; identical to SEQ ID NO: 88741

SEQ ID NO: 361109 - RNA, 64 nt, Homo Sapiens; identical to SEQ ID NO: 88742

SEQ ID NO: 361110 - RNA, 64 nt, Homo Sapiens; identical to SEQ ID NO: 88743

SEQ ID NO: 361111 - RNA, 64 nt, Homo Sapiens; identical to SEQ ID NO: 88744

SEQ ID NO: 361112 - RNA, 64 nt, Homo Sapiens; identical to SEQ ID NO: 88745

SEQ ID NO: 361113 - RNA, 64 nt, Homo Sapiens; identical to SEQ ID NO: 88746

SEQ ID NO: 361114 - RNA, 64 nt, Homo Sapiens; identical to SEQ ID NO: 88747

SEQ ID NO: 361115 - RNA, 64 nt, Homo Sapiens; identical to SEQ ID NO: 88748

SEQ ID NO: 361116 - RNA, 64 nt, Homo Sapiens; identical to SEQ ID NO: 88749

SEQ ID NO: 361117 - RNA, 64 nt, Homo Sapiens; identical to SEQ ID NO: 88750

SEQ ID NO: 361118 - RNA, 64 nt, Homo Sapiens; identical to SEQ ID NO: 88751

SEQ ID NO: 361119 - RNA, 64 nt, Homo Sapiens; identical to SEQ ID NO: 88752

SEQ ID NO: 361120 - RNA, 64 nt, Homo Sapiens; identical to SEQ ID NO: 88753

SEQ ID NO: 361121 - RNA, 64 nt, Homo Sapiens; identical to SEQ ID NO: 88754

SEQ ID NO: 361122 - RNA, 64 nt, Homo Sapiens; identical to SEQ ID NO: 88755

SEQ ID NO: 361123 - RNA, 64 nt, Homo Sapiens; identical to SEQ ID NO: 88756

SEQ ID NO: 361124 - RNA, 64 nt, Homo Sapiens; identical to SEQ ID NO: 88757

SEQ ID NO: 361125 - RNA, 64 nt, Homo Sapiens; identical to SEQ ID NO: 88758

SEQ ID NO: 361126 - RNA, 64 nt, Homo Sapiens; identical to SEQ ID NO: 88759

SEQ ID NO: 361127 - RNA, 64 nt, Homo Sapiens; identical to SEQ ID NO: 88760

SEQ ID NO: 361128 - RNA, 64 nt, Homo Sapiens; identical to SEQ ID NO: 88761

SEQ ID NO: 361129 - RNA, 64 nt, Homo Sapiens; identical to SEQ ID NO: 88762

SEQ ID NO: 361130 - RNA, 64 nt, Homo Sapiens; identical to SEQ ID NO: 88763

SEQ ID NO: 361131 - RNA, 64 nt, Homo Sapiens; identical to SEQ ID NO: 88764

SEQ ID NO: 361132 - RNA, 64 nt, Homo Sapiens; identical to SEQ ID NO: 88765

SEQ ID NO: 361133 - RNA, 64 nt, Homo Sapiens
gcugccaagcauuagguuggaagaugcaaaguuuauaccugaugaucagggcaguaggcauaau

SEQ ID NO: 361134 - RNA, 64 nt, Homo Sapiens
acauacguauacacacacauacauauauauaaauauaccugaugccagauuuuuuucauaaaua

SEQ ID NO: 361135 - RNA, 64 nt, Homo Sapiens
augcauuuuucugcuacuacuacaguuucacagaauaccugagaagacacacuuggagaaaccu

SEQ ID NO: 361136 - RNA, 64 nt, Homo Sapiens
agagauugguugugccuugucacaacugcaaacaauaccugaguggaguauucaaaaacuugcu

SEQ ID NO: 361137 - RNA, 64 nt, Homo Sapiens
caggacauuggagugggcaaagauuucuuguguaauaccugacaaacaggcaaccaaagcaaaa

SEQ ID NO: 361138 - RNA, 64 nt, Homo Sapiens
cuguuaaguauugcgauaugacuaaacauacuguauaccugaugaucaucuguaaaguuagagu

SEQ ID NO: 361139 - RNA, 64 nt, Homo Sapiens
cuagccuauguguauuuguguagaauaaugugggauaccugaauaauagauuuaaaaggaccaa

SEQ ID NO: 361140 - RNA, 64 nt, Homo Sapiens
uuagaaaaucucacuuuauuaggcagaugacauuauaccugauuaaaagaacaguuuuuuggag

SEQ ID NO: 361141 - RNA, 64 nt, Homo Sapiens
auacuguguaacaaauauuuuuuuuuucauaaccauaccugauucguguuugaguauuuucuca

SEQ ID NO: 361142 - RNA, 64 nt, Homo Sapiens; identical to SEQ ID NO: 277333

SEQ ID NO: 361143 - RNA, 64 nt, Homo Sapiens; identical to SEQ ID NO: 277334

SEQ ID NO: 361144 - RNA, 59 nt, Homo Sapiens; identical to SEQ ID NO: 277335

SEQ ID NO: 361145 - RNA, 64 nt, Homo Sapiens; identical to SEQ ID NO: 277336

SEQ ID NO: 361146 - RNA, 64 nt, Homo Sapiens; identical to SEQ ID NO: 277337

SEQ ID NO: 361147 - RNA, 64 nt, Homo Sapiens; identical to SEQ ID NO: 277338

SEQ ID NO: 361148 - RNA, 64 nt, Homo Sapiens
ccauuuguucuucuguuggagagaugagacauuugacccuuagcuccaguuuucuucugauguu

SEQ ID NO: 361149 - RNA, 64 nt, Homo Sapiens
ccacucuaaaccuucccucuaaguguagagggaagacccuuacguggaguuuccuagugggcuu

SEQ ID NO: 361150 - RNA, 64 nt, Homo Sapiens
uggguuuaaaguuuacuucauuaucugcuagugucauccacagcaguucauccucauccacacu

SEQ ID NO: 361151 - RNA, 64 nt, Homo Sapiens
uuaucugcuagugucauccacagcaguucauccucauccacacuaagccauccuguuagcuuuu

SEQ ID NO: 361152 - RNA, 64 nt, Homo Sapiens
uauuuuauuauguuuauuaaucaccucuaauacucauccacaugaaggguacacauuagguaag

SEQ ID NO: 361153 - RNA, 64 nt, Homo Sapiens
gaaugauuagaaagacgggcaacacagcggguuacauccacacugcugaucacaccaacgacag

SEQ ID NO: 361154 - RNA, 64 nt, Homo Sapiens
ugaguuaaaaaaauaauagaaguagaaaugcccacauccacacuuagcuuguuuggguuugcuu

SEQ ID NO: 361155 - RNA, 64 nt, Homo Sapiens
aggacaguauuucagaaaaggagagguugacagucauccacaaggcauagccuccaaguauacu

SEQ ID NO: 361156 - RNA, 64 nt, Homo Sapiens
ucccaggucuaugcccaagagaauugaaaacauccauccacacaauaccugugcucccgcguuc

SEQ ID NO: 361157 - RNA, 64 nt, Homo Sapiens
ucaaaagucaaacgguagcaacaacccaaauguccauccacagaugaauuaagacaugaagugu

SEQ ID NO: 361158 - RNA, 64 nt, Homo Sapiens
uauuauuucauaaauaauuucaagcaaauacagacauccacaauguagaacaugagagaccccc

SEQ ID NO: 361159 - RNA, 64 nt, Homo Sapiens
aaacauuuacugagugucugucagggaucauucacauccacaucauccucccggccccuccccg

SEQ ID NO: 361160 - RNA, 64 nt, Homo Sapiens
guuuuucugacagugaugauaugauauacagauacauccacaggguaucuauuaccagcauaau

SEQ ID NO: 361161 - RNA, 64 nt, Homo Sapiens
auaaucaauccuuucuaguucagugaauugaccccauccacaggcugauucaucuuuguguuaa

SEQ ID NO: 361162 - RNA, 64 nt, Homo Sapiens
auccucaggaguuccaggcacaugagucaccguccauccacauccaguguggccuggagcugcu

SEQ ID NO: 361163 - RNA, 64 nt, Homo Sapiens
aggccagcccuggccccuccacugcuucucuccccauccacaauggagaaggugaaaagaggag

SEQ ID NO: 361164 - RNA, 64 nt, Homo Sapiens
gcaagaggaaaaugcccugucccuagcucacacucauccacacuuaagcccucgugcacacaca

SEQ ID NO: 361165 - RNA, 64 nt, Homo Sapiens
ccaggccaaagauccccccagacccccauucugacauccacaugcucugcaguccuggcccccu

SEQ ID NO: 361166 - RNA, 64 nt, Homo Sapiens
acuccccaucccccuaugcagggugucauuucaccauccacauccacauccuuguuuguguuuc

SEQ ID NO: 361167 - RNA, 64 nt, Homo Sapiens
caucccccuaugcagggugucauuucaccauccacauccacauccuuguuuguguuucuggccc

SEQ ID NO: 361168 - RNA, 64 nt, Homo Sapiens
ucacacaccuguugucagcaccgggcuucauccacauccacacccagaacggccacucgagacc

SEQ ID NO: 361169 - RNA, 64 nt, Homo Sapiens
cacaccucacacaccuguuggagaccccgggcuucauccacaucuggccccagaacggccacuc

SEQ ID NO: 361170 - RNA, 64 nt, Homo Sapiens
guccccaaagccauccugcuacugugguugcccucauccacaauagagaaaauaaccuggucuc

SEQ ID NO: 361171 - RNA, 64 nt, Homo Sapiens
gguugcagauguccuugaagauucaccugguucccauccacaugauacagccccuuuucccugc

SEQ ID NO: 361172 - RNA, 64 nt, Homo Sapiens; identical to SEQ ID NO: 108245

SEQ ID NO: 361173 - RNA, 64 nt, Homo Sapiens; identical to SEQ ID NO: 108246

SEQ ID NO: 361174 - RNA, 64 nt, Homo Sapiens; identical to SEQ ID NO: 108247

SEQ ID NO: 361175 - RNA, 64 nt, Homo Sapiens; identical to SEQ ID NO: 108248

SEQ ID NO: 361176 - RNA, 64 nt, Homo Sapiens; identical to SEQ ID NO: 108249

SEQ ID NO: 361177 - RNA, 64 nt, Homo Sapiens; identical to SEQ ID NO: 108250

SEQ ID NO: 361178 - RNA, 64 nt, Homo Sapiens; identical to SEQ ID NO: 108251

SEQ ID NO: 361179 - RNA, 64 nt, Homo Sapiens; identical to SEQ ID NO: 108252

SEQ ID NO: 361180 - RNA, 64 nt, Homo Sapiens; identical to SEQ ID NO: 108253

SEQ ID NO: 361181 - RNA, 64 nt, Homo Sapiens; identical to SEQ ID NO: 108254

SEQ ID NO: 361182 - RNA, 64 nt, Homo Sapiens; identical to SEQ ID NO: 108255

SEQ ID NO: 361183 - RNA, 64 nt, Homo Sapiens; identical to SEQ ID NO: 108256

SEQ ID NO: 361184 - RNA, 64 nt, Homo Sapiens; identical to SEQ ID NO: 108257

SEQ ID NO: 361185 - RNA, 64 nt, Homo Sapiens; identical to SEQ ID NO: 108258

SEQ ID NO: 361186 - RNA, 64 nt, Homo Sapiens; identical to SEQ ID NO: 108259

SEQ ID NO: 361187 - RNA, 64 nt, Homo Sapiens; identical to SEQ ID NO: 108260

SEQ ID NO: 361188 - RNA, 64 nt, Homo Sapiens; identical to SEQ ID NO: 108261

SEQ ID NO: 361189 - RNA, 64 nt, Homo Sapiens; identical to SEQ ID NO: 108262

SEQ ID NO: 361190 - RNA, 64 nt, Homo Sapiens; identical to SEQ ID NO: 108263

SEQ ID NO: 361191 - RNA, 64 nt, Homo Sapiens; identical to SEQ ID NO: 108264

SEQ ID NO: 361192 - RNA, 64 nt, Homo Sapiens; identical to SEQ ID NO: 108265

SEQ ID NO: 361193 - RNA, 64 nt, Homo Sapiens; identical to SEQ ID NO: 108266

SEQ ID NO: 361194 - RNA, 64 nt, Homo Sapiens; identical to SEQ ID NO: 108267

SEQ ID NO: 361195 - RNA, 64 nt, Homo Sapiens; identical to SEQ ID NO: 108268

SEQ ID NO: 361196 - RNA, 64 nt, Homo Sapiens; identical to SEQ ID NO: 108269

SEQ ID NO: 361197 - RNA, 64 nt, Homo Sapiens; identical to SEQ ID NO: 108270

SEQ ID NO: 361198 - RNA, 64 nt, Homo Sapiens; identical to SEQ ID NO: 108271

SEQ ID NO: 361199 - RNA, 64 nt, Homo Sapiens; identical to SEQ ID NO: 108272

SEQ ID NO: 361200 - RNA, 64 nt, Homo Sapiens; identical to SEQ ID NO: 108273

SEQ ID NO: 361201 - RNA, 64 nt, Homo Sapiens; identical to SEQ ID NO: 108274

SEQ ID NO: 361202 - RNA, 64 nt, Homo Sapiens; identical to SEQ ID NO: 108275

SEQ ID NO: 361203 - RNA, 64 nt, Homo Sapiens; identical to SEQ ID NO: 108276

SEQ ID NO: 361204 - RNA, 64 nt, Homo Sapiens; identical to SEQ ID NO: 108277

SEQ ID NO: 361205 - RNA, 64 nt, Homo Sapiens; identical to SEQ ID NO: 108278

SEQ ID NO: 361206 - RNA, 64 nt, Homo Sapiens; identical to SEQ ID NO: 108279

SEQ ID NO: 361207 - RNA, 64 nt, Homo Sapiens; identical to SEQ ID NO: 108280

SEQ ID NO: 361208 - RNA, 64 nt, Homo Sapiens; identical to SEQ ID NO: 108281

SEQ ID NO: 361209 - RNA, 64 nt, Homo Sapiens; identical to SEQ ID NO: 108282

SEQ ID NO: 361210 - RNA, 64 nt, Homo Sapiens; identical to SEQ ID NO: 108283

SEQ ID NO: 361211 - RNA, 64 nt, Homo Sapiens; identical to SEQ ID NO: 108284

SEQ ID NO: 361212 - RNA, 64 nt, Homo Sapiens
aaaagauguugaaucuuguuaauguaugucauaaacauguaaauaaaaauuguguaugaccauu

SEQ ID NO: 361213 - RNA, 64 nt, Homo Sapiens
cauuccuaaagcacaagaaagauauaagcagaucacauguaaauguuauaaaguauaaaauuaa

SEQ ID NO: 361214 - RNA, 64 nt, Homo Sapiens
aaaggaagcuaagcagugggagauauaaaugcuuacauguaaagcuucaacccuuuuaaaaccu

SEQ ID NO: 361215 - RNA, 64 nt, Homo Sapiens
caggacaauuuaaaaauuuuauuacaaguauauuacauguaaaauacaaguacauuacauguau

SEQ ID NO: 361216 - RNA, 64 nt, Homo Sapiens
aaacuugagcaccauugcugguuccauuuagcuuacauguaaauguaauuauuuaaaacacaca

SEQ ID NO: 361217 - RNA, 64 nt, Homo Sapiens
cugauuauggugccuaagagagcuauauauauacacauguaaaguccauuguuuuuauuguccu

SEQ ID NO: 361218 - RNA, 64 nt, Homo Sapiens
aagagacucuuugcugaaauugaauugcacuuauacauguaaauugucaacauguaauuuggaa

SEQ ID NO: 361219 - RNA, 64 nt, Homo Sapiens
gaaauugaauugcacuuauacauguaaauugucaacauguaauuuggaauuuucugauuaauaa

SEQ ID NO: 361220 - RNA, 64 nt, Homo Sapiens
acagaaaucccuuucucuccccuaucacaaguuuacauguaaccucacauguaacuucugcaga

SEQ ID NO: 361221 - RNA, 64 nt, Homo Sapiens
ucugcagaccuaucacaaguucacuauccucuucacauguaacuauggaucauggcugacuucc

SEQ ID NO: 361222 - RNA, 64 nt, Homo Sapiens
uuguuaaaaaucaaaaucuucuacauguaauuggacauguaaaccugguuuucauuccuuuuau

SEQ ID NO: 361223 - RNA, 64 nt, Homo Sapiens
ggacauguaaacuuguuaaacauuccuuuuaucuacauguaauuaaggugucuuuacugguuuu

SEQ ID NO: 361224 - RNA, 64 nt, Homo Sapiens
cauugaaucucagggauggcccacaacuggguccacauguaaugagcccuguuuaauaacgaag

SEQ ID NO: 361225 - RNA, 64 nt, Homo Sapiens
uagaugacgcaaagaaucuccugguagagaagcgacauguaaaaaacugguggaaaaagguuuu

SEQ ID NO: 361226 - RNA, 64 nt, Homo Sapiens
uaauacaugaaagaauucuagagagaagccauauacauguaaguaacaugggaaagcuuucaau

SEQ ID NO: 361227 - RNA, 64 nt, Homo Sapiens
cacacguuuuuagccagcccacaugcuuucaacaacauguaagaauguacccuggaucaaaaca

SEQ ID NO: 361228 - RNA, 64 nt, Homo Sapiens
gcgcguuggugucuccguguuugucccugugaaaacauguaacgucugccuuagagccaugacc

SEQ ID NO: 361229 - RNA, 64 nt, Homo Sapiens
caagguuauuaugugcaucuguuauuuuuccaauacauguaaacaguugcagcaugaugcuuug

SEQ ID NO: 361230 - RNA, 64 nt, Homo Sapiens
uaauauguuguuuuucugucccuuuaaagucuuuacauguaauuguagcuguauaaucguuauu

SEQ ID NO: 361231 - RNA, 64 nt, Homo Sapiens
aggaauuugcagccguuuuacaaauaucuguggaacauguaaauacugucaaauggaaaauaaa

SEQ ID NO: 361232 - RNA, 64 nt, Homo Sapiens
uacuuagaucagugucugcuauuuagauguuuauacauguaaugaauuguugggaggauugaua

SEQ ID NO: 361233 - RNA, 64 nt, Homo Sapiens
uacaauuuugagugcuuuauuucagaagucauauacauguaagcuuagaagugugauuuuuauu

SEQ ID NO: 361234 - RNA, 64 nt, Homo Sapiens
uaacauacccuaguugccguuuuuuaauugccaugagccaaauacuucuugguauacaauugau

SEQ ID NO: 361235 - RNA, 64 nt, Homo Sapiens
uggaaaucgccccuuuugaaggugccauucuuaugagccaaaaguuugucauuuaaaaguucau

SEQ ID NO: 361236 - RNA, 64 nt, Homo Sapiens
aagauuuauuaaauuuccuuguggcuccuuugcagagccaaaaccaguuaaaugcuuugauaua

SEQ ID NO: 361237 - RNA, 64 nt, Homo Sapiens
cucggcgcucaccuaagccgcagcagcuggggaggagccaaagcccggcgcagugggaagcucg

SEQ ID NO: 361238 - RNA, 64 nt, Homo Sapiens
gcugaucagaauucacuuuugucgccaaauagcugagccaaaagaagagguuuuuuaaaagacu

SEQ ID NO: 361239 - RNA, 64 nt, Homo Sapiens
ugaccaaggcuauucagcagccuaaaauaggagagagccaaaacgaaacaaaaauauuuuuccc

SEQ ID NO: 361240 - RNA, 64 nt, Homo Sapiens; identical to SEQ ID NO: 125404

SEQ ID NO: 361241 - RNA, 64 nt, Homo Sapiens; identical to SEQ ID NO: 125405

SEQ ID NO: 361242 - RNA, 64 nt, Homo Sapiens; identical to SEQ ID NO: 125406

SEQ ID NO: 361243 - RNA, 64 nt, Homo Sapiens; identical to SEQ ID NO: 125407

SEQ ID NO: 361244 - RNA, 64 nt, Homo Sapiens; identical to SEQ ID NO: 125408

SEQ ID NO: 361245 - RNA, 57 nt, Homo Sapiens; identical to SEQ ID NO: 125409

SEQ ID NO: 361246 - RNA, 64 nt, Homo Sapiens; identical to SEQ ID NO: 125410

SEQ ID NO: 361247 - RNA, 64 nt, Homo Sapiens; identical to SEQ ID NO: 125411

SEQ ID NO: 361248 - RNA, 64 nt, Homo Sapiens; identical to SEQ ID NO: 125412

SEQ ID NO: 361249 - RNA, 64 nt, Homo Sapiens; identical to SEQ ID NO: 125413

SEQ ID NO: 361250 - RNA, 64 nt, Homo Sapiens; identical to SEQ ID NO: 125414

SEQ ID NO: 361251 - RNA, 64 nt, Homo Sapiens; identical to SEQ ID NO: 125415

SEQ ID NO: 361252 - RNA, 64 nt, Homo Sapiens; identical to SEQ ID NO: 125416

SEQ ID NO: 361253 - RNA, 63 nt, Homo Sapiens; identical to SEQ ID NO: 125417

SEQ ID NO: 361254 - RNA, 64 nt, Homo Sapiens; identical to SEQ ID NO: 125418

SEQ ID NO: 361255 - RNA, 64 nt, Homo Sapiens; identical to SEQ ID NO: 125419

SEQ ID NO: 361256 - RNA, 64 nt, Homo Sapiens; identical to SEQ ID NO: 125420

SEQ ID NO: 361257 - RNA, 64 nt, Homo Sapiens; identical to SEQ ID NO: 125421

SEQ ID NO: 361258 - RNA, 53 nt, Homo Sapiens; identical to SEQ ID NO: 125422

SEQ ID NO: 361259 - RNA, 64 nt, Homo Sapiens; identical to SEQ ID NO: 125423

SEQ ID NO: 361260 - RNA, 64 nt, Homo Sapiens; identical to SEQ ID NO: 125424

SEQ ID NO: 361261 - RNA, 64 nt, Homo Sapiens; identical to SEQ ID NO: 125425

SEQ ID NO: 361262 - RNA, 64 nt, Homo Sapiens; identical to SEQ ID NO: 125426

SEQ ID NO: 361263 - RNA, 64 nt, Homo Sapiens; identical to SEQ ID NO: 125427

SEQ ID NO: 361264 - RNA, 64 nt, Homo Sapiens; identical to SEQ ID NO: 125428

SEQ ID NO: 361265 - RNA, 64 nt, Homo Sapiens; identical to SEQ ID NO: 125429

SEQ ID NO: 361266 - RNA, 56 nt, Homo Sapiens; identical to SEQ ID NO: 125430

SEQ ID NO: 361267 - RNA, 64 nt, Homo Sapiens; identical to SEQ ID NO: 125431

SEQ ID NO: 361268 - RNA, 60 nt, Homo Sapiens; identical to SEQ ID NO: 125432

SEQ ID NO: 361269 - RNA, 64 nt, Homo Sapiens; identical to SEQ ID NO: 125433

SEQ ID NO: 361270 - RNA, 64 nt, Homo Sapiens; identical to SEQ ID NO: 125434

SEQ ID NO: 361271 - RNA, 64 nt, Homo Sapiens; identical to SEQ ID NO: 125435

SEQ ID NO: 361272 - RNA, 64 nt, Homo Sapiens; identical to SEQ ID NO: 125436

SEQ ID NO: 361273 - RNA, 60 nt, Homo Sapiens; identical to SEQ ID NO: 125437

SEQ ID NO: 361274 - RNA, 64 nt, Homo Sapiens; identical to SEQ ID NO: 125438

SEQ ID NO: 361275 - RNA, 64 nt, Homo Sapiens; identical to SEQ ID NO: 125439

SEQ ID NO: 361276 - RNA, 64 nt, Homo Sapiens; identical to SEQ ID NO: 125440

SEQ ID NO: 361277 - RNA, 64 nt, Homo Sapiens; identical to SEQ ID NO: 125441

SEQ ID NO: 361278 - RNA, 64 nt, Homo Sapiens; identical to SEQ ID NO: 125442

SEQ ID NO: 361279 - RNA, 64 nt, Homo Sapiens; identical to SEQ ID NO: 125443

SEQ ID NO: 361280 - RNA, 64 nt, Homo Sapiens; identical to SEQ ID NO: 125444

SEQ ID NO: 361281 - RNA, 64 nt, Homo Sapiens; identical to SEQ ID NO: 125445

SEQ ID NO: 361282 - RNA, 64 nt, Homo Sapiens; identical to SEQ ID NO: 125446

SEQ ID NO: 361283 - RNA, 64 nt, Homo Sapiens; identical to SEQ ID NO: 125447

SEQ ID NO: 361284 - RNA, 64 nt, Homo Sapiens; identical to SEQ ID NO: 125448

SEQ ID NO: 361285 - RNA, 64 nt, Homo Sapiens; identical to SEQ ID NO: 125449

SEQ ID NO: 361286 - RNA, 64 nt, Homo Sapiens; identical to SEQ ID NO: 125450

SEQ ID NO: 361287 - RNA, 64 nt, Homo Sapiens; identical to SEQ ID NO: 125451

SEQ ID NO: 361288 - RNA, 64 nt, Homo Sapiens; identical to SEQ ID NO: 125452

SEQ ID NO: 361289 - RNA, 64 nt, Homo Sapiens; identical to SEQ ID NO: 125453

SEQ ID NO: 361290 - RNA, 64 nt, Homo Sapiens; identical to SEQ ID NO: 125454

SEQ ID NO: 361291 - RNA, 64 nt, Homo Sapiens; identical to SEQ ID NO: 125455

SEQ ID NO: 361292 - RNA, 64 nt, Homo Sapiens; identical to SEQ ID NO: 125456

SEQ ID NO: 361293 - RNA, 64 nt, Homo Sapiens; identical to SEQ ID NO: 125457

SEQ ID NO: 361294 - RNA, 64 nt, Homo Sapiens; identical to SEQ ID NO: 125458

SEQ ID NO: 361295 - RNA, 64 nt, Homo Sapiens; identical to SEQ ID NO: 125459

SEQ ID NO: 361296 - RNA, 64 nt, Homo Sapiens; identical to SEQ ID NO: 125460

SEQ ID NO: 361297 - RNA, 59 nt, Homo Sapiens; identical to SEQ ID NO: 125461

SEQ ID NO: 361298 - RNA, 64 nt, Homo Sapiens; identical to SEQ ID NO: 125462

SEQ ID NO: 361299 - RNA, 64 nt, Homo Sapiens; identical to SEQ ID NO: 125463

SEQ ID NO: 361300 - RNA, 64 nt, Homo Sapiens; identical to SEQ ID NO: 125464

SEQ ID NO: 361301 - RNA, 64 nt, Homo Sapiens; identical to SEQ ID NO: 125465

SEQ ID NO: 361302 - RNA, 64 nt, Homo Sapiens; identical to SEQ ID NO: 125466

SEQ ID NO: 361303 - RNA, 64 nt, Homo Sapiens; identical to SEQ ID NO: 125467

SEQ ID NO: 361304 - RNA, 64 nt, Homo Sapiens; identical to SEQ ID NO: 125468

SEQ ID NO: 361305 - RNA, 64 nt, Homo Sapiens; identical to SEQ ID NO: 125469

SEQ ID NO: 361306 - RNA, 64 nt, Homo Sapiens; identical to SEQ ID NO: 125470

SEQ ID NO: 361307 - RNA, 64 nt, Homo Sapiens; identical to SEQ ID NO: 125471

SEQ ID NO: 361308 - RNA, 64 nt, Homo Sapiens; identical to SEQ ID NO: 125472

SEQ ID NO: 361309 - RNA, 64 nt, Homo Sapiens; identical to SEQ ID NO: 125473

SEQ ID NO: 361310 - RNA, 64 nt, Homo Sapiens; identical to SEQ ID NO: 125474

SEQ ID NO: 361311 - RNA, 55 nt, Homo Sapiens; identical to SEQ ID NO: 125475

SEQ ID NO: 361312 - RNA, 64 nt, Homo Sapiens; identical to SEQ ID NO: 125476

SEQ ID NO: 361313 - RNA, 64 nt, Homo Sapiens; identical to SEQ ID NO: 125477

SEQ ID NO: 361314 - RNA, 64 nt, Homo Sapiens; identical to SEQ ID NO: 125478

SEQ ID NO: 361315 - RNA, 64 nt, Homo Sapiens; identical to SEQ ID NO: 125479

SEQ ID NO: 361316 - RNA, 64 nt, Homo Sapiens; identical to SEQ ID NO: 125480

SEQ ID NO: 361317 - RNA, 64 nt, Homo Sapiens; identical to SEQ ID NO: 125481

SEQ ID NO: 361318 - RNA, 64 nt, Homo Sapiens; identical to SEQ ID NO: 125482

SEQ ID NO: 361319 - RNA, 64 nt, Homo Sapiens; identical to SEQ ID NO: 125483

SEQ ID NO: 361320 - RNA, 64 nt, Homo Sapiens; identical to SEQ ID NO: 125484

SEQ ID NO: 361321 - RNA, 64 nt, Homo Sapiens; identical to SEQ ID NO: 125485

SEQ ID NO: 361322 - RNA, 64 nt, Homo Sapiens; identical to SEQ ID NO: 125486

SEQ ID NO: 361323 - RNA, 64 nt, Homo Sapiens; identical to SEQ ID NO: 125487

SEQ ID NO: 361324 - RNA, 64 nt, Homo Sapiens; identical to SEQ ID NO: 125488

SEQ ID NO: 361325 - RNA, 64 nt, Homo Sapiens; identical to SEQ ID NO: 125489

SEQ ID NO: 361326 - RNA, 64 nt, Homo Sapiens; identical to SEQ ID NO: 125490

SEQ ID NO: 361327 - RNA, 64 nt, Homo Sapiens; identical to SEQ ID NO: 125491

SEQ ID NO: 361328 - RNA, 64 nt, Homo Sapiens; identical to SEQ ID NO: 125492

SEQ ID NO: 361329 - RNA, 64 nt, Homo Sapiens; identical to SEQ ID NO: 125493

SEQ ID NO: 361330 - RNA, 64 nt, Homo Sapiens; identical to SEQ ID NO: 125494

SEQ ID NO: 361331 - RNA, 64 nt, Homo Sapiens; identical to SEQ ID NO: 125495

SEQ ID NO: 361332 - RNA, 64 nt, Homo Sapiens; identical to SEQ ID NO: 125496

SEQ ID NO: 361333 - RNA, 61 nt, Homo Sapiens
ucuuggcugguccagggacugcagaaaccaaagcugcuauuguugaggaauaauucagugg

SEQ ID NO: 361334 - RNA, 61 nt, Homo Sapiens
gcccuuuuguccuugcucccuggcuagggaaagcugcuaguggucagccuguuuugccuuu

SEQ ID NO: 361335 - RNA, 61 nt, Homo Sapiens
agucaguacacagcugacuuauguagauuuaagcugcuaauaugcuacuuaaccaucuauu

SEQ ID NO: 361336 - RNA, 61 nt, Homo Sapiens
caaagcaaaaaaaaaaaaaaaaaaaccaguuagcugcuauauaaacacuauaccaagcacu

SEQ ID NO: 361337 - RNA, 61 nt, Homo Sapiens
uccuccuugguggacguuucuguuuacucagagcugcuagagaccauccugcccauccgag

SEQ ID NO: 361338 - RNA, 61 nt, Homo Sapiens
aaguggcauuauuuauguugugcugcuguccagcugcuaagaucccuucaucugcacaagc

SEQ ID NO: 361339 - RNA, 61 nt, Homo Sapiens
agcuucacgcagguuuggccugguggccuguagcugcuaaggaguuaauggcaaccaauaa

SEQ ID NO: 361340 - RNA, 61 nt, Homo Sapiens
auuguauuucaguggcaauguguggauuuuaagcugcuauuuguucgguugugugacuaau

SEQ ID NO: 361341 - RNA, 61 nt, Homo Sapiens
uugugucucugagauugacuucaagauaauaagcugcuaauuguaaacaaaacaguuaccc

SEQ ID NO: 361342 - RNA, 61 nt, Homo Sapiens
auuuuuuccauuugaggaauuuuaugaauaaagcugcuauaagcaugaaauuacaagucuu

SEQ ID NO: 361343 - RNA, 61 nt, Homo Sapiens
ucgucuggcaucucccacacaagacccaaguagcugcuaccuucuuuggccccuugcugga

SEQ ID NO: 361344 - RNA, 61 nt, Homo Sapiens
auuugacucgggccuuagaacuuugcauagcagcugcuacuagcucuuugagauaauacau

SEQ ID NO: 361345 - RNA, 64 nt, Homo Sapiens; identical to SEQ ID NO: 165822

SEQ ID NO: 361346 - RNA, 64 nt, Homo Sapiens; identical to SEQ ID NO: 165823

SEQ ID NO: 361347 - RNA, 64 nt, Homo Sapiens
acuacacacucccuuucuccguuugcucaaaaagcuuggaaaauuguuccaugagaaaaggauu

SEQ ID NO: 361348 - RNA, 64 nt, Homo Sapiens
ucuugcuuggcuauuucugcugauuuaaccagugcuuggaaaaauaaaugcuuuguuuugcugg

SEQ ID NO: 361349 - RNA, 64 nt, Homo Sapiens
ucuaagaucugaaucuuaucucuaacaugcccuacuuggaaagaugcaacuaauccuucuauca

SEQ ID NO: 361350 - RNA, 64 nt, Homo Sapiens
uuccuuugaaauccacccaguguuuaaaaagcaacuuggaaauuuacacauuagcauuguacuu

SEQ ID NO: 361351 - RNA, 64 nt, Homo Sapiens
uuaacaaaaguaaaggaauaaauuugcauauaggcuuggaaagugaggcagcaaugcuguuaac

SEQ ID NO: 361352 - RNA, 64 nt, Homo Sapiens
auccugcucagaaccauucacauuuaauucaauucuuggaaaaaauuaaagcuuuuugcccaca

SEQ ID NO: 361353 - RNA, 64 nt, Homo Sapiens
augauguugcauuaauaguuguuuuugucccuuucuuggaaauguuaaugccaaaguugccuga

SEQ ID NO: 361354 - RNA, 64 nt, Homo Sapiens
cugaucuuuccaaaauauuugaaaggagcucacucuuggaaagaguuuccuguccagcuucuug

SEQ ID NO: 361355 - RNA, 64 nt, Homo Sapiens
agcucacucuuggaaagacuuuccuguccagcuucuuggaaaggcagauccacauuuauugggu

SEQ ID NO: 361356 - RNA, 64 nt, Homo Sapiens
aaacuugauuugagauuuuuaugccugugacuuccuuggaaaucaaauguaaaguuuaauugaa

SEQ ID NO: 361357 - RNA, 64 nt, Homo Sapiens
gcauaguucccaugcacgcugggcaaugagaauccuuggaaacauuggugaugcuaucaguuuu

SEQ ID NO: 361358 - RNA, 64 nt, Homo Sapiens
ccacaugcaaacgucaugagaguagguaaccuugcuuggaaaccaagauacggauccugccugg

SEQ ID NO: 361359 - RNA, 64 nt, Homo Sapiens
caauguuugugcagaguugauuccuuacaaauuacuuggaaauuaauguaauaagaugaauaua

SEQ ID NO: 361360 - RNA, 64 nt, Homo Sapiens
auaaaaacaucaguaacaaaaaauguuaacuguucuuggaaaaagaggccaauaggugccuagu

SEQ ID NO: 361361 - RNA, 64 nt, Homo Sapiens
aguagaaagcuaaagugaucgaaucgcaaguuaacuuggaaaucgcuauuuuagaaagcuaaau

SEQ ID NO: 361362 - RNA, 64 nt, Homo Sapiens
cagcgucuuccuucuuuaucagugaccuucugaucuuggaaaaauagauggaccccagcauuua

SEQ ID NO: 361363 - RNA, 64 nt, Homo Sapiens
gaagaucuuaugccuuuucuuuguuuguugacagcuuggaaaggcuuaauagaggagcugcuug

SEQ ID NO: 361364 - RNA, 64 nt, Homo Sapiens
acacaauaaaguauuuugagaaaaaaucccuauucuuggaaaauaguauacuuugauuaaguaa

SEQ ID NO: 361365 - RNA, 64 nt, Homo Sapiens
uggaugauuccaaagcaaggaggaaccaaggcuacuuggaaaaauaauauaguuugccacuaaa

SEQ ID NO: 361366 - RNA, 64 nt, Homo Sapiens
ucuggccacugugggagggaaggacaaggguucccuuggaaaugugaagggucuuggccucauc

SEQ ID NO: 361367 - RNA, 64 nt, Homo Sapiens
uuucucucuggaaaguugaaguaucuccaaaggccuuggaaauggcacaaaggugauaaggagc

SEQ ID NO: 361368 - RNA, 64 nt, Homo Sapiens
uuucaagacuugauacugcagaugggucuccgcacuuggaaaggccauaguuauuuacuugaaa

SEQ ID NO: 361369 - RNA, 64 nt, Homo Sapiens
gaaagaaacacucaacaauagguuccuuuuucaacuuggaaaaagguucaagagacacugcuug

SEQ ID NO: 361370 - RNA, 64 nt, Homo Sapiens
cugauugauuuuuaugcuuggugagcaaaacauacuuggaaaugugugaaauaacugcgauuuu

SEQ ID NO: 361371 - RNA, 64 nt, Homo Sapiens
cuccaaccaaauagcaguuuagguacagcuguuucuuggaaaucagguaauaccugccucucac

SEQ ID NO: 361372 - RNA, 64 nt, Homo Sapiens
cuuuaccuggcagugauaaagaugggcuguggagcuuggaaaaccaccucuguuuuccuugcuc

SEQ ID NO: 361373 - RNA, 64 nt, Homo Sapiens
aggggaccuuuuuuuguuucuccugacauccagacuuggaaauaucuaacuacuugcaaaacua

SEQ ID NO: 361374 - RNA, 64 nt, Homo Sapiens
aucuugguuucauauaaauugggacugagaaaagcuuggaaagacucacucagucccuaauuau

SEQ ID NO: 361375 - RNA, 64 nt, Homo Sapiens
gcugcucccagcccucugcucuacagccagagaccuuggaaacaggggaccagcucuuuguugu

SEQ ID NO: 361376 - RNA, 64 nt, Homo Sapiens
cucucuucugaaccuggagcaauuuugucuccugcuuggaaaguuugagugaguucccuuagug

SEQ ID NO: 361377 - RNA, 64 nt, Homo Sapiens
ggaaguuggcagcaacucucgaggaacuucugaacuuggaaaggcuucuuuucauuuuugauua

SEQ ID NO: 361378 - RNA, 64 nt, Homo Sapiens
aacuugggaagacaaaauugagccauuaucuccucuuggaaacgaaucuugccagaaaaacggg

SEQ ID NO: 361379 - RNA, 64 nt, Homo Sapiens
ggaacagucgccuguaguccugguagcuguugugcuuggaaauaacgagcgcauccuugccuca

SEQ ID NO: 361380 - RNA, 64 nt, Homo Sapiens
gggaucugggggaugagggcggaaggccuagcuccuuggaaauggccuguacuuuaaggacgcu

SEQ ID NO: 361381 - RNA, 64 nt, Homo Sapiens
guugugucucagagagaguuauuucugugacucucuuggaaaugccuugacugaaugugcaaua

SEQ ID NO: 361382 - RNA, 64 nt, Homo Sapiens
guguaccugaaagugagggggagaauggaaccaacuuggaaaacacucugcaggauauuaucca

SEQ ID NO: 361383 - RNA, 64 nt, Homo Sapiens
aggauuaagaaacucacucaaaaccgcucaacuacuuggaaacugaacaaccugcuccugaaug

SEQ ID NO: 361384 - RNA, 64 nt, Homo Sapiens
ugaguaacuuacauucucuuaauuguaaugguuccuuggaaagucaucguggaaaaugaaggcu

SEQ ID NO: 361385 - RNA, 64 nt, Homo Sapiens
gguuaaauuaaaaaaaaaaaagagcacgacaaaccuuggaaaucaagaaaguucuggaaugaug

SEQ ID NO: 361386 - RNA, 64 nt, Homo Sapiens
augauauagcaguuacucacucaguuuauuaauccuuggaaacaauaucugauuaaaucauuuc

SEQ ID NO: 361387 - RNA, 64 nt, Homo Sapiens
cucacuuuaccaagcauauauugauuuuugcuuucuuggaaagaaggcuuugaaguacucagau

SEQ ID NO: 361388 - RNA, 64 nt, Homo Sapiens
gcacuccagccugggcaccaaugugagaaccugucuuggaaaaaaaaaaaaagaaacauguuuu

SEQ ID NO: 361389 - RNA, 64 nt, Homo Sapiens
cagggcucuccuguugguaguuccugcuuuucuucuuggaaauuccucguggaccucgagaucu

SEQ ID NO: 361390 - RNA, 64 nt, Homo Sapiens
aaacuuuuccauuuuagauuccuuuauagacacgucagccuaaaaaucagccuauucggguguu

SEQ ID NO: 361391 - RNA, 64 nt, Homo Sapiens
uuuagauuccuuuauagacacgucagccuaaaaaucagccuauucggguguucuuuugaauauc

SEQ ID NO: 361392 - RNA, 64 nt, Homo Sapiens
ccuuguucccugguggggucuuaagagaucaaacucagccuauugacaaguuaaaaaguagacu

SEQ ID NO: 361393 - RNA, 64 nt, Homo Sapiens
uccuucuuccuuaaccccaaucuuccuuuccugcucagccuagaacacuguaccuggcuucucu

SEQ ID NO: 361394 - RNA, 64 nt, Homo Sapiens
cacagagucuaagauucugucugagauucugaguucagccuagcugucagccuagccacagagu

SEQ ID NO: 361395 - RNA, 64 nt, Homo Sapiens
cacagagucugagauucugaacagcauaagaaugucagccuagcuauuaggcuauuucaaagcc

SEQ ID NO: 361396 - RNA, 64 nt, Homo Sapiens
acucugaggauaaaguugccaguccuuuuaauggucagccuaaucauucugucagccuaaucgg

SEQ ID NO: 361397 - RNA, 64 nt, Homo Sapiens
gccaguccuuuuaauggucagccuaaucauucugucagccuaaucggguaauugcuuuuuuuaa

SEQ ID NO: 361398 - RNA, 64 nt, Homo Sapiens
uguuuugucuucucuuuucuaagaaacaugugccucagccuagacuuuuguuugcuaaaccuug

SEQ ID NO: 361399 - RNA, 64 nt, Homo Sapiens
guaggagggggauguggcguuuucaauauuguauucagccuauuuuuuugcacuccuucuuugu

SEQ ID NO: 361400 - RNA, 64 nt, Homo Sapiens
ugcuauugcagacaaagccaucuugaaaauuagccaggaucaaauaagaaugagucugaauggu

SEQ ID NO: 361401 - RNA, 64 nt, Homo Sapiens
cuaguuuuugcuuugagcagagaaaauuuuacaacaggaucacacuugccuuuuucagagaaaa

SEQ ID NO: 361402 - RNA, 64 nt, Homo Sapiens; identical to SEQ ID NO: 115828

SEQ ID NO: 361403 - RNA, 64 nt, Homo Sapiens; identical to SEQ ID NO: 115829

SEQ ID NO: 361404 - RNA, 64 nt, Homo Sapiens; identical to SEQ ID NO: 115830

SEQ ID NO: 361405 - RNA, 64 nt, Homo Sapiens; identical to SEQ ID NO: 115831

SEQ ID NO: 361406 - RNA, 64 nt, Homo Sapiens; identical to SEQ ID NO: 115832

SEQ ID NO: 361407 - RNA, 64 nt, Homo Sapiens; identical to SEQ ID NO: 115833

SEQ ID NO: 361408 - RNA, 64 nt, Homo Sapiens; identical to SEQ ID NO: 115834

SEQ ID NO: 361409 - RNA, 64 nt, Homo Sapiens; identical to SEQ ID NO: 115835

SEQ ID NO: 361410 - RNA, 64 nt, Homo Sapiens; identical to SEQ ID NO: 115836

SEQ ID NO: 361411 - RNA, 64 nt, Homo Sapiens; identical to SEQ ID NO: 115837

SEQ ID NO: 361412 - RNA, 64 nt, Homo Sapiens; identical to SEQ ID NO: 115838

SEQ ID NO: 361413 - RNA, 64 nt, Homo Sapiens; identical to SEQ ID NO: 115839

SEQ ID NO: 361414 - RNA, 64 nt, Homo Sapiens; identical to SEQ ID NO: 115840

SEQ ID NO: 361415 - RNA, 64 nt, Homo Sapiens; identical to SEQ ID NO: 115841

SEQ ID NO: 361416 - RNA, 64 nt, Homo Sapiens; identical to SEQ ID NO: 115842

SEQ ID NO: 361417 - RNA, 64 nt, Homo Sapiens; identical to SEQ ID NO: 115843

SEQ ID NO: 361418 - RNA, 64 nt, Homo Sapiens; identical to SEQ ID NO: 115844

SEQ ID NO: 361419 - RNA, 64 nt, Homo Sapiens; identical to SEQ ID NO: 115845

SEQ ID NO: 361420 - RNA, 64 nt, Homo Sapiens; identical to SEQ ID NO: 115846

SEQ ID NO: 361421 - RNA, 64 nt, Homo Sapiens; identical to SEQ ID NO: 115847

SEQ ID NO: 361422 - RNA, 64 nt, Homo Sapiens; identical to SEQ ID NO: 115848

SEQ ID NO: 361423 - RNA, 64 nt, Homo Sapiens; identical to SEQ ID NO: 115849

SEQ ID NO: 361424 - RNA, 64 nt, Homo Sapiens; identical to SEQ ID NO: 115850

SEQ ID NO: 361425 - RNA, 64 nt, Homo Sapiens; identical to SEQ ID NO: 115851

SEQ ID NO: 361426 - RNA, 64 nt, Homo Sapiens; identical to SEQ ID NO: 115852

SEQ ID NO: 361427 - RNA, 64 nt, Homo Sapiens
aaauaggcucauuugggagauucuuuugccaggagagauucaacuuuccaaucuaaguauucca

SEQ ID NO: 361428 - RNA, 64 nt, Homo Sapiens
gaauguguggacaggucagcuuagaagagauggggagauucaggaucccccugugccagagcac

SEQ ID NO: 361429 - RNA, 64 nt, Homo Sapiens
cuguggaugccgauuucuguaaacucugcauccagagauucauuuucuagauacaauaaauugc

SEQ ID NO: 361430 - RNA, 64 nt, Homo Sapiens
uugaccugcauuguaaauagguucuucuuguucugagauucaauauugaauuuuuccuaugcua

SEQ ID NO: 361431 - RNA, 64 nt, Homo Sapiens
uaggacaauaacaagaggcugggcuuccgggggugagauucaaguugccaagaaaggaucucug

SEQ ID NO: 361432 - RNA, 64 nt, Homo Sapiens
auaauuaacucuuccucucuucuuuagaaagaaugagauucacagucuuaguuaagauucacaa

SEQ ID NO: 361433 - RNA, 55 nt, Homo Sapiens; identical to SEQ ID NO: 113265

SEQ ID NO: 361434 - RNA, 64 nt, Homo Sapiens; identical to SEQ ID NO: 113266

SEQ ID NO: 361435 - RNA, 64 nt, Homo Sapiens; identical to SEQ ID NO: 113267

SEQ ID NO: 361436 - RNA, 64 nt, Homo Sapiens; identical to SEQ ID NO: 113268

SEQ ID NO: 361437 - RNA, 64 nt, Homo Sapiens; identical to SEQ ID NO: 113269

SEQ ID NO: 361438 - RNA, 64 nt, Homo Sapiens; identical to SEQ ID NO: 113270

SEQ ID NO: 361439 - RNA, 64 nt, Homo Sapiens; identical to SEQ ID NO: 113271

SEQ ID NO: 361440 - RNA, 64 nt, Homo Sapiens; identical to SEQ ID NO: 113272

SEQ ID NO: 361441 - RNA, 64 nt, Homo Sapiens; identical to SEQ ID NO: 113273

SEQ ID NO: 361442 - RNA, 64 nt, Homo Sapiens; identical to SEQ ID NO: 113274

SEQ ID NO: 361443 - RNA, 64 nt, Homo Sapiens; identical to SEQ ID NO: 113275

SEQ ID NO: 361444 - RNA, 64 nt, Homo Sapiens; identical to SEQ ID NO: 113276

SEQ ID NO: 361445 - RNA, 64 nt, Homo Sapiens; identical to SEQ ID NO: 113277

SEQ ID NO: 361446 - RNA, 64 nt, Homo Sapiens; identical to SEQ ID NO: 113278

SEQ ID NO: 361447 - RNA, 64 nt, Homo Sapiens; identical to SEQ ID NO: 189094

SEQ ID NO: 361448 - RNA, 64 nt, Homo Sapiens; identical to SEQ ID NO: 189095

SEQ ID NO: 361449 - RNA, 64 nt, Homo Sapiens; identical to SEQ ID NO: 189096

SEQ ID NO: 361450 - RNA, 64 nt, Homo Sapiens; identical to SEQ ID NO: 189097

SEQ ID NO: 361451 - RNA, 64 nt, Homo Sapiens; identical to SEQ ID NO: 189098

SEQ ID NO: 361452 - RNA, 64 nt, Homo Sapiens; identical to SEQ ID NO: 189099

SEQ ID NO: 361453 - RNA, 64 nt, Homo Sapiens; identical to SEQ ID NO: 189100

SEQ ID NO: 361454 - RNA, 64 nt, Homo Sapiens; identical to SEQ ID NO: 189101

SEQ ID NO: 361455 - RNA, 64 nt, Homo Sapiens; identical to SEQ ID NO: 189102

SEQ ID NO: 361456 - RNA, 64 nt, Homo Sapiens; identical to SEQ ID NO: 189103

SEQ ID NO: 361457 - RNA, 64 nt, Homo Sapiens; identical to SEQ ID NO: 189104

SEQ ID NO: 361458 - RNA, 64 nt, Homo Sapiens; identical to SEQ ID NO: 189105

SEQ ID NO: 361459 - RNA, 64 nt, Homo Sapiens; identical to SEQ ID NO: 189106

SEQ ID NO: 361460 - RNA, 64 nt, Homo Sapiens; identical to SEQ ID NO: 189107

SEQ ID NO: 361461 - RNA, 64 nt, Homo Sapiens; identical to SEQ ID NO: 189108

SEQ ID NO: 361462 - RNA, 64 nt, Homo Sapiens; identical to SEQ ID NO: 189109

SEQ ID NO: 361463 - RNA, 64 nt, Homo Sapiens; identical to SEQ ID NO: 189110

SEQ ID NO: 361464 - RNA, 64 nt, Homo Sapiens; identical to SEQ ID NO: 189111

SEQ ID NO: 361465 - RNA, 64 nt, Homo Sapiens; identical to SEQ ID NO: 189112

SEQ ID NO: 361466 - RNA, 64 nt, Homo Sapiens; identical to SEQ ID NO: 189113

SEQ ID NO: 361467 - RNA, 64 nt, Homo Sapiens; identical to SEQ ID NO: 189114

SEQ ID NO: 361468 - RNA, 64 nt, Homo Sapiens; identical to SEQ ID NO: 189115

SEQ ID NO: 361469 - RNA, 64 nt, Homo Sapiens; identical to SEQ ID NO: 189116

SEQ ID NO: 361470 - RNA, 64 nt, Homo Sapiens; identical to SEQ ID NO: 189117

SEQ ID NO: 361471 - RNA, 64 nt, Homo Sapiens; identical to SEQ ID NO: 189118

SEQ ID NO: 361472 - RNA, 64 nt, Homo Sapiens; identical to SEQ ID NO: 189119

SEQ ID NO: 361473 - RNA, 64 nt, Homo Sapiens
ccgguaaaguuuaguugaggaggugagccagggccagggggacccgagcgaauuaacggugucg

SEQ ID NO: 361474 - RNA, 64 nt, Homo Sapiens
uggcggacucccacuccccggugagccagcauuucagggggagcgugagaagcccgucuccuca

SEQ ID NO: 361475 - RNA, 64 nt, Homo Sapiens
cuccccugccuugcuguuggucaugugggucuuccagggggaaggccaaggggagucaccuucc

SEQ ID NO: 361476 - RNA, 64 nt, Homo Sapiens
gcacaggaugcuguguugucaacaaaccaagcaucagggggaagaagcagagagaugcggccaa

SEQ ID NO: 361477 - RNA, 64 nt, Homo Sapiens
acccgagcuaaucauggaauaugcucccaguaaccagggggaccuguccuuguguuccuaucgg

SEQ ID NO: 361478 - RNA, 64 nt, Homo Sapiens
cuuggcaccugaccucgagcuggacaggacggggcagggggagaccacucggauggcacucagg

SEQ ID NO: 361479 - RNA, 64 nt, Homo Sapiens
gaggggcccucgacaaaggcgggauggggagcggcagggggagaaagaggcgggaggagucaug

SEQ ID NO: 361480 - RNA, 64 nt, Homo Sapiens
ugucagaccucgggaggcaguuuccugcugcucccagggggaggggacucagccuugccugucu

SEQ ID NO: 361481 - RNA, 64 nt, Homo Sapiens
ugucccaguacacuuacaaagcgccaaaauacaacagggggaugucuaucagaaccaauucuau

SEQ ID NO: 361482 - RNA, 64 nt, Homo Sapiens
cuggcugcuugcuuagguggugaaaagagagggucagggggagggaagugagugggagcacagc

SEQ ID NO: 361483 - RNA, 64 nt, Homo Sapiens
gcgccccagcucggccuugggagguggucguguccagggggaugauggagagcuguccaaccaa

SEQ ID NO: 361484 - RNA, 64 nt, Homo Sapiens
ucugggcucagagagaggcccuugagcugcagcucagggggaugcgaggcuucguggacugugu

SEQ ID NO: 361485 - RNA, 64 nt, Homo Sapiens
agguauuuucgagauaaagccccacugucuggggcagggggagauuuuugcugcccccuccccg

SEQ ID NO: 361486 - RNA, 64 nt, Homo Sapiens
uugccagaggggaccagggcgaggccgagccaagcagggggacgcgaggccaggauggaggugg

SEQ ID NO: 361487 - RNA, 60 nt, Homo Sapiens
ugcugagcccucaccucccuaggauucuccucucucuaggagaguugaaagagaggccuu

SEQ ID NO: 361488 - RNA, 60 nt, Homo Sapiens
aauagggucuguuucacagguuuuccucugucucucuaggugugccauaccagcugaggu

SEQ ID NO: 361489 - RNA, 60 nt, Homo Sapiens
cagagcguuccuggccagagugcagagggcucucucuaggguccccgaucuagggccagc

SEQ ID NO: 361490 - RNA, 60 nt, Homo Sapiens
ccuaugaaccacaaagcaggcgcugucgggucucucuaggcucacucacacugggcagcc

SEQ ID NO: 361491 - RNA, 60 nt, Homo Sapiens
agucuauuuccauucuuucaagugccuuccucucucuacccacauaccuucauguggcuc

SEQ ID NO: 361492 - RNA, 60 nt, Homo Sapiens
agucuauuuccacugaacaaagugccuuccucucucuacccacauaccuucaugugguuc

SEQ ID NO: 361493 - RNA, 60 nt, Homo Sapiens
agucuauuuccacugaacaaacugccuuccucucucuacccacguaccuucaugugauuc

SEQ ID NO: 361494 - RNA, 60 nt, Homo Sapiens
ugcucuggaauggaugagugcuucugugcuucucucuaucucauauugccucuagauuuu

SEQ ID NO: 361495 - RNA, 60 nt, Homo Sapiens
aaagcucuugcaccuuuauccuagaaacugucucucuaggacuguguuccaggaacuaug

SEQ ID NO: 361496 - RNA, 60 nt, Homo Sapiens
uugcuauuugccaccauccuagauuuaucaucucucuauuaucauuugauuuuggaucca

SEQ ID NO: 361497 - RNA, 60 nt, Homo Sapiens
uggaugaaucaaaauguaauucucucucucucucucuauuuagugccaaaaaucuugaaa

SEQ ID NO: 361498 - RNA, 60 nt, Homo Sapiens
aaaacaaucuccucucucucucucucucucucucucuaucucucucucuaucuccucucu

SEQ ID NO: 361499 - RNA, 60 nt, Homo Sapiens
ucucucucucucucucucucucucuaucucucucucuaucuccucucucucucuccucuc

SEQ ID NO: 361500 - RNA, 60 nt, Homo Sapiens
auuuuucugcgugcucucacucucucuuucucucucuagcuuuuuaauucaugaauauuu

SEQ ID NO: 361501 - RNA, 60 nt, Homo Sapiens
acaaaguaggucauuccaucaccacccuugucucucuacacauuuugccuuuggggaucu

SEQ ID NO: 361502 - RNA, 60 nt, Homo Sapiens
ccagcuuacugugggacauagaauuugaguucucucuaacucgguuuuguuuuccaucag

SEQ ID NO: 361503 - RNA, 60 nt, Homo Sapiens
cuguucuacaagcaaacaaaagcacuuacaucucucuaugcaaagccauccuuggcaucu

SEQ ID NO: 361504 - RNA, 60 nt, Homo Sapiens
caauucagggccugcuuucccuccaccaagucucucuagaacaaggcgggccguggccuc

SEQ ID NO: 361505 - RNA, 60 nt, Homo Sapiens
ccucucccuuacuggcccacacugguguccucucucuagcugaaagucaacccuauguaa

SEQ ID NO: 361506 - RNA, 60 nt, Homo Sapiens
ccucauugucagagggaauugcuaggcaccucucucuaacggcuuugcugcuuucuaacu

SEQ ID NO: 361507 - RNA, 60 nt, Homo Sapiens
ugggcaccagugaacaugcguugccauuuuucucucuaacggugacucccacauacacag

SEQ ID NO: 361508 - RNA, 60 nt, Homo Sapiens
ccaggacacccagccugugccccacaaggaucucucuaaaugggagggauugaggcuacu

SEQ ID NO: 361509 - RNA, 60 nt, Homo Sapiens
uauucaucucuuuguuuuuugucacucuuuucucucuaauugugucauuuguacuguuug

SEQ ID NO: 361510 - RNA, 64 nt, Homo Sapiens
uugagaaaucaucuaauuucucagaacuuuuucuuaucucuaacacaguuauuaccauaauaau

SEQ ID NO: 361511 - RNA, 64 nt, Homo Sapiens
gaaguucuguucccuauaaucugcaaugcugaaguaucucuauucaauucccuuccuuaucugu

SEQ ID NO: 361512 - RNA, 64 nt, Homo Sapiens
uuuaagguuauauuuuuuaaaauaaugaauuuucuaucucuaggcaacaugucuuuauuauuca

SEQ ID NO: 361513 - RNA, 64 nt, Homo Sapiens
ggcaaacaaacaaaaaaugcuuucaguguugaaauaucucuauuuuccaaagaugauaaacuuu

SEQ ID NO: 361514 - RNA, 64 nt, Homo Sapiens
auccugauuuucuugguaagcuuuuuuacuuuauuaucucuauaauuuauuaucucuauccaua

SEQ ID NO: 361515 - RNA, 64 nt, Homo Sapiens
uaagcuuuuuuacuuuauuaucucuauaauuuauuaucucuauccauauuuguggaucggguag

SEQ ID NO: 361516 - RNA, 64 nt, Homo Sapiens
uacacauuuuaaacauuauuggaggagucuauacuaucucuauacuuucccuccaugcuuccgc

SEQ ID NO: 361517 - RNA, 64 nt, Homo Sapiens
ggaucuggccccccagcccacagccaagcaccccuaucucuagacaggugucagccaccgcacc

SEQ ID NO: 361518 - RNA, 64 nt, Homo Sapiens
uguucuugcaccaccauccaugaggagagcuggacucgcucaucccaggaggcccuugggagca

SEQ ID NO: 361519 - RNA, 64 nt, Homo Sapiens
cuuuccagaccagcggggcaugaggcagugcugucucgcucagucgaugcauccugggcugugc

SEQ ID NO: 361520 - RNA, 64 nt, Homo Sapiens
ucuuuuuguauaacuucaauaaagauuguaagcaaagguugaggcuuugaugguuuuuuucuua

SEQ ID NO: 361521 - RNA, 64 nt, Homo Sapiens
cuggcugguugaguuuuguuauuuucuguauagaaagguugagauauaucaacacuuggaauug

SEQ ID NO: 361522 - RNA, 64 nt, Homo Sapiens
agcauggcucagagucuagacugauugccacauuaagguugaacaguucacugcccaugugaua

SEQ ID NO: 361523 - RNA, 64 nt, Homo Sapiens
aacauggcucagagucuugucugauucccacauuaagguugaacaguucacuacucaugugaua

SEQ ID NO: 361524 - RNA, 64 nt, Homo Sapiens
uggauugggucagaugccuguccuuggaggggacaagguugacugcuuaggaggcgcgacgcac

SEQ ID NO: 361525 - RNA, 64 nt, Homo Sapiens
cgcacagggcugccaggccuggccccucucugggaagguugagagcugagacgggcagcccugu

SEQ ID NO: 361526 - RNA, 64 nt, Homo Sapiens
ucuguauaaauaaugagcguacagaauauucuguaaaccuaauggugaauuuuggugauguaaa

SEQ ID NO: 361527 - RNA, 64 nt, Homo Sapiens
uuaagaaguacaauaagcagcuuucccagguauaaaaccuaaaaaagcucuaauagagucacag

SEQ ID NO: 361528 - RNA, 64 nt, Homo Sapiens
cuuuucucacucacuuuuagaaaugcucagauugaaaccuaaaugucaaggucuacagcuagua

SEQ ID NO: 361529 - RNA, 64 nt, Homo Sapiens
cauagaaagauaaguagaccauuugacagaugaaaaaccuaaugauuuggguacuauuauuucc

SEQ ID NO: 361530 - RNA, 64 nt, Homo Sapiens
auuauuuucaguuuuccaaaauucuaucaucuuuaaaccuaaauaauucaauuucauggaugca

SEQ ID NO: 361531 - RNA, 64 nt, Homo Sapiens
ggagcucucugugcuaucugcucaauuuuucucuaaaccuaaaacuguucuaaaauagaaaguc

SEQ ID NO: 361532 - RNA, 64 nt, Homo Sapiens
uaagaaaacccagauuuaccaccuuacuauaaguaaaccuaagaauuuuaucuucuuaccaagu

SEQ ID NO: 361533 - RNA, 64 nt, Homo Sapiens
gagaaaauggaaucccugacagagcaauaaaugcaaaccuaaauauccugcagucacagacuug

SEQ ID NO: 361534 - RNA, 64 nt, Homo Sapiens
ucuagcugccgucuuguagaaauggucaguauugaaaccuaaucuaauugcuuguaggauagua

SEQ ID NO: 361535 - RNA, 64 nt, Homo Sapiens
ggucucuugucuauuaguuugcuaugguaacacuaaaccuaaguuaguaaacuuauaaaaggcu

SEQ ID NO: 361536 - RNA, 64 nt, Homo Sapiens
aacaccucccaggggcuccaccuguucaggagcugaagcccaugcuuucccaccagcaugucac

SEQ ID NO: 361537 - RNA, 64 nt, Homo Sapiens
gccuagcuuucauuugacacacagacuacagccagaagcccauggagcagggaugucacgucuu

SEQ ID NO: 361538 - RNA, 64 nt, Homo Sapiens
uuggcaagaggagcugguccccacucuuugcucugaagcccagagacuuuccccucccuggugg

SEQ ID NO: 361539 - RNA, 64 nt, Homo Sapiens
ggcucuuuuuaacuuucaacaggagcuguauaaagaagcccaggugucuuuccuggucuguccu

SEQ ID NO: 361540 - RNA, 64 nt, Homo Sapiens
cacagcccagcugagcaugaaacaaaggccucuugaagcccagcuugcuaaccaggaugcuggg

SEQ ID NO: 361541 - RNA, 64 nt, Homo Sapiens
cccucaaccccucuggaugcacugugacaucccagaagcccagccuccugcucugggcucagau

SEQ ID NO: 361542 - RNA, 64 nt, Homo Sapiens
augcuagugcuucuagacccucauuguuaucacugaagcccaacaggugcucaauaaauguugg

SEQ ID NO: 361543 - RNA, 64 nt, Homo Sapiens
cagcaagcucucuccuacccuucccugcguggaggaagcccaccaggaagccccaucucugcug

SEQ ID NO: 361544 - RNA, 64 nt, Homo Sapiens
gguccuguuuguaaaacaacucuggaggaagagggaagcccaggcaaggccccagauccuucuc

SEQ ID NO: 361545 - RNA, 64 nt, Homo Sapiens
gaggggacaaaaaagucaaaacgaggcgagaggcgaagcccacuuuuguauaccggccggcgcg

SEQ ID NO: 361546 - RNA, 64 nt, Homo Sapiens
gaugaaauuauauuuuuggaaaaaaaaaacacuugaagcccagauggaaauacguuuauuucag

SEQ ID NO: 361547 - RNA, 64 nt, Homo Sapiens
ugaaauuccuccuuccccccaucucugaguggaggaagcccaccaaucugcccuuugcagugug

SEQ ID NO: 361548 - RNA, 64 nt, Homo Sapiens
uauaacuuuuguggaccaauacuaagaauaacaagaagcccaguggugaggaaagugcguucuc

SEQ ID NO: 361549 - RNA, 64 nt, Homo Sapiens
ugggugaaucaccugaggucucccagcacuuugggaagcccaagauguuggcucccgccuguaa

SEQ ID NO: 361550 - RNA, 64 nt, Homo Sapiens
cucgggucguauggacuucuguuuuuggagaccugaagcccacaaugcccagcuugugauuauc

SEQ ID NO: 361551 - RNA, 64 nt, Homo Sapiens
ccacugaagagccugagucccaggaggccuccuggaagcccaggacugcccacccaccacgcug

SEQ ID NO: 361552 - RNA, 64 nt, Homo Sapiens
gccaagcccugccgaucagacaugugggcuccccgaagcccagccagagacugccgugcugugg

SEQ ID NO: 361553 - RNA, 64 nt, Homo Sapiens
gagaugucccuggggcagaccacagaagcccauggaagcccaggccaccgaaagcucaggggag

SEQ ID NO: 361554 - RNA, 64 nt, Homo Sapiens
gaagcccagggagauguccccucaggggagcacagaagcccaugccaucagggcccaccgaaag

SEQ ID NO: 361555 - RNA, 64 nt, Homo Sapiens
ugcccccguccagagcugcagcugagccccaucugaagcccagucccucggagcugcagacagc

SEQ ID NO: 361556 - RNA, 64 nt, Homo Sapiens
ggucagcugcccacagcccucuugccugaccccugaagcccagaacucugaucuucacagcccu

SEQ ID NO: 361557 - RNA, 64 nt, Homo Sapiens
uaaaugucaaucagccuaguugaucagcuuauugucuagugaaacucguuaauuuguaguguug

SEQ ID NO: 361558 - RNA, 64 nt, Homo Sapiens
caagacugcacaucaaaauaugccccauucaacaucuagugagcagucaggaaagagaacuucc

SEQ ID NO: 361559 - RNA, 64 nt, Homo Sapiens
cuccucacucccaguucccuggacagagcuaaacucucgagacuucucugugaacuucccuacc

SEQ ID NO: 361560 - RNA, 64 nt, Homo Sapiens
cgugcaucugaauuucaggggucaugcugaugccucucgagacauacaaauccuugcuuuguca

SEQ ID NO: 361561 - RNA, 64 nt, Homo Sapiens
ugucuugucucuguguguuugcagugugugagguucucgagaacugaaaacaaaugggagcaua

SEQ ID NO: 361562 - RNA, 64 nt, Homo Sapiens
gaaagaaagauccucugcugaccccuggagcagcucucgagaacuaccuguugguauuguccac

SEQ ID NO: 361563 - RNA, 64 nt, Homo Sapiens
agagagaaaaaucugcuauuuuucuaaguaagagucucgagaagcagaguuuuugucuugucau

SEQ ID NO: 361564 - RNA, 64 nt, Homo Sapiens
aauagccagccuagagcacauuauucucccucagucucgagauauugcuauggaauaagaccuu

SEQ ID NO: 361565 - RNA, 64 nt, Homo Sapiens
cacaugcacgccugggcgugcccaggcccacaggucucgagacgcacgggaagccuuucugccg

SEQ ID NO: 361566 - RNA, 64 nt, Homo Sapiens
cuggggggaguuaccaacuuacaacccagacgauucucgagagaacauuuaaaaauauggaaaa

SEQ ID NO: 361567 - RNA, 64 nt, Homo Sapiens
cuggucccuggagaacugcggggaaagcgcccccucucgagagggccccggcuuccccugcacc

SEQ ID NO: 361568 - RNA, 64 nt, Homo Sapiens
cccaagcagccugauggggcuggugauuucuagcucucgagauaguacagagcuggcaucuauc

SEQ ID NO: 361569 - RNA, 64 nt, Homo Sapiens
cagagcagcaguugaauguagaggccagccggccucucgagagcgaacgccaagccggaggccc

SEQ ID NO: 361570 - RNA, 64 nt, Homo Sapiens
guuuuuucuuuuuaaugaaaccagaacuuuuuccucucgagauaaacacugaacuccuauuuga

SEQ ID NO: 361571 - RNA, 64 nt, Homo Sapiens
gguuggauuaccugagaucagguggauuaccuggucucgagaccagccugaccaauauggugaa

SEQ ID NO: 361572 - RNA, 64 nt, Homo Sapiens
ucuccucauuccccgccgggagcaacaucucucuucucgagaccccagccccuccgcugucuac

SEQ ID NO: 361573 - RNA, 64 nt, Homo Sapiens
caauucaguccugggcaaagggugacaguauuacucucgagagggguaguucuaaggauggaaa

SEQ ID NO: 361574 - RNA, 64 nt, Homo Sapiens
uuaaaaaaaaaaaaaacuuaugacagagacccugucucgagaaaucacugcacuccagcuuggg

SEQ ID NO: 361575 - RNA, 64 nt, Homo Sapiens
agauucuccccuccaguauggacccccacagggcucucgagaacgaggagacgggcugggcggc

SEQ ID NO: 361576 - RNA, 64 nt, Homo Sapiens
ccugcuguucucagcuccagcuucaaaccucgagucucgagagggccacggggugguuuuuaug

SEQ ID NO: 361577 - RNA, 64 nt, Homo Sapiens
acuggcaugaggaguuaggucccccgcgaagaaaucucgagagagggcugcuuccucgcggcag

SEQ ID NO: 361578 - RNA, 64 nt, Homo Sapiens
gcauggcgcucccuucaacagcaagccugacuguucucgagaacucugcaaucuuuuaaauaag

SEQ ID NO: 361579 - RNA, 64 nt, Homo Sapiens
ccccuggacaauugaggaugagagcaggucagcgucucgagaggaggcaggcaccaccgucccc

SEQ ID NO: 361580 - RNA, 64 nt, Homo Sapiens
auggugauaaagggcagcccggcgggucccagcaucucgagacccucugcagaaguauuaucag

SEQ ID NO: 361581 - RNA, 64 nt, Homo Sapiens
cgccugcuccuaacaauucauccugggcucagaaucucgagaacgcaugguucacagaaaagga

SEQ ID NO: 361582 - RNA, 64 nt, Homo Sapiens
gggaugugagaguggaguaccuuccuuucucaagucucgagaugccagugaaaccaguauuccc

SEQ ID NO: 361583 - RNA, 64 nt, Homo Sapiens
uuaggaaaaguauaugucuuuauuccauugaaguucucgagagugauauaaauacuuugggggg

SEQ ID NO: 361584 - RNA, 64 nt, Homo Sapiens
cuucccaugcuucaggaaguaaaccuuggccuggucucgagaagcguggugccaugaaggaaag

SEQ ID NO: 361585 - RNA, 62 nt, Homo Sapiens
aaaaaguaauuauaaauacgcuuguucuauuuuucaaucaucauaaguaaaccuaguaaaac

SEQ ID NO: 361586 - RNA, 62 nt, Homo Sapiens
gaaguauauucuuauuggaauuuuggcuucauuucaaucauucaaacccuggugguauuuua

SEQ ID NO: 361587 - RNA, 62 nt, Homo Sapiens
agcaaaguacacccauuauucuuaaaaugcauuucaaucagauuagauaaaucagaacucuc

SEQ ID NO: 361588 - RNA, 62 nt, Homo Sapiens
gcagagaacgcuuuuagauauuuuuugaugaauucaaucaaucuguugucauggcugaguag

SEQ ID NO: 361589 - RNA, 62 nt, Homo Sapiens
cauuuccuauauaacaauuaaaaauggaacauuucaaucaaagcuauaagcuuggugaaaug

SEQ ID NO: 361590 - RNA, 62 nt, Homo Sapiens
agucuugguagauaagaaaacuacuucugcuguucaaucaaguuaccuuuugauuuguaaca

SEQ ID NO: 361591 - RNA, 62 nt, Homo Sapiens
cagauguuaguggaagcauagcaaugguucuguucaaucauuuuaagcaaugcagccuagaa

SEQ ID NO: 361592 - RNA, 62 nt, Homo Sapiens
auuucaaaugcaauccuaaguagauuuuguuuuucaaucaugcuuuuccccuucaguagaau

SEQ ID NO: 361593 - RNA, 62 nt, Homo Sapiens
aaguccucaaucaacaagucuuucaccccaccuucaaucaacgccagaaaccugugucaucu

SEQ ID NO: 361594 - RNA, 62 nt, Homo Sapiens
cuuuuccaaaggguuguauacaucuuucucuuuucaaucaggaugccucucccuccgcaucu

SEQ ID NO: 361595 - RNA, 62 nt, Homo Sapiens
uccaucacuucuuaaaucgguuaccagugaccuucaaucaaccuuuguggcugaggggucag

SEQ ID NO: 361596 - RNA, 62 nt, Homo Sapiens
cuuuguggaaaaacauuucccuuuuuuuuuuuuucaaucacagaagggaagcuuuuuuuuuu

SEQ ID NO: 361597 - RNA, 62 nt, Homo Sapiens
uuuuagugggcuauuuauaaugaaggaaugucuucaaucauauagcuacaccuuuaauaaaa

SEQ ID NO: 361598 - RNA, 62 nt, Homo Sapiens
uacuuuuguguauagaaaauuaaaacacaaauuucaaucaaacuuagcaaugaaauugcugu

SEQ ID NO: 361599 - RNA, 62 nt, Homo Sapiens
auguauguuugcuauguucugcagugggcugauucaaucaaguucaaucaagauccgugcuc

SEQ ID NO: 361600 - RNA, 62 nt, Homo Sapiens
auccgugcucgcagugggcuccaauaggcugauucaaucaaguauguagaccuaaaacuaca

SEQ ID NO: 361601 - RNA, 62 nt, Homo Sapiens
auguauguagaccuaaaacuccaguagguugauucaaucaagugauagaccaaaaaacuaca

SEQ ID NO: 361602 - RNA, 64 nt, Homo Sapiens; identical to SEQ ID NO: 305640

SEQ ID NO: 361603 - RNA, 64 nt, Homo Sapiens; identical to SEQ ID NO: 305641

SEQ ID NO: 361604 - RNA, 64 nt, Homo Sapiens
uuauuuuuugcacauugugauuaaaauuauaaauagauaauauauugagcuggcuguauauauu

SEQ ID NO: 361605 - RNA, 64 nt, Homo Sapiens
ucuccaauugggacuccccauuaaacaaguagaaagauaauauuaauggauugcaaccaaaacu

SEQ ID NO: 361606 - RNA, 64 nt, Homo Sapiens
acuuuuuuauuguuuuuauuucuagccauaccucagauaauauguuuaguuuuacauuuuaaaa

SEQ ID NO: 361607 - RNA, 64 nt, Homo Sapiens
cuaguaaacauauguuccuaauaagugaagggaaagauaauaaugauggucaacaauaagccac

SEQ ID NO: 361608 - RNA, 64 nt, Homo Sapiens
aaugacacagaaggcuuuaacaugguuguuccaaagauaauagaaaaaccccaagggacuaauu

SEQ ID NO: 361609 - RNA, 64 nt, Homo Sapiens
agagcguccccucacaaauauguuacugagccacagauaauacaaaucuaauuauaggagcauu

SEQ ID NO: 361610 - RNA, 64 nt, Homo Sapiens
uucaaaaaauauugggaccaauuccucuggauaaagauaauauaccuucuuagccauuaaugua

SEQ ID NO: 361611 - RNA, 64 nt, Homo Sapiens
acuguucaucuuuuucugucgaauauuacauuccagauaauaugcuauacuugacuugccuuca

SEQ ID NO: 361612 - RNA, 64 nt, Homo Sapiens; identical to SEQ ID NO: 243840

SEQ ID NO: 361613 - RNA, 64 nt, Homo Sapiens; identical to SEQ ID NO: 243841

SEQ ID NO: 361614 - RNA, 64 nt, Homo Sapiens; identical to SEQ ID NO: 243842

SEQ ID NO: 361615 - RNA, 64 nt, Homo Sapiens; identical to SEQ ID NO: 243843

SEQ ID NO: 361616 - RNA, 64 nt, Homo Sapiens; identical to SEQ ID NO: 243844

SEQ ID NO: 361617 - RNA, 64 nt, Homo Sapiens; identical to SEQ ID NO: 243845

SEQ ID NO: 361618 - RNA, 64 nt, Homo Sapiens; identical to SEQ ID NO: 243846

SEQ ID NO: 361619 - RNA, 64 nt, Homo Sapiens; identical to SEQ ID NO: 243847

SEQ ID NO: 361620 - RNA, 64 nt, Homo Sapiens; identical to SEQ ID NO: 243848

SEQ ID NO: 361621 - RNA, 64 nt, Homo Sapiens; identical to SEQ ID NO: 243849

SEQ ID NO: 361622 - RNA, 64 nt, Homo Sapiens; identical to SEQ ID NO: 243850

SEQ ID NO: 361623 - RNA, 64 nt, Homo Sapiens; identical to SEQ ID NO: 243851

SEQ ID NO: 361624 - RNA, 64 nt, Homo Sapiens; identical to SEQ ID NO: 243852

SEQ ID NO: 361625 - RNA, 64 nt, Homo Sapiens; identical to SEQ ID NO: 243853

SEQ ID NO: 361626 - RNA, 64 nt, Homo Sapiens; identical to SEQ ID NO: 243854

SEQ ID NO: 361627 - RNA, 64 nt, Homo Sapiens; identical to SEQ ID NO: 243855

SEQ ID NO: 361628 - RNA, 61 nt, Homo Sapiens; identical to SEQ ID NO: 238490

SEQ ID NO: 361629 - RNA, 61 nt, Homo Sapiens; identical to SEQ ID NO: 238491

SEQ ID NO: 361630 - RNA, 61 nt, Homo Sapiens; identical to SEQ ID NO: 238492

SEQ ID NO: 361631 - RNA, 56 nt, Homo Sapiens; identical to SEQ ID NO: 238493

SEQ ID NO: 361632 - RNA, 61 nt, Homo Sapiens; identical to SEQ ID NO: 238494

SEQ ID NO: 361633 - RNA, 61 nt, Homo Sapiens; identical to SEQ ID NO: 238495

SEQ ID NO: 361634 - RNA, 61 nt, Homo Sapiens; identical to SEQ ID NO: 238496

SEQ ID NO: 361635 - RNA, 61 nt, Homo Sapiens; identical to SEQ ID NO: 238497

SEQ ID NO: 361636 - RNA, 61 nt, Homo Sapiens; identical to SEQ ID NO: 238498

SEQ ID NO: 361637 - RNA, 61 nt, Homo Sapiens; identical to SEQ ID NO: 238499

SEQ ID NO: 361638 - RNA, 61 nt, Homo Sapiens; identical to SEQ ID NO: 238500

SEQ ID NO: 361639 - RNA, 61 nt, Homo Sapiens; identical to SEQ ID NO: 238501

SEQ ID NO: 361640 - RNA, 61 nt, Homo Sapiens; identical to SEQ ID NO: 238502

SEQ ID NO: 361641 - RNA, 61 nt, Homo Sapiens; identical to SEQ ID NO: 238503

SEQ ID NO: 361642 - RNA, 64 nt, Homo Sapiens
ugcugcccagauucagaagaauauugcccacauuucacuguauuuggugcugggucauuuugac

SEQ ID NO: 361643 - RNA, 64 nt, Homo Sapiens
ugcccaggcuggagugcaguggugccaucauagcucacuguagccucgaccuuccgggaucaag

SEQ ID NO: 361644 - RNA, 64 nt, Homo Sapiens
cucuugcugagaauguggauauacaaccaaugcaucacuguauagcucccugcaagcugagcag

SEQ ID NO: 361645 - RNA, 64 nt, Homo Sapiens
uggaauucugccugcuagugugaggagaaggacaucacuguauucccccaagcgaaugcccuau

SEQ ID NO: 361646 - RNA, 64 nt, Homo Sapiens
ucacacgcauugguguuaacaaccucacuguacuucacuguacuaacguuugccacugagccuu

SEQ ID NO: 361647 - RNA, 64 nt, Homo Sapiens
ucacuguacuucacacgcauacugagccuuaaccucacuguacugggccucuuuaacguuugcc

SEQ ID NO: 361648 - RNA, 64 nt, Homo Sapiens
uuguucauaguguauccccaauggggcagggacuucacuguauuccuacuagaauguaagcucc

SEQ ID NO: 361649 - RNA, 64 nt, Homo Sapiens
aacacggcagacuuuagccuuuauuccuuuucagucacuguacgcccaaaugaggauauaguca

SEQ ID NO: 361650 - RNA, 64 nt, Homo Sapiens
uuuuaaugaacuuugauuggauuuauaccgguuuucacuguauauagauuaugguguuugccua

SEQ ID NO: 361651 - RNA, 64 nt, Homo Sapiens
uuagauaaggauaaaaauauuuauuuaguaauggucacuguaugaaacugcaugcauguaaugc

SEQ ID NO: 361652 - RNA, 64 nt, Homo Sapiens
cucgaauuccugggcucaagggcacaaucauugcucacuguaaccacccaggccagaguguagu

SEQ ID NO: 361653 - RNA, 64 nt, Homo Sapiens
acccaggccagaguguaguguuagagacagggucucacuguaucuucuccuaaucuuuccuuuu

SEQ ID NO: 361654 - RNA, 64 nt, Homo Sapiens
agcacuuugcugagaggguugucuccaaagauggucacuguaacuguaaugaggcuauuuccaa

SEQ ID NO: 361655 - RNA, 64 nt, Homo Sapiens
aucaaaaaauccccagcagcaugaggaugaugagucacuguaauaucagauuauuuucauucaa

SEQ ID NO: 361656 - RNA, 64 nt, Homo Sapiens
uggaaagaguagauuuuauuggucuacccuuuucucacuguagcugcuggcagcccugugccau

SEQ ID NO: 361657 - RNA, 64 nt, Homo Sapiens
gaauucucugguuuucuguguaauuccagaugagucacuguaacucuagaagauuaaccuucca

SEQ ID NO: 361658 - RNA, 64 nt, Homo Sapiens
uaacuguugcacuugucaacacaauuguaaggugucacuguauuuuucugugcauguucucuac

SEQ ID NO: 361659 - RNA, 64 nt, Homo Sapiens
aauuugacaacugucaccaaagggggaacagaguucacuguacaaggguaaaaagacuaaaaug

SEQ ID NO: 361660 - RNA, 64 nt, Homo Sapiens
gacacuaauucauuaaauacaacuaccuuauuuuucacuguacaaaaauuuaaguuuuuuuaac

SEQ ID NO: 361661 - RNA, 64 nt, Homo Sapiens
acagaacuuuuaaaugaagcaaaggaagaauaagucacuguaaaaaucaaugggacucugauau

SEQ ID NO: 361662 - RNA, 62 nt, Homo Sapiens
ucauuuucuuuauauuggacaagaagaacuauucacuguauuauaaauacagcucaucuuga

SEQ ID NO: 361663 - RNA, 64 nt, Homo Sapiens
uaaaauagaaagaaaaaaacauuuggcuuauuuuucacuguagcuagucuuuuauacaauaauc

SEQ ID NO: 361664 - RNA, 64 nt, Homo Sapiens
ucaaccagcagcaagaaguucaaauuuuuuucugucacuguaacagaaaacacaauauguauau

SEQ ID NO: 361665 - RNA, 64 nt, Homo Sapiens
gcccaggccugggaugcagugaugugaucauagcucacuguaaccucaaacucuggggcucaag

SEQ ID NO: 361666 - RNA, 64 nt, Homo Sapiens
aagcuauaucgaauauaguucuguguagagaaugucacuguaguuuugaguguauacaugugug

SEQ ID NO: 361667 - RNA, 64 nt, Homo Sapiens
uaacaaacagccauauuuaaacaugucugcagaaucacuguauguguauuucacugucauguca

SEQ ID NO: 361668 - RNA, 64 nt, Homo Sapiens
gcaguugaaagaauuuauucagacugaagauuggucacuguaaaaucacccgggaagacgacag

SEQ ID NO: 361669 - RNA, 64 nt, Homo Sapiens
ugagcaacucaucuuuuuaauaaguugucaguuaucacuguagagauuugcaaaaucacaaaac

SEQ ID NO: 361670 - RNA, 64 nt, Homo Sapiens
cuauguaauuccugaaggggucuucagcauuuaaucacuguauaucaauuguuuuucuuuauuu

SEQ ID NO: 361671 - RNA, 64 nt, Homo Sapiens
gacaaauaaaugauuauauuacauucuuccaucaucacuguaaauauugaaaggggacaccugu

SEQ ID NO: 361672 - RNA, 64 nt, Homo Sapiens
uaaacauauuuuuauacuuuagauuauugugacuucacuguauauaaauaaauuucccaguuaa

SEQ ID NO: 361673 - RNA, 64 nt, Homo Sapiens
uugguuuuauuugaaaaccuaaaacauuaucuugucacuguagucugucuauggaauuacaugu

SEQ ID NO: 361674 - RNA, 64 nt, Homo Sapiens
gggaaggaacagaggcccugucuuaagacauguaucacuguagaagcaugggagccacgacccu

SEQ ID NO: 361675 - RNA, 64 nt, Homo Sapiens
uguuauucaguguuugguguuuugucagauaauuucacuguacaauaaugucucuuuuaaaguc

SEQ ID NO: 361676 - RNA, 64 nt, Homo Sapiens
uaucaguucuaaaauuuccacuuuuaaauuuuggucacuguaugccacugagugcauucaccac

SEQ ID NO: 361677 - RNA, 64 nt, Homo Sapiens
uauaucauaucuguucucaauaguuucaaguaucucacuguaccaacuaucaacuaucaaauuc

SEQ ID NO: 361678 - RNA, 64 nt, Homo Sapiens
acugguucuccauuaaaauggccgaguuaccuggucacuguaauuuuuuaagugauaauaccau

SEQ ID NO: 361679 - RNA, 64 nt, Homo Sapiens
ucacuauauaauauauaauaauccucaucugucauauccagaaaugugaugguguaagagcuaa

SEQ ID NO: 361680 - RNA, 64 nt, Homo Sapiens
uuuguagauaaauguugccagcuuccuacguguauauccagaggcacuaguggaaauaccaaaa

SEQ ID NO: 361681 - RNA, 64 nt, Homo Sapiens
auccugaacacuguguauuuuuauuuaagauggcuauccagauauggucaugcggaacacucug

SEQ ID NO: 361682 - RNA, 64 nt, Homo Sapiens
ccuucuccacaaugaugaauuuuucaacuauguuuauccagacucucuaccucuaagccagugu

SEQ ID NO: 361683 - RNA, 64 nt, Homo Sapiens
uggcugagggauacagagaugaaauuguaaacuguauccagauuaucaaagcuaauuugacuag

SEQ ID NO: 361684 - RNA, 64 nt, Homo Sapiens
uagcaagggauucagaucuuuguaccuuaucuuauauccagagcagauuccauuuggcagauag

SEQ ID NO: 361685 - RNA, 64 nt, Homo Sapiens
gcaacauauuugcaaaauuuuauuuaauaacuuuuauccagauggguaaguaaaaaggcaucua

SEQ ID NO: 361686 - RNA, 64 nt, Homo Sapiens
ugggagccagugaauuuaauggggcaauaauucuuauccagacauauugcacguuggggcauua

SEQ ID NO: 361687 - RNA, 64 nt, Homo Sapiens; identical to SEQ ID NO: 138011

SEQ ID NO: 361688 - RNA, 64 nt, Homo Sapiens; identical to SEQ ID NO: 138012

SEQ ID NO: 361689 - RNA, 64 nt, Homo Sapiens; identical to SEQ ID NO: 138013

SEQ ID NO: 361690 - RNA, 64 nt, Homo Sapiens; identical to SEQ ID NO: 138014

SEQ ID NO: 361691 - RNA, 64 nt, Homo Sapiens; identical to SEQ ID NO: 138015

SEQ ID NO: 361692 - RNA, 59 nt, Homo Sapiens; identical to SEQ ID NO: 138016

SEQ ID NO: 361693 - RNA, 64 nt, Homo Sapiens; identical to SEQ ID NO: 138017

SEQ ID NO: 361694 - RNA, 64 nt, Homo Sapiens; identical to SEQ ID NO: 138018

SEQ ID NO: 361695 - RNA, 64 nt, Homo Sapiens; identical to SEQ ID NO: 138019

SEQ ID NO: 361696 - RNA, 64 nt, Homo Sapiens; identical to SEQ ID NO: 138020

SEQ ID NO: 361697 - RNA, 64 nt, Homo Sapiens; identical to SEQ ID NO: 138021

SEQ ID NO: 361698 - RNA, 64 nt, Homo Sapiens; identical to SEQ ID NO: 138022

SEQ ID NO: 361699 - RNA, 64 nt, Homo Sapiens; identical to SEQ ID NO: 138023

SEQ ID NO: 361700 - RNA, 64 nt, Homo Sapiens; identical to SEQ ID NO: 138024

SEQ ID NO: 361701 - RNA, 64 nt, Homo Sapiens; identical to SEQ ID NO: 138025

SEQ ID NO: 361702 - RNA, 64 nt, Homo Sapiens; identical to SEQ ID NO: 138026

SEQ ID NO: 361703 - RNA, 64 nt, Homo Sapiens; identical to SEQ ID NO: 138027

SEQ ID NO: 361704 - RNA, 64 nt, Homo Sapiens; identical to SEQ ID NO: 138028

SEQ ID NO: 361705 - RNA, 64 nt, Homo Sapiens; identical to SEQ ID NO: 138029

SEQ ID NO: 361706 - RNA, 64 nt, Homo Sapiens; identical to SEQ ID NO: 138030

SEQ ID NO: 361707 - RNA, 64 nt, Homo Sapiens; identical to SEQ ID NO: 138031

SEQ ID NO: 361708 - RNA, 64 nt, Homo Sapiens; identical to SEQ ID NO: 138032

SEQ ID NO: 361709 - RNA, 64 nt, Homo Sapiens; identical to SEQ ID NO: 138033

SEQ ID NO: 361710 - RNA, 64 nt, Homo Sapiens; identical to SEQ ID NO: 138034

SEQ ID NO: 361711 - RNA, 64 nt, Homo Sapiens; identical to SEQ ID NO: 138035

SEQ ID NO: 361712 - RNA, 64 nt, Homo Sapiens; identical to SEQ ID NO: 138036

SEQ ID NO: 361713 - RNA, 64 nt, Homo Sapiens; identical to SEQ ID NO: 138037

SEQ ID NO: 361714 - RNA, 64 nt, Homo Sapiens; identical to SEQ ID NO: 138038

SEQ ID NO: 361715 - RNA, 64 nt, Homo Sapiens; identical to SEQ ID NO: 138039

SEQ ID NO: 361716 - RNA, 64 nt, Homo Sapiens; identical to SEQ ID NO: 138040

SEQ ID NO: 361717 - RNA, 64 nt, Homo Sapiens; identical to SEQ ID NO: 138041

SEQ ID NO: 361718 - RNA, 64 nt, Homo Sapiens; identical to SEQ ID NO: 138042

SEQ ID NO: 361719 - RNA, 64 nt, Homo Sapiens; identical to SEQ ID NO: 138043

SEQ ID NO: 361720 - RNA, 64 nt, Homo Sapiens; identical to SEQ ID NO: 138044

SEQ ID NO: 361721 - RNA, 64 nt, Homo Sapiens; identical to SEQ ID NO: 138045

SEQ ID NO: 361722 - RNA, 64 nt, Homo Sapiens; identical to SEQ ID NO: 138046

SEQ ID NO: 361723 - RNA, 64 nt, Homo Sapiens; identical to SEQ ID NO: 138047

SEQ ID NO: 361724 - RNA, 64 nt, Homo Sapiens; identical to SEQ ID NO: 138048

SEQ ID NO: 361725 - RNA, 64 nt, Homo Sapiens; identical to SEQ ID NO: 138049

SEQ ID NO: 361726 - RNA, 64 nt, Homo Sapiens; identical to SEQ ID NO: 138050

SEQ ID NO: 361727 - RNA, 64 nt, Homo Sapiens; identical to SEQ ID NO: 138051

SEQ ID NO: 361728 - RNA, 64 nt, Homo Sapiens; identical to SEQ ID NO: 138052

SEQ ID NO: 361729 - RNA, 64 nt, Homo Sapiens; identical to SEQ ID NO: 138053

SEQ ID NO: 361730 - RNA, 64 nt, Homo Sapiens; identical to SEQ ID NO: 138054

SEQ ID NO: 361731 - RNA, 64 nt, Homo Sapiens; identical to SEQ ID NO: 138055

SEQ ID NO: 361732 - RNA, 64 nt, Homo Sapiens; identical to SEQ ID NO: 138056

SEQ ID NO: 361733 - RNA, 64 nt, Homo Sapiens; identical to SEQ ID NO: 138057

SEQ ID NO: 361734 - RNA, 64 nt, Homo Sapiens; identical to SEQ ID NO: 138058

SEQ ID NO: 361735 - RNA, 64 nt, Homo Sapiens; identical to SEQ ID NO: 138059

SEQ ID NO: 361736 - RNA, 64 nt, Homo Sapiens; identical to SEQ ID NO: 138060

SEQ ID NO: 361737 - RNA, 64 nt, Homo Sapiens; identical to SEQ ID NO: 138061

SEQ ID NO: 361738 - RNA, 64 nt, Homo Sapiens; identical to SEQ ID NO: 138062

SEQ ID NO: 361739 - RNA, 64 nt, Homo Sapiens; identical to SEQ ID NO: 138063

SEQ ID NO: 361740 - RNA, 64 nt, Homo Sapiens; identical to SEQ ID NO: 138064

SEQ ID NO: 361741 - RNA, 64 nt, Homo Sapiens; identical to SEQ ID NO: 138065

SEQ ID NO: 361742 - RNA, 64 nt, Homo Sapiens; identical to SEQ ID NO: 138066

SEQ ID NO: 361743 - RNA, 64 nt, Homo Sapiens; identical to SEQ ID NO: 133930

SEQ ID NO: 361744 - RNA, 64 nt, Homo Sapiens; identical to SEQ ID NO: 133931

SEQ ID NO: 361745 - RNA, 64 nt, Homo Sapiens; identical to SEQ ID NO: 133932

SEQ ID NO: 361746 - RNA, 64 nt, Homo Sapiens; identical to SEQ ID NO: 133933

SEQ ID NO: 361747 - RNA, 64 nt, Homo Sapiens; identical to SEQ ID NO: 133934

SEQ ID NO: 361748 - RNA, 64 nt, Homo Sapiens; identical to SEQ ID NO: 133935

SEQ ID NO: 361749 - RNA, 64 nt, Homo Sapiens; identical to SEQ ID NO: 133936

SEQ ID NO: 361750 - RNA, 64 nt, Homo Sapiens; identical to SEQ ID NO: 133937

SEQ ID NO: 361751 - RNA, 64 nt, Homo Sapiens; identical to SEQ ID NO: 133938

SEQ ID NO: 361752 - RNA, 64 nt, Homo Sapiens; identical to SEQ ID NO: 133939

SEQ ID NO: 361753 - RNA, 64 nt, Homo Sapiens; identical to SEQ ID NO: 133940

SEQ ID NO: 361754 - RNA, 64 nt, Homo Sapiens; identical to SEQ ID NO: 133941

SEQ ID NO: 361755 - RNA, 64 nt, Homo Sapiens; identical to SEQ ID NO: 133942

SEQ ID NO: 361756 - RNA, 64 nt, Homo Sapiens; identical to SEQ ID NO: 133943

SEQ ID NO: 361757 - RNA, 64 nt, Homo Sapiens; identical to SEQ ID NO: 133944

SEQ ID NO: 361758 - RNA, 64 nt, Homo Sapiens; identical to SEQ ID NO: 133945

SEQ ID NO: 361759 - RNA, 64 nt, Homo Sapiens; identical to SEQ ID NO: 133946

SEQ ID NO: 361760 - RNA, 64 nt, Homo Sapiens; identical to SEQ ID NO: 133947

SEQ ID NO: 361761 - RNA, 64 nt, Homo Sapiens; identical to SEQ ID NO: 133948

SEQ ID NO: 361762 - RNA, 64 nt, Homo Sapiens; identical to SEQ ID NO: 133949

SEQ ID NO: 361763 - RNA, 64 nt, Homo Sapiens; identical to SEQ ID NO: 133950

SEQ ID NO: 361764 - RNA, 64 nt, Homo Sapiens; identical to SEQ ID NO: 133951

SEQ ID NO: 361765 - RNA, 64 nt, Homo Sapiens; identical to SEQ ID NO: 133952

SEQ ID NO: 361766 - RNA, 64 nt, Homo Sapiens; identical to SEQ ID NO: 133953

SEQ ID NO: 361767 - RNA, 64 nt, Homo Sapiens; identical to SEQ ID NO: 133954

SEQ ID NO: 361768 - RNA, 64 nt, Homo Sapiens; identical to SEQ ID NO: 133955

SEQ ID NO: 361769 - RNA, 64 nt, Homo Sapiens; identical to SEQ ID NO: 133956

SEQ ID NO: 361770 - RNA, 64 nt, Homo Sapiens; identical to SEQ ID NO: 133957

SEQ ID NO: 361771 - RNA, 64 nt, Homo Sapiens; identical to SEQ ID NO: 133958

SEQ ID NO: 361772 - RNA, 64 nt, Homo Sapiens; identical to SEQ ID NO: 133959

SEQ ID NO: 361773 - RNA, 64 nt, Homo Sapiens; identical to SEQ ID NO: 133960

SEQ ID NO: 361774 - RNA, 64 nt, Homo Sapiens; identical to SEQ ID NO: 133961

SEQ ID NO: 361775 - RNA, 64 nt, Homo Sapiens; identical to SEQ ID NO: 133962

SEQ ID NO: 361776 - RNA, 64 nt, Homo Sapiens; identical to SEQ ID NO: 133963

SEQ ID NO: 361777 - RNA, 64 nt, Homo Sapiens; identical to SEQ ID NO: 133964

SEQ ID NO: 361778 - RNA, 64 nt, Homo Sapiens; identical to SEQ ID NO: 133965

SEQ ID NO: 361779 - RNA, 64 nt, Homo Sapiens; identical to SEQ ID NO: 133966

SEQ ID NO: 361780 - RNA, 64 nt, Homo Sapiens
ccagcaaauacucauuuuaggaaaaaaaaaagcaugaucugaaaaauacuuuuggugguauguu

SEQ ID NO: 361781 - RNA, 64 nt, Homo Sapiens
uagcaagacuguuagcccucaaacuugacucuacugaucugaccauuucccucucaucgccaga

SEQ ID NO: 361782 - RNA, 64 nt, Homo Sapiens
caugcugaugcuucaaggagucgggucaagauuuugaucugagagcaagaaaaaugcugaggcc

SEQ ID NO: 361783 - RNA, 64 nt, Homo Sapiens
gguauuuagguugaaggaaaaucagaggagccacugaucugaguugcugcucgugagcaggaaa

SEQ ID NO: 361784 - RNA, 64 nt, Homo Sapiens
aucuuggaacucaaucuucuguuggaucacgggaaaucaagacacccaggaggaauugaaagag

SEQ ID NO: 361785 - RNA, 64 nt, Homo Sapiens
uauuguauauauuaaaacagagauaugugcaugaaaucaagaaaaaagaaaugaacaaaagcaa

SEQ ID NO: 361786 - RNA, 64 nt, Homo Sapiens
ggugaacugaaaaguuauuuuaacuauuauacauaaucaagauccugccucuacggaauuagcu

SEQ ID NO: 361787 - RNA, 64 nt, Homo Sapiens
acugucuugaaauugaaucuguccaucuguuuauaaucaagaacauaucagaaauauauagguc

SEQ ID NO: 361788 - RNA, 64 nt, Homo Sapiens
cucacuguucucucccuugaaucucauuuguaggaaucaagagauuccuauacaugggacuuuu

SEQ ID NO: 361789 - RNA, 64 nt, Homo Sapiens
uacccaccagaguaagcaaucuuuucuuuuuagaaaucaagaauuuggcuucacagauggcuuc

SEQ ID NO: 361790 - RNA, 64 nt, Homo Sapiens
aacuucaaaguuaaugggauuuuuuucuucuauuaaucaagagauccuuuucuucacccucccc

SEQ ID NO: 361791 - RNA, 64 nt, Homo Sapiens
gagauguagaaaguuguaaagccaggaaggccaaaaucaagagugggacugccaggcuguuuca

SEQ ID NO: 361792 - RNA, 64 nt, Homo Sapiens
gugaaaaauaguuuuugaaaacaucagauuauaaaaucaagauaguccggacgcgguggcacau

SEQ ID NO: 361793 - RNA, 64 nt, Homo Sapiens
gggcgacagagcgagacuccaccucaaaaaauaaaaucaagauaaccucuugaauguaauagcu

SEQ ID NO: 361794 - RNA, 64 nt, Homo Sapiens
caaauacauuuuaauuaaacacaaucuguaacagaaucaagaaaaagaaacaaauuuuaauuaa

SEQ ID NO: 361795 - RNA, 64 nt, Homo Sapiens
caaauuuuaauuaaacaauccauguauauaacagaaucaagaaacccuuuucacaugguuucuc

SEQ ID NO: 361796 - RNA, 64 nt, Homo Sapiens
aguaggcccaauacaaacuauacaguuuucaaaaaaucaagacaauagaaguuauucaaaauua

SEQ ID NO: 361797 - RNA, 64 nt, Homo Sapiens
uuaacagauauaugugacaguaaauauuaauauuaaucaagaauugaguuaagaaaguuuuauu

SEQ ID NO: 361798 - RNA, 64 nt, Homo Sapiens
auuucuuuugcuuuuaaaaaaauuccugguagcaaaucaagauaaauaauugcuucauuuucuu

SEQ ID NO: 361799 - RNA, 64 nt, Homo Sapiens
aauauaugaccaugacuuugaaaggcaaaagaggaaucaagaauaaauaaaacaaacuuaaucu

SEQ ID NO: 361800 - RNA, 64 nt, Homo Sapiens
gguucccgugagauaaguuaacccggccugacagaaucaagaaaauugagaugagauuugaaag

SEQ ID NO: 361801 - RNA, 64 nt, Homo Sapiens
gugaaggugaucaguguagcaguaagacaucuaaaaucaagacaaugacaugggggcuuugugu

SEQ ID NO: 361802 - RNA, 64 nt, Homo Sapiens
aagaggaguaauguuccgaaucauguuuuugaaaaaucaagaccuccuguuaagggcccacuug

SEQ ID NO: 361803 - RNA, 64 nt, Homo Sapiens
uaccaucuugaaggugaagggaguuaagaaaaguaaucaagaccugcuccuaagcauaugagac

SEQ ID NO: 361804 - RNA, 64 nt, Homo Sapiens
ccuuuuuuuuucuuuuuuuuaaaauuucagagagaaucaagauaaaaaacaucagaaauaauaa

SEQ ID NO: 361805 - RNA, 64 nt, Homo Sapiens
uggcuuacaaaaagaaauauuguggugauagcaaaaucaagagacaaaucucuacaaauuuuuc

SEQ ID NO: 361806 - RNA, 64 nt, Homo Sapiens
caaacaaaagcugaacacaugcuuccugucaagcaaucaagaaacuuucuccuuuuuuuugaca

SEQ ID NO: 361807 - RNA, 64 nt, Homo Sapiens
uauguuugcuauguucuaagcagugggcugauucaaucaagaugucaaucaagauccgugcucg

SEQ ID NO: 361808 - RNA, 64 nt, Homo Sapiens
cgugcucgcagugggcugaucaauaggcugauucaaucaagaucauguagaccuaaaacuacac

SEQ ID NO: 361809 - RNA, 64 nt, Homo Sapiens
uauguagaccuaaaacuacacaguagguugauucaaucaagauggauagaccaaaaaacuacac

SEQ ID NO: 361810 - RNA, 64 nt, Homo Sapiens; identical to SEQ ID NO: 124084

SEQ ID NO: 361811 - RNA, 64 nt, Homo Sapiens; identical to SEQ ID NO: 124085

SEQ ID NO: 361812 - RNA, 64 nt, Homo Sapiens; identical to SEQ ID NO: 124086

SEQ ID NO: 361813 - RNA, 64 nt, Homo Sapiens; identical to SEQ ID NO: 124087

SEQ ID NO: 361814 - RNA, 64 nt, Homo Sapiens; identical to SEQ ID NO: 124088

SEQ ID NO: 361815 - RNA, 64 nt, Homo Sapiens; identical to SEQ ID NO: 124089

SEQ ID NO: 361816 - RNA, 64 nt, Homo Sapiens; identical to SEQ ID NO: 124090

SEQ ID NO: 361817 - RNA, 64 nt, Homo Sapiens; identical to SEQ ID NO: 124091

SEQ ID NO: 361818 - RNA, 64 nt, Homo Sapiens; identical to SEQ ID NO: 124092

SEQ ID NO: 361819 - RNA, 64 nt, Homo Sapiens; identical to SEQ ID NO: 124093

SEQ ID NO: 361820 - RNA, 64 nt, Homo Sapiens; identical to SEQ ID NO: 124094

SEQ ID NO: 361821 - RNA, 64 nt, Homo Sapiens; identical to SEQ ID NO: 124095

SEQ ID NO: 361822 - RNA, 64 nt, Homo Sapiens; identical to SEQ ID NO: 124096

SEQ ID NO: 361823 - RNA, 64 nt, Homo Sapiens; identical to SEQ ID NO: 124097

SEQ ID NO: 361824 - RNA, 64 nt, Homo Sapiens; identical to SEQ ID NO: 124098

SEQ ID NO: 361825 - RNA, 64 nt, Homo Sapiens; identical to SEQ ID NO: 124099

SEQ ID NO: 361826 - RNA, 64 nt, Homo Sapiens; identical to SEQ ID NO: 124100

SEQ ID NO: 361827 - RNA, 64 nt, Homo Sapiens; identical to SEQ ID NO: 124101

SEQ ID NO: 361828 - RNA, 64 nt, Homo Sapiens; identical to SEQ ID NO: 124102

SEQ ID NO: 361829 - RNA, 64 nt, Homo Sapiens; identical to SEQ ID NO: 124103

SEQ ID NO: 361830 - RNA, 64 nt, Homo Sapiens; identical to SEQ ID NO: 124104

SEQ ID NO: 361831 - RNA, 64 nt, Homo Sapiens; identical to SEQ ID NO: 124105

SEQ ID NO: 361832 - RNA, 64 nt, Homo Sapiens; identical to SEQ ID NO: 124106

SEQ ID NO: 361833 - RNA, 64 nt, Homo Sapiens; identical to SEQ ID NO: 124107

SEQ ID NO: 361834 - RNA, 64 nt, Homo Sapiens; identical to SEQ ID NO: 124108

SEQ ID NO: 361835 - RNA, 64 nt, Homo Sapiens; identical to SEQ ID NO: 124109

SEQ ID NO: 361836 - RNA, 64 nt, Homo Sapiens; identical to SEQ ID NO: 124110

SEQ ID NO: 361837 - RNA, 64 nt, Homo Sapiens; identical to SEQ ID NO: 124111

SEQ ID NO: 361838 - RNA, 64 nt, Homo Sapiens; identical to SEQ ID NO: 124112

SEQ ID NO: 361839 - RNA, 64 nt, Homo Sapiens; identical to SEQ ID NO: 124113

SEQ ID NO: 361840 - RNA, 64 nt, Homo Sapiens; identical to SEQ ID NO: 124114

SEQ ID NO: 361841 - RNA, 64 nt, Homo Sapiens; identical to SEQ ID NO: 124115

SEQ ID NO: 361842 - RNA, 64 nt, Homo Sapiens; identical to SEQ ID NO: 124116

SEQ ID NO: 361843 - RNA, 64 nt, Homo Sapiens; identical to SEQ ID NO: 124117

SEQ ID NO: 361844 - RNA, 64 nt, Homo Sapiens; identical to SEQ ID NO: 124118

SEQ ID NO: 361845 - RNA, 64 nt, Homo Sapiens; identical to SEQ ID NO: 124119

SEQ ID NO: 361846 - RNA, 64 nt, Homo Sapiens; identical to SEQ ID NO: 124120

SEQ ID NO: 361847 - RNA, 64 nt, Homo Sapiens; identical to SEQ ID NO: 124121

SEQ ID NO: 361848 - RNA, 64 nt, Homo Sapiens; identical to SEQ ID NO: 124122

SEQ ID NO: 361849 - RNA, 64 nt, Homo Sapiens; identical to SEQ ID NO: 124123

SEQ ID NO: 361850 - RNA, 64 nt, Homo Sapiens; identical to SEQ ID NO: 245914

SEQ ID NO: 361851 - RNA, 64 nt, Homo Sapiens; identical to SEQ ID NO: 245915

SEQ ID NO: 361852 - RNA, 64 nt, Homo Sapiens
caggggguaguucuuuacucucccuuuacuacccuggagggacagcucugcccuugaggcccuu

SEQ ID NO: 361853 - RNA, 64 nt, Homo Sapiens
caggaggagcccuucauccuggcaggccggauuguggagggacuucccucccccucuuuuccau

SEQ ID NO: 361854 - RNA, 64 nt, Homo Sapiens
agccucacacaagcagaaacgccgaacuuuguuauggagggagcuguuuugucuguugccguca

SEQ ID NO: 361855 - RNA, 64 nt, Homo Sapiens
augggucuugcaguacauuugggaguguauuaacuggagggaagcccccucugcagcccauccu

SEQ ID NO: 361856 - RNA, 64 nt, Homo Sapiens
uaggcacugccucagucuucuugauccucagauguggagggaggucuguucuugccacaccugc

SEQ ID NO: 361857 - RNA, 64 nt, Homo Sapiens
gggaagcaagaccaagaugacagcagcaacaggcuggagggagacaucuuggcacccagaggag

SEQ ID NO: 361858 - RNA, 64 nt, Homo Sapiens
uuccaugucaacaauuuguccaaaggaaaacugcuggagggagguggagggaggaaggugggaa

SEQ ID NO: 361859 - RNA, 64 nt, Homo Sapiens
acaauuuguccaaaggaaaacugcuggagggagguggagggaggaaggugggaauuauuauuua

SEQ ID NO: 361860 - RNA, 64 nt, Homo Sapiens
gucccaaauuagcaaacccuacaggccaacuauauggagggagggaaugucugcucuggggggc

SEQ ID NO: 361861 - RNA, 64 nt, Homo Sapiens
ugcguuggaaauucuaggccuugcccccaucuccuggagggagggggagagagaggcaguguac

SEQ ID NO: 361862 - RNA, 64 nt, Homo Sapiens
gcaggcauggcccugggcggggcgugggggggcguggagggaggccccagggggucucacccau

SEQ ID NO: 361863 - RNA, 64 nt, Homo Sapiens
aguuuuauagccuggacugcuaccuuucaaagcuuggagggaagccgugaauucaguugguucg

SEQ ID NO: 361864 - RNA, 64 nt, Homo Sapiens
cugaagacagauagcuuccucuccacagcaacucuggagggaagaucugucagaggaaaauggu

SEQ ID NO: 361865 - RNA, 64 nt, Homo Sapiens
caggggacauaauggccuccccagcagguggcgcuggagggaguugggcuuuuccucugagauu

SEQ ID NO: 361866 - RNA, 64 nt, Homo Sapiens
ggacaaucucaggcugaaaucccauaaaggaacuuggagggaauauuaugauggagggaaguga

SEQ ID NO: 361867 - RNA, 64 nt, Homo Sapiens
aaucccauaaaggaacuuggagggaauauuaugauggagggaagugaggugaauccaggcacau

SEQ ID NO: 361868 - RNA, 64 nt, Homo Sapiens
caggccacguggagacaccacggucgacgacggcuggagggacguuucagaggcgaguccuggg

SEQ ID NO: 361869 - RNA, 64 nt, Homo Sapiens
gugcacgugcccugcgccacauccucacgcucgguggagggacgcgugcggcgggacggugccu

SEQ ID NO: 361870 - RNA, 64 nt, Homo Sapiens
gauuuucucagaugccuuuacacgcugaugggacuggagggagcccacccuucagcacgagcac

SEQ ID NO: 361871 - RNA, 64 nt, Homo Sapiens
aagaagacgacugcuaagacacggcaggggggccuggagggagccuccgacucugagcugcucc

SEQ ID NO: 361872 - RNA, 64 nt, Homo Sapiens
cccugcccuuccccaggucggccucuccgcugucuggagggaaggggauuuggagggaggcugu

SEQ ID NO: 361873 - RNA, 64 nt, Homo Sapiens
gucggccucuccgcugucuggagggaaggggauuuggagggaggcugucgucgcccccaggaaa

SEQ ID NO: 361874 - RNA, 64 nt, Homo Sapiens
ccuuccucccagcagcagcagugcagagcccaccuggagggaugugggggcugugcagggugca

SEQ ID NO: 361875 - RNA, 64 nt, Homo Sapiens
gguggauccugggaagcagccucuggaugcugaguggagggagccacugagcacagcaaggcac

SEQ ID NO: 361876 - RNA, 64 nt, Homo Sapiens
gagugguuugcagguggccacagauuccuucccauggagggaggccuggucaccuaggaagccu

SEQ ID NO: 361877 - RNA, 64 nt, Homo Sapiens
gaguggcccuuucggauccaaggcugagugcauuuggagggaguuggucccuuguauccccugc

SEQ ID NO: 361878 - RNA, 64 nt, Homo Sapiens
cugguuacuuuuggccucccguuucauuugcuuuuggagggaagggauuagaagaccaacaggu

SEQ ID NO: 361879 - RNA, 64 nt, Homo Sapiens
gggcugucucuguuuguggguugguagagaaugcuggagggaaggcugacaagguuugaagggc

SEQ ID NO: 361880 - RNA, 64 nt, Homo Sapiens
gaacagaguugggaaaaacaggcagggguuggauuggagggagacuagccugcccaugcacugu

SEQ ID NO: 361881 - RNA, 64 nt, Homo Sapiens
aggcacugggcggugugacugcacccagaggccuuggagggacacucccuguggacuugcgucg

SEQ ID NO: 361882 - RNA, 64 nt, Homo Sapiens
caucccuucccuguccaccuacuuuccuacaaaauggagggagcgaaucaagagggcagccccc

SEQ ID NO: 361883 - RNA, 64 nt, Homo Sapiens
ccacccagcaacacagagcuucagccacggagccuggagggauggcccacaauggagugggaga

SEQ ID NO: 361884 - RNA, 64 nt, Homo Sapiens
ccaggcaucauuaaacaagcaauuguguugcuccuggagggagcggagagcugagauuggaggg

SEQ ID NO: 361885 - RNA, 64 nt, Homo Sapiens
uguguugcuccuggagggagaggagagcugagauuggagggaauugugagcucuagcagggaua

SEQ ID NO: 361886 - RNA, 64 nt, Homo Sapiens
cccaugacuuuggaugacaaacugccuccuggcuuggagggaucuuugggcucauggaugaaug

SEQ ID NO: 361887 - RNA, 64 nt, Homo Sapiens
ccucuccugagcucuaggcugggauuacacccgcuggagggacacucaccccaucugcucccac

SEQ ID NO: 361888 - RNA, 64 nt, Homo Sapiens
gcccccaugccuggcccugccugagccagguggguggagggagggagaucaugagggacuugga

SEQ ID NO: 361889 - RNA, 64 nt, Homo Sapiens
cagguggguggagggagggagaucaugagggacuuggagggagcugggaguucauccacgggag

SEQ ID NO: 361890 - RNA, 64 nt, Homo Sapiens
uaaauccacccuuaccccuccugacccccccaaguggagggaacagauccuggccugagggguc

SEQ ID NO: 361891 - RNA, 64 nt, Homo Sapiens
acaugaaauggaucagcacuugaauggggagaaguggagggagaggcccugggccugucccugc

SEQ ID NO: 361892 - RNA, 64 nt, Homo Sapiens
uugaagaaaggaacugaggcguaauguuagaauuuggagggaauuggaucuuucuaaaaaucuu

SEQ ID NO: 361893 - RNA, 64 nt, Homo Sapiens
gggagcagggcagaaaacaccagagagcuagggcuggagggacacugugugcugacaggagacc

SEQ ID NO: 361894 - RNA, 64 nt, Homo Sapiens
gccuggguaaccccagccauggaccgucaguggcuggagggagcuucgugucugugcuggagcu

SEQ ID NO: 361895 - RNA, 64 nt, Homo Sapiens
cuggaguaccccgagaucccagcagcgcacacaguggagggaugaggauggauggguccuaacc

SEQ ID NO: 361896 - RNA, 64 nt, Homo Sapiens
acgauuggacgugugugguugacugggaugaaguuggagggaggggcagggccuugcaggggau

SEQ ID NO: 361897 - RNA, 64 nt, Homo Sapiens
ggauguggagaagcucugugugagcggugagggguggagggaugucgcggagaggggaaggggg

SEQ ID NO: 361898 - RNA, 64 nt, Homo Sapiens
auaugcguggggacauccugggucaucucagucauggagggagacggggaugucacgccguccc

SEQ ID NO: 361899 - RNA, 64 nt, Homo Sapiens
cacucuucagaggcuaggccccaccucuggggguuggagggacccugugucuuacucgccccuc

SEQ ID NO: 361900 - RNA, 64 nt, Homo Sapiens
ccuggggccuucgaugggcuuuucuucuugucaguggagggagcagcuccccacucagcccugg

SEQ ID NO: 361901 - RNA, 64 nt, Homo Sapiens
ccagugcacuaggcagcuggggaguagccuguguuggagggacagguggcacauggguguuggg

SEQ ID NO: 361902 - RNA, 64 nt, Homo Sapiens
uguugacuucuuggaauuauguaagggugaaggcuggagggauuaauaacacacuggcccauua

SEQ ID NO: 361903 - RNA, 64 nt, Homo Sapiens
gcuauuuaacacaaauccuaagacaggaugaggguggagggagaucuuagaucuugguacaucc

SEQ ID NO: 361904 - RNA, 64 nt, Homo Sapiens
auaaggccagaaacuucugaaagcaauuauuuuauggagggaaauucuucaucuucucuaagcc

SEQ ID NO: 361905 - RNA, 64 nt, Homo Sapiens
guuaggaaacaccagcuccuucuucaggaccaacuggagggagaccuuguaaggggccauagcc

SEQ ID NO: 361906 - RNA, 64 nt, Homo Sapiens
cgcauucaaggcacagaauuaaggagcagggcucuggagggauuaaucccaaggcugggggugg

SEQ ID NO: 361907 - RNA, 64 nt, Homo Sapiens
ugacugcuccuggcugacccugagcucucgcaguuggagggaagcagacagacuugacuuuuug

SEQ ID NO: 361908 - RNA, 64 nt, Homo Sapiens
gacagacuugacuuuuugcaaguccgcguguugcuggagggacacguguauuggagcccagaag

SEQ ID NO: 361909 - RNA, 64 nt, Homo Sapiens
agcugucagggacccagggcucuagcgucagugcuggagggagacccuuaaucugccagaaacu

SEQ ID NO: 361910 - RNA, 64 nt, Homo Sapiens
cacugccucccuuaaucugcgguuuugcuucuccuggagggaagucccugacucuucaagugcc

SEQ ID NO: 361911 - RNA, 64 nt, Homo Sapiens
cucgucgucaccagcugacugacguggugccugcuggagggaggagugggccuggggccucucu

SEQ ID NO: 361912 - RNA, 64 nt, Homo Sapiens
ugagcgcaggaagacgcagauuuccgagugcagcuggagggaucuucgccugggacucggcacc

SEQ ID NO: 361913 - RNA, 64 nt, Homo Sapiens; identical to SEQ ID NO: 125533

SEQ ID NO: 361914 - RNA, 64 nt, Homo Sapiens; identical to SEQ ID NO: 125534

SEQ ID NO: 361915 - RNA, 64 nt, Homo Sapiens; identical to SEQ ID NO: 125535

SEQ ID NO: 361916 - RNA, 64 nt, Homo Sapiens; identical to SEQ ID NO: 125536

SEQ ID NO: 361917 - RNA, 64 nt, Homo Sapiens; identical to SEQ ID NO: 125537

SEQ ID NO: 361918 - RNA, 64 nt, Homo Sapiens; identical to SEQ ID NO: 125538

SEQ ID NO: 361919 - RNA, 64 nt, Homo Sapiens; identical to SEQ ID NO: 125539

SEQ ID NO: 361920 - RNA, 64 nt, Homo Sapiens; identical to SEQ ID NO: 125540

SEQ ID NO: 361921 - RNA, 64 nt, Homo Sapiens; identical to SEQ ID NO: 125541

SEQ ID NO: 361922 - RNA, 64 nt, Homo Sapiens; identical to SEQ ID NO: 125542

SEQ ID NO: 361923 - RNA, 64 nt, Homo Sapiens; identical to SEQ ID NO: 125543

SEQ ID NO: 361924 - RNA, 64 nt, Homo Sapiens; identical to SEQ ID NO: 125544

SEQ ID NO: 361925 - RNA, 64 nt, Homo Sapiens; identical to SEQ ID NO: 125545

SEQ ID NO: 361926 - RNA, 64 nt, Homo Sapiens; identical to SEQ ID NO: 125546

SEQ ID NO: 361927 - RNA, 64 nt, Homo Sapiens; identical to SEQ ID NO: 125547

SEQ ID NO: 361928 - RNA, 64 nt, Homo Sapiens; identical to SEQ ID NO: 125548

SEQ ID NO: 361929 - RNA, 64 nt, Homo Sapiens; identical to SEQ ID NO: 125549

SEQ ID NO: 361930 - RNA, 64 nt, Homo Sapiens; identical to SEQ ID NO: 125550

SEQ ID NO: 361931 - RNA, 64 nt, Homo Sapiens; identical to SEQ ID NO: 125551

SEQ ID NO: 361932 - RNA, 64 nt, Homo Sapiens; identical to SEQ ID NO: 125552

SEQ ID NO: 361933 - RNA, 64 nt, Homo Sapiens; identical to SEQ ID NO: 125553

SEQ ID NO: 361934 - RNA, 64 nt, Homo Sapiens; identical to SEQ ID NO: 125554

SEQ ID NO: 361935 - RNA, 64 nt, Homo Sapiens; identical to SEQ ID NO: 125555

SEQ ID NO: 361936 - RNA, 64 nt, Homo Sapiens; identical to SEQ ID NO: 125556

SEQ ID NO: 361937 - RNA, 64 nt, Homo Sapiens; identical to SEQ ID NO: 125557

SEQ ID NO: 361938 - RNA, 64 nt, Homo Sapiens; identical to SEQ ID NO: 125558

SEQ ID NO: 361939 - RNA, 64 nt, Homo Sapiens; identical to SEQ ID NO: 125559

SEQ ID NO: 361940 - RNA, 64 nt, Homo Sapiens; identical to SEQ ID NO: 125560

SEQ ID NO: 361941 - RNA, 64 nt, Homo Sapiens; identical to SEQ ID NO: 125561

SEQ ID NO: 361942 - RNA, 64 nt, Homo Sapiens; identical to SEQ ID NO: 125562

SEQ ID NO: 361943 - RNA, 64 nt, Homo Sapiens; identical to SEQ ID NO: 125563

SEQ ID NO: 361944 - RNA, 64 nt, Homo Sapiens; identical to SEQ ID NO: 125564

SEQ ID NO: 361945 - RNA, 64 nt, Homo Sapiens; identical to SEQ ID NO: 125565

SEQ ID NO: 361946 - RNA, 64 nt, Homo Sapiens; identical to SEQ ID NO: 125566

SEQ ID NO: 361947 - RNA, 64 nt, Homo Sapiens; identical to SEQ ID NO: 125567

SEQ ID NO: 361948 - RNA, 64 nt, Homo Sapiens; identical to SEQ ID NO: 125568

SEQ ID NO: 361949 - RNA, 64 nt, Homo Sapiens
gagagagaaggacagugcacggagagguuuccagagcacaaauuguugguuccuagcacaaauu

SEQ ID NO: 361950 - RNA, 64 nt, Homo Sapiens
ggagagguuuccagagcacaaauuguugguuccuagcacaaauuagaugguuuggagcacaaug

SEQ ID NO: 361951 - RNA, 64 nt, Homo Sapiens
agagagagcgcgggagagagugagagagagugagagcacaaagauaacgcaggagagagagaga

SEQ ID NO: 361952 - RNA, 64 nt, Homo Sapiens
ccaugagguaaaagagccaaguucaaagaacccuagcacaaauuugcuuugggauuuucuuuuc

SEQ ID NO: 361953 - RNA, 64 nt, Homo Sapiens
aaucccccauaaaauaaaccuuuugggguacuaaagcacaaaaaauguaugcgaacauauguga

SEQ ID NO: 361954 - RNA, 64 nt, Homo Sapiens
cagcuacaaugaaauauuuuuagaagaucuucuaagcacaaauaccauuuucuguuuuuaaauc

SEQ ID NO: 361955 - RNA, 64 nt, Homo Sapiens
ccuaaauaaucauugaugaaguaugucaguuacaagcacaaaagaauauaacugcuuuuauaaa

SEQ ID NO: 361956 - RNA, 64 nt, Homo Sapiens
aaaaucagcuuuuuaauguagguuaccacuuauaagcacaaaagaaacauguauaagaaaccag

SEQ ID NO: 361957 - RNA, 64 nt, Homo Sapiens
uuaaaacauugccauauguuaguuaccucuugaaagcacaaaaaccucagcuuccuaucgauuu

SEQ ID NO: 361958 - RNA, 64 nt, Homo Sapiens
aaucauuugguuucacuuugauuuccauucauuuagcacaaauaaaguauauucugaauacauu

SEQ ID NO: 361959 - RNA, 64 nt, Homo Sapiens
agacggagaccccgguggcaguggaaaaaucagaagcacaaaggaaaacucuuggccucugcuu

SEQ ID NO: 361960 - RNA, 64 nt, Homo Sapiens
caaaggaaaacucuuggccucugcuuucuccuguagcacaaagagggaguuggcuggaucuuuu

SEQ ID NO: 361961 - RNA, 64 nt, Homo Sapiens
gcugggauagccauuuccauggcucuguuaugcaagcacaaauuucaucuccuagauggacuuc

SEQ ID NO: 361962 - RNA, 64 nt, Homo Sapiens
uccucucccaggaccaggaguuuaugaccaggcgagcacaaauggcuaaaagccaagcuguccu

SEQ ID NO: 361963 - RNA, 64 nt, Homo Sapiens
gcagccaggagggcucuugggauuuccuuuccaaagcacaaaaauacugggacccaagaagaac

SEQ ID NO: 361964 - RNA, 64 nt, Homo Sapiens
gaauggcuugucccaucagcagaugaauguguuaagcacaaagcaucuuccuuaaagcacaaag

SEQ ID NO: 361965 - RNA, 64 nt, Homo Sapiens
gaugaauguguuaagcacaaagcaucuuccuuaaagcacaaagagagggacuaacugaugcugc

SEQ ID NO: 361966 - RNA, 64 nt, Homo Sapiens
aaaagugaaagggaaagagaccuuuguuuucaaaagcacaaaggauuuauaacaccugcuuuag

SEQ ID NO: 361967 - RNA, 64 nt, Homo Sapiens
cuauugugaacucugcaugcuagauucucauaggagcacaaaucugucagcucaguggcagcau

SEQ ID NO: 361968 - RNA, 64 nt, Homo Sapiens
ucgccucuggaucugcugcauccaggacugugccagcacaaagugggagcccgauaaauauuua

SEQ ID NO: 361969 - RNA, 64 nt, Homo Sapiens
ccuguaguccagucucuccagcaucaauuccaucagcacaaagacauaauuuaauuccuucuac

SEQ ID NO: 361970 - RNA, 64 nt, Homo Sapiens
uucuuauuuuguuugaauuguuaauucacagaauagcacaaacuacaauuaaaacuaagcacaa

SEQ ID NO: 361971 - RNA, 64 nt, Homo Sapiens
auucacagaauagcacaaacuacaauuaaaacuaagcacaaagccauucuaagucauuggggaa

SEQ ID NO: 361972 - RNA, 64 nt, Homo Sapiens; identical to SEQ ID NO: 183967

SEQ ID NO: 361973 - RNA, 64 nt, Homo Sapiens; identical to SEQ ID NO: 183968

SEQ ID NO: 361974 - RNA, 64 nt, Homo Sapiens
cucacccugcuugaagcgcagaaggcacagccuuacugaccagcacgcccacugacuggcaucu

SEQ ID NO: 361975 - RNA, 64 nt, Homo Sapiens
guuucuaaagcagagucggccucagaagccaaaaacugaccagaagauggugcucaaaccuuua

SEQ ID NO: 361976 - RNA, 64 nt, Homo Sapiens
agacgggacccccugcagcuucccugaccacgccacugaccagcuaucuggggaaguuuacugu

SEQ ID NO: 361977 - RNA, 64 nt, Homo Sapiens
gccacucuugggacuuugguccacguccugagccacugaccacggccagucucucuuuuuauau

SEQ ID NO: 361978 - RNA, 64 nt, Homo Sapiens
caguuguuaucuguguccgucgcauguggcugccacugaccacuugcucgugccgcuggcugcc

SEQ ID NO: 361979 - RNA, 64 nt, Homo Sapiens
gggaccuugcucgugccgcuccuuuguggcugccacugaccaaagggccuccccaaagccuggg

SEQ ID NO: 361980 - RNA, 64 nt, Homo Sapiens
cuuuuaugguuccagccgagcguuccugaaaugaacugaccauuaacagcgccucuuugauagg

SEQ ID NO: 361981 - RNA, 64 nt, Homo Sapiens
cagaaaacacagugccaguaagguucuacauaccacugaccaucugcuuaauagacauguauuu

SEQ ID NO: 361982 - RNA, 64 nt, Homo Sapiens
gcuggacuucagaccucagggauccuuuugaugcacugaccaggaauugugauaauccuuuuca

SEQ ID NO: 361983 - RNA, 64 nt, Homo Sapiens
uaaaaugacacaaggccaaaaacaaauggguuuaacugaccagagcgagagaacucugcacuau

SEQ ID NO: 361984 - RNA, 64 nt, Homo Sapiens
aaaaucucucucaucgaguaucugccucucuaaaacugaccagaucucaggcauuguggccagc

SEQ ID NO: 361985 - RNA, 64 nt, Homo Sapiens
aaauaaacacauguugccaacuaucagaaccugcacugaccaacauuauagagaaguaauagac

SEQ ID NO: 361986 - RNA, 64 nt, Homo Sapiens
aacuaaguacuggguaaacucuccucccgaaacuacugaccacccacaguucuacuaacuauau

SEQ ID NO: 361987 - RNA, 64 nt, Homo Sapiens
gaaugaaguauauaaguuaaggaaaaaauacaaaacugaccaugaccauuguugguugaauauu

SEQ ID NO: 361988 - RNA, 64 nt, Homo Sapiens
caauuguacuucacuaugccauauguauguauucacugaccaaaaauucacugaccaaccaacc

SEQ ID NO: 361989 - RNA, 64 nt, Homo Sapiens
augccauauguauguauucacugaccaaaaauucacugaccaaccaaccaaacuccacacuuca

SEQ ID NO: 361990 - RNA, 64 nt, Homo Sapiens
gacugcagaacccccaggugagauagaaagcuggacugaccaaagcggaagccaaaggcagcua

SEQ ID NO: 361991 - RNA, 64 nt, Homo Sapiens
ccaaccaggccuucauccucgaagcauugccuggacugaccacaggcuucauuccggacuggca

SEQ ID NO: 361992 - RNA, 64 nt, Homo Sapiens
uacaagaugauuauacaggguugcagauugggugacugaccagacuuguugggguccugggaug

SEQ ID NO: 361993 - RNA, 64 nt, Homo Sapiens
uuuuuaguuuucaguguucagguuauagaauauaacugaccauaaaaauuaccugcagguauuu

SEQ ID NO: 361994 - RNA, 64 nt, Homo Sapiens
uaaccacauccacucucaaccccguccccuucgcacugaccacacccaccccguucggccccgc

SEQ ID NO: 361995 - RNA, 64 nt, Homo Sapiens
ccucccccucgccgcucgaccccgcccucaccacacugaccacccucaacccauugcgcccagu

SEQ ID NO: 361996 - RNA, 64 nt, Homo Sapiens
cacacccucacuggcucggcccugcccccaguauacugaccauuccccagccacuucccuuccg

SEQ ID NO: 361997 - RNA, 64 nt, Homo Sapiens
cugggacuguagcccguccaaguugacacauaaaacugaccaucgggccgggggcgguggcuca

SEQ ID NO: 361998 - RNA, 64 nt, Homo Sapiens
acagggcaagacucugucucaaaaaaaauaaaaaacugaccaucuaguccuugucaucugggca

SEQ ID NO: 361999 - RNA, 64 nt, Homo Sapiens
gccuaccuuagcuaaccagaguuauuuguaaagaguucuauacucauggcauaauugaaauacu

SEQ ID NO: 362000 - RNA, 64 nt, Homo Sapiens
uauuauguuuagugugguuuuuuuaacaaagcgaguucuauauucuugaauguauacuguagau

SEQ ID NO: 362001 - RNA, 64 nt, Homo Sapiens
aucagcccagaaagcuaucagauuuuuguucggaguucuauacuggauugucuugugcuuuggg

SEQ ID NO: 362002 - RNA, 64 nt, Homo Sapiens
uaaagccauaagaauccuuuaaucucuaguuuuuguucuauagaucuauuaacaugaucuucag

SEQ ID NO: 362003 - RNA, 64 nt, Homo Sapiens
caaacauaaaaaucccuuuaauuguaguguaguuguucuauaaaccauauuuuuucaugaugug

SEQ ID NO: 362004 - RNA, 64 nt, Homo Sapiens
aguuauuagaaaugagucacggcacuaacucaugguucuauacucauuuuaagaaauuguaaag

SEQ ID NO: 362005 - RNA, 64 nt, Homo Sapiens
auauucuuauauguagagcaauaaugcaaaagcuguucuauaugcaaacaugaugucuuuauua

SEQ ID NO: 362006 - RNA, 64 nt, Homo Sapiens
uaauuuccaaaauauaagcuguuuucauuagccaguucuauaauaucuuccugugauuuaugua

SEQ ID NO: 362007 - RNA, 64 nt, Homo Sapiens
auuaagagauaauguaagaaaauacauuuuuuugguucuauauaaugcuucaugauucauuuag

SEQ ID NO: 362008 - RNA, 64 nt, Homo Sapiens
cagaauaguuauauuugaaguagcccuggcccuaguucuauagggcuuggcuauuuaauauuuu

SEQ ID NO: 362009 - RNA, 64 nt, Homo Sapiens; identical to SEQ ID NO: 143712

SEQ ID NO: 362010 - RNA, 64 nt, Homo Sapiens; identical to SEQ ID NO: 143713

SEQ ID NO: 362011 - RNA, 64 nt, Homo Sapiens; identical to SEQ ID NO: 143714

SEQ ID NO: 362012 - RNA, 64 nt, Homo Sapiens; identical to SEQ ID NO: 143715

SEQ ID NO: 362013 - RNA, 64 nt, Homo Sapiens; identical to SEQ ID NO: 143716

SEQ ID NO: 362014 - RNA, 64 nt, Homo Sapiens; identical to SEQ ID NO: 143717

SEQ ID NO: 362015 - RNA, 64 nt, Homo Sapiens; identical to SEQ ID NO: 143718

SEQ ID NO: 362016 - RNA, 64 nt, Homo Sapiens; identical to SEQ ID NO: 143719

SEQ ID NO: 362017 - RNA, 64 nt, Homo Sapiens; identical to SEQ ID NO: 143720

SEQ ID NO: 362018 - RNA, 64 nt, Homo Sapiens; identical to SEQ ID NO: 143721

SEQ ID NO: 362019 - RNA, 64 nt, Homo Sapiens; identical to SEQ ID NO: 143722

SEQ ID NO: 362020 - RNA, 64 nt, Homo Sapiens; identical to SEQ ID NO: 143723

SEQ ID NO: 362021 - RNA, 64 nt, Homo Sapiens; identical to SEQ ID NO: 143724

SEQ ID NO: 362022 - RNA, 64 nt, Homo Sapiens; identical to SEQ ID NO: 143725

SEQ ID NO: 362023 - RNA, 64 nt, Homo Sapiens; identical to SEQ ID NO: 143726

SEQ ID NO: 362024 - RNA, 64 nt, Homo Sapiens; identical to SEQ ID NO: 143727

SEQ ID NO: 362025 - RNA, 64 nt, Homo Sapiens; identical to SEQ ID NO: 143728

SEQ ID NO: 362026 - RNA, 64 nt, Homo Sapiens; identical to SEQ ID NO: 143729

SEQ ID NO: 362027 - RNA, 64 nt, Homo Sapiens; identical to SEQ ID NO: 143730

SEQ ID NO: 362028 - RNA, 64 nt, Homo Sapiens; identical to SEQ ID NO: 143731

SEQ ID NO: 362029 - RNA, 64 nt, Homo Sapiens; identical to SEQ ID NO: 143732

SEQ ID NO: 362030 - RNA, 64 nt, Homo Sapiens; identical to SEQ ID NO: 143733

SEQ ID NO: 362031 - RNA, 64 nt, Homo Sapiens; identical to SEQ ID NO: 143734

SEQ ID NO: 362032 - RNA, 64 nt, Homo Sapiens; identical to SEQ ID NO: 143735

SEQ ID NO: 362033 - RNA, 64 nt, Homo Sapiens; identical to SEQ ID NO: 143736

SEQ ID NO: 362034 - RNA, 64 nt, Homo Sapiens; identical to SEQ ID NO: 143737

SEQ ID NO: 362035 - RNA, 64 nt, Homo Sapiens; identical to SEQ ID NO: 143738

SEQ ID NO: 362036 - RNA, 64 nt, Homo Sapiens; identical to SEQ ID NO: 143739

SEQ ID NO: 362037 - RNA, 64 nt, Homo Sapiens; identical to SEQ ID NO: 143740

SEQ ID NO: 362038 - RNA, 64 nt, Homo Sapiens; identical to SEQ ID NO: 143741

SEQ ID NO: 362039 - RNA, 64 nt, Homo Sapiens; identical to SEQ ID NO: 143742

SEQ ID NO: 362040 - RNA, 64 nt, Homo Sapiens; identical to SEQ ID NO: 143743

SEQ ID NO: 362041 - RNA, 64 nt, Homo Sapiens; identical to SEQ ID NO: 143744

SEQ ID NO: 362042 - RNA, 64 nt, Homo Sapiens; identical to SEQ ID NO: 143745

SEQ ID NO: 362043 - RNA, 64 nt, Homo Sapiens; identical to SEQ ID NO: 143746

SEQ ID NO: 362044 - RNA, 64 nt, Homo Sapiens; identical to SEQ ID NO: 143747

SEQ ID NO: 362045 - RNA, 64 nt, Homo Sapiens; identical to SEQ ID NO: 143748

SEQ ID NO: 362046 - RNA, 64 nt, Homo Sapiens; identical to SEQ ID NO: 143749

SEQ ID NO: 362047 - RNA, 64 nt, Homo Sapiens; identical to SEQ ID NO: 143750

SEQ ID NO: 362048 - RNA, 64 nt, Homo Sapiens; identical to SEQ ID NO: 143751

SEQ ID NO: 362049 - RNA, 64 nt, Homo Sapiens; identical to SEQ ID NO: 143752

SEQ ID NO: 362050 - RNA, 64 nt, Homo Sapiens; identical to SEQ ID NO: 143753

SEQ ID NO: 362051 - RNA, 64 nt, Homo Sapiens; identical to SEQ ID NO: 143754

SEQ ID NO: 362052 - RNA, 64 nt, Homo Sapiens; identical to SEQ ID NO: 143755

SEQ ID NO: 362053 - RNA, 64 nt, Homo Sapiens; identical to SEQ ID NO: 143756

SEQ ID NO: 362054 - RNA, 64 nt, Homo Sapiens; identical to SEQ ID NO: 143757

SEQ ID NO: 362055 - RNA, 64 nt, Homo Sapiens; identical to SEQ ID NO: 143758

SEQ ID NO: 362056 - RNA, 64 nt, Homo Sapiens; identical to SEQ ID NO: 143759

SEQ ID NO: 362057 - RNA, 64 nt, Homo Sapiens; identical to SEQ ID NO: 143760

SEQ ID NO: 362058 - RNA, 64 nt, Homo Sapiens; identical to SEQ ID NO: 143761

SEQ ID NO: 362059 - RNA, 64 nt, Homo Sapiens; identical to SEQ ID NO: 143762

SEQ ID NO: 362060 - RNA, 64 nt, Homo Sapiens; identical to SEQ ID NO: 143763

SEQ ID NO: 362061 - RNA, 64 nt, Homo Sapiens; identical to SEQ ID NO: 143764

SEQ ID NO: 362062 - RNA, 64 nt, Homo Sapiens; identical to SEQ ID NO: 143765

SEQ ID NO: 362063 - RNA, 64 nt, Homo Sapiens; identical to SEQ ID NO: 143766

SEQ ID NO: 362064 - RNA, 64 nt, Homo Sapiens; identical to SEQ ID NO: 143767

SEQ ID NO: 362065 - RNA, 64 nt, Homo Sapiens; identical to SEQ ID NO: 143768

SEQ ID NO: 362066 - RNA, 64 nt, Homo Sapiens; identical to SEQ ID NO: 143769

SEQ ID NO: 362067 - RNA, 64 nt, Homo Sapiens; identical to SEQ ID NO: 143770

SEQ ID NO: 362068 - RNA, 64 nt, Homo Sapiens; identical to SEQ ID NO: 143771

SEQ ID NO: 362069 - RNA, 64 nt, Homo Sapiens; identical to SEQ ID NO: 143772

SEQ ID NO: 362070 - RNA, 64 nt, Homo Sapiens; identical to SEQ ID NO: 143773

SEQ ID NO: 362071 - RNA, 64 nt, Homo Sapiens; identical to SEQ ID NO: 143774

SEQ ID NO: 362072 - RNA, 64 nt, Homo Sapiens; identical to SEQ ID NO: 143775

SEQ ID NO: 362073 - RNA, 64 nt, Homo Sapiens; identical to SEQ ID NO: 143776

SEQ ID NO: 362074 - RNA, 64 nt, Homo Sapiens; identical to SEQ ID NO: 143777

SEQ ID NO: 362075 - RNA, 64 nt, Homo Sapiens; identical to SEQ ID NO: 143778

SEQ ID NO: 362076 - RNA, 64 nt, Homo Sapiens; identical to SEQ ID NO: 143779

SEQ ID NO: 362077 - RNA, 64 nt, Homo Sapiens; identical to SEQ ID NO: 143780

SEQ ID NO: 362078 - RNA, 64 nt, Homo Sapiens; identical to SEQ ID NO: 143781

SEQ ID NO: 362079 - RNA, 64 nt, Homo Sapiens; identical to SEQ ID NO: 143782

SEQ ID NO: 362080 - RNA, 64 nt, Homo Sapiens; identical to SEQ ID NO: 143783

SEQ ID NO: 362081 - RNA, 64 nt, Homo Sapiens; identical to SEQ ID NO: 143784

SEQ ID NO: 362082 - RNA, 64 nt, Homo Sapiens; identical to SEQ ID NO: 143785

SEQ ID NO: 362083 - RNA, 64 nt, Homo Sapiens; identical to SEQ ID NO: 143786

SEQ ID NO: 362084 - RNA, 64 nt, Homo Sapiens; identical to SEQ ID NO: 143787

SEQ ID NO: 362085 - RNA, 64 nt, Homo Sapiens; identical to SEQ ID NO: 143788

SEQ ID NO: 362086 - RNA, 64 nt, Homo Sapiens; identical to SEQ ID NO: 143789

SEQ ID NO: 362087 - RNA, 57 nt, Homo Sapiens; identical to SEQ ID NO: 143790

SEQ ID NO: 362088 - RNA, 64 nt, Homo Sapiens; identical to SEQ ID NO: 143791

SEQ ID NO: 362089 - RNA, 64 nt, Homo Sapiens; identical to SEQ ID NO: 143792

SEQ ID NO: 362090 - RNA, 64 nt, Homo Sapiens; identical to SEQ ID NO: 143793

SEQ ID NO: 362091 - RNA, 64 nt, Homo Sapiens; identical to SEQ ID NO: 143794

SEQ ID NO: 362092 - RNA, 64 nt, Homo Sapiens; identical to SEQ ID NO: 143795

SEQ ID NO: 362093 - RNA, 64 nt, Homo Sapiens; identical to SEQ ID NO: 143796

SEQ ID NO: 362094 - RNA, 64 nt, Homo Sapiens; identical to SEQ ID NO: 143797

SEQ ID NO: 362095 - RNA, 64 nt, Homo Sapiens; identical to SEQ ID NO: 143798

SEQ ID NO: 362096 - RNA, 64 nt, Homo Sapiens; identical to SEQ ID NO: 143799

SEQ ID NO: 362097 - RNA, 64 nt, Homo Sapiens; identical to SEQ ID NO: 143800

SEQ ID NO: 362098 - RNA, 64 nt, Homo Sapiens; identical to SEQ ID NO: 143801

SEQ ID NO: 362099 - RNA, 64 nt, Homo Sapiens; identical to SEQ ID NO: 143802

SEQ ID NO: 362100 - RNA, 64 nt, Homo Sapiens; identical to SEQ ID NO: 143803

SEQ ID NO: 362101 - RNA, 64 nt, Homo Sapiens; identical to SEQ ID NO: 143804

SEQ ID NO: 362102 - RNA, 64 nt, Homo Sapiens; identical to SEQ ID NO: 143805

SEQ ID NO: 362103 - RNA, 64 nt, Homo Sapiens; identical to SEQ ID NO: 143806

SEQ ID NO: 362104 - RNA, 64 nt, Homo Sapiens; identical to SEQ ID NO: 143807

SEQ ID NO: 362105 - RNA, 64 nt, Homo Sapiens; identical to SEQ ID NO: 143808

SEQ ID NO: 362106 - RNA, 64 nt, Homo Sapiens; identical to SEQ ID NO: 143809

SEQ ID NO: 362107 - RNA, 64 nt, Homo Sapiens; identical to SEQ ID NO: 143810

SEQ ID NO: 362108 - RNA, 64 nt, Homo Sapiens; identical to SEQ ID NO: 143811

SEQ ID NO: 362109 - RNA, 64 nt, Homo Sapiens; identical to SEQ ID NO: 143812

SEQ ID NO: 362110 - RNA, 64 nt, Homo Sapiens
ugaaaaguagaaaaaugucacguuuccauaucuccugcuggaaaucagaaaauauaauaaaauu

SEQ ID NO: 362111 - RNA, 64 nt, Homo Sapiens
aucauugaaucaauggaucuguugaagaacucagcugcuggaaaccaugcaaaauguuuugaau

SEQ ID NO: 362112 - RNA, 64 nt, Homo Sapiens
ccucagaaacugcagcagccacgcacacagaagccugcuggaagacaggucucucuccguccac

SEQ ID NO: 362113 - RNA, 64 nt, Homo Sapiens
auaauuuuacauaagaucugccuuccacacuucccugcuggaaggcauucucagagcuuuaugu

SEQ ID NO: 362114 - RNA, 64 nt, Homo Sapiens
cgggccuuuccugcccucuguggucaucugccaccugcuggaucaagugcuuucucuuuuacac

SEQ ID NO: 362115 - RNA, 64 nt, Homo Sapiens
gcgccauuccugguugucuguugaaucuuucuggcugcuggaauuggagauaggauguuuugcu

SEQ ID NO: 362116 - RNA, 64 nt, Homo Sapiens
ggagauucaggagcagcaaugggucucaccauagcugcuggaaucacaccugagaacugagaua

SEQ ID NO: 362117 - RNA, 64 nt, Homo Sapiens
cacgaugcuguccucgugcgauugcccucuccugcugcuggacuucugccuuuguuggccugau

SEQ ID NO: 362118 - RNA, 64 nt, Homo Sapiens
ccccauccgcccucuggaccuguguagggccucacugcuggagcggggaaaccgcagcucagcc

SEQ ID NO: 362119 - RNA, 64 nt, Homo Sapiens
cccuucgccucccagccccucaagacaccgcuggcugcuggacacccucuucacuugugugugu

SEQ ID NO: 362120 - RNA, 64 nt, Homo Sapiens
ccuggcugggaguggcauguaugacgugacuggccugcuggauguggagggggcgcgugcaggc

SEQ ID NO: 362121 - RNA, 64 nt, Homo Sapiens
cgggguuugccaugcuggccaggcuggucucgaacugcuggauucaagugauccgcccaucucc

SEQ ID NO: 362122 - RNA, 64 nt, Homo Sapiens
cuccuuccaggccuacccuacugcccgcugcguccugcuggaggugcaagugccugcugcccuu

SEQ ID NO: 362123 - RNA, 64 nt, Homo Sapiens
cgcccgacugcaacugcugacccugcagagcuggcugcuggacgcaccgugcucgcugcccgca

SEQ ID NO: 362124 - RNA, 64 nt, Homo Sapiens
cugagaguucaagaccagcccugaggcaggaaggcugcuggaaacaguggcucacuuugggagg

SEQ ID NO: 362125 - RNA, 64 nt, Homo Sapiens
cucaggcuaacauccuggaguauaguuccuucugcugcuggauucaaauagaagccuuagaugc

SEQ ID NO: 362126 - RNA, 64 nt, Homo Sapiens
caaauugcgcccauuuagaggauguggcuguaaccugcuggaugggacuccauagcuccuuccc

SEQ ID NO: 362127 - RNA, 64 nt, Homo Sapiens
ugggccuuggcugggccucugguucugacacuuucugcuggaagcugucaggcugggacaggcu

SEQ ID NO: 362128 - RNA, 64 nt, Homo Sapiens
acugaccucacagacugaccauuccaucccacagcugcuggacauagagugauuugcagccccu

SEQ ID NO: 362129 - RNA, 64 nt, Homo Sapiens
ccucugugagugaccauccaggcagucaccauaacugcuggagugucugggauugguagcucuc

SEQ ID NO: 362130 - RNA, 64 nt, Homo Sapiens
uugggucccucggucucccucuucuccauugucccugcuggagacaccacgcgcucuacggagg

SEQ ID NO: 362131 - RNA, 64 nt, Homo Sapiens
ggccuuaggggugaagguggcugucguccacgcccugcuggaccgggccuccccuacaucgcug

SEQ ID NO: 362132 - RNA, 64 nt, Homo Sapiens
aagacagggacaaacaacucaagugucuuaacagcugcuggagugggauccuuguuaucucuua

SEQ ID NO: 362133 - RNA, 64 nt, Homo Sapiens
gauucuuguuuuaguaaucauucuauaaaugauacugcuggauugauugccguggguugauagc

SEQ ID NO: 362134 - RNA, 64 nt, Homo Sapiens
gugcuuguguuggcaacacagcgugugcauggggcugcuggaggagagcauuccagagcaguac

SEQ ID NO: 362135 - RNA, 64 nt, Homo Sapiens
gcagaaggguccgaugugccaagugaucaugauucugcuggaaagaggauuuuaaauauugugg

SEQ ID NO: 362136 - RNA, 64 nt, Homo Sapiens
cacgaucgagggccuggccucgcuguugguggcccugcuggagaagaccacgugggucgaccgu

SEQ ID NO: 362137 - RNA, 64 nt, Homo Sapiens
gccgcuggaggagaccgacuggucgcacucgcagcugcuggacuugggccccaucgacgcgcuc

SEQ ID NO: 362138 - RNA, 64 nt, Homo Sapiens
uguaaauaauuuaaaauccuuauggcagaugaaccugcuggauuugggacggaagccaagccau

SEQ ID NO: 362139 - RNA, 64 nt, Homo Sapiens
aggugaaagucgcuuugggagaacuaaaaaauugcugcuggagacagccucccaaaaggacaga

SEQ ID NO: 362140 - RNA, 64 nt, Homo Sapiens
gugggucucagucugcuugaauggugaugagauucugcuggaucucagcacgcugcaggugucu

SEQ ID NO: 362141 - RNA, 64 nt, Homo Sapiens
uuucagauucaguuagcaaaccuugaugaagcaccugcuggacacugagggacccaaagcucaa

SEQ ID NO: 362142 - RNA, 64 nt, Homo Sapiens
caccauaucagccugcgggaggaagccauggagucugcuggagguggggacccugcacccuccg

SEQ ID NO: 362143 - RNA, 64 nt, Homo Sapiens
gugaacuggggacccugcacagcugcugccacuccugcuggagggccacugcuagggguacccc

SEQ ID NO: 362144 - RNA, 64 nt, Homo Sapiens
cagacuggcauugcucggguaccacuugcuggagcugcuggaggcccugggguugguagggcag

SEQ ID NO: 362145 - RNA, 64 nt, Homo Sapiens
ggaguaccagcuggugugccaauuccccaggccccugcuggauuggcaggcccuguccgaggag

SEQ ID NO: 362146 - RNA, 64 nt, Homo Sapiens
ugguguugcagcuugugggcagaugaaggugaagcugcuggagcgcuggcucaggacaaggagg

SEQ ID NO: 362147 - RNA, 64 nt, Homo Sapiens
uugaguggaaagccgagccuagcaagaggagaggcugcuggagcgcaagaggagaggaugcugg

SEQ ID NO: 362148 - RNA, 64 nt, Homo Sapiens
caggacucugcccagaccacacguagcccccaggcugcuggacacgucggacagcgaaguaucc

SEQ ID NO: 362149 - RNA, 64 nt, Homo Sapiens
aagugggacuucccgucgccugcgagccugcggccugcuggagccugcgcagcuuggauggaga

SEQ ID NO: 362150 - RNA, 64 nt, Homo Sapiens
agaugcuacaaaaccucaugccuacugucugccacugcuggagaaggaaucaugguuucuagaa

SEQ ID NO: 362151 - RNA, 64 nt, Homo Sapiens
uugguggauccauguauguguccagcacagcggccugcuggacucugagaacugggaaagauca

SEQ ID NO: 362152 - RNA, 64 nt, Homo Sapiens
gcgagugggaaucagagccuugagcaaccucccacugcuggaguagggacggaaugccuggucu

SEQ ID NO: 362153 - RNA, 64 nt, Homo Sapiens
caucuuucccaagccuugccaaccccucagugggcugcuggaccguaggcucagaaaugaaggg

SEQ ID NO: 362154 - RNA, 64 nt, Homo Sapiens
cugcaccuacugaggaugucgcuggggaccuuggcugcuggaggaccugcuggggaccucaccu

SEQ ID NO: 362155 - RNA, 64 nt, Homo Sapiens
ccuuuguggccaacccucucgccuggggccucaccugcuggaguggcugccgggaaccucaucu

SEQ ID NO: 362156 - RNA, 64 nt, Homo Sapiens
ccagauucuggguccccaauccuggcaacugcagcugcuggauucaguggcacagcaaguggau

SEQ ID NO: 362157 - RNA, 64 nt, Homo Sapiens
cuggaugucaacaaaccucaaucuccaagcucagcugcuggauuccccaugccucgagcccugg

SEQ ID NO: 362158 - RNA, 64 nt, Homo Sapiens
cugauguggaaggcuucccugcccagccuggguucugcuggaaggaccaguuuuggccagaagg

SEQ ID NO: 362159 - RNA, 64 nt, Homo Sapiens
ccuuugccagaguuaaaucauugcauguucuaaacugcuggaggugugucuugcaggagcuccu

SEQ ID NO: 362160 - RNA, 64 nt, Homo Sapiens
gccagcugcccuaugggccugccgggcugagggccugcuggaggccucaggugcuguccauggg

SEQ ID NO: 362161 - RNA, 64 nt, Homo Sapiens
ucccagggcaaggguuaaggccugaaucaugagccugcuggaagcccagccccuacugcuguga

SEQ ID NO: 362162 - RNA, 64 nt, Homo Sapiens
accucugauucaaaacuuauuagaacaguagcuucugcuggaauuugcaaucacugaagucaua

SEQ ID NO: 362163 - RNA, 64 nt, Homo Sapiens
uuuauuuuguuugcugucugucuccccugccccacugcuggaacagaggcuccaagaaaacagg

SEQ ID NO: 362164 - RNA, 64 nt, Homo Sapiens
auuuuauuucacuuguguuuugucuuaaacccuacugcuggaaacaauuuuauguaauaagcaa

SEQ ID NO: 362165 - RNA, 64 nt, Homo Sapiens
ugccuaguugccugcaaagcuacauucucauguccugcuggaagaguuccgguaguggccaucu

SEQ ID NO: 362166 - RNA, 64 nt, Homo Sapiens
gcucagagcaagcugggcucaggcuuggccagcacugcuggaugcagcauuuggccaagcucgg

SEQ ID NO: 362167 - RNA, 64 nt, Homo Sapiens
uugcugaucuuuuccaaguuacauccgcaaagcccugcuggacacgcccagcgcuuuggaaacc

SEQ ID NO: 362168 - RNA, 64 nt, Homo Sapiens
uguacagccugaaggaugagucccugagaugaaccugcuggagaggaccugcccccaacuggcc

SEQ ID NO: 362169 - RNA, 64 nt, Homo Sapiens
cgcugaugaccucuucuucuguuaccgcuggcugcugcuggaacucaagcgugaguucgccuuc

SEQ ID NO: 362170 - RNA, 64 nt, Homo Sapiens
gaacccauucaugcuguuccucugccuggccauccugcuggagcaccgcgaccacaucaugcgc

SEQ ID NO: 362171 - RNA, 64 nt, Homo Sapiens
aagucccuccugauuuugugugugugugucuguguuuaagcaagcguucgguugguauaguuuu

SEQ ID NO: 362172 - RNA, 64 nt, Homo Sapiens
uaauauugcaguuggaauucuugcuguauuauuuuuuaagcaaguguuaggugcauuuaacugc

SEQ ID NO: 362173 - RNA, 64 nt, Homo Sapiens
ccauacaucaguuauucauucugugaucauuuauuuuaagcacucuuaaagcaaaaaaugaaug

SEQ ID NO: 362174 - RNA, 64 nt, Homo Sapiens
cuauuuaaacuuauaaaucauauugaugaaaagauuuaagcacaaacuuuaggguaaaaauugc

SEQ ID NO: 362175 - RNA, 64 nt, Homo Sapiens
caagauugguucugauucuuuuggaaaaugacaguuuaagcacuugguuccucaguuggauaac

SEQ ID NO: 362176 - RNA, 64 nt, Homo Sapiens
caaugaagaaaaggccuucuggagauuucuguuuuuuaagcacauucuccuuccauccacauau

SEQ ID NO: 362177 - RNA, 64 nt, Homo Sapiens
gauucugaugccacugaaguuugaggagcauugguuuaagcaagauuaccuacggagaggcugu

SEQ ID NO: 362178 - RNA, 64 nt, Homo Sapiens
uuuguaauccuaugcauuuuacgcauuaaaacauuuuaagcauuuaaaacguagguaucauuag

SEQ ID NO: 362179 - RNA, 64 nt, Homo Sapiens
uagcaaucagcuuuuauuugccuuaauauaagcuuuuaagcaguuaucuaacuaguguccacaa

SEQ ID NO: 362180 - RNA, 64 nt, Homo Sapiens
ugauuuuccuuuacauucuuaucaugaacacuauuuuaagcaucaaaugcaaucaucuaaaaua

SEQ ID NO: 362181 - RNA, 64 nt, Homo Sapiens
uuuuuacauuuauuuuagucuuuauauuuuuauuuuuaagcauugauguacuuaguuguugaaa

SEQ ID NO: 362182 - RNA, 64 nt, Homo Sapiens
aacaaugccaggauccaaacugauuaaguuacaguuuaagcacccuucaguauuaauauauacg

SEQ ID NO: 362183 - RNA, 64 nt, Homo Sapiens
ucaaaacaaaauaauacaaaaaaugcuuuuagaguuuaagcaaugguugaaauuuguagguacu

SEQ ID NO: 362184 - RNA, 64 nt, Homo Sapiens
gaaaggggcaaagagaaccuauuauuugccaguuuuuaagcagagcucaaucuaugccagcucu

SEQ ID NO: 362185 - RNA, 64 nt, Homo Sapiens
ugcuuccucagugucagggcuauuggaaagugauuuuaagcaaucaaaauauuuuaucagcugu

SEQ ID NO: 362186 - RNA, 64 nt, Homo Sapiens
gaaucuuggcaaugagugagagaaaacuaauauuuuuaagcagaugcuauuuuggcaacagcac

SEQ ID NO: 362187 - RNA, 64 nt, Homo Sapiens
ugcuucuguuuucccuaccuuacuuauucccauuuuuaagcauugucucuguguacagaauaca

SEQ ID NO: 362188 - RNA, 64 nt, Homo Sapiens
gauguucaaaaucuuacauaaaggaauuuaauauuuuaagcaaguaaccuuguaucucauuuug

SEQ ID NO: 362189 - RNA, 64 nt, Homo Sapiens
uagagcagcacuuuguuauguggaagacagguuuuuuaagcaaccuuugaauccagcucuaguc

SEQ ID NO: 362190 - RNA, 64 nt, Homo Sapiens
accacucagguaagaacacucacucauggcaguuuuuaagcaugaaaauuguuuucugaaagua

SEQ ID NO: 362191 - RNA, 64 nt, Homo Sapiens
uuuuccuuuuuuguuuuuuuuguuuuguuuuguuuuuaagcaaagaugaagggaaaacgaacua

SEQ ID NO: 362192 - RNA, 64 nt, Homo Sapiens
uagauugcaaacuggaaauguaaaacucaugaaauuuaagcaauauagguuuagcuaucugugu

SEQ ID NO: 362193 - RNA, 64 nt, Homo Sapiens
ucucauucugacuucauggagaauuaaucccaccuuuaagcaaaggcuacuaaguuaaugguau

SEQ ID NO: 362194 - RNA, 64 nt, Homo Sapiens
uaagcuccugaaucugcauuccacuuggguuguuuuuaagcauucuaaauuuuaguugauuaua

SEQ ID NO: 362195 - RNA, 64 nt, Homo Sapiens
agcgaaagcagagcauguuauuuauauaacugcauuuaagcaguaccaagacugaaaaaaaagg

SEQ ID NO: 362196 - RNA, 64 nt, Homo Sapiens
auuuuaaaaauauuuuuuaucuauuuacuguguguuuaagcaagcaacagugcacugaucuggu

SEQ ID NO: 362197 - RNA, 64 nt, Homo Sapiens
gcauucugaauggaacauuccggcucuucaauuuuuuaagcaauuuagacuguagcaagaaaau

SEQ ID NO: 362198 - RNA, 64 nt, Homo Sapiens
agagcacagucccugcuuuugacuggguuccuauuuuaagcacaaaugagagcucuggagccag

SEQ ID NO: 362199 - RNA, 64 nt, Homo Sapiens
aaaaagaagauggggaagaauuucuauguucuuuuuuaagcaccuuggcugcuagauccuggug

SEQ ID NO: 362200 - RNA, 64 nt, Homo Sapiens
uguaaaguuacagcaaaagauguaaaauuuuacauuuaagcauuaauauauaauuuuuuacaaa

SEQ ID NO: 362201 - RNA, 64 nt, Homo Sapiens
uuuaaaucaagguauuccaauuaaaacacuguuguuuaagcaugacauuguuuaaaacagaaug

SEQ ID NO: 362202 - RNA, 64 nt, Homo Sapiens
uuuuauaaugaauuaaauuaaaguuaagccaaaauuuaagcaguucaaagacuggauuaaaaaa

SEQ ID NO: 362203 - RNA, 64 nt, Homo Sapiens
aauaaaaugguugaggauguguuguauguccuuuuuuaagcagagagcccagaccucuacaaac

SEQ ID NO: 362204 - RNA, 64 nt, Homo Sapiens
ucagaugaaaagcaauuagguuuaaaaggauuccuuuaagcauguauucauuguuucuuaucag

SEQ ID NO: 362205 - RNA, 64 nt, Homo Sapiens
ugaguauauuuugaagucuucuuugcugucauaauuuaagcauuucucaacaccuuccuuaagu

SEQ ID NO: 362206 - RNA, 64 nt, Homo Sapiens
uuucucugcuaagacaagauaaacaaguugcauuuuuaagcacggagaaaaaccaaggaagaua

SEQ ID NO: 362207 - RNA, 64 nt, Homo Sapiens
auacuauguucaugauagugugauuuuuuucacauuuaagcaggaaugcaauauaaaaauguga

SEQ ID NO: 362208 - RNA, 64 nt, Homo Sapiens
cuuuauauauugauuauauauuguugacaacugguuuaagcaucauagccuaugaugauaaaca

SEQ ID NO: 362209 - RNA, 64 nt, Homo Sapiens
cucccugggguauccacaggaauggacauucaaaugguuguagccuggugggguagaaggcaga

SEQ ID NO: 362210 - RNA, 64 nt, Homo Sapiens
ucuauguaagguguuaauguguguguaugugcuuugguuguaggaaaacuugaaaauuccaaaa

SEQ ID NO: 362211 - RNA, 64 nt, Homo Sapiens
uaucagguaaaauauuuuccguguuuucuucuugugguuguauauugacuaaagccauuugucu

SEQ ID NO: 362212 - RNA, 64 nt, Homo Sapiens
agcccacuguaacaauacuguauagguugucuugugguuguaggucagcucacugguuuacaaa

SEQ ID NO: 362213 - RNA, 64 nt, Homo Sapiens
aauuguguggagaacucagugccacaccucgaacugguuguagugggaagucccgcgaaacccg

SEQ ID NO: 362214 - RNA, 64 nt, Homo Sapiens
uuuugcucuagggcccuuucuugcacuguccagcugguuguacccucuccaggcauuuauucaa

SEQ ID NO: 362215 - RNA, 64 nt, Homo Sapiens
gaacacugacuuuauuaagcauuuucagauguggugguuguauuuuugccccaagaaguguuug

SEQ ID NO: 362216 - RNA, 64 nt, Homo Sapiens
ugaauaugugaaacagcuggaauuguacaaauuuugguuguauuuaaagcucaguuuccuuuuu

SEQ ID NO: 362217 - RNA, 64 nt, Homo Sapiens
ggcuauuugaaacuucaccuacuuuucauuagauugguuguaccaugucaccuuagcuuuuaaa

SEQ ID NO: 362218 - RNA, 64 nt, Homo Sapiens
cugaacaacaaaugaauaacgaugaaugucuuuuugguuguaauuuaacaagucaaauaaaaua

SEQ ID NO: 362219 - RNA, 64 nt, Homo Sapiens; identical to SEQ ID NO: 312019

SEQ ID NO: 362220 - RNA, 64 nt, Homo Sapiens; identical to SEQ ID NO: 312020

SEQ ID NO: 362221 - RNA, 64 nt, Homo Sapiens; identical to SEQ ID NO: 312021

SEQ ID NO: 362222 - RNA, 64 nt, Homo Sapiens; identical to SEQ ID NO: 312022

SEQ ID NO: 362223 - RNA, 64 nt, Homo Sapiens; identical to SEQ ID NO: 312023

SEQ ID NO: 362224 - RNA, 64 nt, Homo Sapiens; identical to SEQ ID NO: 312024

SEQ ID NO: 362225 - RNA, 64 nt, Homo Sapiens; identical to SEQ ID NO: 312025

SEQ ID NO: 362226 - RNA, 64 nt, Homo Sapiens; identical to SEQ ID NO: 312026

SEQ ID NO: 362227 - RNA, 64 nt, Homo Sapiens; identical to SEQ ID NO: 312027

SEQ ID NO: 362228 - RNA, 64 nt, Homo Sapiens; identical to SEQ ID NO: 312028

SEQ ID NO: 362229 - RNA, 64 nt, Homo Sapiens; identical to SEQ ID NO: 312029

SEQ ID NO: 362230 - RNA, 64 nt, Homo Sapiens; identical to SEQ ID NO: 312030

SEQ ID NO: 362231 - RNA, 64 nt, Homo Sapiens; identical to SEQ ID NO: 312031

SEQ ID NO: 362232 - RNA, 64 nt, Homo Sapiens; identical to SEQ ID NO: 312032

SEQ ID NO: 362233 - RNA, 64 nt, Homo Sapiens; identical to SEQ ID NO: 312033

SEQ ID NO: 362234 - RNA, 64 nt, Homo Sapiens; identical to SEQ ID NO: 312034

SEQ ID NO: 362235 - RNA, 64 nt, Homo Sapiens; identical to SEQ ID NO: 312035

SEQ ID NO: 362236 - RNA, 64 nt, Homo Sapiens; identical to SEQ ID NO: 312036

SEQ ID NO: 362237 - RNA, 64 nt, Homo Sapiens
uuuaugauaauagauucucuuguauaagauccuagauccuaagggucgaaagcucuagaaucug

SEQ ID NO: 362238 - RNA, 64 nt, Homo Sapiens
aaggcacucuagauuccauugguccaagauuccggauccuaagcaucuaaguuauaagacucuc

SEQ ID NO: 362239 - RNA, 64 nt, Homo Sapiens; identical to SEQ ID NO: 96876

SEQ ID NO: 362240 - RNA, 64 nt, Homo Sapiens; identical to SEQ ID NO: 96877

SEQ ID NO: 362241 - RNA, 64 nt, Homo Sapiens; identical to SEQ ID NO: 96878

SEQ ID NO: 362242 - RNA, 64 nt, Homo Sapiens; identical to SEQ ID NO: 96879

SEQ ID NO: 362243 - RNA, 64 nt, Homo Sapiens; identical to SEQ ID NO: 96880

SEQ ID NO: 362244 - RNA, 51 nt, Homo Sapiens; identical to SEQ ID NO: 96881

SEQ ID NO: 362245 - RNA, 64 nt, Homo Sapiens; identical to SEQ ID NO: 96882

SEQ ID NO: 362246 - RNA, 64 nt, Homo Sapiens; identical to SEQ ID NO: 96883

SEQ ID NO: 362247 - RNA, 64 nt, Homo Sapiens; identical to SEQ ID NO: 96884

SEQ ID NO: 362248 - RNA, 64 nt, Homo Sapiens; identical to SEQ ID NO: 96885

SEQ ID NO: 362249 - RNA, 64 nt, Homo Sapiens; identical to SEQ ID NO: 96886

SEQ ID NO: 362250 - RNA, 64 nt, Homo Sapiens; identical to SEQ ID NO: 96887

SEQ ID NO: 362251 - RNA, 64 nt, Homo Sapiens; identical to SEQ ID NO: 96888

SEQ ID NO: 362252 - RNA, 64 nt, Homo Sapiens
gcauucguggucugugcaaacacuucgugguucuauauaucagcagcaagugugcaaaauaaag

SEQ ID NO: 362253 - RNA, 64 nt, Homo Sapiens
acuguaaccuaaauguauuacuucugauaaaacuauauaucaaaugucacugcaaauuaguuuu

SEQ ID NO: 362254 - RNA, 64 nt, Homo Sapiens
auaaaaacaagguauauacuagcugugugacaagauauaucaauacauauaucaugugcauuca

SEQ ID NO: 362255 - RNA, 64 nt, Homo Sapiens
ugcauucaagcugugugacaauuuuauuauguacauauaucauggcaguaaaugcauugauguc

SEQ ID NO: 362256 - RNA, 64 nt, Homo Sapiens
ucauuuaauuccucauagaaucccagucaccuuuauauaucauauuauuggaagagauucaucu

SEQ ID NO: 362257 - RNA, 64 nt, Homo Sapiens
uuuauucacucuucauagaaucacaauuaccuuuauauaucauauguuauuggaagagauuccu

SEQ ID NO: 362258 - RNA, 64 nt, Homo Sapiens
uauuagcaucauaauucuuuguuauguaaguuaaauauaucaagaaagaagagacuguuuggaa

SEQ ID NO: 362259 - RNA, 64 nt, Homo Sapiens
aauagaauuagggagaguuuacacuuacuuaccuauauaucagcagauuuuucuggaagaaacc

SEQ ID NO: 362260 - RNA, 64 nt, Homo Sapiens
gucuuacauaaugccaccaguccauccaaaaccuauauaucaccuauacuauauauaucauaua

SEQ ID NO: 362261 - RNA, 64 nt, Homo Sapiens
aguccauccaaaaccuauauaucaccuauacuauauauaucauauauauaguugaauggcagua

SEQ ID NO: 362262 - RNA, 64 nt, Homo Sapiens
guuuauccauucuacuauuaauuucauuguaugaauauaucacaucuuuuuauuaccaaguacu

SEQ ID NO: 362263 - RNA, 64 nt, Homo Sapiens
uaugcaaaggccuaaacugauugcuuuugucuuaauauaucagauacacugcaaauauuuguuu

SEQ ID NO: 362264 - RNA, 64 nt, Homo Sapiens
uauauuuuaagcuuauuucuucaaaauuauuuucauauaucacagauauaucauuggaagauau

SEQ ID NO: 362265 - RNA, 64 nt, Homo Sapiens
cuuauuucuucaaaauuauuuucauauaucacagauauaucauuggaagauauaauuugcauau

SEQ ID NO: 362266 - RNA, 64 nt, Homo Sapiens
aacccuaugaagaauuccucuggaacuugcaggcauauaucaaguuaacuuuuguuaucauaaa

SEQ ID NO: 362267 - RNA, 64 nt, Homo Sapiens
ucuauaagcaggauuugagucaguauaaauguaaauauaucagucacuaaaaacucugaaacuu

SEQ ID NO: 362268 - RNA, 64 nt, Homo Sapiens
guguuccugaaucaugguuuguacacaaagagauauauaucacuccucacaggcacccacaaau

SEQ ID NO: 362269 - RNA, 64 nt, Homo Sapiens
uacuuauuuaaagcugcugucacucuauuauuagauauaucaugcaaagcaaguagagaagaca

SEQ ID NO: 362270 - RNA, 64 nt, Homo Sapiens
ucucaacauuguugguuucuacuuuuuguguaaaauauaucagaauauuuuaaauuguuuuuga

SEQ ID NO: 362271 - RNA, 64 nt, Homo Sapiens
uaacauccugacaauaaauuugaaagcagcaugaauauaucaccauuuauaggguuuagauuuc

SEQ ID NO: 362272 - RNA, 64 nt, Homo Sapiens
ggguagugcccaagccuggucguguugccaggaguggugacaagaaaugcagcuuacaucaaac

SEQ ID NO: 362273 - RNA, 64 nt, Homo Sapiens
uuguuucuacaaaucucucucaaauguauuauuuuggugacaaaaaugaaggagcuuuguaaau

SEQ ID NO: 362274 - RNA, 64 nt, Homo Sapiens
ugugucuacaaaaaauuuaaaaauuagccaaguauggugacaggcaccuaugguuccagcuacu

SEQ ID NO: 362275 - RNA, 64 nt, Homo Sapiens
caaggucaagagauuaagaucauccuggccaacauggugacaccccgucucuacuaaaaauaca

SEQ ID NO: 362276 - RNA, 64 nt, Homo Sapiens
cuauaugccauggaugugaauuucccauagaagcuggugacauguuccuggaagcucugggcua

SEQ ID NO: 362277 - RNA, 64 nt, Homo Sapiens
cagugagcugagaucacaccacugcacuccagccuggugacagagcaagacuccggcucuuaaa

SEQ ID NO: 362278 - RNA, 64 nt, Homo Sapiens
ggagucuugcucugucgcccaggcuggaacgcaguggugacaucucggcucacugcaaccucca

SEQ ID NO: 362279 - RNA, 64 nt, Homo Sapiens
uaagacaguuucugcccaaagucauguuaccaguuggugacagagcuggaaauacguagagauc

SEQ ID NO: 362280 - RNA, 64 nt, Homo Sapiens
ccccugcccuucgcuucuguucccaacggcaugcuggugacaccgccgccuccgcaucugacug

SEQ ID NO: 362281 - RNA, 64 nt, Homo Sapiens
cugugcgcagcagccccaggcagcuuuccccaccuggugacaggccagcccaguuacugcaggg

SEQ ID NO: 362282 - RNA, 64 nt, Homo Sapiens
aagaaacaaccauaugguguuguauauuauaaacuggugacauucuacuauugaauuauguaca

SEQ ID NO: 362283 - RNA, 64 nt, Homo Sapiens
aauuuacugaauuaaaggauuaaauuaggugacauggugacaucuaucccuuuauuuugacacu

SEQ ID NO: 362284 - RNA, 64 nt, Homo Sapiens
cagugagccgagaucacgccacugcacuccagccuggugacagcgugagacucuuuaaaaaaag

SEQ ID NO: 362285 - RNA, 64 nt, Homo Sapiens
caucugagaacccacucucugccggagaaccccauggugacacauuuucaucuuucugaccaga

SEQ ID NO: 362286 - RNA, 64 nt, Homo Sapiens
gccuacugggcauccggccugugcugggcauggguggugacauuggcagaaauggccacuggaa

SEQ ID NO: 362287 - RNA, 64 nt, Homo Sapiens
caucuguggugaaccaagugaagguggugacuucuggugacauaguaauaaagugaagacucag

SEQ ID NO: 362288 - RNA, 64 nt, Homo Sapiens
cagugagcuaagacugcaccacugcacuccagccuggugacagaacgagacucugucuuaaaaa

SEQ ID NO: 362289 - RNA, 64 nt, Homo Sapiens
uuuuaaagauaugauguuuuauuguuuuaacucuuggugacaguagaugcucucuggagcgcag

SEQ ID NO: 362290 - RNA, 64 nt, Homo Sapiens
gggaaggcgcucccucaucugggccaaaggaaggaggacgaagcccuccucagcuggccugugu

SEQ ID NO: 362291 - RNA, 64 nt, Homo Sapiens
ccagcacagagccaccggaacaucaagauccuagaggacgaaccccacaguaaggaugagaccc

SEQ ID NO: 362292 - RNA, 64 nt, Homo Sapiens
ccccaucuuucguugccauucuucauuccuacaaaggacgaacuuggauuacaucaacuuugga

SEQ ID NO: 362293 - RNA, 64 nt, Homo Sapiens
ggaggaggaugaggaggacagaaggaccuugcagaggacgaagaacccaacagacaagauggaa

SEQ ID NO: 362294 - RNA, 64 nt, Homo Sapiens
gaggagaguucuccauccccauuccccgggagagaggacgaagcaacgcagugcgggguuaggg

SEQ ID NO: 362295 - RNA, 64 nt, Homo Sapiens
gaaaagcauuuggaaguuuacacaaagcugcagaaggacgaaaucaucuuccagcucagcucca

SEQ ID NO: 362296 - RNA, 64 nt, Homo Sapiens
ugcacagugauauauuucuacaguuauaaagucaaggacgaauuguauaauuugaggugaaauu

SEQ ID NO: 362297 - RNA, 64 nt, Homo Sapiens
caguccagcaugguuuugaucaaccagcucuuccaggacgaacuugcuuuccuuguggcccugc

SEQ ID NO: 362298 - RNA, 64 nt, Homo Sapiens
gcacccuaccuguggguguuggggguaucaaagaaggacgaauaccggaggagggcgcagggug

SEQ ID NO: 362299 - RNA, 64 nt, Homo Sapiens
aagauggauuuaaaccaagaugccuccaggaaagaggacgaaaugaguauauucacagaggaau

SEQ ID NO: 362300 - RNA, 64 nt, Homo Sapiens
augaggaugagucccaagaagguucuuuggaaggaggacgaauagaauggaguaaugaaauucu

SEQ ID NO: 362301 - RNA, 64 nt, Homo Sapiens
gagacaucugggugccaggggcucugugucagccaggacgaagggaagagcagaugaccaccau

SEQ ID NO: 362302 - RNA, 64 nt, Homo Sapiens
uuuccagguguggccucuggaaccugacuccguuaggacgaacaucugccccuucagggagggu

SEQ ID NO: 362303 - RNA, 64 nt, Homo Sapiens
aaaaugauccuuaugauguccaacaaggaaauagaggacgaaggccuguguguugccaggcagg

SEQ ID NO: 362304 - RNA, 64 nt, Homo Sapiens
ucauguaggacgcggcauccugccccugguagagaggacgaauguuccacaccauggucucuac

SEQ ID NO: 362305 - RNA, 64 nt, Homo Sapiens
accucgcccacccuggcaaggacagcugcggccaaggacgaaagcccucccuuggcuggccuca

SEQ ID NO: 362306 - RNA, 64 nt, Homo Sapiens
ccuuuaaauguucgucuauacccuaaguaaaaugaggacgaaagacaaauauuuugaaagccua

SEQ ID NO: 362307 - RNA, 64 nt, Homo Sapiens
auuuuaugugcuaaugcaugcuguaaagaugucuaggacgaaauguucauauuugccaagucuu

SEQ ID NO: 362308 - RNA, 64 nt, Homo Sapiens
aguguaagucccgcugauucacaagguagagaaaaggacgaagaguuuuucuuuuaagggggaa

SEQ ID NO: 362309 - RNA, 64 nt, Homo Sapiens
aacccuccaauuuucccaaaaauaaaaaaaacuaaggacgaaaaaaaaccauauccuguaauuu

SEQ ID NO: 362310 - RNA, 64 nt, Homo Sapiens
acuguccugagucauaaguaaguggguccccgugaggacgaacuggguuggugaaaaguuggcc

SEQ ID NO: 362311 - RNA, 64 nt, Homo Sapiens
ggguucuagggcugaaccaggcgccaggcuccagaggacgaagggacucuguugccccacacua

SEQ ID NO: 362312 - RNA, 64 nt, Homo Sapiens
ugcagacaacggagggcagcgcccccccgagaucaggacgaaggaccaccgucgguccucagca

SEQ ID NO: 362313 - RNA, 64 nt, Homo Sapiens
ggauugugaucacacauucccgaaguaauaagugaggacgaaugcacugcucuggaacauaacc

SEQ ID NO: 362314 - RNA, 64 nt, Homo Sapiens
uuuaccauauguugugucuaaucuccuucugagaaggacgaaaaacuuucuuccaagugaagau

SEQ ID NO: 362315 - RNA, 64 nt, Homo Sapiens
aaagcauggagaguggcaucuucuuugcauccuaaggacgaaaaacacagugcacucagagcug

SEQ ID NO: 362316 - RNA, 64 nt, Homo Sapiens
uguugguggugguggugguguuagcucuucucugaggacgaagcuuuuugguuuuguuuuuaau

SEQ ID NO: 362317 - RNA, 64 nt, Homo Sapiens
guuagggucucuaauugcaaagugacuguacaauaggacgaaaguugccucugugucugagaaa

SEQ ID NO: 362318 - RNA, 64 nt, Homo Sapiens
cucucuucugccugauagagggaagaggaagaggaggacgaacagagauccugaaauucugacu

SEQ ID NO: 362319 - RNA, 52 nt, Homo Sapiens
uugggaucauugcccugugaggaggacgaacauccaaccuucccaaacgccu

SEQ ID NO: 362320 - RNA, 64 nt, Homo Sapiens
ggcugugacucucucucuaaugcugcucucgggaaggacgaaagugaccugcaaggagagaaau

SEQ ID NO: 362321 - RNA, 64 nt, Homo Sapiens
ggugggacuuugcgagcucugaggcagggaucagaggacgaacacugggacuccugagauggga

SEQ ID NO: 362322 - RNA, 64 nt, Homo Sapiens
acaaagauggucugagaaaaaaagugaauuuauaaggacgaaucaaauuaccccgauuuaggac

SEQ ID NO: 362323 - RNA, 64 nt, Homo Sapiens
cggcuguuuuugaacacggggucauucugcagucaggacgaaccgguccccgucgcagacggag

SEQ ID NO: 362324 - RNA, 64 nt, Homo Sapiens
gaagaugcuguuucuccggcagaaccaacccuccaggacgaaguuucagaauuggcugaugguc

SEQ ID NO: 362325 - RNA, 64 nt, Homo Sapiens
ucaaaagguucuugaacaccacugugauucuccaaggacgaauuacguaaauuauacuuucaua

SEQ ID NO: 362326 - RNA, 64 nt, Homo Sapiens
gacacucuccuucagggaaaauguuauguggaggaggacgaauaaauuuauuuuguuuuccugu

SEQ ID NO: 362327 - RNA, 64 nt, Homo Sapiens
agacacagagauggagaagcagggacaugcugagaggacgaagccaaggaaauuagggaggaga

SEQ ID NO: 362328 - RNA, 64 nt, Homo Sapiens
ugagaaggaaaacgccaaauuccauguagcaaccaggacgaaguuuuucuuuucuaaaugaaac

SEQ ID NO: 362329 - RNA, 64 nt, Homo Sapiens
cuccagugaccuggaccuggaagugucccccuugaggacgaagcccccugacccaggaggcugg

SEQ ID NO: 362330 - RNA, 64 nt, Homo Sapiens
agccaugacuuuuagauaugagaugacgggaagcaggacgaaauaucggcguguggcuggagcc

SEQ ID NO: 362331 - RNA, 64 nt, Homo Sapiens
auuucucacagacccuucagcaauggcuacuagaaggacgaacaauugcccuccuuuggaagua

SEQ ID NO: 362332 - RNA, 64 nt, Homo Sapiens
agaggcauacacacagcaguccagagccccaagcaggacgaaaacuccucagagcgccaggaag

SEQ ID NO: 362333 - RNA, 64 nt, Homo Sapiens
cauaauuugucauaaccacugcugaguggccuugaggacgaaccccgcagggagcaagcaguac

SEQ ID NO: 362334 - RNA, 64 nt, Homo Sapiens
cauauucaacacacugccuugugguucauuccacaggacgaaugguaucauguaucucucugug

SEQ ID NO: 362335 - RNA, 64 nt, Homo Sapiens
cccauccaagggcaagacuuggugcccagcuggaaggacgaaagcacacuuugugaccgccauc

SEQ ID NO: 362336 - RNA, 63 nt, Homo Sapiens
gcuucuuacauauucuagauuaugacugauucaaggacgaauaaggauuggccggcaggguga

SEQ ID NO: 362337 - RNA, 64 nt, Homo Sapiens
ucaaucccacgcuguuuccuuucaaaguucugggaggacgaacucaccgaggcgagaaguguaa

SEQ ID NO: 362338 - RNA, 64 nt, Homo Sapiens
uguagcugugugucuugggccaccaguggccugcaggacgaagguacuguuccaucaccugcgg

SEQ ID NO: 362339 - RNA, 64 nt, Homo Sapiens
cugagacugcuaaguaggggcagugaugguugccaggacgaauugagauaauaucugugaggug

SEQ ID NO: 362340 - RNA, 64 nt, Homo Sapiens
cugaauucaauucccacguagacucuuauuuuauaggacgaaugccaaauugcagcuucugggg

SEQ ID NO: 362341 - RNA, 64 nt, Homo Sapiens
cuucugaguuacagcucaggaauacauuguuugcaggacgaaaaagcuaauaaacacauuugua

SEQ ID NO: 362342 - RNA, 64 nt, Homo Sapiens
gaguuuaauuacucauugcguggaaaucuuccggaggacgaauauacauaacguucaguuggga

SEQ ID NO: 362343 - RNA, 64 nt, Homo Sapiens
cugaggguacgaugaggccugggcucagugagccaggacgaaugugacagacaccccuugcugc

SEQ ID NO: 362344 - RNA, 64 nt, Homo Sapiens
gccuuugggugggcagggcagcagagggcagaagaggacgaaaugaugcagagagcccacccgu

SEQ ID NO: 362345 - RNA, 64 nt, Homo Sapiens
uuuucuauuguuuccaggccccaggauaugcuaaaggacgaagauccaacucuuguuuucuagu

SEQ ID NO: 362346 - RNA, 64 nt, Homo Sapiens
aagcuguacauuguugcuugaucucuuagcauggaggacgaagauuugacccuuaagcuuuuac

SEQ ID NO: 362347 - RNA, 64 nt, Homo Sapiens
cuguuguggcgucuucugggguccugacggcagcaggacgaagcugcuuuuccaagccgccagg

SEQ ID NO: 362348 - RNA, 64 nt, Homo Sapiens
gucgauguuucuuagcagagugcuuggaggcugcaggacgaacuucugauggcugagguuagug

SEQ ID NO: 362349 - RNA, 64 nt, Homo Sapiens
aaaccaggacaggccaucugcagugacccagcccaggacgaaguuuacaaacaccuccuggaac

SEQ ID NO: 362350 - RNA, 64 nt, Homo Sapiens
cuugcaucugacuugccacuagcacaggaagcucaggacgaaggcagcguuaggagaauaguug

SEQ ID NO: 362351 - RNA, 64 nt, Homo Sapiens
acccagggucaaccugccuaccacaggcacuagaaggacgaaucugccuacugcccaugaacgg

SEQ ID NO: 362352 - RNA, 64 nt, Homo Sapiens
ccuccagcaagcucgcaagugcuggugcagcguaaggacgaacugcugaugagagacagcgcau

SEQ ID NO: 362353 - RNA, 64 nt, Homo Sapiens
cuacaggggcaagggccgcuaugacgggaaccuaaggacgaagcaaacccuucugauuaccuuc

SEQ ID NO: 362354 - RNA, 64 nt, Homo Sapiens
cugacuccuucacgucaggcucagguuccaugggaggacgaagcaguggacgcauugugggcuu

SEQ ID NO: 362355 - RNA, 64 nt, Homo Sapiens
uugggggugggugggcagaggacgggguaaugugaggacgaagcgggcacggagccagauggcc

SEQ ID NO: 362356 - RNA, 64 nt, Homo Sapiens
ugucuuaaauuuacgaugaauuucuugugagcagaggacgaaacaggugaauucucaccagacu

SEQ ID NO: 362357 - RNA, 64 nt, Homo Sapiens
ggucaagaaccuugcagaaaaguuucacccccagaggacgaagaucgcaggcagccucucagaa

SEQ ID NO: 362358 - RNA, 64 nt, Homo Sapiens
gaguggaucacugaaguccaccuggcacuuugggaggacgaagcugguggcucacgccuguaau

SEQ ID NO: 362359 - RNA, 52 nt, Homo Sapiens
agcugcaaacccucaucugaagaggacgaaugaggaggaccacuguggugca

SEQ ID NO: 362360 - RNA, 56 nt, Homo Sapiens
cagacguggaugaagaauagcucugcaggacgaaugccuuaguuuccacuuuccag

SEQ ID NO: 362361 - RNA, 64 nt, Homo Sapiens
ccagcccugcuucucaguguggggcaggugucucaggacgaaggcgccgcgugaccacaugggc

SEQ ID NO: 362362 - RNA, 64 nt, Homo Sapiens
cauggggacaauuuggauuugaacauaaugucaaaggacgaaauaagacuaagauaaccaagau

SEQ ID NO: 362363 - RNA, 64 nt, Homo Sapiens
aggaagcaugccguggauccccuacuggcugcagaggacgaagcaguccuggccacaggagucc

SEQ ID NO: 362364 - RNA, 64 nt, Homo Sapiens
ugagagaacuccaucaauccaguccaagaggaggaggacgaaggccuagacucagcugaaggau

SEQ ID NO: 362365 - RNA, 64 nt, Homo Sapiens
auccucacaggaggaugaagaguccaagaggaggaggacgaaggugagagaacuccaucaaucc

SEQ ID NO: 362366 - RNA, 64 nt, Homo Sapiens; identical to SEQ ID NO: 198310

SEQ ID NO: 362367 - RNA, 64 nt, Homo Sapiens; identical to SEQ ID NO: 198311

SEQ ID NO: 362368 - RNA, 64 nt, Homo Sapiens; identical to SEQ ID NO: 198312

SEQ ID NO: 362369 - RNA, 64 nt, Homo Sapiens; identical to SEQ ID NO: 198313

SEQ ID NO: 362370 - RNA, 64 nt, Homo Sapiens; identical to SEQ ID NO: 198314

SEQ ID NO: 362371 - RNA, 64 nt, Homo Sapiens; identical to SEQ ID NO: 198315

SEQ ID NO: 362372 - RNA, 64 nt, Homo Sapiens; identical to SEQ ID NO: 198316

SEQ ID NO: 362373 - RNA, 64 nt, Homo Sapiens; identical to SEQ ID NO: 198317

SEQ ID NO: 362374 - RNA, 64 nt, Homo Sapiens; identical to SEQ ID NO: 198318

SEQ ID NO: 362375 - RNA, 64 nt, Homo Sapiens; identical to SEQ ID NO: 198319

SEQ ID NO: 362376 - RNA, 64 nt, Homo Sapiens; identical to SEQ ID NO: 198320

SEQ ID NO: 362377 - RNA, 64 nt, Homo Sapiens; identical to SEQ ID NO: 198321

SEQ ID NO: 362378 - RNA, 64 nt, Homo Sapiens; identical to SEQ ID NO: 198322

SEQ ID NO: 362379 - RNA, 64 nt, Homo Sapiens; identical to SEQ ID NO: 198323

SEQ ID NO: 362380 - RNA, 64 nt, Homo Sapiens; identical to SEQ ID NO: 198324

SEQ ID NO: 362381 - RNA, 64 nt, Homo Sapiens; identical to SEQ ID NO: 198325

SEQ ID NO: 362382 - RNA, 64 nt, Homo Sapiens; identical to SEQ ID NO: 198326

SEQ ID NO: 362383 - RNA, 64 nt, Homo Sapiens; identical to SEQ ID NO: 198327

SEQ ID NO: 362384 - RNA, 64 nt, Homo Sapiens; identical to SEQ ID NO: 198328

SEQ ID NO: 362385 - RNA, 64 nt, Homo Sapiens; identical to SEQ ID NO: 198329

SEQ ID NO: 362386 - RNA, 64 nt, Homo Sapiens; identical to SEQ ID NO: 198330

SEQ ID NO: 362387 - RNA, 64 nt, Homo Sapiens; identical to SEQ ID NO: 198331

SEQ ID NO: 362388 - RNA, 64 nt, Homo Sapiens; identical to SEQ ID NO: 300837

SEQ ID NO: 362389 - RNA, 64 nt, Homo Sapiens; identical to SEQ ID NO: 300838

SEQ ID NO: 362390 - RNA, 64 nt, Homo Sapiens; identical to SEQ ID NO: 300839

SEQ ID NO: 362391 - RNA, 64 nt, Homo Sapiens; identical to SEQ ID NO: 300840

SEQ ID NO: 362392 - RNA, 64 nt, Homo Sapiens; identical to SEQ ID NO: 300841

SEQ ID NO: 362393 - RNA, 64 nt, Homo Sapiens; identical to SEQ ID NO: 300842

SEQ ID NO: 362394 - RNA, 64 nt, Homo Sapiens; identical to SEQ ID NO: 300843

SEQ ID NO: 362395 - RNA, 64 nt, Homo Sapiens; identical to SEQ ID NO: 300844

SEQ ID NO: 362396 - RNA, 64 nt, Homo Sapiens; identical to SEQ ID NO: 300845

SEQ ID NO: 362397 - RNA, 64 nt, Homo Sapiens; identical to SEQ ID NO: 300846

SEQ ID NO: 362398 - RNA, 64 nt, Homo Sapiens; identical to SEQ ID NO: 300847

SEQ ID NO: 362399 - RNA, 64 nt, Homo Sapiens; identical to SEQ ID NO: 300848

SEQ ID NO: 362400 - RNA, 64 nt, Homo Sapiens; identical to SEQ ID NO: 300849

SEQ ID NO: 362401 - RNA, 64 nt, Homo Sapiens; identical to SEQ ID NO: 300850

SEQ ID NO: 362402 - RNA, 64 nt, Homo Sapiens; identical to SEQ ID NO: 300851

SEQ ID NO: 362403 - RNA, 64 nt, Homo Sapiens; identical to SEQ ID NO: 300852

SEQ ID NO: 362404 - RNA, 64 nt, Homo Sapiens; identical to SEQ ID NO: 300853

SEQ ID NO: 362405 - RNA, 64 nt, Homo Sapiens; identical to SEQ ID NO: 300854

SEQ ID NO: 362406 - RNA, 64 nt, Homo Sapiens
agucuacuuaaauucacuugccugccucuucuauuguucugauucagagacgguaucuccuccu

SEQ ID NO: 362407 - RNA, 64 nt, Homo Sapiens
auauugaaaagagguucacuuuguuuguuauuguuguucugaccgucucaaaaauuaaagaauu

SEQ ID NO: 362408 - RNA, 64 nt, Homo Sapiens
aaguuaucaaguuaaagcaacuuucacugggagcuguucugacauaauaugcuguuucauaguu

SEQ ID NO: 362409 - RNA, 64 nt, Homo Sapiens
uaagccaugaaguauuuuugcuaguugucaaagguguucugagagucaugcuaaagccaagaca

SEQ ID NO: 362410 - RNA, 64 nt, Homo Sapiens
gcaaaauauuguauaugauauuuacauagcuuaguguucugauguugaguagacagcaaugauc

SEQ ID NO: 362411 - RNA, 64 nt, Homo Sapiens
ucucuacacauuucauccuuuuauuugccucgcuuguucugaaacagccucucgcaccauguga

SEQ ID NO: 362412 - RNA, 64 nt, Homo Sapiens
ugcaacuugacugggaagccuuaaaacacagagguguucugaccuccuucaaaaaaauuauuuu

SEQ ID NO: 362413 - RNA, 64 nt, Homo Sapiens
guuuugaacuggagcaugcauguuguugugguguuguucugauucugucugugauucuuuuguu

SEQ ID NO: 362414 - RNA, 64 nt, Homo Sapiens
ccacccgcacccguccccuagagccauaguacuguguucugaaagccauuuagaauuucuuugu

SEQ ID NO: 362415 - RNA, 64 nt, Homo Sapiens
cccuccuaaaauaugacuuaacuuuuaagagaaauguucugacacccaccuaaacacacaaggc

SEQ ID NO: 362416 - RNA, 64 nt, Homo Sapiens
cugaacuauuugguaauaaaggaauuagaauucuuguucugaugaauguaaaggaaacccuuuu

SEQ ID NO: 362417 - RNA, 64 nt, Homo Sapiens
agaugugacuaaggucaagguagaaagcauugaauguucugaucgccuaaacccagaguuuaug

SEQ ID NO: 362418 - RNA, 64 nt, Homo Sapiens
uuuaacaauaacuacuguguuccuggcaauaguguguucugauuagaaaugaccaauauuauac

SEQ ID NO: 362419 - RNA, 64 nt, Homo Sapiens
uguuacugaucaugcauuguugagguggucugaauguucugacauuaacaguuuuccaugaaaa

SEQ ID NO: 362420 - RNA, 64 nt, Homo Sapiens
guaaaaaaugaaggggauaauauaugauaaauuauguucugauauccuccuacaguaguuuaaa

SEQ ID NO: 362421 - RNA, 64 nt, Homo Sapiens
ugagaaacaacacauuuuuccccaugaacggugcuguucugaagucuucaaauuuuucccucua

SEQ ID NO: 362422 - RNA, 64 nt, Homo Sapiens
gccuggugguauauugggcauucuuuggauugaguguucugaggugagagagucuucccgaggc

SEQ ID NO: 362423 - RNA, 64 nt, Homo Sapiens
ccagcauauuuccccuucuacccuuuuacuuuguuguucugauuuuaggacucuggcuggccau

SEQ ID NO: 362424 - RNA, 64 nt, Homo Sapiens
agccugaggcacagcugccuguauuguccucaucuguucugacugaaggauggaggugcugaau

SEQ ID NO: 362425 - RNA, 64 nt, Homo Sapiens
ugccuucuuaaaccgaguuuacuccauuucagccuguucugaauuggugacucugucaccaaua

SEQ ID NO: 362426 - RNA, 64 nt, Homo Sapiens
uggcuuagaauguaaaauugauuguuaaaaguuuuguucugaauaaauauuuaucuuuuguauu

SEQ ID NO: 362427 - RNA, 64 nt, Homo Sapiens
ucccagacucugggcugucauacaaucaaggccacugcuacaucccugcccugugaauuacugc

SEQ ID NO: 362428 - RNA, 64 nt, Homo Sapiens
caaggccacugcuacaucucugcccugugaauuacugcuacaauuccugugucagaaccagucc

SEQ ID NO: 362429 - RNA, 64 nt, Homo Sapiens
cccccagaucccacugggguccauuugggggguccugcuacacuccaccgauccccaaggaagu

SEQ ID NO: 362430 - RNA, 64 nt, Homo Sapiens
gaccagaccguuugccuuuucaaguuuccuaguccugcuacaagaugagcuucuuccgugguuu

SEQ ID NO: 362431 - RNA, 64 nt, Homo Sapiens
aagacuggaaaguuaggagaacugacuagcuaaacugcuacaguaugcaauuucuauuacaauu

SEQ ID NO: 362432 - RNA, 64 nt, Homo Sapiens
aucuguagcccuaacacaugggaugaacguuuuacugcuacacccagauuuguguugaacgaaa

SEQ ID NO: 362433 - RNA, 64 nt, Homo Sapiens
cuguguuagaaguagcaaugacaaugaccaaggacugcuacaccucugauuacaauucugaugu

SEQ ID NO: 362434 - RNA, 64 nt, Homo Sapiens
auggaucagcucuuccuguguuuguaauuuaaugcugcuacaagauguuucuguuucuuagauu

SEQ ID NO: 362435 - RNA, 64 nt, Homo Sapiens
agaaagaaaugaagugacucagcuucuggcuucucugcuacaucaaauaucuuguuuaaugggg

SEQ ID NO: 362436 - RNA, 64 nt, Homo Sapiens
uaguuuccccuagcagacuuuuacuucucuuacacugcuacaccauuacuuucuugagacauuu

SEQ ID NO: 362437 - RNA, 64 nt, Homo Sapiens
acuguacccagugccgccaccaguucugcagcggcugcuacaaugccuuuuacgccaagaaugu

SEQ ID NO: 362438 - RNA, 64 nt, Homo Sapiens
ccugcgggacuggacugcucuccggcuucagaagcugcuacaggacaauaacgucauguuuaau

SEQ ID NO: 362439 - RNA, 64 nt, Homo Sapiens
agguacggcagccccagccccugcuacauggcaacugcuacaacucagccucuauggcaaggcc

SEQ ID NO: 362440 - RNA, 64 nt, Homo Sapiens
gcaacugcuacaacagguacucuauggcaaggcccugcuacaugagaugaggccagccucagcc

SEQ ID NO: 362441 - RNA, 64 nt, Homo Sapiens
gcugagaaucucguuaguagcauguggccuaacaaaaggaaaaaauguuuuuaaacacacacac

SEQ ID NO: 362442 - RNA, 64 nt, Homo Sapiens
ugugaagaggaggaaaagugaaucacggagagagaaaggaaaggauagaaucacaggcugcguc

SEQ ID NO: 362443 - RNA, 64 nt, Homo Sapiens
acccaucauuucacacauaggcucugaaagugggaaaggaaagcugaucaagcaggggccggac

SEQ ID NO: 362444 - RNA, 64 nt, Homo Sapiens
uugcauggaugguuguaaagaaacaaucagaaauaaaggaaaacugagcagaaucugucuggug

SEQ ID NO: 362445 - RNA, 64 nt, Homo Sapiens
auuugcacuguguucauauuaauccucuuuuaaaaaaggaaauauacagaagacaaacauugua

SEQ ID NO: 362446 - RNA, 64 nt, Homo Sapiens
uccaggcuugagugacagagcaagacuguaucucaaaggaaaaaggaaacuaggccaggcgugg

SEQ ID NO: 362447 - RNA, 64 nt, Homo Sapiens
uugagugacagagcaagacuguaucucaaaggaaaaaggaaacuaggccaggcgugguggcuca

SEQ ID NO: 362448 - RNA, 64 nt, Homo Sapiens
gaauaaacuuuuccagaagcacgagguaguuugcaaaggaaaagucugcacuguuugcucuaaa

SEQ ID NO: 362449 - RNA, 64 nt, Homo Sapiens
guguuuugcuguauuucaaaauuuuccuucuguuaaaggaaaauauugugaauaaccacuggug

SEQ ID NO: 362450 - RNA, 64 nt, Homo Sapiens
ucaaacaauauagaauuaaaugagggagaaaggaaaaggaaacugcagagggaaagggguacac

SEQ ID NO: 362451 - RNA, 64 nt, Homo Sapiens
gaaacuucaaacaauauagaguacacugagggagaaaggaaaagaggcuggcagagggaaaggg

SEQ ID NO: 362452 - RNA, 64 nt, Homo Sapiens
cagaagcccugcugucugucaaaggaaaaaaaaaaaaggaaaacuaaaaaaaaaaaaaaaggaa

SEQ ID NO: 362453 - RNA, 64 nt, Homo Sapiens
aaaaaaaggaaaaccagaagaaaaaaaaaaggaaaaaggaaaaacuaugcuuucuucuuaaaaa

SEQ ID NO: 362454 - RNA, 64 nt, Homo Sapiens
ggaaaaaaaaaaaaggaaaauuaaaaaaaaaaaaaaaggaaaaaucaaccucuaugcuuucuuc

SEQ ID NO: 362455 - RNA, 64 nt, Homo Sapiens
gcaaguuugcucagucaaguuuguguuuuaaauaaaaggaaagauuaguucaggaaguuuuguu

SEQ ID NO: 362456 - RNA, 64 nt, Homo Sapiens
aaaaauguuuuacuauguggcgacugauuuuuaaaaaggaaaaauguagggaaaaacuuuugcc

SEQ ID NO: 362457 - RNA, 64 nt, Homo Sapiens
gacuugaguuguuggauuagaguguaauguucucaaaggaaacacuuuggagacuagagccaau

SEQ ID NO: 362458 - RNA, 64 nt, Homo Sapiens
uuguguuaccuuuuuuaaaucccaaggacuacuaaaaggaaaaaaaacuauucuaucauaacua

SEQ ID NO: 362459 - RNA, 64 nt, Homo Sapiens
uauuuguaagauguugcacuguuucuguuuuuuuaaaggaaaacauguagagagcuguugauuu

SEQ ID NO: 362460 - RNA, 64 nt, Homo Sapiens
aagaaaccgaagccaguauuuuguaggaaauuugaaaggaaaaacacacaaauauguaaagcaa

SEQ ID NO: 362461 - RNA, 64 nt, Homo Sapiens
uugaaaggauugugaauacuguuuuuuccccuuuaaaggaaacucauauuucuuacaagccucu

SEQ ID NO: 362462 - RNA, 64 nt, Homo Sapiens
uuuugccuuuuguaucuuauccuggaucauggguaaaggaaacauuuaggauucuuggagcuag

SEQ ID NO: 362463 - RNA, 64 nt, Homo Sapiens
agacuuaaauuuucuccuaucauuuauaaaauaaaaaggaaaacaacaaguauaaaauaaaaua

SEQ ID NO: 362464 - RNA, 64 nt, Homo Sapiens
gcuauugaacuuaagcaucuaacggauaaguuugaaaggaaacuacagacucccauuucuuaaa

SEQ ID NO: 362465 - RNA, 64 nt, Homo Sapiens
ugaagugccccaggagaagaaguaacuuagaccaaaaggaaaaaacuuaaaauagcuuccaaua

SEQ ID NO: 362466 - RNA, 64 nt, Homo Sapiens
ugaaagauaagauuuauucugggagguugauugcaaaggaaauuugguuguaaagcucauuuug

SEQ ID NO: 362467 - RNA, 64 nt, Homo Sapiens
uuagagugaaaaaguguguuuuaugucaauugugaaaggaaaauguuaggaguaugguuuuuaa

SEQ ID NO: 362468 - RNA, 64 nt, Homo Sapiens
uuuugcaugcucaauuucuagguccuuugucuagaaaggaaauuugccucaguugaauuaguga

SEQ ID NO: 362469 - RNA, 64 nt, Homo Sapiens
uucaugccacggauaaaugaggcaaauccgaagaaaaggaaaaucgaauaaaaaauagucccac

SEQ ID NO: 362470 - RNA, 64 nt, Homo Sapiens
aauucauccauacagaauuuggaugacuauguauaaaggaaaacuuaaaucuuaauuauuauca

SEQ ID NO: 362471 - RNA, 64 nt, Homo Sapiens
agguuuuaaacgacuuuuguuugcggggcuuuuaaaaggaaaaccgaauuagguccacuucaau

SEQ ID NO: 362472 - RNA, 64 nt, Homo Sapiens
ccgaauuagguccacuucaauguccaccugugagaaaggaaaaauuuuuuuguuguuuaacuug

SEQ ID NO: 362473 - RNA, 64 nt, Homo Sapiens
cacacaccguuaagccagagguucugacuucgcuaaaggaaauguaagagguuuuguugucugu

SEQ ID NO: 362474 - RNA, 64 nt, Homo Sapiens
agguaaaaaaacauaaugucuucagccucauaauaaaggaaaguuaauuaaaaaaaaaaagcaa

SEQ ID NO: 362475 - RNA, 64 nt, Homo Sapiens
ggaaagucaaaaaaacgaaagagaaggagaagaaaaaggaaaagggcaaauugaaagucaagga

SEQ ID NO: 362476 - RNA, 64 nt, Homo Sapiens
gagaaaaagcgcaaagaggagaaugaagauccagaaaggaaaauaaagaagaagggcuucggcg

SEQ ID NO: 362477 - RNA, 58 nt, Homo Sapiens; identical to SEQ ID NO: 292228

SEQ ID NO: 362478 - RNA, 64 nt, Homo Sapiens
caaggcccugcuuuuuuucuuaaaaguacuuuaaaaaggaaauuuguuuguauuuuuuauuuac

SEQ ID NO: 362479 - RNA, 64 nt, Homo Sapiens
uuguuucaauguuuauuauaaaguuuacacuuugaaaggaaaucguguguguaguaauagaugu

SEQ ID NO: 362480 - RNA, 64 nt, Homo Sapiens
guacaguauucuuuuaauaacaaaaauaguuuuuaaaggaaaaaauuuuuaccuuguaaaguca

SEQ ID NO: 362481 - RNA, 64 nt, Homo Sapiens
aaaacaaaaaacgaaugaaauaaccuaguuaaagaaaggaaaaguggcuuauuuaauaugcuua

SEQ ID NO: 362482 - RNA, 64 nt, Homo Sapiens
uguguuuauauggaagaaagagaugcuugcggcaaaaggaaagcauguaggcccagucgucauc

SEQ ID NO: 362483 - RNA, 64 nt, Homo Sapiens
ccgagcaggccguguugcauagcuaaugcucuacaaaggaaagggaggacaccuuuguaucuca

SEQ ID NO: 362484 - RNA, 64 nt, Homo Sapiens
cuuaaagcaaggcggaacagaugaaacagauuucaaaggaaaagggagcccauauaugcggucc

SEQ ID NO: 362485 - RNA, 64 nt, Homo Sapiens
guuuucucaaccauuuaaaaagguuauuccaguaaaaggaaauaaaguuaccaucgcaaaggaa

SEQ ID NO: 362486 - RNA, 64 nt, Homo Sapiens
uuauuccaguaaaaggaaauaaaguuaccaucgcaaaggaaagggccuauacucccaagacuac

SEQ ID NO: 362487 - RNA, 64 nt, Homo Sapiens
gcaugacauuguguaucgauaaaaaaaaaaaggaaaaggaaaaacgcugagcugcuuguuuaaa

SEQ ID NO: 362488 - RNA, 64 nt, Homo Sapiens
gaaaaagcaugacauuguguuuuaaaaaaaaaaaaaaggaaaagccaaaucgcugagcugcuug

SEQ ID NO: 362489 - RNA, 64 nt, Homo Sapiens
cugauguuuccauauagcuuugacguaucuuagaaaaggaaagguauuuaaggaagaauuggag

SEQ ID NO: 362490 - RNA, 64 nt, Homo Sapiens
agaauaugaucaauuccuuguuuaugaauuccugaaaggaaaauaaaggugcuauccuagggau

SEQ ID NO: 362491 - RNA, 64 nt, Homo Sapiens
gggucacgcacaucauguacugacacacguaaggaaaggaaaggaaaaugucuuaauggcugug

SEQ ID NO: 362492 - RNA, 64 nt, Homo Sapiens
uuucaaagcagaaauuuuaagccaaaaacaaacgaaaggaaagcggggaggggaaaacagaccc

SEQ ID NO: 362493 - RNA, 64 nt, Homo Sapiens
ucuuuugugacucuuguacagcuuaaugugcaauaaaggaaaaguuauaucugucuucaguguu

SEQ ID NO: 362494 - RNA, 64 nt, Homo Sapiens
uauaauuaggcuuuauuaucuuccuaaaucaaggaaaggaaaucauccccagaccauuuaugcu

SEQ ID NO: 362495 - RNA, 64 nt, Homo Sapiens
auuauuaguugauucacaguacagaacaagguauaaaggaaaaaacccugcuagguaguguuau

SEQ ID NO: 362496 - RNA, 64 nt, Homo Sapiens
cccagucccccaaccccagccgcucggaggccccaaaggaaaaagcacaagaagcgugagacgc

SEQ ID NO: 362497 - RNA, 64 nt, Homo Sapiens
gcucauucucguagcuuuuuaaaaaaaugaaaguaaaggaaaaaaaaaaaacugcaaaucuaga

SEQ ID NO: 362498 - RNA, 64 nt, Homo Sapiens
aggcaacacaagaauauuucacuuagauaugaagaaaggaaacacuagucuccauucacuugaa

SEQ ID NO: 362499 - RNA, 64 nt, Homo Sapiens
uggauuuuauucuuagaaauccagaaucccuugaaaaggaaauauuuucuguuucuuauaaaua

SEQ ID NO: 362500 - RNA, 64 nt, Homo Sapiens
aaccucguuuuucuuuuguuugcauuuucugcaaaaaggaaaaagaaaccacaaauuggggaaa

SEQ ID NO: 362501 - RNA, 64 nt, Homo Sapiens
aaugggaagagaggagagggagaaaaauaaaaugaaaggaaaaaaaaaaguuugcaaauucaga

SEQ ID NO: 362502 - RNA, 64 nt, Homo Sapiens
gaugcaguugaauggaaaauuacucaguguauagaaaggaaaaaaaccagaaauuuaaaauaga

SEQ ID NO: 362503 - RNA, 64 nt, Homo Sapiens
caaauaacauaagucugaaagcaaugaaaacgucaaaggaaaauguuuauauacauccacaugu

SEQ ID NO: 362504 - RNA, 64 nt, Homo Sapiens
cacauaagugcugucaguauaaaguuguggggauaaaggaaacuggauauuuuuagcacgaugu

SEQ ID NO: 362505 - RNA, 64 nt, Homo Sapiens
cuuucuuuuuucuaaaaaaagaaaaaaaagaaaaaaaggaaaagaagaacaaagaaacaugacu

SEQ ID NO: 362506 - RNA, 64 nt, Homo Sapiens
cagcauggagaaaacccgguacgcucaaaaagaaaaaggaaaaaaaaaaaucccaucacccaca

SEQ ID NO: 362507 - RNA, 64 nt, Homo Sapiens
aauuuggacauuuuaauuguuuaaaaauuguacaaaaggaaaaaauuagaauaaguacuggcga

SEQ ID NO: 362508 - RNA, 64 nt, Homo Sapiens
auauauguuagaguuuugaaguuaagugguggaaaaaggaaaguaagccgaugggggcaguggc

SEQ ID NO: 362509 - RNA, 64 nt, Homo Sapiens
gaaaacaggaccuagguguuaagauccugucucaaaaggaaaaauccagcuugggcaacagagc

SEQ ID NO: 362510 - RNA, 64 nt, Homo Sapiens
aguuauuccuagcuccauuucccaaugaagaggaaaaggaaaguagaucauucaguuggauuuu

SEQ ID NO: 362511 - RNA, 64 nt, Homo Sapiens
uaguccuaaucuuuacuaucacaagcagcaccccaaaggaaauauugucauucaguaauuuccu

SEQ ID NO: 362512 - RNA, 64 nt, Homo Sapiens
aaugucuugcaaugugcuguuaggacguuuauuaaaaggaaaaagaaagggaaacucagaguac

SEQ ID NO: 362513 - RNA, 64 nt, Homo Sapiens
ucuaaagcacaagaaauaguuuuaagagaaauacaaaggaaauuuuggggaagaagcaagauac

SEQ ID NO: 362514 - RNA, 64 nt, Homo Sapiens
auaucauauaugaugauguauguuccuaucuucuaaaggaaaguuugaccucuaaaaagcccuu

SEQ ID NO: 362515 - RNA, 64 nt, Homo Sapiens
cuuguauggcaucgaauagcgauuguuuuauguaaaaggaaaauauuuuugagauguaauuuaa

SEQ ID NO: 362516 - RNA, 64 nt, Homo Sapiens
auuuggagaauugaacucacaaacuuauuacuuuaaaggaaagggacauuaauaaagaugaaau

SEQ ID NO: 362517 - RNA, 64 nt, Homo Sapiens
auaaaucagaacuccauaaagcacacuuaaaagcaaaggaaaaaauucacgugcacaaagauua

SEQ ID NO: 362518 - RNA, 64 nt, Homo Sapiens
uauuuaggaaauuacauuaaguauuaaugaggggaaaggaaaugagcucuacgaggauuucacc

SEQ ID NO: 362519 - RNA, 64 nt, Homo Sapiens
uuccccacccccaucacagggcuuucaguuuggcaaaggaaaagcagauaaaaacagaacauuc

SEQ ID NO: 362520 - RNA, 64 nt, Homo Sapiens
ugaccucagggagagcaccuguccaggucugccuaaaggaaauggcuccagugggucuaaacaa

SEQ ID NO: 362521 - RNA, 64 nt, Homo Sapiens
cuauuguaaauauguuuuuuagaucaaauacuuuaaaggaaaaaauguuggauuuauaaaugcu

SEQ ID NO: 362522 - RNA, 64 nt, Homo Sapiens
uauaaaugcuauuuuuuauuuuacuuuuauaauaaaaggaaaagcaaauugaugaccucaccuu

SEQ ID NO: 362523 - RNA, 64 nt, Homo Sapiens
uuagcaagcaugaauuuuucacccaagagugaaaaaaggaaaaucuaccauggcuugaaguuaa

SEQ ID NO: 362524 - RNA, 64 nt, Homo Sapiens
gguggcagguacuaugaauguaauucauaauuuaaaaggaaaacuaaaaacuauuuugauuugg

SEQ ID NO: 362525 - RNA, 64 nt, Homo Sapiens
cuuaucacacugauguguucaacuguuuaugggaaaaggaaacuaggaugguuuuauuugugaa

SEQ ID NO: 362526 - RNA, 64 nt, Homo Sapiens
agcgcagagcagagugcugaguaaagaugucagaaaaggaaagcaauggucugguacaagucuu

SEQ ID NO: 362527 - RNA, 64 nt, Homo Sapiens
aucuucuuugaagaaaaguaaaagaagaaaaaagaaaggaaaagaacuuuggguaccaaaccaa

SEQ ID NO: 362528 - RNA, 64 nt, Homo Sapiens
gcauguucugaccauuuuagcugaacugccuuugaaaggaaauuacccuccuugagccaaugca

SEQ ID NO: 362529 - RNA, 64 nt, Homo Sapiens
aagcguucaccgccacaaauguuuaaaaaaauaaaaaggaaaggguguuuggcaguaauugucu

SEQ ID NO: 362530 - RNA, 64 nt, Homo Sapiens
uuuucaugccuuuagaugugugggucaguugauaaaaggaaacccacuauugggguaugauguu

SEQ ID NO: 362531 - RNA, 64 nt, Homo Sapiens
aaacuaacaaccaaccaaccuauauauaaauuaaaaaggaaagauauauauauauauauauaua

SEQ ID NO: 362532 - RNA, 64 nt, Homo Sapiens
uauauauauauauauauauaucguauucuauucaaaaggaaauaaaccuagaacuucaaaaugu

SEQ ID NO: 362533 - RNA, 64 nt, Homo Sapiens
uuuaaauagcuuaauaucaaaagaguugguuugcaaaggaaaaguugaaaguuuaaagaggggg

SEQ ID NO: 362534 - RNA, 64 nt, Homo Sapiens
gugauagaauaauauucaagcuguggaaacaugcaaaggaaaaagaggaugagaaguaagcaaa

SEQ ID NO: 362535 - RNA, 64 nt, Homo Sapiens
aaaagccuaaauguucagaauauuuauugugacaaaaggaaauaaaagauauguuuuauauugu

SEQ ID NO: 362536 - RNA, 64 nt, Homo Sapiens
uuucaagagucuauaucuauaucaugcaagcugcaaaggaaacacucuacugacaaaguaugcc

SEQ ID NO: 362537 - RNA, 64 nt, Homo Sapiens
uuauggacucuguuaagaaaugucuggccuuuggaaaggaaaaaacuaucuguaacaucagagc

SEQ ID NO: 362538 - RNA, 64 nt, Homo Sapiens
ccuucacacccucacagaggccuucacaggugcgaaaggaaagggcccaagauaggccuucaca

SEQ ID NO: 362539 - RNA, 64 nt, Homo Sapiens
aagaaguguacagaauuaacaacaagggguaaaaaaaggaaagaucuacuauagcuuauuuuca

SEQ ID NO: 362540 - RNA, 64 nt, Homo Sapiens
augaccuguuaggcugagcucaggaauuguccaaaaaggaaaaagcaaaauaauuaauugagag

SEQ ID NO: 362541 - RNA, 64 nt, Homo Sapiens
gucugaguccagauuucucaucaacuggcaauacaaaggaaaauaugguacaggaguuaguuag

SEQ ID NO: 362542 - RNA, 64 nt, Homo Sapiens
uuaaaaugacuguuuucucucucuauggaaauaaaaaggaaaaaaaaaaaggaaacuuuuuuug

SEQ ID NO: 362543 - RNA, 64 nt, Homo Sapiens
uuucucucucuauggaaauaaaaaggaaaaaaaaaaaggaaacuuuuuuuguuugcucuugcau

SEQ ID NO: 362544 - RNA, 64 nt, Homo Sapiens
ugauuggcaagacauguauuuaaacaauaaacuaaaaggaaauaaucuccacguacuaccaucu

SEQ ID NO: 362545 - RNA, 64 nt, Homo Sapiens
uuuucuucaaaggcuuguuaaaccaaucauguuaaaaggaaauucuugguuuugguuuguuguu

SEQ ID NO: 362546 - RNA, 64 nt, Homo Sapiens
ccgugauugguugguuuguagcacuaaggucuaaaaaggaaaaccauaaaagacaucagauuac

SEQ ID NO: 362547 - RNA, 64 nt, Homo Sapiens
acagggaggaugggauuaguggaagcuuaauggaaaaggaaaguuaugauccuccaagacccuu

SEQ ID NO: 362548 - RNA, 64 nt, Homo Sapiens
uaaaaacauuccacaagaagaauaauaauauaagaaaggaaauuucuaaaaaaaccuaaggaag

SEQ ID NO: 362549 - RNA, 64 nt, Homo Sapiens
cauucaggaagaaaugaccuuaaaaauaaaagaaaaaggaaaauaauaauccuccuucaaaaaa

SEQ ID NO: 362550 - RNA, 64 nt, Homo Sapiens
aagagugcuuuugggcauccagucaucaacuuggaaaggaaacauuuuuaggaaauauacgaag

SEQ ID NO: 362551 - RNA, 64 nt, Homo Sapiens
uacgaagagucaucaacuuggugcccauauggaaaaaggaaauauugauacuuuaaaagccaag

SEQ ID NO: 362552 - RNA, 64 nt, Homo Sapiens
uuaggcuuucuuuguccuuucccagaaaaaaggaaaaggaaaguaaugcugcuuccuauuggag

SEQ ID NO: 362553 - RNA, 64 nt, Homo Sapiens
gaaaguuuaggcuuucuuuguuggagcccagaaaaaaggaaaagguuguaaaugcugcuuccua

SEQ ID NO: 362554 - RNA, 64 nt, Homo Sapiens
ugaguuuaaauagaaacauguuuuuuaauuaaaaaaaggaaauucaccuauguacccacaaaaa

SEQ ID NO: 362555 - RNA, 64 nt, Homo Sapiens
ugcaugaagggauggauaccaaauuuguguucacaaaggaaaaaugcauacccuucucuucaag

SEQ ID NO: 362556 - RNA, 64 nt, Homo Sapiens
uaaagaagacuaugauaccauaaucucucuggaaaaaggaaagcuuaagaaccagaaaaauaau

SEQ ID NO: 362557 - RNA, 64 nt, Homo Sapiens
cagauuuugaaaucugacucgaggugagggauuaaaaggaaagggguaacuugaaggcagcaca

SEQ ID NO: 362558 - RNA, 64 nt, Homo Sapiens
uagcauccuuaagauuuaaaaaaaaaaaaaaaaaaaaggaaaaaaaagugauggaagccguaag

SEQ ID NO: 362559 - RNA, 64 nt, Homo Sapiens
aucuugucuauuuuuucucuucauguuguaacaaaaaggaaaaaagaaaaaaaaaucccauccc

SEQ ID NO: 362560 - RNA, 64 nt, Homo Sapiens
cagcaaaauuugaaauaauuucaccaggcuaaauaaaggaaaauggaaaccaguuaagaggcac

SEQ ID NO: 362561 - RNA, 64 nt, Homo Sapiens
gacaaaccaaagguaaccagcuagcccaccacugaaaggaaagaucugagacaugggauuccca

SEQ ID NO: 362562 - RNA, 64 nt, Homo Sapiens
uaugcaaguaaaucuuaucguuaguucuucuucaaaaggaaauugcaucuugugacuuaguaga

SEQ ID NO: 362563 - RNA, 64 nt, Homo Sapiens
ucuccagaagcugcagcaagagguacagcucaacaaaggaaaaccacaggacuggauaugcaac

SEQ ID NO: 362564 - RNA, 64 nt, Homo Sapiens
gucagaauauucuuuuuauauucuguggaaaaauaaaggaaauucagauuguuuaaaugccuaa

SEQ ID NO: 362565 - RNA, 64 nt, Homo Sapiens
uaaaaguuuugagauaaguuuuguuucaauuagaaaaggaaauagguuuuagguggcauagugg

SEQ ID NO: 362566 - RNA, 64 nt, Homo Sapiens
gcuucuauuuugugaagggacuauauuuuuugagaaaggaaaaucucaguuagauauauuuugu

SEQ ID NO: 362567 - RNA, 64 nt, Homo Sapiens
gaauuuuuauuuccuguaguaggcuugcuggagcaaaggaaaugugcugcuaaaaaucaacuua

SEQ ID NO: 362568 - RNA, 64 nt, Homo Sapiens
ccccgucccuuaaaaagacaaaaaaaauaaggcaaaaggaaagcaacuaagacacuggacuauc

SEQ ID NO: 362569 - RNA, 64 nt, Homo Sapiens
gauaaauaccuggcaaaacuaaauaaauuaccaaaaaggaaaaaaaauccaccaaaccaugaua

SEQ ID NO: 362570 - RNA, 64 nt, Homo Sapiens
acaaagaaaugcauucauaucaaaauuggaauagaaaggaaaaccuauuuuuaagauaucaacc

SEQ ID NO: 362571 - RNA, 64 nt, Homo Sapiens
ggucugucauaaauuauuuccccgguaauuuuugaaaggaaaaauguauaacaaguacuauuua

SEQ ID NO: 362572 - RNA, 64 nt, Homo Sapiens
gugguguuuguuuccauccccaaggcaaacaaggaaaggaaaggaaagaagaaaaggugccuua

SEQ ID NO: 362573 - RNA, 64 nt, Homo Sapiens
guuuguuuccauccccaaggcaaacaaggaaaggaaaggaaagaagaaaaggugccuuaguccu

SEQ ID NO: 362574 - RNA, 64 nt, Homo Sapiens
acacuaguguucuuucaguauuuuuucacaacggaaaggaaagauucaauuccucagaaacaac

SEQ ID NO: 362575 - RNA, 64 nt, Homo Sapiens
augugauucaagauauuuacugagauuucagaagaaaggaaacagugcugugagaauucuccuu

SEQ ID NO: 362576 - RNA, 64 nt, Homo Sapiens
cacucuuucauugcugaauugcauuggaagagagaaaggaaacauaagggguuguuguguaguu

SEQ ID NO: 362577 - RNA, 64 nt, Homo Sapiens
uuguaugaccacuguucuauaugccaaauuugggaaaggaaauuuuaaggacaaagauguaaaa

SEQ ID NO: 362578 - RNA, 64 nt, Homo Sapiens
aggaaauuguaagcuuuauuugacacauuaaaauaaaggaaauaaauaucuuuaaguguuuuuu

SEQ ID NO: 362579 - RNA, 64 nt, Homo Sapiens
gcagccuuuacuauuuuuucaauaagcacuuuaaaaaggaaaaguuguuuuuggauauaaagcu

SEQ ID NO: 362580 - RNA, 64 nt, Homo Sapiens
caugcaauuuuaccuagacauucaauuuuaugguaaaggaaaccugaggguaaaaaaaaauuga

SEQ ID NO: 362581 - RNA, 64 nt, Homo Sapiens
uagauagugauacugaggguaauauuuuaagaaaaaaggaaaagaauacaaaucaaacaauuua

SEQ ID NO: 362582 - RNA, 64 nt, Homo Sapiens
ggauuuaugagugauugcucuacauuauuucuucaaaggaaaggaaaggaauugaagacuuugc

SEQ ID NO: 362583 - RNA, 64 nt, Homo Sapiens
uaugagugauugcucuacauuauuucuucaaaggaaaggaaaggaauugaagacuuugcuacuc

SEQ ID NO: 362584 - RNA, 64 nt, Homo Sapiens
aaugucauugguauaugguggcuguuuaccaauaaaaggaaaaaauucauuaaccgguugcuuc

SEQ ID NO: 362585 - RNA, 64 nt, Homo Sapiens
ucuuccuugucucaugaaaaccuaaauauaaaaaaaaggaaaauacuggaguuuuuauuucucu

SEQ ID NO: 362586 - RNA, 64 nt, Homo Sapiens
cagacaguuauuccauaaagcauuuguauaauuaaaaggaaaacagaaaaaggaaaaguaggca

SEQ ID NO: 362587 - RNA, 64 nt, Homo Sapiens
auaaagcauuuguauaauuaaaaggaaaacagaaaaaggaaaaguaggcaaaugugaaaauagu

SEQ ID NO: 362588 - RNA, 64 nt, Homo Sapiens
uugcagagcuauagauagaaacagcuggaaaacuaaaggaaaaauacaaguguuuucggggcau

SEQ ID NO: 362589 - RNA, 64 nt, Homo Sapiens
cucuuucccucuccccgcugccaaaaaaaaaaaaaaaggaaacguuuaucaugaaucaacaggg

SEQ ID NO: 362590 - RNA, 64 nt, Homo Sapiens
gcccauuucuguuaaccucuuaucacuaagaaagaaaggaaagaaggagaugaauagaagaaag

SEQ ID NO: 362591 - RNA, 64 nt, Homo Sapiens
uuuaaaccacagucuggagugauagcuacuguagaaaggaaauagacuuuguaugaacucuuua

SEQ ID NO: 362592 - RNA, 64 nt, Homo Sapiens
gccuagcuccaggcuguguugguacuuuguggucaaaggaaaucuggugcugaguuagacucca

SEQ ID NO: 362593 - RNA, 64 nt, Homo Sapiens
cuaccaguuuuuuauucagauauagcaaaacaggaaaggaaaagguucuagaaagccacuguuu

SEQ ID NO: 362594 - RNA, 64 nt, Homo Sapiens
aaagacuuaaaacuggaguggugggagacauaagaaaggaaagacuuuuaaaacuugaauauag

SEQ ID NO: 362595 - RNA, 60 nt, Homo Sapiens; identical to SEQ ID NO: 292346

SEQ ID NO: 362596 - RNA, 64 nt, Homo Sapiens
aacuaccuuuuuauaaugcaccugacuuaaaacaaaaggaaagauuuuuaaaaaucuaccuguu

SEQ ID NO: 362597 - RNA, 64 nt, Homo Sapiens
uugaggggggggcauuagugauuuucuauaagaaaaaggaaaagggagguauuguaagcuuucc

SEQ ID NO: 362598 - RNA, 64 nt, Homo Sapiens
aauaaaauauguucguuuauaaguaacugauuuaaaaggaaaauauuaaacagucuucauuuuu

SEQ ID NO: 362599 - RNA, 64 nt, Homo Sapiens
cacagaacauaucuucacauauagggccaaguucaaaggaaaugaaaagaaaagaaaagaaauc

SEQ ID NO: 362600 - RNA, 64 nt, Homo Sapiens
ugaucaaaaacaaaguaagguccaaaauucagcuaaaggaaaaaagaguaagugcuauuggcau

SEQ ID NO: 362601 - RNA, 64 nt, Homo Sapiens
ugaacacuauaaaacuauuauacaguauaguuagaaaggaaagcgcuaugauuugcacuauuag

SEQ ID NO: 362602 - RNA, 64 nt, Homo Sapiens
agagaggagagucuuacggagggcugggagcuuaaaaggaaaacaauguccuuacuuguaaaca

SEQ ID NO: 362603 - RNA, 64 nt, Homo Sapiens
cacgacuucuguuucacaguucagaccggucuucaaaggaaaagccuguccgauuuuuccaugg

SEQ ID NO: 362604 - RNA, 64 nt, Homo Sapiens
cacagaaaagcaaagucaguguacacucugagugaaaggaaauguaauguggauaaaggcccgc

SEQ ID NO: 362605 - RNA, 64 nt, Homo Sapiens
guuuaugauaccaaaaaaauuacaguuuuguuuaaaaggaaauguugauguuuucaacuccaaa

SEQ ID NO: 362606 - RNA, 64 nt, Homo Sapiens
aagcugaaaucuauucucauucuuguuugucaagaaaggaaaaucuguuauucaagguaaauua

SEQ ID NO: 362607 - RNA, 64 nt, Homo Sapiens
guccaucuuaguuuuguuaaaaaaaaaaaaaaaaaaaggaaacagccucacuuuuuugugcucc

SEQ ID NO: 362608 - RNA, 64 nt, Homo Sapiens
cagugccaaauaugagaggauauuuaccuaauuaaaaggaaaggagaugaagauuauaacuguu

SEQ ID NO: 362609 - RNA, 64 nt, Homo Sapiens
aacuacugggaaauuaugcaauuaaggcucauuaaaaggaaaggcuuuuaauuagucaaacuaa

SEQ ID NO: 362610 - RNA, 64 nt, Homo Sapiens
uuuuucaacuucuucuauauaugucuuuuaauaaaaaggaaauaucaaaugauuaugauuaguu

SEQ ID NO: 362611 - RNA, 64 nt, Homo Sapiens
accuuuauuuuauuuuuuuuaguuuauuauuuucaaaggaaaacuucauauagccagggauuga

SEQ ID NO: 362612 - RNA, 64 nt, Homo Sapiens
uacauucccgguguuaguagguguuaauauugagaaaggaaaaauuaauaugaauauauaucau

SEQ ID NO: 362613 - RNA, 64 nt, Homo Sapiens
uuugagcugcaccuucaguugcccuuggauaagaaaaggaaacugaagacaaugguccuauaau

SEQ ID NO: 362614 - RNA, 64 nt, Homo Sapiens
gaagguaauugaauagaauauggaguguugguggaaaggaaacucugauagguuaggucucauu

SEQ ID NO: 362615 - RNA, 64 nt, Homo Sapiens
gguacacuuucagauaauuugucaguaaaaguaaaaaggaaaaagccaacaucaccuuaaaguc

SEQ ID NO: 362616 - RNA, 64 nt, Homo Sapiens
gaauguagcucaacuugugauuguucaacucuauaaaggaaaagugugcaaucaccccugccuu

SEQ ID NO: 362617 - RNA, 64 nt, Homo Sapiens
agacagaaugauuuccaaaauguaaaccaaguucaaaggaaaaucuaacccuuucaaaaguguu

SEQ ID NO: 362618 - RNA, 64 nt, Homo Sapiens
cauuuauauuaaagaauuugcuguucuuauuguaaaaggaaaguuaaaaagugggaaggugaug

SEQ ID NO: 362619 - RNA, 64 nt, Homo Sapiens
uugaaccuuauguaccgagcuaaauaaaaaaaggaaaggaaacuaaacauugcaaaauauaaaa

SEQ ID NO: 362620 - RNA, 64 nt, Homo Sapiens
aaacuuugaaccuuauguacuaaaauaaauaaaaaaaggaaaggaaaaaaaacauugcaaaaua

SEQ ID NO: 362621 - RNA, 64 nt, Homo Sapiens
aaugucauucaggguuuccugacugcuaaugcagaaaggaaaaucguaaaggaaacagaaagau

SEQ ID NO: 362622 - RNA, 64 nt, Homo Sapiens
guuuccugacugcuaaugcagaaaggaaaaucguaaaggaaacagaaagaugaaauaagccauu

SEQ ID NO: 362623 - RNA, 57 nt, Homo Sapiens; identical to SEQ ID NO: 292374

SEQ ID NO: 362624 - RNA, 64 nt, Homo Sapiens
guuuaagaacuauuuuaaaguguuccagacccaaaaaggaaaaauaaaaaaaaaggaauauuug

SEQ ID NO: 362625 - RNA, 64 nt, Homo Sapiens
ucagcaauccugcugcuggguauauacccgaaagaaaggaaaaggaagccaguauauugaagag

SEQ ID NO: 362626 - RNA, 64 nt, Homo Sapiens
cauagagaguagaagguugguuaccagaagcuggaaaggaaagugggguugggaggaagguggg

SEQ ID NO: 362627 - RNA, 64 nt, Homo Sapiens
ugaaagaaagaaaaagaaagaaagaaagaaagagaaaggaaauuauaaggucaaguuaacaguu

SEQ ID NO: 362628 - RNA, 64 nt, Homo Sapiens
guacagauagagauaauagaagacaaagagauuaaaaggaaauaaaaaugcaugauuaaaaacu

SEQ ID NO: 362629 - RNA, 64 nt, Homo Sapiens
aacuaagaauaaaaaaccuauuuuuauguuuccuaaaggaaauuguuuauucuacagccucagu

SEQ ID NO: 362630 - RNA, 64 nt, Homo Sapiens
aacaguuugaacacaaaggcaggaaaaaaagaaaaaaggaaaaaaaagaaaaaaugaaaaaaaa

SEQ ID NO: 362631 - RNA, 64 nt, Homo Sapiens
aagaaaaaaggaaaaaaacaaaaaaaugaaaaaaaaaggaaaaaguuugaaaucuuaaaaaaag

SEQ ID NO: 362632 - RNA, 64 nt, Homo Sapiens
aacugaagaaagaagauaaucaacacaaaggcagaaaggaaagaaagaggaagacuggacaaaa

SEQ ID NO: 362633 - RNA, 64 nt, Homo Sapiens
aggaagacuggacaaaacaauuuuaaauaaaaaaaaaggaaaagaauaguuuaagaaauuuuuu

SEQ ID NO: 362634 - RNA, 64 nt, Homo Sapiens
guuaauauguuucuguuguuccguuaaauuugccaaaggaaacuguucacaucagcauucacuu

SEQ ID NO: 362635 - RNA, 64 nt, Homo Sapiens
aaaauuauguggugugaaaccguuaaguuacauaaaaggaaaacuugcauccuucuugcuuaua

SEQ ID NO: 362636 - RNA, 64 nt, Homo Sapiens
ucauauuuauuccugcacccaucccauuuuggggaaaggaaaaguacucugcuuuucugucaac

SEQ ID NO: 362637 - RNA, 64 nt, Homo Sapiens
aaauuaccacugggaaaaucggaaguaaaaacagaaaggaaaaggucuaacaacacugauaaua

SEQ ID NO: 362638 - RNA, 64 nt, Homo Sapiens
cucaagccucuauucaccccaaguccuaccacacaaaggaaaguguccaggggauuucuccucc

SEQ ID NO: 362639 - RNA, 64 nt, Homo Sapiens
ccaaucuuauuauggaaagcuuuuuuuuuuuuuuaaaggaaaucagaaugcaguuuggccucuu

SEQ ID NO: 362640 - RNA, 64 nt, Homo Sapiens
aggcccaagugcaaaagaaauuuuccugaauuggaaaggaaaaggauaccaggcacuuaaagcc

SEQ ID NO: 362641 - RNA, 64 nt, Homo Sapiens
gugaacaaacuuagaaaggggguuccguuuuagaaaaggaaaacccaauacagucuaguuuccu

SEQ ID NO: 362642 - RNA, 64 nt, Homo Sapiens
uuaaaacccaauacagucuaauucagcuuuguccaaaggaaagcuuagugacaccacacauuua

SEQ ID NO: 362643 - RNA, 64 nt, Homo Sapiens
aaaugcacauaaauuuggaagugauaccaaaaaaaaaggaaauauggaagugcuaucuaaugca

SEQ ID NO: 362644 - RNA, 64 nt, Homo Sapiens
uacagaucaauauuuccaguaaaaacauuacaagaaaggaaaaccccuaauaccaaagccaggc

SEQ ID NO: 362645 - RNA, 64 nt, Homo Sapiens
auaauugagaaaguguucauuuuuauagaaaaaaaaaggaaaaaugaaaaaauaucauuugacu

SEQ ID NO: 362646 - RNA, 64 nt, Homo Sapiens
aauguauaccguaucuaucuggacucgggccacgaaaggaaagacugacacccgcgcgugggga

SEQ ID NO: 362647 - RNA, 64 nt, Homo Sapiens
ugaaaaagcauaagaaauuuuguuaggguuagauaaaggaaaagaauaaacaggaaauuagaag

SEQ ID NO: 362648 - RNA, 64 nt, Homo Sapiens
aacgaaugcacuucauauagaaauaauaauaacaaaaggaaagcaacuuguuacaacaauuuaa

SEQ ID NO: 362649 - RNA, 64 nt, Homo Sapiens
caaacuguaaauguauaaaugcucaaaaaagaugaaaggaaaugggacaugcagaauugaauuu

SEQ ID NO: 362650 - RNA, 64 nt, Homo Sapiens
auggaaggaaagugauucugcauguagggacaggaaaggaaacauugaaugaagcaagggaagg

SEQ ID NO: 362651 - RNA, 64 nt, Homo Sapiens
aaaacaaacuuguucuuugcgauucuaaauuuaaaaaggaaaacugcuaauguguuguaaacaa

SEQ ID NO: 362652 - RNA, 64 nt, Homo Sapiens
augcuggucaucacaggaacgugaaaauuccucaaaaggaaauuaauccugaggcugaugaauu

SEQ ID NO: 362653 - RNA, 64 nt, Homo Sapiens
gaaaaacaaaaucuccgcagcagaucggacuaaaaaaggaaaaaugacccaucuggaggaaaac

SEQ ID NO: 362654 - RNA, 64 nt, Homo Sapiens
augggggugggggguggggggacgaacaaaagggaaaggaaaaagcccacuggaugagcgguga

SEQ ID NO: 362655 - RNA, 64 nt, Homo Sapiens
cacaaauugcccccagauugccaccuuugcaaagaaaggaaaaagacaggagcugucuggagcu

SEQ ID NO: 362656 - RNA, 64 nt, Homo Sapiens
uucccuuaacucuuucugcuaaggaacaggaaugaaaggaaaccacuguucaaaagcaaaagag

SEQ ID NO: 362657 - RNA, 64 nt, Homo Sapiens
aaaguuuauuuugcuauugugaaaaacuaaauguaaaggaaaucaccuacuuucaugcaggugu

SEQ ID NO: 362658 - RNA, 64 nt, Homo Sapiens
aaucaccuacuuucaugcagguguauaaucuugaaaaggaaaaaugcuuccauguugaagccag

SEQ ID NO: 362659 - RNA, 64 nt, Homo Sapiens
uuugaaaagaaaaggggaaugugucccacuagugaaaggaaaacuuuucaacacuaucccugcu

SEQ ID NO: 362660 - RNA, 64 nt, Homo Sapiens
guauucaaauuugauuguggcgaaucuacuucaaaaaggaaaaauaauccaacuuuguggauau

SEQ ID NO: 362661 - RNA, 64 nt, Homo Sapiens
cugugagguuuauacuauuucugguuuuuaaccaaaaggaaaucaucuggaagcaggaggcaaa

SEQ ID NO: 362662 - RNA, 64 nt, Homo Sapiens
uaaagguugacauauuccaaaacccuucuuuuuaaaaggaaaaaggauggagagaaggauggaa

SEQ ID NO: 362663 - RNA, 64 nt, Homo Sapiens
ugcgaagcagaggaaaagaaacguuuucagaccuaaaggaaauguuuggucauguuaagaaaac

SEQ ID NO: 362664 - RNA, 64 nt, Homo Sapiens
gggugggaggguaagaguuuugacaaguuguggcaaaggaaacuauacuuuucauuuuuaaaaa

SEQ ID NO: 362665 - RNA, 64 nt, Homo Sapiens
gauugcaaacacauggcuccaucuucugcacacgaaaggaaagucccucuccuuuucuacaguc

SEQ ID NO: 362666 - RNA, 64 nt, Homo Sapiens
cugaucccagggugaggagaagauugggacauagaaaggaaacugcaucagaaacaugaacaga

SEQ ID NO: 362667 - RNA, 64 nt, Homo Sapiens
aguuuucauaaaacucaugguaacaaaugaugugaaaggaaaguaucauggguguggcauucuc

SEQ ID NO: 362668 - RNA, 64 nt, Homo Sapiens
aaagguugucucuugauuucccuuugcuacuuugaaaggaaaaaucagccaaucuuuuauuguu

SEQ ID NO: 362669 - RNA, 64 nt, Homo Sapiens
caaaacuaauaaaauugcuggauagcaaaaucuaaaaggaaaauugggagaaaauagagaacau

SEQ ID NO: 362670 - RNA, 64 nt, Homo Sapiens
agucuuucagaaucugucagaagaaacaaugcgcaaaggaaagccugagaaaggagugagaagg

SEQ ID NO: 362671 - RNA, 62 nt, Homo Sapiens
guggcaagauuccaucagcuuuaaagucuauucaaaaggaaaauuuuucacuuugcucucaa

SEQ ID NO: 362672 - RNA, 64 nt, Homo Sapiens
ucaguugaucuucuucaucccuccuccucacuaaaaaggaaacucuuucaagucugacucucca

SEQ ID NO: 362673 - RNA, 64 nt, Homo Sapiens
caauucugccauguuuuugcuuacuggguccaccaaaggaaaccaaagugguugggaaacucau

SEQ ID NO: 362674 - RNA, 64 nt, Homo Sapiens
aaugcguauauuucuauguucaagcuuucuuuaaaaaggaaaaaaugguaacugaugauauaaa

SEQ ID NO: 362675 - RNA, 64 nt, Homo Sapiens
agauuucuucagugacuuugugccuugaaaguuaaaaggaaagcgagaacuacauuuuucuuau

SEQ ID NO: 362676 - RNA, 64 nt, Homo Sapiens
uaugguuuccagagaaaaggaguugauuauuaaaaaaggaaaaacuuucuuacauauacaucuu

SEQ ID NO: 362677 - RNA, 64 nt, Homo Sapiens
uccccaaaguauuaaagaauuuuuuguuaaaggaaaaggaaaugauauaguaucacuucuauuc

SEQ ID NO: 362678 - RNA, 64 nt, Homo Sapiens
gaaauguccccaaaguauuacuauucuuuuuguuaaaggaaaagagcaguauauaguaucacuu

SEQ ID NO: 362679 - RNA, 64 nt, Homo Sapiens
caggugcuuuuuaaaaaucaaagcaagaugaaaaaaaggaaaaguuuaaaagcugaaaauuuag

SEQ ID NO: 362680 - RNA, 64 nt, Homo Sapiens
aaggaaggagguucagugagaaugacuugaaggcaaaggaaacugguuaauuccagaagagagg

SEQ ID NO: 362681 - RNA, 64 nt, Homo Sapiens
caggacuuguggggugggugugugcgcaguugggaaaggaaagccaguugcagcuguaaucaau

SEQ ID NO: 362682 - RNA, 64 nt, Homo Sapiens
agguuaaacaaacaaaaaaaaauuuuaaacaaagaaaggaaaaaaauugacaauaaaagucacu

SEQ ID NO: 362683 - RNA, 64 nt, Homo Sapiens
ugauacacuuuacuaaucaugaaauucuaaccuaaaaggaaaacauuuuccugcuugucuuaga

SEQ ID NO: 362684 - RNA, 64 nt, Homo Sapiens
guuucaauuucuacacaauauaaauauccaguauaaaggaaagcguuaagucgguaagcuagag

SEQ ID NO: 362685 - RNA, 64 nt, Homo Sapiens
gcuaaggcuaguguacuagauguacuuuuucuaaaaaggaaaggacagaaaaaaaugaagaaag

SEQ ID NO: 362686 - RNA, 64 nt, Homo Sapiens
uuuucuaaaaaggaaaggacagaaaaaaaugaagaaaggaaaggaagacaaauguaaagaaaua

SEQ ID NO: 362687 - RNA, 64 nt, Homo Sapiens
uccuuguuccagcccggaguuuugggaaagaaagaaaggaaaggucacagugaccuaggauugg

SEQ ID NO: 362688 - RNA, 64 nt, Homo Sapiens
ugcugauuuaccgauguauuuaauguaaguaaaaaaaggaaaaaaagaaaagggcauuggagug

SEQ ID NO: 362689 - RNA, 64 nt, Homo Sapiens
auaucuagggucuguaaccguuuugguuugagaaaaaggaaaggccccuugucacauccucuaa

SEQ ID NO: 362690 - RNA, 64 nt, Homo Sapiens
acauauuuuagugggagccagacuauaaggaauaaaaggaaaaacuuucuuccucucucuccaa

SEQ ID NO: 362691 - RNA, 64 nt, Homo Sapiens
guacagagguuacauauucuggguguucuuuuauaaaggaaacauuuuaaaucccacaaauuga

SEQ ID NO: 362692 - RNA, 64 nt, Homo Sapiens
uuguaugauccuuacuacuggaauuaccggguuaaaaggaaaugcuuaccacuaagaugucagu

SEQ ID NO: 362693 - RNA, 64 nt, Homo Sapiens
aguauagccccacuuauacuuucucaguauccugaaaggaaaaaacagcugccaguuuacacau

SEQ ID NO: 362694 - RNA, 64 nt, Homo Sapiens
acuagcaaaaagaauagccaaaagaaaaaagugaaaaggaaacaagaaaaaagauaaaguagaa

SEQ ID NO: 362695 - RNA, 64 nt, Homo Sapiens
ugucccaggauucauccuaauuuagugcuuuuuuaaaggaaaguauuaagugucuaaacuaagg

SEQ ID NO: 362696 - RNA, 64 nt, Homo Sapiens
agugccuguccagcagggaggcuguaccagggauaaaggaaagauugaacagacaaguggaagg

SEQ ID NO: 362697 - RNA, 64 nt, Homo Sapiens
aguaguuaaggauaccugaucaagauaguuucuaaaaggaaaucaauuaugaaaaucuaacacu

SEQ ID NO: 362698 - RNA, 64 nt, Homo Sapiens
uuauuuucaaaaaccuaaucagaccauuuuccaaaaaggaaacuucuaagacauuucugaaugu

SEQ ID NO: 362699 - RNA, 64 nt, Homo Sapiens
ucucaaggccuuuugaagaguuuuucuuaaucagaaaggaaaauuaaaaauauugcagugcuau

SEQ ID NO: 362700 - RNA, 64 nt, Homo Sapiens
uguaauaauugauaugauuuugguuauuaacaaaaaaggaaaaauccaagagacuuccaugucc

SEQ ID NO: 362701 - RNA, 64 nt, Homo Sapiens
uaagaucagucacccaugugaauaagaagccaggaaaggaaagauggggaagcccagaucacca

SEQ ID NO: 362702 - RNA, 64 nt, Homo Sapiens
augugacaaaugaacagcaggauuaugaauuaucaaaggaaaaaguauuugcugaggugaaaaa

SEQ ID NO: 362703 - RNA, 64 nt, Homo Sapiens
gguaauagaauacuaguaggauagaaacaacuagaaaggaaagugugacacaguuuuuaaauuu

SEQ ID NO: 362704 - RNA, 64 nt, Homo Sapiens
agauguagaaaauaaugaauuaaugagauuggugaaaggaaaucaugcaaaacauuugaaugca

SEQ ID NO: 362705 - RNA, 64 nt, Homo Sapiens
aauauuaguaaaauaaacacuaauuucuuuuuuuaaaggaaauucuauaaaccuuuugccccca

SEQ ID NO: 362706 - RNA, 64 nt, Homo Sapiens
uauuuggcuccuuuaauuccgcagaugcauuaucaaaggaaaaauguuauucaguguugcggua

SEQ ID NO: 362707 - RNA, 64 nt, Homo Sapiens
aaaaucuaaaacugcgaagaagugguuuucgcuuaaaggaaaaauuuggaauuuuuuucagugg

SEQ ID NO: 362708 - RNA, 64 nt, Homo Sapiens
uucuauucauaaucaggguaagacaaguuauuaaaaaggaaaggucauuggaauuuauauuaaa

SEQ ID NO: 362709 - RNA, 64 nt, Homo Sapiens
aauaaguauucuugcaucugaugucuucuauuuaaaaggaaaagacuuucauaaauuuuauggc

SEQ ID NO: 362710 - RNA, 64 nt, Homo Sapiens
aaguauauugcugcacuuuuaccauuucguagauaaaggaaacucaguuuugaauuggaauugc

SEQ ID NO: 362711 - RNA, 64 nt, Homo Sapiens
cagcaaaacaaaaagcaaacgagucccugaguauaaaggaaaaaucuguuuaaguugaaagcaa

SEQ ID NO: 362712 - RNA, 64 nt, Homo Sapiens
agauuauuguaaauauuuuauuguauucaaagaaaaaggaaaaaaaaacauuuuugucauauuc

SEQ ID NO: 362713 - RNA, 64 nt, Homo Sapiens
gcuuuagaaauuuuaacuccaacagaacaaaagcaaaggaaaauauaaagacaaacuaaaacaa

SEQ ID NO: 362714 - RNA, 64 nt, Homo Sapiens
cugaaagcuuguucuaucacaauguaaaggaaagaaaggaaaaacuguuucacugugaauagug

SEQ ID NO: 362715 - RNA, 64 nt, Homo Sapiens
aaggaaaaacugaaagcuugugaauagugaauguaaaggaaagaaacaugcaccuguuucacug

SEQ ID NO: 362716 - RNA, 64 nt, Homo Sapiens
aaaacacagaguuguaaauagaguaaaaucuccuaaaggaaauaaagaaagaaacuguauuuca

SEQ ID NO: 362717 - RNA, 64 nt, Homo Sapiens
aaauauguaaauucuauugaaugaaaaccauuuuaaaggaaagaucaaauugauuauacaggcu

SEQ ID NO: 362718 - RNA, 64 nt, Homo Sapiens
acucuaguuuugcaaguauaacauuuucccauuuaaaggaaaacugaagccccaaggacacaaa

SEQ ID NO: 362719 - RNA, 64 nt, Homo Sapiens
ucccuguuucaaaaucuauucuaggugcaagugcaaaggaaauuaguucagcauuuuuagggac

SEQ ID NO: 362720 - RNA, 64 nt, Homo Sapiens
auucuggaugguucuuugacaauagucacuuuaaaaaggaaaugaggacauugaaagcgacaua

SEQ ID NO: 362721 - RNA, 64 nt, Homo Sapiens
uguagacucugacuuccgucauaugaccauugaaaaaggaaaaaaaauaacuuuaauuaggauc

SEQ ID NO: 362722 - RNA, 64 nt, Homo Sapiens
cagugggucugguggugcugccaugauaccuauuaaaggaaaacuucaguggguuaauuauacc

SEQ ID NO: 362723 - RNA, 64 nt, Homo Sapiens
auggaaggguucacgcugaugaugucaugugaucaaaggaaaccaaggagaaggaaaucauaau

SEQ ID NO: 362724 - RNA, 64 nt, Homo Sapiens
uuuuaaaacugcaacaagagcagauauccaaaguaaaggaaauggaaaauguaaugaauuuuau

SEQ ID NO: 362725 - RNA, 64 nt, Homo Sapiens
uuacuaauaguaugcuguuaauuguguaagaaagaaaggaaauuagaaaacauauuugcauaaa

SEQ ID NO: 362726 - RNA, 64 nt, Homo Sapiens
aaagucugugaaaaaaaacaaaaguaaaguuauaaaaggaaaagaaaacagaggcuuuaaauua

SEQ ID NO: 362727 - RNA, 64 nt, Homo Sapiens
ucacgccuagcaguuucugguuccuuuaacagcaaaaggaaagagagguucugauucuuaccuc

SEQ ID NO: 362728 - RNA, 64 nt, Homo Sapiens
ucagcaucuccuugccuguuuucuuuauuaguccaaaggaaaacaacagcaacaaaaucuguuu

SEQ ID NO: 362729 - RNA, 64 nt, Homo Sapiens
aauauucaucauacucuaauuaucuagcaaguagaaaggaaaaaacauauuuauggacuuugag

SEQ ID NO: 362730 - RNA, 64 nt, Homo Sapiens
aaaauauacaugaugggauuuaucucaaaaacaaaaaggaaaagugaguaacaaaaugagaccc

SEQ ID NO: 362731 - RNA, 64 nt, Homo Sapiens
aagccacuugauccucaacauauacuauaauugcaaaggaaacaugaggccaucuucccuuguu

SEQ ID NO: 362732 - RNA, 64 nt, Homo Sapiens
aaaagugaccuuaacuguauuuauucucaaagggaaaggaaauaucagauguuuauuugguuau

SEQ ID NO: 362733 - RNA, 64 nt, Homo Sapiens
ccgguuuuaguugagucuucacauuuagaauuugaaaggaaaaacagaacauuucucaugugcu

SEQ ID NO: 362734 - RNA, 64 nt, Homo Sapiens
acagaacauuucucaugugcuuuguagcuuaaaaaaaggaaaacucaccauuucauccauauuu

SEQ ID NO: 362735 - RNA, 64 nt, Homo Sapiens
gucggguuagugguaguauuauuguuauuuuuuuaaaggaaacaaacagacaacaaaaagaaga

SEQ ID NO: 362736 - RNA, 64 nt, Homo Sapiens
uauuacccccccacuaugcccucauuuuuuuaaaaaaggaaaaaaaaaagaaacuggguuccag

SEQ ID NO: 362737 - RNA, 64 nt, Homo Sapiens
aaauaaaaaaauaaauaaaaauaaaaaaaauaaaaaaggaaaaaaaaaaaagaagaaacaagac

SEQ ID NO: 362738 - RNA, 64 nt, Homo Sapiens
caucucuugugacagccuggggcguccugucuguaaaggaaauuuagaccauggccuguuagga

SEQ ID NO: 362739 - RNA, 64 nt, Homo Sapiens
cugagaugguugccaggacuauuggggaaucaggaaaggaaagaguaaaaguggucccgcuacc

SEQ ID NO: 362740 - RNA, 64 nt, Homo Sapiens
gguaugaguacauuuuuaauaagauuuauuuaaaaaaggaaaaauuuugaaaagaugaaaaaua

SEQ ID NO: 362741 - RNA, 64 nt, Homo Sapiens
ugaauaaauggagagagagagagggccacuuuacaaaggaaauugagaaauuuaagucuucacu

SEQ ID NO: 362742 - RNA, 64 nt, Homo Sapiens
uggcuggggcuauauauacuggaaguugaagguuaaaggaaaagcacaagaaacuuuggaagca

SEQ ID NO: 362743 - RNA, 64 nt, Homo Sapiens
agucccuuuauaaagagugcuacaugguuuagauaaaggaaacauauaacuauugaguuacagg

SEQ ID NO: 362744 - RNA, 64 nt, Homo Sapiens
agaaccugggauaauucuuuacuuuuuuugaaauaaaggaaaggaaauucagacucuuacauug

SEQ ID NO: 362745 - RNA, 64 nt, Homo Sapiens
cugggauaauucuuuacuuuuuuugaaauaaaggaaaggaaauucagacucuuacauuguucuc

SEQ ID NO: 362746 - RNA, 64 nt, Homo Sapiens
uaagaaggcauuuaauccaguaucucuaguguacaaaggaaacuugaaguuuuaauggauuauu

SEQ ID NO: 362747 - RNA, 64 nt, Homo Sapiens
gauauagcauaguauguuuauccauucgcccauuaaaggaaaucuugauugcuuccaguuuuca

SEQ ID NO: 362748 - RNA, 64 nt, Homo Sapiens
cuuucuggcuccugauaggguggagcaaaaguggaaaggaaaggaaagaggccuuuucucacag

SEQ ID NO: 362749 - RNA, 64 nt, Homo Sapiens
uggcuccugauaggguggagcaaaaguggaaaggaaaggaaagaggccuuuucucacagccauu

SEQ ID NO: 362750 - RNA, 64 nt, Homo Sapiens
uccugcucacacuccagaauuaaauucuauugaaaaaggaaaaucagcaauucagcaaaaaaua

SEQ ID NO: 362751 - RNA, 64 nt, Homo Sapiens
uuaaugacagauguucuguuuuuauaaccuaccaaaaggaaacuagaggcuucuuggugaagag

SEQ ID NO: 362752 - RNA, 64 nt, Homo Sapiens
auccuucccuagagcuaguagauacgcuguuuaaaaaggaaaaauccauccuaggcaacagagu

SEQ ID NO: 362753 - RNA, 64 nt, Homo Sapiens
aggagaagguggaaauggguaacagaaggaaaaaaaaggaaaauacagagugagacuccaucuc

SEQ ID NO: 362754 - RNA, 64 nt, Homo Sapiens
agaaaagauuuuugcagaauuuuaacagaagggaaaaggaaagaaaaaagaaaggacauugagu

SEQ ID NO: 362755 - RNA, 64 nt, Homo Sapiens
aaaaaaagaaaggacauugaggugccuggagcaaaaaggaaaaacugagcagaacaaaucguca

SEQ ID NO: 362756 - RNA, 64 nt, Homo Sapiens
ugaaaucugcugcugaacuuguuagacauuuuugaaaggaaaauuagguuagcguacaauuuau

SEQ ID NO: 362757 - RNA, 64 nt, Homo Sapiens
acuuacugcaaaguuuguuuauacuuuugccuaaaaaggaaauuggaugggauacuguggcaaa

SEQ ID NO: 362758 - RNA, 64 nt, Homo Sapiens
uuggcucuuuuuuuaaaagaugcgcucuaccugaaaaggaaauuggauuuuagaacuggaugug

SEQ ID NO: 362759 - RNA, 64 nt, Homo Sapiens
uauaaaaccucuugcuugugugcaaaaguuccuaaaaggaaacacaaguaaugccuauccauua

SEQ ID NO: 362760 - RNA, 64 nt, Homo Sapiens
gaauagaaacuugaagugcuaaauggaauaauccaaaggaaauuuuuuaaaugcagguucuagc

SEQ ID NO: 362761 - RNA, 64 nt, Homo Sapiens
aaguuaaaccauucugggauuugggaacuucuuuaaaggaaaauuguaguagaggucaucuuga

SEQ ID NO: 362762 - RNA, 64 nt, Homo Sapiens
agcauacauuucugccacauucuuaaguagcaaaaaaggaaaagugcuuuccuccucugcagga

SEQ ID NO: 362763 - RNA, 64 nt, Homo Sapiens
uacaacaacaaaaaaacuauauuaaacaggguuuaaaggaaauuaaaacagaacuaugagaagu

SEQ ID NO: 362764 - RNA, 64 nt, Homo Sapiens
caaguguggggagucaugggguguggaggggaggaaaggaaagguauuuuguuucuuugucuau

SEQ ID NO: 362765 - RNA, 64 nt, Homo Sapiens
gaugaaagcuuuaauuuagaaagaaaguucaaguaaaggaaauuauuuugauuaaauauauuuu

SEQ ID NO: 362766 - RNA, 64 nt, Homo Sapiens
aagggguggccugacacuggaaaaaaaaaaaaggaaaggaaagauuuacauaauuuguaccaaa

SEQ ID NO: 362767 - RNA, 64 nt, Homo Sapiens
aaagaaagggguggccugacccaaaaaaaaaaaaaaaggaaaggaauguuuuacauaauuugua

SEQ ID NO: 362768 - RNA, 64 nt, Homo Sapiens
gagaccgaaaacuuagggucgaucuaucaaaggaaaaggaaacucuguucauacagugaauaaa

SEQ ID NO: 362769 - RNA, 64 nt, Homo Sapiens
gaaacugagaccgaaaacuuaauaaagaucuaucaaaggaaaaggugacucuguucauacagug

SEQ ID NO: 362770 - RNA, 64 nt, Homo Sapiens
auaaauacauauuguuuaaaaaaaagcaagaaaaaaaggaaaacaaaggaaaauauccccaaag

SEQ ID NO: 362771 - RNA, 64 nt, Homo Sapiens
auuguuuaaaaaaaagcaagaaaaaaaggaaaacaaaggaaaauauccccaaaguuguuuucua

SEQ ID NO: 362772 - RNA, 64 nt, Homo Sapiens
cauuuagucugcauuuccugaaaauguguaaaugaaaggaaaguuagggaaccacuucauucug

SEQ ID NO: 362773 - RNA, 64 nt, Homo Sapiens
auauguuaaugaacauauagaggaaguuuuauuuaaaggaaagaucaugcucacaacuaagcau

SEQ ID NO: 362774 - RNA, 64 nt, Homo Sapiens
ccucgagauuuuggaauucgugcaggaagccaugaaaggaaagaucagugaagacagcaaucac

SEQ ID NO: 362775 - RNA, 64 nt, Homo Sapiens
cacuuguaauuuuaugugcuuucaucacaaauccaaaggaaagaauaaaaauuucuuaacacaa

SEQ ID NO: 362776 - RNA, 64 nt, Homo Sapiens
acucucagcaaacacgggacuguguucaguccacaaaggaaaagcguuuuugaagcucucauug

SEQ ID NO: 362777 - RNA, 64 nt, Homo Sapiens
uagcaucacuauagggggucaauauuuacacaaaaaaggaaagucacaagccuguuuaaaauga

SEQ ID NO: 362778 - RNA, 64 nt, Homo Sapiens
aggcauaaaaugaccuucuauuuaucacugcuaaaaaggaaaaaaauuaauagguugcuaauua

SEQ ID NO: 362779 - RNA, 64 nt, Homo Sapiens
aaaaagcacuuuuuucuuaaaaaaaaaaagaaagaaaggaaaacauacuuuucuggcaaaaaaa

SEQ ID NO: 362780 - RNA, 64 nt, Homo Sapiens
cagaacaugcaaaaggccugaauucaggagaacaaaaggaaacacuagaugaggacaugagaau

SEQ ID NO: 362781 - RNA, 64 nt, Homo Sapiens
agauccuccccucugcuuuuuaagaaaggaaaggaaaggaaaacggucaaauugauacccuuaa

SEQ ID NO: 362782 - RNA, 64 nt, Homo Sapiens
aaaacagauccuccccucugcuuaauaagaaaggaaaggaaaggcuuauggucaaauugauacc

SEQ ID NO: 362783 - RNA, 64 nt, Homo Sapiens
aaaggaaaacagauccucccauacccuuaauaagaaaggaaaggcuugucuuauggucaaauug

SEQ ID NO: 362784 - RNA, 64 nt, Homo Sapiens
caggcaaagggauccauaugcauaaaaaggaaaaaaaggaaacuuccugcugggucuuaacaag

SEQ ID NO: 362785 - RNA, 64 nt, Homo Sapiens
aaggaaacucaggcaaagggcuuaacaagcauaaaaaggaaaaagacguccauuccugcugggu

SEQ ID NO: 362786 - RNA, 64 nt, Homo Sapiens
aggaggugccgggggccuggguucagcagggaccaaaggaaaggugguggcucuaggaauuggg

SEQ ID NO: 362787 - RNA, 64 nt, Homo Sapiens
uugagguggcagagcagaccgcugcaguccagagaaaggaaagauucuugaccugguggaugug

SEQ ID NO: 362788 - RNA, 64 nt, Homo Sapiens
aaauaaauugggccagggugggagcagggaaagaaaaggaaaauaguagcaagagcugcaaagc

SEQ ID NO: 362789 - RNA, 64 nt, Homo Sapiens
acagacuuuaggaucacgugugugacuaauacagaaaggaaacauggcgucggggagagggaua

SEQ ID NO: 362790 - RNA, 64 nt, Homo Sapiens
ggaugcugguauuuuaacagauggagagacaaggaaaggaaaggaaaggccuggcaugggcauu

SEQ ID NO: 362791 - RNA, 64 nt, Homo Sapiens
cugguauuuuaacagauggagagacaaggaaaggaaaggaaaggccuggcaugggcauugugag

SEQ ID NO: 362792 - RNA, 64 nt, Homo Sapiens
uuuaucccauauucaaauaaguaacuuaugaauaaaaggaaaagagguauacuuacaaugugaa

SEQ ID NO: 362793 - RNA, 64 nt, Homo Sapiens
ugauuucaaacauugacaaguuuaccaagcauauaaaggaaaaagcuuucuuggaaagacucac

SEQ ID NO: 362794 - RNA, 64 nt, Homo Sapiens
ccuaccuuuuccauccuccuccucugccuucaaaaaaggaaacuuucccuugguugucuuaauu

SEQ ID NO: 362795 - RNA, 64 nt, Homo Sapiens
cgguaaauggcauccccuuaggcgccucuuugggaaaggaaaguggaugcuccuuugaggcagg

SEQ ID NO: 362796 - RNA, 64 nt, Homo Sapiens
gccacaaagaagaaaaagaaacaguuugggaagaaaaggaaaagaaucccgcccacuaagacgc

SEQ ID NO: 362797 - RNA, 64 nt, Homo Sapiens
uuucuguguuugugaggacugacucccauuuccuaaaggaaaugcccccggggaggacauuggg

SEQ ID NO: 362798 - RNA, 64 nt, Homo Sapiens
auuaagcauaugugcuuucgcagcugauaauauaaaaggaaaucccacagucuagauauagccc

SEQ ID NO: 362799 - RNA, 64 nt, Homo Sapiens
cuaccuaauuuucaagcauggaucuccauauuucaaaggaaaguuuuaaaaauguuuuuaaaac

SEQ ID NO: 362800 - RNA, 64 nt, Homo Sapiens
uggggaggucuuuuuuuucuucguugugcucacgaaaggaaaaagaggaauggcuuuguggucg

SEQ ID NO: 362801 - RNA, 64 nt, Homo Sapiens
ucgggacucuauucauccacgcacuaccagaagaaaaggaaaccgguugaaagugaaacuuuga

SEQ ID NO: 362802 - RNA, 64 nt, Homo Sapiens
aaucaguguccguuugccagaugggacacauuucaaaggaaauaaacuuguauaguguguuuaa

SEQ ID NO: 362803 - RNA, 64 nt, Homo Sapiens
gacuuuuuuuuuaaacuuuagccuucaguuuaaaaaaggaaaagacaaaaaaaaucugaauuca

SEQ ID NO: 362804 - RNA, 64 nt, Homo Sapiens
acagugcagaauuaaaccgucuacugugacaugcaaaggaaaggaauauuuaaugugugaacag

SEQ ID NO: 362805 - RNA, 64 nt, Homo Sapiens
accaguuuagacuaaguuaccauaagagaggagcaaaggaaauuaucuuuaaauuuucccacac

SEQ ID NO: 362806 - RNA, 64 nt, Homo Sapiens
uuuuaaaagccacguuauaguuuguuccagaauaaaaggaaauaucauuguccuuucuccaguu

SEQ ID NO: 362807 - RNA, 64 nt, Homo Sapiens
uguuacagaaaagacaagaagagaacauaagagaaaaggaaaccaaagaacauaagaacucaag

SEQ ID NO: 362808 - RNA, 64 nt, Homo Sapiens
agaggaggauagagucaaggcaagagcaucagacaaaggaaaaggauacagauuuagacaaaga

SEQ ID NO: 362809 - RNA, 64 nt, Homo Sapiens
gaguuaugaagauacagauugcaguccaagcauaaaaggaaaaaaaagaaaggccagagaaaga

SEQ ID NO: 362810 - RNA, 64 nt, Homo Sapiens
ugcuuuaggcaugagucauaguaugcagguuugaaaaggaaauggguguaaaaagggaauaacu

SEQ ID NO: 362811 - RNA, 64 nt, Homo Sapiens
cgucauuaaucuaaagacagugaauaagugaaauaaaggaaacuuuuauuucauacuaaacuag

SEQ ID NO: 362812 - RNA, 64 nt, Homo Sapiens; identical to SEQ ID NO: 89176

SEQ ID NO: 362813 - RNA, 64 nt, Homo Sapiens; identical to SEQ ID NO: 89177

SEQ ID NO: 362814 - RNA, 64 nt, Homo Sapiens; identical to SEQ ID NO: 89178

SEQ ID NO: 362815 - RNA, 64 nt, Homo Sapiens; identical to SEQ ID NO: 89179

SEQ ID NO: 362816 - RNA, 64 nt, Homo Sapiens; identical to SEQ ID NO: 89180

SEQ ID NO: 362817 - RNA, 64 nt, Homo Sapiens; identical to SEQ ID NO: 89181

SEQ ID NO: 362818 - RNA, 64 nt, Homo Sapiens
gaggaugucagcugccaauuguguuuuccugcagcaauuccauaaacacauccuggugucauca

SEQ ID NO: 362819 - RNA, 64 nt, Homo Sapiens
cuugagauucuuuauacucucugccuucagcaaucaauuccauucauacaucagcacucugcug

SEQ ID NO: 362820 - RNA, 64 nt, Homo Sapiens
gaucacugccagagauaaacuaaugguccacacccaauuccacucugauagaauuauuucacaa

SEQ ID NO: 362821 - RNA, 64 nt, Homo Sapiens
agguguuuguuuaauggacacuuuucaccuccuucaauuccauauauccuuuucuucuauguag

SEQ ID NO: 362822 - RNA, 64 nt, Homo Sapiens
auugccaccaagcccacguacccgcccaugaacccaauuccagcaccguugccuccugacauac

SEQ ID NO: 362823 - RNA, 64 nt, Homo Sapiens
cucaagauuuuuggagagcagagguggucucuggcaauuccaucugguuuugagaaacuuagca

SEQ ID NO: 362824 - RNA, 64 nt, Homo Sapiens
guuucaccccuuuucuuccuucagcagaggccaggcuauggagcagggccacugaauuugcugu

SEQ ID NO: 362825 - RNA, 64 nt, Homo Sapiens
auaucacucuucagguuuagcuuacagagccauggcuauggauucuuagcucuguaaggaagug

SEQ ID NO: 362826 - RNA, 64 nt, Homo Sapiens
ggcugcuaauaccuuggacuuuggacagaauggagcuauggacguuaauuugaccgucuacucc

SEQ ID NO: 362827 - RNA, 64 nt, Homo Sapiens
ggcuucugaagguaaagggacacuggauccagaagcuauggaaccagcaguugauucuuguauu

SEQ ID NO: 362828 - RNA, 64 nt, Homo Sapiens; identical to SEQ ID NO: 133550

SEQ ID NO: 362829 - RNA, 64 nt, Homo Sapiens; identical to SEQ ID NO: 133551

SEQ ID NO: 362830 - RNA, 64 nt, Homo Sapiens; identical to SEQ ID NO: 133552

SEQ ID NO: 362831 - RNA, 64 nt, Homo Sapiens; identical to SEQ ID NO: 133553

SEQ ID NO: 362832 - RNA, 64 nt, Homo Sapiens; identical to SEQ ID NO: 133554

SEQ ID NO: 362833 - RNA, 64 nt, Homo Sapiens; identical to SEQ ID NO: 133555

SEQ ID NO: 362834 - RNA, 64 nt, Homo Sapiens; identical to SEQ ID NO: 133556

SEQ ID NO: 362835 - RNA, 64 nt, Homo Sapiens; identical to SEQ ID NO: 133557

SEQ ID NO: 362836 - RNA, 64 nt, Homo Sapiens; identical to SEQ ID NO: 133558

SEQ ID NO: 362837 - RNA, 64 nt, Homo Sapiens; identical to SEQ ID NO: 133559

SEQ ID NO: 362838 - RNA, 64 nt, Homo Sapiens; identical to SEQ ID NO: 133560

SEQ ID NO: 362839 - RNA, 64 nt, Homo Sapiens; identical to SEQ ID NO: 133561

SEQ ID NO: 362840 - RNA, 64 nt, Homo Sapiens; identical to SEQ ID NO: 133562

SEQ ID NO: 362841 - RNA, 64 nt, Homo Sapiens; identical to SEQ ID NO: 133563

SEQ ID NO: 362842 - RNA, 64 nt, Homo Sapiens; identical to SEQ ID NO: 133564

SEQ ID NO: 362843 - RNA, 64 nt, Homo Sapiens; identical to SEQ ID NO: 133565

SEQ ID NO: 362844 - RNA, 64 nt, Homo Sapiens; identical to SEQ ID NO: 133566

SEQ ID NO: 362845 - RNA, 64 nt, Homo Sapiens; identical to SEQ ID NO: 133567

SEQ ID NO: 362846 - RNA, 64 nt, Homo Sapiens; identical to SEQ ID NO: 133568

SEQ ID NO: 362847 - RNA, 64 nt, Homo Sapiens; identical to SEQ ID NO: 133569

SEQ ID NO: 362848 - RNA, 64 nt, Homo Sapiens; identical to SEQ ID NO: 133570

SEQ ID NO: 362849 - RNA, 64 nt, Homo Sapiens; identical to SEQ ID NO: 133571

SEQ ID NO: 362850 - RNA, 64 nt, Homo Sapiens; identical to SEQ ID NO: 133572

SEQ ID NO: 362851 - RNA, 64 nt, Homo Sapiens; identical to SEQ ID NO: 133573

SEQ ID NO: 362852 - RNA, 64 nt, Homo Sapiens; identical to SEQ ID NO: 133574

SEQ ID NO: 362853 - RNA, 64 nt, Homo Sapiens; identical to SEQ ID NO: 133575

SEQ ID NO: 362854 - RNA, 64 nt, Homo Sapiens; identical to SEQ ID NO: 133576

SEQ ID NO: 362855 - RNA, 64 nt, Homo Sapiens; identical to SEQ ID NO: 133577

SEQ ID NO: 362856 - RNA, 64 nt, Homo Sapiens; identical to SEQ ID NO: 133578

SEQ ID NO: 362857 - RNA, 64 nt, Homo Sapiens; identical to SEQ ID NO: 133579

SEQ ID NO: 362858 - RNA, 64 nt, Homo Sapiens; identical to SEQ ID NO: 133580

SEQ ID NO: 362859 - RNA, 64 nt, Homo Sapiens; identical to SEQ ID NO: 133581

SEQ ID NO: 362860 - RNA, 64 nt, Homo Sapiens; identical to SEQ ID NO: 133582

SEQ ID NO: 362861 - RNA, 64 nt, Homo Sapiens; identical to SEQ ID NO: 133583

SEQ ID NO: 362862 - RNA, 64 nt, Homo Sapiens; identical to SEQ ID NO: 133584

SEQ ID NO: 362863 - RNA, 64 nt, Homo Sapiens; identical to SEQ ID NO: 133585

SEQ ID NO: 362864 - RNA, 64 nt, Homo Sapiens; identical to SEQ ID NO: 133586

SEQ ID NO: 362865 - RNA, 64 nt, Homo Sapiens; identical to SEQ ID NO: 133587

SEQ ID NO: 362866 - RNA, 64 nt, Homo Sapiens; identical to SEQ ID NO: 133588

SEQ ID NO: 362867 - RNA, 64 nt, Homo Sapiens; identical to SEQ ID NO: 133589

SEQ ID NO: 362868 - RNA, 64 nt, Homo Sapiens; identical to SEQ ID NO: 133590

SEQ ID NO: 362869 - RNA, 64 nt, Homo Sapiens; identical to SEQ ID NO: 133591

SEQ ID NO: 362870 - RNA, 64 nt, Homo Sapiens; identical to SEQ ID NO: 133592

SEQ ID NO: 362871 - RNA, 64 nt, Homo Sapiens; identical to SEQ ID NO: 133593

SEQ ID NO: 362872 - RNA, 64 nt, Homo Sapiens; identical to SEQ ID NO: 133594

SEQ ID NO: 362873 - RNA, 64 nt, Homo Sapiens; identical to SEQ ID NO: 133595

SEQ ID NO: 362874 - RNA, 64 nt, Homo Sapiens; identical to SEQ ID NO: 133596

SEQ ID NO: 362875 - RNA, 64 nt, Homo Sapiens; identical to SEQ ID NO: 133597

SEQ ID NO: 362876 - RNA, 64 nt, Homo Sapiens; identical to SEQ ID NO: 133598

SEQ ID NO: 362877 - RNA, 64 nt, Homo Sapiens; identical to SEQ ID NO: 133599

SEQ ID NO: 362878 - RNA, 64 nt, Homo Sapiens; identical to SEQ ID NO: 133600

SEQ ID NO: 362879 - RNA, 64 nt, Homo Sapiens; identical to SEQ ID NO: 133601

SEQ ID NO: 362880 - RNA, 64 nt, Homo Sapiens; identical to SEQ ID NO: 133602

SEQ ID NO: 362881 - RNA, 64 nt, Homo Sapiens; identical to SEQ ID NO: 133603

SEQ ID NO: 362882 - RNA, 64 nt, Homo Sapiens; identical to SEQ ID NO: 133604

SEQ ID NO: 362883 - RNA, 64 nt, Homo Sapiens; identical to SEQ ID NO: 133605

SEQ ID NO: 362884 - RNA, 64 nt, Homo Sapiens; identical to SEQ ID NO: 133606

SEQ ID NO: 362885 - RNA, 64 nt, Homo Sapiens; identical to SEQ ID NO: 133607

SEQ ID NO: 362886 - RNA, 64 nt, Homo Sapiens; identical to SEQ ID NO: 133608

SEQ ID NO: 362887 - RNA, 64 nt, Homo Sapiens; identical to SEQ ID NO: 133609

SEQ ID NO: 362888 - RNA, 64 nt, Homo Sapiens; identical to SEQ ID NO: 133610

SEQ ID NO: 362889 - RNA, 52 nt, Homo Sapiens; identical to SEQ ID NO: 133611

SEQ ID NO: 362890 - RNA, 55 nt, Homo Sapiens; identical to SEQ ID NO: 133612

SEQ ID NO: 362891 - RNA, 64 nt, Homo Sapiens; identical to SEQ ID NO: 133613

SEQ ID NO: 362892 - RNA, 64 nt, Homo Sapiens; identical to SEQ ID NO: 133614

SEQ ID NO: 362893 - RNA, 64 nt, Homo Sapiens; identical to SEQ ID NO: 133615

SEQ ID NO: 362894 - RNA, 64 nt, Homo Sapiens; identical to SEQ ID NO: 133616

SEQ ID NO: 362895 - RNA, 64 nt, Homo Sapiens; identical to SEQ ID NO: 133617

SEQ ID NO: 362896 - RNA, 64 nt, Homo Sapiens; identical to SEQ ID NO: 133618

SEQ ID NO: 362897 - RNA, 64 nt, Homo Sapiens; identical to SEQ ID NO: 133619

SEQ ID NO: 362898 - RNA, 64 nt, Homo Sapiens; identical to SEQ ID NO: 133620

SEQ ID NO: 362899 - RNA, 64 nt, Homo Sapiens; identical to SEQ ID NO: 133621

SEQ ID NO: 362900 - RNA, 64 nt, Homo Sapiens; identical to SEQ ID NO: 133622

SEQ ID NO: 362901 - RNA, 64 nt, Homo Sapiens; identical to SEQ ID NO: 133623

SEQ ID NO: 362902 - RNA, 64 nt, Homo Sapiens; identical to SEQ ID NO: 133624

SEQ ID NO: 362903 - RNA, 64 nt, Homo Sapiens; identical to SEQ ID NO: 133625

SEQ ID NO: 362904 - RNA, 64 nt, Homo Sapiens; identical to SEQ ID NO: 133626

SEQ ID NO: 362905 - RNA, 64 nt, Homo Sapiens; identical to SEQ ID NO: 133627

SEQ ID NO: 362906 - RNA, 64 nt, Homo Sapiens; identical to SEQ ID NO: 133628

SEQ ID NO: 362907 - RNA, 64 nt, Homo Sapiens; identical to SEQ ID NO: 133629

SEQ ID NO: 362908 - RNA, 64 nt, Homo Sapiens; identical to SEQ ID NO: 133630

SEQ ID NO: 362909 - RNA, 64 nt, Homo Sapiens; identical to SEQ ID NO: 133631

SEQ ID NO: 362910 - RNA, 64 nt, Homo Sapiens; identical to SEQ ID NO: 133632

SEQ ID NO: 362911 - RNA, 64 nt, Homo Sapiens; identical to SEQ ID NO: 133633

SEQ ID NO: 362912 - RNA, 64 nt, Homo Sapiens; identical to SEQ ID NO: 133634

SEQ ID NO: 362913 - RNA, 64 nt, Homo Sapiens; identical to SEQ ID NO: 133635

SEQ ID NO: 362914 - RNA, 64 nt, Homo Sapiens; identical to SEQ ID NO: 133636

SEQ ID NO: 362915 - RNA, 64 nt, Homo Sapiens; identical to SEQ ID NO: 133637

SEQ ID NO: 362916 - RNA, 64 nt, Homo Sapiens; identical to SEQ ID NO: 133638

SEQ ID NO: 362917 - RNA, 63 nt, Homo Sapiens; identical to SEQ ID NO: 133639

SEQ ID NO: 362918 - RNA, 51 nt, Homo Sapiens; identical to SEQ ID NO: 133640

SEQ ID NO: 362919 - RNA, 64 nt, Homo Sapiens; identical to SEQ ID NO: 133641

SEQ ID NO: 362920 - RNA, 64 nt, Homo Sapiens; identical to SEQ ID NO: 133642

SEQ ID NO: 362921 - RNA, 64 nt, Homo Sapiens; identical to SEQ ID NO: 133643

SEQ ID NO: 362922 - RNA, 64 nt, Homo Sapiens; identical to SEQ ID NO: 133644

SEQ ID NO: 362923 - RNA, 64 nt, Homo Sapiens; identical to SEQ ID NO: 133645

SEQ ID NO: 362924 - RNA, 64 nt, Homo Sapiens; identical to SEQ ID NO: 133646

SEQ ID NO: 362925 - RNA, 64 nt, Homo Sapiens; identical to SEQ ID NO: 133647

SEQ ID NO: 362926 - RNA, 64 nt, Homo Sapiens; identical to SEQ ID NO: 133648

SEQ ID NO: 362927 - RNA, 64 nt, Homo Sapiens; identical to SEQ ID NO: 133649

SEQ ID NO: 362928 - RNA, 64 nt, Homo Sapiens; identical to SEQ ID NO: 133650

SEQ ID NO: 362929 - RNA, 64 nt, Homo Sapiens; identical to SEQ ID NO: 133651

SEQ ID NO: 362930 - RNA, 64 nt, Homo Sapiens; identical to SEQ ID NO: 133652

SEQ ID NO: 362931 - RNA, 64 nt, Homo Sapiens; identical to SEQ ID NO: 133653

SEQ ID NO: 362932 - RNA, 64 nt, Homo Sapiens; identical to SEQ ID NO: 133654

SEQ ID NO: 362933 - RNA, 64 nt, Homo Sapiens; identical to SEQ ID NO: 133655

SEQ ID NO: 362934 - RNA, 64 nt, Homo Sapiens; identical to SEQ ID NO: 133656

SEQ ID NO: 362935 - RNA, 64 nt, Homo Sapiens; identical to SEQ ID NO: 133657

SEQ ID NO: 362936 - RNA, 64 nt, Homo Sapiens; identical to SEQ ID NO: 133658

SEQ ID NO: 362937 - RNA, 64 nt, Homo Sapiens; identical to SEQ ID NO: 133659

SEQ ID NO: 362938 - RNA, 64 nt, Homo Sapiens; identical to SEQ ID NO: 133660

SEQ ID NO: 362939 - RNA, 64 nt, Homo Sapiens; identical to SEQ ID NO: 133661

SEQ ID NO: 362940 - RNA, 64 nt, Homo Sapiens; identical to SEQ ID NO: 133662

SEQ ID NO: 362941 - RNA, 64 nt, Homo Sapiens; identical to SEQ ID NO: 133663

SEQ ID NO: 362942 - RNA, 64 nt, Homo Sapiens; identical to SEQ ID NO: 133664

SEQ ID NO: 362943 - RNA, 64 nt, Homo Sapiens; identical to SEQ ID NO: 133665

SEQ ID NO: 362944 - RNA, 64 nt, Homo Sapiens; identical to SEQ ID NO: 133666

SEQ ID NO: 362945 - RNA, 64 nt, Homo Sapiens; identical to SEQ ID NO: 133667

SEQ ID NO: 362946 - RNA, 64 nt, Homo Sapiens; identical to SEQ ID NO: 133668

SEQ ID NO: 362947 - RNA, 64 nt, Homo Sapiens; identical to SEQ ID NO: 133669

SEQ ID NO: 362948 - RNA, 64 nt, Homo Sapiens; identical to SEQ ID NO: 133670

SEQ ID NO: 362949 - RNA, 64 nt, Homo Sapiens; identical to SEQ ID NO: 133671

SEQ ID NO: 362950 - RNA, 64 nt, Homo Sapiens; identical to SEQ ID NO: 133672

SEQ ID NO: 362951 - RNA, 64 nt, Homo Sapiens; identical to SEQ ID NO: 133673

SEQ ID NO: 362952 - RNA, 64 nt, Homo Sapiens; identical to SEQ ID NO: 133674

SEQ ID NO: 362953 - RNA, 64 nt, Homo Sapiens; identical to SEQ ID NO: 133675

SEQ ID NO: 362954 - RNA, 64 nt, Homo Sapiens; identical to SEQ ID NO: 133676

SEQ ID NO: 362955 - RNA, 50 nt, Homo Sapiens; identical to SEQ ID NO: 133677

SEQ ID NO: 362956 - RNA, 64 nt, Homo Sapiens; identical to SEQ ID NO: 133678

SEQ ID NO: 362957 - RNA, 64 nt, Homo Sapiens; identical to SEQ ID NO: 133679

SEQ ID NO: 362958 - RNA, 64 nt, Homo Sapiens; identical to SEQ ID NO: 133680

SEQ ID NO: 362959 - RNA, 64 nt, Homo Sapiens; identical to SEQ ID NO: 133681

SEQ ID NO: 362960 - RNA, 64 nt, Homo Sapiens; identical to SEQ ID NO: 133682

SEQ ID NO: 362961 - RNA, 64 nt, Homo Sapiens; identical to SEQ ID NO: 133683

SEQ ID NO: 362962 - RNA, 64 nt, Homo Sapiens; identical to SEQ ID NO: 133684

SEQ ID NO: 362963 - RNA, 64 nt, Homo Sapiens; identical to SEQ ID NO: 133685

SEQ ID NO: 362964 - RNA, 64 nt, Homo Sapiens; identical to SEQ ID NO: 133686

SEQ ID NO: 362965 - RNA, 64 nt, Homo Sapiens; identical to SEQ ID NO: 133687

SEQ ID NO: 362966 - RNA, 64 nt, Homo Sapiens; identical to SEQ ID NO: 133688

SEQ ID NO: 362967 - RNA, 64 nt, Homo Sapiens; identical to SEQ ID NO: 133689

SEQ ID NO: 362968 - RNA, 64 nt, Homo Sapiens; identical to SEQ ID NO: 133690

SEQ ID NO: 362969 - RNA, 64 nt, Homo Sapiens; identical to SEQ ID NO: 133691

SEQ ID NO: 362970 - RNA, 64 nt, Homo Sapiens; identical to SEQ ID NO: 133692

SEQ ID NO: 362971 - RNA, 64 nt, Homo Sapiens; identical to SEQ ID NO: 133693

SEQ ID NO: 362972 - RNA, 64 nt, Homo Sapiens; identical to SEQ ID NO: 133694

SEQ ID NO: 362973 - RNA, 64 nt, Homo Sapiens; identical to SEQ ID NO: 133695

SEQ ID NO: 362974 - RNA, 64 nt, Homo Sapiens; identical to SEQ ID NO: 133696

SEQ ID NO: 362975 - RNA, 64 nt, Homo Sapiens; identical to SEQ ID NO: 133697

SEQ ID NO: 362976 - RNA, 64 nt, Homo Sapiens; identical to SEQ ID NO: 133698

SEQ ID NO: 362977 - RNA, 64 nt, Homo Sapiens; identical to SEQ ID NO: 133699

SEQ ID NO: 362978 - RNA, 64 nt, Homo Sapiens; identical to SEQ ID NO: 133700

SEQ ID NO: 362979 - RNA, 64 nt, Homo Sapiens; identical to SEQ ID NO: 133701

SEQ ID NO: 362980 - RNA, 64 nt, Homo Sapiens; identical to SEQ ID NO: 133702

SEQ ID NO: 362981 - RNA, 64 nt, Homo Sapiens; identical to SEQ ID NO: 133703

SEQ ID NO: 362982 - RNA, 64 nt, Homo Sapiens; identical to SEQ ID NO: 133704

SEQ ID NO: 362983 - RNA, 64 nt, Homo Sapiens; identical to SEQ ID NO: 133705

SEQ ID NO: 362984 - RNA, 64 nt, Homo Sapiens; identical to SEQ ID NO: 133706

SEQ ID NO: 362985 - RNA, 64 nt, Homo Sapiens; identical to SEQ ID NO: 133707

SEQ ID NO: 362986 - RNA, 64 nt, Homo Sapiens; identical to SEQ ID NO: 133708

SEQ ID NO: 362987 - RNA, 64 nt, Homo Sapiens; identical to SEQ ID NO: 133709

SEQ ID NO: 362988 - RNA, 64 nt, Homo Sapiens; identical to SEQ ID NO: 133710

SEQ ID NO: 362989 - RNA, 64 nt, Homo Sapiens; identical to SEQ ID NO: 133711

SEQ ID NO: 362990 - RNA, 64 nt, Homo Sapiens; identical to SEQ ID NO: 133712

SEQ ID NO: 362991 - RNA, 64 nt, Homo Sapiens; identical to SEQ ID NO: 133713

SEQ ID NO: 362992 - RNA, 64 nt, Homo Sapiens; identical to SEQ ID NO: 133714

SEQ ID NO: 362993 - RNA, 64 nt, Homo Sapiens; identical to SEQ ID NO: 133715

SEQ ID NO: 362994 - RNA, 64 nt, Homo Sapiens; identical to SEQ ID NO: 133716

SEQ ID NO: 362995 - RNA, 64 nt, Homo Sapiens; identical to SEQ ID NO: 133717

SEQ ID NO: 362996 - RNA, 64 nt, Homo Sapiens; identical to SEQ ID NO: 133718

SEQ ID NO: 362997 - RNA, 64 nt, Homo Sapiens; identical to SEQ ID NO: 133719

SEQ ID NO: 362998 - RNA, 64 nt, Homo Sapiens; identical to SEQ ID NO: 133720

SEQ ID NO: 362999 - RNA, 64 nt, Homo Sapiens; identical to SEQ ID NO: 133721

SEQ ID NO: 363000 - RNA, 64 nt, Homo Sapiens; identical to SEQ ID NO: 133722

SEQ ID NO: 363001 - RNA, 64 nt, Homo Sapiens; identical to SEQ ID NO: 133723

SEQ ID NO: 363002 - RNA, 64 nt, Homo Sapiens; identical to SEQ ID NO: 133724

SEQ ID NO: 363003 - RNA, 64 nt, Homo Sapiens; identical to SEQ ID NO: 133725

SEQ ID NO: 363004 - RNA, 64 nt, Homo Sapiens; identical to SEQ ID NO: 133726

SEQ ID NO: 363005 - RNA, 64 nt, Homo Sapiens; identical to SEQ ID NO: 133727

SEQ ID NO: 363006 - RNA, 64 nt, Homo Sapiens; identical to SEQ ID NO: 133728

SEQ ID NO: 363007 - RNA, 64 nt, Homo Sapiens; identical to SEQ ID NO: 133729

SEQ ID NO: 363008 - RNA, 64 nt, Homo Sapiens; identical to SEQ ID NO: 133730

SEQ ID NO: 363009 - RNA, 64 nt, Homo Sapiens; identical to SEQ ID NO: 133731

SEQ ID NO: 363010 - RNA, 64 nt, Homo Sapiens; identical to SEQ ID NO: 133732

SEQ ID NO: 363011 - RNA, 64 nt, Homo Sapiens; identical to SEQ ID NO: 133733

SEQ ID NO: 363012 - RNA, 64 nt, Homo Sapiens; identical to SEQ ID NO: 133734

SEQ ID NO: 363013 - RNA, 64 nt, Homo Sapiens; identical to SEQ ID NO: 133735

SEQ ID NO: 363014 - RNA, 64 nt, Homo Sapiens; identical to SEQ ID NO: 133736

SEQ ID NO: 363015 - RNA, 64 nt, Homo Sapiens; identical to SEQ ID NO: 133737

SEQ ID NO: 363016 - RNA, 64 nt, Homo Sapiens; identical to SEQ ID NO: 133738

SEQ ID NO: 363017 - RNA, 64 nt, Homo Sapiens; identical to SEQ ID NO: 133739

SEQ ID NO: 363018 - RNA, 64 nt, Homo Sapiens; identical to SEQ ID NO: 133740

SEQ ID NO: 363019 - RNA, 64 nt, Homo Sapiens; identical to SEQ ID NO: 133741

SEQ ID NO: 363020 - RNA, 64 nt, Homo Sapiens; identical to SEQ ID NO: 133742

SEQ ID NO: 363021 - RNA, 64 nt, Homo Sapiens; identical to SEQ ID NO: 133743

SEQ ID NO: 363022 - RNA, 64 nt, Homo Sapiens; identical to SEQ ID NO: 133744

SEQ ID NO: 363023 - RNA, 64 nt, Homo Sapiens; identical to SEQ ID NO: 133745

SEQ ID NO: 363024 - RNA, 64 nt, Homo Sapiens; identical to SEQ ID NO: 133746

SEQ ID NO: 363025 - RNA, 64 nt, Homo Sapiens; identical to SEQ ID NO: 133747

SEQ ID NO: 363026 - RNA, 64 nt, Homo Sapiens; identical to SEQ ID NO: 133748

SEQ ID NO: 363027 - RNA, 64 nt, Homo Sapiens; identical to SEQ ID NO: 133749

SEQ ID NO: 363028 - RNA, 64 nt, Homo Sapiens; identical to SEQ ID NO: 133750

SEQ ID NO: 363029 - RNA, 64 nt, Homo Sapiens; identical to SEQ ID NO: 133751

SEQ ID NO: 363030 - RNA, 64 nt, Homo Sapiens; identical to SEQ ID NO: 133752

SEQ ID NO: 363031 - RNA, 64 nt, Homo Sapiens; identical to SEQ ID NO: 133753

SEQ ID NO: 363032 - RNA, 64 nt, Homo Sapiens; identical to SEQ ID NO: 133754

SEQ ID NO: 363033 - RNA, 64 nt, Homo Sapiens; identical to SEQ ID NO: 133755

SEQ ID NO: 363034 - RNA, 64 nt, Homo Sapiens; identical to SEQ ID NO: 133756

SEQ ID NO: 363035 - RNA, 64 nt, Homo Sapiens; identical to SEQ ID NO: 133757

SEQ ID NO: 363036 - RNA, 64 nt, Homo Sapiens; identical to SEQ ID NO: 133758

SEQ ID NO: 363037 - RNA, 64 nt, Homo Sapiens; identical to SEQ ID NO: 133759

SEQ ID NO: 363038 - RNA, 64 nt, Homo Sapiens; identical to SEQ ID NO: 133760

SEQ ID NO: 363039 - RNA, 64 nt, Homo Sapiens; identical to SEQ ID NO: 133761

SEQ ID NO: 363040 - RNA, 64 nt, Homo Sapiens; identical to SEQ ID NO: 133762

SEQ ID NO: 363041 - RNA, 64 nt, Homo Sapiens; identical to SEQ ID NO: 133763

SEQ ID NO: 363042 - RNA, 64 nt, Homo Sapiens; identical to SEQ ID NO: 133764

SEQ ID NO: 363043 - RNA, 64 nt, Homo Sapiens; identical to SEQ ID NO: 133765

SEQ ID NO: 363044 - RNA, 60 nt, Homo Sapiens; identical to SEQ ID NO: 133766

SEQ ID NO: 363045 - RNA, 57 nt, Homo Sapiens; identical to SEQ ID NO: 133767

SEQ ID NO: 363046 - RNA, 64 nt, Homo Sapiens; identical to SEQ ID NO: 133768

SEQ ID NO: 363047 - RNA, 64 nt, Homo Sapiens; identical to SEQ ID NO: 133769

SEQ ID NO: 363048 - RNA, 64 nt, Homo Sapiens; identical to SEQ ID NO: 133770

SEQ ID NO: 363049 - RNA, 64 nt, Homo Sapiens; identical to SEQ ID NO: 133771

SEQ ID NO: 363050 - RNA, 64 nt, Homo Sapiens; identical to SEQ ID NO: 133772

SEQ ID NO: 363051 - RNA, 64 nt, Homo Sapiens; identical to SEQ ID NO: 133773

SEQ ID NO: 363052 - RNA, 64 nt, Homo Sapiens; identical to SEQ ID NO: 133774

SEQ ID NO: 363053 - RNA, 64 nt, Homo Sapiens; identical to SEQ ID NO: 133775

SEQ ID NO: 363054 - RNA, 64 nt, Homo Sapiens; identical to SEQ ID NO: 133776

SEQ ID NO: 363055 - RNA, 64 nt, Homo Sapiens; identical to SEQ ID NO: 133777

SEQ ID NO: 363056 - RNA, 64 nt, Homo Sapiens; identical to SEQ ID NO: 133778

SEQ ID NO: 363057 - RNA, 64 nt, Homo Sapiens; identical to SEQ ID NO: 133779

SEQ ID NO: 363058 - RNA, 64 nt, Homo Sapiens; identical to SEQ ID NO: 133780

SEQ ID NO: 363059 - RNA, 64 nt, Homo Sapiens; identical to SEQ ID NO: 133781

SEQ ID NO: 363060 - RNA, 64 nt, Homo Sapiens; identical to SEQ ID NO: 133782

SEQ ID NO: 363061 - RNA, 64 nt, Homo Sapiens; identical to SEQ ID NO: 133783

SEQ ID NO: 363062 - RNA, 64 nt, Homo Sapiens; identical to SEQ ID NO: 133784

SEQ ID NO: 363063 - RNA, 64 nt, Homo Sapiens; identical to SEQ ID NO: 133785

SEQ ID NO: 363064 - RNA, 64 nt, Homo Sapiens; identical to SEQ ID NO: 133786

SEQ ID NO: 363065 - RNA, 64 nt, Homo Sapiens; identical to SEQ ID NO: 133787

SEQ ID NO: 363066 - RNA, 64 nt, Homo Sapiens; identical to SEQ ID NO: 133788

SEQ ID NO: 363067 - RNA, 64 nt, Homo Sapiens; identical to SEQ ID NO: 133789

SEQ ID NO: 363068 - RNA, 64 nt, Homo Sapiens; identical to SEQ ID NO: 133790

SEQ ID NO: 363069 - RNA, 64 nt, Homo Sapiens; identical to SEQ ID NO: 133791

SEQ ID NO: 363070 - RNA, 64 nt, Homo Sapiens; identical to SEQ ID NO: 133792

SEQ ID NO: 363071 - RNA, 64 nt, Homo Sapiens; identical to SEQ ID NO: 133793

SEQ ID NO: 363072 - RNA, 64 nt, Homo Sapiens; identical to SEQ ID NO: 133794

SEQ ID NO: 363073 - RNA, 64 nt, Homo Sapiens; identical to SEQ ID NO: 133795

SEQ ID NO: 363074 - RNA, 64 nt, Homo Sapiens; identical to SEQ ID NO: 133796

SEQ ID NO: 363075 - RNA, 64 nt, Homo Sapiens; identical to SEQ ID NO: 133797

SEQ ID NO: 363076 - RNA, 64 nt, Homo Sapiens; identical to SEQ ID NO: 133798

SEQ ID NO: 363077 - RNA, 64 nt, Homo Sapiens; identical to SEQ ID NO: 133799

SEQ ID NO: 363078 - RNA, 64 nt, Homo Sapiens; identical to SEQ ID NO: 133800

SEQ ID NO: 363079 - RNA, 64 nt, Homo Sapiens; identical to SEQ ID NO: 133801

SEQ ID NO: 363080 - RNA, 64 nt, Homo Sapiens; identical to SEQ ID NO: 133802

SEQ ID NO: 363081 - RNA, 64 nt, Homo Sapiens; identical to SEQ ID NO: 133803

SEQ ID NO: 363082 - RNA, 64 nt, Homo Sapiens; identical to SEQ ID NO: 133804

SEQ ID NO: 363083 - RNA, 64 nt, Homo Sapiens; identical to SEQ ID NO: 133805

SEQ ID NO: 363084 - RNA, 64 nt, Homo Sapiens; identical to SEQ ID NO: 133806

SEQ ID NO: 363085 - RNA, 64 nt, Homo Sapiens; identical to SEQ ID NO: 133807

SEQ ID NO: 363086 - RNA, 64 nt, Homo Sapiens; identical to SEQ ID NO: 133808

SEQ ID NO: 363087 - RNA, 64 nt, Homo Sapiens; identical to SEQ ID NO: 133809

SEQ ID NO: 363088 - RNA, 64 nt, Homo Sapiens; identical to SEQ ID NO: 133810

SEQ ID NO: 363089 - RNA, 64 nt, Homo Sapiens; identical to SEQ ID NO: 133811

SEQ ID NO: 363090 - RNA, 64 nt, Homo Sapiens; identical to SEQ ID NO: 133812

SEQ ID NO: 363091 - RNA, 64 nt, Homo Sapiens; identical to SEQ ID NO: 133813

SEQ ID NO: 363092 - RNA, 64 nt, Homo Sapiens; identical to SEQ ID NO: 133814

SEQ ID NO: 363093 - RNA, 64 nt, Homo Sapiens; identical to SEQ ID NO: 133815

SEQ ID NO: 363094 - RNA, 64 nt, Homo Sapiens; identical to SEQ ID NO: 133816

SEQ ID NO: 363095 - RNA, 64 nt, Homo Sapiens; identical to SEQ ID NO: 133817

SEQ ID NO: 363096 - RNA, 64 nt, Homo Sapiens; identical to SEQ ID NO: 133818

SEQ ID NO: 363097 - RNA, 64 nt, Homo Sapiens; identical to SEQ ID NO: 133819

SEQ ID NO: 363098 - RNA, 64 nt, Homo Sapiens; identical to SEQ ID NO: 133820

SEQ ID NO: 363099 - RNA, 64 nt, Homo Sapiens; identical to SEQ ID NO: 133821

SEQ ID NO: 363100 - RNA, 64 nt, Homo Sapiens; identical to SEQ ID NO: 133822

SEQ ID NO: 363101 - RNA, 64 nt, Homo Sapiens; identical to SEQ ID NO: 133823

SEQ ID NO: 363102 - RNA, 64 nt, Homo Sapiens; identical to SEQ ID NO: 133824

SEQ ID NO: 363103 - RNA, 64 nt, Homo Sapiens; identical to SEQ ID NO: 133825

SEQ ID NO: 363104 - RNA, 64 nt, Homo Sapiens; identical to SEQ ID NO: 133826

SEQ ID NO: 363105 - RNA, 64 nt, Homo Sapiens; identical to SEQ ID NO: 133827

SEQ ID NO: 363106 - RNA, 64 nt, Homo Sapiens; identical to SEQ ID NO: 133828

SEQ ID NO: 363107 - RNA, 64 nt, Homo Sapiens; identical to SEQ ID NO: 133829

SEQ ID NO: 363108 - RNA, 61 nt, Homo Sapiens
caggcgggacucgugucccagagaggaaggggcugcugaggucugauggggcccuuccucc

SEQ ID NO: 363109 - RNA, 61 nt, Homo Sapiens
guugcucccgugcugccugcgccagccccaggcugcugaggagcagaggccagaccagggc

SEQ ID NO: 363110 - RNA, 61 nt, Homo Sapiens
cgggcccugugcugggggugguagaaaggaugcugcugaggcagcuggaggagugggagua

SEQ ID NO: 363111 - RNA, 61 nt, Homo Sapiens
cugaaagaaguauggccaaaagcacuuuaaugcugcugacauuguuguuuuuauguucauu

SEQ ID NO: 363112 - RNA, 61 nt, Homo Sapiens
ccaguuacccauggaaugcauucuaccaggggcugcugacuaaagcccaguucuugcuguc

SEQ ID NO: 363113 - RNA, 61 nt, Homo Sapiens
ugaaguuaaguuuggaaagaauuccauguaugcugcugaaaaaacuuugaaaagugucaau

SEQ ID NO: 363114 - RNA, 61 nt, Homo Sapiens
uugugaagacaguggaguucagcuuccaccagcugcugaguccugucucaguucuucagag

SEQ ID NO: 363115 - RNA, 61 nt, Homo Sapiens
ugaagcaguggguucagcuggggaauugauagcugcugagccauuuugugcuuuuagaaca

SEQ ID NO: 363116 - RNA, 61 nt, Homo Sapiens
aagacauacccgagacuggguccguuuucacgcugcugauaguaccaauuuacuguauuag

SEQ ID NO: 363117 - RNA, 61 nt, Homo Sapiens
aagacguacccgagacugggucuguauuaaugcugcugauagcuucaagcaucuguauuag

SEQ ID NO: 363118 - RNA, 61 nt, Homo Sapiens
acuccucucaggugcacccgcuagcugugcugcugcugaccgacggggacgugcacauccg

SEQ ID NO: 363119 - RNA, 61 nt, Homo Sapiens
ugcggcuggagggugacucgcguaccgugcggcugcugaaggagcugcggcgggcccuggg

SEQ ID NO: 363120 - RNA, 61 nt, Homo Sapiens
cccguggugacggccacacggacuucguggcgcugcugacagggccgaggucgcaggcggu

SEQ ID NO: 363121 - RNA, 61 nt, Homo Sapiens
uugggccuccuggaacgccagggccucggcggcugcugaagggauucuauggcucagaggu

SEQ ID NO: 363122 - RNA, 61 nt, Homo Sapiens
auccuauuuagcauaugcaaggaccucuucagcugcugacauacuaguccaaucaccccca

SEQ ID NO: 363123 - RNA, 61 nt, Homo Sapiens
cgaaauauaaaacugagacuacuucaucccagcugcugaggcccugcggcucuggaaagca

SEQ ID NO: 363124 - RNA, 61 nt, Homo Sapiens
gcucagcugcaaguugcuggagccuggaauggcugcugagaccaggagguggaacugaauc

SEQ ID NO: 363125 - RNA, 61 nt, Homo Sapiens
aaaaggguuagagggugggggucagugugcagcugcugagcaacaaugaaccagaggcuug

SEQ ID NO: 363126 - RNA, 61 nt, Homo Sapiens
aaaauggaaguggauucuggauggccgggcugcugcugauguaggagcuggauuugggagc

SEQ ID NO: 363127 - RNA, 61 nt, Homo Sapiens
uguaggagugagaagaaggaagaucuugagagcugcugagggaccuuggagagcucaggau

SEQ ID NO: 363128 - RNA, 61 nt, Homo Sapiens
aaccgaguucagaccgagcaccucguggacugcugcugagagcugcugaagaggagggagg

SEQ ID NO: 363129 - RNA, 61 nt, Homo Sapiens
aggagggaggccucguggacccccaacgaaugcugcugaaguaaaauuccaaggauauaug

SEQ ID NO: 363130 - RNA, 61 nt, Homo Sapiens
auuuacuuggugcccucauccuauuacaccagcugcugagguaauguccauaucuagccau

SEQ ID NO: 363131 - RNA, 61 nt, Homo Sapiens
ucuuugccugccacucagggcuuugggaagagcugcugagccaccucccuucccucccugg

SEQ ID NO: 363132 - RNA, 61 nt, Homo Sapiens
cugugcuuugucauugaauccuaaguucuuagcugcugaugcaaguugucccccaaggcca

SEQ ID NO: 363133 - RNA, 61 nt, Homo Sapiens
uccauaacccucuguauugacugcaauguaagcugcugaggagacugguucuguuggucag

SEQ ID NO: 363134 - RNA, 61 nt, Homo Sapiens
ccccugacuuuuauuaaagauuaccagugacgcugcugacaucguggagcgccaucauguc

SEQ ID NO: 363135 - RNA, 61 nt, Homo Sapiens
cgccacggagggcuggggaucugggugaucugcugcugagacaagcccgaccgggccaggc

SEQ ID NO: 363136 - RNA, 61 nt, Homo Sapiens
aggccuugagggaaguagagacugagccccagcugcugagacuucugagaccaccuucccc

SEQ ID NO: 363137 - RNA, 61 nt, Homo Sapiens
cugcagagggaaggggugggguguccucccugcugcugaccaagucagagcaccuggacag

SEQ ID NO: 363138 - RNA, 64 nt, Homo Sapiens
aucaaggugauugugauuauagugacaaugaagaugaugcuauuaauacugcauaaaaagugcc

SEQ ID NO: 363139 - RNA, 64 nt, Homo Sapiens
uuguuguuauuaacagcugauacagguauucugcugaugcuacugcugccuaguuaccaugaac

SEQ ID NO: 363140 - RNA, 64 nt, Homo Sapiens
cacgcugggcaaugagaauccuuggaaacauuggugaugcuaucaguuuuauagcuuuauuucu

SEQ ID NO: 363141 - RNA, 64 nt, Homo Sapiens
gggggagggcgcuggaugcaaaaguugaagaucgugaugcuaugauguuaguuuuccuuagcug

SEQ ID NO: 363142 - RNA, 64 nt, Homo Sapiens
guacagaacuggacagguugagggaaucagagcuugaugcuacugagggagcaaggggaguuug

SEQ ID NO: 363143 - RNA, 64 nt, Homo Sapiens
agagaaucauauugaagaugucacuaauuuuaccugaugcuaugaggcugccuuuccucuagag

SEQ ID NO: 363144 - RNA, 64 nt, Homo Sapiens
ucuuuaaaaguuuauuuuuuauaaauuaauuuuaugaugcuaauuauuuuguauuuuuauugga

SEQ ID NO: 363145 - RNA, 64 nt, Homo Sapiens
gaaaugucuguacaaaauaaaaguuguguaauggugaugcuaaaaacuaggcacauuuuuaaga

SEQ ID NO: 363146 - RNA, 64 nt, Homo Sapiens
cauuaauuuucaugaacaagaauauguaccuuuuugaugcuauauuacugcgauuaaaaaguuc

SEQ ID NO: 363147 - RNA, 64 nt, Homo Sapiens
ugaagagaugccuuuguuucaugagauucaaacuugaugcuaugcuuuaaaauaaacucaguac

SEQ ID NO: 363148 - RNA, 64 nt, Homo Sapiens
cguccuuccccauaacuaugugagcaccucccauccugcucacauucuggagaggacagucagc

SEQ ID NO: 363149 - RNA, 64 nt, Homo Sapiens
ucagaagagccuucuggagauggcccuggggucuccugcucagcucuagguuggggcucggcug

SEQ ID NO: 363150 - RNA, 64 nt, Homo Sapiens
gucaguguagccccucgcccgaccuagagugcauccugcucauugcuccgugccuguccacaau

SEQ ID NO: 363151 - RNA, 64 nt, Homo Sapiens
cacaaaugugugcccucagcgcuuucuuuaucaaccugcucacuuucucauuauuggcuaguua

SEQ ID NO: 363152 - RNA, 64 nt, Homo Sapiens
guggccccucagaacaacagccuggcaguguuugccugcucagacucuguguguagugagugac

SEQ ID NO: 363153 - RNA, 64 nt, Homo Sapiens
cccucugcuuagcuggugggaaaaacgaggcauuccugcucauugggagugggugcccauucug

SEQ ID NO: 363154 - RNA, 64 nt, Homo Sapiens
uuuccaacucagaaauucaauuuggauuuaaaagccugcucaaucccugaggacugauuucaga

SEQ ID NO: 363155 - RNA, 64 nt, Homo Sapiens
uaccgucuuuuccuguuuccuagcugugugaauaccugcucacgucaaaugcauacaaguuuca

SEQ ID NO: 363156 - RNA, 64 nt, Homo Sapiens
ucucuggucucaucacuugcaugguguccuugucccugcucacccagcauggcuugugagacuc

SEQ ID NO: 363157 - RNA, 64 nt, Homo Sapiens
gagugggaaguggggcuauaggugaggagcugagccugcucaagcuuaaugggaagggggcagg

SEQ ID NO: 363158 - RNA, 64 nt, Homo Sapiens
gugacugaugguuugguuuccucucugcucugccccugcucagcacagggagaauguugacuua

SEQ ID NO: 363159 - RNA, 64 nt, Homo Sapiens
acccucucugcaucuguccccaggaccuaugcucccugcucacccccuucuccaaagcccaagc

SEQ ID NO: 363160 - RNA, 64 nt, Homo Sapiens
ggucaaaaccuacacagcuguacuauuaccaccaccugcucacuaguaaguagcaacccuguga

SEQ ID NO: 363161 - RNA, 64 nt, Homo Sapiens
ucugaaucuccuuguuguucacacuuauaaauauccugcucacagauccaauaauuuuccugug

SEQ ID NO: 363162 - RNA, 64 nt, Homo Sapiens
gugugagccuaucagaguugcugcaaaccugaccccugcucaguaaagcacuugcaaccgucug

SEQ ID NO: 363163 - RNA, 64 nt, Homo Sapiens
agcugccugguauauccaaaagcuuuuuauuccuccugcucauauugugauucugccuuugggg

SEQ ID NO: 363164 - RNA, 64 nt, Homo Sapiens
guguucucagggagugcguggucuuggaugccauccugcucaucuccagcauuuccucucaccu

SEQ ID NO: 363165 - RNA, 64 nt, Homo Sapiens
guguucucggggagugcguggugucagaucccauccugcucaucuccagcauuuccucucaccu

SEQ ID NO: 363166 - RNA, 64 nt, Homo Sapiens
ucuuagguuucacuggugagacccuagcugccaaccugcucauuaccgaaagccuccaacacaa

SEQ ID NO: 363167 - RNA, 64 nt, Homo Sapiens
ggagccaggagcuaacucagcuggcagcugacggccugcucagucuggguauccgcgugguggg

SEQ ID NO: 363168 - RNA, 64 nt, Homo Sapiens
ccaccuugaaaggacucuuggcuccugccggguuccugcucaggcuggaauugggaaaauaugc

SEQ ID NO: 363169 - RNA, 64 nt, Homo Sapiens
ucucagaggcagauaccuaggggagcugcugcugccugcucauucuagcuuccgauuccauucc

SEQ ID NO: 363170 - RNA, 64 nt, Homo Sapiens
ugggccacccccucccacccuuucccagcugcuuccugcucagcuggaugaggggguccuuggg

SEQ ID NO: 363171 - RNA, 64 nt, Homo Sapiens
guuuuuaagcccucucaaccugccuauccccuccccugcucagacccugccccgggacccuauc

SEQ ID NO: 363172 - RNA, 64 nt, Homo Sapiens
uugaagugcgcuguucacacaccggagccaggcgccugcucaugcaccacugaagugaggacac

SEQ ID NO: 363173 - RNA, 64 nt, Homo Sapiens
cuucucucagccaaagccucaccauucccagcucccugcucacucagcucccuucccugccugg

SEQ ID NO: 363174 - RNA, 64 nt, Homo Sapiens
cacccuuguccaaggcuuuacucuacuuaucaucccugcucacaaggccucuacacacccccca

SEQ ID NO: 363175 - RNA, 64 nt, Homo Sapiens
uugcugggagcuuuauucuggccuccguaucaggccugcucaccgguggauggccaugggcuga

SEQ ID NO: 363176 - RNA, 64 nt, Homo Sapiens
cccagauuccuguguacagaaucauuaagauuccccugcucaaaaggggaaucauuuaauuuaa

SEQ ID NO: 363177 - RNA, 64 nt, Homo Sapiens
cccuucaguccccugcuugggaaugcacagucucccugcucauggaguccccuuugcccauccu

SEQ ID NO: 363178 - RNA, 64 nt, Homo Sapiens
cauuggguugucugucuccgucauggggagggucccugcucaguucuggagacacuggaguugg

SEQ ID NO: 363179 - RNA, 64 nt, Homo Sapiens
gacagaggacucagaaguggccuuuccuccaaagccugcucagacacaggucuguagggccagg

SEQ ID NO: 363180 - RNA, 64 nt, Homo Sapiens
cugugaucacccucucggccuccucccacaagcaccugcucaacauaggccugcucagccucua

SEQ ID NO: 363181 - RNA, 64 nt, Homo Sapiens
cggccuccucccacaagcaccugcucaacauaggccugcucagccucuagcaccaggacucagg

SEQ ID NO: 363182 - RNA, 64 nt, Homo Sapiens
cagcacagaggaaggggcaaaguccuguaggaucccugcucaagcauguggggucuguggugag

SEQ ID NO: 363183 - RNA, 64 nt, Homo Sapiens
uguuugcccucaggcagccaccaggggaaaaaccccugcucacucacgcaguugcgacaggagg

SEQ ID NO: 363184 - RNA, 64 nt, Homo Sapiens
aucuggagauacaggcccacggggcuggccaggcccugcucaaccccucuaggaugcccccuca

SEQ ID NO: 363185 - RNA, 64 nt, Homo Sapiens
auuccuguugaggagaugccacugugcucuaaacccugcucaggagacccucccccuccugccc

SEQ ID NO: 363186 - RNA, 64 nt, Homo Sapiens
cagggacuuucuuccuggcagaucuguggccuucccugcucagccucuugguccccccacuccc

SEQ ID NO: 363187 - RNA, 64 nt, Homo Sapiens
ccaggagccucucccugcuacaggggguggggguccugcucagcaggguagguggugguuuuag

SEQ ID NO: 363188 - RNA, 64 nt, Homo Sapiens
guguugccuuaaaacugaguugggugacuugguaccugcucaggaccccccgcacugucccaau

SEQ ID NO: 363189 - RNA, 64 nt, Homo Sapiens
cuccagcuggccucacuccgcuggugacuucguaccugcucaggagcccccacugucccagucc

SEQ ID NO: 363190 - RNA, 64 nt, Homo Sapiens
ucacaucuggccagagggcugucuggaccugggcccugcucaaugccaccugucugccugggcu

SEQ ID NO: 363191 - RNA, 64 nt, Homo Sapiens
ccuccauggacagugugagccccgggccgugcauccugcucaguguggcgucagugucggggcu

SEQ ID NO: 363192 - RNA, 64 nt, Homo Sapiens
accuggcguugguacacaggcucccaccccacucccugcucagugacccaccccccugccaccc

SEQ ID NO: 363193 - RNA, 64 nt, Homo Sapiens
ccagucacauagagaauugguugguugccucuccccugcucacuccagggaucugacuccugag

SEQ ID NO: 363194 - RNA, 64 nt, Homo Sapiens
cagccccacucccugggcuuuaggcucuauggccccugcucaguccagcucccucuucccuuac

SEQ ID NO: 363195 - RNA, 64 nt, Homo Sapiens
cuccucggggaggggaagcaggaccugagaagggccugcucaccaggaaugacccucuauccca

SEQ ID NO: 363196 - RNA, 64 nt, Homo Sapiens; identical to SEQ ID NO: 144070

SEQ ID NO: 363197 - RNA, 64 nt, Homo Sapiens; identical to SEQ ID NO: 144071

SEQ ID NO: 363198 - RNA, 64 nt, Homo Sapiens; identical to SEQ ID NO: 144072

SEQ ID NO: 363199 - RNA, 64 nt, Homo Sapiens; identical to SEQ ID NO: 144073

SEQ ID NO: 363200 - RNA, 64 nt, Homo Sapiens; identical to SEQ ID NO: 144074

SEQ ID NO: 363201 - RNA, 64 nt, Homo Sapiens; identical to SEQ ID NO: 144075

SEQ ID NO: 363202 - RNA, 64 nt, Homo Sapiens; identical to SEQ ID NO: 144076

SEQ ID NO: 363203 - RNA, 64 nt, Homo Sapiens; identical to SEQ ID NO: 144077

SEQ ID NO: 363204 - RNA, 64 nt, Homo Sapiens; identical to SEQ ID NO: 144078

SEQ ID NO: 363205 - RNA, 64 nt, Homo Sapiens; identical to SEQ ID NO: 144079

SEQ ID NO: 363206 - RNA, 64 nt, Homo Sapiens; identical to SEQ ID NO: 144080

SEQ ID NO: 363207 - RNA, 64 nt, Homo Sapiens; identical to SEQ ID NO: 144081

SEQ ID NO: 363208 - RNA, 64 nt, Homo Sapiens; identical to SEQ ID NO: 144082

SEQ ID NO: 363209 - RNA, 64 nt, Homo Sapiens; identical to SEQ ID NO: 144083

SEQ ID NO: 363210 - RNA, 64 nt, Homo Sapiens; identical to SEQ ID NO: 144084

SEQ ID NO: 363211 - RNA, 64 nt, Homo Sapiens; identical to SEQ ID NO: 144085

SEQ ID NO: 363212 - RNA, 64 nt, Homo Sapiens; identical to SEQ ID NO: 144086

SEQ ID NO: 363213 - RNA, 64 nt, Homo Sapiens; identical to SEQ ID NO: 144087

SEQ ID NO: 363214 - RNA, 64 nt, Homo Sapiens; identical to SEQ ID NO: 144088

SEQ ID NO: 363215 - RNA, 64 nt, Homo Sapiens; identical to SEQ ID NO: 144089

SEQ ID NO: 363216 - RNA, 64 nt, Homo Sapiens; identical to SEQ ID NO: 144090

SEQ ID NO: 363217 - RNA, 64 nt, Homo Sapiens; identical to SEQ ID NO: 144091

SEQ ID NO: 363218 - RNA, 64 nt, Homo Sapiens; identical to SEQ ID NO: 144092

SEQ ID NO: 363219 - RNA, 64 nt, Homo Sapiens; identical to SEQ ID NO: 144093

SEQ ID NO: 363220 - RNA, 64 nt, Homo Sapiens; identical to SEQ ID NO: 144094

SEQ ID NO: 363221 - RNA, 64 nt, Homo Sapiens; identical to SEQ ID NO: 144095

SEQ ID NO: 363222 - RNA, 64 nt, Homo Sapiens; identical to SEQ ID NO: 144096

SEQ ID NO: 363223 - RNA, 64 nt, Homo Sapiens; identical to SEQ ID NO: 144097

SEQ ID NO: 363224 - RNA, 64 nt, Homo Sapiens; identical to SEQ ID NO: 144098

SEQ ID NO: 363225 - RNA, 64 nt, Homo Sapiens; identical to SEQ ID NO: 144099

SEQ ID NO: 363226 - RNA, 64 nt, Homo Sapiens; identical to SEQ ID NO: 144100

SEQ ID NO: 363227 - RNA, 64 nt, Homo Sapiens; identical to SEQ ID NO: 144101

SEQ ID NO: 363228 - RNA, 64 nt, Homo Sapiens; identical to SEQ ID NO: 144102

SEQ ID NO: 363229 - RNA, 64 nt, Homo Sapiens; identical to SEQ ID NO: 144103

SEQ ID NO: 363230 - RNA, 64 nt, Homo Sapiens; identical to SEQ ID NO: 144104

SEQ ID NO: 363231 - RNA, 64 nt, Homo Sapiens; identical to SEQ ID NO: 144105

SEQ ID NO: 363232 - RNA, 64 nt, Homo Sapiens; identical to SEQ ID NO: 144106

SEQ ID NO: 363233 - RNA, 64 nt, Homo Sapiens; identical to SEQ ID NO: 144107

SEQ ID NO: 363234 - RNA, 64 nt, Homo Sapiens; identical to SEQ ID NO: 144108

SEQ ID NO: 363235 - RNA, 64 nt, Homo Sapiens; identical to SEQ ID NO: 144109

SEQ ID NO: 363236 - RNA, 64 nt, Homo Sapiens; identical to SEQ ID NO: 144110

SEQ ID NO: 363237 - RNA, 64 nt, Homo Sapiens; identical to SEQ ID NO: 144111

SEQ ID NO: 363238 - RNA, 64 nt, Homo Sapiens; identical to SEQ ID NO: 144112

SEQ ID NO: 363239 - RNA, 64 nt, Homo Sapiens; identical to SEQ ID NO: 144113

SEQ ID NO: 363240 - RNA, 64 nt, Homo Sapiens; identical to SEQ ID NO: 144114

SEQ ID NO: 363241 - RNA, 64 nt, Homo Sapiens; identical to SEQ ID NO: 144115

SEQ ID NO: 363242 - RNA, 64 nt, Homo Sapiens; identical to SEQ ID NO: 144116

SEQ ID NO: 363243 - RNA, 64 nt, Homo Sapiens; identical to SEQ ID NO: 144117

SEQ ID NO: 363244 - RNA, 64 nt, Homo Sapiens; identical to SEQ ID NO: 144118

SEQ ID NO: 363245 - RNA, 64 nt, Homo Sapiens; identical to SEQ ID NO: 144119

SEQ ID NO: 363246 - RNA, 64 nt, Homo Sapiens; identical to SEQ ID NO: 144120

SEQ ID NO: 363247 - RNA, 64 nt, Homo Sapiens; identical to SEQ ID NO: 144121

SEQ ID NO: 363248 - RNA, 64 nt, Homo Sapiens; identical to SEQ ID NO: 144122

SEQ ID NO: 363249 - RNA, 64 nt, Homo Sapiens; identical to SEQ ID NO: 144123

SEQ ID NO: 363250 - RNA, 64 nt, Homo Sapiens; identical to SEQ ID NO: 144124

SEQ ID NO: 363251 - RNA, 64 nt, Homo Sapiens; identical to SEQ ID NO: 144125

SEQ ID NO: 363252 - RNA, 64 nt, Homo Sapiens; identical to SEQ ID NO: 144126

SEQ ID NO: 363253 - RNA, 64 nt, Homo Sapiens; identical to SEQ ID NO: 144127

SEQ ID NO: 363254 - RNA, 64 nt, Homo Sapiens; identical to SEQ ID NO: 144128

SEQ ID NO: 363255 - RNA, 64 nt, Homo Sapiens; identical to SEQ ID NO: 144129

SEQ ID NO: 363256 - RNA, 64 nt, Homo Sapiens; identical to SEQ ID NO: 144130

SEQ ID NO: 363257 - RNA, 64 nt, Homo Sapiens; identical to SEQ ID NO: 144131

SEQ ID NO: 363258 - RNA, 64 nt, Homo Sapiens; identical to SEQ ID NO: 144132

SEQ ID NO: 363259 - RNA, 64 nt, Homo Sapiens; identical to SEQ ID NO: 144133

SEQ ID NO: 363260 - RNA, 64 nt, Homo Sapiens; identical to SEQ ID NO: 144134

SEQ ID NO: 363261 - RNA, 64 nt, Homo Sapiens; identical to SEQ ID NO: 144135

SEQ ID NO: 363262 - RNA, 64 nt, Homo Sapiens; identical to SEQ ID NO: 144136

SEQ ID NO: 363263 - RNA, 64 nt, Homo Sapiens; identical to SEQ ID NO: 144137

SEQ ID NO: 363264 - RNA, 64 nt, Homo Sapiens; identical to SEQ ID NO: 144138

SEQ ID NO: 363265 - RNA, 64 nt, Homo Sapiens; identical to SEQ ID NO: 144139

SEQ ID NO: 363266 - RNA, 64 nt, Homo Sapiens; identical to SEQ ID NO: 144140

SEQ ID NO: 363267 - RNA, 64 nt, Homo Sapiens; identical to SEQ ID NO: 144141

SEQ ID NO: 363268 - RNA, 64 nt, Homo Sapiens; identical to SEQ ID NO: 144142

SEQ ID NO: 363269 - RNA, 64 nt, Homo Sapiens; identical to SEQ ID NO: 144143

SEQ ID NO: 363270 - RNA, 64 nt, Homo Sapiens; identical to SEQ ID NO: 144144

SEQ ID NO: 363271 - RNA, 64 nt, Homo Sapiens; identical to SEQ ID NO: 144145

SEQ ID NO: 363272 - RNA, 64 nt, Homo Sapiens; identical to SEQ ID NO: 144146

SEQ ID NO: 363273 - RNA, 64 nt, Homo Sapiens; identical to SEQ ID NO: 144147

SEQ ID NO: 363274 - RNA, 64 nt, Homo Sapiens; identical to SEQ ID NO: 144148

SEQ ID NO: 363275 - RNA, 64 nt, Homo Sapiens; identical to SEQ ID NO: 144149

SEQ ID NO: 363276 - RNA, 64 nt, Homo Sapiens; identical to SEQ ID NO: 144150

SEQ ID NO: 363277 - RNA, 64 nt, Homo Sapiens; identical to SEQ ID NO: 144151

SEQ ID NO: 363278 - RNA, 64 nt, Homo Sapiens; identical to SEQ ID NO: 144152

SEQ ID NO: 363279 - RNA, 64 nt, Homo Sapiens; identical to SEQ ID NO: 144153

SEQ ID NO: 363280 - RNA, 64 nt, Homo Sapiens; identical to SEQ ID NO: 144154

SEQ ID NO: 363281 - RNA, 64 nt, Homo Sapiens; identical to SEQ ID NO: 144155

SEQ ID NO: 363282 - RNA, 64 nt, Homo Sapiens; identical to SEQ ID NO: 79249

SEQ ID NO: 363283 - RNA, 64 nt, Homo Sapiens; identical to SEQ ID NO: 79250

SEQ ID NO: 363284 - RNA, 64 nt, Homo Sapiens; identical to SEQ ID NO: 79251

SEQ ID NO: 363285 - RNA, 64 nt, Homo Sapiens; identical to SEQ ID NO: 79252

SEQ ID NO: 363286 - RNA, 64 nt, Homo Sapiens; identical to SEQ ID NO: 79253

SEQ ID NO: 363287 - RNA, 64 nt, Homo Sapiens; identical to SEQ ID NO: 79254

SEQ ID NO: 363288 - RNA, 64 nt, Homo Sapiens; identical to SEQ ID NO: 79255

SEQ ID NO: 363289 - RNA, 64 nt, Homo Sapiens; identical to SEQ ID NO: 79256

SEQ ID NO: 363290 - RNA, 64 nt, Homo Sapiens; identical to SEQ ID NO: 79257

SEQ ID NO: 363291 - RNA, 64 nt, Homo Sapiens; identical to SEQ ID NO: 79258

SEQ ID NO: 363292 - RNA, 64 nt, Homo Sapiens; identical to SEQ ID NO: 79259

SEQ ID NO: 363293 - RNA, 64 nt, Homo Sapiens; identical to SEQ ID NO: 79260

SEQ ID NO: 363294 - RNA, 64 nt, Homo Sapiens; identical to SEQ ID NO: 79261

SEQ ID NO: 363295 - RNA, 64 nt, Homo Sapiens; identical to SEQ ID NO: 79262

SEQ ID NO: 363296 - RNA, 64 nt, Homo Sapiens; identical to SEQ ID NO: 79263

SEQ ID NO: 363297 - RNA, 64 nt, Homo Sapiens; identical to SEQ ID NO: 79264

SEQ ID NO: 363298 - RNA, 64 nt, Homo Sapiens; identical to SEQ ID NO: 79265

SEQ ID NO: 363299 - RNA, 64 nt, Homo Sapiens; identical to SEQ ID NO: 79266

SEQ ID NO: 363300 - RNA, 64 nt, Homo Sapiens; identical to SEQ ID NO: 79267

SEQ ID NO: 363301 - RNA, 64 nt, Homo Sapiens; identical to SEQ ID NO: 79268

SEQ ID NO: 363302 - RNA, 64 nt, Homo Sapiens; identical to SEQ ID NO: 79269

SEQ ID NO: 363303 - RNA, 64 nt, Homo Sapiens; identical to SEQ ID NO: 79270

SEQ ID NO: 363304 - RNA, 64 nt, Homo Sapiens; identical to SEQ ID NO: 79271

SEQ ID NO: 363305 - RNA, 64 nt, Homo Sapiens; identical to SEQ ID NO: 79272

SEQ ID NO: 363306 - RNA, 64 nt, Homo Sapiens; identical to SEQ ID NO: 79273

SEQ ID NO: 363307 - RNA, 64 nt, Homo Sapiens; identical to SEQ ID NO: 79274

SEQ ID NO: 363308 - RNA, 64 nt, Homo Sapiens; identical to SEQ ID NO: 79275

SEQ ID NO: 363309 - RNA, 64 nt, Homo Sapiens; identical to SEQ ID NO: 79276

SEQ ID NO: 363310 - RNA, 64 nt, Homo Sapiens; identical to SEQ ID NO: 79277

SEQ ID NO: 363311 - RNA, 64 nt, Homo Sapiens; identical to SEQ ID NO: 79278

SEQ ID NO: 363312 - RNA, 64 nt, Homo Sapiens; identical to SEQ ID NO: 79279

SEQ ID NO: 363313 - RNA, 64 nt, Homo Sapiens; identical to SEQ ID NO: 79280

SEQ ID NO: 363314 - RNA, 64 nt, Homo Sapiens; identical to SEQ ID NO: 79281

SEQ ID NO: 363315 - RNA, 64 nt, Homo Sapiens; identical to SEQ ID NO: 79282

SEQ ID NO: 363316 - RNA, 64 nt, Homo Sapiens; identical to SEQ ID NO: 79283

SEQ ID NO: 363317 - RNA, 64 nt, Homo Sapiens; identical to SEQ ID NO: 79284

SEQ ID NO: 363318 - RNA, 64 nt, Homo Sapiens; identical to SEQ ID NO: 79285

SEQ ID NO: 363319 - RNA, 64 nt, Homo Sapiens; identical to SEQ ID NO: 79286

SEQ ID NO: 363320 - RNA, 64 nt, Homo Sapiens; identical to SEQ ID NO: 79287

SEQ ID NO: 363321 - RNA, 64 nt, Homo Sapiens; identical to SEQ ID NO: 79288

SEQ ID NO: 363322 - RNA, 64 nt, Homo Sapiens; identical to SEQ ID NO: 79289

SEQ ID NO: 363323 - RNA, 64 nt, Homo Sapiens; identical to SEQ ID NO: 79290

SEQ ID NO: 363324 - RNA, 64 nt, Homo Sapiens; identical to SEQ ID NO: 161026

SEQ ID NO: 363325 - RNA, 64 nt, Homo Sapiens; identical to SEQ ID NO: 161027

SEQ ID NO: 363326 - RNA, 64 nt, Homo Sapiens; identical to SEQ ID NO: 161028

SEQ ID NO: 363327 - RNA, 64 nt, Homo Sapiens; identical to SEQ ID NO: 161029

SEQ ID NO: 363328 - RNA, 64 nt, Homo Sapiens; identical to SEQ ID NO: 161030

SEQ ID NO: 363329 - RNA, 64 nt, Homo Sapiens; identical to SEQ ID NO: 161031

SEQ ID NO: 363330 - RNA, 64 nt, Homo Sapiens; identical to SEQ ID NO: 161032

SEQ ID NO: 363331 - RNA, 64 nt, Homo Sapiens; identical to SEQ ID NO: 161033

SEQ ID NO: 363332 - RNA, 64 nt, Homo Sapiens; identical to SEQ ID NO: 161034

SEQ ID NO: 363333 - RNA, 50 nt, Homo Sapiens; identical to SEQ ID NO: 161035

SEQ ID NO: 363334 - RNA, 64 nt, Homo Sapiens; identical to SEQ ID NO: 161036

SEQ ID NO: 363335 - RNA, 64 nt, Homo Sapiens; identical to SEQ ID NO: 161037

SEQ ID NO: 363336 - RNA, 64 nt, Homo Sapiens; identical to SEQ ID NO: 161038

SEQ ID NO: 363337 - RNA, 64 nt, Homo Sapiens; identical to SEQ ID NO: 161039

SEQ ID NO: 363338 - RNA, 64 nt, Homo Sapiens; identical to SEQ ID NO: 161040

SEQ ID NO: 363339 - RNA, 64 nt, Homo Sapiens; identical to SEQ ID NO: 161041

SEQ ID NO: 363340 - RNA, 64 nt, Homo Sapiens; identical to SEQ ID NO: 161042

SEQ ID NO: 363341 - RNA, 64 nt, Homo Sapiens; identical to SEQ ID NO: 161043

SEQ ID NO: 363342 - RNA, 64 nt, Homo Sapiens; identical to SEQ ID NO: 161044

SEQ ID NO: 363343 - RNA, 64 nt, Homo Sapiens; identical to SEQ ID NO: 161045

SEQ ID NO: 363344 - RNA, 64 nt, Homo Sapiens; identical to SEQ ID NO: 161046

SEQ ID NO: 363345 - RNA, 64 nt, Homo Sapiens; identical to SEQ ID NO: 161047

SEQ ID NO: 363346 - RNA, 64 nt, Homo Sapiens; identical to SEQ ID NO: 270210

SEQ ID NO: 363347 - RNA, 64 nt, Homo Sapiens; identical to SEQ ID NO: 270211

SEQ ID NO: 363348 - RNA, 64 nt, Homo Sapiens; identical to SEQ ID NO: 270212

SEQ ID NO: 363349 - RNA, 64 nt, Homo Sapiens; identical to SEQ ID NO: 270213

SEQ ID NO: 363350 - RNA, 64 nt, Homo Sapiens; identical to SEQ ID NO: 270214

SEQ ID NO: 363351 - RNA, 64 nt, Homo Sapiens; identical to SEQ ID NO: 270215

SEQ ID NO: 363352 - RNA, 64 nt, Homo Sapiens; identical to SEQ ID NO: 270216

SEQ ID NO: 363353 - RNA, 64 nt, Homo Sapiens; identical to SEQ ID NO: 270217

SEQ ID NO: 363354 - RNA, 64 nt, Homo Sapiens; identical to SEQ ID NO: 270218

SEQ ID NO: 363355 - RNA, 64 nt, Homo Sapiens; identical to SEQ ID NO: 270219

SEQ ID NO: 363356 - RNA, 64 nt, Homo Sapiens; identical to SEQ ID NO: 270220

SEQ ID NO: 363357 - RNA, 64 nt, Homo Sapiens; identical to SEQ ID NO: 270221

SEQ ID NO: 363358 - RNA, 64 nt, Homo Sapiens; identical to SEQ ID NO: 270222

SEQ ID NO: 363359 - RNA, 64 nt, Homo Sapiens; identical to SEQ ID NO: 270223

SEQ ID NO: 363360 - RNA, 64 nt, Homo Sapiens; identical to SEQ ID NO: 270224

SEQ ID NO: 363361 - RNA, 64 nt, Homo Sapiens; identical to SEQ ID NO: 270225

SEQ ID NO: 363362 - RNA, 64 nt, Homo Sapiens; identical to SEQ ID NO: 270226

SEQ ID NO: 363363 - RNA, 64 nt, Homo Sapiens; identical to SEQ ID NO: 270227

SEQ ID NO: 363364 - RNA, 64 nt, Homo Sapiens; identical to SEQ ID NO: 270228

SEQ ID NO: 363365 - RNA, 64 nt, Homo Sapiens; identical to SEQ ID NO: 270229

SEQ ID NO: 363366 - RNA, 64 nt, Homo Sapiens; identical to SEQ ID NO: 270230

SEQ ID NO: 363367 - RNA, 64 nt, Homo Sapiens; identical to SEQ ID NO: 270231

SEQ ID NO: 363368 - RNA, 64 nt, Homo Sapiens; identical to SEQ ID NO: 270232

SEQ ID NO: 363369 - RNA, 64 nt, Homo Sapiens; identical to SEQ ID NO: 270233

SEQ ID NO: 363370 - RNA, 64 nt, Homo Sapiens; identical to SEQ ID NO: 270234

SEQ ID NO: 363371 - RNA, 64 nt, Homo Sapiens; identical to SEQ ID NO: 270235

SEQ ID NO: 363372 - RNA, 64 nt, Homo Sapiens; identical to SEQ ID NO: 270236

SEQ ID NO: 363373 - RNA, 64 nt, Homo Sapiens; identical to SEQ ID NO: 270237

SEQ ID NO: 363374 - RNA, 64 nt, Homo Sapiens; identical to SEQ ID NO: 270238

SEQ ID NO: 363375 - RNA, 64 nt, Homo Sapiens; identical to SEQ ID NO: 270239

SEQ ID NO: 363376 - RNA, 64 nt, Homo Sapiens; identical to SEQ ID NO: 270240

SEQ ID NO: 363377 - RNA, 64 nt, Homo Sapiens; identical to SEQ ID NO: 270241

SEQ ID NO: 363378 - RNA, 64 nt, Homo Sapiens; identical to SEQ ID NO: 270242

SEQ ID NO: 363379 - RNA, 64 nt, Homo Sapiens; identical to SEQ ID NO: 284057

SEQ ID NO: 363380 - RNA, 64 nt, Homo Sapiens; identical to SEQ ID NO: 284058

SEQ ID NO: 363381 - RNA, 64 nt, Homo Sapiens; identical to SEQ ID NO: 284059

SEQ ID NO: 363382 - RNA, 64 nt, Homo Sapiens; identical to SEQ ID NO: 284060

SEQ ID NO: 363383 - RNA, 64 nt, Homo Sapiens; identical to SEQ ID NO: 284061

SEQ ID NO: 363384 - RNA, 64 nt, Homo Sapiens; identical to SEQ ID NO: 284062

SEQ ID NO: 363385 - RNA, 64 nt, Homo Sapiens
acccuuccucaucugugccuacucccuccucacacuccagaauuugaacagugcucugccucua

SEQ ID NO: 363386 - RNA, 64 nt, Homo Sapiens
ugcugccuuuuuaaguuuugaggacuggccguggcuccagaaugcaggggaagcugcuagggga

SEQ ID NO: 363387 - RNA, 64 nt, Homo Sapiens
cauaacccuucucuccacacuuuucuccccacuccuccagaaggccuuuucccuaaucauuccc

SEQ ID NO: 363388 - RNA, 64 nt, Homo Sapiens
ugccagagugcacuggggggaccugccucucuggcuccagaagcucuucucauaguguacaccc

SEQ ID NO: 363389 - RNA, 64 nt, Homo Sapiens
guucugaugggggagggcggucuucccacuuccucuccagaacuccagaaagagcagugugcuu

SEQ ID NO: 363390 - RNA, 64 nt, Homo Sapiens
gggggagggcggucuucccacuuccucuccagaacuccagaaagagcagugugcuuaugcuuca

SEQ ID NO: 363391 - RNA, 64 nt, Homo Sapiens
uuuaguguagaugaaaauguccuucacccacucccuccagaacacauagcuucccuucccuccc

SEQ ID NO: 363392 - RNA, 64 nt, Homo Sapiens
cguggccuuccagaacaguccagacucccacugucuccagaagucagaaaaacacaaacaaaaa

SEQ ID NO: 363393 - RNA, 64 nt, Homo Sapiens
auguguguggcuucccuacccuaacugugcucugcuccagaaaccaucugaauguuccagcagc

SEQ ID NO: 363394 - RNA, 64 nt, Homo Sapiens
cagcagagccuucuagggucguggagguuucagccuccagaagagucacuuuaguuaugcuaaa

SEQ ID NO: 363395 - RNA, 64 nt, Homo Sapiens
aagauguuuacuacaaaagcaugccaaaccuaggcuccagaaaccacguccaucagcugcauac

SEQ ID NO: 363396 - RNA, 64 nt, Homo Sapiens
uacuagcauugcacauauagucugcuuucuguuccuccagaauuugaguccuguuaauguagua

SEQ ID NO: 363397 - RNA, 64 nt, Homo Sapiens
ucauucuucaacagugccuugcauguaacaagcacuccagaaauguuuguugaaugaaugaaug

SEQ ID NO: 363398 - RNA, 64 nt, Homo Sapiens
cauggcuggagagcugaucagccaggcacagaaucuccagaacaaccuagagagugaaugcuaa

SEQ ID NO: 363399 - RNA, 64 nt, Homo Sapiens
uuuuauuuuccugucuucuuucuccugugguuugcuccagaauuaagguuuguuuuccauccau

SEQ ID NO: 363400 - RNA, 64 nt, Homo Sapiens
ucucccuuuugacacaguuguuucagaaagagcucuccagaagccaauauugagauguaauuca

SEQ ID NO: 363401 - RNA, 64 nt, Homo Sapiens
ugaagcccaaaagcucuuaaggagaauuguauuucuccagaagcugcagcaagagguacagcuc

SEQ ID NO: 363402 - RNA, 64 nt, Homo Sapiens
aauuauucaauuucaugaauaacucuuguuugcacuccagaaaacaacauacauguuuaaauac

SEQ ID NO: 363403 - RNA, 64 nt, Homo Sapiens
auuaaccaccccucucuaguaauuccacagcugccuccagaaacgagagggggagcaaacagga

SEQ ID NO: 363404 - RNA, 64 nt, Homo Sapiens
accccgacggggggccuuaucccugggaggcaggcuccagaagccgccagcuccucagccugcu

SEQ ID NO: 363405 - RNA, 64 nt, Homo Sapiens
cacuuugagauacuuaaagauaguaaaaagauuucuccagaaaagaauaucaaguauaaugaug

SEQ ID NO: 363406 - RNA, 64 nt, Homo Sapiens
cuucuggcugauuguuccgaugugcuuccucuuucuccagaagcguaguucuguucuguggguu

SEQ ID NO: 363407 - RNA, 64 nt, Homo Sapiens
cugcauugaauugaauaugaauuucucuaacucucuccagaaaauggauggagauaacuugucu

SEQ ID NO: 363408 - RNA, 64 nt, Homo Sapiens
gugagauucuuuagccacuuuggggagccugucucuccagaagccuuucuuaguggugcccaca

SEQ ID NO: 363409 - RNA, 64 nt, Homo Sapiens
gugagaaauaaauguguuuuuuggaccucccagccuccagaacuugucugcuggcaccuugauc

SEQ ID NO: 363410 - RNA, 64 nt, Homo Sapiens
auuuuguuugcuuugacccugggcuacacugaaccuccagaauccauacaacauacuuaaugca

SEQ ID NO: 363411 - RNA, 64 nt, Homo Sapiens
gccguagcaguuugacgauagaauauaaauuucgcuccagaaaguucuuucacauggcuacugg

SEQ ID NO: 363412 - RNA, 64 nt, Homo Sapiens
gcacaggaacgaaauaccucucaaaagaugaaaacuccagaaacgcucuuaugagucauuuuuu

SEQ ID NO: 363413 - RNA, 64 nt, Homo Sapiens
uaaugcuuauuaugaguuuaagaagcaguucuuccuccagaaagaagggggcgauagcaugcag

SEQ ID NO: 363414 - RNA, 64 nt, Homo Sapiens
gccgcagcccuggggccaguaggaagcggacccgcuccagaaguccccacgagaagaagaagaa

SEQ ID NO: 363415 - RNA, 64 nt, Homo Sapiens
gaggaacgguguuauggacugaauguucauguuccuccagaauucauaugcugaagccucuguc

SEQ ID NO: 363416 - RNA, 64 nt, Homo Sapiens
cgucugcuggcaccuugaucuugaacuucccagccuccagaacugugagaaagaaaucucuaug

SEQ ID NO: 363417 - RNA, 64 nt, Homo Sapiens
uuuccaucccaaaggcagucuagaauggagggagcuccagaaacauguuccugccccacaggaa

SEQ ID NO: 363418 - RNA, 64 nt, Homo Sapiens
agccccucggaggcagaggacacacaacagugcccuccagaagcugcaaaccucacaggguccc

SEQ ID NO: 363419 - RNA, 64 nt, Homo Sapiens
ugguucaugaugcauaaagcgcuaggcccuagaacuccagaaacagcacagcuggggcggggac

SEQ ID NO: 363420 - RNA, 64 nt, Homo Sapiens
gccacagccacaccucaccgcccaguccagcugucuccagaaggggacaggcaguccgcggucu

SEQ ID NO: 363421 - RNA, 64 nt, Homo Sapiens
ccagcccggagcccagcccccugccccggcccugcuccagaacccagcccagaucggaggacaa

SEQ ID NO: 363422 - RNA, 64 nt, Homo Sapiens
cuagaacccaauccaauuuggagccccagcccaacuccagaacccaacccuucucuagaaucca

SEQ ID NO: 363423 - RNA, 64 nt, Homo Sapiens
ggggcucugggagggauguuguccuccauuucaacuccagaaguaagguaacugagagcagaug

SEQ ID NO: 363424 - RNA, 64 nt, Homo Sapiens
ugcauaaucagcgcccuggagugccuuucucuggcuccagaauaacuccagaauccacaaagcc

SEQ ID NO: 363425 - RNA, 64 nt, Homo Sapiens
cacaaagccgugccuuucucuccaaguuccugcacuccagaauccacccccuccagcuccaguu

SEQ ID NO: 363426 - RNA, 64 nt, Homo Sapiens
gcuauccugggagaucuaccugaaggagaacuaccuccagaaccgacaguuccagcaaaagcag

SEQ ID NO: 363427 - RNA, 64 nt, Homo Sapiens
gcgcaucccacucuaugcgaaccacaagacccuccuccagaaggcagccgcugaguucggggcu

SEQ ID NO: 363428 - RNA, 64 nt, Homo Sapiens
cugacuuaagagaguaagauguugggacagccaucuccagaaacuagacaggcuggauuccagu

SEQ ID NO: 363429 - RNA, 64 nt, Homo Sapiens
gcuggaaaggaugcugccagcagcugcugacugucuccagaaggugcugguucccggaaugaau

SEQ ID NO: 363430 - RNA, 64 nt, Homo Sapiens; identical to SEQ ID NO: 206137

SEQ ID NO: 363431 - RNA, 64 nt, Homo Sapiens; identical to SEQ ID NO: 206138

SEQ ID NO: 363432 - RNA, 64 nt, Homo Sapiens; identical to SEQ ID NO: 206139

SEQ ID NO: 363433 - RNA, 64 nt, Homo Sapiens; identical to SEQ ID NO: 206140

SEQ ID NO: 363434 - RNA, 64 nt, Homo Sapiens; identical to SEQ ID NO: 206141

SEQ ID NO: 363435 - RNA, 64 nt, Homo Sapiens; identical to SEQ ID NO: 206142

SEQ ID NO: 363436 - RNA, 64 nt, Homo Sapiens; identical to SEQ ID NO: 206143

SEQ ID NO: 363437 - RNA, 64 nt, Homo Sapiens; identical to SEQ ID NO: 206144

SEQ ID NO: 363438 - RNA, 64 nt, Homo Sapiens; identical to SEQ ID NO: 206145

SEQ ID NO: 363439 - RNA, 64 nt, Homo Sapiens; identical to SEQ ID NO: 206146

SEQ ID NO: 363440 - RNA, 64 nt, Homo Sapiens; identical to SEQ ID NO: 206147

SEQ ID NO: 363441 - RNA, 64 nt, Homo Sapiens; identical to SEQ ID NO: 206148

SEQ ID NO: 363442 - RNA, 64 nt, Homo Sapiens; identical to SEQ ID NO: 206149

SEQ ID NO: 363443 - RNA, 64 nt, Homo Sapiens; identical to SEQ ID NO: 206150

SEQ ID NO: 363444 - RNA, 64 nt, Homo Sapiens
ggcagcuuguaggugauuguacaagugagaauuaaagagagaacagauauuuaaacaggugcug

SEQ ID NO: 363445 - RNA, 64 nt, Homo Sapiens
aacagguuccuaccagcagcacuggugugaaugaaagagagacccagccgcgucucacacaggu

SEQ ID NO: 363446 - RNA, 64 nt, Homo Sapiens
agucucccuuucccugucuggcuucucccuuaagaagagagagauacuuguagaauuggguggg

SEQ ID NO: 363447 - RNA, 64 nt, Homo Sapiens
gaauaaggagccuuucuuauggaagaaaugggagaagagagacaggguucuuuucagcagaguc

SEQ ID NO: 363448 - RNA, 64 nt, Homo Sapiens
uauccugagccaucggugaaacuaacagauaagcaagagagauguuuuggggacucauuucauu

SEQ ID NO: 363449 - RNA, 64 nt, Homo Sapiens
uguguguguguguguguguguguguguaugacuaaagagagaauguagauauugugaaguacau

SEQ ID NO: 363450 - RNA, 64 nt, Homo Sapiens
accaacguuccuaaaaguacugacuaaggaaucaaagagagagagugaaccauacuguccccaa

SEQ ID NO: 363451 - RNA, 64 nt, Homo Sapiens
gaagccagcccugccaaagggaggucucuaacugaagagagaugcugcugcugaacuuuuaaaa

SEQ ID NO: 363452 - RNA, 64 nt, Homo Sapiens
caaaaaagugugacauuacaucaaaaaaaaaaaaaagagagaaagugcaaauuauuuguaugcu

SEQ ID NO: 363453 - RNA, 64 nt, Homo Sapiens
gagagaaaaagaccaugcugcguucugagagaaaaagagagagacauguugcuguuuccaguuc

SEQ ID NO: 363454 - RNA, 64 nt, Homo Sapiens
cugugaaagaaccaaaagagaucacaauacucaaaagagagagagagagaaaaaagagagaucu

SEQ ID NO: 363455 - RNA, 64 nt, Homo Sapiens
gaucacaauacucaaaagagagagagagagaaaaaagagagaucuugauccacagaaauacaug

SEQ ID NO: 363456 - RNA, 64 nt, Homo Sapiens
gaaagagacccuacacauggccuagaaaugagagaagagagagguauuuacccagaggauuuuc

SEQ ID NO: 363457 - RNA, 64 nt, Homo Sapiens
aauugccccuuuuucuguuccuaaaaggaaggauaagagagaacauuccaggugaggcacuuca

SEQ ID NO: 363458 - RNA, 64 nt, Homo Sapiens
aagguugacuuuuugcacuucuguauauagucaaaagagagaaaccuguauaauaguaagaucu

SEQ ID NO: 363459 - RNA, 64 nt, Homo Sapiens
caaaacuacugcauguuuaaaacuucaacaaaaaaagagagaaagaacuauacuaagaacauau

SEQ ID NO: 363460 - RNA, 64 nt, Homo Sapiens
aaagaggaaguguucacuuucuaguuaaauguagaagagagaagaguuuuuuuuaaacaugauu

SEQ ID NO: 363461 - RNA, 64 nt, Homo Sapiens
aauauacauuauaaaagcaggauaugaaaaacagaagagagaaaaauagcauuuagaaguuuug

SEQ ID NO: 363462 - RNA, 64 nt, Homo Sapiens
ucagugacuguguugugauucauaguacauuaaaaagagagagagagagaaagaaucccacagg

SEQ ID NO: 363463 - RNA, 64 nt, Homo Sapiens
gaauucuugcacaccuuuccuaaaaauuucucccaagagagacuuguuugggccuuuuguggug

SEQ ID NO: 363464 - RNA, 64 nt, Homo Sapiens
gagagaggugugagggacaaauuuaauaaaaaaaaagagagagaaucuacuuuugcuaagaugc

SEQ ID NO: 363465 - RNA, 64 nt, Homo Sapiens
uuaggaagcaugagggcaacagaguuauuagagcaagagagagccuugggcuuggcccagaauu

SEQ ID NO: 363466 - RNA, 64 nt, Homo Sapiens
agauuaccugccacuuccaggagcccagagggccaagagagacauugccuccaccucuccuugg

SEQ ID NO: 363467 - RNA, 64 nt, Homo Sapiens
aggaguucguggcugcaaaagaaguuucuggagcaagagagagcucgcucuugggagucaggac

SEQ ID NO: 363468 - RNA, 64 nt, Homo Sapiens
gauguaauuuaaaaaguuuagauuuuaaaaaaaaaagagagagauuuugacauaaaagagccuu

SEQ ID NO: 363469 - RNA, 64 nt, Homo Sapiens
uccacggacgaaacauacggaggggaaugaauucaagagagaugggcgaggagaggagaaggcc

SEQ ID NO: 363470 - RNA, 64 nt, Homo Sapiens
ggaaacacacucuuucauuguguaguugcauuggaagagagaaaacaauguuaagggguuguug

SEQ ID NO: 363471 - RNA, 64 nt, Homo Sapiens
guggacucugaaucccuuuucugggacaacuaagaagagagaaugggaagugaggacuguccug

SEQ ID NO: 363472 - RNA, 64 nt, Homo Sapiens
guugcugcugucaugaccuauccauugaacuaagaagagagacccaaguucagaaacuagacau

SEQ ID NO: 363473 - RNA, 64 nt, Homo Sapiens
uagcauugugucugagguuauaucuuuuuuaaaaaagagagaauuaaaacugcucuaaaaaaaa

SEQ ID NO: 363474 - RNA, 56 nt, Homo Sapiens
uuacagccccaugcuacagguguaacaagagagacuccaauuuuuccuugauguga

SEQ ID NO: 363475 - RNA, 64 nt, Homo Sapiens
caaacauguaggaaaaaauagaaggaaagagaggaagagagaagauacacacacacgagagaca

SEQ ID NO: 363476 - RNA, 64 nt, Homo Sapiens
aguaccacuguggcuagauaaaauguaauaacaaaagagagagaucauuauacacuaugaggua

SEQ ID NO: 363477 - RNA, 64 nt, Homo Sapiens
uuuuagguaagagaaaagaaaaagauaaggaaagaagagagaagagagacaaagaucacuacag

SEQ ID NO: 363478 - RNA, 64 nt, Homo Sapiens
uaagagaaaagaaaaagauaaggaaagaagagagaagagagacaaagaucacuacagaccaaaa

SEQ ID NO: 363479 - RNA, 64 nt, Homo Sapiens
agauaccaaacaucacgagauauucguauuaggaaagagagacuuuggaguccuaauaguacuc

SEQ ID NO: 363480 - RNA, 64 nt, Homo Sapiens
agauuucacauuauccaucacacagacauagacaaagagagauacuuuuagccaguugcucugc

SEQ ID NO: 363481 - RNA, 64 nt, Homo Sapiens
uguaucuuugccaagaccgugaucaagguagcuuaagagagauggucaggagaaaacacuguuu

SEQ ID NO: 363482 - RNA, 64 nt, Homo Sapiens
cacacccaguauuugcagaagggcaaagcugcuuaagagagaggaucagggugaaguuuggcac

SEQ ID NO: 363483 - RNA, 64 nt, Homo Sapiens
gaauaaauguaaaguuugaccuuuuuaaaacgaaaagagagacaaagucucagcacauuccaag

SEQ ID NO: 363484 - RNA, 64 nt, Homo Sapiens
uagcucaucuguggugucagaauccuuggagcugaagagagaaaucaaaagagcaugaugaugg

SEQ ID NO: 363485 - RNA, 64 nt, Homo Sapiens
cagagagaaggagaaagagggagggagagagagaaagagagagaaagagagagagagagagaga

SEQ ID NO: 363486 - RNA, 64 nt, Homo Sapiens
gagaaagagggagggagagagagaaagagagagaaagagagagagagagagagagagagaaagc

SEQ ID NO: 363487 - RNA, 64 nt, Homo Sapiens
gugauaugugcuaagaagggaaaugaacuuaaucaagagagacuuuggggagacugacacagga

SEQ ID NO: 363488 - RNA, 64 nt, Homo Sapiens
ccccugugacgcccgggcuggggggccagaucagaagagagaggccaggacgucuguucuuugu

SEQ ID NO: 363489 - RNA, 64 nt, Homo Sapiens
gaugauggacccuuuccuaaugagccuccucaauaagagagaaguucucauugugggaaucuga

SEQ ID NO: 363490 - RNA, 64 nt, Homo Sapiens
auauugaaaaucauuuacauuggccuauauuuggaagagagauagucuuuuguuuuuaauaagu

SEQ ID NO: 363491 - RNA, 64 nt, Homo Sapiens
uauuaaucucauggaugguucucaaagguaaaaaaagagagagaaagagagagagcuagcugug

SEQ ID NO: 363492 - RNA, 64 nt, Homo Sapiens
auggaugguucucaaagguaaaaaaagagagagaaagagagagagcuagcugugggauucugug

SEQ ID NO: 363493 - RNA, 64 nt, Homo Sapiens
aagagaaugcgauggauuuuauuacacaugguggaagagagaagaggcguguagguuugcaaac

SEQ ID NO: 363494 - RNA, 64 nt, Homo Sapiens
acaugaaggccccuccccugggaucacuguguuuaagagagagugguuccugcuguuuauucuc

SEQ ID NO: 363495 - RNA, 64 nt, Homo Sapiens
uuuccucaguggaaaaacuuaugaaacuucuuauaagagagaguaaucucaggccggacaugcu

SEQ ID NO: 363496 - RNA, 64 nt, Homo Sapiens
cagagcaacacucugucuuaaaagaaaaaaaaaaaagagagagauaguaaucucuugggcaaaa

SEQ ID NO: 363497 - RNA, 64 nt, Homo Sapiens
caguucggggauauauuaagauauuuuuguacauaagagagaaagagagagaaaaauuuauaga

SEQ ID NO: 363498 - RNA, 64 nt, Homo Sapiens
ggauauauuaagauauuuuuguacauaagagagaaagagagagaaaaauuuauagaaguuuugu

SEQ ID NO: 363499 - RNA, 64 nt, Homo Sapiens
gagagaaagagaacaauauuaaaaaaaaaaaaaaaagagagagaagagcaagacucugucucag

SEQ ID NO: 363500 - RNA, 64 nt, Homo Sapiens
gccgggcgugguggcucacgaaaaaaaaaaaagaaagagagaggauccugucucucaaaaaaaa

SEQ ID NO: 363501 - RNA, 64 nt, Homo Sapiens
aggagagagacaguagccaaagagagagaggagaaagagagagagacauuuccuagagaaagag

SEQ ID NO: 363502 - RNA, 64 nt, Homo Sapiens
gagaggagaaagagagagaaacauuuccuagagaaagagagagaugaggccugcuucacaacag

SEQ ID NO: 363503 - RNA, 64 nt, Homo Sapiens
acagugagaccccuucucaaaaaaaaaaaaaaaaaagagagagugugugauuagaagcuaaaua

SEQ ID NO: 363504 - RNA, 64 nt, Homo Sapiens
ggcaacaagagcgagacuccguuuccaaaaaaauaagagagaauagaagaagcuacugcaugau

SEQ ID NO: 363505 - RNA, 64 nt, Homo Sapiens
aguuucacuccggagugagaagcuuugcccuccuaagagagagagacagagagacagagagaga

SEQ ID NO: 363506 - RNA, 64 nt, Homo Sapiens
cuaagagagagagacagagagacagagagagagaaagagagagugugugggucuauguaaaugc

SEQ ID NO: 363507 - RNA, 64 nt, Homo Sapiens
gccugcgggacagagugagacccugucugaaagaaagagagaaagaaagaaagaaagagagaga

SEQ ID NO: 363508 - RNA, 64 nt, Homo Sapiens
cccugucugaaagaaagagagaaagaaagaaagaaagagagagaaagaaagaaagaaagaaagg

SEQ ID NO: 363509 - RNA, 64 nt, Homo Sapiens
gaaagauggaaggaaggaaggaaaaagaaagagaaagagagagagagagaaagaaaaagaaaga

SEQ ID NO: 363510 - RNA, 64 nt, Homo Sapiens
gcaccauuuggaagcuugagagaaaccaaaauuaaagagagaaagagagagcgugcacgcuccu

SEQ ID NO: 363511 - RNA, 63 nt, Homo Sapiens
uggaagcuugagagaaaccaaaauuaaagagagaaagagagagcgugcacgcuccugcuuugu

SEQ ID NO: 363512 - RNA, 64 nt, Homo Sapiens
gcacaggcagccccacggacgagagaaggggcccaagagagacagagagaaagagagagagaga

SEQ ID NO: 363513 - RNA, 64 nt, Homo Sapiens
gagagagagaaggggcccaagagagagagagagaaagagagagacccccuccccgggcagcaga

SEQ ID NO: 363514 - RNA, 64 nt, Homo Sapiens
aguugucagagugaagaguuaaaaagaaaaacugaagagagagucaaaacuccaucuaaagaag

SEQ ID NO: 363515 - RNA, 64 nt, Homo Sapiens
ccaggcgcgguggcucacacuuguuuugaaauugaagagagaggagagugaugaaaaauugauc

SEQ ID NO: 363516 - RNA, 64 nt, Homo Sapiens
ucuccgggcccuuauuuauuagagagaguuuaccaagagagaugaccugggccuggccggagga

SEQ ID NO: 363517 - RNA, 64 nt, Homo Sapiens
uuaccaagagagaugucuccggccuggccggaggaagagagagugcugguguggaccacaccug

SEQ ID NO: 363518 - RNA, 64 nt, Homo Sapiens
gaaagaaagucuccagaccagaaagagagaaggaaagagagagaagcaacauagaagagggaag

SEQ ID NO: 363519 - RNA, 64 nt, Homo Sapiens
gaaagagagagagaaagaaaagaagagggaaggaaagagagaagcccuacccgcucagcaacau

SEQ ID NO: 363520 - RNA, 64 nt, Homo Sapiens
uaaccgaaggaaagaccguucaccagacuuggcuccucuaaacauuugcuguucaaacauguuu

SEQ ID NO: 363521 - RNA, 64 nt, Homo Sapiens
cucugucaugauggcgguugugcaauucugguauccucuaaauuuguaagcauucauaaaacag

SEQ ID NO: 363522 - RNA, 64 nt, Homo Sapiens
auuucagggguaggggagauugucauagagggaaccucuaaauagcuaaaaaaaagcaaggguu

SEQ ID NO: 363523 - RNA, 64 nt, Homo Sapiens
caugcuuagaggucaaggacucugugaauucuaaccucuaaagguuugacaauugaauuuguuu

SEQ ID NO: 363524 - RNA, 64 nt, Homo Sapiens
aaauuacauugugcucacacucagcaacauaauuccucuaaauacuucuuagguuauagccaag

SEQ ID NO: 363525 - RNA, 64 nt, Homo Sapiens
aaacaccaacaacaaaagaaggugccaguucccaccucuaaaaaucuggguaacauuuuuuaga

SEQ ID NO: 363526 - RNA, 64 nt, Homo Sapiens
aaacacaugacuucuucccagcagcccuucccggccucuaaaguuuggucccagcagcccuucc

SEQ ID NO: 363527 - RNA, 64 nt, Homo Sapiens
gccucuaaaguuuggucccagcagcccuucccagccucuaaaguuuggucugguaugaaauggg

SEQ ID NO: 363528 - RNA, 64 nt, Homo Sapiens; identical to SEQ ID NO: 96929

SEQ ID NO: 363529 - RNA, 64 nt, Homo Sapiens; identical to SEQ ID NO: 96930

SEQ ID NO: 363530 - RNA, 64 nt, Homo Sapiens; identical to SEQ ID NO: 96931

SEQ ID NO: 363531 - RNA, 64 nt, Homo Sapiens; identical to SEQ ID NO: 96932

SEQ ID NO: 363532 - RNA, 64 nt, Homo Sapiens; identical to SEQ ID NO: 96933

SEQ ID NO: 363533 - RNA, 64 nt, Homo Sapiens; identical to SEQ ID NO: 96934

SEQ ID NO: 363534 - RNA, 64 nt, Homo Sapiens; identical to SEQ ID NO: 96935

SEQ ID NO: 363535 - RNA, 64 nt, Homo Sapiens; identical to SEQ ID NO: 96936

SEQ ID NO: 363536 - RNA, 64 nt, Homo Sapiens
ggcccagaggagcugggagccgggccgcagacuugaccccgacgccacagcccagccacggacg

SEQ ID NO: 363537 - RNA, 64 nt, Homo Sapiens
uuuaaaaucgaucuacacacauccacgcacaugcgaccccgaggaaacgaaacccacucuagaa

SEQ ID NO: 363538 - RNA, 64 nt, Homo Sapiens; identical to SEQ ID NO: 283916

SEQ ID NO: 363539 - RNA, 64 nt, Homo Sapiens; identical to SEQ ID NO: 283917

SEQ ID NO: 363540 - RNA, 64 nt, Homo Sapiens; identical to SEQ ID NO: 283918

SEQ ID NO: 363541 - RNA, 64 nt, Homo Sapiens; identical to SEQ ID NO: 283919

SEQ ID NO: 363542 - RNA, 64 nt, Homo Sapiens; identical to SEQ ID NO: 164108

SEQ ID NO: 363543 - RNA, 64 nt, Homo Sapiens; identical to SEQ ID NO: 164109

SEQ ID NO: 363544 - RNA, 64 nt, Homo Sapiens; identical to SEQ ID NO: 164110

SEQ ID NO: 363545 - RNA, 64 nt, Homo Sapiens; identical to SEQ ID NO: 164111

SEQ ID NO: 363546 - RNA, 64 nt, Homo Sapiens; identical to SEQ ID NO: 164112

SEQ ID NO: 363547 - RNA, 64 nt, Homo Sapiens; identical to SEQ ID NO: 164113

SEQ ID NO: 363548 - RNA, 64 nt, Homo Sapiens; identical to SEQ ID NO: 164114

SEQ ID NO: 363549 - RNA, 64 nt, Homo Sapiens; identical to SEQ ID NO: 164115

SEQ ID NO: 363550 - RNA, 64 nt, Homo Sapiens; identical to SEQ ID NO: 164116

SEQ ID NO: 363551 - RNA, 64 nt, Homo Sapiens; identical to SEQ ID NO: 164117

SEQ ID NO: 363552 - RNA, 64 nt, Homo Sapiens; identical to SEQ ID NO: 164118

SEQ ID NO: 363553 - RNA, 64 nt, Homo Sapiens; identical to SEQ ID NO: 164119

SEQ ID NO: 363554 - RNA, 64 nt, Homo Sapiens; identical to SEQ ID NO: 164120

SEQ ID NO: 363555 - RNA, 64 nt, Homo Sapiens; identical to SEQ ID NO: 164121

SEQ ID NO: 363556 - RNA, 64 nt, Homo Sapiens; identical to SEQ ID NO: 164122

SEQ ID NO: 363557 - RNA, 64 nt, Homo Sapiens; identical to SEQ ID NO: 164123

SEQ ID NO: 363558 - RNA, 64 nt, Homo Sapiens; identical to SEQ ID NO: 164124

SEQ ID NO: 363559 - RNA, 64 nt, Homo Sapiens; identical to SEQ ID NO: 164125

SEQ ID NO: 363560 - RNA, 64 nt, Homo Sapiens; identical to SEQ ID NO: 164126

SEQ ID NO: 363561 - RNA, 64 nt, Homo Sapiens; identical to SEQ ID NO: 164127

SEQ ID NO: 363562 - RNA, 64 nt, Homo Sapiens; identical to SEQ ID NO: 164128

SEQ ID NO: 363563 - RNA, 64 nt, Homo Sapiens; identical to SEQ ID NO: 164129

SEQ ID NO: 363564 - RNA, 64 nt, Homo Sapiens; identical to SEQ ID NO: 164130

SEQ ID NO: 363565 - RNA, 64 nt, Homo Sapiens; identical to SEQ ID NO: 131343

SEQ ID NO: 363566 - RNA, 64 nt, Homo Sapiens; identical to SEQ ID NO: 131344

SEQ ID NO: 363567 - RNA, 64 nt, Homo Sapiens; identical to SEQ ID NO: 131345

SEQ ID NO: 363568 - RNA, 64 nt, Homo Sapiens; identical to SEQ ID NO: 131346

SEQ ID NO: 363569 - RNA, 64 nt, Homo Sapiens; identical to SEQ ID NO: 131347

SEQ ID NO: 363570 - RNA, 64 nt, Homo Sapiens; identical to SEQ ID NO: 131348

SEQ ID NO: 363571 - RNA, 64 nt, Homo Sapiens; identical to SEQ ID NO: 131349

SEQ ID NO: 363572 - RNA, 64 nt, Homo Sapiens; identical to SEQ ID NO: 131350

SEQ ID NO: 363573 - RNA, 64 nt, Homo Sapiens
guuugcccuacacggaugggcuguccugggagcuacuggacagucaccuuggugggaaugccag

SEQ ID NO: 363574 - RNA, 64 nt, Homo Sapiens
gugccagccacgugugaaagaagaacuccaaguuacuggacaccaggacaaaccagguagauca

SEQ ID NO: 363575 - RNA, 64 nt, Homo Sapiens
agucaaaacagggauguuugguuuuguuuuggaaacuggacaggagguguauguauguuuuguu

SEQ ID NO: 363576 - RNA, 64 nt, Homo Sapiens
gcuucugucucuguguguacaggcuggaggagccacuggacaaacucuaacaccacacagaaag

SEQ ID NO: 363577 - RNA, 64 nt, Homo Sapiens
cggucugcagugcacauuauagcuacgcaaaguuacuggacaugaccaaugagaggccacaucc

SEQ ID NO: 363578 - RNA, 64 nt, Homo Sapiens
cuuggggaaggguggggagaaauauaggauagacacuggacauggcccauuggagcaccugggc

SEQ ID NO: 363579 - RNA, 64 nt, Homo Sapiens
cacuggacauggcccauuggagcaccugggccccacuggacaacacugauuccuggagaggugg

SEQ ID NO: 363580 - RNA, 64 nt, Homo Sapiens
cuugaauaggaggaacgcugccaguuuuccuuucacuggacaauuugcuaaucauuucagaggu

SEQ ID NO: 363581 - RNA, 64 nt, Homo Sapiens
ccugaagcccauugccuaggaaagguuguuauggacuggacacccaaaaaaaaaaaaaaaaaag

SEQ ID NO: 363582 - RNA, 64 nt, Homo Sapiens
agaucagccaaauggccgaugacacaguggcagaacuggacaggcaucuggcagugaagaccaa

SEQ ID NO: 363583 - RNA, 64 nt, Homo Sapiens
cauuuuaaaacucugauauuggccuucaccugugacuggacacuuuacuagaggcccauuuuca

SEQ ID NO: 363584 - RNA, 64 nt, Homo Sapiens
uucuuuaugccacaccuaccgcuccuggagcuucacuggacauaugacuggaaacacgcagccu

SEQ ID NO: 363585 - RNA, 64 nt, Homo Sapiens
gaagucuccgcccugauuggccaacuucacugggacuggacaggccuggauuggacgggaucgc

SEQ ID NO: 363586 - RNA, 64 nt, Homo Sapiens
uguuuuaacuuucuuguggcaagcuauaccggaaaagcggcaugucaaaaauacuuuagguucu

SEQ ID NO: 363587 - RNA, 64 nt, Homo Sapiens
caucuuuagaaauguaaaauucaguauaguuugaaagcggcacaauuaaaaauuaauuuucuaa

SEQ ID NO: 363588 - RNA, 64 nt, Homo Sapiens
acuaugcccaggcugaaguccucacccucucuuaaagcggcaccaacgugagagagacaggcag

SEQ ID NO: 363589 - RNA, 64 nt, Homo Sapiens
gaggggcagccaggcugcucagggaaggggcugaaagcggcagaggagugcccuggcuugguca

SEQ ID NO: 363590 - RNA, 64 nt, Homo Sapiens
aguucugcguugaguggacggacuuauuccugugaagcggcauaauuugucuccauugaaaaau

SEQ ID NO: 363591 - RNA, 64 nt, Homo Sapiens
uugaagaaaaucugggggauucuuccaagaacagaagcggcauggcagaaucgaggcaguuaac

SEQ ID NO: 363592 - RNA, 64 nt, Homo Sapiens
uggcugcuggacgcaccgugcucgcugcccgcagaagcggcacugugcuggcgggcuccgggug

SEQ ID NO: 363593 - RNA, 64 nt, Homo Sapiens
cucuguucucuggaaugcucacuuuguauuuuugaagcggcaaaugcuugacugcaugcuggaa

SEQ ID NO: 363594 - RNA, 64 nt, Homo Sapiens
ugccaucuucugaaaacuccuuagagcauagaagaagcggcaccgcaugcagcucacaucuguu

SEQ ID NO: 363595 - RNA, 64 nt, Homo Sapiens
uuugggguugaacuuacuuggucuuaaugcugggaagcggcaacuagaagaggggugggugcau

SEQ ID NO: 363596 - RNA, 64 nt, Homo Sapiens
ucuuuacugaaagagagagcgaaacauuugccaaaagcggcagauacauguaaauagacaaaag

SEQ ID NO: 363597 - RNA, 64 nt, Homo Sapiens
cucuuccaaccacugacauguuguuuaauaaucuaagcggcaguccuggaggcuaccagacuua

SEQ ID NO: 363598 - RNA, 64 nt, Homo Sapiens
gcagacccaugcagugugcugccagggcuggaagaagcggcacccgggggcgcucaccugugaa

SEQ ID NO: 363599 - RNA, 64 nt, Homo Sapiens
gcgaagacugcuccuggugagccugugcauagggaagcggcagcaucggaugucagcccccugc

SEQ ID NO: 363600 - RNA, 64 nt, Homo Sapiens
gucagaguugaagaggcugacuuggcccacugcuaagcggcagaggcagggccagccauccugu

SEQ ID NO: 363601 - RNA, 64 nt, Homo Sapiens
uucaguccauaucaauugugccgugauagccagaaagcggcagucaaacuagcugugucaaggc

SEQ ID NO: 363602 - RNA, 64 nt, Homo Sapiens
cauuuugcggaggccaugcguggggccguuuguuaagcggcacuccagccggacugccgggcau

SEQ ID NO: 363603 - RNA, 64 nt, Homo Sapiens
ccuugcuuucccaaauacugcaugugacuuuccuaagcggcagcugaaagacucgagcccgugc

SEQ ID NO: 363604 - RNA, 64 nt, Homo Sapiens
aaaauaguggugaugagggcuuuaaccaagugcaaagcggcaugaaugcaaaguauuuuucugc

SEQ ID NO: 363605 - RNA, 64 nt, Homo Sapiens
gcacccguggugcaugguauaaagguccuguaagaagcggcauagaaggucuuuugagggcuaa

SEQ ID NO: 363606 - RNA, 64 nt, Homo Sapiens
agccaaugcacgccccugcacaauucaauuacaaaagcggcagcuguuuguuugagguuuaaaa

SEQ ID NO: 363607 - RNA, 64 nt, Homo Sapiens
ucugcgccaucuaccggcugcaugugggaagcugaagcggcagccgugcucaggcugcuccagg

SEQ ID NO: 363608 - RNA, 64 nt, Homo Sapiens
uggaauuucaguacagaacacugacaaacaaggaaagcggcagagaaagaagaaagaccuagaa

SEQ ID NO: 363609 - RNA, 64 nt, Homo Sapiens
cugugguuacccagugucuucucuacauggcauaaagcggcaaagcccaccauuaggugaggcg

SEQ ID NO: 363610 - RNA, 64 nt, Homo Sapiens
gagagaauguuugagguccagccuugguguagagaagcggcagaaacagaaaucccaaaaggug

SEQ ID NO: 363611 - RNA, 64 nt, Homo Sapiens
cagugcuuauuacaugcuaagauaacuggaaguaaagcggcaaauguguuuucacuuucgugca

SEQ ID NO: 363612 - RNA, 64 nt, Homo Sapiens
cucgcgcucagaaaaggaccuugugagacggaggaagcggcagaaggcggacgcgugccggcgg

SEQ ID NO: 363613 - RNA, 64 nt, Homo Sapiens
uuuguagcauacaaguuauuguuucgaugaguggaagcggcaugauaguaaggauuauuggcuu

SEQ ID NO: 363614 - RNA, 64 nt, Homo Sapiens
augcacauguugcaacaagagcuucugggaagguaagcggcaucggagcuagaucacguuucac

SEQ ID NO: 363615 - RNA, 64 nt, Homo Sapiens
caggcugacuggaagauggaaagccacaggaaggaagcggcaccugauggugaucuuggcacuc

SEQ ID NO: 363616 - RNA, 64 nt, Homo Sapiens
ggagcuagaucacguuucacgcuucugggaagguaagcggcaucaugcacauguugcaacaaga

SEQ ID NO: 363617 - RNA, 64 nt, Homo Sapiens
caggauugggcuuuucuggcccacugucaggguuaagcggcaggccagcuggauucucugccug

SEQ ID NO: 363618 - RNA, 64 nt, Homo Sapiens
gcucucccaaauagguaccucaaaaacuguuagcaagcggcauuuggaugucuugacaggggcu

SEQ ID NO: 363619 - RNA, 64 nt, Homo Sapiens
ugucucugggaaagcaagggaggcuuccuggaggaagcggcauuguuaugagccuugaaggaag

SEQ ID NO: 363620 - RNA, 59 nt, Homo Sapiens
caaucggagcgcgaggacguuccgcccaaaagcggcagcugcuacaauccagcuucuaa

SEQ ID NO: 363621 - RNA, 64 nt, Homo Sapiens
uaugugaccaaggcagcaggggcuuuuaccugcuaagcggcaauccuuuggcccugagaauuug

SEQ ID NO: 363622 - RNA, 64 nt, Homo Sapiens
acaugguccuucaaacucccaaccaaagugagaaaagcggcaugcagugaaaugagcagugagc

SEQ ID NO: 363623 - RNA, 64 nt, Homo Sapiens
uuucucaaucuugccucacagugacugcagcgccaagcggcauccaccaagcaucaaguuggag

SEQ ID NO: 363624 - RNA, 64 nt, Homo Sapiens
cacaaguccuccucagggagcucugcccugguggaagcggcagcgugcuggccccuccugugcc

SEQ ID NO: 363625 - RNA, 64 nt, Homo Sapiens
accugcuggcccauggcccggguguagagaaaccaagcggcagccaccaccaguguuguuuuga

SEQ ID NO: 363626 - RNA, 64 nt, Homo Sapiens
acacggagaccacuugguugucguuccugcagggaagcggcagccucuugcugggagguccgga

SEQ ID NO: 363627 - RNA, 64 nt, Homo Sapiens
agaugaccuauauaaaucaaagcaugcauauauacuucacaaaguguguaugaguuucuaugug

SEQ ID NO: 363628 - RNA, 64 nt, Homo Sapiens
cuauuugcauaagacaaaauuuacuucauuaauacuucacaauagguccuugaauaaaauuguc

SEQ ID NO: 363629 - RNA, 64 nt, Homo Sapiens
uaguucguaccuggcuugaaauuuuguaucaccucuucacaauucucucuuacugcuucaugua

SEQ ID NO: 363630 - RNA, 64 nt, Homo Sapiens
aaggaagaaaagaaggaguguggguccacacggucuucacaaagccauguucaccaagauuugg

SEQ ID NO: 363631 - RNA, 64 nt, Homo Sapiens
gcaagcccaguuucuccugagcauucagacccccaggccccagcacuuggcguuuucaggaggc

SEQ ID NO: 363632 - RNA, 64 nt, Homo Sapiens
cccaaaacacggccccgacacuuaguguggccccaggccccagcgagccucgcccucccaguuu

SEQ ID NO: 363633 - RNA, 64 nt, Homo Sapiens
ucccuccccuaaacugacuggacggcugccaaggaggccccaaacccaggccccaugcaaaggc

SEQ ID NO: 363634 - RNA, 64 nt, Homo Sapiens
cugacuggacggcugccaaggaggccccaaacccaggccccaugcaaaggcacgugguuuccuu

SEQ ID NO: 363635 - RNA, 64 nt, Homo Sapiens
gggccacuuggguuuugagaccagcuuucauuauaggccccaguuccauacccgaaaggugaaa

SEQ ID NO: 363636 - RNA, 64 nt, Homo Sapiens
cucaagcauuccucaggaagguuaggccugccgcaggccccaccagaggugaggccagaaaguu

SEQ ID NO: 363637 - RNA, 64 nt, Homo Sapiens
cuuuccucccagagcucagcccaugucacccuccaggccccagaauccagaguggccucauuuc

SEQ ID NO: 363638 - RNA, 64 nt, Homo Sapiens
gucuugcucugggaauuaggugaccuuccuggggaggccccaggagagugaaucagggacucuu

SEQ ID NO: 363639 - RNA, 64 nt, Homo Sapiens
ucagggucucaccucacauugucccuacaaggacaggccccaacugauaaccguugcuuuuuuu

SEQ ID NO: 363640 - RNA, 64 nt, Homo Sapiens
ugguggguaacacccucaagucucuuugccagugaggccccaccacaucggugugaguuagguu

SEQ ID NO: 363641 - RNA, 64 nt, Homo Sapiens
acacucaaaaucacugccaugguucaauguucccaggccccaggccauccacuugccggccccc

SEQ ID NO: 363642 - RNA, 64 nt, Homo Sapiens
cuaggguauccuugggcccaaugaauuaggggugaggccccagaacccguuaucuaugaguugu

SEQ ID NO: 363643 - RNA, 63 nt, Homo Sapiens
ucccagugaucuguauuugaugaggaggagccgaggccccagcuucauccagcuucaaccaau

SEQ ID NO: 363644 - RNA, 64 nt, Homo Sapiens
ccugcacacuccagcccaaagggucuguggccggaggccccacgagcaggccccagcagucacc

SEQ ID NO: 363645 - RNA, 64 nt, Homo Sapiens
gcccaaagggucuguggccggaggccccacgagcaggccccagcagucaccggcucuggucuug

SEQ ID NO: 363646 - RNA, 64 nt, Homo Sapiens
aacguacucaggcuugugccacgggugagcacugaggccccagguguccucccucccccacugu

SEQ ID NO: 363647 - RNA, 64 nt, Homo Sapiens
ggugagaacagguucugagagggggcuucuaggaaggccccagcccuaguccuaggcgacuuga

SEQ ID NO: 363648 - RNA, 64 nt, Homo Sapiens
aguguaagaaacacacugaggcagggaaguccccaggccccaggaagccgugcccugcccccgu

SEQ ID NO: 363649 - RNA, 64 nt, Homo Sapiens
gucccacucaagccaagcagccaagcuccuugggaggccccacuggggaaauaacagcuguggc

SEQ ID NO: 363650 - RNA, 64 nt, Homo Sapiens
ucuccacccugaacuccccagggaggccaccaccaggccccagcucggacuaugacuggcuacg

SEQ ID NO: 363651 - RNA, 64 nt, Homo Sapiens
cugagccugcccugggcagcaguguccccaacgcaggccccacuccccgaccugggaugcgcac

SEQ ID NO: 363652 - RNA, 64 nt, Homo Sapiens
cccugccucuccauuauuuaagccccuccaccucaggccccagcgucacauaagccaacgccag

SEQ ID NO: 363653 - RNA, 64 nt, Homo Sapiens
acccugugguccccuggcucuggaggugccagggaggccccaggccccagaggcgagggaccag

SEQ ID NO: 363654 - RNA, 64 nt, Homo Sapiens
uuugauggcacauuuaauaccucuuuuagaauugaggccccaaccuagaguaccuuugccuaaa

SEQ ID NO: 363655 - RNA, 64 nt, Homo Sapiens
agacacacacaugagcaggggcuuaccgggugauaggccccauauucccagcauccuaggcuca

SEQ ID NO: 363656 - RNA, 64 nt, Homo Sapiens
accacucguaggaggucucagccucuucgugggaaggccccaguaggcccgagagccuccccag

SEQ ID NO: 363657 - RNA, 64 nt, Homo Sapiens
gccgagacuccuggugacagggaccgcagcaggcaggccccagccagcaucagacgggcuucca

SEQ ID NO: 363658 - RNA, 64 nt, Homo Sapiens
ccgggcaaaggagcacaaggaaaccaagcagcagaggccccaucagcacagagggccucguucc

SEQ ID NO: 363659 - RNA, 64 nt, Homo Sapiens
aauucucuauucugacauuacagaccaccggauaaggccccauucuuccuuuacacccuccccu

SEQ ID NO: 363660 - RNA, 64 nt, Homo Sapiens
ucccuuuucccauuguuccugcgcugcaaauugcaggccccagcaaucgugacugacguuugcu

SEQ ID NO: 363661 - RNA, 64 nt, Homo Sapiens
uucgguugacccaggucauggaauggaaacggugaggccccaguggcuguucuggaagaaacag

SEQ ID NO: 363662 - RNA, 64 nt, Homo Sapiens
guggcuguucuggaagaaacagaucuccuggcaaaggccccagcaucucccucacugaaaccag

SEQ ID NO: 363663 - RNA, 64 nt, Homo Sapiens
gaacugagcuccucugggcaggaccucagaguccaggccccaaaaccacagcccugucagugca

SEQ ID NO: 363664 - RNA, 64 nt, Homo Sapiens
ccaacaccagggaugguacuagggggaagugacaaggccccagagacucagagggaggaaucga

SEQ ID NO: 363665 - RNA, 64 nt, Homo Sapiens
augauccugaaaucugcauccacccaaaugggccaggccccagcuccugacagaaagcuccucc

SEQ ID NO: 363666 - RNA, 57 nt, Homo Sapiens; identical to SEQ ID NO: 262389

SEQ ID NO: 363667 - RNA, 64 nt, Homo Sapiens
ggguccugggucuucccaaccauaccccgagaucaggccccaccugccagcucuacugggcuug

SEQ ID NO: 363668 - RNA, 64 nt, Homo Sapiens
cagacaccgucucacacguuggcuuuggacaaccaggccccaacuuggucccugcccuagggac

SEQ ID NO: 363669 - RNA, 64 nt, Homo Sapiens
ugcaggggaggcuguggggguccuggcagccaggaggccccaggugguuuugaggcucgcucuu

SEQ ID NO: 363670 - RNA, 64 nt, Homo Sapiens
gcggugccugagaagagggugaaggagcuggggcaggccccauccugggcauuggagaugauga

SEQ ID NO: 363671 - RNA, 64 nt, Homo Sapiens
gcccugaggggaucucaaaucucuaauaaauggaaggccccaagccaaauccuaaagccuccau

SEQ ID NO: 363672 - RNA, 64 nt, Homo Sapiens
cuaggacucuggggaucccaaccccaaaauuuggaggccccauuacgacuucccccuuuggggg

SEQ ID NO: 363673 - RNA, 64 nt, Homo Sapiens
auuaacagauacucccauaagcccucgaucauugaggccccauuguagagaccccuguuagcca

SEQ ID NO: 363674 - RNA, 64 nt, Homo Sapiens
uggcgcugcaggggugucggcgcgccaccucuccaggccccagaagcccuucuugcccaaaggc

SEQ ID NO: 363675 - RNA, 64 nt, Homo Sapiens
cacacaaaccucugugguauaggugaggggugugaggccccagccuggagccaggcacugggug

SEQ ID NO: 363676 - RNA, 64 nt, Homo Sapiens
augguaucugagcugcccacacccccaccugccaaggccccacagagcccaaaacagaaggggg

SEQ ID NO: 363677 - RNA, 64 nt, Homo Sapiens
gcagggccugcaggugcuccccgcccugagacccaggccccaaaucagcaauaaugaacaaacc

SEQ ID NO: 363678 - RNA, 64 nt, Homo Sapiens
gaggguauacugaggggucuggauugcuggggccaggccccaugcacccaagguugucagcuuu

SEQ ID NO: 363679 - RNA, 64 nt, Homo Sapiens
ccuucccuauaggaacagccggaauggaggagccaggccccaccggaacucuccuggccuucua

SEQ ID NO: 363680 - RNA, 64 nt, Homo Sapiens
ccuguaaucaggcaaggagggaggagaugugaucaggccccaccgcccagguauccugggggaa

SEQ ID NO: 363681 - RNA, 64 nt, Homo Sapiens; identical to SEQ ID NO: 363627

SEQ ID NO: 363682 - RNA, 64 nt, Homo Sapiens; identical to SEQ ID NO: 363628

SEQ ID NO: 363683 - RNA, 64 nt, Homo Sapiens; identical to SEQ ID NO: 363629

SEQ ID NO: 363684 - RNA, 64 nt, Homo Sapiens; identical to SEQ ID NO: 363630

SEQ ID NO: 363685 - RNA, 64 nt, Homo Sapiens; identical to SEQ ID NO: 363631

SEQ ID NO: 363686 - RNA, 64 nt, Homo Sapiens; identical to SEQ ID NO: 363632

SEQ ID NO: 363687 - RNA, 64 nt, Homo Sapiens; identical to SEQ ID NO: 363633

SEQ ID NO: 363688 - RNA, 64 nt, Homo Sapiens; identical to SEQ ID NO: 363634

SEQ ID NO: 363689 - RNA, 64 nt, Homo Sapiens; identical to SEQ ID NO: 363635

SEQ ID NO: 363690 - RNA, 64 nt, Homo Sapiens; identical to SEQ ID NO: 363636

SEQ ID NO: 363691 - RNA, 64 nt, Homo Sapiens; identical to SEQ ID NO: 363637

SEQ ID NO: 363692 - RNA, 64 nt, Homo Sapiens; identical to SEQ ID NO: 363638

SEQ ID NO: 363693 - RNA, 64 nt, Homo Sapiens; identical to SEQ ID NO: 363639

SEQ ID NO: 363694 - RNA, 64 nt, Homo Sapiens; identical to SEQ ID NO: 363640

SEQ ID NO: 363695 - RNA, 64 nt, Homo Sapiens; identical to SEQ ID NO: 363641

SEQ ID NO: 363696 - RNA, 64 nt, Homo Sapiens; identical to SEQ ID NO: 363642

SEQ ID NO: 363697 - RNA, 63 nt, Homo Sapiens; identical to SEQ ID NO: 363643

SEQ ID NO: 363698 - RNA, 64 nt, Homo Sapiens; identical to SEQ ID NO: 363644

SEQ ID NO: 363699 - RNA, 64 nt, Homo Sapiens; identical to SEQ ID NO: 363645

SEQ ID NO: 363700 - RNA, 64 nt, Homo Sapiens; identical to SEQ ID NO: 363646

SEQ ID NO: 363701 - RNA, 64 nt, Homo Sapiens; identical to SEQ ID NO: 363647

SEQ ID NO: 363702 - RNA, 64 nt, Homo Sapiens; identical to SEQ ID NO: 363648

SEQ ID NO: 363703 - RNA, 64 nt, Homo Sapiens; identical to SEQ ID NO: 363649

SEQ ID NO: 363704 - RNA, 64 nt, Homo Sapiens; identical to SEQ ID NO: 363650

SEQ ID NO: 363705 - RNA, 64 nt, Homo Sapiens; identical to SEQ ID NO: 363651

SEQ ID NO: 363706 - RNA, 64 nt, Homo Sapiens; identical to SEQ ID NO: 363652

SEQ ID NO: 363707 - RNA, 64 nt, Homo Sapiens; identical to SEQ ID NO: 363653

SEQ ID NO: 363708 - RNA, 64 nt, Homo Sapiens; identical to SEQ ID NO: 363654

SEQ ID NO: 363709 - RNA, 64 nt, Homo Sapiens; identical to SEQ ID NO: 363655

SEQ ID NO: 363710 - RNA, 64 nt, Homo Sapiens; identical to SEQ ID NO: 363656

SEQ ID NO: 363711 - RNA, 64 nt, Homo Sapiens; identical to SEQ ID NO: 363657

SEQ ID NO: 363712 - RNA, 64 nt, Homo Sapiens; identical to SEQ ID NO: 363658

SEQ ID NO: 363713 - RNA, 64 nt, Homo Sapiens; identical to SEQ ID NO: 363659

SEQ ID NO: 363714 - RNA, 64 nt, Homo Sapiens; identical to SEQ ID NO: 363660

SEQ ID NO: 363715 - RNA, 64 nt, Homo Sapiens; identical to SEQ ID NO: 363661

SEQ ID NO: 363716 - RNA, 64 nt, Homo Sapiens; identical to SEQ ID NO: 363662

SEQ ID NO: 363717 - RNA, 64 nt, Homo Sapiens; identical to SEQ ID NO: 363663

SEQ ID NO: 363718 - RNA, 64 nt, Homo Sapiens; identical to SEQ ID NO: 363664

SEQ ID NO: 363719 - RNA, 64 nt, Homo Sapiens; identical to SEQ ID NO: 363665

SEQ ID NO: 363720 - RNA, 57 nt, Homo Sapiens; identical to SEQ ID NO: 262389

SEQ ID NO: 363721 - RNA, 64 nt, Homo Sapiens; identical to SEQ ID NO: 363667

SEQ ID NO: 363722 - RNA, 64 nt, Homo Sapiens; identical to SEQ ID NO: 363668

SEQ ID NO: 363723 - RNA, 64 nt, Homo Sapiens; identical to SEQ ID NO: 363669

SEQ ID NO: 363724 - RNA, 64 nt, Homo Sapiens; identical to SEQ ID NO: 363670

SEQ ID NO: 363725 - RNA, 64 nt, Homo Sapiens; identical to SEQ ID NO: 363671

SEQ ID NO: 363726 - RNA, 64 nt, Homo Sapiens; identical to SEQ ID NO: 363672

SEQ ID NO: 363727 - RNA, 64 nt, Homo Sapiens; identical to SEQ ID NO: 363673

SEQ ID NO: 363728 - RNA, 64 nt, Homo Sapiens; identical to SEQ ID NO: 363674

SEQ ID NO: 363729 - RNA, 64 nt, Homo Sapiens; identical to SEQ ID NO: 363675

SEQ ID NO: 363730 - RNA, 64 nt, Homo Sapiens; identical to SEQ ID NO: 363676

SEQ ID NO: 363731 - RNA, 64 nt, Homo Sapiens; identical to SEQ ID NO: 363677

SEQ ID NO: 363732 - RNA, 64 nt, Homo Sapiens; identical to SEQ ID NO: 363678

SEQ ID NO: 363733 - RNA, 64 nt, Homo Sapiens; identical to SEQ ID NO: 363679

SEQ ID NO: 363734 - RNA, 64 nt, Homo Sapiens; identical to SEQ ID NO: 363680

SEQ ID NO: 363735 - RNA, 64 nt, Homo Sapiens; identical to SEQ ID NO: 363627

SEQ ID NO: 363736 - RNA, 64 nt, Homo Sapiens; identical to SEQ ID NO: 363628

SEQ ID NO: 363737 - RNA, 64 nt, Homo Sapiens; identical to SEQ ID NO: 363629

SEQ ID NO: 363738 - RNA, 64 nt, Homo Sapiens; identical to SEQ ID NO: 363630

SEQ ID NO: 363739 - RNA, 64 nt, Homo Sapiens; identical to SEQ ID NO: 363631

SEQ ID NO: 363740 - RNA, 64 nt, Homo Sapiens; identical to SEQ ID NO: 363632

SEQ ID NO: 363741 - RNA, 64 nt, Homo Sapiens; identical to SEQ ID NO: 363633

SEQ ID NO: 363742 - RNA, 64 nt, Homo Sapiens; identical to SEQ ID NO: 363634

SEQ ID NO: 363743 - RNA, 64 nt, Homo Sapiens; identical to SEQ ID NO: 363635

SEQ ID NO: 363744 - RNA, 64 nt, Homo Sapiens; identical to SEQ ID NO: 363636

SEQ ID NO: 363745 - RNA, 64 nt, Homo Sapiens; identical to SEQ ID NO: 363637

SEQ ID NO: 363746 - RNA, 64 nt, Homo Sapiens; identical to SEQ ID NO: 363638

SEQ ID NO: 363747 - RNA, 64 nt, Homo Sapiens; identical to SEQ ID NO: 363639

SEQ ID NO: 363748 - RNA, 64 nt, Homo Sapiens; identical to SEQ ID NO: 363640

SEQ ID NO: 363749 - RNA, 64 nt, Homo Sapiens; identical to SEQ ID NO: 363641

SEQ ID NO: 363750 - RNA, 64 nt, Homo Sapiens; identical to SEQ ID NO: 363642

SEQ ID NO: 363751 - RNA, 63 nt, Homo Sapiens; identical to SEQ ID NO: 363643

SEQ ID NO: 363752 - RNA, 64 nt, Homo Sapiens; identical to SEQ ID NO: 363644

SEQ ID NO: 363753 - RNA, 64 nt, Homo Sapiens; identical to SEQ ID NO: 363645

SEQ ID NO: 363754 - RNA, 64 nt, Homo Sapiens; identical to SEQ ID NO: 363646

SEQ ID NO: 363755 - RNA, 64 nt, Homo Sapiens; identical to SEQ ID NO: 363647

SEQ ID NO: 363756 - RNA, 64 nt, Homo Sapiens; identical to SEQ ID NO: 363648

SEQ ID NO: 363757 - RNA, 64 nt, Homo Sapiens; identical to SEQ ID NO: 363649

SEQ ID NO: 363758 - RNA, 64 nt, Homo Sapiens; identical to SEQ ID NO: 363650

SEQ ID NO: 363759 - RNA, 64 nt, Homo Sapiens; identical to SEQ ID NO: 363651

SEQ ID NO: 363760 - RNA, 64 nt, Homo Sapiens; identical to SEQ ID NO: 363652

SEQ ID NO: 363761 - RNA, 64 nt, Homo Sapiens; identical to SEQ ID NO: 363653

SEQ ID NO: 363762 - RNA, 64 nt, Homo Sapiens; identical to SEQ ID NO: 363654

SEQ ID NO: 363763 - RNA, 64 nt, Homo Sapiens; identical to SEQ ID NO: 363655

SEQ ID NO: 363764 - RNA, 64 nt, Homo Sapiens; identical to SEQ ID NO: 363656

SEQ ID NO: 363765 - RNA, 64 nt, Homo Sapiens; identical to SEQ ID NO: 363657

SEQ ID NO: 363766 - RNA, 64 nt, Homo Sapiens; identical to SEQ ID NO: 363658

SEQ ID NO: 363767 - RNA, 64 nt, Homo Sapiens; identical to SEQ ID NO: 363659

SEQ ID NO: 363768 - RNA, 64 nt, Homo Sapiens; identical to SEQ ID NO: 363660

SEQ ID NO: 363769 - RNA, 64 nt, Homo Sapiens; identical to SEQ ID NO: 363661

SEQ ID NO: 363770 - RNA, 64 nt, Homo Sapiens; identical to SEQ ID NO: 363662

SEQ ID NO: 363771 - RNA, 64 nt, Homo Sapiens; identical to SEQ ID NO: 363663

SEQ ID NO: 363772 - RNA, 64 nt, Homo Sapiens; identical to SEQ ID NO: 363664

SEQ ID NO: 363773 - RNA, 64 nt, Homo Sapiens; identical to SEQ ID NO: 363665

SEQ ID NO: 363774 - RNA, 57 nt, Homo Sapiens; identical to SEQ ID NO: 262389

SEQ ID NO: 363775 - RNA, 64 nt, Homo Sapiens; identical to SEQ ID NO: 363667

SEQ ID NO: 363776 - RNA, 64 nt, Homo Sapiens; identical to SEQ ID NO: 363668

SEQ ID NO: 363777 - RNA, 64 nt, Homo Sapiens; identical to SEQ ID NO: 363669

SEQ ID NO: 363778 - RNA, 64 nt, Homo Sapiens; identical to SEQ ID NO: 363670

SEQ ID NO: 363779 - RNA, 64 nt, Homo Sapiens; identical to SEQ ID NO: 363671

SEQ ID NO: 363780 - RNA, 64 nt, Homo Sapiens; identical to SEQ ID NO: 363672

SEQ ID NO: 363781 - RNA, 64 nt, Homo Sapiens; identical to SEQ ID NO: 363673

SEQ ID NO: 363782 - RNA, 64 nt, Homo Sapiens; identical to SEQ ID NO: 363674

SEQ ID NO: 363783 - RNA, 64 nt, Homo Sapiens; identical to SEQ ID NO: 363675

SEQ ID NO: 363784 - RNA, 64 nt, Homo Sapiens; identical to SEQ ID NO: 363676

SEQ ID NO: 363785 - RNA, 64 nt, Homo Sapiens; identical to SEQ ID NO: 363677

SEQ ID NO: 363786 - RNA, 64 nt, Homo Sapiens; identical to SEQ ID NO: 363678

SEQ ID NO: 363787 - RNA, 64 nt, Homo Sapiens; identical to SEQ ID NO: 363679

SEQ ID NO: 363788 - RNA, 64 nt, Homo Sapiens; identical to SEQ ID NO: 363680

SEQ ID NO: 363789 - RNA, 64 nt, Homo Sapiens; identical to SEQ ID NO: 361852

SEQ ID NO: 363790 - RNA, 64 nt, Homo Sapiens; identical to SEQ ID NO: 361853

SEQ ID NO: 363791 - RNA, 64 nt, Homo Sapiens; identical to SEQ ID NO: 361854

SEQ ID NO: 363792 - RNA, 64 nt, Homo Sapiens; identical to SEQ ID NO: 361855

SEQ ID NO: 363793 - RNA, 64 nt, Homo Sapiens; identical to SEQ ID NO: 361856

SEQ ID NO: 363794 - RNA, 64 nt, Homo Sapiens; identical to SEQ ID NO: 361857

SEQ ID NO: 363795 - RNA, 64 nt, Homo Sapiens; identical to SEQ ID NO: 361858

SEQ ID NO: 363796 - RNA, 64 nt, Homo Sapiens; identical to SEQ ID NO: 361859

SEQ ID NO: 363797 - RNA, 64 nt, Homo Sapiens; identical to SEQ ID NO: 361860

SEQ ID NO: 363798 - RNA, 64 nt, Homo Sapiens; identical to SEQ ID NO: 361861

SEQ ID NO: 363799 - RNA, 64 nt, Homo Sapiens; identical to SEQ ID NO: 361862

SEQ ID NO: 363800 - RNA, 64 nt, Homo Sapiens; identical to SEQ ID NO: 361863

SEQ ID NO: 363801 - RNA, 64 nt, Homo Sapiens; identical to SEQ ID NO: 361864

SEQ ID NO: 363802 - RNA, 64 nt, Homo Sapiens; identical to SEQ ID NO: 361865

SEQ ID NO: 363803 - RNA, 64 nt, Homo Sapiens; identical to SEQ ID NO: 361866

SEQ ID NO: 363804 - RNA, 64 nt, Homo Sapiens; identical to SEQ ID NO: 361867

SEQ ID NO: 363805 - RNA, 64 nt, Homo Sapiens; identical to SEQ ID NO: 361868

SEQ ID NO: 363806 - RNA, 64 nt, Homo Sapiens; identical to SEQ ID NO: 361869

SEQ ID NO: 363807 - RNA, 64 nt, Homo Sapiens; identical to SEQ ID NO: 361870

SEQ ID NO: 363808 - RNA, 64 nt, Homo Sapiens; identical to SEQ ID NO: 361871

SEQ ID NO: 363809 - RNA, 64 nt, Homo Sapiens; identical to SEQ ID NO: 361872

SEQ ID NO: 363810 - RNA, 64 nt, Homo Sapiens; identical to SEQ ID NO: 361873

SEQ ID NO: 363811 - RNA, 64 nt, Homo Sapiens; identical to SEQ ID NO: 361874

SEQ ID NO: 363812 - RNA, 64 nt, Homo Sapiens; identical to SEQ ID NO: 361875

SEQ ID NO: 363813 - RNA, 64 nt, Homo Sapiens; identical to SEQ ID NO: 361876

SEQ ID NO: 363814 - RNA, 64 nt, Homo Sapiens; identical to SEQ ID NO: 361877

SEQ ID NO: 363815 - RNA, 64 nt, Homo Sapiens; identical to SEQ ID NO: 361878

SEQ ID NO: 363816 - RNA, 64 nt, Homo Sapiens; identical to SEQ ID NO: 361879

SEQ ID NO: 363817 - RNA, 64 nt, Homo Sapiens; identical to SEQ ID NO: 361880

SEQ ID NO: 363818 - RNA, 64 nt, Homo Sapiens; identical to SEQ ID NO: 361881

SEQ ID NO: 363819 - RNA, 64 nt, Homo Sapiens; identical to SEQ ID NO: 361882

SEQ ID NO: 363820 - RNA, 64 nt, Homo Sapiens; identical to SEQ ID NO: 361883

SEQ ID NO: 363821 - RNA, 64 nt, Homo Sapiens; identical to SEQ ID NO: 361884

SEQ ID NO: 363822 - RNA, 64 nt, Homo Sapiens; identical to SEQ ID NO: 361885

SEQ ID NO: 363823 - RNA, 64 nt, Homo Sapiens; identical to SEQ ID NO: 361886

SEQ ID NO: 363824 - RNA, 64 nt, Homo Sapiens; identical to SEQ ID NO: 361887

SEQ ID NO: 363825 - RNA, 64 nt, Homo Sapiens; identical to SEQ ID NO: 361888

SEQ ID NO: 363826 - RNA, 64 nt, Homo Sapiens; identical to SEQ ID NO: 361889

SEQ ID NO: 363827 - RNA, 64 nt, Homo Sapiens; identical to SEQ ID NO: 361890

SEQ ID NO: 363828 - RNA, 64 nt, Homo Sapiens; identical to SEQ ID NO: 361891

SEQ ID NO: 363829 - RNA, 64 nt, Homo Sapiens; identical to SEQ ID NO: 361892

SEQ ID NO: 363830 - RNA, 64 nt, Homo Sapiens; identical to SEQ ID NO: 361893

SEQ ID NO: 363831 - RNA, 64 nt, Homo Sapiens; identical to SEQ ID NO: 361894

SEQ ID NO: 363832 - RNA, 64 nt, Homo Sapiens; identical to SEQ ID NO: 361895

SEQ ID NO: 363833 - RNA, 64 nt, Homo Sapiens; identical to SEQ ID NO: 361896

SEQ ID NO: 363834 - RNA, 64 nt, Homo Sapiens; identical to SEQ ID NO: 361897

SEQ ID NO: 363835 - RNA, 64 nt, Homo Sapiens; identical to SEQ ID NO: 361898

SEQ ID NO: 363836 - RNA, 64 nt, Homo Sapiens; identical to SEQ ID NO: 361899

SEQ ID NO: 363837 - RNA, 64 nt, Homo Sapiens; identical to SEQ ID NO: 361900

SEQ ID NO: 363838 - RNA, 64 nt, Homo Sapiens; identical to SEQ ID NO: 361901

SEQ ID NO: 363839 - RNA, 64 nt, Homo Sapiens; identical to SEQ ID NO: 361902

SEQ ID NO: 363840 - RNA, 64 nt, Homo Sapiens; identical to SEQ ID NO: 361903

SEQ ID NO: 363841 - RNA, 64 nt, Homo Sapiens; identical to SEQ ID NO: 361904

SEQ ID NO: 363842 - RNA, 64 nt, Homo Sapiens; identical to SEQ ID NO: 361905

SEQ ID NO: 363843 - RNA, 64 nt, Homo Sapiens; identical to SEQ ID NO: 361906

SEQ ID NO: 363844 - RNA, 64 nt, Homo Sapiens; identical to SEQ ID NO: 361907

SEQ ID NO: 363845 - RNA, 64 nt, Homo Sapiens; identical to SEQ ID NO: 361908

SEQ ID NO: 363846 - RNA, 64 nt, Homo Sapiens; identical to SEQ ID NO: 361909

SEQ ID NO: 363847 - RNA, 64 nt, Homo Sapiens; identical to SEQ ID NO: 361910

SEQ ID NO: 363848 - RNA, 64 nt, Homo Sapiens; identical to SEQ ID NO: 361911

SEQ ID NO: 363849 - RNA, 64 nt, Homo Sapiens; identical to SEQ ID NO: 361912

SEQ ID NO: 363850 - RNA, 64 nt, Homo Sapiens; identical to SEQ ID NO: 178899

SEQ ID NO: 363851 - RNA, 64 nt, Homo Sapiens; identical to SEQ ID NO: 178900

SEQ ID NO: 363852 - RNA, 64 nt, Homo Sapiens; identical to SEQ ID NO: 178901

SEQ ID NO: 363853 - RNA, 64 nt, Homo Sapiens; identical to SEQ ID NO: 178902

SEQ ID NO: 363854 - RNA, 64 nt, Homo Sapiens; identical to SEQ ID NO: 178903

SEQ ID NO: 363855 - RNA, 64 nt, Homo Sapiens; identical to SEQ ID NO: 178904

SEQ ID NO: 363856 - RNA, 64 nt, Homo Sapiens; identical to SEQ ID NO: 178905

SEQ ID NO: 363857 - RNA, 64 nt, Homo Sapiens; identical to SEQ ID NO: 178906

SEQ ID NO: 363858 - RNA, 64 nt, Homo Sapiens; identical to SEQ ID NO: 178907

SEQ ID NO: 363859 - RNA, 64 nt, Homo Sapiens; identical to SEQ ID NO: 178908

SEQ ID NO: 363860 - RNA, 64 nt, Homo Sapiens; identical to SEQ ID NO: 178909

SEQ ID NO: 363861 - RNA, 64 nt, Homo Sapiens; identical to SEQ ID NO: 178910

SEQ ID NO: 363862 - RNA, 64 nt, Homo Sapiens; identical to SEQ ID NO: 178911

SEQ ID NO: 363863 - RNA, 64 nt, Homo Sapiens; identical to SEQ ID NO: 178912

SEQ ID NO: 363864 - RNA, 64 nt, Homo Sapiens; identical to SEQ ID NO: 178913

SEQ ID NO: 363865 - RNA, 64 nt, Homo Sapiens; identical to SEQ ID NO: 178914

SEQ ID NO: 363866 - RNA, 64 nt, Homo Sapiens; identical to SEQ ID NO: 178915

SEQ ID NO: 363867 - RNA, 64 nt, Homo Sapiens; identical to SEQ ID NO: 178916

SEQ ID NO: 363868 - RNA, 64 nt, Homo Sapiens; identical to SEQ ID NO: 178917

SEQ ID NO: 363869 - RNA, 64 nt, Homo Sapiens; identical to SEQ ID NO: 178918

SEQ ID NO: 363870 - RNA, 64 nt, Homo Sapiens; identical to SEQ ID NO: 178919

SEQ ID NO: 363871 - RNA, 64 nt, Homo Sapiens; identical to SEQ ID NO: 178920

SEQ ID NO: 363872 - RNA, 64 nt, Homo Sapiens; identical to SEQ ID NO: 178921

SEQ ID NO: 363873 - RNA, 64 nt, Homo Sapiens; identical to SEQ ID NO: 178922

SEQ ID NO: 363874 - RNA, 64 nt, Homo Sapiens; identical to SEQ ID NO: 178923

SEQ ID NO: 363875 - RNA, 64 nt, Homo Sapiens; identical to SEQ ID NO: 178924

SEQ ID NO: 363876 - RNA, 58 nt, Homo Sapiens; identical to SEQ ID NO: 178925

SEQ ID NO: 363877 - RNA, 64 nt, Homo Sapiens; identical to SEQ ID NO: 178926

SEQ ID NO: 363878 - RNA, 64 nt, Homo Sapiens; identical to SEQ ID NO: 178927

SEQ ID NO: 363879 - RNA, 64 nt, Homo Sapiens; identical to SEQ ID NO: 178928

SEQ ID NO: 363880 - RNA, 64 nt, Homo Sapiens; identical to SEQ ID NO: 178929

SEQ ID NO: 363881 - RNA, 64 nt, Homo Sapiens; identical to SEQ ID NO: 178930

SEQ ID NO: 363882 - RNA, 64 nt, Homo Sapiens; identical to SEQ ID NO: 178931

SEQ ID NO: 363883 - RNA, 64 nt, Homo Sapiens; identical to SEQ ID NO: 178932

SEQ ID NO: 363884 - RNA, 64 nt, Homo Sapiens; identical to SEQ ID NO: 178933

SEQ ID NO: 363885 - RNA, 64 nt, Homo Sapiens; identical to SEQ ID NO: 178934

SEQ ID NO: 363886 - RNA, 64 nt, Homo Sapiens; identical to SEQ ID NO: 178935

SEQ ID NO: 363887 - RNA, 64 nt, Homo Sapiens; identical to SEQ ID NO: 178936

SEQ ID NO: 363888 - RNA, 64 nt, Homo Sapiens; identical to SEQ ID NO: 178937

SEQ ID NO: 363889 - RNA, 64 nt, Homo Sapiens; identical to SEQ ID NO: 178938

SEQ ID NO: 363890 - RNA, 64 nt, Homo Sapiens; identical to SEQ ID NO: 178939

SEQ ID NO: 363891 - RNA, 64 nt, Homo Sapiens; identical to SEQ ID NO: 178940

SEQ ID NO: 363892 - RNA, 64 nt, Homo Sapiens; identical to SEQ ID NO: 178941

SEQ ID NO: 363893 - RNA, 64 nt, Homo Sapiens; identical to SEQ ID NO: 178942

SEQ ID NO: 363894 - RNA, 64 nt, Homo Sapiens; identical to SEQ ID NO: 178943

SEQ ID NO: 363895 - RNA, 64 nt, Homo Sapiens; identical to SEQ ID NO: 178944

SEQ ID NO: 363896 - RNA, 60 nt, Homo Sapiens; identical to SEQ ID NO: 178945

SEQ ID NO: 363897 - RNA, 64 nt, Homo Sapiens; identical to SEQ ID NO: 178946

SEQ ID NO: 363898 - RNA, 64 nt, Homo Sapiens; identical to SEQ ID NO: 178947

SEQ ID NO: 363899 - RNA, 64 nt, Homo Sapiens; identical to SEQ ID NO: 178948

SEQ ID NO: 363900 - RNA, 64 nt, Homo Sapiens; identical to SEQ ID NO: 178949

SEQ ID NO: 363901 - RNA, 64 nt, Homo Sapiens; identical to SEQ ID NO: 178950

SEQ ID NO: 363902 - RNA, 64 nt, Homo Sapiens; identical to SEQ ID NO: 178951

SEQ ID NO: 363903 - RNA, 64 nt, Homo Sapiens; identical to SEQ ID NO: 178952

SEQ ID NO: 363904 - RNA, 64 nt, Homo Sapiens; identical to SEQ ID NO: 178953

SEQ ID NO: 363905 - RNA, 64 nt, Homo Sapiens; identical to SEQ ID NO: 178954

SEQ ID NO: 363906 - RNA, 64 nt, Homo Sapiens; identical to SEQ ID NO: 178955

SEQ ID NO: 363907 - RNA, 64 nt, Homo Sapiens; identical to SEQ ID NO: 178956

SEQ ID NO: 363908 - RNA, 64 nt, Homo Sapiens; identical to SEQ ID NO: 178957

SEQ ID NO: 363909 - RNA, 64 nt, Homo Sapiens; identical to SEQ ID NO: 178958

SEQ ID NO: 363910 - RNA, 64 nt, Homo Sapiens; identical to SEQ ID NO: 178959

SEQ ID NO: 363911 - RNA, 64 nt, Homo Sapiens; identical to SEQ ID NO: 178960

SEQ ID NO: 363912 - RNA, 64 nt, Homo Sapiens; identical to SEQ ID NO: 178961

SEQ ID NO: 363913 - RNA, 64 nt, Homo Sapiens; identical to SEQ ID NO: 178962

SEQ ID NO: 363914 - RNA, 64 nt, Homo Sapiens; identical to SEQ ID NO: 178963

SEQ ID NO: 363915 - RNA, 64 nt, Homo Sapiens; identical to SEQ ID NO: 178964

SEQ ID NO: 363916 - RNA, 64 nt, Homo Sapiens; identical to SEQ ID NO: 178965

SEQ ID NO: 363917 - RNA, 64 nt, Homo Sapiens; identical to SEQ ID NO: 178966

SEQ ID NO: 363918 - RNA, 64 nt, Homo Sapiens; identical to SEQ ID NO: 178967

SEQ ID NO: 363919 - RNA, 64 nt, Homo Sapiens; identical to SEQ ID NO: 178968

SEQ ID NO: 363920 - RNA, 64 nt, Homo Sapiens; identical to SEQ ID NO: 178969

SEQ ID NO: 363921 - RNA, 64 nt, Homo Sapiens; identical to SEQ ID NO: 178970

SEQ ID NO: 363922 - RNA, 64 nt, Homo Sapiens; identical to SEQ ID NO: 178971

SEQ ID NO: 363923 - RNA, 64 nt, Homo Sapiens; identical to SEQ ID NO: 178972

SEQ ID NO: 363924 - RNA, 64 nt, Homo Sapiens; identical to SEQ ID NO: 178973

SEQ ID NO: 363925 - RNA, 64 nt, Homo Sapiens; identical to SEQ ID NO: 178974

SEQ ID NO: 363926 - RNA, 64 nt, Homo Sapiens; identical to SEQ ID NO: 178975

SEQ ID NO: 363927 - RNA, 64 nt, Homo Sapiens; identical to SEQ ID NO: 178976

SEQ ID NO: 363928 - RNA, 64 nt, Homo Sapiens; identical to SEQ ID NO: 178977

SEQ ID NO: 363929 - RNA, 64 nt, Homo Sapiens; identical to SEQ ID NO: 178978

SEQ ID NO: 363930 - RNA, 64 nt, Homo Sapiens; identical to SEQ ID NO: 178979

SEQ ID NO: 363931 - RNA, 64 nt, Homo Sapiens; identical to SEQ ID NO: 178980

SEQ ID NO: 363932 - RNA, 64 nt, Homo Sapiens; identical to SEQ ID NO: 178981

SEQ ID NO: 363933 - RNA, 64 nt, Homo Sapiens; identical to SEQ ID NO: 178982

SEQ ID NO: 363934 - RNA, 64 nt, Homo Sapiens; identical to SEQ ID NO: 178983

SEQ ID NO: 363935 - RNA, 64 nt, Homo Sapiens; identical to SEQ ID NO: 178984

SEQ ID NO: 363936 - RNA, 64 nt, Homo Sapiens; identical to SEQ ID NO: 178985

SEQ ID NO: 363937 - RNA, 64 nt, Homo Sapiens; identical to SEQ ID NO: 178986

SEQ ID NO: 363938 - RNA, 64 nt, Homo Sapiens; identical to SEQ ID NO: 178987

SEQ ID NO: 363939 - RNA, 64 nt, Homo Sapiens; identical to SEQ ID NO: 178988

SEQ ID NO: 363940 - RNA, 64 nt, Homo Sapiens; identical to SEQ ID NO: 178989

SEQ ID NO: 363941 - RNA, 64 nt, Homo Sapiens; identical to SEQ ID NO: 178990

SEQ ID NO: 363942 - RNA, 64 nt, Homo Sapiens; identical to SEQ ID NO: 178991

SEQ ID NO: 363943 - RNA, 64 nt, Homo Sapiens
auggaaagaggugaaaaugaagaaggaagcuguguugaaacagaaaaauaagucaaaaggaaca

SEQ ID NO: 363944 - RNA, 64 nt, Homo Sapiens
uaugacaugaaaaguuauuuaugcuauaaauuuuuugaaacacaauaccuacaauaaacuggua

SEQ ID NO: 363945 - RNA, 64 nt, Homo Sapiens
caaauacuuugauauauuauaacucuauuggucuuugaaacaaagcgauacaguguagguggua

SEQ ID NO: 363946 - RNA, 64 nt, Homo Sapiens
aaacaggggagcuuugucuggaaaauacacugaguugaaacacuucauccuuggaaggauuaua

SEQ ID NO: 363947 - RNA, 64 nt, Homo Sapiens
guguucuguugaaauuuuuguuuuuuuaccuuuauugaaacaacaaaaagucaguauugaaaca

SEQ ID NO: 363948 - RNA, 64 nt, Homo Sapiens
uuuuuaccuuuauugaaacaacaaaaagucaguauugaaacauaucuuccuguuuucuguuguc

SEQ ID NO: 363949 - RNA, 64 nt, Homo Sapiens
acuuauguauuuaugaccuuauaguguuaauaucuugaaacauagagaucuauguacuguaaua

SEQ ID NO: 363950 - RNA, 64 nt, Homo Sapiens
gaaaugucuggucuguccaccccaucaacaagucuugaaacaagcaacagauggauagucuguc

SEQ ID NO: 363951 - RNA, 64 nt, Homo Sapiens
gugagcagucuucuuaugugucagcucauuauuuuugaaacauuugccuuuaggcuguucuuug

SEQ ID NO: 363952 - RNA, 64 nt, Homo Sapiens
agcccccucuugggggguuggggaagucucuuuuuugaaacacuucagaacugcugcuauaaag

SEQ ID NO: 363953 - RNA, 64 nt, Homo Sapiens
ugaacacuugaugacuuuaguagucuuacccuccuugaaacacucuaugcuaaguccuuguuaa

SEQ ID NO: 363954 - RNA, 64 nt, Homo Sapiens
uuaaucugugguuacuaaucuccugucuuaacuauugaaacaccuaaaaacucuuguuccaaag

SEQ ID NO: 363955 - RNA, 64 nt, Homo Sapiens
aggugcaaaacauagauauagaacugaacagggcuugaaacaauauuaggauuacuacccaggg

SEQ ID NO: 363956 - RNA, 64 nt, Homo Sapiens
uuucuucaguuagaaauauauauccuuccuucaguugaaacauauaccuuuuucacaucuagga

SEQ ID NO: 363957 - RNA, 64 nt, Homo Sapiens
auugcuucaauaugcuuauuuaaaaauguaaauauugaaacaagcaucuauuuauaugcaaaca

SEQ ID NO: 363958 - RNA, 64 nt, Homo Sapiens
accaguguccucuaagucucgggauguagauaaguugaaacaaauaguucuuguagauaacaca

SEQ ID NO: 363959 - RNA, 64 nt, Homo Sapiens
uuuauacuuucugauauaguuuuuuuuuuucuguuugaaacaguuuuuggggggcuuaaggauu

SEQ ID NO: 363960 - RNA, 64 nt, Homo Sapiens
ucacuucagggcuuggaaaaccugaauguggacguugaaacauacuaguugacuuuucucuuag

SEQ ID NO: 363961 - RNA, 64 nt, Homo Sapiens
ugccaagaacuuucucuugcuaucauugcuccuuuugaaacaauucaauuuucaugucuacagc

SEQ ID NO: 363962 - RNA, 64 nt, Homo Sapiens
aaagguaacaaucuucauucuacagaugaacucauugaaacaauuuaggggaaugaggggcaaa

SEQ ID NO: 363963 - RNA, 64 nt, Homo Sapiens
guuucaguucuauaugaaguauuugauguuuuguuugaaacaauacagcauuaaagaaccaaug

SEQ ID NO: 363964 - RNA, 64 nt, Homo Sapiens
agacaguguaaauaguuaaagaauguugauaaaauugaaacauuugguuguggaauugugugug

SEQ ID NO: 363965 - RNA, 64 nt, Homo Sapiens
uugauaaaaauuaacuaguaauacuuguauuuauuugaaacacugggcuguuugcacagcucca

SEQ ID NO: 363966 - RNA, 64 nt, Homo Sapiens
uuuuaaacugggcaucugguuucuaaaaauuuauuugaaacaaucuagaauuuucuuggugcaa

SEQ ID NO: 363967 - RNA, 64 nt, Homo Sapiens
cauugauuauagaaccacuauuacgugaaaaggcuugaaacaaccaacauauacaaauaaaacc

SEQ ID NO: 363968 - RNA, 64 nt, Homo Sapiens
uauauuggcuuuucuucuuaacuugggagauauauugaaacaaggugcuuuauaagauuauugu

SEQ ID NO: 363969 - RNA, 64 nt, Homo Sapiens
uugucuagcauguuuguuuaauccuuugaaauauuugaaacaucaauuucuauuuucugaccuc

SEQ ID NO: 363970 - RNA, 64 nt, Homo Sapiens
cuggcguaaguucaauuuacacagaauauuugaauugaaacaauagaaauuuuucucauaauau

SEQ ID NO: 363971 - RNA, 64 nt, Homo Sapiens
uuucucuuguaaacguuucaaaucuguaagcucuuugaaacaaccucuuggguggguaagacua

SEQ ID NO: 363972 - RNA, 64 nt, Homo Sapiens
gagggagagagggagagagcuauuuuuauauagcuugaaacauacugcucuuaugccauuuguu

SEQ ID NO: 363973 - RNA, 64 nt, Homo Sapiens
ucauuagcugaguguagagaagaacaacugcugauugaaacaccaauaucggcuccucauccaa

SEQ ID NO: 363974 - RNA, 64 nt, Homo Sapiens
aaaaugaauaccaaggaccuaaauaaaucaguuauugaaacauaucuuaaguacaagggggaaa

SEQ ID NO: 363975 - RNA, 64 nt, Homo Sapiens
cuaaaaaacgaaaagucuccaaagucucuggaauuugaaacacuuugcauaacguauaaaagcc

SEQ ID NO: 363976 - RNA, 64 nt, Homo Sapiens
aacaugaauauuuaguguucauaaauaaaguuuguugaaacacaaccaagaucauucuuuuacu

SEQ ID NO: 363977 - RNA, 64 nt, Homo Sapiens
cguucauguauauacauuuuuaaaagugcuuucuuugaaacacuggaacuuuguuaagcugccu

SEQ ID NO: 363978 - RNA, 64 nt, Homo Sapiens
uagauuuguuaaaacuauuuuuuccauaaauacuuugaaacauauuuauauauuucaauuuaag

SEQ ID NO: 363979 - RNA, 63 nt, Homo Sapiens
ucaaauugugcaaccaugauguauaauaaagaauuugaaacagaaacugagcuugcuguuugc

SEQ ID NO: 363980 - RNA, 64 nt, Homo Sapiens
gaguuagcugucagcucuugugaagacuauaaacuugaaacaaauuaauuuguuucuugauaua

SEQ ID NO: 363981 - RNA, 64 nt, Homo Sapiens
acugaagcccuuuuuaccuacucagaguagaacuuugaaacaggaauuaccuagcaguugugcc

SEQ ID NO: 363982 - RNA, 64 nt, Homo Sapiens
gacguaacuggaaauuagguuuaaaaagugaacauugaaacaucagauguggguaguugagaac

SEQ ID NO: 363983 - RNA, 64 nt, Homo Sapiens
aaacaauuuugaaucuugcuuuuauuuuuaaauuuugaaacacauagaaaauuuaggagauaaa

SEQ ID NO: 363984 - RNA, 64 nt, Homo Sapiens
cacuuugaaauuugaauaggagaaauguguucucuugaaacaaguaguuuaaagguaguaggug

SEQ ID NO: 363985 - RNA, 64 nt, Homo Sapiens
gaagagcaaaaggggcuggguccacacauguauuuugaaacacucuuugcaagaaaacagcuuc

SEQ ID NO: 363986 - RNA, 64 nt, Homo Sapiens
acagugcuuaucucaaacaguuuguucucuaagguugaaacaugcacuaucuuguugauagcuu

SEQ ID NO: 363987 - RNA, 64 nt, Homo Sapiens
aaguuguuuuuacuguuuuguuguuguaacuagauugaaacacuaugcacaggaucaacagggu

SEQ ID NO: 363988 - RNA, 64 nt, Homo Sapiens
auuauuggcaguuucuccuuccaguuguguuuuuuugaaacaucgugauaaugucaauuggcag

SEQ ID NO: 363989 - RNA, 64 nt, Homo Sapiens
uuuccauaugaaguuuuuuuuuucaauaaauauuuugaaacauggaaugucaugguaaauuguu

SEQ ID NO: 363990 - RNA, 64 nt, Homo Sapiens
gguccaguccauugaagaccggcuggaauuugcauugaaacacuaaaaccauguuguuuugggg

SEQ ID NO: 363991 - RNA, 64 nt, Homo Sapiens
auucucuccauugcaguuugccaaacuaagccauuugaaacaagugauacauuuagacaaaacc

SEQ ID NO: 363992 - RNA, 64 nt, Homo Sapiens
aaauagauaucauguuauuuaccaccaagaaguguugaaacaccaaguuucccccuuuugaauu

SEQ ID NO: 363993 - RNA, 64 nt, Homo Sapiens
guuuuauggaauaaagucacuugaucagaaggaauugaaacaauagaucauuuuguuaccuacu

SEQ ID NO: 363994 - RNA, 64 nt, Homo Sapiens
uauaauuuagguucugcagaaauaugauucuuaauugaaacauauaauuugcuuaauuacguga

SEQ ID NO: 363995 - RNA, 64 nt, Homo Sapiens
ugaaaaugaagagcccucccuggacugaugcugcgcacaugagcuaucuguguauuguacuaaa

SEQ ID NO: 363996 - RNA, 64 nt, Homo Sapiens
acauucaugacacacaaaacguuguucccagccugcacaugaacggaggaggacuaaaugaaaa

SEQ ID NO: 363997 - RNA, 64 nt, Homo Sapiens
gugggaugugcuacauugucuauuuuuggcggcugcacaugacaucaaauuguuuccugaauuu

SEQ ID NO: 363998 - RNA, 64 nt, Homo Sapiens
guaaaaaguguucauggggaaaaagcucuguuuagcacaugauuuuauuguauugcguuauuag

SEQ ID NO: 363999 - RNA, 64 nt, Homo Sapiens
agaaagccuucaaccagaagagugcgcugcaggugcacaugaagaagcacacgggggagcggcc

SEQ ID NO: 364000 - RNA, 64 nt, Homo Sapiens
ucaugggcuucacgcagaagagcaacaugaagcugcacaugaagcgggcgcacagcuaugcugg

SEQ ID NO: 364001 - RNA, 64 nt, Homo Sapiens
augcacacuggagagaaaccacaggcuuucgagugcacaugagagaaaacccuucaguuuccuu

SEQ ID NO: 364002 - RNA, 64 nt, Homo Sapiens
guacucacacuggagauaaacuuuagguuuucaagcacaugaaaugggaaaacuuacuugucuc

SEQ ID NO: 364003 - RNA, 64 nt, Homo Sapiens
gaacucacacuggagaaaaacuguagguuuucaagcacaugaaauggaaaaaccuacauaucuu

SEQ ID NO: 364004 - RNA, 64 nt, Homo Sapiens
ggaaucacacuguacagaaagccauucugcucgagcacaugaaaugggaaacccuucauuuacc

SEQ ID NO: 364005 - RNA, 64 nt, Homo Sapiens
gcaucacuucuuuuuuauguauuguccacggccagcacaugaaaauacgcuucaguuuuuccac

SEQ ID NO: 364006 - RNA, 64 nt, Homo Sapiens
uguucugacaacagcgcuguauccaccccugucugcacaugagucacacugcccggcacgccac

SEQ ID NO: 364007 - RNA, 64 nt, Homo Sapiens
uggacggcaggcucacugccaggccagccuccgagagggagagagagagagagaggacagcuug

SEQ ID NO: 364008 - RNA, 64 nt, Homo Sapiens
cacuggagguugaagccaaguggggugcugggaggagggagagggaggucacuggaaaggggag

SEQ ID NO: 364009 - RNA, 64 nt, Homo Sapiens
uucucacaagcaacccugagagagacagucuugugagggagaucugggggaggcaggaagcucc

SEQ ID NO: 364010 - RNA, 64 nt, Homo Sapiens
cuuauaugagacaugaagcauuggcucagaaguagagggagaagaggaacccaguucccuugac

SEQ ID NO: 364011 - RNA, 64 nt, Homo Sapiens
ugcauuugaggggccaggggcaggcagggcugcagagggagacggcccugcuggggcuuaggaa

SEQ ID NO: 364012 - RNA, 64 nt, Homo Sapiens
ucugugccauggccccccacucccccuucccuuggagggagagguggcaggaauacuucaccuu

SEQ ID NO: 364013 - RNA, 64 nt, Homo Sapiens
gagugaagagccugcccuccgagggagagagagggagggagagguguuggauucugaggguggg

SEQ ID NO: 364014 - RNA, 64 nt, Homo Sapiens
gagggagggagagggagugaauucugaggguggggagggagagauugcaaacgacugcuguugg

SEQ ID NO: 364015 - RNA, 64 nt, Homo Sapiens
aaaccucauggcaaucuuguuacuguuacugggagagggagacacaguugccuguuucacuugu

SEQ ID NO: 364016 - RNA, 64 nt, Homo Sapiens
cugagagaugcuccuuugggcguugcguguacuugagggagauuuccaucucagugaucauuua

SEQ ID NO: 364017 - RNA, 64 nt, Homo Sapiens
gcccugcuuuggucccagagcuggguuucaggaggagggagacuuacuccucccacacuagaca

SEQ ID NO: 364018 - RNA, 64 nt, Homo Sapiens
ggggguccagggcuggugcucaugaaggacugaggagggagagugcugccaugauaaguccuuc

SEQ ID NO: 364019 - RNA, 64 nt, Homo Sapiens
uuucccaggccgcaccauuugagaaaauguaaaggagggagaucauaaggaggaggagggagaa

SEQ ID NO: 364020 - RNA, 64 nt, Homo Sapiens
agaaaauguaaaggagggagagaauaaggaggaggagggagaagucuguuggaggcacaguuuu

SEQ ID NO: 364021 - RNA, 64 nt, Homo Sapiens
uccaaaguuuugaagucaucuuagcuuuccacaggagggagagaacuuaaaaaagcaacaguag

SEQ ID NO: 364022 - RNA, 64 nt, Homo Sapiens
gcuggucucccuccagcuggaauugcugcucucugagggagaggcugugguggcugucucuguc

SEQ ID NO: 364023 - RNA, 64 nt, Homo Sapiens
uaauuuauugugcaaaugcucugguaccagggaagagggagaauguucaggggugguaaggacu

SEQ ID NO: 364024 - RNA, 64 nt, Homo Sapiens
agcaauugucagucaggauaugaaucuucucucagagggagauguccuagguguuaccauucac

SEQ ID NO: 364025 - RNA, 64 nt, Homo Sapiens
guggcaaaaagguuuagaugaguaagagauggcagagggagaugcagagcaggagggagacuga

SEQ ID NO: 364026 - RNA, 64 nt, Homo Sapiens
gaaguaagagauggcagaggugcuggcagagcaggagggagacugaagccucccucacucucca

SEQ ID NO: 364027 - RNA, 64 nt, Homo Sapiens
cagggcucgggaagccacgcuggggggguucugugagggagaaugaggcucucccaggggcuga

SEQ ID NO: 364028 - RNA, 64 nt, Homo Sapiens
gcacaucucuucugggcggcaguuccucuggugggagggagaacgcggcauggaggguggugug

SEQ ID NO: 364029 - RNA, 64 nt, Homo Sapiens
aucugagaaguggcccaugugcuucaaggcccaggagggagaucugucagcucauucuugccuu

SEQ ID NO: 364030 - RNA, 64 nt, Homo Sapiens
agucuugguaaaaggagggagccugcugagccaggagggagaaaagaagauugaccagcuugcu

SEQ ID NO: 364031 - RNA, 64 nt, Homo Sapiens
ggguggaagugggguaggggaagaggaggggcaggagggagaguuccugugagcaugugggggg

SEQ ID NO: 364032 - RNA, 64 nt, Homo Sapiens
ccuccuguccccucugggaacauuucaugcuucagagggagagguuuuuauugagcuuguuuca

SEQ ID NO: 364033 - RNA, 64 nt, Homo Sapiens
cugccgcccccucuccccuuacaccgaagugcucgagggagaggaaguuaccuuccuggugcac

SEQ ID NO: 364034 - RNA, 64 nt, Homo Sapiens
ccuucccauccuuacccaccgcugccucuggugagagggagagcucauggggcccugagcuucu

SEQ ID NO: 364035 - RNA, 64 nt, Homo Sapiens
ugcaguuugaccccauuugggggggagggagauagagggagagagguuugaggcugggcuggga

SEQ ID NO: 364036 - RNA, 64 nt, Homo Sapiens
gagggagagaugcaguuugaugggcugggagggggagggagauaucuccugggggguuugaggc

SEQ ID NO: 364037 - RNA, 64 nt, Homo Sapiens
uuuauacguuuuguaccuuugagacgggggacuggagggagacugcaugcgugugacaggugca

SEQ ID NO: 364038 - RNA, 64 nt, Homo Sapiens
gaucaccagccccaaggucccgaagggcaggucagagggagagaggcuggagaccugggcuggg

SEQ ID NO: 364039 - RNA, 64 nt, Homo Sapiens
ccccugcccugauagggcuuaccugugggugggggagggagaccacacaugucagagguaguga

SEQ ID NO: 364040 - RNA, 64 nt, Homo Sapiens
gcugagaagacuguucacgcaaaggagaaaggcagagggagagcgaucgugucucagcaucagg

SEQ ID NO: 364041 - RNA, 64 nt, Homo Sapiens
ccccacgcccccacucucccacccugggauccuggagggagaggugcccguccuggccuggagc

SEQ ID NO: 364042 - RNA, 64 nt, Homo Sapiens
acggaaaagacugccugccuuggaggggucacaugagggagaccugugccugauuucauuagga

SEQ ID NO: 364043 - RNA, 64 nt, Homo Sapiens
aauuuauuagcgcugcucugcaccccucccuugggagggagacuucaugugguuuauugcgagu

SEQ ID NO: 364044 - RNA, 64 nt, Homo Sapiens
gaagcgguuuuugcaaauucauauuacuuaagcagagggagagaaccucuacugaucagagcau

SEQ ID NO: 364045 - RNA, 64 nt, Homo Sapiens
ucggugugguccuagaugaagcauuggggugggggagggagagggagcuuuguguuaagugccu

SEQ ID NO: 364046 - RNA, 64 nt, Homo Sapiens
gccucccaccuuuccccugcagggaaggagccaggagggagagaucuggccagagcagggcugg

SEQ ID NO: 364047 - RNA, 64 nt, Homo Sapiens
gcgaacacccacgcugguuuuugggggugggggagagggagagacccacaugggguaagggggg

SEQ ID NO: 364048 - RNA, 64 nt, Homo Sapiens
ggaagaaagaaacaaugucuaggaagaaaggaaggagggagaagagggagagagaggaaaggga

SEQ ID NO: 364049 - RNA, 64 nt, Homo Sapiens
gaggaaagggaaggaagaaaaacaggaaagaagagagggagagaaaggauagcugcaacaauga

SEQ ID NO: 364050 - RNA, 64 nt, Homo Sapiens
uaaaggggcuaggacuagggugagagggaguggggagggagagggcaggaaggaggcagagcug

SEQ ID NO: 364051 - RNA, 64 nt, Homo Sapiens
ugcauucuucaaaaccauuccugauagaguagccgagggagagucuuggggccaagaagggccc

SEQ ID NO: 364052 - RNA, 64 nt, Homo Sapiens
aagaaaaagccacguaagggugcugcuggaugaugagggagaucccacuagugccugagcucag

SEQ ID NO: 364053 - RNA, 64 nt, Homo Sapiens
gaacuccgagggguguccccagggaaagacuggggagggagaguaagugccguuuggaugggga

SEQ ID NO: 364054 - RNA, 64 nt, Homo Sapiens
aggagggaggcgcuccugggauggcccgagggaggagggagagagggagggagggagggagaga

SEQ ID NO: 364055 - RNA, 64 nt, Homo Sapiens
auggcccgagggaggagggagggagggagggagggagggagagacauauaaacacuggagggga

SEQ ID NO: 364056 - RNA, 64 nt, Homo Sapiens
gccuauaccccuuacuuagcaacauagagggagagagggagagauuuauuuuuauauagcuuga

SEQ ID NO: 364057 - RNA, 64 nt, Homo Sapiens
gggagagagccuauaccccuuagcuugaaacauagagggagagagccauuuguuuauuuuuaua

SEQ ID NO: 364058 - RNA, 64 nt, Homo Sapiens
gggaggggaggaguccagggcgagcgagggagaggagggagaggagugagggcggccgggaggg

SEQ ID NO: 364059 - RNA, 64 nt, Homo Sapiens
agggagagggggaggggaggccgggagggcgagcgagggagaggugggguaucagugagggcgg

SEQ ID NO: 364060 - RNA, 64 nt, Homo Sapiens
cccuguugcccaguguucucgauaugaaacuguagagggagagguuauuuuucuccacugcuug

SEQ ID NO: 364061 - RNA, 64 nt, Homo Sapiens
gggcccuggcuuucucaagcaaaacuguuugagagagggagaguagcauugacuucucuacccu

SEQ ID NO: 364062 - RNA, 64 nt, Homo Sapiens
uggcaacagcagcaggacagggcacggagggagcgagggagagaggaccggucccagcuuuugg

SEQ ID NO: 364063 - RNA, 64 nt, Homo Sapiens
gaggauuuaucucaaaaaccaacauccaaaaugggagggagauguggcuugaggucaagcgcca

SEQ ID NO: 364064 - RNA, 64 nt, Homo Sapiens
aguccuuuuugugccaaaucugugguagcaaaaggagggagaggugcacaggagugggaugggg

SEQ ID NO: 364065 - RNA, 64 nt, Homo Sapiens
cucuggggagccagcuuuggugcacagagcagaggagggagaagccagccaggugucccuccua

SEQ ID NO: 364066 - RNA, 64 nt, Homo Sapiens
auggggcuaugccuggcuuagggagagggagggggagggagaaaacgaugccgacuggaaggga

SEQ ID NO: 364067 - RNA, 64 nt, Homo Sapiens
gagggggagggagaaaauggugccgacuggaagggagggagagggggcugugggcagcagacga

SEQ ID NO: 364068 - RNA, 64 nt, Homo Sapiens
cugcaguuaaugggguagaggagggcaugggagggagggagagguggggagggagacagagaca

SEQ ID NO: 364069 - RNA, 64 nt, Homo Sapiens
guagaggagggcaugggagggagggagagguggggagggagacagagacagaaacagagagaga

SEQ ID NO: 364070 - RNA, 64 nt, Homo Sapiens
cagaaacagagagagacagagacagagagagacugagggagagacucugaggacauggagagag

SEQ ID NO: 364071 - RNA, 64 nt, Homo Sapiens
cauggucaugaaagcgugguucuguaagaaaucagagggagaaagggagagaagggggagggag

SEQ ID NO: 364072 - RNA, 64 nt, Homo Sapiens
guaagaaaucagagggagaaagggagagaagggggagggagacaacccaaacguuggaggguau

SEQ ID NO: 364073 - RNA, 64 nt, Homo Sapiens
gaaaugccuccccaggucugucucuggaggcucugagggagaugggcuugggggcuguaggagg

SEQ ID NO: 364074 - RNA, 64 nt, Homo Sapiens
guccaaccaagagagcgggagggagggaaggagggagggagagagauagagagagagagagaga

SEQ ID NO: 364075 - RNA, 64 nt, Homo Sapiens
uuagagaauggcuacugcugaguccuuugggguugagggagaugggagcuagggggaggggagg

SEQ ID NO: 364076 - RNA, 64 nt, Homo Sapiens
uugggguugagggagaugggagcuagggggaggggagggagaugucuuguuguggggacuuggg

SEQ ID NO: 364077 - RNA, 64 nt, Homo Sapiens
ggaugggucucagagagcaaccuccucccucguagagggagauuauauccccaacuccagggac

SEQ ID NO: 364078 - RNA, 64 nt, Homo Sapiens
gggcugccaaaggggcagagggugguggagaggagagggagaaagggaagucccagggcccggg

SEQ ID NO: 364079 - RNA, 64 nt, Homo Sapiens
aaucgugguucuuccccgagggugcauguugcaggagggagagggcagggaagacucacagcag

SEQ ID NO: 364080 - RNA, 64 nt, Homo Sapiens
agaaugggcuuccuuuuugguucaguauuagugagagggagagggagauggauggugggguagg

SEQ ID NO: 364081 - RNA, 64 nt, Homo Sapiens
ggcuuccuuuuugguucaguauuagugagagggagagggagauggauggugggguagguuuucu

SEQ ID NO: 364082 - RNA, 64 nt, Homo Sapiens
aaaucgccugaacccaggaggcggagguugcagggagggagacugcaccacugcacuucagccu

SEQ ID NO: 364083 - RNA, 64 nt, Homo Sapiens
gagacugcaccacugcacuucagccugggugacagagggagacucugucuuaaaaaaaaaaaaa

SEQ ID NO: 364084 - RNA, 64 nt, Homo Sapiens
cggcggcccaggcacagaagggcagggccauagggagggagauucgcuacggauccaggccauu

SEQ ID NO: 364085 - RNA, 64 nt, Homo Sapiens
gguccucuguccccacagugaccugacugggggugagggagaaggaggagagagcccaugugug

SEQ ID NO: 364086 - RNA, 64 nt, Homo Sapiens
gagccuccugcagagccagcgaaggaaagcucuagagggagacgacuccaccgccucucugcuc

SEQ ID NO: 364087 - RNA, 64 nt, Homo Sapiens
acuggagggcgcaucaaagaagaguccuacccaggagggagagcgcagcugcugcaggauucuc

SEQ ID NO: 364088 - RNA, 64 nt, Homo Sapiens
agcuaccacucuggcugcuagacagcuugguggcgagggagaugacuccuuguagcugauacuu

SEQ ID NO: 364089 - RNA, 64 nt, Homo Sapiens
gaggcucucuuaagagcuaugugccuuccaaccagagggagacccaguagaaagaaaaacaucc

SEQ ID NO: 364090 - RNA, 64 nt, Homo Sapiens
augcuuuuaaugaauuuaaggcaaaaaagguggagagggagaugugugagcauccugcaaggug

SEQ ID NO: 364091 - RNA, 64 nt, Homo Sapiens
caggauaaaaaauacauacuguggucggcaaggugagggagauagggauauccaggggaagagg

SEQ ID NO: 364092 - RNA, 64 nt, Homo Sapiens
gggacagagagagauagagcggcagagagacagagagggagagagagaggcagagagggagaga

SEQ ID NO: 364093 - RNA, 64 nt, Homo Sapiens
ggcagagagacagagagggagggagagaggcagagagggagagagagaaggagagaggcagaga

SEQ ID NO: 364094 - RNA, 64 nt, Homo Sapiens
ggcagagagggagagaggcaaggagagaggcagagagggagagaaggaaagagacaggcagaga

SEQ ID NO: 364095 - RNA, 64 nt, Homo Sapiens
gagacagaggggaagagagggggagagagagacagagggagagaagaaacagaggagacagaga

SEQ ID NO: 364096 - RNA, 64 nt, Homo Sapiens
gagacagagggagagagagaacagaggagacagagagggagagaggaggcagagagggagagaa

SEQ ID NO: 364097 - RNA, 64 nt, Homo Sapiens
aacagaggagacagagagggacagaggaggcagagagggagagaagagauaugaggagagagag

SEQ ID NO: 364098 - RNA, 64 nt, Homo Sapiens
gauggagaggaggggagagagggagggaaaggaggagggagagaaggugcauaaauggggguca

SEQ ID NO: 364099 - RNA, 64 nt, Homo Sapiens
caguagaaagaaaaacauccgugccuuccacccagagggagaccgaggcucucuuaagagcuau

SEQ ID NO: 364100 - RNA, 64 nt, Homo Sapiens
acuccuuguagcugauacuugauagcuugguggggagggagaugagcuaccacucuggcugcua

SEQ ID NO: 364101 - RNA, 64 nt, Homo Sapiens
cagccuguguuuuuuaugcaugaggggguaggaggagggagaaauaacugcugugaacucacuu

SEQ ID NO: 364102 - RNA, 64 nt, Homo Sapiens
cgagaugggaugggggagcccccuaggguuuccggagggagagccccacuuaaagugcuucugc

SEQ ID NO: 364103 - RNA, 64 nt, Homo Sapiens
ggacccgaggcugaggcauacaugagcugagggagagggagagggagcucuggccacugcuucc

SEQ ID NO: 364104 - RNA, 64 nt, Homo Sapiens
gagaggggacccgaggcugagcuucccaugagcugagggagaggccuggggagcucuggccacu

SEQ ID NO: 364105 - RNA, 64 nt, Homo Sapiens
uuuuguggaaagaggaguuggugguaucggugucgagggagaggaggggguuggggaggaccca

SEQ ID NO: 364106 - RNA, 64 nt, Homo Sapiens
uuacagugcacggaguguggaagggggucuaggagagggagagcuggaaaaggagcugaugggg

SEQ ID NO: 364107 - RNA, 64 nt, Homo Sapiens
ugggggugucuccuggcugggaaggagggaaagggagggagaguuuugcggggguuggcagugg

SEQ ID NO: 364108 - RNA, 64 nt, Homo Sapiens
ucucugcucaucagcacugucccaggauccuggagagggagaacuccuggccccaggggaaaga

SEQ ID NO: 364109 - RNA, 64 nt, Homo Sapiens
uuggaagggugcagcccacucccaggggagugaggagggagaacugaggaggagcccagaggac

SEQ ID NO: 364110 - RNA, 64 nt, Homo Sapiens
gauggaggcaguggcugguggggcucuggugggagagggagacacagggagggaacccugggca

SEQ ID NO: 364111 - RNA, 64 nt, Homo Sapiens
ugaguggguuagcuaccugcagcuauaaagaaaagagggagagauucucuuuaaaaaaaauaga

SEQ ID NO: 364112 - RNA, 64 nt, Homo Sapiens
aaagaaccccagaccucugaucuagcuuuagcuggagggagauaaagacacauaaugagguccc

SEQ ID NO: 364113 - RNA, 64 nt, Homo Sapiens
ucaaauacaugaaaaaucuuacacuggagagaaacccuaugaguguaagcaaugugggaaagcc

SEQ ID NO: 364114 - RNA, 64 nt, Homo Sapiens
ucgauaucaugaaaggacucacacuggagagaaccccuaugaguguaagcaauuugggaaagcc

SEQ ID NO: 364115 - RNA, 64 nt, Homo Sapiens
uugaauacaugcaagaacacacaauggagagaaacccuaugaauguaaagaaugcagaaaagca

SEQ ID NO: 364116 - RNA, 64 nt, Homo Sapiens
ucaauaucaugaaaggacucacaugggagagaaacccuaugaguguaugccaagugggaaagcc

SEQ ID NO: 364117 - RNA, 64 nt, Homo Sapiens
ucaauaucaugaaaggacucacacuggagagaagcccuaugaauauaagcaaugugggaaagcc

SEQ ID NO: 364118 - RNA, 64 nt, Homo Sapiens
ucaaaugcauggaaggacucacacuggagaaaaacccuaugaauguaagcaguaugggaaagcg

SEQ ID NO: 364119 - RNA, 64 nt, Homo Sapiens
uucaauuuaugaaaggacacacacuggagagaaacccuaugaauguaagaaauguggaaaagcg

SEQ ID NO: 364120 - RNA, 64 nt, Homo Sapiens
uuucauagacauguaaagacacaccagaaggaaacccuaugaauguaagcaauguggcaaaagc

SEQ ID NO: 364121 - RNA, 64 nt, Homo Sapiens
ucaguaucaugaaaggacucacacuggagagaaacccuaugaguguaagcaaugugggaaagcc

SEQ ID NO: 364122 - RNA, 64 nt, Homo Sapiens
cuucgaaggcaugguaggacucacuggagagaaacccuaugaguguaaggaaugugggaaagcc

SEQ ID NO: 364123 - RNA, 64 nt, Homo Sapiens
ucaaagacaugaaaaaacucacacugcagagaaacccuaugaaugcaagcaaugugguaaagcc

SEQ ID NO: 364124 - RNA, 64 nt, Homo Sapiens
uugguaccaugaaaggacucacacuggagagaaacccuaugaguguaagcaaugugggaaagcc

SEQ ID NO: 364125 - RNA, 64 nt, Homo Sapiens
ucgaauccaugguagaacucacacuggagagaaacccuaugaguguaaggaaugugggaaagcc

SEQ ID NO: 364126 - RNA, 64 nt, Homo Sapiens
ucaaauaccugaaaaaucuuacacuggagagaaacccuaugaguguaagcaaugugggaaagcc

SEQ ID NO: 364127 - RNA, 64 nt, Homo Sapiens
ucgauaacaugaaaggacucacacuggagagaaacccuaugaguguaagcaauguggaaaaacc

SEQ ID NO: 364128 - RNA, 54 nt, Homo Sapiens
augcgaaaucauacagcugagaaacccuaugaauguaaggaauguggaaaagcc

SEQ ID NO: 364129 - RNA, 64 nt, Homo Sapiens
cacucuucaugugagaagucacacaggggagaaacccuaugaauguaauaaaugugggaaagcc

SEQ ID NO: 364130 - RNA, 64 nt, Homo Sapiens
guaaagaauguggaaaacccauacuggagagaaacccuaugaauucauauacaugaacgaauuc

SEQ ID NO: 364131 - RNA, 64 nt, Homo Sapiens
guaaaaaaugugggaaagugacacuggagaaaaacccuaugaauucaagcacaugaaagaacuc

SEQ ID NO: 364132 - RNA, 64 nt, Homo Sapiens
guaaugaaugugagaaggcccuacuggugagaaacccuaugaauuacucaacaucaaagaauuc

SEQ ID NO: 364133 - RNA, 64 nt, Homo Sapiens
uuaaggaaugugggaaggccauacuggugagaaacccuaugaguuagucaacaucaaaauauuc

SEQ ID NO: 364134 - RNA, 64 nt, Homo Sapiens
guaaagauuguaaaaaagcuacacuggugacaaacccuaugaaugaauaaacaucagacaauuc

SEQ ID NO: 364135 - RNA, 64 nt, Homo Sapiens
guaaggaauguguaaagaccauaccagugugaaacccuaugaauuacucaacaucaaagaauuc

SEQ ID NO: 364136 - RNA, 64 nt, Homo Sapiens
guaaugaaugugggaaugccacaguggggagaaacccuaugaauaaugagacaucagagaauuc

SEQ ID NO: 364137 - RNA, 64 nt, Homo Sapiens; identical to SEQ ID NO: 355250

SEQ ID NO: 364138 - RNA, 64 nt, Homo Sapiens; identical to SEQ ID NO: 355251

SEQ ID NO: 364139 - RNA, 64 nt, Homo Sapiens; identical to SEQ ID NO: 355252

SEQ ID NO: 364140 - RNA, 64 nt, Homo Sapiens; identical to SEQ ID NO: 355253

SEQ ID NO: 364141 - RNA, 64 nt, Homo Sapiens; identical to SEQ ID NO: 355254

SEQ ID NO: 364142 - RNA, 64 nt, Homo Sapiens; identical to SEQ ID NO: 355255

SEQ ID NO: 364143 - RNA, 64 nt, Homo Sapiens; identical to SEQ ID NO: 355256

SEQ ID NO: 364144 - RNA, 64 nt, Homo Sapiens; identical to SEQ ID NO: 355257

SEQ ID NO: 364145 - RNA, 64 nt, Homo Sapiens; identical to SEQ ID NO: 355258

SEQ ID NO: 364146 - RNA, 64 nt, Homo Sapiens; identical to SEQ ID NO: 355259

SEQ ID NO: 364147 - RNA, 64 nt, Homo Sapiens; identical to SEQ ID NO: 355260

SEQ ID NO: 364148 - RNA, 64 nt, Homo Sapiens; identical to SEQ ID NO: 355261

SEQ ID NO: 364149 - RNA, 64 nt, Homo Sapiens; identical to SEQ ID NO: 355262

SEQ ID NO: 364150 - RNA, 64 nt, Homo Sapiens; identical to SEQ ID NO: 355263

SEQ ID NO: 364151 - RNA, 64 nt, Homo Sapiens; identical to SEQ ID NO: 355264

SEQ ID NO: 364152 - RNA, 64 nt, Homo Sapiens; identical to SEQ ID NO: 355265

SEQ ID NO: 364153 - RNA, 64 nt, Homo Sapiens; identical to SEQ ID NO: 355266

SEQ ID NO: 364154 - RNA, 64 nt, Homo Sapiens; identical to SEQ ID NO: 355267

SEQ ID NO: 364155 - RNA, 61 nt, Homo Sapiens; identical to SEQ ID NO: 188794

SEQ ID NO: 364156 - RNA, 64 nt, Homo Sapiens; identical to SEQ ID NO: 355269

SEQ ID NO: 364157 - RNA, 64 nt, Homo Sapiens; identical to SEQ ID NO: 355270

SEQ ID NO: 364158 - RNA, 64 nt, Homo Sapiens; identical to SEQ ID NO: 355271

SEQ ID NO: 364159 - RNA, 64 nt, Homo Sapiens; identical to SEQ ID NO: 355272

SEQ ID NO: 364160 - RNA, 64 nt, Homo Sapiens; identical to SEQ ID NO: 355273

SEQ ID NO: 364161 - RNA, 64 nt, Homo Sapiens; identical to SEQ ID NO: 355274

SEQ ID NO: 364162 - RNA, 64 nt, Homo Sapiens; identical to SEQ ID NO: 355275

SEQ ID NO: 364163 - RNA, 64 nt, Homo Sapiens; identical to SEQ ID NO: 355276

SEQ ID NO: 364164 - RNA, 64 nt, Homo Sapiens; identical to SEQ ID NO: 355277

SEQ ID NO: 364165 - RNA, 64 nt, Homo Sapiens; identical to SEQ ID NO: 355278

SEQ ID NO: 364166 - RNA, 64 nt, Homo Sapiens; identical to SEQ ID NO: 355279

SEQ ID NO: 364167 - RNA, 64 nt, Homo Sapiens; identical to SEQ ID NO: 355280

SEQ ID NO: 364168 - RNA, 64 nt, Homo Sapiens; identical to SEQ ID NO: 355281

SEQ ID NO: 364169 - RNA, 64 nt, Homo Sapiens; identical to SEQ ID NO: 355282

SEQ ID NO: 364170 - RNA, 64 nt, Homo Sapiens; identical to SEQ ID NO: 355283

SEQ ID NO: 364171 - RNA, 64 nt, Homo Sapiens; identical to SEQ ID NO: 355284

SEQ ID NO: 364172 - RNA, 64 nt, Homo Sapiens; identical to SEQ ID NO: 355285

SEQ ID NO: 364173 - RNA, 64 nt, Homo Sapiens; identical to SEQ ID NO: 355286

SEQ ID NO: 364174 - RNA, 64 nt, Homo Sapiens; identical to SEQ ID NO: 123011

SEQ ID NO: 364175 - RNA, 64 nt, Homo Sapiens; identical to SEQ ID NO: 123012

SEQ ID NO: 364176 - RNA, 64 nt, Homo Sapiens; identical to SEQ ID NO: 123013

SEQ ID NO: 364177 - RNA, 64 nt, Homo Sapiens; identical to SEQ ID NO: 123014

SEQ ID NO: 364178 - RNA, 64 nt, Homo Sapiens; identical to SEQ ID NO: 123015

SEQ ID NO: 364179 - RNA, 64 nt, Homo Sapiens; identical to SEQ ID NO: 123016

SEQ ID NO: 364180 - RNA, 64 nt, Homo Sapiens; identical to SEQ ID NO: 123017

SEQ ID NO: 364181 - RNA, 64 nt, Homo Sapiens; identical to SEQ ID NO: 123018

SEQ ID NO: 364182 - RNA, 64 nt, Homo Sapiens; identical to SEQ ID NO: 123019

SEQ ID NO: 364183 - RNA, 64 nt, Homo Sapiens; identical to SEQ ID NO: 123020

SEQ ID NO: 364184 - RNA, 64 nt, Homo Sapiens; identical to SEQ ID NO: 123021

SEQ ID NO: 364185 - RNA, 64 nt, Homo Sapiens; identical to SEQ ID NO: 123022

SEQ ID NO: 364186 - RNA, 64 nt, Homo Sapiens; identical to SEQ ID NO: 123023

SEQ ID NO: 364187 - RNA, 64 nt, Homo Sapiens; identical to SEQ ID NO: 123024

SEQ ID NO: 364188 - RNA, 64 nt, Homo Sapiens; identical to SEQ ID NO: 123025

SEQ ID NO: 364189 - RNA, 64 nt, Homo Sapiens; identical to SEQ ID NO: 123026

SEQ ID NO: 364190 - RNA, 64 nt, Homo Sapiens; identical to SEQ ID NO: 123027

SEQ ID NO: 364191 - RNA, 64 nt, Homo Sapiens; identical to SEQ ID NO: 123028

SEQ ID NO: 364192 - RNA, 64 nt, Homo Sapiens; identical to SEQ ID NO: 123029

SEQ ID NO: 364193 - RNA, 64 nt, Homo Sapiens; identical to SEQ ID NO: 123030

SEQ ID NO: 364194 - RNA, 64 nt, Homo Sapiens; identical to SEQ ID NO: 123031

SEQ ID NO: 364195 - RNA, 64 nt, Homo Sapiens; identical to SEQ ID NO: 123032

SEQ ID NO: 364196 - RNA, 64 nt, Homo Sapiens; identical to SEQ ID NO: 123033

SEQ ID NO: 364197 - RNA, 64 nt, Homo Sapiens; identical to SEQ ID NO: 123034

SEQ ID NO: 364198 - RNA, 64 nt, Homo Sapiens; identical to SEQ ID NO: 123035

SEQ ID NO: 364199 - RNA, 64 nt, Homo Sapiens; identical to SEQ ID NO: 123036

SEQ ID NO: 364200 - RNA, 64 nt, Homo Sapiens; identical to SEQ ID NO: 123037

SEQ ID NO: 364201 - RNA, 64 nt, Homo Sapiens; identical to SEQ ID NO: 123038

SEQ ID NO: 364202 - RNA, 64 nt, Homo Sapiens; identical to SEQ ID NO: 123039

SEQ ID NO: 364203 - RNA, 64 nt, Homo Sapiens; identical to SEQ ID NO: 123040

SEQ ID NO: 364204 - RNA, 64 nt, Homo Sapiens; identical to SEQ ID NO: 123041

SEQ ID NO: 364205 - RNA, 64 nt, Homo Sapiens; identical to SEQ ID NO: 123042

SEQ ID NO: 364206 - RNA, 64 nt, Homo Sapiens; identical to SEQ ID NO: 123043

SEQ ID NO: 364207 - RNA, 64 nt, Homo Sapiens; identical to SEQ ID NO: 123044

SEQ ID NO: 364208 - RNA, 64 nt, Homo Sapiens; identical to SEQ ID NO: 123045

SEQ ID NO: 364209 - RNA, 64 nt, Homo Sapiens; identical to SEQ ID NO: 123046

SEQ ID NO: 364210 - RNA, 64 nt, Homo Sapiens; identical to SEQ ID NO: 123047

SEQ ID NO: 364211 - RNA, 64 nt, Homo Sapiens; identical to SEQ ID NO: 123048

SEQ ID NO: 364212 - RNA, 64 nt, Homo Sapiens; identical to SEQ ID NO: 123049

SEQ ID NO: 364213 - RNA, 64 nt, Homo Sapiens; identical to SEQ ID NO: 123050

SEQ ID NO: 364214 - RNA, 64 nt, Homo Sapiens; identical to SEQ ID NO: 123051

SEQ ID NO: 364215 - RNA, 64 nt, Homo Sapiens; identical to SEQ ID NO: 123052

SEQ ID NO: 364216 - RNA, 64 nt, Homo Sapiens; identical to SEQ ID NO: 123053

SEQ ID NO: 364217 - RNA, 64 nt, Homo Sapiens; identical to SEQ ID NO: 123054

SEQ ID NO: 364218 - RNA, 64 nt, Homo Sapiens; identical to SEQ ID NO: 123055

SEQ ID NO: 364219 - RNA, 64 nt, Homo Sapiens; identical to SEQ ID NO: 123056

SEQ ID NO: 364220 - RNA, 64 nt, Homo Sapiens; identical to SEQ ID NO: 123057

SEQ ID NO: 364221 - RNA, 64 nt, Homo Sapiens; identical to SEQ ID NO: 123058

SEQ ID NO: 364222 - RNA, 64 nt, Homo Sapiens; identical to SEQ ID NO: 123059

SEQ ID NO: 364223 - RNA, 64 nt, Homo Sapiens; identical to SEQ ID NO: 123060

SEQ ID NO: 364224 - RNA, 64 nt, Homo Sapiens; identical to SEQ ID NO: 123061

SEQ ID NO: 364225 - RNA, 64 nt, Homo Sapiens; identical to SEQ ID NO: 123062

SEQ ID NO: 364226 - RNA, 64 nt, Homo Sapiens; identical to SEQ ID NO: 123063

SEQ ID NO: 364227 - RNA, 64 nt, Homo Sapiens; identical to SEQ ID NO: 123064

SEQ ID NO: 364228 - RNA, 64 nt, Homo Sapiens; identical to SEQ ID NO: 123065

SEQ ID NO: 364229 - RNA, 64 nt, Homo Sapiens; identical to SEQ ID NO: 123066

SEQ ID NO: 364230 - RNA, 64 nt, Homo Sapiens; identical to SEQ ID NO: 123067

SEQ ID NO: 364231 - RNA, 64 nt, Homo Sapiens; identical to SEQ ID NO: 123068

SEQ ID NO: 364232 - RNA, 64 nt, Homo Sapiens; identical to SEQ ID NO: 123069

SEQ ID NO: 364233 - RNA, 64 nt, Homo Sapiens; identical to SEQ ID NO: 123070

SEQ ID NO: 364234 - RNA, 64 nt, Homo Sapiens; identical to SEQ ID NO: 123071

SEQ ID NO: 364235 - RNA, 64 nt, Homo Sapiens; identical to SEQ ID NO: 123072

SEQ ID NO: 364236 - RNA, 64 nt, Homo Sapiens; identical to SEQ ID NO: 123073

SEQ ID NO: 364237 - RNA, 64 nt, Homo Sapiens; identical to SEQ ID NO: 123074

SEQ ID NO: 364238 - RNA, 64 nt, Homo Sapiens
auucccugguaagugcuccuaacuuugaaaaccuuucacugauggccauuggugggaaucagua

SEQ ID NO: 364239 - RNA, 64 nt, Homo Sapiens
uuacuaagcauugcagcacaacuuugaauacuauuucacugacgugggaggagucgugauuuuu

SEQ ID NO: 364240 - RNA, 64 nt, Homo Sapiens
uuauuccuauaauuuuaaaggcacauucacugaauucacugagaauacuugguugauuuagguu

SEQ ID NO: 364241 - RNA, 64 nt, Homo Sapiens
ucacugagauuauuccuauaauuuagguugcacauucacugaauuacuacaguauacuugguug

SEQ ID NO: 364242 - RNA, 64 nt, Homo Sapiens
gugugauuuccccuccaagguaugguuaauaaguuucacugacuuagaaccaggcgagagacuu

SEQ ID NO: 364243 - RNA, 64 nt, Homo Sapiens
uugaacacagucucacccagacuccaggcugucuuucacugaaugcuucugacuucauagauuu

SEQ ID NO: 364244 - RNA, 64 nt, Homo Sapiens
auuggcuuucucuuucugaccagucccaucgacguucacugaaccacucacccuccacagcacu

SEQ ID NO: 364245 - RNA, 64 nt, Homo Sapiens
uuucugagggcagagucuuaaaauggaccugccuuucacugaauuuuuguuuuuuucuuacuga

SEQ ID NO: 364246 - RNA, 64 nt, Homo Sapiens
cuagguauuuauuucaaauaaagcaaggcauauguucacugauuuacgaguaagcugaugagag

SEQ ID NO: 364247 - RNA, 64 nt, Homo Sapiens
uagucccacucuugcuugugucagcaccuuguucuucacugaacugcaauucuucaauuauucu

SEQ ID NO: 364248 - RNA, 64 nt, Homo Sapiens
ucaaaauaaacugguuuuuuuggccuagacucuuuucacugaucuaaagagcuguucuuuucug

SEQ ID NO: 364249 - RNA, 64 nt, Homo Sapiens
caaaacucuuuauggcauuuccuucagcaaaauauucacugaccaguuaaauguaaguguuauu

SEQ ID NO: 364250 - RNA, 64 nt, Homo Sapiens
aagcaauuguacuucacuaugccauauguauguauucacugaccaaaaauucacugaccaacca

SEQ ID NO: 364251 - RNA, 64 nt, Homo Sapiens
acuaugccauauguauguauucacugaccaaaaauucacugaccaaccaaccaaacuccacacu

SEQ ID NO: 364252 - RNA, 64 nt, Homo Sapiens
cagugaaauaaaaugaaaacaaccagugaaauauuucacugaaaaaaauuacauguuucacuga

SEQ ID NO: 364253 - RNA, 64 nt, Homo Sapiens
ccagugaaauauuucacugacuaaaauuacauguuucacugaaauuuuauugagaauaaauuuu

SEQ ID NO: 364254 - RNA, 61 nt, Homo Sapiens
uaaggaugucuuuacacugaggcugucaugucuccaccacuucccucugcuguggguucug

SEQ ID NO: 364255 - RNA, 61 nt, Homo Sapiens
aggacccugucuuuggguuuccuacccaggucuccaccaucuccugugucuguccuccgga

SEQ ID NO: 364256 - RNA, 61 nt, Homo Sapiens
cacucaccccuagcccuggugacccuguguccuccaccaugggauucgagcaucaggcuaa

SEQ ID NO: 364257 - RNA, 61 nt, Homo Sapiens
aaggggaccccgagaacccuagugcaccugccuccaccagcagaguacauuugcuuuaaug

SEQ ID NO: 364258 - RNA, 61 nt, Homo Sapiens
ccuaucauuuuucuuuuuaguauagcuugcucuccaccaggaggaaaggcugauguuucca

SEQ ID NO: 364259 - RNA, 61 nt, Homo Sapiens
ugaagucccucucacgcagcaagaacagcagcuccaccaaagcugggcggcguccacaccu

SEQ ID NO: 364260 - RNA, 61 nt, Homo Sapiens
ugcuugugggggcaccugggaggucaaaggucuccaccacaucaaccuauuuuguuuuacc

SEQ ID NO: 364261 - RNA, 61 nt, Homo Sapiens
gccuuccaaacagcuccgucgccccuagcaacuccaccauugggcacugccaugcagagac

SEQ ID NO: 364262 - RNA, 61 nt, Homo Sapiens
uguacagguaacuaauucuguucacagacaacuccaccaauuauggugugacaucaccuua

SEQ ID NO: 364263 - RNA, 61 nt, Homo Sapiens
accaguggugccacauguggccuuucugccccuccaccagugugggacauucuacagaacc

SEQ ID NO: 364264 - RNA, 61 nt, Homo Sapiens
ccccuuucugagcccuuccuguggugaccagcuccaccaagcaauuuagccaugucaucug

SEQ ID NO: 364265 - RNA, 61 nt, Homo Sapiens
cccagguggacuugcagcccgcccucuuccccuccaccacagguagcuggacuuccccagg

SEQ ID NO: 364266 - RNA, 61 nt, Homo Sapiens
aaacugagguggggauggggagaggcuuugccuccaccauucccaccccacccuccccuua

SEQ ID NO: 364267 - RNA, 61 nt, Homo Sapiens
caggaauuuuguaaucucauaacuuuccaagcuccaccacuuccuaaaucuuaagaacuuu

SEQ ID NO: 364268 - RNA, 61 nt, Homo Sapiens
ccuuggcugccagccuacccugccugcacuccuccaccaucacaaucucacccaaacuccu

SEQ ID NO: 364269 - RNA, 61 nt, Homo Sapiens
gcggguuuccuggguccccucuccagcaagccuccaccagcaagcucggcccagagcuucc

SEQ ID NO: 364270 - RNA, 61 nt, Homo Sapiens
gaccgagacccccugauccuccguggacucacuccaccagcuuccuauaacuuggacgaug

SEQ ID NO: 364271 - RNA, 61 nt, Homo Sapiens
gccaguuaacaagaagauggugugagguguucuccaccagucucuccuguuugagacuguu

SEQ ID NO: 364272 - RNA, 61 nt, Homo Sapiens
ccaucagaaggagaaggaagcuggcuuguaacuccaccaacgggacccuuuccuuccuucc

SEQ ID NO: 364273 - RNA, 61 nt, Homo Sapiens
caaaagucaaaaggugccugucuuauucucacuccaccaccugauguaggguaaggugccu

SEQ ID NO: 364274 - RNA, 61 nt, Homo Sapiens
ucucggccugccaguucucacagcucuggagcuccaccaacaguaacugcacgccuuugug

SEQ ID NO: 364275 - RNA, 61 nt, Homo Sapiens
agugcugguugccuccuacucaggaaagccacuccaccagugcccucgggaccugcugcac

SEQ ID NO: 364276 - RNA, 61 nt, Homo Sapiens
ccuuggaugcccucuaguuggccugcacaggcuccaccaggugcuccacgaggaagcucag

SEQ ID NO: 364277 - RNA, 61 nt, Homo Sapiens
ccccagcaaggucagcugccgauugggcacacuccaccagagggugggggcuucaaguaca

SEQ ID NO: 364278 - RNA, 61 nt, Homo Sapiens
uauagacauuaggaagggagugagacggcuccuccaccauccucagccagugcaacccauu

SEQ ID NO: 364279 - RNA, 61 nt, Homo Sapiens
ccugaacuccugagcgacagaagccccaggccuccaccagccuugaacccuugcaaagggg

SEQ ID NO: 364280 - RNA, 61 nt, Homo Sapiens
guggggaggagaaaaucccaccuccccugaccuccaccaccuccaccaccaccaccaccac

SEQ ID NO: 364281 - RNA, 61 nt, Homo Sapiens
agaaaaucccaccuccccugaccuccaccaccuccaccaccaccaccaccaccaccaccac

SEQ ID NO: 364282 - RNA, 61 nt, Homo Sapiens
uccuaaaucuuaagaacuuuaacuuuccaagcuccaccacucaggaauuuuguaaucucau

SEQ ID NO: 364283 - RNA, 61 nt, Homo Sapiens
cccacccacccuccccuuaaagagccuuugccuccaccauuaaacugagguggggaugggg

SEQ ID NO: 364284 - RNA, 61 nt, Homo Sapiens
cugggucccaggcagcuuuccuucaaagcugcuccaccaugugcacccagaggggacucag

SEQ ID NO: 364285 - RNA, 61 nt, Homo Sapiens
aacuccacccgaccccagcacuaucacagaacuccaccagcgaaaggagaugccaauucug

SEQ ID NO: 364286 - RNA, 61 nt, Homo Sapiens
caaggaggugggggcaagggcaggcuccuggcuccaccagcaggugugcacaggggccucc

SEQ ID NO: 364287 - RNA, 61 nt, Homo Sapiens
ggaccucagcugucccuccucuccaggccuucuccaccacaaucuccuuggucacccucug

SEQ ID NO: 364288 - RNA, 64 nt, Homo Sapiens
auagcccacgggaauaucucaguuguguuaaacuacaggcaaacccaucaauaaaauaaugcau

SEQ ID NO: 364289 - RNA, 64 nt, Homo Sapiens
uuguguucucugugcccucaaggggguugaggguacaggcaacccuuucccugaaaagccuuga

SEQ ID NO: 364290 - RNA, 64 nt, Homo Sapiens
gugucaccugaagacucauucuucuguacgucugacaggcaaugcuggcuguuggcugggggcc

SEQ ID NO: 364291 - RNA, 64 nt, Homo Sapiens
ccagacccggcugcgugguugaugaucuuugcagacaggcaagcaccuccugccucgaacuggc

SEQ ID NO: 364292 - RNA, 64 nt, Homo Sapiens
uaaaugggcuaaaugcuccaauuaaaagacacagacaggcaaauuggauaaauagucaagaccc

SEQ ID NO: 364293 - RNA, 64 nt, Homo Sapiens
uucugcacagcaaaagaaacuaccaucagagucaacaggcaaccuacaaaaugggagaaaauuu

SEQ ID NO: 364294 - RNA, 64 nt, Homo Sapiens
uuucaugcauuuguccuucucccacccccuuacuacacccuagcagaucagcugaguguacuuu

SEQ ID NO: 364295 - RNA, 64 nt, Homo Sapiens
caccaagaaguggaaguccucagaaauucucggcacacccuagaguauuguacaaccaacaccc

SEQ ID NO: 364296 - RNA, 64 nt, Homo Sapiens
cucaugacauuaaauaaaaggcuucuuccgguccacacccuauacaacugugaaacucuguauu

SEQ ID NO: 364297 - RNA, 64 nt, Homo Sapiens
uagacacuuccugaaugcuacuuuuuuuuccuccacacccuauaucugaaaugucccacaucuc

SEQ ID NO: 364298 - RNA, 64 nt, Homo Sapiens; identical to SEQ ID NO: 272831

SEQ ID NO: 364299 - RNA, 64 nt, Homo Sapiens; identical to SEQ ID NO: 272832

SEQ ID NO: 364300 - RNA, 64 nt, Homo Sapiens; identical to SEQ ID NO: 272833

SEQ ID NO: 364301 - RNA, 64 nt, Homo Sapiens; identical to SEQ ID NO: 272834

SEQ ID NO: 364302 - RNA, 64 nt, Homo Sapiens; identical to SEQ ID NO: 272835

SEQ ID NO: 364303 - RNA, 64 nt, Homo Sapiens; identical to SEQ ID NO: 272836

SEQ ID NO: 364304 - RNA, 64 nt, Homo Sapiens; identical to SEQ ID NO: 272837

SEQ ID NO: 364305 - RNA, 64 nt, Homo Sapiens; identical to SEQ ID NO: 272838

SEQ ID NO: 364306 - RNA, 64 nt, Homo Sapiens; identical to SEQ ID NO: 272839

SEQ ID NO: 364307 - RNA, 64 nt, Homo Sapiens; identical to SEQ ID NO: 272840

SEQ ID NO: 364308 - RNA, 64 nt, Homo Sapiens; identical to SEQ ID NO: 272841

SEQ ID NO: 364309 - RNA, 64 nt, Homo Sapiens; identical to SEQ ID NO: 272842

SEQ ID NO: 364310 - RNA, 64 nt, Homo Sapiens; identical to SEQ ID NO: 272843

SEQ ID NO: 364311 - RNA, 64 nt, Homo Sapiens; identical to SEQ ID NO: 272844

SEQ ID NO: 364312 - RNA, 64 nt, Homo Sapiens; identical to SEQ ID NO: 272845

SEQ ID NO: 364313 - RNA, 64 nt, Homo Sapiens; identical to SEQ ID NO: 272846

SEQ ID NO: 364314 - RNA, 64 nt, Homo Sapiens; identical to SEQ ID NO: 127802

SEQ ID NO: 364315 - RNA, 64 nt, Homo Sapiens; identical to SEQ ID NO: 127803

SEQ ID NO: 364316 - RNA, 64 nt, Homo Sapiens; identical to SEQ ID NO: 127804

SEQ ID NO: 364317 - RNA, 64 nt, Homo Sapiens; identical to SEQ ID NO: 127805

SEQ ID NO: 364318 - RNA, 64 nt, Homo Sapiens; identical to SEQ ID NO: 127806

SEQ ID NO: 364319 - RNA, 64 nt, Homo Sapiens; identical to SEQ ID NO: 127807

SEQ ID NO: 364320 - RNA, 64 nt, Homo Sapiens; identical to SEQ ID NO: 127808

SEQ ID NO: 364321 - RNA, 64 nt, Homo Sapiens; identical to SEQ ID NO: 127809

SEQ ID NO: 364322 - RNA, 64 nt, Homo Sapiens; identical to SEQ ID NO: 127810

SEQ ID NO: 364323 - RNA, 64 nt, Homo Sapiens; identical to SEQ ID NO: 127811

SEQ ID NO: 364324 - RNA, 64 nt, Homo Sapiens; identical to SEQ ID NO: 127812

SEQ ID NO: 364325 - RNA, 64 nt, Homo Sapiens; identical to SEQ ID NO: 127813

SEQ ID NO: 364326 - RNA, 64 nt, Homo Sapiens; identical to SEQ ID NO: 127814

SEQ ID NO: 364327 - RNA, 64 nt, Homo Sapiens; identical to SEQ ID NO: 127815

SEQ ID NO: 364328 - RNA, 64 nt, Homo Sapiens; identical to SEQ ID NO: 127816

SEQ ID NO: 364329 - RNA, 64 nt, Homo Sapiens; identical to SEQ ID NO: 127817

SEQ ID NO: 364330 - RNA, 64 nt, Homo Sapiens; identical to SEQ ID NO: 127818

SEQ ID NO: 364331 - RNA, 64 nt, Homo Sapiens; identical to SEQ ID NO: 127819

SEQ ID NO: 364332 - RNA, 64 nt, Homo Sapiens; identical to SEQ ID NO: 127820

SEQ ID NO: 364333 - RNA, 64 nt, Homo Sapiens; identical to SEQ ID NO: 127821

SEQ ID NO: 364334 - RNA, 64 nt, Homo Sapiens; identical to SEQ ID NO: 127822

SEQ ID NO: 364335 - RNA, 64 nt, Homo Sapiens; identical to SEQ ID NO: 127823

SEQ ID NO: 364336 - RNA, 64 nt, Homo Sapiens; identical to SEQ ID NO: 127824

SEQ ID NO: 364337 - RNA, 64 nt, Homo Sapiens; identical to SEQ ID NO: 127825

SEQ ID NO: 364338 - RNA, 64 nt, Homo Sapiens; identical to SEQ ID NO: 127826

SEQ ID NO: 364339 - RNA, 64 nt, Homo Sapiens; identical to SEQ ID NO: 127827

SEQ ID NO: 364340 - RNA, 64 nt, Homo Sapiens; identical to SEQ ID NO: 127828

SEQ ID NO: 364341 - RNA, 64 nt, Homo Sapiens; identical to SEQ ID NO: 127829

SEQ ID NO: 364342 - RNA, 64 nt, Homo Sapiens; identical to SEQ ID NO: 127830

SEQ ID NO: 364343 - RNA, 64 nt, Homo Sapiens; identical to SEQ ID NO: 127831

SEQ ID NO: 364344 - RNA, 64 nt, Homo Sapiens; identical to SEQ ID NO: 127832

SEQ ID NO: 364345 - RNA, 64 nt, Homo Sapiens; identical to SEQ ID NO: 127833

SEQ ID NO: 364346 - RNA, 64 nt, Homo Sapiens; identical to SEQ ID NO: 127834

SEQ ID NO: 364347 - RNA, 64 nt, Homo Sapiens; identical to SEQ ID NO: 127835

SEQ ID NO: 364348 - RNA, 64 nt, Homo Sapiens; identical to SEQ ID NO: 127836

SEQ ID NO: 364349 - RNA, 64 nt, Homo Sapiens; identical to SEQ ID NO: 127837

SEQ ID NO: 364350 - RNA, 64 nt, Homo Sapiens; identical to SEQ ID NO: 127838

SEQ ID NO: 364351 - RNA, 64 nt, Homo Sapiens; identical to SEQ ID NO: 127839

SEQ ID NO: 364352 - RNA, 64 nt, Homo Sapiens; identical to SEQ ID NO: 127840

SEQ ID NO: 364353 - RNA, 64 nt, Homo Sapiens; identical to SEQ ID NO: 127841

SEQ ID NO: 364354 - RNA, 64 nt, Homo Sapiens; identical to SEQ ID NO: 127842

SEQ ID NO: 364355 - RNA, 64 nt, Homo Sapiens; identical to SEQ ID NO: 127843

SEQ ID NO: 364356 - RNA, 64 nt, Homo Sapiens; identical to SEQ ID NO: 127844

SEQ ID NO: 364357 - RNA, 64 nt, Homo Sapiens; identical to SEQ ID NO: 127845

SEQ ID NO: 364358 - RNA, 64 nt, Homo Sapiens; identical to SEQ ID NO: 127846

SEQ ID NO: 364359 - RNA, 64 nt, Homo Sapiens; identical to SEQ ID NO: 127847

SEQ ID NO: 364360 - RNA, 64 nt, Homo Sapiens; identical to SEQ ID NO: 127848

SEQ ID NO: 364361 - RNA, 64 nt, Homo Sapiens; identical to SEQ ID NO: 127849

SEQ ID NO: 364362 - RNA, 64 nt, Homo Sapiens; identical to SEQ ID NO: 127850

SEQ ID NO: 364363 - RNA, 64 nt, Homo Sapiens; identical to SEQ ID NO: 127851

SEQ ID NO: 364364 - RNA, 64 nt, Homo Sapiens; identical to SEQ ID NO: 127852

SEQ ID NO: 364365 - RNA, 64 nt, Homo Sapiens; identical to SEQ ID NO: 127853

SEQ ID NO: 364366 - RNA, 64 nt, Homo Sapiens; identical to SEQ ID NO: 127854

SEQ ID NO: 364367 - RNA, 64 nt, Homo Sapiens; identical to SEQ ID NO: 127855

SEQ ID NO: 364368 - RNA, 64 nt, Homo Sapiens; identical to SEQ ID NO: 127856

SEQ ID NO: 364369 - RNA, 64 nt, Homo Sapiens; identical to SEQ ID NO: 127857

SEQ ID NO: 364370 - RNA, 64 nt, Homo Sapiens; identical to SEQ ID NO: 127858

SEQ ID NO: 364371 - RNA, 64 nt, Homo Sapiens; identical to SEQ ID NO: 127859

SEQ ID NO: 364372 - RNA, 64 nt, Homo Sapiens; identical to SEQ ID NO: 127860

SEQ ID NO: 364373 - RNA, 64 nt, Homo Sapiens; identical to SEQ ID NO: 127861

SEQ ID NO: 364374 - RNA, 64 nt, Homo Sapiens; identical to SEQ ID NO: 127862

SEQ ID NO: 364375 - RNA, 64 nt, Homo Sapiens; identical to SEQ ID NO: 127863

SEQ ID NO: 364376 - RNA, 64 nt, Homo Sapiens; identical to SEQ ID NO: 127864

SEQ ID NO: 364377 - RNA, 64 nt, Homo Sapiens; identical to SEQ ID NO: 127865

SEQ ID NO: 364378 - RNA, 64 nt, Homo Sapiens; identical to SEQ ID NO: 127866

SEQ ID NO: 364379 - RNA, 64 nt, Homo Sapiens; identical to SEQ ID NO: 127867

SEQ ID NO: 364380 - RNA, 64 nt, Homo Sapiens; identical to SEQ ID NO: 127868

SEQ ID NO: 364381 - RNA, 64 nt, Homo Sapiens; identical to SEQ ID NO: 127869

SEQ ID NO: 364382 - RNA, 64 nt, Homo Sapiens; identical to SEQ ID NO: 127870

SEQ ID NO: 364383 - RNA, 64 nt, Homo Sapiens; identical to SEQ ID NO: 127871

SEQ ID NO: 364384 - RNA, 64 nt, Homo Sapiens; identical to SEQ ID NO: 127872

SEQ ID NO: 364385 - RNA, 64 nt, Homo Sapiens; identical to SEQ ID NO: 127873

SEQ ID NO: 364386 - RNA, 64 nt, Homo Sapiens; identical to SEQ ID NO: 127874

SEQ ID NO: 364387 - RNA, 64 nt, Homo Sapiens; identical to SEQ ID NO: 127875

SEQ ID NO: 364388 - RNA, 64 nt, Homo Sapiens; identical to SEQ ID NO: 127876

SEQ ID NO: 364389 - RNA, 64 nt, Homo Sapiens; identical to SEQ ID NO: 127877

SEQ ID NO: 364390 - RNA, 64 nt, Homo Sapiens; identical to SEQ ID NO: 127878

SEQ ID NO: 364391 - RNA, 52 nt, Homo Sapiens; identical to SEQ ID NO: 127879

SEQ ID NO: 364392 - RNA, 64 nt, Homo Sapiens; identical to SEQ ID NO: 127880

SEQ ID NO: 364393 - RNA, 64 nt, Homo Sapiens; identical to SEQ ID NO: 127881

SEQ ID NO: 364394 - RNA, 64 nt, Homo Sapiens; identical to SEQ ID NO: 127882

SEQ ID NO: 364395 - RNA, 64 nt, Homo Sapiens; identical to SEQ ID NO: 127883

SEQ ID NO: 364396 - RNA, 64 nt, Homo Sapiens; identical to SEQ ID NO: 127884

SEQ ID NO: 364397 - RNA, 64 nt, Homo Sapiens; identical to SEQ ID NO: 127885

SEQ ID NO: 364398 - RNA, 64 nt, Homo Sapiens; identical to SEQ ID NO: 127886

SEQ ID NO: 364399 - RNA, 64 nt, Homo Sapiens; identical to SEQ ID NO: 127887

SEQ ID NO: 364400 - RNA, 64 nt, Homo Sapiens; identical to SEQ ID NO: 127888

SEQ ID NO: 364401 - RNA, 64 nt, Homo Sapiens; identical to SEQ ID NO: 127889

SEQ ID NO: 364402 - RNA, 64 nt, Homo Sapiens; identical to SEQ ID NO: 127890

SEQ ID NO: 364403 - RNA, 64 nt, Homo Sapiens; identical to SEQ ID NO: 127891

SEQ ID NO: 364404 - RNA, 64 nt, Homo Sapiens; identical to SEQ ID NO: 127892

SEQ ID NO: 364405 - RNA, 64 nt, Homo Sapiens; identical to SEQ ID NO: 127893

SEQ ID NO: 364406 - RNA, 64 nt, Homo Sapiens; identical to SEQ ID NO: 127894

SEQ ID NO: 364407 - RNA, 64 nt, Homo Sapiens; identical to SEQ ID NO: 127895

SEQ ID NO: 364408 - RNA, 64 nt, Homo Sapiens; identical to SEQ ID NO: 127896

SEQ ID NO: 364409 - RNA, 64 nt, Homo Sapiens; identical to SEQ ID NO: 127897

SEQ ID NO: 364410 - RNA, 64 nt, Homo Sapiens; identical to SEQ ID NO: 127898

SEQ ID NO: 364411 - RNA, 64 nt, Homo Sapiens; identical to SEQ ID NO: 127899

SEQ ID NO: 364412 - RNA, 64 nt, Homo Sapiens; identical to SEQ ID NO: 127900

SEQ ID NO: 364413 - RNA, 64 nt, Homo Sapiens; identical to SEQ ID NO: 127901

SEQ ID NO: 364414 - RNA, 64 nt, Homo Sapiens; identical to SEQ ID NO: 127902

SEQ ID NO: 364415 - RNA, 64 nt, Homo Sapiens; identical to SEQ ID NO: 127903

SEQ ID NO: 364416 - RNA, 64 nt, Homo Sapiens; identical to SEQ ID NO: 127904

SEQ ID NO: 364417 - RNA, 64 nt, Homo Sapiens; identical to SEQ ID NO: 127905

SEQ ID NO: 364418 - RNA, 64 nt, Homo Sapiens; identical to SEQ ID NO: 127906

SEQ ID NO: 364419 - RNA, 64 nt, Homo Sapiens; identical to SEQ ID NO: 127907

SEQ ID NO: 364420 - RNA, 64 nt, Homo Sapiens; identical to SEQ ID NO: 127908

SEQ ID NO: 364421 - RNA, 64 nt, Homo Sapiens; identical to SEQ ID NO: 127909

SEQ ID NO: 364422 - RNA, 64 nt, Homo Sapiens; identical to SEQ ID NO: 127910

SEQ ID NO: 364423 - RNA, 64 nt, Homo Sapiens; identical to SEQ ID NO: 127826

SEQ ID NO: 364424 - RNA, 64 nt, Homo Sapiens; identical to SEQ ID NO: 127912

SEQ ID NO: 364425 - RNA, 64 nt, Homo Sapiens; identical to SEQ ID NO: 127913

SEQ ID NO: 364426 - RNA, 64 nt, Homo Sapiens; identical to SEQ ID NO: 127914

SEQ ID NO: 364427 - RNA, 64 nt, Homo Sapiens; identical to SEQ ID NO: 127915

SEQ ID NO: 364428 - RNA, 64 nt, Homo Sapiens; identical to SEQ ID NO: 127916

SEQ ID NO: 364429 - RNA, 64 nt, Homo Sapiens; identical to SEQ ID NO: 127917

SEQ ID NO: 364430 - RNA, 64 nt, Homo Sapiens; identical to SEQ ID NO: 127918

SEQ ID NO: 364431 - RNA, 64 nt, Homo Sapiens; identical to SEQ ID NO: 127919

SEQ ID NO: 364432 - RNA, 64 nt, Homo Sapiens; identical to SEQ ID NO: 127920

SEQ ID NO: 364433 - RNA, 64 nt, Homo Sapiens; identical to SEQ ID NO: 127921

SEQ ID NO: 364434 - RNA, 64 nt, Homo Sapiens; identical to SEQ ID NO: 127922

SEQ ID NO: 364435 - RNA, 64 nt, Homo Sapiens; identical to SEQ ID NO: 127923

SEQ ID NO: 364436 - RNA, 64 nt, Homo Sapiens; identical to SEQ ID NO: 127924

SEQ ID NO: 364437 - RNA, 64 nt, Homo Sapiens; identical to SEQ ID NO: 127925

SEQ ID NO: 364438 - RNA, 64 nt, Homo Sapiens; identical to SEQ ID NO: 127926

SEQ ID NO: 364439 - RNA, 64 nt, Homo Sapiens; identical to SEQ ID NO: 127927

SEQ ID NO: 364440 - RNA, 64 nt, Homo Sapiens; identical to SEQ ID NO: 127928

SEQ ID NO: 364441 - RNA, 64 nt, Homo Sapiens; identical to SEQ ID NO: 127929

SEQ ID NO: 364442 - RNA, 64 nt, Homo Sapiens; identical to SEQ ID NO: 127930

SEQ ID NO: 364443 - RNA, 64 nt, Homo Sapiens; identical to SEQ ID NO: 127931

SEQ ID NO: 364444 - RNA, 64 nt, Homo Sapiens; identical to SEQ ID NO: 127932

SEQ ID NO: 364445 - RNA, 64 nt, Homo Sapiens; identical to SEQ ID NO: 127933

SEQ ID NO: 364446 - RNA, 64 nt, Homo Sapiens; identical to SEQ ID NO: 127934

SEQ ID NO: 364447 - RNA, 64 nt, Homo Sapiens; identical to SEQ ID NO: 127935

SEQ ID NO: 364448 - RNA, 64 nt, Homo Sapiens; identical to SEQ ID NO: 127936

SEQ ID NO: 364449 - RNA, 64 nt, Homo Sapiens; identical to SEQ ID NO: 127937

SEQ ID NO: 364450 - RNA, 64 nt, Homo Sapiens; identical to SEQ ID NO: 127938

SEQ ID NO: 364451 - RNA, 64 nt, Homo Sapiens; identical to SEQ ID NO: 127939

SEQ ID NO: 364452 - RNA, 64 nt, Homo Sapiens; identical to SEQ ID NO: 127940

SEQ ID NO: 364453 - RNA, 64 nt, Homo Sapiens; identical to SEQ ID NO: 127941

SEQ ID NO: 364454 - RNA, 64 nt, Homo Sapiens; identical to SEQ ID NO: 127942

SEQ ID NO: 364455 - RNA, 64 nt, Homo Sapiens; identical to SEQ ID NO: 127943

SEQ ID NO: 364456 - RNA, 64 nt, Homo Sapiens; identical to SEQ ID NO: 127944

SEQ ID NO: 364457 - RNA, 64 nt, Homo Sapiens; identical to SEQ ID NO: 127945

SEQ ID NO: 364458 - RNA, 64 nt, Homo Sapiens; identical to SEQ ID NO: 127946

SEQ ID NO: 364459 - RNA, 64 nt, Homo Sapiens; identical to SEQ ID NO: 127947

SEQ ID NO: 364460 - RNA, 64 nt, Homo Sapiens; identical to SEQ ID NO: 127948

SEQ ID NO: 364461 - RNA, 64 nt, Homo Sapiens; identical to SEQ ID NO: 127949

SEQ ID NO: 364462 - RNA, 64 nt, Homo Sapiens; identical to SEQ ID NO: 127950

SEQ ID NO: 364463 - RNA, 64 nt, Homo Sapiens; identical to SEQ ID NO: 127951

SEQ ID NO: 364464 - RNA, 64 nt, Homo Sapiens; identical to SEQ ID NO: 127952

SEQ ID NO: 364465 - RNA, 64 nt, Homo Sapiens; identical to SEQ ID NO: 127953

SEQ ID NO: 364466 - RNA, 64 nt, Homo Sapiens; identical to SEQ ID NO: 127954

SEQ ID NO: 364467 - RNA, 64 nt, Homo Sapiens; identical to SEQ ID NO: 127955

SEQ ID NO: 364468 - RNA, 64 nt, Homo Sapiens; identical to SEQ ID NO: 127956

SEQ ID NO: 364469 - RNA, 64 nt, Homo Sapiens; identical to SEQ ID NO: 127957

SEQ ID NO: 364470 - RNA, 64 nt, Homo Sapiens; identical to SEQ ID NO: 127958

SEQ ID NO: 364471 - RNA, 64 nt, Homo Sapiens; identical to SEQ ID NO: 127959

SEQ ID NO: 364472 - RNA, 64 nt, Homo Sapiens; identical to SEQ ID NO: 127960

SEQ ID NO: 364473 - RNA, 64 nt, Homo Sapiens; identical to SEQ ID NO: 127961

SEQ ID NO: 364474 - RNA, 64 nt, Homo Sapiens; identical to SEQ ID NO: 127962

SEQ ID NO: 364475 - RNA, 64 nt, Homo Sapiens; identical to SEQ ID NO: 127963

SEQ ID NO: 364476 - RNA, 64 nt, Homo Sapiens; identical to SEQ ID NO: 127964

SEQ ID NO: 364477 - RNA, 64 nt, Homo Sapiens; identical to SEQ ID NO: 127965

SEQ ID NO: 364478 - RNA, 64 nt, Homo Sapiens; identical to SEQ ID NO: 127966

SEQ ID NO: 364479 - RNA, 64 nt, Homo Sapiens; identical to SEQ ID NO: 127967

SEQ ID NO: 364480 - RNA, 64 nt, Homo Sapiens; identical to SEQ ID NO: 127968

SEQ ID NO: 364481 - RNA, 64 nt, Homo Sapiens; identical to SEQ ID NO: 127969

SEQ ID NO: 364482 - RNA, 64 nt, Homo Sapiens; identical to SEQ ID NO: 127970

SEQ ID NO: 364483 - RNA, 64 nt, Homo Sapiens; identical to SEQ ID NO: 127971

SEQ ID NO: 364484 - RNA, 64 nt, Homo Sapiens; identical to SEQ ID NO: 127972

SEQ ID NO: 364485 - RNA, 64 nt, Homo Sapiens; identical to SEQ ID NO: 127973

SEQ ID NO: 364486 - RNA, 64 nt, Homo Sapiens; identical to SEQ ID NO: 127974

SEQ ID NO: 364487 - RNA, 64 nt, Homo Sapiens; identical to SEQ ID NO: 127975

SEQ ID NO: 364488 - RNA, 64 nt, Homo Sapiens; identical to SEQ ID NO: 127976

SEQ ID NO: 364489 - RNA, 64 nt, Homo Sapiens; identical to SEQ ID NO: 127977

SEQ ID NO: 364490 - RNA, 64 nt, Homo Sapiens; identical to SEQ ID NO: 127978

SEQ ID NO: 364491 - RNA, 64 nt, Homo Sapiens; identical to SEQ ID NO: 127979

SEQ ID NO: 364492 - RNA, 64 nt, Homo Sapiens; identical to SEQ ID NO: 127980

SEQ ID NO: 364493 - RNA, 64 nt, Homo Sapiens; identical to SEQ ID NO: 127981

SEQ ID NO: 364494 - RNA, 64 nt, Homo Sapiens; identical to SEQ ID NO: 127982

SEQ ID NO: 364495 - RNA, 64 nt, Homo Sapiens; identical to SEQ ID NO: 127983

SEQ ID NO: 364496 - RNA, 64 nt, Homo Sapiens; identical to SEQ ID NO: 127984

SEQ ID NO: 364497 - RNA, 64 nt, Homo Sapiens; identical to SEQ ID NO: 127985

SEQ ID NO: 364498 - RNA, 64 nt, Homo Sapiens; identical to SEQ ID NO: 127986

SEQ ID NO: 364499 - RNA, 64 nt, Homo Sapiens; identical to SEQ ID NO: 127987

SEQ ID NO: 364500 - RNA, 64 nt, Homo Sapiens; identical to SEQ ID NO: 127988

SEQ ID NO: 364501 - RNA, 64 nt, Homo Sapiens; identical to SEQ ID NO: 127989

SEQ ID NO: 364502 - RNA, 64 nt, Homo Sapiens; identical to SEQ ID NO: 127990

SEQ ID NO: 364503 - RNA, 64 nt, Homo Sapiens; identical to SEQ ID NO: 127991

SEQ ID NO: 364504 - RNA, 64 nt, Homo Sapiens; identical to SEQ ID NO: 127992

SEQ ID NO: 364505 - RNA, 64 nt, Homo Sapiens; identical to SEQ ID NO: 127993

SEQ ID NO: 364506 - RNA, 64 nt, Homo Sapiens; identical to SEQ ID NO: 127994

SEQ ID NO: 364507 - RNA, 64 nt, Homo Sapiens; identical to SEQ ID NO: 127995

SEQ ID NO: 364508 - RNA, 64 nt, Homo Sapiens; identical to SEQ ID NO: 127996

SEQ ID NO: 364509 - RNA, 64 nt, Homo Sapiens; identical to SEQ ID NO: 127997

SEQ ID NO: 364510 - RNA, 64 nt, Homo Sapiens; identical to SEQ ID NO: 127998

SEQ ID NO: 364511 - RNA, 64 nt, Homo Sapiens; identical to SEQ ID NO: 127999

SEQ ID NO: 364512 - RNA, 64 nt, Homo Sapiens; identical to SEQ ID NO: 128000

SEQ ID NO: 364513 - RNA, 64 nt, Homo Sapiens; identical to SEQ ID NO: 128001

SEQ ID NO: 364514 - RNA, 64 nt, Homo Sapiens; identical to SEQ ID NO: 128002

SEQ ID NO: 364515 - RNA, 64 nt, Homo Sapiens; identical to SEQ ID NO: 128003

SEQ ID NO: 364516 - RNA, 64 nt, Homo Sapiens; identical to SEQ ID NO: 128004

SEQ ID NO: 364517 - RNA, 64 nt, Homo Sapiens; identical to SEQ ID NO: 128005

SEQ ID NO: 364518 - RNA, 64 nt, Homo Sapiens; identical to SEQ ID NO: 128006

SEQ ID NO: 364519 - RNA, 64 nt, Homo Sapiens; identical to SEQ ID NO: 128007

SEQ ID NO: 364520 - RNA, 64 nt, Homo Sapiens; identical to SEQ ID NO: 128008

SEQ ID NO: 364521 - RNA, 64 nt, Homo Sapiens; identical to SEQ ID NO: 128009

SEQ ID NO: 364522 - RNA, 64 nt, Homo Sapiens; identical to SEQ ID NO: 128010

SEQ ID NO: 364523 - RNA, 64 nt, Homo Sapiens; identical to SEQ ID NO: 128011

SEQ ID NO: 364524 - RNA, 64 nt, Homo Sapiens; identical to SEQ ID NO: 128012

SEQ ID NO: 364525 - RNA, 64 nt, Homo Sapiens; identical to SEQ ID NO: 128013

SEQ ID NO: 364526 - RNA, 64 nt, Homo Sapiens; identical to SEQ ID NO: 128014

SEQ ID NO: 364527 - RNA, 64 nt, Homo Sapiens; identical to SEQ ID NO: 128015

SEQ ID NO: 364528 - RNA, 64 nt, Homo Sapiens; identical to SEQ ID NO: 128016

SEQ ID NO: 364529 - RNA, 64 nt, Homo Sapiens; identical to SEQ ID NO: 128017

SEQ ID NO: 364530 - RNA, 64 nt, Homo Sapiens; identical to SEQ ID NO: 128018

SEQ ID NO: 364531 - RNA, 64 nt, Homo Sapiens; identical to SEQ ID NO: 128019

SEQ ID NO: 364532 - RNA, 64 nt, Homo Sapiens; identical to SEQ ID NO: 128020

SEQ ID NO: 364533 - RNA, 64 nt, Homo Sapiens; identical to SEQ ID NO: 128021

SEQ ID NO: 364534 - RNA, 64 nt, Homo Sapiens; identical to SEQ ID NO: 128022

SEQ ID NO: 364535 - RNA, 64 nt, Homo Sapiens; identical to SEQ ID NO: 128023

SEQ ID NO: 364536 - RNA, 64 nt, Homo Sapiens; identical to SEQ ID NO: 128024

SEQ ID NO: 364537 - RNA, 64 nt, Homo Sapiens; identical to SEQ ID NO: 128025

SEQ ID NO: 364538 - RNA, 64 nt, Homo Sapiens; identical to SEQ ID NO: 128026

SEQ ID NO: 364539 - RNA, 64 nt, Homo Sapiens; identical to SEQ ID NO: 128027

SEQ ID NO: 364540 - RNA, 64 nt, Homo Sapiens; identical to SEQ ID NO: 128028

SEQ ID NO: 364541 - RNA, 64 nt, Homo Sapiens; identical to SEQ ID NO: 128029

SEQ ID NO: 364542 - RNA, 64 nt, Homo Sapiens
ggcucuugaggcauuuccagacuugaaauucucaucaguccauugcucuugagucuuugcagag

SEQ ID NO: 364543 - RNA, 64 nt, Homo Sapiens
cggacggggcugacuccugcucucuggaggacggucaguccaugucucggagaaacgggugagc

SEQ ID NO: 364544 - RNA, 64 nt, Homo Sapiens
gccacucccugcccccagcccaucucuagguggcucaguccauguaccauaccaacuucucucc

SEQ ID NO: 364545 - RNA, 64 nt, Homo Sapiens
cuuuggaaaaccuucaccuccugauccaggccccucaguccaagcucuuuccgucccucucuuu

SEQ ID NO: 364546 - RNA, 64 nt, Homo Sapiens
gcauuuaugaggggagcuuaaaauggcagggugaucaguccaaaauucuaaaggaagaagcacu

SEQ ID NO: 364547 - RNA, 64 nt, Homo Sapiens
gggagcccaugggcuguuugauagcaaagaugcuucaguccagaaccacaggacaacucugccc

SEQ ID NO: 364548 - RNA, 64 nt, Homo Sapiens
cggcuccuguuuagcuuuuauuucaguucuaaccucaguccagaaacauaugugagguuguuuc

SEQ ID NO: 364549 - RNA, 64 nt, Homo Sapiens
uuuuagcucuugcuuuaaguguuuguuuguuaucucaguccagaaccaauauuaucguaauuaa

SEQ ID NO: 364550 - RNA, 64 nt, Homo Sapiens
caacugacaugcuuuuauuauguugaucgcugguucaguccaggucgugugcauucugggcgca

SEQ ID NO: 364551 - RNA, 64 nt, Homo Sapiens
caguuugucuuagcauuauugguccccagcgcucucaguccaauauccauucuaacagaagacu

SEQ ID NO: 364552 - RNA, 64 nt, Homo Sapiens
gaauuucugcucugguuagaaaaaggacucugcuucaguccacuucugcucugguuagaaaaag

SEQ ID NO: 364553 - RNA, 64 nt, Homo Sapiens
ccacuucugcucugguuagaaaaaggacucugcuucaguccacaguacauaaaauguacucagg

SEQ ID NO: 364554 - RNA, 64 nt, Homo Sapiens
uucuucgaggaaagccaagcuccucaaacaggguucaguccacguuguguuuucacaccuuucu

SEQ ID NO: 364555 - RNA, 64 nt, Homo Sapiens
gagaccaccucuguggccaccucagauagucaucucaguccaaggaucccaaaacacaaaucua

SEQ ID NO: 364556 - RNA, 64 nt, Homo Sapiens
uagauggugauauuuuccuuaugauagaagauauuuaagauaucaaauugguuuaagauauugg

SEQ ID NO: 364557 - RNA, 64 nt, Homo Sapiens
ggaugauagaagauauuuaauuuaagaaauugguuuaagauauuaguaccuuugaauaaaacaa

SEQ ID NO: 364558 - RNA, 64 nt, Homo Sapiens
accuuuuaaagcauuguuuuagaaugucugaguauuaagauacagauuaauugggaauaucuga

SEQ ID NO: 364559 - RNA, 64 nt, Homo Sapiens
aaaaugccugaaaaaagcuaaauuauuuaagucauuaagauauugagaaaaaauuugaaauuuu

SEQ ID NO: 364560 - RNA, 64 nt, Homo Sapiens
uguuuguauacacaugucauuuauuauuauuacuuuaagauagguauuauucaugugucaaugu

SEQ ID NO: 364561 - RNA, 64 nt, Homo Sapiens
aacacaauggaguacuaagaugguauuugcacauuuaagauauguuacuuuaccaauuuuuaau

SEQ ID NO: 364562 - RNA, 64 nt, Homo Sapiens
uuuuuuaccugucuuuucucaagacuacuacagguuaagauaauuaaaaauuuuaaaaagaaaa

SEQ ID NO: 364563 - RNA, 64 nt, Homo Sapiens
aaucccaguucucuaauuuguauguuuugcuucuuuaagauagacuaccauuauauuuuggggu

SEQ ID NO: 364564 - RNA, 64 nt, Homo Sapiens
ugacuaaaauggacaauuguacuuuuuuuuuuuuuuaagauauacugauuuacuacacagagaa

SEQ ID NO: 364565 - RNA, 64 nt, Homo Sapiens
uuaaaaugacuaaaugcuuuaaacauauuguagcuuaagauauauguguuaagauauauacaug

SEQ ID NO: 364566 - RNA, 64 nt, Homo Sapiens
ugcuuuaaacauauuguagcuuaagauauauguguuaagauauauacaugagaaacuuuaaaag

SEQ ID NO: 364567 - RNA, 64 nt, Homo Sapiens
aaucugaaaugcaucuguaaccuacugcuugcaauuaagauaucguuugguuuuuacagucaag

SEQ ID NO: 364568 - RNA, 64 nt, Homo Sapiens
auauaauuaacuccaugagagaugcugccauauauuaagauagauuguaaauugaagaaaacaa

SEQ ID NO: 364569 - RNA, 64 nt, Homo Sapiens
cgagguuacaucguagguuuugauuuuucucaauuuaagauacagaaauacagcaagccuuaau

SEQ ID NO: 364570 - RNA, 64 nt, Homo Sapiens
aauuacauguauauuuugguguuaagguugauuuuuaagauacuucugauuuguacaaaaggaa

SEQ ID NO: 364571 - RNA, 64 nt, Homo Sapiens
uucauuuguuuugcacauaugcauaugugcccauuuaagauauuugcauauacuugauagaaac

SEQ ID NO: 364572 - RNA, 64 nt, Homo Sapiens
gaagagauuguauuagauauuauauuuauuucauuuaagauaauuuucaaaguuaauuuucuaa

SEQ ID NO: 364573 - RNA, 64 nt, Homo Sapiens
cagaacuuuuacaauuuuuucaucuaaaaguauuuuaagauauuuuuaaaauccaagagcuucu

SEQ ID NO: 364574 - RNA, 64 nt, Homo Sapiens
aucccauuaucaacccugaaaguuugcuuguccuuuaagauaaaaauguaauguugugauauuc

SEQ ID NO: 364575 - RNA, 64 nt, Homo Sapiens; identical to SEQ ID NO: 91262

SEQ ID NO: 364576 - RNA, 64 nt, Homo Sapiens; identical to SEQ ID NO: 91263

SEQ ID NO: 364577 - RNA, 64 nt, Homo Sapiens; identical to SEQ ID NO: 91264

SEQ ID NO: 364578 - RNA, 64 nt, Homo Sapiens; identical to SEQ ID NO: 91265

SEQ ID NO: 364579 - RNA, 64 nt, Homo Sapiens; identical to SEQ ID NO: 91266

SEQ ID NO: 364580 - RNA, 64 nt, Homo Sapiens; identical to SEQ ID NO: 91267

SEQ ID NO: 364581 - RNA, 64 nt, Homo Sapiens; identical to SEQ ID NO: 91268

SEQ ID NO: 364582 - RNA, 64 nt, Homo Sapiens; identical to SEQ ID NO: 91269

SEQ ID NO: 364583 - RNA, 64 nt, Homo Sapiens; identical to SEQ ID NO: 91270

SEQ ID NO: 364584 - RNA, 64 nt, Homo Sapiens; identical to SEQ ID NO: 91271

SEQ ID NO: 364585 - RNA, 64 nt, Homo Sapiens; identical to SEQ ID NO: 91272

SEQ ID NO: 364586 - RNA, 64 nt, Homo Sapiens; identical to SEQ ID NO: 91273

SEQ ID NO: 364587 - RNA, 64 nt, Homo Sapiens; identical to SEQ ID NO: 91274

SEQ ID NO: 364588 - RNA, 64 nt, Homo Sapiens; identical to SEQ ID NO: 91275

SEQ ID NO: 364589 - RNA, 64 nt, Homo Sapiens; identical to SEQ ID NO: 91276

SEQ ID NO: 364590 - RNA, 64 nt, Homo Sapiens; identical to SEQ ID NO: 91277

SEQ ID NO: 364591 - RNA, 64 nt, Homo Sapiens; identical to SEQ ID NO: 91278

SEQ ID NO: 364592 - RNA, 64 nt, Homo Sapiens; identical to SEQ ID NO: 91279

SEQ ID NO: 364593 - RNA, 64 nt, Homo Sapiens; identical to SEQ ID NO: 91280

SEQ ID NO: 364594 - RNA, 64 nt, Homo Sapiens; identical to SEQ ID NO: 91281

SEQ ID NO: 364595 - RNA, 64 nt, Homo Sapiens; identical to SEQ ID NO: 91282

SEQ ID NO: 364596 - RNA, 64 nt, Homo Sapiens; identical to SEQ ID NO: 91283

SEQ ID NO: 364597 - RNA, 64 nt, Homo Sapiens; identical to SEQ ID NO: 91284

SEQ ID NO: 364598 - RNA, 64 nt, Homo Sapiens; identical to SEQ ID NO: 91285

SEQ ID NO: 364599 - RNA, 64 nt, Homo Sapiens; identical to SEQ ID NO: 91286

SEQ ID NO: 364600 - RNA, 64 nt, Homo Sapiens; identical to SEQ ID NO: 91287

SEQ ID NO: 364601 - RNA, 64 nt, Homo Sapiens; identical to SEQ ID NO: 91288

SEQ ID NO: 364602 - RNA, 64 nt, Homo Sapiens; identical to SEQ ID NO: 91289

SEQ ID NO: 364603 - RNA, 64 nt, Homo Sapiens; identical to SEQ ID NO: 91290

SEQ ID NO: 364604 - RNA, 64 nt, Homo Sapiens; identical to SEQ ID NO: 91291

SEQ ID NO: 364605 - RNA, 64 nt, Homo Sapiens; identical to SEQ ID NO: 91292

SEQ ID NO: 364606 - RNA, 64 nt, Homo Sapiens; identical to SEQ ID NO: 91293

SEQ ID NO: 364607 - RNA, 64 nt, Homo Sapiens; identical to SEQ ID NO: 91294

SEQ ID NO: 364608 - RNA, 64 nt, Homo Sapiens; identical to SEQ ID NO: 91295

SEQ ID NO: 364609 - RNA, 64 nt, Homo Sapiens; identical to SEQ ID NO: 91296

SEQ ID NO: 364610 - RNA, 64 nt, Homo Sapiens; identical to SEQ ID NO: 91297

SEQ ID NO: 364611 - RNA, 64 nt, Homo Sapiens; identical to SEQ ID NO: 91298

SEQ ID NO: 364612 - RNA, 64 nt, Homo Sapiens; identical to SEQ ID NO: 91299

SEQ ID NO: 364613 - RNA, 64 nt, Homo Sapiens; identical to SEQ ID NO: 91300

SEQ ID NO: 364614 - RNA, 64 nt, Homo Sapiens; identical to SEQ ID NO: 91301

SEQ ID NO: 364615 - RNA, 64 nt, Homo Sapiens; identical to SEQ ID NO: 91302

SEQ ID NO: 364616 - RNA, 64 nt, Homo Sapiens; identical to SEQ ID NO: 91303

SEQ ID NO: 364617 - RNA, 64 nt, Homo Sapiens; identical to SEQ ID NO: 91304

SEQ ID NO: 364618 - RNA, 64 nt, Homo Sapiens; identical to SEQ ID NO: 91305

SEQ ID NO: 364619 - RNA, 64 nt, Homo Sapiens; identical to SEQ ID NO: 91306

SEQ ID NO: 364620 - RNA, 64 nt, Homo Sapiens; identical to SEQ ID NO: 91307

SEQ ID NO: 364621 - RNA, 64 nt, Homo Sapiens; identical to SEQ ID NO: 91308

SEQ ID NO: 364622 - RNA, 64 nt, Homo Sapiens; identical to SEQ ID NO: 91309

SEQ ID NO: 364623 - RNA, 64 nt, Homo Sapiens; identical to SEQ ID NO: 91310

SEQ ID NO: 364624 - RNA, 64 nt, Homo Sapiens; identical to SEQ ID NO: 91311

SEQ ID NO: 364625 - RNA, 64 nt, Homo Sapiens; identical to SEQ ID NO: 91312

SEQ ID NO: 364626 - RNA, 64 nt, Homo Sapiens; identical to SEQ ID NO: 91313

SEQ ID NO: 364627 - RNA, 64 nt, Homo Sapiens; identical to SEQ ID NO: 91314

SEQ ID NO: 364628 - RNA, 64 nt, Homo Sapiens; identical to SEQ ID NO: 91315

SEQ ID NO: 364629 - RNA, 64 nt, Homo Sapiens; identical to SEQ ID NO: 91316

SEQ ID NO: 364630 - RNA, 64 nt, Homo Sapiens; identical to SEQ ID NO: 91317

SEQ ID NO: 364631 - RNA, 64 nt, Homo Sapiens; identical to SEQ ID NO: 91318

SEQ ID NO: 364632 - RNA, 64 nt, Homo Sapiens; identical to SEQ ID NO: 91319

SEQ ID NO: 364633 - RNA, 64 nt, Homo Sapiens; identical to SEQ ID NO: 91320

SEQ ID NO: 364634 - RNA, 64 nt, Homo Sapiens; identical to SEQ ID NO: 91321

SEQ ID NO: 364635 - RNA, 64 nt, Homo Sapiens; identical to SEQ ID NO: 91322

SEQ ID NO: 364636 - RNA, 64 nt, Homo Sapiens; identical to SEQ ID NO: 91323

SEQ ID NO: 364637 - RNA, 64 nt, Homo Sapiens; identical to SEQ ID NO: 91324

SEQ ID NO: 364638 - RNA, 64 nt, Homo Sapiens; identical to SEQ ID NO: 91325

SEQ ID NO: 364639 - RNA, 64 nt, Homo Sapiens; identical to SEQ ID NO: 91326

SEQ ID NO: 364640 - RNA, 64 nt, Homo Sapiens; identical to SEQ ID NO: 91327

SEQ ID NO: 364641 - RNA, 64 nt, Homo Sapiens; identical to SEQ ID NO: 91328

SEQ ID NO: 364642 - RNA, 64 nt, Homo Sapiens; identical to SEQ ID NO: 91329

SEQ ID NO: 364643 - RNA, 64 nt, Homo Sapiens; identical to SEQ ID NO: 91330

SEQ ID NO: 364644 - RNA, 64 nt, Homo Sapiens; identical to SEQ ID NO: 91331

SEQ ID NO: 364645 - RNA, 64 nt, Homo Sapiens; identical to SEQ ID NO: 91332

SEQ ID NO: 364646 - RNA, 64 nt, Homo Sapiens; identical to SEQ ID NO: 91333

SEQ ID NO: 364647 - RNA, 64 nt, Homo Sapiens; identical to SEQ ID NO: 91334

SEQ ID NO: 364648 - RNA, 64 nt, Homo Sapiens; identical to SEQ ID NO: 91335

SEQ ID NO: 364649 - RNA, 64 nt, Homo Sapiens; identical to SEQ ID NO: 91336

SEQ ID NO: 364650 - RNA, 64 nt, Homo Sapiens; identical to SEQ ID NO: 91337

SEQ ID NO: 364651 - RNA, 64 nt, Homo Sapiens; identical to SEQ ID NO: 91338

SEQ ID NO: 364652 - RNA, 64 nt, Homo Sapiens; identical to SEQ ID NO: 91339

SEQ ID NO: 364653 - RNA, 64 nt, Homo Sapiens; identical to SEQ ID NO: 91340

SEQ ID NO: 364654 - RNA, 64 nt, Homo Sapiens; identical to SEQ ID NO: 91341

SEQ ID NO: 364655 - RNA, 64 nt, Homo Sapiens; identical to SEQ ID NO: 91342

SEQ ID NO: 364656 - RNA, 64 nt, Homo Sapiens; identical to SEQ ID NO: 91343

SEQ ID NO: 364657 - RNA, 64 nt, Homo Sapiens; identical to SEQ ID NO: 91344

SEQ ID NO: 364658 - RNA, 64 nt, Homo Sapiens; identical to SEQ ID NO: 91345

SEQ ID NO: 364659 - RNA, 64 nt, Homo Sapiens; identical to SEQ ID NO: 91346

SEQ ID NO: 364660 - RNA, 64 nt, Homo Sapiens; identical to SEQ ID NO: 91347

SEQ ID NO: 364661 - RNA, 64 nt, Homo Sapiens; identical to SEQ ID NO: 91348

SEQ ID NO: 364662 - RNA, 64 nt, Homo Sapiens; identical to SEQ ID NO: 91349

SEQ ID NO: 364663 - RNA, 64 nt, Homo Sapiens; identical to SEQ ID NO: 91350

SEQ ID NO: 364664 - RNA, 64 nt, Homo Sapiens; identical to SEQ ID NO: 91351

SEQ ID NO: 364665 - RNA, 64 nt, Homo Sapiens; identical to SEQ ID NO: 91352

SEQ ID NO: 364666 - RNA, 64 nt, Homo Sapiens; identical to SEQ ID NO: 91353

SEQ ID NO: 364667 - RNA, 54 nt, Homo Sapiens; identical to SEQ ID NO: 91354

SEQ ID NO: 364668 - RNA, 64 nt, Homo Sapiens; identical to SEQ ID NO: 91355

SEQ ID NO: 364669 - RNA, 64 nt, Homo Sapiens; identical to SEQ ID NO: 91356

SEQ ID NO: 364670 - RNA, 64 nt, Homo Sapiens; identical to SEQ ID NO: 91357

SEQ ID NO: 364671 - RNA, 64 nt, Homo Sapiens; identical to SEQ ID NO: 91358

SEQ ID NO: 364672 - RNA, 64 nt, Homo Sapiens; identical to SEQ ID NO: 91359

SEQ ID NO: 364673 - RNA, 64 nt, Homo Sapiens; identical to SEQ ID NO: 91360

SEQ ID NO: 364674 - RNA, 64 nt, Homo Sapiens; identical to SEQ ID NO: 91361

SEQ ID NO: 364675 - RNA, 64 nt, Homo Sapiens; identical to SEQ ID NO: 91362

SEQ ID NO: 364676 - RNA, 64 nt, Homo Sapiens; identical to SEQ ID NO: 91363

SEQ ID NO: 364677 - RNA, 64 nt, Homo Sapiens; identical to SEQ ID NO: 91364

SEQ ID NO: 364678 - RNA, 64 nt, Homo Sapiens; identical to SEQ ID NO: 91365

SEQ ID NO: 364679 - RNA, 64 nt, Homo Sapiens; identical to SEQ ID NO: 91366

SEQ ID NO: 364680 - RNA, 64 nt, Homo Sapiens; identical to SEQ ID NO: 91367

SEQ ID NO: 364681 - RNA, 64 nt, Homo Sapiens; identical to SEQ ID NO: 91368

SEQ ID NO: 364682 - RNA, 64 nt, Homo Sapiens; identical to SEQ ID NO: 91369

SEQ ID NO: 364683 - RNA, 64 nt, Homo Sapiens; identical to SEQ ID NO: 91370

SEQ ID NO: 364684 - RNA, 64 nt, Homo Sapiens; identical to SEQ ID NO: 91371

SEQ ID NO: 364685 - RNA, 64 nt, Homo Sapiens; identical to SEQ ID NO: 91372

SEQ ID NO: 364686 - RNA, 64 nt, Homo Sapiens; identical to SEQ ID NO: 91373

SEQ ID NO: 364687 - RNA, 64 nt, Homo Sapiens; identical to SEQ ID NO: 91374

SEQ ID NO: 364688 - RNA, 64 nt, Homo Sapiens; identical to SEQ ID NO: 91375

SEQ ID NO: 364689 - RNA, 64 nt, Homo Sapiens; identical to SEQ ID NO: 91376

SEQ ID NO: 364690 - RNA, 64 nt, Homo Sapiens; identical to SEQ ID NO: 91377

SEQ ID NO: 364691 - RNA, 64 nt, Homo Sapiens; identical to SEQ ID NO: 91378

SEQ ID NO: 364692 - RNA, 64 nt, Homo Sapiens; identical to SEQ ID NO: 91379

SEQ ID NO: 364693 - RNA, 64 nt, Homo Sapiens; identical to SEQ ID NO: 91380

SEQ ID NO: 364694 - RNA, 64 nt, Homo Sapiens
gcugaagauucuaccacugagaagaacugccuaaggugugaaaaagaaacagaaauagauggug

SEQ ID NO: 364695 - RNA, 64 nt, Homo Sapiens
gcccucugcuuuuucccccaccugucccgucuggggugugaagucccucaguaaggaauggaaa

SEQ ID NO: 364696 - RNA, 64 nt, Homo Sapiens
ugagcacaguccagaaauggcacaugucauacaaggugugaauuuccaggccagcuccucugcc

SEQ ID NO: 364697 - RNA, 64 nt, Homo Sapiens
cccccgacagcagcccuccggcacuggggucucuggugugaacaacccguguccuccguugcuc

SEQ ID NO: 364698 - RNA, 64 nt, Homo Sapiens
uguuuuguuuuguuuuuuuaauaucaaaagagucggugugaaccuugguuggaccccaaguuca

SEQ ID NO: 364699 - RNA, 64 nt, Homo Sapiens
aacucuuucaagcaucaucuuugaagagucguguggugugaauugguuuguguacauuagaaug

SEQ ID NO: 364700 - RNA, 64 nt, Homo Sapiens
aauuauguuuggaugcagcaagccauuuauugauggugugaauuaucauuuguuagccaagcaa

SEQ ID NO: 364701 - RNA, 64 nt, Homo Sapiens
auuuugauguugaauuagacuuaaaguacaguagggugugaauuaguggacuuuguuguuauuu

SEQ ID NO: 364702 - RNA, 64 nt, Homo Sapiens
cuguugcuucagagagacacaaagugaacacacuggugugaaugucgcucucugugugcuugug

SEQ ID NO: 364703 - RNA, 64 nt, Homo Sapiens
uucuuucaggggugggaguuauggggaaggggugggugugaagggguagaugaaagcuuuaauu

SEQ ID NO: 364704 - RNA, 64 nt, Homo Sapiens; identical to SEQ ID NO: 216180

SEQ ID NO: 364705 - RNA, 64 nt, Homo Sapiens; identical to SEQ ID NO: 216181

SEQ ID NO: 364706 - RNA, 64 nt, Homo Sapiens; identical to SEQ ID NO: 216182

SEQ ID NO: 364707 - RNA, 64 nt, Homo Sapiens; identical to SEQ ID NO: 216183

SEQ ID NO: 364708 - RNA, 64 nt, Homo Sapiens; identical to SEQ ID NO: 216184

SEQ ID NO: 364709 - RNA, 64 nt, Homo Sapiens; identical to SEQ ID NO: 216185

SEQ ID NO: 364710 - RNA, 64 nt, Homo Sapiens; identical to SEQ ID NO: 216186

SEQ ID NO: 364711 - RNA, 64 nt, Homo Sapiens; identical to SEQ ID NO: 216187

SEQ ID NO: 364712 - RNA, 64 nt, Homo Sapiens; identical to SEQ ID NO: 216188

SEQ ID NO: 364713 - RNA, 64 nt, Homo Sapiens; identical to SEQ ID NO: 216189

SEQ ID NO: 364714 - RNA, 64 nt, Homo Sapiens; identical to SEQ ID NO: 216190

SEQ ID NO: 364715 - RNA, 64 nt, Homo Sapiens; identical to SEQ ID NO: 216191

SEQ ID NO: 364716 - RNA, 64 nt, Homo Sapiens; identical to SEQ ID NO: 216192

SEQ ID NO: 364717 - RNA, 64 nt, Homo Sapiens; identical to SEQ ID NO: 216193

SEQ ID NO: 364718 - RNA, 64 nt, Homo Sapiens; identical to SEQ ID NO: 216194

SEQ ID NO: 364719 - RNA, 64 nt, Homo Sapiens; identical to SEQ ID NO: 216195

SEQ ID NO: 364720 - RNA, 64 nt, Homo Sapiens; identical to SEQ ID NO: 216196

SEQ ID NO: 364721 - RNA, 64 nt, Homo Sapiens; identical to SEQ ID NO: 216197

SEQ ID NO: 364722 - RNA, 64 nt, Homo Sapiens; identical to SEQ ID NO: 216198

SEQ ID NO: 364723 - RNA, 64 nt, Homo Sapiens; identical to SEQ ID NO: 216199

SEQ ID NO: 364724 - RNA, 64 nt, Homo Sapiens; identical to SEQ ID NO: 216200

SEQ ID NO: 364725 - RNA, 64 nt, Homo Sapiens; identical to SEQ ID NO: 216201

SEQ ID NO: 364726 - RNA, 64 nt, Homo Sapiens; identical to SEQ ID NO: 216202

SEQ ID NO: 364727 - RNA, 64 nt, Homo Sapiens; identical to SEQ ID NO: 216203

SEQ ID NO: 364728 - RNA, 64 nt, Homo Sapiens; identical to SEQ ID NO: 216204

SEQ ID NO: 364729 - RNA, 64 nt, Homo Sapiens; identical to SEQ ID NO: 216205

SEQ ID NO: 364730 - RNA, 64 nt, Homo Sapiens; identical to SEQ ID NO: 216206

SEQ ID NO: 364731 - RNA, 64 nt, Homo Sapiens; identical to SEQ ID NO: 216207

SEQ ID NO: 364732 - RNA, 64 nt, Homo Sapiens; identical to SEQ ID NO: 216208

SEQ ID NO: 364733 - RNA, 64 nt, Homo Sapiens; identical to SEQ ID NO: 216209

SEQ ID NO: 364734 - RNA, 64 nt, Homo Sapiens; identical to SEQ ID NO: 216210

SEQ ID NO: 364735 - RNA, 64 nt, Homo Sapiens; identical to SEQ ID NO: 216211

SEQ ID NO: 364736 - RNA, 64 nt, Homo Sapiens; identical to SEQ ID NO: 216212

SEQ ID NO: 364737 - RNA, 64 nt, Homo Sapiens; identical to SEQ ID NO: 216213

SEQ ID NO: 364738 - RNA, 64 nt, Homo Sapiens; identical to SEQ ID NO: 216214

SEQ ID NO: 364739 - RNA, 64 nt, Homo Sapiens; identical to SEQ ID NO: 172917

SEQ ID NO: 364740 - RNA, 64 nt, Homo Sapiens; identical to SEQ ID NO: 172918

SEQ ID NO: 364741 - RNA, 64 nt, Homo Sapiens; identical to SEQ ID NO: 172919

SEQ ID NO: 364742 - RNA, 64 nt, Homo Sapiens; identical to SEQ ID NO: 172920

SEQ ID NO: 364743 - RNA, 64 nt, Homo Sapiens; identical to SEQ ID NO: 172921

SEQ ID NO: 364744 - RNA, 64 nt, Homo Sapiens; identical to SEQ ID NO: 172922

SEQ ID NO: 364745 - RNA, 64 nt, Homo Sapiens; identical to SEQ ID NO: 172923

SEQ ID NO: 364746 - RNA, 64 nt, Homo Sapiens; identical to SEQ ID NO: 172924

SEQ ID NO: 364747 - RNA, 64 nt, Homo Sapiens; identical to SEQ ID NO: 172925

SEQ ID NO: 364748 - RNA, 64 nt, Homo Sapiens; identical to SEQ ID NO: 172926

SEQ ID NO: 364749 - RNA, 64 nt, Homo Sapiens; identical to SEQ ID NO: 172927

SEQ ID NO: 364750 - RNA, 64 nt, Homo Sapiens; identical to SEQ ID NO: 172928

SEQ ID NO: 364751 - RNA, 64 nt, Homo Sapiens; identical to SEQ ID NO: 172929

SEQ ID NO: 364752 - RNA, 64 nt, Homo Sapiens; identical to SEQ ID NO: 172930

SEQ ID NO: 364753 - RNA, 64 nt, Homo Sapiens; identical to SEQ ID NO: 172931

SEQ ID NO: 364754 - RNA, 64 nt, Homo Sapiens; identical to SEQ ID NO: 172932

SEQ ID NO: 364755 - RNA, 64 nt, Homo Sapiens; identical to SEQ ID NO: 172933

SEQ ID NO: 364756 - RNA, 64 nt, Homo Sapiens; identical to SEQ ID NO: 172934

SEQ ID NO: 364757 - RNA, 64 nt, Homo Sapiens; identical to SEQ ID NO: 172935

SEQ ID NO: 364758 - RNA, 64 nt, Homo Sapiens; identical to SEQ ID NO: 172936

SEQ ID NO: 364759 - RNA, 64 nt, Homo Sapiens; identical to SEQ ID NO: 172937

SEQ ID NO: 364760 - RNA, 64 nt, Homo Sapiens; identical to SEQ ID NO: 172938

SEQ ID NO: 364761 - RNA, 64 nt, Homo Sapiens; identical to SEQ ID NO: 172939

SEQ ID NO: 364762 - RNA, 64 nt, Homo Sapiens; identical to SEQ ID NO: 172940

SEQ ID NO: 364763 - RNA, 64 nt, Homo Sapiens; identical to SEQ ID NO: 172941

SEQ ID NO: 364764 - RNA, 64 nt, Homo Sapiens; identical to SEQ ID NO: 172942

SEQ ID NO: 364765 - RNA, 64 nt, Homo Sapiens; identical to SEQ ID NO: 172943

SEQ ID NO: 364766 - RNA, 64 nt, Homo Sapiens; identical to SEQ ID NO: 172944

SEQ ID NO: 364767 - RNA, 64 nt, Homo Sapiens; identical to SEQ ID NO: 172945

SEQ ID NO: 364768 - RNA, 64 nt, Homo Sapiens; identical to SEQ ID NO: 172946

SEQ ID NO: 364769 - RNA, 64 nt, Homo Sapiens; identical to SEQ ID NO: 172947

SEQ ID NO: 364770 - RNA, 64 nt, Homo Sapiens; identical to SEQ ID NO: 172948

SEQ ID NO: 364771 - RNA, 64 nt, Homo Sapiens; identical to SEQ ID NO: 172949

SEQ ID NO: 364772 - RNA, 64 nt, Homo Sapiens; identical to SEQ ID NO: 172950

SEQ ID NO: 364773 - RNA, 64 nt, Homo Sapiens; identical to SEQ ID NO: 172951

SEQ ID NO: 364774 - RNA, 64 nt, Homo Sapiens; identical to SEQ ID NO: 172952

SEQ ID NO: 364775 - RNA, 64 nt, Homo Sapiens; identical to SEQ ID NO: 172953

SEQ ID NO: 364776 - RNA, 64 nt, Homo Sapiens; identical to SEQ ID NO: 172954

SEQ ID NO: 364777 - RNA, 64 nt, Homo Sapiens; identical to SEQ ID NO: 172955

SEQ ID NO: 364778 - RNA, 64 nt, Homo Sapiens; identical to SEQ ID NO: 172956

SEQ ID NO: 364779 - RNA, 64 nt, Homo Sapiens; identical to SEQ ID NO: 172957

SEQ ID NO: 364780 - RNA, 64 nt, Homo Sapiens; identical to SEQ ID NO: 172958

SEQ ID NO: 364781 - RNA, 64 nt, Homo Sapiens; identical to SEQ ID NO: 172959

SEQ ID NO: 364782 - RNA, 64 nt, Homo Sapiens
gauaaauauggcuuugaaauuaaacuaaaauuuauggcacaaaaauacauuauaauguaauaua

SEQ ID NO: 364783 - RNA, 64 nt, Homo Sapiens
aacaccuacugauauucacagccacagcagcccauggcacaacuuuaaggggauagacuagacu

SEQ ID NO: 364784 - RNA, 64 nt, Homo Sapiens
cuguguuuauauauuuaaaacuugccuucugaaguggcacaaacauuaguguauuucuccugug

SEQ ID NO: 364785 - RNA, 64 nt, Homo Sapiens
caugugacucugccaguguagaaauuguuccaauuggcacaaccaauucuggggcaaauccaug

SEQ ID NO: 364786 - RNA, 64 nt, Homo Sapiens
acacacguagacugauggaaaaacagcauaguacuggcacaaaacuacaaggcuacaguaacca

SEQ ID NO: 364787 - RNA, 64 nt, Homo Sapiens
ucggcccgcugcagccucugcugcuggagugcaguggcacaaucgucuuacucugucucccagg

SEQ ID NO: 364788 - RNA, 64 nt, Homo Sapiens
auggcucacugcagccuugaaggcuggagugcaguggcacaaucagagucuugcucugucuccc

SEQ ID NO: 364789 - RNA, 64 nt, Homo Sapiens
gcuggccccaggaaugggcaaggccagagccacguggcacaauucaggcucaggcuagaccuga

SEQ ID NO: 364790 - RNA, 64 nt, Homo Sapiens
gacccuggcuaaggagggaguggaggaggaggcauggcacaaguuuccccugaggggcacgggc

SEQ ID NO: 364791 - RNA, 64 nt, Homo Sapiens
agccuuagagcucuuguguucagaagaaucuuccuggcacaauguuggagcagcaggccucugg

SEQ ID NO: 364792 - RNA, 64 nt, Homo Sapiens
ucucugccaguuacuugggcuucaacagccaagcuggcacaaaagacagcuggcggaggcugcu

SEQ ID NO: 364793 - RNA, 64 nt, Homo Sapiens
auauauaggauuacaaaggaaaaucauguuuuuaaaugcauaaaagccuaugaaugccuucuua

SEQ ID NO: 364794 - RNA, 64 nt, Homo Sapiens
agacaagcacuuuggaagaauguuaaaguaaagaaaugcauaaacaacacauauuuuuauauua

SEQ ID NO: 364795 - RNA, 64 nt, Homo Sapiens
ccccucuccauagaggagagugacuuuucaccuuaaugcauauuccuuucucacuuuuggaagg

SEQ ID NO: 364796 - RNA, 64 nt, Homo Sapiens
gucuuuaaaaagcauguugugggaaugugagcacaaugcauaauccuuuggaaacaacauuuaa

SEQ ID NO: 364797 - RNA, 64 nt, Homo Sapiens
accucgagacaugguuuuuggcaaagccauuagaaaugcauaaaucuggguaucucuccuaugg

SEQ ID NO: 364798 - RNA, 64 nt, Homo Sapiens
gggcaugagcaacugaggcaauaaaaccagaggaaaugcauacaguauuuucuuaauuugaaua

SEQ ID NO: 364799 - RNA, 64 nt, Homo Sapiens
caugaacugaugguaacuguacauuuugugcuaaaaugcauauuuauauguguauaccauaugu

SEQ ID NO: 364800 - RNA, 64 nt, Homo Sapiens
uaucuuuuuauaauuuuuuuuccuaagauaaacaaaugcauaguuuucuucuaugggugauaga

SEQ ID NO: 364801 - RNA, 64 nt, Homo Sapiens
aaaagcuaaucccuaaaauaguuagaucuuuguaaaugcauauuaaauaauaaaguaugaccca

SEQ ID NO: 364802 - RNA, 64 nt, Homo Sapiens
cauauucaauguauugagaaccaaagcaaccacaaaugcauaaaugcauaauuuauggucuuca

SEQ ID NO: 364803 - RNA, 64 nt, Homo Sapiens
auguauugagaaccaaagcaaccacaaaugcauaaaugcauaauuuauggucuucaaccaaggc

SEQ ID NO: 364804 - RNA, 64 nt, Homo Sapiens
aagccaauuaucugauuaagcauucuuuccacugaaugcauaauguuuaaauagcauaaaauga

SEQ ID NO: 364805 - RNA, 64 nt, Homo Sapiens
aagauaauaaugauggucaacaauaagccacgucaaugcauaaguuguauaggcuaaauguugc

SEQ ID NO: 364806 - RNA, 64 nt, Homo Sapiens
ucaacuuaacaaacacuuacguucuccuuuauaaaaugcauaguaaaccacuaacguuagcugu

SEQ ID NO: 364807 - RNA, 64 nt, Homo Sapiens
ggacuagaauucugacuuugaaacuuauuaaauuaaugcauacuggaaguacuuugauacucaa

SEQ ID NO: 364808 - RNA, 64 nt, Homo Sapiens
aauuuuuaauggaaagagcauguuagagcaaacaaaugcauaagcaagacugagcagcauuaua

SEQ ID NO: 364809 - RNA, 64 nt, Homo Sapiens
acagauaacacuguaguuccuaaaaaaaaaauuaaaugcauaagcauaagguagaaauuaaaau

SEQ ID NO: 364810 - RNA, 64 nt, Homo Sapiens
uauacuucuugcauggaagacuaagcuaucuuaaaaugcauauacuagaaguuaacucuuaauu

SEQ ID NO: 364811 - RNA, 64 nt, Homo Sapiens
cccaaacuguggaaaggacaugggagggauguacaaugcauauuauccuuacucauacacuugu

SEQ ID NO: 364812 - RNA, 64 nt, Homo Sapiens
uuuuaaaaguauguuuuggaaaaucaaugauuuuaaugcauagcaguauguuugaaaaauagac

SEQ ID NO: 364813 - RNA, 64 nt, Homo Sapiens
uuugaucaucugaaaaaacauuucagugggaagaaaugcauaaaaugccuauaagaaguagaaa

SEQ ID NO: 364814 - RNA, 64 nt, Homo Sapiens
guacaucaacuauuuucagcccaaaaaggugccaaaugcauauaaaucuugauaaacaaagucu

SEQ ID NO: 364815 - RNA, 64 nt, Homo Sapiens
acacauuaugugugauguacuuaaaggaauaauaaaugcauaauaugaggucaguggacgccau

SEQ ID NO: 364816 - RNA, 64 nt, Homo Sapiens
cuuaaauauacaaagguagaccacuccuagccuuaaugcauauuaggauuacuggcgugagcca

SEQ ID NO: 364817 - RNA, 64 nt, Homo Sapiens
cucuuuuuuuuuuuuuuuuuauauugucuugccuaaugcauauuauuuuuguaauuggagguuu

SEQ ID NO: 364818 - RNA, 64 nt, Homo Sapiens
guuccuccauggaccagaguaauuggcacauuuuaaugcauaagcuggggguuucauuuuccca

SEQ ID NO: 364819 - RNA, 64 nt, Homo Sapiens
cauuguugauaauuuccuuguuagugguauuuggaaugcauauagauugucuugucauugugcu

SEQ ID NO: 364820 - RNA, 64 nt, Homo Sapiens
uguacagugcacgggcuaugagauagcaacaaaaaaugcauaguuaauggucauagacuuuauu

SEQ ID NO: 364821 - RNA, 64 nt, Homo Sapiens
agguaaacuugaauauucccaguaaauguuugagaaugcauaaaauuauaccaauuuaaaaaua

SEQ ID NO: 364822 - RNA, 64 nt, Homo Sapiens
ccacaccaaaaccagacucacaaguaauccacauaaugcauaagacacagcaaugaauggcaca

SEQ ID NO: 364823 - RNA, 64 nt, Homo Sapiens
uuucacuuugacucuggucuaaugcuugccucauaaugcauaaccaaccuuucucccuucucaa

SEQ ID NO: 364824 - RNA, 64 nt, Homo Sapiens
cuguuaauaucagacaaaauugcuucucugaggaaaugcauaauucuguauauaugggaccuac

SEQ ID NO: 364825 - RNA, 64 nt, Homo Sapiens
cuauguaaaccauaagugaauggaauaaauucccaaugcauauccuuaugccuuuacucuuaca

SEQ ID NO: 364826 - RNA, 64 nt, Homo Sapiens
uuuucacuccauacucagauaugcuucauugucaaaugcauauuuagauuagauuauugaauug

SEQ ID NO: 364827 - RNA, 64 nt, Homo Sapiens
uuuuuccugauauguagagcagucuguuggcaaaaaugcauauauuuucuuucauauuuguaaa

SEQ ID NO: 364828 - RNA, 64 nt, Homo Sapiens
cauggggaugcuuuagggugagucuauaguacaaaaugcauaaaccauguccccaggaaauuug

SEQ ID NO: 364829 - RNA, 64 nt, Homo Sapiens
uuugcuauaaaauguacuuaaaagucuuaggaaaaaugcauaauauaaggcgauauuggugaug

SEQ ID NO: 364830 - RNA, 50 nt, Homo Sapiens
agucaggguguuuggcuaauaaugcauacaauuugccugacauuuauuaa

SEQ ID NO: 364831 - RNA, 64 nt, Homo Sapiens
uaaaauauuucaaagucauagaaauaguuugagaaaugcauagcauuauuuaacacuauugaac

SEQ ID NO: 364832 - RNA, 64 nt, Homo Sapiens
acauauuuugguucuucuaucucaaauuauuuaaaaugcauaauucacauuuuuguaauaauuc

SEQ ID NO: 364833 - RNA, 64 nt, Homo Sapiens
gacaccacaccuugccugccugccccacccgaauaaugcauaugcuagugagagcugugaucuu

SEQ ID NO: 364834 - RNA, 64 nt, Homo Sapiens
aaggggaaggugcucggucaaaugcccccuucagaaugcauaccgcugagauggaggagaaaaa

SEQ ID NO: 364835 - RNA, 64 nt, Homo Sapiens; identical to SEQ ID NO: 189259

SEQ ID NO: 364836 - RNA, 64 nt, Homo Sapiens; identical to SEQ ID NO: 189260

SEQ ID NO: 364837 - RNA, 64 nt, Homo Sapiens; identical to SEQ ID NO: 189261

SEQ ID NO: 364838 - RNA, 64 nt, Homo Sapiens; identical to SEQ ID NO: 189262

SEQ ID NO: 364839 - RNA, 56 nt, Homo Sapiens; identical to SEQ ID NO: 189263

SEQ ID NO: 364840 - RNA, 64 nt, Homo Sapiens; identical to SEQ ID NO: 189264

SEQ ID NO: 364841 - RNA, 64 nt, Homo Sapiens; identical to SEQ ID NO: 189265

SEQ ID NO: 364842 - RNA, 64 nt, Homo Sapiens; identical to SEQ ID NO: 189266

SEQ ID NO: 364843 - RNA, 64 nt, Homo Sapiens; identical to SEQ ID NO: 189267

SEQ ID NO: 364844 - RNA, 64 nt, Homo Sapiens; identical to SEQ ID NO: 189268

SEQ ID NO: 364845 - RNA, 64 nt, Homo Sapiens; identical to SEQ ID NO: 189269

SEQ ID NO: 364846 - RNA, 64 nt, Homo Sapiens; identical to SEQ ID NO: 189270

SEQ ID NO: 364847 - RNA, 64 nt, Homo Sapiens; identical to SEQ ID NO: 189271

SEQ ID NO: 364848 - RNA, 64 nt, Homo Sapiens; identical to SEQ ID NO: 189272

SEQ ID NO: 364849 - RNA, 64 nt, Homo Sapiens; identical to SEQ ID NO: 189273

SEQ ID NO: 364850 - RNA, 64 nt, Homo Sapiens; identical to SEQ ID NO: 189274

SEQ ID NO: 364851 - RNA, 64 nt, Homo Sapiens; identical to SEQ ID NO: 189275

SEQ ID NO: 364852 - RNA, 64 nt, Homo Sapiens; identical to SEQ ID NO: 189276

SEQ ID NO: 364853 - RNA, 64 nt, Homo Sapiens; identical to SEQ ID NO: 189277

SEQ ID NO: 364854 - RNA, 64 nt, Homo Sapiens; identical to SEQ ID NO: 189278

SEQ ID NO: 364855 - RNA, 64 nt, Homo Sapiens; identical to SEQ ID NO: 189279

SEQ ID NO: 364856 - RNA, 64 nt, Homo Sapiens; identical to SEQ ID NO: 189280

SEQ ID NO: 364857 - RNA, 60 nt, Homo Sapiens
gcagccuggagaagcccuaggggggcgacccgcggagaccccagcagaggucgcagccca

SEQ ID NO: 364858 - RNA, 64 nt, Homo Sapiens
cuggccagugugccacauuaaauacccgugcaggcgcggagaagcaaccggcacccccuuccgg

SEQ ID NO: 364859 - RNA, 64 nt, Homo Sapiens
uccugggcgcgccccgccgcgggcccuugaggcgcgcggagacaccagcgcuggcuucccgggc

SEQ ID NO: 364860 - RNA, 64 nt, Homo Sapiens
ggugccugugguuugcacccaccacugaaaaagccgcggagaugcgcagcgcguacacugacuu

SEQ ID NO: 364861 - RNA, 64 nt, Homo Sapiens
gagccucuuuuugcaaauaaaguuggugcagcuucgcggagaggagaggcgcugcagucugugc

SEQ ID NO: 364862 - RNA, 64 nt, Homo Sapiens
cuggcuacucucucguuuccccgucggcuccaugcgcggagagucggcggugugcuggugggug

SEQ ID NO: 364863 - RNA, 64 nt, Homo Sapiens
cggcgggaaagagcuucggcggacggggacgaggcgcggagaggguuggggguuggguggggcu

SEQ ID NO: 364864 - RNA, 64 nt, Homo Sapiens
aguuuauacuuagaacugaccaccuccccggccacgcggagagcuguacaguguguaaaucugc

SEQ ID NO: 364865 - RNA, 64 nt, Homo Sapiens
agaccggcugcgugauccagccugugccaaaacccgcggagaaggcugccauggcaccgugcau

SEQ ID NO: 364866 - RNA, 64 nt, Homo Sapiens
cgucagauggcagauuuggacagcuucagggcaucgcggagacgcaaaaucaacaucaggaacc

SEQ ID NO: 364867 - RNA, 64 nt, Homo Sapiens
ggguucugagaacauuucacagaagugccugagacgcggagacauggcugguguuaaauggagc

SEQ ID NO: 364868 - RNA, 64 nt, Homo Sapiens
acugcgauauuggaacaccuuaauggaguguccacgcggagauaguucacacgcggggucgguu

SEQ ID NO: 364869 - RNA, 64 nt, Homo Sapiens
agugggguuacagggagucauggagcuuugggaacgcggagaacauggguuucugcucucuaga

SEQ ID NO: 364870 - RNA, 64 nt, Homo Sapiens
ggugcgccgugggcucaagagucagcgcugugcgcgcggagagacugccugcgcgccgccgaca

SEQ ID NO: 364871 - RNA, 64 nt, Homo Sapiens
cugcacuuugcaauggggcccccaccgccaccuccgcggagaaaccauggcccucugccacuga

SEQ ID NO: 364872 - RNA, 64 nt, Homo Sapiens
agcugagcuaguugccuggcacccaccugucgcgcgcggagaggggguucccuguugcuuuugu

SEQ ID NO: 364873 - RNA, 64 nt, Homo Sapiens
ucagagggccguccccaccccucacgccagccaucgcggagagccccagaagucucagaggcac

SEQ ID NO: 364874 - RNA, 64 nt, Homo Sapiens
uccugacaacgucucuucaaaccuaaugauuccgcgcggagaccucagugcaccugccucagcu

SEQ ID NO: 364875 - RNA, 64 nt, Homo Sapiens
cgcacauuccguugccuuacccgauggcuugugacgcggagagaaccgauuaaaaccguuugag

SEQ ID NO: 364876 - RNA, 64 nt, Homo Sapiens
agcucugugugagcggugagggguggagggaugucgcggagaggggaagggggaaacugaccaa

SEQ ID NO: 364877 - RNA, 64 nt, Homo Sapiens
gcugaaccuggacaagcagcuuccuugccucacccgcggagagcggcucgggcgucuccucggu

SEQ ID NO: 364878 - RNA, 64 nt, Homo Sapiens
cagucaucaucauccauggaguggagcuguggcccgcggagaagcgagcgagcagccuauggag

SEQ ID NO: 364879 - RNA, 64 nt, Homo Sapiens
uaggcgaugcagacucgcgaacgcacgcaagagacgcggagagauacaccauuuauauaccuac

SEQ ID NO: 364880 - RNA, 64 nt, Homo Sapiens
acgucacgcaagcaacggcgccagagcacacggccgcggagaugcgcgccucacgaucccucac

SEQ ID NO: 364881 - RNA, 64 nt, Homo Sapiens
cacagcagaaaccaacuuuucuaacgacugaguucgcggagauagcaucaucccugaucaagga

SEQ ID NO: 364882 - RNA, 64 nt, Homo Sapiens
cagagccggcccugaggacaguccugcccauccacgcggagauguggcugccgcguuugcauga

SEQ ID NO: 364883 - RNA, 64 nt, Homo Sapiens
uccucugaccaaggggcacucccucgucugugcccgcggagaccccuguuuccuugucauuuga

SEQ ID NO: 364884 - RNA, 64 nt, Homo Sapiens
guccuagacccaguggggagcugggguccccacccgcggagacgcagggcacaugccuggccgg

SEQ ID NO: 364885 - RNA, 64 nt, Homo Sapiens
cacggcucugcaggaucagggcucgggcaggccccgcggagaugaagaauuugcagggagccuc

SEQ ID NO: 364886 - RNA, 64 nt, Homo Sapiens
ccgggaccguccacgcacgacccagccagacccucgcggagauggugcagaaggcggagcgggu

SEQ ID NO: 364887 - RNA, 64 nt, Homo Sapiens; identical to SEQ ID NO: 47807

SEQ ID NO: 364888 - RNA, 64 nt, Homo Sapiens; identical to SEQ ID NO: 47808

SEQ ID NO: 364889 - RNA, 64 nt, Homo Sapiens; identical to SEQ ID NO: 47809

SEQ ID NO: 364890 - RNA, 64 nt, Homo Sapiens; identical to SEQ ID NO: 47810

SEQ ID NO: 364891 - RNA, 64 nt, Homo Sapiens; identical to SEQ ID NO: 47811

SEQ ID NO: 364892 - RNA, 64 nt, Homo Sapiens; identical to SEQ ID NO: 47812

SEQ ID NO: 364893 - RNA, 64 nt, Homo Sapiens; identical to SEQ ID NO: 47813

SEQ ID NO: 364894 - RNA, 64 nt, Homo Sapiens; identical to SEQ ID NO: 47814

SEQ ID NO: 364895 - RNA, 64 nt, Homo Sapiens; identical to SEQ ID NO: 47815

SEQ ID NO: 364896 - RNA, 64 nt, Homo Sapiens; identical to SEQ ID NO: 47816

SEQ ID NO: 364897 - RNA, 64 nt, Homo Sapiens; identical to SEQ ID NO: 47817

SEQ ID NO: 364898 - RNA, 64 nt, Homo Sapiens; identical to SEQ ID NO: 47818

SEQ ID NO: 364899 - RNA, 64 nt, Homo Sapiens; identical to SEQ ID NO: 47819

SEQ ID NO: 364900 - RNA, 64 nt, Homo Sapiens; identical to SEQ ID NO: 47820

SEQ ID NO: 364901 - RNA, 64 nt, Homo Sapiens; identical to SEQ ID NO: 47821

SEQ ID NO: 364902 - RNA, 64 nt, Homo Sapiens; identical to SEQ ID NO: 47822

SEQ ID NO: 364903 - RNA, 64 nt, Homo Sapiens; identical to SEQ ID NO: 47823

SEQ ID NO: 364904 - RNA, 64 nt, Homo Sapiens; identical to SEQ ID NO: 47824

SEQ ID NO: 364905 - RNA, 64 nt, Homo Sapiens; identical to SEQ ID NO: 47825

SEQ ID NO: 364906 - RNA, 64 nt, Homo Sapiens; identical to SEQ ID NO: 47826

SEQ ID NO: 364907 - RNA, 64 nt, Homo Sapiens; identical to SEQ ID NO: 47827

SEQ ID NO: 364908 - RNA, 64 nt, Homo Sapiens; identical to SEQ ID NO: 47828

SEQ ID NO: 364909 - RNA, 64 nt, Homo Sapiens; identical to SEQ ID NO: 47829

SEQ ID NO: 364910 - RNA, 64 nt, Homo Sapiens; identical to SEQ ID NO: 47830

SEQ ID NO: 364911 - RNA, 64 nt, Homo Sapiens; identical to SEQ ID NO: 47831

SEQ ID NO: 364912 - RNA, 64 nt, Homo Sapiens; identical to SEQ ID NO: 47832

SEQ ID NO: 364913 - RNA, 64 nt, Homo Sapiens; identical to SEQ ID NO: 47833

SEQ ID NO: 364914 - RNA, 64 nt, Homo Sapiens; identical to SEQ ID NO: 47834

SEQ ID NO: 364915 - RNA, 64 nt, Homo Sapiens; identical to SEQ ID NO: 47835

SEQ ID NO: 364916 - RNA, 64 nt, Homo Sapiens; identical to SEQ ID NO: 47836

SEQ ID NO: 364917 - RNA, 64 nt, Homo Sapiens; identical to SEQ ID NO: 47837

SEQ ID NO: 364918 - RNA, 64 nt, Homo Sapiens; identical to SEQ ID NO: 47838

SEQ ID NO: 364919 - RNA, 64 nt, Homo Sapiens; identical to SEQ ID NO: 47839

SEQ ID NO: 364920 - RNA, 64 nt, Homo Sapiens; identical to SEQ ID NO: 47840

SEQ ID NO: 364921 - RNA, 64 nt, Homo Sapiens; identical to SEQ ID NO: 47841

SEQ ID NO: 364922 - RNA, 64 nt, Homo Sapiens; identical to SEQ ID NO: 47842

SEQ ID NO: 364923 - RNA, 64 nt, Homo Sapiens; identical to SEQ ID NO: 47843

SEQ ID NO: 364924 - RNA, 64 nt, Homo Sapiens; identical to SEQ ID NO: 47844

SEQ ID NO: 364925 - RNA, 64 nt, Homo Sapiens; identical to SEQ ID NO: 47845

SEQ ID NO: 364926 - RNA, 64 nt, Homo Sapiens; identical to SEQ ID NO: 47846

SEQ ID NO: 364927 - RNA, 64 nt, Homo Sapiens; identical to SEQ ID NO: 47847

SEQ ID NO: 364928 - RNA, 64 nt, Homo Sapiens; identical to SEQ ID NO: 47848

SEQ ID NO: 364929 - RNA, 64 nt, Homo Sapiens; identical to SEQ ID NO: 47849

SEQ ID NO: 364930 - RNA, 64 nt, Homo Sapiens; identical to SEQ ID NO: 47850

SEQ ID NO: 364931 - RNA, 55 nt, Homo Sapiens; identical to SEQ ID NO: 47851

SEQ ID NO: 364932 - RNA, 64 nt, Homo Sapiens; identical to SEQ ID NO: 47852

SEQ ID NO: 364933 - RNA, 64 nt, Homo Sapiens; identical to SEQ ID NO: 47853

SEQ ID NO: 364934 - RNA, 64 nt, Homo Sapiens; identical to SEQ ID NO: 47854

SEQ ID NO: 364935 - RNA, 64 nt, Homo Sapiens; identical to SEQ ID NO: 47855

SEQ ID NO: 364936 - RNA, 64 nt, Homo Sapiens; identical to SEQ ID NO: 47856

SEQ ID NO: 364937 - RNA, 64 nt, Homo Sapiens; identical to SEQ ID NO: 47857

SEQ ID NO: 364938 - RNA, 64 nt, Homo Sapiens; identical to SEQ ID NO: 47858

SEQ ID NO: 364939 - RNA, 64 nt, Homo Sapiens; identical to SEQ ID NO: 47859

SEQ ID NO: 364940 - RNA, 64 nt, Homo Sapiens; identical to SEQ ID NO: 47860

SEQ ID NO: 364941 - RNA, 64 nt, Homo Sapiens; identical to SEQ ID NO: 47861

SEQ ID NO: 364942 - RNA, 64 nt, Homo Sapiens; identical to SEQ ID NO: 47862

SEQ ID NO: 364943 - RNA, 64 nt, Homo Sapiens
gaaaagugaguuugcagaaaugcauugaggagacuccacagacugaaccacccuccccagaggc

SEQ ID NO: 364944 - RNA, 64 nt, Homo Sapiens
uggcucugcucagaagccaucuguucaccaggacuccacagagcugggucgagcgccugagauc

SEQ ID NO: 364945 - RNA, 64 nt, Homo Sapiens
uauguucuucuuuuuuauguaagggacagcuuucuccacagaguccuuucugcuggugaggaca

SEQ ID NO: 364946 - RNA, 64 nt, Homo Sapiens
gagagaaugugcugucuaucuuccugguuuucaguccacagagucgguagaccagggguuacgu

SEQ ID NO: 364947 - RNA, 64 nt, Homo Sapiens
uauaauuacauccuccaauguaccguuuccuuauuccacagauaucuuuuucauuauugugaag

SEQ ID NO: 364948 - RNA, 64 nt, Homo Sapiens
cuuaucaacacuauaauuguucccuaugaaagauuccacagagauguuuauggugagguuuaaa

SEQ ID NO: 364949 - RNA, 64 nt, Homo Sapiens
cguguuaggcugggguuggggcccauuuucacaguccacagaagcccacugcuggcaggagaag

SEQ ID NO: 364950 - RNA, 64 nt, Homo Sapiens
gggaagggccgaggggagaguucugcaggggauguccacagagagaaccucggggacuugagcc

SEQ ID NO: 364951 - RNA, 64 nt, Homo Sapiens
aaacauuugcaccacuuguggcuuuugaauaucuuccacagagggaaguuuaaaacccaaacuu

SEQ ID NO: 364952 - RNA, 64 nt, Homo Sapiens
cuuugccagucucauuuucaucuucuuccaugguuccacagaagcuuuguuucuugggcaagca

SEQ ID NO: 364953 - RNA, 64 nt, Homo Sapiens
aaaaugggcagagagagaugaccucggaagcauuuccacagauggugucaggguuucaagaagu

SEQ ID NO: 364954 - RNA, 64 nt, Homo Sapiens
gaaaccauuuuuuuaaaaagugaauguacacaaauccacagaggacuguggcuggacauucauc

SEQ ID NO: 364955 - RNA, 64 nt, Homo Sapiens
guccuaggccacugcagagggcagacugcuggucuccacagauaccugcuguucucagcuccag

SEQ ID NO: 364956 - RNA, 64 nt, Homo Sapiens
cauccaugugugcaaaccaucugccccagcugccuccacagacugcugucuccuuguccuccuc

SEQ ID NO: 364957 - RNA, 64 nt, Homo Sapiens
cagugcgccuucuagugcuccauccaccccucucuccacagacgcacccgaauuucuguccguu

SEQ ID NO: 364958 - RNA, 64 nt, Homo Sapiens
uccaagugcaauuaauaauaacucauuuauaccuuccacagaauuuaauaaagauucuacuugu

SEQ ID NO: 364959 - RNA, 64 nt, Homo Sapiens
gugcugugucccucucagaccccccaccugagucuccacagagccccacgccuggcauggcauu

SEQ ID NO: 364960 - RNA, 64 nt, Homo Sapiens
gagucuccacagagccccacgccuggcauggcauuccacagaaaccauaaagguuggcugaguc

SEQ ID NO: 364961 - RNA, 64 nt, Homo Sapiens
agacccuccuuagaaugccacagucccccaacccuccacagagcccccagacccaccagaacuu

SEQ ID NO: 364962 - RNA, 64 nt, Homo Sapiens
aacccuccacagagcccccagacccaccagaacuuccacagacgcccccacuagcuacuccacg

SEQ ID NO: 364963 - RNA, 64 nt, Homo Sapiens
gcccgcuccagagagccucagcccugccucccuuuccacagaggugguuuuauguggaacgagg

SEQ ID NO: 364964 - RNA, 64 nt, Homo Sapiens
ggcaaagggaugggcaugagcgaaggcuccaggguccacagagcagggaguguggagaaggugg

SEQ ID NO: 364965 - RNA, 64 nt, Homo Sapiens; identical to SEQ ID NO: 288888

SEQ ID NO: 364966 - RNA, 64 nt, Homo Sapiens; identical to SEQ ID NO: 288889

SEQ ID NO: 364967 - RNA, 64 nt, Homo Sapiens; identical to SEQ ID NO: 288890

SEQ ID NO: 364968 - RNA, 64 nt, Homo Sapiens; identical to SEQ ID NO: 288891

SEQ ID NO: 364969 - RNA, 64 nt, Homo Sapiens; identical to SEQ ID NO: 76570

SEQ ID NO: 364970 - RNA, 64 nt, Homo Sapiens; identical to SEQ ID NO: 76571

SEQ ID NO: 364971 - RNA, 64 nt, Homo Sapiens; identical to SEQ ID NO: 76572

SEQ ID NO: 364972 - RNA, 64 nt, Homo Sapiens; identical to SEQ ID NO: 76573

SEQ ID NO: 364973 - RNA, 64 nt, Homo Sapiens; identical to SEQ ID NO: 76574

SEQ ID NO: 364974 - RNA, 64 nt, Homo Sapiens; identical to SEQ ID NO: 76575

SEQ ID NO: 364975 - RNA, 64 nt, Homo Sapiens; identical to SEQ ID NO: 76576

SEQ ID NO: 364976 - RNA, 64 nt, Homo Sapiens; identical to SEQ ID NO: 76577

SEQ ID NO: 364977 - RNA, 64 nt, Homo Sapiens; identical to SEQ ID NO: 76578

SEQ ID NO: 364978 - RNA, 64 nt, Homo Sapiens; identical to SEQ ID NO: 76579

SEQ ID NO: 364979 - RNA, 64 nt, Homo Sapiens
ucgaagauauacaaaaacaucccaaugccuauaaaaugcccauuaugauuuuaagaggcuuugg

SEQ ID NO: 364980 - RNA, 64 nt, Homo Sapiens
ucacuucuuugcagagccuugcaacuugcuucuaaaugcccagucacagagccugaauuuguaa

SEQ ID NO: 364981 - RNA, 64 nt, Homo Sapiens
caccuccuccuucagcacaauuuugacauaaaacaaugcccauuggaccuguggauagacuuag

SEQ ID NO: 364982 - RNA, 64 nt, Homo Sapiens
cuuuaaaaauuaaaaauggaaaucuguugugagaaaugcccagguagaauuaauucaaauucag

SEQ ID NO: 364983 - RNA, 64 nt, Homo Sapiens
ugacacuugcuuuguaugcucaguguguugugaaaguuuggaaggucagaccuuuuucuccaag

SEQ ID NO: 364984 - RNA, 64 nt, Homo Sapiens
auaauaagugaaccaauuucaaaugugaucacaaaguuuggaaagcuuuuauucacagagguug

SEQ ID NO: 364985 - RNA, 64 nt, Homo Sapiens
auuuauauauauuuuuuuguaauuauuauauucuaguuuggaguacuugcuguaggauucaagc

SEQ ID NO: 364986 - RNA, 64 nt, Homo Sapiens
aaaaggcuuuuuaacccauuuuugaagagggugaaguuuggagaacaaauuuaaaaaccaucag

SEQ ID NO: 364987 - RNA, 64 nt, Homo Sapiens
uuaucauaguaucuucucuucccucuuccccuuuaguuuggauagccuaacucugagaaguuaa

SEQ ID NO: 364988 - RNA, 64 nt, Homo Sapiens
ucugauucuaccuguuaacuuuuaaaaagucguaaguuuggaugaaagugcaagauguggaaca

SEQ ID NO: 364989 - RNA, 64 nt, Homo Sapiens
ggaagacuauugacuauuucucacauucucuuauaguuuggaugaaguaugauguugaagaaau

SEQ ID NO: 364990 - RNA, 64 nt, Homo Sapiens
uuguuugcccugauaccuuguguacaaaaugaaaaguuuggaaagcuguaguuauucauccuuc

SEQ ID NO: 364991 - RNA, 64 nt, Homo Sapiens
uauuuuuccuuugguauuugcuacagugaaaagaaguuuggaaaguagauacauaaagacuuga

SEQ ID NO: 364992 - RNA, 64 nt, Homo Sapiens
aagauaaauccaguuaucagcuuccugucucugaaguuuggaucauuuuauagauccacgcaau

SEQ ID NO: 364993 - RNA, 64 nt, Homo Sapiens
ccugagaguggagugaggccagcaugcaggaaggaguuuggagagaguguuugcugugauccau

SEQ ID NO: 364994 - RNA, 64 nt, Homo Sapiens
augaaaacagucuuuuuauagccuuuagcuugugaguuuggaaguuuggggggucuuauguuug

SEQ ID NO: 364995 - RNA, 64 nt, Homo Sapiens
acuuuuuuuuuuuuggagauguuuuugauuuuggaguuuggaauaaauacuugggacuggaagu

SEQ ID NO: 364996 - RNA, 64 nt, Homo Sapiens
cauuuuggguagcugaucuucugggugguugcagaguuuggagcuucgcucacgcagcagguau

SEQ ID NO: 364997 - RNA, 64 nt, Homo Sapiens
ugcuccucgucaggcgcagcuaaugaagaauggaaguuuggaucgacuugauuuccccacguca

SEQ ID NO: 364998 - RNA, 64 nt, Homo Sapiens
cuugauguggguuuugaccugauccaggaaauccaguuuggagguccuaguuacaugaggaugu

SEQ ID NO: 364999 - RNA, 64 nt, Homo Sapiens
ccacagggccuccucuuuagcaggaauucacaacaguuuggaugcccuaaacuucuguagcuca

SEQ ID NO: 365000 - RNA, 64 nt, Homo Sapiens
acauagcuugaaaauuuauuuuuauacugauauuaguuuggaugugccacuuuuggcaccaaac

SEQ ID NO: 365001 - RNA, 64 nt, Homo Sapiens
uaaaugguucacgguccacugcagguuucuuuauaguuuggaaagcagugucuuuucucagaga

SEQ ID NO: 365002 - RNA, 64 nt, Homo Sapiens
ggguuuuggaccuccagggguucuaaagggacugaguuuggacuauuuccaaggcacagcagcu

SEQ ID NO: 365003 - RNA, 64 nt, Homo Sapiens
uugguuugcaaaaagagcacagcccuggacuacaaguuuggagauuuaaauucugaucuugagu

SEQ ID NO: 365004 - RNA, 64 nt, Homo Sapiens
gacuacaaguuuggagauuuaaauucugaucuugaguuuggaacugacaaguugugugacccug

SEQ ID NO: 365005 - RNA, 64 nt, Homo Sapiens; identical to SEQ ID NO: 284541

SEQ ID NO: 365006 - RNA, 64 nt, Homo Sapiens; identical to SEQ ID NO: 284542

SEQ ID NO: 365007 - RNA, 64 nt, Homo Sapiens; identical to SEQ ID NO: 284543

SEQ ID NO: 365008 - RNA, 64 nt, Homo Sapiens; identical to SEQ ID NO: 284544

SEQ ID NO: 365009 - RNA, 64 nt, Homo Sapiens; identical to SEQ ID NO: 284545

SEQ ID NO: 365010 - RNA, 64 nt, Homo Sapiens; identical to SEQ ID NO: 284546

SEQ ID NO: 365011 - RNA, 64 nt, Homo Sapiens; identical to SEQ ID NO: 284547

SEQ ID NO: 365012 - RNA, 64 nt, Homo Sapiens; identical to SEQ ID NO: 284548

SEQ ID NO: 365013 - RNA, 64 nt, Homo Sapiens; identical to SEQ ID NO: 284549

SEQ ID NO: 365014 - RNA, 64 nt, Homo Sapiens; identical to SEQ ID NO: 284550

SEQ ID NO: 365015 - RNA, 64 nt, Homo Sapiens; identical to SEQ ID NO: 284551

SEQ ID NO: 365016 - RNA, 64 nt, Homo Sapiens; identical to SEQ ID NO: 284552

SEQ ID NO: 365017 - RNA, 64 nt, Homo Sapiens; identical to SEQ ID NO: 284553

SEQ ID NO: 365018 - RNA, 64 nt, Homo Sapiens; identical to SEQ ID NO: 284554

SEQ ID NO: 365019 - RNA, 64 nt, Homo Sapiens; identical to SEQ ID NO: 284555

SEQ ID NO: 365020 - RNA, 64 nt, Homo Sapiens; identical to SEQ ID NO: 284556

SEQ ID NO: 365021 - RNA, 64 nt, Homo Sapiens; identical to SEQ ID NO: 284557

SEQ ID NO: 365022 - RNA, 64 nt, Homo Sapiens; identical to SEQ ID NO: 284558

SEQ ID NO: 365023 - RNA, 64 nt, Homo Sapiens; identical to SEQ ID NO: 284559

SEQ ID NO: 365024 - RNA, 64 nt, Homo Sapiens; identical to SEQ ID NO: 284560

SEQ ID NO: 365025 - RNA, 64 nt, Homo Sapiens; identical to SEQ ID NO: 284561

SEQ ID NO: 365026 - RNA, 64 nt, Homo Sapiens; identical to SEQ ID NO: 284562

SEQ ID NO: 365027 - RNA, 64 nt, Homo Sapiens; identical to SEQ ID NO: 284563

SEQ ID NO: 365028 - RNA, 64 nt, Homo Sapiens; identical to SEQ ID NO: 284564

SEQ ID NO: 365029 - RNA, 64 nt, Homo Sapiens; identical to SEQ ID NO: 284565

SEQ ID NO: 365030 - RNA, 64 nt, Homo Sapiens; identical to SEQ ID NO: 284566

SEQ ID NO: 365031 - RNA, 64 nt, Homo Sapiens; identical to SEQ ID NO: 284567

SEQ ID NO: 365032 - RNA, 64 nt, Homo Sapiens; identical to SEQ ID NO: 284568

SEQ ID NO: 365033 - RNA, 64 nt, Homo Sapiens; identical to SEQ ID NO: 284569

SEQ ID NO: 365034 - RNA, 64 nt, Homo Sapiens; identical to SEQ ID NO: 284570

SEQ ID NO: 365035 - RNA, 59 nt, Homo Sapiens; identical to SEQ ID NO: 284571

SEQ ID NO: 365036 - RNA, 64 nt, Homo Sapiens; identical to SEQ ID NO: 284572

SEQ ID NO: 365037 - RNA, 64 nt, Homo Sapiens; identical to SEQ ID NO: 284573

SEQ ID NO: 365038 - RNA, 64 nt, Homo Sapiens; identical to SEQ ID NO: 284574

SEQ ID NO: 365039 - RNA, 64 nt, Homo Sapiens; identical to SEQ ID NO: 284575

SEQ ID NO: 365040 - RNA, 64 nt, Homo Sapiens; identical to SEQ ID NO: 284576

SEQ ID NO: 365041 - RNA, 64 nt, Homo Sapiens; identical to SEQ ID NO: 284577

SEQ ID NO: 365042 - RNA, 64 nt, Homo Sapiens; identical to SEQ ID NO: 284578

SEQ ID NO: 365043 - RNA, 64 nt, Homo Sapiens; identical to SEQ ID NO: 284579

SEQ ID NO: 365044 - RNA, 64 nt, Homo Sapiens; identical to SEQ ID NO: 284580

SEQ ID NO: 365045 - RNA, 64 nt, Homo Sapiens; identical to SEQ ID NO: 284581

SEQ ID NO: 365046 - RNA, 64 nt, Homo Sapiens; identical to SEQ ID NO: 284582

SEQ ID NO: 365047 - RNA, 64 nt, Homo Sapiens; identical to SEQ ID NO: 284583

SEQ ID NO: 365048 - RNA, 56 nt, Homo Sapiens; identical to SEQ ID NO: 284584

SEQ ID NO: 365049 - RNA, 64 nt, Homo Sapiens; identical to SEQ ID NO: 284585

SEQ ID NO: 365050 - RNA, 64 nt, Homo Sapiens; identical to SEQ ID NO: 284586

SEQ ID NO: 365051 - RNA, 64 nt, Homo Sapiens; identical to SEQ ID NO: 284587

SEQ ID NO: 365052 - RNA, 64 nt, Homo Sapiens; identical to SEQ ID NO: 284588

SEQ ID NO: 365053 - RNA, 64 nt, Homo Sapiens; identical to SEQ ID NO: 284589

SEQ ID NO: 365054 - RNA, 64 nt, Homo Sapiens; identical to SEQ ID NO: 284590

SEQ ID NO: 365055 - RNA, 64 nt, Homo Sapiens; identical to SEQ ID NO: 284591

SEQ ID NO: 365056 - RNA, 64 nt, Homo Sapiens; identical to SEQ ID NO: 284592

SEQ ID NO: 365057 - RNA, 64 nt, Homo Sapiens; identical to SEQ ID NO: 284593

SEQ ID NO: 365058 - RNA, 64 nt, Homo Sapiens; identical to SEQ ID NO: 284594

SEQ ID NO: 365059 - RNA, 64 nt, Homo Sapiens; identical to SEQ ID NO: 284595

SEQ ID NO: 365060 - RNA, 64 nt, Homo Sapiens; identical to SEQ ID NO: 284596

SEQ ID NO: 365061 - RNA, 64 nt, Homo Sapiens; identical to SEQ ID NO: 284597

SEQ ID NO: 365062 - RNA, 64 nt, Homo Sapiens; identical to SEQ ID NO: 284598

SEQ ID NO: 365063 - RNA, 64 nt, Homo Sapiens; identical to SEQ ID NO: 284599

SEQ ID NO: 365064 - RNA, 64 nt, Homo Sapiens; identical to SEQ ID NO: 284600

SEQ ID NO: 365065 - RNA, 64 nt, Homo Sapiens; identical to SEQ ID NO: 284601

SEQ ID NO: 365066 - RNA, 64 nt, Homo Sapiens; identical to SEQ ID NO: 284602

SEQ ID NO: 365067 - RNA, 64 nt, Homo Sapiens; identical to SEQ ID NO: 284603

SEQ ID NO: 365068 - RNA, 64 nt, Homo Sapiens; identical to SEQ ID NO: 284604

SEQ ID NO: 365069 - RNA, 64 nt, Homo Sapiens; identical to SEQ ID NO: 284605

SEQ ID NO: 365070 - RNA, 64 nt, Homo Sapiens
agguucuuuacaagaugauaccuuaauuacacucccgcaacacagccauuauuuuauugucuag

SEQ ID NO: 365071 - RNA, 64 nt, Homo Sapiens
cgucuuaguuuauuuaaacgcuuaacaucuuccaccgcaacagcuugccucuagagggggaauu

SEQ ID NO: 365072 - RNA, 64 nt, Homo Sapiens
caucaccacuucaauagauccuuuauggcugaaaccgcaacaccuugccuacuaugccagaugc

SEQ ID NO: 365073 - RNA, 64 nt, Homo Sapiens
ugcagacaacugcugcaaugugugcaugaauucaccgcaacacaacauugaccauuuuuuuuaa

SEQ ID NO: 365074 - RNA, 64 nt, Homo Sapiens
ugaauccuggguuuuguaauguggaguggaaagaccgcaacaccacuguuaguguaacgugcca

SEQ ID NO: 365075 - RNA, 64 nt, Homo Sapiens
ucagcgaggagugaaggaccggaagaaaaggcugccgcaacaucucuccugccacaaccgcauu

SEQ ID NO: 365076 - RNA, 64 nt, Homo Sapiens
uuuuuaugcuaaucagggagccuaagccuuccugccgcaacaguucaaaauggagggaauaaua

SEQ ID NO: 365077 - RNA, 64 nt, Homo Sapiens
uuuccgggugugcccagaggagauggccuggcuuccgcaacacagaucugccauuuguucucag

SEQ ID NO: 365078 - RNA, 64 nt, Homo Sapiens
caaguggaacgaauguaaguaugcgggccuuucuccgcaacagcacagacuggggacccuggac

SEQ ID NO: 365079 - RNA, 64 nt, Homo Sapiens
ucugaauacuuucuguuucaaggcacugauaaaaccgcaacaaaaacauguaagaaauaaaaua

SEQ ID NO: 365080 - RNA, 64 nt, Homo Sapiens
uugguaggaaagauucauccccagaggcccuucaccgcaacaacugucuaacuguaugucaacc

SEQ ID NO: 365081 - RNA, 64 nt, Homo Sapiens
gccccaaaggcucuuuucagcuggcgugugaaaaccgcaacaaaugccaaaaagaaguaggaag

SEQ ID NO: 365082 - RNA, 64 nt, Homo Sapiens
cuucaguaucagggcugaaaaaaaauaagaaacaccgcaacaggcauaaucaggcuccagccag

SEQ ID NO: 365083 - RNA, 64 nt, Homo Sapiens
cacaucaccuccccaccaccugucccccccuaccccgcaacaccucucccugucaauggccucg

SEQ ID NO: 365084 - RNA, 64 nt, Homo Sapiens
uauuggaaaaauguauccaggcuuuaaaaccgacccgcaacaagcuucacucuccaggguacau

SEQ ID NO: 365085 - RNA, 64 nt, Homo Sapiens
aguggcugcgguguuuggcaaugcuaauucaaugccgcaacauauaguugaggccgaggauaaa

SEQ ID NO: 365086 - RNA, 64 nt, Homo Sapiens
aaaaacacaaauccuuggcauauacugcugacaaccgcaacaacgaacacggcuggccacuggg

SEQ ID NO: 365087 - RNA, 64 nt, Homo Sapiens
guccagugaauccacgacccgcagaccuguccccccgcaacagcuuauaccauggaaugaggac

SEQ ID NO: 365088 - RNA, 64 nt, Homo Sapiens
uguccgaggucugcgagggcuucgacgaggagggccgcaacauuagcaagacccgcggguggca

SEQ ID NO: 365089 - RNA, 64 nt, Homo Sapiens
gugagccggagcucaugccgaccuuuccccaccaccgcaacaagcgggccgccccagccaccuc

SEQ ID NO: 365090 - RNA, 64 nt, Homo Sapiens
cuucucccgugugucgccgccgugcgucgugcgcccgcaacagagccccaaccgggccuuugcc

SEQ ID NO: 365091 - RNA, 64 nt, Homo Sapiens
uuucaacauugcaacaacaguaacaacaagacaaccgcaacaugugggcguagucaggcaaugc

SEQ ID NO: 365092 - RNA, 64 nt, Homo Sapiens
uaccuggcaaagaaaguaaaauuguuuuuucuguccgcaacacuggcucccgagcagcuuuugu

SEQ ID NO: 365093 - RNA, 64 nt, Homo Sapiens
accugcggcaacuccagacccaggcacagaggcaccgcaacaccguagccccggccugggucau

SEQ ID NO: 365094 - RNA, 64 nt, Homo Sapiens
aauuguuuuuauuucauguaugaaaucaaaccugccgcaacagauuuuacagauucaacugugu

SEQ ID NO: 365095 - RNA, 64 nt, Homo Sapiens
ugcaggacugccagggaucggcagagaacuuuucccgcaacagguggauagacggagcuguggu

SEQ ID NO: 365096 - RNA, 64 nt, Homo Sapiens
uuuucuccuguuccagcuguaucagauacucguuccgcaacacagaaaugacucagaaucucag

SEQ ID NO: 365097 - RNA, 64 nt, Homo Sapiens; identical to SEQ ID NO: 170678

SEQ ID NO: 365098 - RNA, 60 nt, Homo Sapiens; identical to SEQ ID NO: 170679

SEQ ID NO: 365099 - RNA, 64 nt, Homo Sapiens; identical to SEQ ID NO: 170680

SEQ ID NO: 365100 - RNA, 64 nt, Homo Sapiens; identical to SEQ ID NO: 170681

SEQ ID NO: 365101 - RNA, 64 nt, Homo Sapiens; identical to SEQ ID NO: 170682

SEQ ID NO: 365102 - RNA, 64 nt, Homo Sapiens; identical to SEQ ID NO: 170683

SEQ ID NO: 365103 - RNA, 64 nt, Homo Sapiens; identical to SEQ ID NO: 170684

SEQ ID NO: 365104 - RNA, 64 nt, Homo Sapiens; identical to SEQ ID NO: 170685

SEQ ID NO: 365105 - RNA, 64 nt, Homo Sapiens; identical to SEQ ID NO: 170686

SEQ ID NO: 365106 - RNA, 64 nt, Homo Sapiens; identical to SEQ ID NO: 170687

SEQ ID NO: 365107 - RNA, 64 nt, Homo Sapiens; identical to SEQ ID NO: 170688

SEQ ID NO: 365108 - RNA, 64 nt, Homo Sapiens; identical to SEQ ID NO: 170689

SEQ ID NO: 365109 - RNA, 64 nt, Homo Sapiens; identical to SEQ ID NO: 170690

SEQ ID NO: 365110 - RNA, 64 nt, Homo Sapiens; identical to SEQ ID NO: 170691

SEQ ID NO: 365111 - RNA, 64 nt, Homo Sapiens; identical to SEQ ID NO: 170692

SEQ ID NO: 365112 - RNA, 64 nt, Homo Sapiens; identical to SEQ ID NO: 170693

SEQ ID NO: 365113 - RNA, 64 nt, Homo Sapiens; identical to SEQ ID NO: 170694

SEQ ID NO: 365114 - RNA, 64 nt, Homo Sapiens; identical to SEQ ID NO: 170695

SEQ ID NO: 365115 - RNA, 64 nt, Homo Sapiens; identical to SEQ ID NO: 170696

SEQ ID NO: 365116 - RNA, 64 nt, Homo Sapiens; identical to SEQ ID NO: 170697

SEQ ID NO: 365117 - RNA, 64 nt, Homo Sapiens; identical to SEQ ID NO: 170698

SEQ ID NO: 365118 - RNA, 64 nt, Homo Sapiens; identical to SEQ ID NO: 170699

SEQ ID NO: 365119 - RNA, 64 nt, Homo Sapiens; identical to SEQ ID NO: 170700

SEQ ID NO: 365120 - RNA, 64 nt, Homo Sapiens; identical to SEQ ID NO: 170701

SEQ ID NO: 365121 - RNA, 64 nt, Homo Sapiens; identical to SEQ ID NO: 170702

SEQ ID NO: 365122 - RNA, 64 nt, Homo Sapiens; identical to SEQ ID NO: 170703

SEQ ID NO: 365123 - RNA, 64 nt, Homo Sapiens; identical to SEQ ID NO: 170704

SEQ ID NO: 365124 - RNA, 64 nt, Homo Sapiens; identical to SEQ ID NO: 170705

SEQ ID NO: 365125 - RNA, 64 nt, Homo Sapiens; identical to SEQ ID NO: 170706

SEQ ID NO: 365126 - RNA, 64 nt, Homo Sapiens; identical to SEQ ID NO: 170707

SEQ ID NO: 365127 - RNA, 64 nt, Homo Sapiens; identical to SEQ ID NO: 170708

SEQ ID NO: 365128 - RNA, 64 nt, Homo Sapiens; identical to SEQ ID NO: 170709

SEQ ID NO: 365129 - RNA, 64 nt, Homo Sapiens; identical to SEQ ID NO: 170710

SEQ ID NO: 365130 - RNA, 64 nt, Homo Sapiens; identical to SEQ ID NO: 170711

SEQ ID NO: 365131 - RNA, 64 nt, Homo Sapiens; identical to SEQ ID NO: 170712

SEQ ID NO: 365132 - RNA, 64 nt, Homo Sapiens; identical to SEQ ID NO: 170713

SEQ ID NO: 365133 - RNA, 64 nt, Homo Sapiens; identical to SEQ ID NO: 170714

SEQ ID NO: 365134 - RNA, 64 nt, Homo Sapiens; identical to SEQ ID NO: 170715

SEQ ID NO: 365135 - RNA, 50 nt, Homo Sapiens; identical to SEQ ID NO: 170716

SEQ ID NO: 365136 - RNA, 64 nt, Homo Sapiens; identical to SEQ ID NO: 170717

SEQ ID NO: 365137 - RNA, 64 nt, Homo Sapiens; identical to SEQ ID NO: 170718

SEQ ID NO: 365138 - RNA, 64 nt, Homo Sapiens; identical to SEQ ID NO: 170719

SEQ ID NO: 365139 - RNA, 64 nt, Homo Sapiens; identical to SEQ ID NO: 170720

SEQ ID NO: 365140 - RNA, 64 nt, Homo Sapiens; identical to SEQ ID NO: 170721

SEQ ID NO: 365141 - RNA, 64 nt, Homo Sapiens
aaaaacaucacaauccuaaauccucucguaucucaccccaaaccccaaacugggggaaaaaaag

SEQ ID NO: 365142 - RNA, 64 nt, Homo Sapiens
ucacaauccuaaauccucucguaucucaccccaaaccccaaacugggggaaaaaaaguuaacuc

SEQ ID NO: 365143 - RNA, 64 nt, Homo Sapiens
uugugcuggguaaaagaggagagcugugcuuucuaccccaaaguuguugguaauggagccgguc

SEQ ID NO: 365144 - RNA, 64 nt, Homo Sapiens
aaaacauguuuaagauaaaauacaaacuuuaccuaccccaaauucauaaaguacauuuagugcu

SEQ ID NO: 365145 - RNA, 64 nt, Homo Sapiens
cagcaggcaaaugcuuuuuaaaaucaaaacaaaaaccccaaaaaauuuguaaggcugggcuuca

SEQ ID NO: 365146 - RNA, 64 nt, Homo Sapiens
ucagacaggacuuucuaugcgucaaggcuguuuuaccccaaaacgagucagcuacuucacacuu

SEQ ID NO: 365147 - RNA, 64 nt, Homo Sapiens
uugguacccauucccauuucacaaacuccuccaaaccccaaaccccaaacggaaaucucuggga

SEQ ID NO: 365148 - RNA, 64 nt, Homo Sapiens
ccauucccauuucacaaacuccuccaaaccccaaaccccaaacggaaaucucugggacaauggc

SEQ ID NO: 365149 - RNA, 64 nt, Homo Sapiens
caggccgaaugaucaagggggaacaggaaaagaaaccccaaacuacuuuugguaagggaaaagg

SEQ ID NO: 365150 - RNA, 64 nt, Homo Sapiens
gaagauuauuuuuuaugaggaacaacaaaaaauaaccccaaaaugauuuuuuuuuagaacagaa

SEQ ID NO: 365151 - RNA, 64 nt, Homo Sapiens
uuauuuugucaucagauuacuuguggguauaccuaccccaaaauuguuuucucauucacagcau

SEQ ID NO: 365152 - RNA, 64 nt, Homo Sapiens
uuaaaaauauuauugguauuaaagaaauccauucaccccaaaacuuguuuuacaggauuacaau

SEQ ID NO: 365153 - RNA, 64 nt, Homo Sapiens
acgcugucucagaaaacgaaaacggaggaaaaaaaccccaaaccccaaacaaucuuaauaaaca

SEQ ID NO: 365154 - RNA, 64 nt, Homo Sapiens
cucagaaaacgaaaacggaggaaaaaaaccccaaaccccaaacaaucuuaauaaacacgacuga

SEQ ID NO: 365155 - RNA, 64 nt, Homo Sapiens
gcagaaaagcaacacagucauuccugaucuacucaccccaaaagaggaaagcuugcugauuauc

SEQ ID NO: 365156 - RNA, 64 nt, Homo Sapiens
auagucaauggugccucaaaccugcucuccuaugaccccaaaucauccugguuccaucaguaua

SEQ ID NO: 365157 - RNA, 64 nt, Homo Sapiens
ggggcaacaacuccagagaguuacucggacaaagaccccaaagugugggccaaucuacuugaag

SEQ ID NO: 365158 - RNA, 64 nt, Homo Sapiens
gacccaacgauguccacacaguuuugggguucacaccccaaaauucuggcacaccuuguacaga

SEQ ID NO: 365159 - RNA, 64 nt, Homo Sapiens
caagcacuuuacuuccuguuccuccccagccuuaaccccaaagcccuccugcaccccaaagaag

SEQ ID NO: 365160 - RNA, 64 nt, Homo Sapiens
uuccuccccagccuuaaccccaaagcccuccugcaccccaaagaagccacugaggcuggccgag

SEQ ID NO: 365161 - RNA, 64 nt, Homo Sapiens
cuaaagccuccaucucuaauccagcccuaagggaaccccaaaucgacaccaaauuccaagagcc

SEQ ID NO: 365162 - RNA, 64 nt, Homo Sapiens
uuggaggccccauucuaggaucccccuuugggggaccccaaaaucuauuuuuuaaguaacgacu

SEQ ID NO: 365163 - RNA, 64 nt, Homo Sapiens
auggugacccucuccacauacagauuuccauaucaccccaaaugagagcagauucccagauuaa

SEQ ID NO: 365164 - RNA, 64 nt, Homo Sapiens
aggcuccucuuuauggggcagauaucuauagccaaccccaaaacuucugucuucuaucauucug

SEQ ID NO: 365165 - RNA, 64 nt, Homo Sapiens
agcagacagaauacauagccaccauugguaguacaccccaaaagcaaggauggcaugaugcugg

SEQ ID NO: 365166 - RNA, 64 nt, Homo Sapiens
gaaauccugcacccaucagcuuagaaaguuuaucaccccaaagaccauuaucacuagaucaauu

SEQ ID NO: 365167 - RNA, 64 nt, Homo Sapiens
accacaacacaguacaauugcaguauauguagggaccccaaaugacaggacaggcugcacaucu

SEQ ID NO: 365168 - RNA, 64 nt, Homo Sapiens
cccaucagaacuuggcagccgagauguuccuggaggaggacacucucugcucgucgggggcugg

SEQ ID NO: 365169 - RNA, 64 nt, Homo Sapiens
cccaucagaaccuggcagcccugaagacauuccuggaggacacugggcucugcccgcugggggc

SEQ ID NO: 365170 - RNA, 64 nt, Homo Sapiens
uuuauguacccagaggccccaugaugacuauuugggaggacacacuaaccaauacauugaaugu

SEQ ID NO: 365171 - RNA, 64 nt, Homo Sapiens
acugccuuucaaacuuuuuagguuucagugaugaggaggacaacagcugucauuacagacaaca

SEQ ID NO: 365172 - RNA, 64 nt, Homo Sapiens
ggccuggacgacacggccucaggagagcaagccaggaggacaugacacucucgggguugucugc

SEQ ID NO: 365173 - RNA, 64 nt, Homo Sapiens
ggcugcugcugcugcaaaccauggagggcgacgaggaggacagaagagggagguagaagccauc

SEQ ID NO: 365174 - RNA, 64 nt, Homo Sapiens
acagcgggaguguggggguggguuagacaagccuggaggacaaacccgugaggagggggagaag

SEQ ID NO: 365175 - RNA, 64 nt, Homo Sapiens
uggaggcgagccagauuagggaccagaaguggcaggaggacaggucugagccuuaguuucagcu

SEQ ID NO: 365176 - RNA, 64 nt, Homo Sapiens
auacccagccuaaguguugcccugcacuauggcuggaggacacauuugguagaggucacacugc

SEQ ID NO: 365177 - RNA, 64 nt, Homo Sapiens
cauaugucaaggagcacuugcaggcagaaugggaggaggacauggagcugauggaguccaggcu

SEQ ID NO: 365178 - RNA, 64 nt, Homo Sapiens
uguguccuauggaauccaguucugaagaggugggggaggacaacugugggaaaagcccuggggg

SEQ ID NO: 365179 - RNA, 64 nt, Homo Sapiens
agcauggagaaagauccuagugccaugacuuccuggaggacagcaccugcuggagauguaaauu

SEQ ID NO: 365180 - RNA, 64 nt, Homo Sapiens
gcuaagggucucgaccccuuaacauccuggcucaggaggacacuagguagcggauuuccugcag

SEQ ID NO: 365181 - RNA, 64 nt, Homo Sapiens
guccugcccccuuccuuccuucccacggcugcugggaggacaugggguuaaaggaguccgcagc

SEQ ID NO: 365182 - RNA, 64 nt, Homo Sapiens
ggugugugugugacugcaggggguuugcugcuggggaggacauggggaugcuccuggauggaga

SEQ ID NO: 365183 - RNA, 64 nt, Homo Sapiens
cgcuucucggugguggauaugguggcggccccucggaggacaaggcaagagcaccccaucuuca

SEQ ID NO: 365184 - RNA, 64 nt, Homo Sapiens
aaagugaacuccaccgucaugagauaaggguggaggaggacacgaauuccccuuuaagaccaag

SEQ ID NO: 365185 - RNA, 64 nt, Homo Sapiens
cuagcuucaggcuacuugguaacuggaagaagcuggaggacagaagcaguacucaacuugcugu

SEQ ID NO: 365186 - RNA, 64 nt, Homo Sapiens
uggaauuagagaauacaaucaaacuuuaccacuuggaggacacgggguuaguccaggaccaaag

SEQ ID NO: 365187 - RNA, 64 nt, Homo Sapiens
ggcccccaagcugaucugguaacuuaaagagcuaggaggacagagccuagaagcccugagaaag

SEQ ID NO: 365188 - RNA, 64 nt, Homo Sapiens
gguuugggggugcaccuccuaagcccaucuaacaggaggacauucuuagaugugcucuuugggg

SEQ ID NO: 365189 - RNA, 64 nt, Homo Sapiens
accaccaugcauuaagauuuuucauaggaacccaggaggacaaaugauccuaaaagguagccuc

SEQ ID NO: 365190 - RNA, 64 nt, Homo Sapiens
gaaaaggcuggguuggggacgguaccuuccccauggaggacacuccaaggccuggagcuauucu

SEQ ID NO: 365191 - RNA, 64 nt, Homo Sapiens
gcaacuaugcccccgaugaggaccaagggcaccuggaggacagcuggaccgguaucugccaucc

SEQ ID NO: 365192 - RNA, 64 nt, Homo Sapiens
gcaugaaccuggaccccuucggcagcuacucagaggaggacauuuggugggcuuuggagcuguc

SEQ ID NO: 365193 - RNA, 64 nt, Homo Sapiens
augaagauggaggccuuguaugguuuuuaggauuggaggacaucuuuggaggcccugucucugg

SEQ ID NO: 365194 - RNA, 51 nt, Homo Sapiens
ucuacaaguaucuacauaucuggaggacaggauaccugugaaaaugaauag

SEQ ID NO: 365195 - RNA, 64 nt, Homo Sapiens
guggguggaucacuugaggcaucccagcacuuugggaggacaaggcacaggggucacaccugua

SEQ ID NO: 365196 - RNA, 64 nt, Homo Sapiens
cugcuagcaagauggaaguuaugcaagccaaaagggaggacagugcugcuugcuucaucaaggc

SEQ ID NO: 365197 - RNA, 64 nt, Homo Sapiens
cuugcuaccccaagucacuaccucaacugacuuaggaggacaguagcuucaucccgaugucacu

SEQ ID NO: 365198 - RNA, 64 nt, Homo Sapiens
cucagggagaagaccucugucaucuuguacuaaaggaggacacaauuagcaauaaguuaaaccu

SEQ ID NO: 365199 - RNA, 64 nt, Homo Sapiens
acugacucccauuuccuaaaggaaaugcccccggggaggacauugggaggaagauggccugagu

SEQ ID NO: 365200 - RNA, 64 nt, Homo Sapiens
aacacagaacccucaagacaaggaugacagagcuggaggacacaucuagcugccauugcaaccu

SEQ ID NO: 365201 - RNA, 64 nt, Homo Sapiens
accaacgggucugugggacucagcuagguuaauaggaggacagauccccacucccgugaugaaa

SEQ ID NO: 365202 - RNA, 64 nt, Homo Sapiens
gagggaacagaccucggcugaaggggaucuaaaaggaggacaggccucccuguccccugagguu

SEQ ID NO: 365203 - RNA, 64 nt, Homo Sapiens
gaccauugaugcacuuggugucuuuuugccugcuggaggacacguggccacacacuuccaugug

SEQ ID NO: 365204 - RNA, 64 nt, Homo Sapiens
cucaguuugcuccacauggcccagacggggggcuggaggacaccgggccggccaggcagggcac

SEQ ID NO: 365205 - RNA, 64 nt, Homo Sapiens
ccaggccgugaggcuggagaaacuggcaguuauugcugucaaaagccuguucucucaacugcug

SEQ ID NO: 365206 - RNA, 64 nt, Homo Sapiens
caguuauugcugucaaaagccuguucucucaacugcugucaauaaaauuaaagauacagauuug

SEQ ID NO: 365207 - RNA, 64 nt, Homo Sapiens; identical to SEQ ID NO: 161197

SEQ ID NO: 365208 - RNA, 64 nt, Homo Sapiens; identical to SEQ ID NO: 161198

SEQ ID NO: 365209 - RNA, 64 nt, Homo Sapiens; identical to SEQ ID NO: 161199

SEQ ID NO: 365210 - RNA, 64 nt, Homo Sapiens; identical to SEQ ID NO: 161200

SEQ ID NO: 365211 - RNA, 64 nt, Homo Sapiens; identical to SEQ ID NO: 161201

SEQ ID NO: 365212 - RNA, 64 nt, Homo Sapiens; identical to SEQ ID NO: 161202

SEQ ID NO: 365213 - RNA, 64 nt, Homo Sapiens; identical to SEQ ID NO: 161203

SEQ ID NO: 365214 - RNA, 64 nt, Homo Sapiens; identical to SEQ ID NO: 161204

SEQ ID NO: 365215 - RNA, 64 nt, Homo Sapiens; identical to SEQ ID NO: 161205

SEQ ID NO: 365216 - RNA, 64 nt, Homo Sapiens; identical to SEQ ID NO: 161206

SEQ ID NO: 365217 - RNA, 64 nt, Homo Sapiens; identical to SEQ ID NO: 161207

SEQ ID NO: 365218 - RNA, 64 nt, Homo Sapiens; identical to SEQ ID NO: 161208

SEQ ID NO: 365219 - RNA, 64 nt, Homo Sapiens; identical to SEQ ID NO: 161209

SEQ ID NO: 365220 - RNA, 64 nt, Homo Sapiens; identical to SEQ ID NO: 161210

SEQ ID NO: 365221 - RNA, 64 nt, Homo Sapiens; identical to SEQ ID NO: 161211

SEQ ID NO: 365222 - RNA, 64 nt, Homo Sapiens; identical to SEQ ID NO: 161212

SEQ ID NO: 365223 - RNA, 64 nt, Homo Sapiens; identical to SEQ ID NO: 161213

SEQ ID NO: 365224 - RNA, 64 nt, Homo Sapiens; identical to SEQ ID NO: 161214

SEQ ID NO: 365225 - RNA, 64 nt, Homo Sapiens; identical to SEQ ID NO: 161215

SEQ ID NO: 365226 - RNA, 64 nt, Homo Sapiens; identical to SEQ ID NO: 161216

SEQ ID NO: 365227 - RNA, 64 nt, Homo Sapiens; identical to SEQ ID NO: 161217

SEQ ID NO: 365228 - RNA, 64 nt, Homo Sapiens; identical to SEQ ID NO: 161218

SEQ ID NO: 365229 - RNA, 64 nt, Homo Sapiens; identical to SEQ ID NO: 161219

SEQ ID NO: 365230 - RNA, 64 nt, Homo Sapiens; identical to SEQ ID NO: 161220

SEQ ID NO: 365231 - RNA, 64 nt, Homo Sapiens; identical to SEQ ID NO: 161221

SEQ ID NO: 365232 - RNA, 64 nt, Homo Sapiens; identical to SEQ ID NO: 161222

SEQ ID NO: 365233 - RNA, 64 nt, Homo Sapiens; identical to SEQ ID NO: 161223

SEQ ID NO: 365234 - RNA, 64 nt, Homo Sapiens; identical to SEQ ID NO: 161224

SEQ ID NO: 365235 - RNA, 64 nt, Homo Sapiens; identical to SEQ ID NO: 161225

SEQ ID NO: 365236 - RNA, 64 nt, Homo Sapiens; identical to SEQ ID NO: 161226

SEQ ID NO: 365237 - RNA, 64 nt, Homo Sapiens; identical to SEQ ID NO: 161227

SEQ ID NO: 365238 - RNA, 64 nt, Homo Sapiens; identical to SEQ ID NO: 161228

SEQ ID NO: 365239 - RNA, 64 nt, Homo Sapiens; identical to SEQ ID NO: 161229

SEQ ID NO: 365240 - RNA, 64 nt, Homo Sapiens; identical to SEQ ID NO: 161230

SEQ ID NO: 365241 - RNA, 64 nt, Homo Sapiens; identical to SEQ ID NO: 161231

SEQ ID NO: 365242 - RNA, 64 nt, Homo Sapiens; identical to SEQ ID NO: 161232

SEQ ID NO: 365243 - RNA, 60 nt, Homo Sapiens; identical to SEQ ID NO: 161233

SEQ ID NO: 365244 - RNA, 64 nt, Homo Sapiens; identical to SEQ ID NO: 161234

SEQ ID NO: 365245 - RNA, 64 nt, Homo Sapiens; identical to SEQ ID NO: 161235

SEQ ID NO: 365246 - RNA, 64 nt, Homo Sapiens; identical to SEQ ID NO: 161236

SEQ ID NO: 365247 - RNA, 64 nt, Homo Sapiens; identical to SEQ ID NO: 161237

SEQ ID NO: 365248 - RNA, 64 nt, Homo Sapiens; identical to SEQ ID NO: 161238

SEQ ID NO: 365249 - RNA, 64 nt, Homo Sapiens; identical to SEQ ID NO: 161239

SEQ ID NO: 365250 - RNA, 64 nt, Homo Sapiens; identical to SEQ ID NO: 161240

SEQ ID NO: 365251 - RNA, 64 nt, Homo Sapiens; identical to SEQ ID NO: 161241

SEQ ID NO: 365252 - RNA, 64 nt, Homo Sapiens; identical to SEQ ID NO: 161242

SEQ ID NO: 365253 - RNA, 64 nt, Homo Sapiens; identical to SEQ ID NO: 161243

SEQ ID NO: 365254 - RNA, 64 nt, Homo Sapiens; identical to SEQ ID NO: 161244

SEQ ID NO: 365255 - RNA, 64 nt, Homo Sapiens; identical to SEQ ID NO: 161245

SEQ ID NO: 365256 - RNA, 64 nt, Homo Sapiens; identical to SEQ ID NO: 161246

SEQ ID NO: 365257 - RNA, 64 nt, Homo Sapiens; identical to SEQ ID NO: 161247

SEQ ID NO: 365258 - RNA, 64 nt, Homo Sapiens; identical to SEQ ID NO: 161248

SEQ ID NO: 365259 - RNA, 64 nt, Homo Sapiens; identical to SEQ ID NO: 161249

SEQ ID NO: 365260 - RNA, 64 nt, Homo Sapiens; identical to SEQ ID NO: 161250

SEQ ID NO: 365261 - RNA, 64 nt, Homo Sapiens; identical to SEQ ID NO: 161251

SEQ ID NO: 365262 - RNA, 64 nt, Homo Sapiens; identical to SEQ ID NO: 161252

SEQ ID NO: 365263 - RNA, 64 nt, Homo Sapiens; identical to SEQ ID NO: 161253

SEQ ID NO: 365264 - RNA, 64 nt, Homo Sapiens; identical to SEQ ID NO: 161254

SEQ ID NO: 365265 - RNA, 64 nt, Homo Sapiens; identical to SEQ ID NO: 161255

SEQ ID NO: 365266 - RNA, 64 nt, Homo Sapiens; identical to SEQ ID NO: 161256

SEQ ID NO: 365267 - RNA, 64 nt, Homo Sapiens; identical to SEQ ID NO: 161257

SEQ ID NO: 365268 - RNA, 64 nt, Homo Sapiens; identical to SEQ ID NO: 161258

SEQ ID NO: 365269 - RNA, 64 nt, Homo Sapiens; identical to SEQ ID NO: 161259

SEQ ID NO: 365270 - RNA, 64 nt, Homo Sapiens; identical to SEQ ID NO: 161260

SEQ ID NO: 365271 - RNA, 64 nt, Homo Sapiens; identical to SEQ ID NO: 161261

SEQ ID NO: 365272 - RNA, 64 nt, Homo Sapiens; identical to SEQ ID NO: 161262

SEQ ID NO: 365273 - RNA, 64 nt, Homo Sapiens; identical to SEQ ID NO: 161263

SEQ ID NO: 365274 - RNA, 64 nt, Homo Sapiens; identical to SEQ ID NO: 161264

SEQ ID NO: 365275 - RNA, 64 nt, Homo Sapiens; identical to SEQ ID NO: 161265

SEQ ID NO: 365276 - RNA, 64 nt, Homo Sapiens; identical to SEQ ID NO: 161266

SEQ ID NO: 365277 - RNA, 64 nt, Homo Sapiens; identical to SEQ ID NO: 161267

SEQ ID NO: 365278 - RNA, 64 nt, Homo Sapiens; identical to SEQ ID NO: 161268

SEQ ID NO: 365279 - RNA, 64 nt, Homo Sapiens; identical to SEQ ID NO: 161269

SEQ ID NO: 365280 - RNA, 64 nt, Homo Sapiens; identical to SEQ ID NO: 161270

SEQ ID NO: 365281 - RNA, 64 nt, Homo Sapiens; identical to SEQ ID NO: 161271

SEQ ID NO: 365282 - RNA, 64 nt, Homo Sapiens; identical to SEQ ID NO: 161272

SEQ ID NO: 365283 - RNA, 64 nt, Homo Sapiens; identical to SEQ ID NO: 161273

SEQ ID NO: 365284 - RNA, 64 nt, Homo Sapiens; identical to SEQ ID NO: 161274

SEQ ID NO: 365285 - RNA, 64 nt, Homo Sapiens; identical to SEQ ID NO: 161275

SEQ ID NO: 365286 - RNA, 64 nt, Homo Sapiens; identical to SEQ ID NO: 161276

SEQ ID NO: 365287 - RNA, 64 nt, Homo Sapiens; identical to SEQ ID NO: 161277

SEQ ID NO: 365288 - RNA, 64 nt, Homo Sapiens; identical to SEQ ID NO: 161278

SEQ ID NO: 365289 - RNA, 64 nt, Homo Sapiens; identical to SEQ ID NO: 161279

SEQ ID NO: 365290 - RNA, 63 nt, Homo Sapiens; identical to SEQ ID NO: 161280

SEQ ID NO: 365291 - RNA, 64 nt, Homo Sapiens; identical to SEQ ID NO: 161281

SEQ ID NO: 365292 - RNA, 64 nt, Homo Sapiens; identical to SEQ ID NO: 161282

SEQ ID NO: 365293 - RNA, 64 nt, Homo Sapiens; identical to SEQ ID NO: 161283

SEQ ID NO: 365294 - RNA, 64 nt, Homo Sapiens; identical to SEQ ID NO: 161284

SEQ ID NO: 365295 - RNA, 64 nt, Homo Sapiens; identical to SEQ ID NO: 85920

SEQ ID NO: 365296 - RNA, 64 nt, Homo Sapiens; identical to SEQ ID NO: 85921

SEQ ID NO: 365297 - RNA, 64 nt, Homo Sapiens; identical to SEQ ID NO: 85922

SEQ ID NO: 365298 - RNA, 64 nt, Homo Sapiens; identical to SEQ ID NO: 85923

SEQ ID NO: 365299 - RNA, 64 nt, Homo Sapiens; identical to SEQ ID NO: 85924

SEQ ID NO: 365300 - RNA, 64 nt, Homo Sapiens; identical to SEQ ID NO: 85925

SEQ ID NO: 365301 - RNA, 64 nt, Homo Sapiens; identical to SEQ ID NO: 85926

SEQ ID NO: 365302 - RNA, 64 nt, Homo Sapiens; identical to SEQ ID NO: 85927

SEQ ID NO: 365303 - RNA, 64 nt, Homo Sapiens; identical to SEQ ID NO: 85928

SEQ ID NO: 365304 - RNA, 64 nt, Homo Sapiens; identical to SEQ ID NO: 85929

SEQ ID NO: 365305 - RNA, 64 nt, Homo Sapiens; identical to SEQ ID NO: 85930

SEQ ID NO: 365306 - RNA, 64 nt, Homo Sapiens; identical to SEQ ID NO: 85931

SEQ ID NO: 365307 - RNA, 64 nt, Homo Sapiens; identical to SEQ ID NO: 85932

SEQ ID NO: 365308 - RNA, 64 nt, Homo Sapiens; identical to SEQ ID NO: 85933

SEQ ID NO: 365309 - RNA, 64 nt, Homo Sapiens; identical to SEQ ID NO: 85934

SEQ ID NO: 365310 - RNA, 64 nt, Homo Sapiens; identical to SEQ ID NO: 85935

SEQ ID NO: 365311 - RNA, 64 nt, Homo Sapiens; identical to SEQ ID NO: 85936

SEQ ID NO: 365312 - RNA, 64 nt, Homo Sapiens; identical to SEQ ID NO: 85937

SEQ ID NO: 365313 - RNA, 64 nt, Homo Sapiens; identical to SEQ ID NO: 85938

SEQ ID NO: 365314 - RNA, 64 nt, Homo Sapiens; identical to SEQ ID NO: 85939

SEQ ID NO: 365315 - RNA, 64 nt, Homo Sapiens; identical to SEQ ID NO: 85940

SEQ ID NO: 365316 - RNA, 64 nt, Homo Sapiens; identical to SEQ ID NO: 85941

SEQ ID NO: 365317 - RNA, 64 nt, Homo Sapiens; identical to SEQ ID NO: 85942

SEQ ID NO: 365318 - RNA, 64 nt, Homo Sapiens; identical to SEQ ID NO: 85943

SEQ ID NO: 365319 - RNA, 64 nt, Homo Sapiens
acacuggcgaccugacuagccacuucugccguccacaucccagccagcaccaccuccugcacug

SEQ ID NO: 365320 - RNA, 64 nt, Homo Sapiens
ccucaguccucagucaucuuaccucaagcccccaacaucccaguuacaacuacuacuucuuggg

SEQ ID NO: 365321 - RNA, 64 nt, Homo Sapiens
caucuugucuuacacauaaaagccacugcuuuuaacaucccauuguacauuuaacacauaaaug

SEQ ID NO: 365322 - RNA, 64 nt, Homo Sapiens
aucccauuguacauuuaacacauaaaugguguuaacaucccauuguacauuuaacacauaaaug

SEQ ID NO: 365323 - RNA, 64 nt, Homo Sapiens
gagcuuaucccccagacccugcuuuauaccauucacaucccagggcuguguccagacagcacaa

SEQ ID NO: 365324 - RNA, 64 nt, Homo Sapiens
gguguuuaauggguuaaaaauaagccacugccugacaucccaacauuugacaccccagcaaugu

SEQ ID NO: 365325 - RNA, 64 nt, Homo Sapiens
uuggcaccccacagcccuucaccuucgcuaucaaacaucccaggaaaggguaagaauuuagggc

SEQ ID NO: 365326 - RNA, 64 nt, Homo Sapiens
gauggcucuaagggcuauaaauuacaaacaaaacacaucccagacauuaggaguucauaaguau

SEQ ID NO: 365327 - RNA, 64 nt, Homo Sapiens
cguguccguguggccggccaggcaugucccagacacaucccacaaggccugugcacacauccca

SEQ ID NO: 365328 - RNA, 64 nt, Homo Sapiens
caugucccagacacaucccaggaggccugugcacacaucccaggaaugagcugugaccauccca

SEQ ID NO: 365329 - RNA, 64 nt, Homo Sapiens
acucacagaaggggacugacagugggcaacacucacaucccacuggcugcuguucugaaaccau

SEQ ID NO: 365330 - RNA, 64 nt, Homo Sapiens
cgcucucgagcuguucuguaaauaccuggugcuaacaucccaugccgcucccuccucacgaugc

SEQ ID NO: 365331 - RNA, 64 nt, Homo Sapiens
aaacgguuacuggggcugcauggagaauuucaccugcggugauuuugauccagggacugcaucu

SEQ ID NO: 365332 - RNA, 64 nt, Homo Sapiens
uuugccaaaggcagaguggggcugagaaacaggcugcggugauugcaauuaccauccgguguuc

SEQ ID NO: 365333 - RNA, 64 nt, Homo Sapiens
agccaccugggcugggagaaggugcuugggcuucugcggugaggcaggggagucugcuugucuu

SEQ ID NO: 365334 - RNA, 64 nt, Homo Sapiens
gucaagagcaggggugggccggggagggguccuuugcggugagcuauguuuacaugacacagug

SEQ ID NO: 365335 - RNA, 64 nt, Homo Sapiens
acaggagaaucacuugaaccugggagguggagguugcggugagcugagaucgugccacugcacu

SEQ ID NO: 365336 - RNA, 64 nt, Homo Sapiens
ccacacagcagccuccaggauaccagcaaauggaugcggugacaaauggcagcuuagcuacaaa

SEQ ID NO: 365337 - RNA, 64 nt, Homo Sapiens
cagaucuuagaaaccaaccauacagacgagccgaugcggugaggagaagcgucaggcggcgcuu

SEQ ID NO: 365338 - RNA, 64 nt, Homo Sapiens
uacaaccugaugucauauuccauuuuggacugggugcggugacucaugccuguaaucccaguac

SEQ ID NO: 365339 - RNA, 64 nt, Homo Sapiens
gcauuuaauauuuuuauaaugugucuaggcugggugcggugacucacgccugaaaucccagcac

SEQ ID NO: 365340 - RNA, 64 nt, Homo Sapiens
auuuccucagcauugaacaaagcauuuaucagacugcggugaaccuacugaaacucccagccac

SEQ ID NO: 365341 - RNA, 64 nt, Homo Sapiens
gcuagagaaucacuugaacccagcaggcggagguugcggugagucgagaucacgccauugcacu

SEQ ID NO: 365342 - RNA, 64 nt, Homo Sapiens
guauggagagcccagcccaccagguccugccuuuugcggugauaaccuucucuggcagagugac

SEQ ID NO: 365343 - RNA, 64 nt, Homo Sapiens
acuggucaagcucucuccggcugcccgggggcccugcggugaacuuuagggccaagucccaagc

SEQ ID NO: 365344 - RNA, 64 nt, Homo Sapiens
gcggggugugguggccuguggcuuagauucuguaugcggugacguguauauaaacgugucccga

SEQ ID NO: 365345 - RNA, 64 nt, Homo Sapiens
ggaagcuaaaagugucaagcaccugccgacuuagugcggugauagagcagcuaucugauuggaa

SEQ ID NO: 365346 - RNA, 64 nt, Homo Sapiens
agagggcgcguuuggguuuguuguuucugcuuucugcggugaucgaaucgccgcucagcccccu

SEQ ID NO: 365347 - RNA, 64 nt, Homo Sapiens
cgagaucgugcuacuacugccaggaggcagagguugcggugagugcaggagaacugccugaacc

SEQ ID NO: 365348 - RNA, 64 nt, Homo Sapiens
gcaggagaauugcuugaacccgggagguggaggcugcggugagccaagaucaugccauugcacu

SEQ ID NO: 365349 - RNA, 64 nt, Homo Sapiens
cuggaagccggagcaagggcugcgccucugcuguugcggugaauggacaagaguggggccacuc

SEQ ID NO: 365350 - RNA, 64 nt, Homo Sapiens
cgagauugcgccauugcacucaggagguggaggcugcggugagcgcaggagaaucacuugaacc

SEQ ID NO: 365351 - RNA, 64 nt, Homo Sapiens
uucuuuuuuuguaaagcaaauagccaaaaccagaugcggugacucaugccauguguaauauacc

SEQ ID NO: 365352 - RNA, 64 nt, Homo Sapiens
cuguaacucgagugcauugaccuugaccugagacugcggugagugcugaggacaguaguaaacc

SEQ ID NO: 365353 - RNA, 64 nt, Homo Sapiens
gcaggagaaucauuugaacucaggaggcggaaguugcggugagccaagauugugccauugcacu

SEQ ID NO: 365354 - RNA, 64 nt, Homo Sapiens
ucccauugggcagcugaggaccgaggcacagaggugcggugacuugcccggggcuccagguagc

SEQ ID NO: 365355 - RNA, 64 nt, Homo Sapiens
ugcagaggccucaccucuaaugggagacggagguugcggugagcgcaggagaauugcuugaacc

SEQ ID NO: 365356 - RNA, 64 nt, Homo Sapiens
ugagauggcaccacugcacucaggaggcggagguugcggugagcgcacgagaaucaccugaacu

SEQ ID NO: 365357 - RNA, 64 nt, Homo Sapiens
ugagauugcacuauugcacucggaagguggagguugcggugagcggcggagaauugcuugaacc

SEQ ID NO: 365358 - RNA, 64 nt, Homo Sapiens
auuuguuucuacagaaauaacagcuggggacaacugcggugaugauguaaaaaccuucccauaa

SEQ ID NO: 365359 - RNA, 64 nt, Homo Sapiens
uucuaucugcaguauuuguaacuugacguaguccugcggugauaaaugauccugaacacucuga

SEQ ID NO: 365360 - RNA, 64 nt, Homo Sapiens
gggcggaaaggcgcagagaacuccaccccauugaugcggugacgcgcaaguguuugaguuuggc

SEQ ID NO: 365361 - RNA, 64 nt, Homo Sapiens
auaaaugggauuuaucuuuuuucucacuuauuuuugcggugaaagucgagggcaugcaagaguu

SEQ ID NO: 365362 - RNA, 63 nt, Homo Sapiens
aaaauagccacuuaccuucaauaaaguaucuacaugcggugaagcauuguugacucuaaugug

SEQ ID NO: 365363 - RNA, 64 nt, Homo Sapiens
gaaugguggcaccacgauauauaugucccucaggugcggugacagcaaucgucugggcucgugg

SEQ ID NO: 365364 - RNA, 64 nt, Homo Sapiens
ccagaucgcgccauugcacuggggaggcagagguugcggugagcgcagaagaauugcuugaacu

SEQ ID NO: 365365 - RNA, 64 nt, Homo Sapiens
uccuuacuguccccagccaguucagugucccuccugcggugaugcugcaguccucgacagccuc

SEQ ID NO: 365366 - RNA, 64 nt, Homo Sapiens
uggaugaaccuugaguacaugaaauucugacauaugcggugacauaccagccuuccgcaggaag

SEQ ID NO: 365367 - RNA, 64 nt, Homo Sapiens
cccacuccaccugggcgccuucugugguuugggcugcggugagucuggggucuggucuuccugc

SEQ ID NO: 365368 - RNA, 64 nt, Homo Sapiens
cagaauuauaacagugagcuugugcuaagguucuugcggugaacuguuuguugaguccuuucuu

SEQ ID NO: 365369 - RNA, 64 nt, Homo Sapiens
guaguguugaauauguugcauuuuccaagcaaacugcggugagcuuuguuguaugacagaaggc

SEQ ID NO: 365370 - RNA, 64 nt, Homo Sapiens
gccugggccugcccagauggccaccucguggugcugcggugacuuuguagccaacuuuauaaua

SEQ ID NO: 365371 - RNA, 64 nt, Homo Sapiens
gugagcaggauccuggggccuuccugccugcaccugcggugacuguccagucccccagggcugc

SEQ ID NO: 365372 - RNA, 64 nt, Homo Sapiens
ggccagacggugcugggaaggacguguuuagaaaugcggugaagcgaggaacagaugugugugu

SEQ ID NO: 365373 - RNA, 64 nt, Homo Sapiens
ccugccccggcugugccaggccccgcugguuuggugcggugagugggcuccagagcucggcagg

SEQ ID NO: 365374 - RNA, 64 nt, Homo Sapiens
aagcugggcgcuguuuucgaaaaagauacgugccugcggugaggcgucucgaggaaaaaaaaag

SEQ ID NO: 365375 - RNA, 64 nt, Homo Sapiens
gcaggagaaucgcuugagccugggaggcagaggcugcggugagccgagaucgugucacugcacu

SEQ ID NO: 365376 - RNA, 64 nt, Homo Sapiens
ccacccagccugaccuguguacugccccaacuccugcggugacaccugugugugccugggggcu

SEQ ID NO: 365377 - RNA, 64 nt, Homo Sapiens
ccgaagcuccccggcugugggagagcagacucugugcggugacuggacugaggagcacagagca

SEQ ID NO: 365378 - RNA, 64 nt, Homo Sapiens
uugaggcuuauaaguuaaaauacauucuuuauucugcggugaagcgauuaugcuuucuuuggcc

SEQ ID NO: 365379 - RNA, 64 nt, Homo Sapiens
uuuaaacucugcucaggauaaucccccaagaggaugcggugaagcagagagaaaaauugccuuc

SEQ ID NO: 365380 - RNA, 64 nt, Homo Sapiens
ugcuuuuuguccaugugccguagucuuugcuguuugcggugaaacuguuaauagaaagguggga

SEQ ID NO: 365381 - RNA, 64 nt, Homo Sapiens
gugggaggaucaccuaaggccaggaggucaaggcugcggugagccgugauugugccaauguacu

SEQ ID NO: 365382 - RNA, 64 nt, Homo Sapiens
gcaggagaaucgcuugaacccagguggcggagguugcggugagcugagaucacgccauugcacu

SEQ ID NO: 365383 - RNA, 64 nt, Homo Sapiens
auucuugccacaauauuggaucuuaauuuuuacuugcggugacuccuuaaucucuacaacagua

SEQ ID NO: 365384 - RNA, 64 nt, Homo Sapiens
augggucuaauaaaggaucaaccacaugggguucugcggugauaaugagcacauagugaggggu

SEQ ID NO: 365385 - RNA, 64 nt, Homo Sapiens
gcaggaaaaucacuugaacccgggaggcggagguugcggugagccaagaucgcaccauugcacu

SEQ ID NO: 365386 - RNA, 64 nt, Homo Sapiens
ccagguggccggcuccucggacucugcuuuauguugcggugagaacucugcccaggugugcagg

SEQ ID NO: 365387 - RNA, 64 nt, Homo Sapiens
ccugaugaccagguucugucucuauggaagucacugcggugauaggucugugauggucccuaag

SEQ ID NO: 365388 - RNA, 64 nt, Homo Sapiens
gagccccacggccucgcacacugaagcaggggcgugcggugacucggugcuucuguuuuggaag

SEQ ID NO: 365389 - RNA, 64 nt, Homo Sapiens
gcggggugggaaccgugucauuccagaguggaucugcggugaagccaagccgcaagguuacaag

SEQ ID NO: 365390 - RNA, 64 nt, Homo Sapiens
ggcugcggugggcgcugcgguccugguggggccgugcggugagggccgcgcgcugggagccgca

SEQ ID NO: 365391 - RNA, 64 nt, Homo Sapiens
ggaugaggggagccuacgccgagcaaaugccccaugcggugagauugagggaaguagaggcugg

SEQ ID NO: 365392 - RNA, 64 nt, Homo Sapiens
cuugccaaaaugguggguuacacauggaacagugugcggugaaacuacuccagcaguauuugaa

SEQ ID NO: 365393 - RNA, 64 nt, Homo Sapiens
caagaucgugccacugcacucaggagguggagguugcggugagcgcaggagaaucgcuugaacu

SEQ ID NO: 365394 - RNA, 64 nt, Homo Sapiens
gcaggaggaucgcuugagaccaagaguuugagccugcggugagcugugaaugcaccacggcacu

SEQ ID NO: 365395 - RNA, 64 nt, Homo Sapiens
gcauaugccgcgagcugggcugguuugcuggggcugcggugacagugcguuuugcauacugggu

SEQ ID NO: 365396 - RNA, 64 nt, Homo Sapiens
uaaaaaaauuaaaucuaguucaccuugcucacccugcggugacagggacagcucaggcucuugg

SEQ ID NO: 365397 - RNA, 64 nt, Homo Sapiens
uaaacacgggugugcauguggaugcacacgggugugcggugaagaucuguggagauggagcugg

SEQ ID NO: 365398 - RNA, 64 nt, Homo Sapiens
caagaucgugccacugcacuugggaggcggagcuugcggugagcgcaggagaauggcgugaacu

SEQ ID NO: 365399 - RNA, 64 nt, Homo Sapiens
caagaucgcaccauugcacucgggagguggagguugcggugagcgcaggagaaucgcuugaacc

SEQ ID NO: 365400 - RNA, 64 nt, Homo Sapiens
caagaucgcgccacugcacucgggaggcggagguugcggugagcgcaggauaaucacuugaauc

SEQ ID NO: 365401 - RNA, 64 nt, Homo Sapiens
cacgccuauaaucccagcacgaaaugcugccgggugcggugacuguaaacgucgucucaaaaau

SEQ ID NO: 365402 - RNA, 64 nt, Homo Sapiens
caagauggcaccauugcacccaugagguggagguugcggugagcgcaggagaauugcuugaacc

SEQ ID NO: 365403 - RNA, 64 nt, Homo Sapiens
ccaacuccagcccauccugucccgguuccuccccugcggugacccucuuccucucgggagccuc

SEQ ID NO: 365404 - RNA, 64 nt, Homo Sapiens
ggaaccacccucccuugcugcugaccccaguggcugcggugaggugggcaggucgugucuccuc

SEQ ID NO: 365405 - RNA, 64 nt, Homo Sapiens
uugaaagaagcugcugcacccgaaacugccagugugcggugacaacggcacacgccuagacuga

SEQ ID NO: 365406 - RNA, 64 nt, Homo Sapiens
agcucgugggacagcaugggcacuacucuucaugugcggugacaccagcccccagaugccuuga

SEQ ID NO: 365407 - RNA, 64 nt, Homo Sapiens
aacuuacgugacaaugauuggccugacgcuggagugcggugaugcagguccacggaaagguuug

SEQ ID NO: 365408 - RNA, 64 nt, Homo Sapiens
gcaggagaguagcgugaacccgggaggcagagcuugcggugagccgagauugcgcuacugcacu

SEQ ID NO: 365409 - RNA, 64 nt, Homo Sapiens
cacaaauauaucugugugugugugugcgugugugugcggugaagggcgguccccauccugggcc

SEQ ID NO: 365410 - RNA, 64 nt, Homo Sapiens
gcaggagaaucacuugaacccaggaggcggagguugcggugagcugagauugcaccauuucauu

SEQ ID NO: 365411 - RNA, 64 nt, Homo Sapiens
aggccccgccaagagacugggagucuggccugcgugcggugaggaacaguuuaagaugcagugu

SEQ ID NO: 365412 - RNA, 64 nt, Homo Sapiens
caagauggcaccacugcacucaggaggcagagauugcggugagcgcaggagaauugcuugaacc

SEQ ID NO: 365413 - RNA, 64 nt, Homo Sapiens
caagauugcgccacugcacuaaagagguggagguugcggugagcgagaaucgcuugaacccaag

SEQ ID NO: 365414 - RNA, 64 nt, Homo Sapiens
cacuuugaauucugugcuaauuuuguggccagaaugcggugaucaaaacgcuccaucuuuuuac

SEQ ID NO: 365415 - RNA, 64 nt, Homo Sapiens
agccauaggaauuuggcuguggaguaagagggaaugcggugaggcacucuggaauaugacccua

SEQ ID NO: 365416 - RNA, 64 nt, Homo Sapiens
gcaggaggaucacuugagcccaggaguuugaggcugcggugagcugugaucacaccaccacacu

SEQ ID NO: 365417 - RNA, 64 nt, Homo Sapiens
gcuguaaccaagaucagguccaacugccugacuaugcggugacuaagccucuguccuguauagg

SEQ ID NO: 365418 - RNA, 64 nt, Homo Sapiens
caagagcgcaccauugcacucgggaggcagagguugcggugagcgcaggagaaucacuugaacc

SEQ ID NO: 365419 - RNA, 64 nt, Homo Sapiens; identical to SEQ ID NO: 336839

SEQ ID NO: 365420 - RNA, 64 nt, Homo Sapiens; identical to SEQ ID NO: 336840

SEQ ID NO: 365421 - RNA, 64 nt, Homo Sapiens; identical to SEQ ID NO: 336841

SEQ ID NO: 365422 - RNA, 64 nt, Homo Sapiens; identical to SEQ ID NO: 336842

SEQ ID NO: 365423 - RNA, 64 nt, Homo Sapiens; identical to SEQ ID NO: 336843

SEQ ID NO: 365424 - RNA, 64 nt, Homo Sapiens; identical to SEQ ID NO: 336844

SEQ ID NO: 365425 - RNA, 64 nt, Homo Sapiens; identical to SEQ ID NO: 336845

SEQ ID NO: 365426 - RNA, 64 nt, Homo Sapiens; identical to SEQ ID NO: 336846

SEQ ID NO: 365427 - RNA, 64 nt, Homo Sapiens; identical to SEQ ID NO: 336847

SEQ ID NO: 365428 - RNA, 64 nt, Homo Sapiens; identical to SEQ ID NO: 336848

SEQ ID NO: 365429 - RNA, 64 nt, Homo Sapiens; identical to SEQ ID NO: 336849

SEQ ID NO: 365430 - RNA, 64 nt, Homo Sapiens; identical to SEQ ID NO: 336850

SEQ ID NO: 365431 - RNA, 64 nt, Homo Sapiens; identical to SEQ ID NO: 336851

SEQ ID NO: 365432 - RNA, 64 nt, Homo Sapiens; identical to SEQ ID NO: 336852

SEQ ID NO: 365433 - RNA, 64 nt, Homo Sapiens; identical to SEQ ID NO: 336853

SEQ ID NO: 365434 - RNA, 64 nt, Homo Sapiens; identical to SEQ ID NO: 336854

SEQ ID NO: 365435 - RNA, 64 nt, Homo Sapiens; identical to SEQ ID NO: 336855

SEQ ID NO: 365436 - RNA, 64 nt, Homo Sapiens; identical to SEQ ID NO: 336856

SEQ ID NO: 365437 - RNA, 64 nt, Homo Sapiens; identical to SEQ ID NO: 336857

SEQ ID NO: 365438 - RNA, 64 nt, Homo Sapiens; identical to SEQ ID NO: 336858

SEQ ID NO: 365439 - RNA, 64 nt, Homo Sapiens; identical to SEQ ID NO: 336859

SEQ ID NO: 365440 - RNA, 64 nt, Homo Sapiens; identical to SEQ ID NO: 336860

SEQ ID NO: 365441 - RNA, 64 nt, Homo Sapiens; identical to SEQ ID NO: 336861

SEQ ID NO: 365442 - RNA, 64 nt, Homo Sapiens; identical to SEQ ID NO: 336862

SEQ ID NO: 365443 - RNA, 64 nt, Homo Sapiens; identical to SEQ ID NO: 336863

SEQ ID NO: 365444 - RNA, 64 nt, Homo Sapiens; identical to SEQ ID NO: 336864

SEQ ID NO: 365445 - RNA, 64 nt, Homo Sapiens; identical to SEQ ID NO: 336865

SEQ ID NO: 365446 - RNA, 64 nt, Homo Sapiens; identical to SEQ ID NO: 336866

SEQ ID NO: 365447 - RNA, 64 nt, Homo Sapiens; identical to SEQ ID NO: 336867

SEQ ID NO: 365448 - RNA, 64 nt, Homo Sapiens; identical to SEQ ID NO: 336868

SEQ ID NO: 365449 - RNA, 64 nt, Homo Sapiens; identical to SEQ ID NO: 336869

SEQ ID NO: 365450 - RNA, 64 nt, Homo Sapiens; identical to SEQ ID NO: 336870

SEQ ID NO: 365451 - RNA, 64 nt, Homo Sapiens; identical to SEQ ID NO: 93680

SEQ ID NO: 365452 - RNA, 64 nt, Homo Sapiens; identical to SEQ ID NO: 93681

SEQ ID NO: 365453 - RNA, 64 nt, Homo Sapiens; identical to SEQ ID NO: 93682

SEQ ID NO: 365454 - RNA, 64 nt, Homo Sapiens; identical to SEQ ID NO: 93683

SEQ ID NO: 365455 - RNA, 64 nt, Homo Sapiens; identical to SEQ ID NO: 93684

SEQ ID NO: 365456 - RNA, 64 nt, Homo Sapiens; identical to SEQ ID NO: 93685

SEQ ID NO: 365457 - RNA, 64 nt, Homo Sapiens; identical to SEQ ID NO: 93686

SEQ ID NO: 365458 - RNA, 64 nt, Homo Sapiens; identical to SEQ ID NO: 93687

SEQ ID NO: 365459 - RNA, 64 nt, Homo Sapiens
cugggcgcgcugggagugugguuguguuucugaaggggauaaaagagggcacgguggugccaag

SEQ ID NO: 365460 - RNA, 64 nt, Homo Sapiens
ccuaacuucugauuuagauacuucucccugagguggggauaaaagaaaaaaaaaaacaacuucu

SEQ ID NO: 365461 - RNA, 64 nt, Homo Sapiens
cccugacuccuggugcccucucccuuuguccccccagagagacauaugcccccagagagagcaa

SEQ ID NO: 365462 - RNA, 64 nt, Homo Sapiens
ucucccuuuguccccccagagagacauaugcccccagagagagcaaaucgaagcgugggaggca

SEQ ID NO: 365463 - RNA, 64 nt, Homo Sapiens
uguacgggguuugugacuggagaggcuagugccucagagagaacuguaaccaagauggaugcaa

SEQ ID NO: 365464 - RNA, 64 nt, Homo Sapiens
ugaguuuugacgucuuuuuaucuguuuuauaaaccagagagaaaguuuggaaaacaguuuuuau

SEQ ID NO: 365465 - RNA, 64 nt, Homo Sapiens
gacuugucuuauguagggugccugggguaaggggcagagagaagccuggugucugccucgccau

SEQ ID NO: 365466 - RNA, 64 nt, Homo Sapiens
gagacagaaagagagagagaguugggaaggguagcagagagagaugugcagugucugagggcag

SEQ ID NO: 365467 - RNA, 64 nt, Homo Sapiens
cagaagucuuguuagcagaauuauuuaucagucacagagagaaaaaucugcuauuuuucuaagu

SEQ ID NO: 365468 - RNA, 64 nt, Homo Sapiens
gaucauucaguuacuugucaggauuucuccucuucagagagauuuuuuuuuauagcacagauuc

SEQ ID NO: 365469 - RNA, 64 nt, Homo Sapiens
auacaguccacagguggacaaagggauccccagccagagagagagagaccagccaacagcuuga

SEQ ID NO: 365470 - RNA, 64 nt, Homo Sapiens
gagaccagccaacagcuugauagaccagugcagccagagagaccaccaaacagagcccccaaaa

SEQ ID NO: 365471 - RNA, 64 nt, Homo Sapiens
ucuuaaugcuguguuugagcuuucaugaguuucccagagagacauagcuggaaaauuccuauug

SEQ ID NO: 365472 - RNA, 64 nt, Homo Sapiens
ggggcaggguuauuccuuuguggaaccagaggcacagagagagucaacugaggccaaaagaggc

SEQ ID NO: 365473 - RNA, 64 nt, Homo Sapiens
ccauucgugaugcuuagaacguugggaauuaaagcagagagaagacuguccuuggcucagaggu

SEQ ID NO: 365474 - RNA, 64 nt, Homo Sapiens
cuguucccuauucccagacaauccccccuugaggcagagagaucacaccagaccuccaggagac

SEQ ID NO: 365475 - RNA, 64 nt, Homo Sapiens
ugauuauuuuuuucuuuaugaugcaaauuaaaugcagagagaaaaaaucugcaaaugcacauua

SEQ ID NO: 365476 - RNA, 64 nt, Homo Sapiens
aaugguuaaaaugugaauaguuaaauuuaaaaugcagagagaccgugcuucaguaacuugaagu

SEQ ID NO: 365477 - RNA, 64 nt, Homo Sapiens
cucuguacacagccccgugaggccaucgugucagcagagagagugucauacacgaagggcgugu

SEQ ID NO: 365478 - RNA, 64 nt, Homo Sapiens
cucuguacacagccccgugaggccaucgugucagcagagagagugucauacgcgaaggccauau

SEQ ID NO: 365479 - RNA, 64 nt, Homo Sapiens
uauugaugauacaagaggaaaacccugagccuuccagagagagccucucaacaccacaguucuc

SEQ ID NO: 365480 - RNA, 62 nt, Homo Sapiens
gccuugucauuucaucauggcccacagaaagccagagagaguagaccugccaaggacacuga

SEQ ID NO: 365481 - RNA, 64 nt, Homo Sapiens
auaacaguguuauaaugcagcuuccuugagccaucagagagaguguauguucacccuaucuggc

SEQ ID NO: 365482 - RNA, 64 nt, Homo Sapiens
cagauggaacgaaaggcgaugugcaaggccaucccagagagacggaagcaggugcgauacuaag

SEQ ID NO: 365483 - RNA, 64 nt, Homo Sapiens
cagugggugcggggggauccgcaggcacccugggcagagagaugggcgcggggcauccuaugag

SEQ ID NO: 365484 - RNA, 64 nt, Homo Sapiens
cuguggcgcggggcauccuagcgggcgcccugggcagagagacuggacgaggaccagcugugag

SEQ ID NO: 365485 - RNA, 64 nt, Homo Sapiens
guaggaaauuucuccuuaguucacaauagcaucccagagagacagaauuccaauuaauuaaaua

SEQ ID NO: 365486 - RNA, 64 nt, Homo Sapiens
ggcggcgggucuuagaagaaggauugaacaacugcagagagaaaagcugaaauacaaaagcaga

SEQ ID NO: 365487 - RNA, 64 nt, Homo Sapiens
gccuucccuacacuagaaguauugcaggagcucccagagagacuaccugggcuaagaguuuggc

SEQ ID NO: 365488 - RNA, 64 nt, Homo Sapiens
gcccccuucccuccagcggcagcucugguucuuccagagagacuacuccaguggugaagggugc

SEQ ID NO: 365489 - RNA, 64 nt, Homo Sapiens
cuccauccccgcuaccguccuggccagcuaccgucagagagaaccagagcuccaagucuuuaau

SEQ ID NO: 365490 - RNA, 64 nt, Homo Sapiens
aggaaccugcuaucaggaaaucuacaugugugcacagagagagaaaaguagaacaguucuuugc

SEQ ID NO: 365491 - RNA, 64 nt, Homo Sapiens
uuuccacagcagccauuuccuagagguggaaaaccagagagaugcaaaauggggcuucuguaag

SEQ ID NO: 365492 - RNA, 64 nt, Homo Sapiens
ggagugggugggcagggguacaugugaggguccccagagagaagcuggggggaggcaggaggca

SEQ ID NO: 365493 - RNA, 64 nt, Homo Sapiens
uguguaugagagagagagagagagacaacagagacagagagaggcagagaggcauagagagaca

SEQ ID NO: 365494 - RNA, 64 nt, Homo Sapiens
cagagacagagagaggcagagaggcauagagagacagagagagagacaagaaacagagauagac

SEQ ID NO: 365495 - RNA, 64 nt, Homo Sapiens
uuugaaaucuggucuguuugcauuucuguuaugacagagagaugauguuugcauuucuguuaug

SEQ ID NO: 365496 - RNA, 64 nt, Homo Sapiens
ugacagagagaugauguuugcauuucuguuaugacagagagaugaugaaaguaggcagggcugu

SEQ ID NO: 365497 - RNA, 64 nt, Homo Sapiens
gagggagagguggggagggagacagagacagaaacagagagagacagagacagagagagacuga

SEQ ID NO: 365498 - RNA, 64 nt, Homo Sapiens
gggagacagagacagaaacagagagagacagagacagagagagacugagggagagacucugagg

SEQ ID NO: 365499 - RNA, 64 nt, Homo Sapiens
gagagcgccuagaaauugaaaacgggaacgcuuacagagagagaaauaauucgugaacgggaag

SEQ ID NO: 365500 - RNA, 64 nt, Homo Sapiens
gcgucgagagcgagaacgcaacgaagagagauugcagagagagauaaauacugauuuuugguag

SEQ ID NO: 365501 - RNA, 64 nt, Homo Sapiens
ccauauccaaaaaaaaaaaauccagucugggugacagagagagacugagaucacgccacugcac

SEQ ID NO: 365502 - RNA, 64 nt, Homo Sapiens
gaguccuccccauugggaacgccaaaaauuacaccagagagacaggggguucagaaccagccug

SEQ ID NO: 365503 - RNA, 64 nt, Homo Sapiens
aacauuccucucugucaacaagccccggggggcacagagagaacuugaauguccaccagacacc

SEQ ID NO: 365504 - RNA, 64 nt, Homo Sapiens
caaucaaaaccuggaagacagaagcuagaggcggcagagagagagagugcgaauaugucucuga

SEQ ID NO: 365505 - RNA, 56 nt, Homo Sapiens
gagaagaacacgcagcugaagaucaacagagagaagcuggaagaacaaugcaguga

SEQ ID NO: 365506 - RNA, 64 nt, Homo Sapiens
gagugagaagcuuugcccuccuaagagagagagacagagagacagagagagagaaagagagagu

SEQ ID NO: 365507 - RNA, 64 nt, Homo Sapiens
agcuuugcccuccuaagagagagagacagagagacagagagagagaaagagagagugugugggu

SEQ ID NO: 365508 - RNA, 64 nt, Homo Sapiens
uagagcaggaggucggggcagagggagagagggacagagagagagagagaggcagagagacaga

SEQ ID NO: 365509 - RNA, 64 nt, Homo Sapiens
gagagggagagagggacagagagagggagagaggcagagagacaggcagagagggagagaggca

SEQ ID NO: 365510 - RNA, 64 nt, Homo Sapiens
agaccaaaaugaggugguggacugggggagggggcagagagaggcggagcagggcagaagaugg

SEQ ID NO: 365511 - RNA, 64 nt, Homo Sapiens
ccccagguacaacaaaugcucccaggucucuauccagagagagucuccgcuuccccccugcuuc

SEQ ID NO: 365512 - RNA, 64 nt, Homo Sapiens
uauacauuccauagucaucaaggaauauauugugcagagagaguauccuugacugcuuaaguca

SEQ ID NO: 365513 - RNA, 64 nt, Homo Sapiens
cacuccagacggcuuucucaguuccaagauuuugcagagagaaggagcaaaccuuuucauugga

SEQ ID NO: 365514 - RNA, 64 nt, Homo Sapiens
uaaguuacuagaaagugaaaagcuuucuguauuucagagagacauuuaugagaauuauaaguaa

SEQ ID NO: 365515 - RNA, 64 nt, Homo Sapiens
ucagaucaguauugugcauucagaagacuggccccagagagaccaaaaggagaaagauaaaaua

SEQ ID NO: 365516 - RNA, 64 nt, Homo Sapiens
cucugcucugagcagccugggaugcugaacucuucagagagauuuuuuuauagagagauuucua

SEQ ID NO: 365517 - RNA, 64 nt, Homo Sapiens
gugcugaggagguuggagagagaaagggugaaagcagagagaccagugcagggcuguuaacagg

SEQ ID NO: 365518 - RNA, 64 nt, Homo Sapiens
caggggagggcugcccaucuccccaacccagucacagagagauaggaaacggcauuugaguggg

SEQ ID NO: 365519 - RNA, 64 nt, Homo Sapiens
auaugugcuguuuggcaccguggcaagaugguaucagagagaaacccaucaauugcucaaauac

SEQ ID NO: 365520 - RNA, 64 nt, Homo Sapiens
ggcaugugugaagguguguggggaguacuccaagcagagagaauaagcaaaugagguuccaggg

SEQ ID NO: 365521 - RNA, 64 nt, Homo Sapiens
ccuggcccucaaaaaggugugaaaaaaagauagccagagagagagggugccaagcucagagggg

SEQ ID NO: 365522 - RNA, 64 nt, Homo Sapiens
uacuuagaauagguuuugaaugggagagguagaacagagagagaauuaagaagggaucugacuu

SEQ ID NO: 365523 - RNA, 64 nt, Homo Sapiens
gcuggggguggagggguauaagaggagggagagucagagagaguguguaugggugugugugagu

SEQ ID NO: 365524 - RNA, 64 nt, Homo Sapiens
aagacugcaggaacggaggguuuccccagugacucagagagagcgagccucuggggggcaccug

SEQ ID NO: 365525 - RNA, 64 nt, Homo Sapiens
ccccugaggagaagggacgccagggcuuuguuagcagagagaaguccucgucugggugugcgca

SEQ ID NO: 365526 - RNA, 64 nt, Homo Sapiens
ccucuucccaugaccuaaaacacugugaggaaaaaucauucaaguggcaugccaagucccuaug

SEQ ID NO: 365527 - RNA, 64 nt, Homo Sapiens
auauguagaaaagugggguccuuuugaauaaaagaucauucaacuaaaaauauuaaaauuuauu

SEQ ID NO: 365528 - RNA, 64 nt, Homo Sapiens
uuguggguaaaagcuaauggccaaaaugguugcaaucauucauacuaguuagaaaaauuaugug

SEQ ID NO: 365529 - RNA, 64 nt, Homo Sapiens
cuuucuaaguauuuccagaaauaccugauuuugaaucauucaacaguagaaaaagaggcauauu

SEQ ID NO: 365530 - RNA, 64 nt, Homo Sapiens
cuuugccuauuaagucuaccaaauuaaaagucuuaucauucagcguguuuugagaguuaauaau

SEQ ID NO: 365531 - RNA, 64 nt, Homo Sapiens
acuaaagacuugagauuauauaaaauuauccagaaucauucagcuaauacuauuggaauauagu

SEQ ID NO: 365532 - RNA, 64 nt, Homo Sapiens
ugcucacugcaugaagacugucucuucuccugugaucauucaagaauggcuucaggacaugggu

SEQ ID NO: 365533 - RNA, 64 nt, Homo Sapiens
gcagucucccucuuauuugugacgcauugguauuaucauucaaauucaagcuguacugugagca

SEQ ID NO: 365534 - RNA, 64 nt, Homo Sapiens
ugggugcaagucagcauuguaaguuuucucagguuauuauuauuagagagguuggaaacauugg

SEQ ID NO: 365535 - RNA, 64 nt, Homo Sapiens
gugcaagucagcauuguaaguuuucucagguuauuauuauuagagagguuggaaacauugguaa

SEQ ID NO: 365536 - RNA, 64 nt, Homo Sapiens
uggaauucauugccuuaggucuuuuuaaauaguguauuauuaucguuggggcuggcucuaugcu

SEQ ID NO: 365537 - RNA, 64 nt, Homo Sapiens
aaaguggucucaaccuaacaucagaaguguuucuuauuauuauuuuauauugaguugaauauug

SEQ ID NO: 365538 - RNA, 64 nt, Homo Sapiens
gguaaaacccagguuagucaucaguaaccuucucuauuauuauuauuuuuuagaaacuuggaau

SEQ ID NO: 365539 - RNA, 64 nt, Homo Sapiens
aaaacccagguuagucaucaguaaccuucucuauuauuauuauuuuuuagaaacuuggaauacu

SEQ ID NO: 365540 - RNA, 64 nt, Homo Sapiens
auuuauguuauuuaugauguuauuuuguacguguuauuauuauuauauuguuuuauaaauggag

SEQ ID NO: 365541 - RNA, 64 nt, Homo Sapiens
uauguuauuuaugauguuauuuuguacguguuauuauuauuauauuguuuuauaaauggaggua

SEQ ID NO: 365542 - RNA, 64 nt, Homo Sapiens
gcuaacuacacuuugauacuaacuccaguuuuacuauuauuauuuugguuggaaaaaaaauuca

SEQ ID NO: 365543 - RNA, 64 nt, Homo Sapiens
gagaauauuuuuaauuugcugcaguacuaugucauauuauuaguaugaaucucauuucccaaag

SEQ ID NO: 365544 - RNA, 64 nt, Homo Sapiens
gagaauguaguugaaauuauucuuaaacaucuuuuauuauuauuacucucaguaguaaaauauc

SEQ ID NO: 365545 - RNA, 64 nt, Homo Sapiens
aauguaguugaaauuauucuuaaacaucuuuuauuauuauuacucucaguaguaaaauaucaca

SEQ ID NO: 365546 - RNA, 64 nt, Homo Sapiens
uuuuuuuuaguuuuuaaauucuuccucuucuuuuuauuauuauucuaauuauuauuauuuuauu

SEQ ID NO: 365547 - RNA, 64 nt, Homo Sapiens
aaauucuuccucuucuuuuuauuauuauucuaauuauuauuauuuuauuauuuacaagacuuuu

SEQ ID NO: 365548 - RNA, 64 nt, Homo Sapiens
uccagaaucucgaagaaaaaagaaaaaagagugguauuauuaugggcaaauaaucauauuccca

SEQ ID NO: 365549 - RNA, 64 nt, Homo Sapiens
ugcacuagggaggaaggauaaaugcuuuuuauguuauuauuauuaauuauuacaaugaccacca

SEQ ID NO: 365550 - RNA, 64 nt, Homo Sapiens
acuagggaggaaggauaaaugcuuuuuauguuauuauuauuaauuauuacaaugaccaccauuu

SEQ ID NO: 365551 - RNA, 64 nt, Homo Sapiens
gaaggugguaccauuaucaauuuuuauuuuauauuauuauuauaaaaaacccagacaucagaug

SEQ ID NO: 365552 - RNA, 64 nt, Homo Sapiens
auagaaggugguaccauuauauguuuuuauuuuauauuauuauuugaaaaaacccagacaucag

SEQ ID NO: 365553 - RNA, 64 nt, Homo Sapiens
aauuuuuguaagaaaccgaguauauuauuauuaauauuauuaugcccagcccgacaaugucgag

SEQ ID NO: 365554 - RNA, 64 nt, Homo Sapiens
auuauuaugaauuuuuguaaaaugucgaguauauuauuauuaaugggccacgccccagcccgac

SEQ ID NO: 365555 - RNA, 64 nt, Homo Sapiens
aauauuauuaugaauuuuuggacaaugucgaguauauuauuauucccgggccacgccccagccc

SEQ ID NO: 365556 - RNA, 64 nt, Homo Sapiens
uaguagaaaaagcauucccauccucaagagcguguauuauuaucaagcaguguaggauuuucuc

SEQ ID NO: 365557 - RNA, 64 nt, Homo Sapiens
aaacaaaaaaaacccaccuacuauuuuaaauucauauuauuaaaugcacucacccuguuugugg

SEQ ID NO: 365558 - RNA, 64 nt, Homo Sapiens
auuguuaaacuucugugcuguguuagaacuuuauuauuauuaauagauaaacuuuccugucaug

SEQ ID NO: 365559 - RNA, 64 nt, Homo Sapiens
aauauuguuaaacuucugugauguguuagaacuuuauuauuauuuccagauaaacuuuccuguc

SEQ ID NO: 365560 - RNA, 64 nt, Homo Sapiens
uuuuuuuuaauuuggauucuuauauuauuauuauuauuauuauauuacauuuguguauaauuau

SEQ ID NO: 365561 - RNA, 64 nt, Homo Sapiens
auauuuuuuuuaauuuggauuauuauauuauuauuauuauuauucgguuacauuuguguauaau

SEQ ID NO: 365562 - RNA, 64 nt, Homo Sapiens
auuauauuuuuuuuaauuugaauuauuauauuauuauuauuauuugacgguuacauuuguguau

SEQ ID NO: 365563 - RNA, 64 nt, Homo Sapiens
auuauuauauuuuuuuuaauuauaauuauuauauuauuauuauuuguugacgguuacauuugug

SEQ ID NO: 365564 - RNA, 64 nt, Homo Sapiens
auuauuauuauauuuuuuuuguguauaauuauuauauuauuauuuccuguugacgguuacauuu

SEQ ID NO: 365565 - RNA, 64 nt, Homo Sapiens
uucucugcuauuguaauauucucuuuauuguuauuauuauuauucugacucccacuucuaauuu

SEQ ID NO: 365566 - RNA, 64 nt, Homo Sapiens
auuuucucugcuauuguaauuuucucuuuauuguuauuauuauuacccugacucccacuucuaa

SEQ ID NO: 365567 - RNA, 64 nt, Homo Sapiens
gacaugaggaaaccuagcacauaauuauaauuauuauuauuauuuuuuuuuaauuauuguuauu

SEQ ID NO: 365568 - RNA, 64 nt, Homo Sapiens
auugacaugaggaaaccuagauuauaauuauaauuauuauuauugauuuuuuuuaauuauuguu

SEQ ID NO: 365569 - RNA, 64 nt, Homo Sapiens
gacagagguugcugaacuuuaaaaaaaauuaauuuauuauuauaaugaccuaauuuauuaaucu

SEQ ID NO: 365570 - RNA, 64 nt, Homo Sapiens
acuaacaggauauaggacaagguguaaauuuuuuuauuauuauuuuaaagauaugauuuauccu

SEQ ID NO: 365571 - RNA, 64 nt, Homo Sapiens
acugguguuuuucccccgcauuugguggauuuuuuauuauuauucaaaaacauaacugaguuuu

SEQ ID NO: 365572 - RNA, 64 nt, Homo Sapiens
uccccucacauucucuauguacuauguauguauguauuauuauuauugcugccaagagggucug

SEQ ID NO: 365573 - RNA, 64 nt, Homo Sapiens
ccucacauucucuauguacuauguauguauguauuauuauuauugcugccaagagggucugaug

SEQ ID NO: 365574 - RNA, 64 nt, Homo Sapiens
gccuacagcugccuccuagaauauagacugucuguauuauuauucaccuauaauuagucauuau

SEQ ID NO: 365575 - RNA, 64 nt, Homo Sapiens
aucugguuaccaaacauaaaugcugaacauuccauauuauuauaguuaaugucuuaauccagcu

SEQ ID NO: 365576 - RNA, 64 nt, Homo Sapiens
gcacaaaacaaaugcucaguggauggaagcugccuauuauuauugucguuguuguuguuugcca

SEQ ID NO: 365577 - RNA, 64 nt, Homo Sapiens
uucuacugggaauuagaauggugcauacacaauguauuauuaucacugucagaugagcaugcuu

SEQ ID NO: 365578 - RNA, 64 nt, Homo Sapiens
cauuuuacccuaggguauaaaacuauuuuucuuuuauuauuauuauuauuauuauuauacuuua

SEQ ID NO: 365579 - RNA, 64 nt, Homo Sapiens
uuuacccuaggguauaaaacuauuuuucuuuuauuauuauuauuauuauuauuauacuuuaagu

SEQ ID NO: 365580 - RNA, 64 nt, Homo Sapiens
acccuaggguauaaaacuauuuuucuuuuauuauuauuauuauuauuauuauacuuuaaguuuu

SEQ ID NO: 365581 - RNA, 64 nt, Homo Sapiens
cuaggguauaaaacuauuuuucuuuuauuauuauuauuauuauuauuauacuuuaaguuuuagg

SEQ ID NO: 365582 - RNA, 64 nt, Homo Sapiens
ggguauaaaacuauuuuucuuuuauuauuauuauuauuauuauuauacuuuaaguuuuagggua

SEQ ID NO: 365583 - RNA, 64 nt, Homo Sapiens
uauaaaacuauuuuucuuuuauuauuauuauuauuauuauuauacuuuaaguuuuaggguacau

SEQ ID NO: 365584 - RNA, 64 nt, Homo Sapiens
cagugcaggaucuaaugacuguacauauuauuguuauuauuauuauuguuauuauuguuguucu

SEQ ID NO: 365585 - RNA, 64 nt, Homo Sapiens
ugcaggaucuaaugacuguacauauuauuguuauuauuauuauuguuauuauuguuguucugua

SEQ ID NO: 365586 - RNA, 64 nt, Homo Sapiens
aagccuugauagaauuuguucauaauggcucauguauuauuauuauuuuugagauggaguuuug

SEQ ID NO: 365587 - RNA, 64 nt, Homo Sapiens
ccuugauagaauuuguucauaauggcucauguauuauuauuauuuuugagauggaguuuugcuc

SEQ ID NO: 365588 - RNA, 64 nt, Homo Sapiens
uauuauuuuugagauggaguuuugcucuuaaugauauuauuauuauuugagacagaguuuugcu

SEQ ID NO: 365589 - RNA, 64 nt, Homo Sapiens
uauuuuugagauggaguuuugcucuuaaugauauuauuauuauuugagacagaguuuugcucuu

SEQ ID NO: 365590 - RNA, 64 nt, Homo Sapiens
uucauguuaaauguguuuguauacacaugucauuuauuauuauuacuuuaagauagguauuauu

SEQ ID NO: 365591 - RNA, 64 nt, Homo Sapiens
auguuaaauguguuuguauacacaugucauuuauuauuauuacuuuaagauagguauuauucau

SEQ ID NO: 365592 - RNA, 64 nt, Homo Sapiens
uuggggucacaguucuauuuuguuugugaguuuguauuauuauuauuauuauuauuauuauuau

SEQ ID NO: 365593 - RNA, 64 nt, Homo Sapiens
gggucacaguucuauuuuguuugugaguuuguauuauuauuauuauuauuauuauuauuauauu

SEQ ID NO: 365594 - RNA, 64 nt, Homo Sapiens
ucacaguucuauuuuguuugugaguuuguauuauuauuauuauuauuauuauuauuauauuuua

SEQ ID NO: 365595 - RNA, 64 nt, Homo Sapiens
caguucuauuuuguuugugaguuuguauuauuauuauuauuauuauuauuauuauauuuuauuu

SEQ ID NO: 365596 - RNA, 64 nt, Homo Sapiens
uucuauuuuguuugugaguuuguauuauuauuauuauuauuauuauuauuauauuuuauuucuu

SEQ ID NO: 365597 - RNA, 64 nt, Homo Sapiens
uauuuuguuugugaguuuguauuauuauuauuauuauuauuauuauuauauuuuauuucuuugg

SEQ ID NO: 365598 - RNA, 64 nt, Homo Sapiens
uuuguuugugaguuuguauuauuauuauuauuauuauuauuauuauauuuuauuucuuuggucu

SEQ ID NO: 365599 - RNA, 64 nt, Homo Sapiens
guuugugaguuuguauuauuauuauuauuauuauuauuauuauauuuuauuucuuuggucugug

SEQ ID NO: 365600 - RNA, 64 nt, Homo Sapiens
uucugagagcuccuuuuuugccaagauuccauacuauuauuauauuagagaggcgugucaaggc

SEQ ID NO: 365601 - RNA, 64 nt, Homo Sapiens
gucucauauuucguggaacuccugugcaaacauauauuauuaaauuuuuuuuccuccugucaau

SEQ ID NO: 365602 - RNA, 64 nt, Homo Sapiens
auuuuccaagguuagauuccaauaaauaucuauuuauuauuaaauauuaaaauaucuauuuauu

SEQ ID NO: 365603 - RNA, 64 nt, Homo Sapiens
uaucuauuuauuauuaaauauuaaaauaucuauuuauuauuaaaaccauuuauaaggcuuuuuc

SEQ ID NO: 365604 - RNA, 64 nt, Homo Sapiens
auacaauguuuauacgucuagaagugacaaagaguauuauuaaaauaauggaaugauuuaaauu

SEQ ID NO: 365605 - RNA, 64 nt, Homo Sapiens
aaaugaagaaauauguauuuuuuuaaaggggaaguauuauuauaugugacaaaccauggcaaau

SEQ ID NO: 365606 - RNA, 64 nt, Homo Sapiens
guuauuccuuuuuaauuuaaaucaguauuuuuauuauuauuauuaggugcccgcacuaccauac

SEQ ID NO: 365607 - RNA, 64 nt, Homo Sapiens
auuguuauuccuuuuuaauuuacaucaguauuuuuauuauuauuaaaaggugcccgcacuacca

SEQ ID NO: 365608 - RNA, 64 nt, Homo Sapiens
cuuuaaguuuuaggguacauuuucuuguuuuuauuauuauuauacucuauuacauaucucuuuu

SEQ ID NO: 365609 - RNA, 64 nt, Homo Sapiens
auacuuuaaguuuuaggguauuuuuucuuguuuuuauuauuauucuucucuauuacauaucucu

SEQ ID NO: 365610 - RNA, 64 nt, Homo Sapiens
uuuguacuuuggcaagaaucaacugcuguauauauauuauuauaucugugccaggcaacaugcu

SEQ ID NO: 365611 - RNA, 64 nt, Homo Sapiens
auaaacaguuaaugguugaaaagcuuauuuucauuauuauuauauaguauccuuuuagauacaa

SEQ ID NO: 365612 - RNA, 64 nt, Homo Sapiens
aaaugaaucugagcugauggugacuuuaaguuaauauuauuaauauaucacugcauauuuuuac

SEQ ID NO: 365613 - RNA, 64 nt, Homo Sapiens
ugaaaagggagaauaaugugaauaucacggcuuauauuauuaaauguugauugauggcuuguaa

SEQ ID NO: 365614 - RNA, 64 nt, Homo Sapiens
aguugaaacaaaaaaaacccccagacuguaauaguauuauuauuauuuuuuaagauggaaucuu

SEQ ID NO: 365615 - RNA, 64 nt, Homo Sapiens
ugaaacaaaaaaaacccccagacuguaauaguauuauuauuauuuuuuaagauggaaucuugcu

SEQ ID NO: 365616 - RNA, 64 nt, Homo Sapiens
ugaaggucuuuguuaugacagugaauauugcuuuuauuauuauuauugcugaagugguugcauu

SEQ ID NO: 365617 - RNA, 64 nt, Homo Sapiens
aggucuuuguuaugacagugaauauugcuuuuauuauuauuauugcugaagugguugcauucua

SEQ ID NO: 365618 - RNA, 64 nt, Homo Sapiens
auugggcaagcauugguaauaaauggaauaagacuauuauuauuauuauuugagauggagucuc

SEQ ID NO: 365619 - RNA, 64 nt, Homo Sapiens
gggcaagcauugguaauaaauggaauaagacuauuauuauuauuauuugagauggagucucacu

SEQ ID NO: 365620 - RNA, 64 nt, Homo Sapiens
caagcauugguaauaaauggaauaagacuauuauuauuauuauuugagauggagucucacucug

SEQ ID NO: 365621 - RNA, 64 nt, Homo Sapiens
auuuuccccaauggcuuuuugacaaguauaaagcuauuauuacauuguauuuuuuaaauguaaa

SEQ ID NO: 365622 - RNA, 64 nt, Homo Sapiens
uauauugacauugccauugaauagcucuagcaacuauuauuauucccccaaacccuaaaauucu

SEQ ID NO: 365623 - RNA, 64 nt, Homo Sapiens
auugagggauagauuguaucucuuaaaguggucauauuauuauuaauuuugccaaaagaagaag

SEQ ID NO: 365624 - RNA, 64 nt, Homo Sapiens
gagggauagauuguaucucuuaaaguggucauauuauuauuaauuuugccaaaagaagaagaau

SEQ ID NO: 365625 - RNA, 64 nt, Homo Sapiens
uuggggucucuuuuguaaauagauaguuuauuauuauuauuauuugacccuacucccuugcccu

SEQ ID NO: 365626 - RNA, 64 nt, Homo Sapiens
auuuuggggucucuuuuguaccuagauaguuuauuauuauuauuaccugacccuacucccuugc

SEQ ID NO: 365627 - RNA, 64 nt, Homo Sapiens
auuauuuuggggucucuuuuugcccuagauaguuuauuauuauuaggaccugacccuacucccu

SEQ ID NO: 365628 - RNA, 64 nt, Homo Sapiens
ggguuuuuuuggacaggguuuuuauuauuguuauuauuauuauuuaugguuucuaauaggauuu

SEQ ID NO: 365629 - RNA, 64 nt, Homo Sapiens
auuggguuuuuuuggacagguuuuuuauuauuguuauuauuauuccuuaugguuucuaauagga

SEQ ID NO: 365630 - RNA, 64 nt, Homo Sapiens
cuguuagcucauuaucauuaaguuucuuauuccuuauuauuaauauaacuuaucugcuauuauu

SEQ ID NO: 365631 - RNA, 64 nt, Homo Sapiens
uucuuauuccuuauuauuaacauaacuuaucugcuauuauuaguuuggccuuuuauuuucuuuc

SEQ ID NO: 365632 - RNA, 64 nt, Homo Sapiens
aaaaaugugugaauaucaguuucuaacauauuauuauuauuauacuaaaugccacacuguaugu

SEQ ID NO: 365633 - RNA, 64 nt, Homo Sapiens
auaaaaaaugugugaauaucuguuucuaacauauuauuauuauuauacuaaaugccacacugua

SEQ ID NO: 365634 - RNA, 64 nt, Homo Sapiens
auuauaaaaaaugugugaauguauguuucuaacauauuauuauuuauauacuaaaugccacacu

SEQ ID NO: 365635 - RNA, 64 nt, Homo Sapiens
gaauauuauucucgcauguaucauagggccaggguauuauuauauccuaauauaaaguacuggc

SEQ ID NO: 365636 - RNA, 64 nt, Homo Sapiens
uccuaauauaaaguacuggccuauaucaucauuuuauuauuaugguaggucucucugguucuuu

SEQ ID NO: 365637 - RNA, 64 nt, Homo Sapiens
uuuuuuuuuuugagacggagauuauuauuauuauuauuauuauuuaauccaguuccuaaagauu

SEQ ID NO: 365638 - RNA, 64 nt, Homo Sapiens
auuuuuuuuuuuuugagacgauuauuauuauuauuauuauuauuacuuaauccaguuccuaaag

SEQ ID NO: 365639 - RNA, 64 nt, Homo Sapiens
auuauuuuuuuuuuuuugagaagauuauuauuauuauuauuauucacacuuaauccaguuccua

SEQ ID NO: 365640 - RNA, 64 nt, Homo Sapiens
auuauuauuuuuuuuuuuuucuaaagauuauuauuauuauuauucuccacacuuaauccaguuc

SEQ ID NO: 365641 - RNA, 64 nt, Homo Sapiens
auuauuauuauuuuuuuuuuuuccuaaagauuauuauuauuauucuucuccacacuuaauccag

SEQ ID NO: 365642 - RNA, 64 nt, Homo Sapiens
auuauuauuauuauuuuuuucaguuccuaaagauuauuauuauuucucuucuccacacuuaauc

SEQ ID NO: 365643 - RNA, 64 nt, Homo Sapiens
uuauuucuuuauuaacccucugaguuuuuguauguauuauuauuaaagaaaaaugcaaucagga

SEQ ID NO: 365644 - RNA, 64 nt, Homo Sapiens
uuucuuuauuaacccucugaguuuuuguauguauuauuauuaaagaaaaaugcaaucaggauuu

SEQ ID NO: 365645 - RNA, 64 nt, Homo Sapiens
ccccccaaauaccuuuuuaaccccucugauuggcuauuauuacuauauuuauuauuauuuauug

SEQ ID NO: 365646 - RNA, 64 nt, Homo Sapiens
uuuaaccccucugauuggcuauuauuacuauauuuauuauuauuuauugaaaccuuagggaaga

SEQ ID NO: 365647 - RNA, 64 nt, Homo Sapiens
gguuguuguuauuuuuauuguauuauuguuauuuuauuauuauuauuguuauaauuuuauuuug

SEQ ID NO: 365648 - RNA, 64 nt, Homo Sapiens
uguuguuauuuuuauuguauuauuguuauuuuauuauuauuauuguuauaauuuuauuuuguug

SEQ ID NO: 365649 - RNA, 64 nt, Homo Sapiens
aagucagaaaaaaaaaacaagagagagaaauucauauuauuauuauuauuauaauacaauauuu

SEQ ID NO: 365650 - RNA, 64 nt, Homo Sapiens
ucagaaaaaaaaaacaagagagagaaauucauauuauuauuauuauuauaauacaauauuuuuu

SEQ ID NO: 365651 - RNA, 64 nt, Homo Sapiens
gaaaaaaaaaacaagagagagaaauucauauuauuauuauuauuauaauacaauauuuuuuuua

SEQ ID NO: 365652 - RNA, 64 nt, Homo Sapiens
aaaaaaaacaagagagagaaauucauauuauuauuauuauuauaauacaauauuuuuuuuaaaa

SEQ ID NO: 365653 - RNA, 64 nt, Homo Sapiens
uugauaaaauauggaacaaaguuggauauaacauuauuauuauucacuugguuauaacucuuua

SEQ ID NO: 365654 - RNA, 64 nt, Homo Sapiens
uguuauauauuacguguuauuaaaggccuucauauauuauuacgcuuugaaauauuaauuuaca

SEQ ID NO: 365655 - RNA, 64 nt, Homo Sapiens
guugggacaggugccauuuaaaauuuauuauuauuauuauuauucauuugcaucaugguuuuua

SEQ ID NO: 365656 - RNA, 64 nt, Homo Sapiens
auuguugggacaggugccauuuaaaauuuauuauuauuauuauuugccauuugcaucaugguuu

SEQ ID NO: 365657 - RNA, 64 nt, Homo Sapiens
auuauuguugggacaggugcuuuuuaaaauuuauuauuauuauuaucugccauuugcaucaugg

SEQ ID NO: 365658 - RNA, 64 nt, Homo Sapiens
auuauuauuguugggacaggugguuuuuaaaauuuauuauuauuuuuaucugccauuugcauca

SEQ ID NO: 365659 - RNA, 64 nt, Homo Sapiens
uuauccuggaacaugcaaaagcaucaacauguauuauuauuacuaauuuuaauggcugaaauuu

SEQ ID NO: 365660 - RNA, 64 nt, Homo Sapiens
acuuuauccuggaacaugcauuugcaucaacauguauuauuauuuuuaauuuuaauggcugaaa

SEQ ID NO: 365661 - RNA, 64 nt, Homo Sapiens
cuuugcuguuugaggagccaccucuaccaugccuuauuauuaccgucacugaaaaaugggaaaa

SEQ ID NO: 365662 - RNA, 64 nt, Homo Sapiens
uuuucaugagaauucuaaaaauuaacugaaauacuauuauuaaaucuuuuucucaaaugccaua

SEQ ID NO: 365663 - RNA, 64 nt, Homo Sapiens
uauuugauugccuccucuucccuuucaguauauguauuauuaauauuauuauuauuauuauuau

SEQ ID NO: 365664 - RNA, 64 nt, Homo Sapiens
gccuccucuucccuuucaguauauguauuauuaauauuauuauuauuauuauuauuauuaguuc

SEQ ID NO: 365665 - RNA, 64 nt, Homo Sapiens
uccucuucccuuucaguauauguauuauuaauauuauuauuauuauuauuauuauuaguucauc

SEQ ID NO: 365666 - RNA, 64 nt, Homo Sapiens
ucuucccuuucaguauauguauuauuaauauuauuauuauuauuauuauuauuaguucaucagu

SEQ ID NO: 365667 - RNA, 64 nt, Homo Sapiens
ucccuuucaguauauguauuauuaauauuauuauuauuauuauuauuauuaguucaucaguuug

SEQ ID NO: 365668 - RNA, 64 nt, Homo Sapiens
cuuucaguauauguauuauuaauauuauuauuauuauuauuauuauuaguucaucaguuugcug

SEQ ID NO: 365669 - RNA, 64 nt, Homo Sapiens
ucaguauauguauuauuaauauuauuauuauuauuauuauuauuaguucaucaguuugcuguuc

SEQ ID NO: 365670 - RNA, 64 nt, Homo Sapiens
guauauguauuauuaauauuauuauuauuauuauuauuauuaguucaucaguuugcuguucucu

SEQ ID NO: 365671 - RNA, 64 nt, Homo Sapiens
gagagaaugagaugaaaaacgauuaauguuucauuauuauuauugugaaaauauuauuaacacu

SEQ ID NO: 365672 - RNA, 64 nt, Homo Sapiens
aacgauuaauguuucauuauuauuauugugaaaauauuauuaacacuggggacuccuuaagagu

SEQ ID NO: 365673 - RNA, 64 nt, Homo Sapiens
ccacugcaucugcaaauuuaguuuuggguuuuuuuauuauuauuauuuugaguuuuuuugugug

SEQ ID NO: 365674 - RNA, 64 nt, Homo Sapiens
cugcaucugcaaauuuaguuuuggguuuuuuuauuauuauuauuuugaguuuuuuugugugugu

SEQ ID NO: 365675 - RNA, 64 nt, Homo Sapiens
uuucuaaaagacuuuucaguauuacaacuaauacuauuauuauccuucuuuuuuuauuuagaua

SEQ ID NO: 365676 - RNA, 64 nt, Homo Sapiens
auaggcacccaccaccacgcccagcuaauuuuuguauuauuaguagagacaggguuucaccaug

SEQ ID NO: 365677 - RNA, 64 nt, Homo Sapiens
uuuuuuuguuggcaaaagaauuuuuuaauuuuauuauuauuaauaaaacggcaaacccacccca

SEQ ID NO: 365678 - RNA, 64 nt, Homo Sapiens
aauuuuuuuuguuggcaaaaccauuuuuuaauuuuauuauuauuaagaaaacggcaaacccacc

SEQ ID NO: 365679 - RNA, 64 nt, Homo Sapiens
uacaauguaauagaagcuuauuaacuuaguauauuauuauuaauugcuagacaguuaaacuggc

SEQ ID NO: 365680 - RNA, 64 nt, Homo Sapiens
aauuacaauguaauagaagcggcuuaacuuaguauauuauuauuuuuugcuagacaguuaaacu

SEQ ID NO: 365681 - RNA, 64 nt, Homo Sapiens
uaaacaacuuggagggaguucauuucuuuuuuauuauuauuaaaaguucagguuuaugugugug

SEQ ID NO: 365682 - RNA, 64 nt, Homo Sapiens
aaauaaacaacuuggagggagugcauuucuuuuuuauuauuauugggaguucagguuuaugugu

SEQ ID NO: 365683 - RNA, 64 nt, Homo Sapiens
guggauacuggcccuugguggcuguugucacuguuauuauuauuuagcauuguauauuauuauu

SEQ ID NO: 365684 - RNA, 64 nt, Homo Sapiens
gcuguugucacuguuauuaucuuauagcauuguauauuauuauuauagaauagauuuuaauaau

SEQ ID NO: 365685 - RNA, 64 nt, Homo Sapiens
cuuaacuaaaauuacauauugugcacaaaaauauuauuauuaguuuacacuaaccauuuuuaaa

SEQ ID NO: 365686 - RNA, 64 nt, Homo Sapiens
agucuuaacuaaaauuacauaaagugcacaaaaauauuauuauuagauuacacuaaccauuuuu

SEQ ID NO: 365687 - RNA, 64 nt, Homo Sapiens
aaaaaaauuucuggagugagauuauuauuaauguuauuauuagacugcugccagaauuauauua

SEQ ID NO: 365688 - RNA, 64 nt, Homo Sapiens
guuauuauuagaaaaaaaauagaauuauauuaauuauuauuaaucauagauuugugcugcugcc

SEQ ID NO: 365689 - RNA, 64 nt, Homo Sapiens
uauuucuacuuaaugaaucauuuuauauauuuauuauuauuaaacuauuuuauaugaauauacu

SEQ ID NO: 365690 - RNA, 64 nt, Homo Sapiens
aaauauuucuacuuaaugaaacuuuuuauauauuuauuauuauuuuucuauuuuauaugaauau

SEQ ID NO: 365691 - RNA, 64 nt, Homo Sapiens
ccuaaauauuuuaucaucuuuaaauuuguuucuguauuauuauaugugcuccugaagcgagcac

SEQ ID NO: 365692 - RNA, 64 nt, Homo Sapiens
aauauuuauuaaauauauuuauuuauuuaaauguuauuauuacuuuaaauauuauuuuaaauau

SEQ ID NO: 365693 - RNA, 64 nt, Homo Sapiens
cauccuaaaucuuuuaccuuucaaucuuuguaucuauuauuacacgugcugcugaagggagcau

SEQ ID NO: 365694 - RNA, 64 nt, Homo Sapiens
cccuuuccauucaguuuauuuugcagcagguuuuuauuauuauuauuauuauuauuauucacaa

SEQ ID NO: 365695 - RNA, 64 nt, Homo Sapiens
uuuccauucaguuuauuuugcagcagguuuuuauuauuauuauuauuauuauuauucacaacag

SEQ ID NO: 365696 - RNA, 64 nt, Homo Sapiens
ccauucaguuuauuuugcagcagguuuuuauuauuauuauuauuauuauuauucacaacagaca

SEQ ID NO: 365697 - RNA, 64 nt, Homo Sapiens
uucaguuuauuuugcagcagguuuuuauuauuauuauuauuauuauuauucacaacagacacuu

SEQ ID NO: 365698 - RNA, 64 nt, Homo Sapiens
aguuuauuuugcagcagguuuuuauuauuauuauuauuauuauuauucacaacagacacuuucc

SEQ ID NO: 365699 - RNA, 64 nt, Homo Sapiens
uuauuuugcagcagguuuuuauuauuauuauuauuauuauuauucacaacagacacuuucccua

SEQ ID NO: 365700 - RNA, 64 nt, Homo Sapiens
uuuugagacagagucuugcuuuuauuuaauuuauuauuauuauugaauuuuuuucucucuguac

SEQ ID NO: 365701 - RNA, 64 nt, Homo Sapiens
auuuuuugagacagagucuuuacuuuauuuaauuuauuauuauugaugaauuuuuuucucucug

SEQ ID NO: 365702 - RNA, 64 nt, Homo Sapiens
uugaacaaacuacaucuuaggaauauauuguugcuauuauuauuagacauaagcauacauaauu

SEQ ID NO: 365703 - RNA, 64 nt, Homo Sapiens
uguuuauuuauuuauuuuuaauuuuuuaauuuuauauuauuauuauuauuauuauacuuuaagg

SEQ ID NO: 365704 - RNA, 64 nt, Homo Sapiens
uuauuuauuuauuuuuaauuuuuuaauuuuauauuauuauuauuauuauuauacuuuaagguuu

SEQ ID NO: 365705 - RNA, 64 nt, Homo Sapiens
uuuauuuauuuuuaauuuuuuaauuuuauauuauuauuauuauuauuauacuuuaagguuuagg

SEQ ID NO: 365706 - RNA, 64 nt, Homo Sapiens
auuuauuuuuaauuuuuuaauuuuauauuauuauuauuauuauuauacuuuaagguuuagggua

SEQ ID NO: 365707 - RNA, 64 nt, Homo Sapiens
uauuuuuaauuuuuuaauuuuauauuauuauuauuauuauuauacuuuaagguuuaggguacau

SEQ ID NO: 365708 - RNA, 64 nt, Homo Sapiens
cagcagccuaaaucuccuccuuggauaauguuaauauuauuauuauuauuaacaaaaaauauau

SEQ ID NO: 365709 - RNA, 64 nt, Homo Sapiens
cagccuaaaucuccuccuuggauaauguuaauauuauuauuauuauuaacaaaaaauauauauu

SEQ ID NO: 365710 - RNA, 64 nt, Homo Sapiens
ccuaaaucuccuccuuggauaauguuaauauuauuauuauuauuaacaaaaaauauauauuuuu

SEQ ID NO: 365711 - RNA, 64 nt, Homo Sapiens
aaaucuccuccuuggauaauguuaauauuauuauuauuauuaacaaaaaauauauauuuuuaaa

SEQ ID NO: 365712 - RNA, 64 nt, Homo Sapiens
aaagugaggcaggaaaaugcaauauuauuauuauuauuauuaauuuaaacuuauuauuauuguu

SEQ ID NO: 365713 - RNA, 64 nt, Homo Sapiens
aauaaagugaggcaggaaaaguuaauauuauuauuauuauuauuuccuuaaacuuauuauuauu

SEQ ID NO: 365714 - RNA, 64 nt, Homo Sapiens
auuaauaaagugaggcaggaauuguuaauauuauuauuauuauuagcuccuuaaacuuauuauu

SEQ ID NO: 365715 - RNA, 64 nt, Homo Sapiens
auuauuaauaaagugaggcaauuauuguuaauauuauuauuauuccaagcuccuuaaacuuauu

SEQ ID NO: 365716 - RNA, 64 nt, Homo Sapiens
auuauuauuaauaaagugagauuauuauuguuaauauuauuauuaacccaagcuccuuaaacuu

SEQ ID NO: 365717 - RNA, 64 nt, Homo Sapiens
guuaauauuauuauuauuauaagcuccuuaaacuuauuauuauuggggacauggagaacaaccc

SEQ ID NO: 365718 - RNA, 64 nt, Homo Sapiens
cgcauuuuucuccuuaauaagcaaucgaaugcuauauuauuaaaacaccuuuccuggaugauau

SEQ ID NO: 365719 - RNA, 64 nt, Homo Sapiens
aaauuuuaagucugucuaauaccauuuucuuaaauauuauuacauuucauuuuuucauaauguu

SEQ ID NO: 365720 - RNA, 64 nt, Homo Sapiens
ucauaugcugaugcuuuguguuguuguuaauuauuauuauuauugauuauuauuaauauuauug

SEQ ID NO: 365721 - RNA, 64 nt, Homo Sapiens
auuucauaugcugaugcuuuuuguuguuguuaauuauuauuauuucagauuauuauuaauauua

SEQ ID NO: 365722 - RNA, 64 nt, Homo Sapiens
auuauuguuguuguuaauuaccggucggucagauuauuauuaauauuaaauccaacagacgcug

SEQ ID NO: 365723 - RNA, 64 nt, Homo Sapiens
uggguucugaugcuuuuuccuucuccuuuccuuuuauuauuauuauuuuuuucuuuuaagaacu

SEQ ID NO: 365724 - RNA, 64 nt, Homo Sapiens
guucugaugcuuuuuccuucuccuuuccuuuuauuauuauuauuuuuuucuuuuaagaacuaag

SEQ ID NO: 365725 - RNA, 64 nt, Homo Sapiens
ucaagcuguucucucucucucuuuuuuuuaauuuuauuauuauuauuuuggcaacauguacauu

SEQ ID NO: 365726 - RNA, 64 nt, Homo Sapiens
agcuguucucucucucucuuuuuuuuaauuuuauuauuauuauuuuggcaacauguacauuucu

SEQ ID NO: 365727 - RNA, 64 nt, Homo Sapiens
uuugggucuguuuuuucaugcuuugcuuuuuaauuauuauuauuauuuuuuuuacauuaggaca

SEQ ID NO: 365728 - RNA, 64 nt, Homo Sapiens
gggucuguuuuuucaugcuuugcuuuuuaauuauuauuauuauuuuuuuuacauuaggacauuu

SEQ ID NO: 365729 - RNA, 64 nt, Homo Sapiens
cuuaggaauaguucaauguauuuucauauuguauuauuauuauuggguauucagauucuggggu

SEQ ID NO: 365730 - RNA, 64 nt, Homo Sapiens
auucuuaggaauaguucaaugguuuuucauauuguauuauuauuccaggguauucagauucugg

SEQ ID NO: 365731 - RNA, 64 nt, Homo Sapiens
guuuuuuaguagagacgggggcuaauuuuuguauuauuauuauuggcucaugccaccaugccca

SEQ ID NO: 365732 - RNA, 64 nt, Homo Sapiens
auuguuuuuuaguagagacgccagcuaauuuuuguauuauuauuacaggcucaugccaccaugc

SEQ ID NO: 365733 - RNA, 64 nt, Homo Sapiens
auuuaaaucacuugaguauuuugucaugguucauuauuauuaaagcacaaaauaaccuauuguu

SEQ ID NO: 365734 - RNA, 64 nt, Homo Sapiens
aaacagccauaucaugaaaaauucuacuuagcuauauuauuauaagcuacauuugcccugaauu

SEQ ID NO: 365735 - RNA, 64 nt, Homo Sapiens
uuuaaaaaucuuuuguuuuacuuaauucuguuuuuauuauuauuauuauuuuguuugaucuauu

SEQ ID NO: 365736 - RNA, 64 nt, Homo Sapiens
aaaaaucuuuuguuuuacuuaauucuguuuuuauuauuauuauuauuuuguuugaucuauuaag

SEQ ID NO: 365737 - RNA, 64 nt, Homo Sapiens
aaucuuuuguuuuacuuaauucuguuuuuauuauuauuauuauuuuguuugaucuauuaaggaa

SEQ ID NO: 365738 - RNA, 64 nt, Homo Sapiens
ccccgaauugaacacuuuuaaaccuaaagagccuuauuauuauuagcucgagaaauaccacaug

SEQ ID NO: 365739 - RNA, 64 nt, Homo Sapiens
cgaauugaacacuuuuaaaccuaaagagccuuauuauuauuagcucgagaaauaccacaugcca

SEQ ID NO: 365740 - RNA, 64 nt, Homo Sapiens
gaaaguugaggccuaaauaaagucuuuuuauaauuauuauuauaacaaugugacauugcacauc

SEQ ID NO: 365741 - RNA, 64 nt, Homo Sapiens
auuacuaguuuuaauuagcucugcccucaugaaguauuauuauaauucaccauaaacagcuauc

SEQ ID NO: 365742 - RNA, 64 nt, Homo Sapiens
auaaacaggguugguuauaucugacaguguuuauuauuauuaaauuaucaugguuuuuaaaaga

SEQ ID NO: 365743 - RNA, 64 nt, Homo Sapiens
aaaauaaacaggguugguuaagacugacaguguuuauuauuauuuuguuaucaugguuuuuaaa

SEQ ID NO: 365744 - RNA, 64 nt, Homo Sapiens
accauaauacucuauucaggugcuauuaaaaugguauuauuaauuaugcugcaauagcuuuugc

SEQ ID NO: 365745 - RNA, 64 nt, Homo Sapiens
uacagucauauuacugaacucuuuuuauuauuauuauuauuauuuuuuuaaagaagaauugggu

SEQ ID NO: 365746 - RNA, 64 nt, Homo Sapiens
auuuacagucauauuacugaggucuuuuuauuauuauuauuauucgauuuuuaaagaagaauug

SEQ ID NO: 365747 - RNA, 64 nt, Homo Sapiens
auuauuuacagucauauuacuugggucuuuuuauuauuauuauuucucgauuuuuaaagaagaa

SEQ ID NO: 365748 - RNA, 64 nt, Homo Sapiens
auuauuauuuacagucauaugaauugggucuuuuuauuauuauucguucucgauuuuuaaagaa

SEQ ID NO: 365749 - RNA, 64 nt, Homo Sapiens
ugggcuagagaaaucagcugcuaugcggguugauuauuauuauuauuucuaauccuuuuccuua

SEQ ID NO: 365750 - RNA, 64 nt, Homo Sapiens
gcuagagaaaucagcugcuaugcggguugauuauuauuauuauuucuaauccuuuuccuuauuu

SEQ ID NO: 365751 - RNA, 64 nt, Homo Sapiens
caguauccaacuucgauacugauagacuuguugauauuauuauuauauguaauccaauuaugaa

SEQ ID NO: 365752 - RNA, 64 nt, Homo Sapiens
uauccaacuucgauacugauagacuuguugauauuauuauuauauguaauccaauuaugaacug

SEQ ID NO: 365753 - RNA, 64 nt, Homo Sapiens
uauucuuugcguguagcuauggaaguugcauaauuauuauuauuauuauuauaacaaguguguc

SEQ ID NO: 365754 - RNA, 64 nt, Homo Sapiens
ucuuugcguguagcuauggaaguugcauaauuauuauuauuauuauuauaacaagugugucuua

SEQ ID NO: 365755 - RNA, 64 nt, Homo Sapiens
uugcguguagcuauggaaguugcauaauuauuauuauuauuauuauaacaagugugucuuacgu

SEQ ID NO: 365756 - RNA, 64 nt, Homo Sapiens
cguguagcuauggaaguugcauaauuauuauuauuauuauuauaacaagugugucuuacgugcc

SEQ ID NO: 365757 - RNA, 64 nt, Homo Sapiens
uaccuuuaccuaaguugcuccuuuauuuuuauuuuauuauuauuauuauuauuauuauuauuuu

SEQ ID NO: 365758 - RNA, 64 nt, Homo Sapiens
cuuuaccuaaguugcuccuuuauuuuuauuuuauuauuauuauuauuauuauuauuauuuuuug

SEQ ID NO: 365759 - RNA, 64 nt, Homo Sapiens
uaccuaaguugcuccuuuauuuuuauuuuauuauuauuauuauuauuauuauuauuuuuugaga

SEQ ID NO: 365760 - RNA, 64 nt, Homo Sapiens
cuaaguugcuccuuuauuuuuauuuuauuauuauuauuauuauuauuauuauuuuuugagaugg

SEQ ID NO: 365761 - RNA, 64 nt, Homo Sapiens
aguugcuccuuuauuuuuauuuuauuauuauuauuauuauuauuauuauuuuuugagauggagu

SEQ ID NO: 365762 - RNA, 64 nt, Homo Sapiens
ugcuccuuuauuuuuauuuuauuauuauuauuauuauuauuauuauuuuuugagauggagucuc

SEQ ID NO: 365763 - RNA, 64 nt, Homo Sapiens
uccuuuauuuuuauuuuauuauuauuauuauuauuauuauuauuuuuugagauggagucucacu

SEQ ID NO: 365764 - RNA, 64 nt, Homo Sapiens
uuuauguuuugcaacuuagaacuggcuauguuauuauuauuaaagaaaagcuugucacaaucua

SEQ ID NO: 365765 - RNA, 64 nt, Homo Sapiens
aaauuuauguuuugcaacuucuaacuggcuauguuauuauuauuaaggaaaagcuugucacaau

SEQ ID NO: 365766 - RNA, 64 nt, Homo Sapiens
aauuuccuuauuauauaaaccuauauaaaagucauauuauuauacacacauacccuauacccca

SEQ ID NO: 365767 - RNA, 64 nt, Homo Sapiens
acuaauagcucuugaauucuucuguucaaauuuguauuauuacaccauauuuuccuauuauuua

SEQ ID NO: 365768 - RNA, 64 nt, Homo Sapiens
aaucuuggguggguaguaggguuauuauuauuguuauuauuaacauuaucgcaguauuauuguu

SEQ ID NO: 365769 - RNA, 64 nt, Homo Sapiens
guuauuauuaacaaucuuggaguauuauuguuguuauuauuauuugaaguauuaauauuaucgc

SEQ ID NO: 365770 - RNA, 64 nt, Homo Sapiens
ugcaaugagagagaugguugguuauuuuuauuauuauuauuauuccaggccuggacugaaggca

SEQ ID NO: 365771 - RNA, 64 nt, Homo Sapiens
auuugcaaugagagagaugggcaguuauuuuuauuauuauuauuucaccaggccuggacugaag

SEQ ID NO: 365772 - RNA, 64 nt, Homo Sapiens
auuauuugcaaugagagagaaaggcaguuauuuuuauuauuauucagucaccaggccuggacug

SEQ ID NO: 365773 - RNA, 64 nt, Homo Sapiens
uucucucuuccuuccuguuuuuuccuaguucuuuuauuauuauucuuauauuauuauuauuauu

SEQ ID NO: 365774 - RNA, 64 nt, Homo Sapiens
cuguuuuuuccuaguucuuuuauuauuauucuuauauuauuauuauuauuauugguuauauacu

SEQ ID NO: 365775 - RNA, 64 nt, Homo Sapiens
uuuuuuccuaguucuuuuauuauuauucuuauauuauuauuauuauuauugguuauauacuguc

SEQ ID NO: 365776 - RNA, 64 nt, Homo Sapiens
uuuccuaguucuuuuauuauuauucuuauauuauuauuauuauuauugguuauauacuguccau

SEQ ID NO: 365777 - RNA, 64 nt, Homo Sapiens
ccuaguucuuuuauuauuauucuuauauuauuauuauuauuauugguuauauacuguccauagu

SEQ ID NO: 365778 - RNA, 64 nt, Homo Sapiens
uaacuuguaaauauauauguauacauauggaagauauuauuauuaucuagauuacuuuaagccu

SEQ ID NO: 365779 - RNA, 64 nt, Homo Sapiens
cuuguaaauauauauguauacauauggaagauauuauuauuaucuagauuacuuuaagccuuuu

SEQ ID NO: 365780 - RNA, 64 nt, Homo Sapiens
gggcggaaguuauucuggcagguacuggugugauuauuauuauuauuuuuaauaaagaguuuua

SEQ ID NO: 365781 - RNA, 64 nt, Homo Sapiens
cggaaguuauucuggcagguacuggugugauuauuauuauuauuuuuaauaaagaguuuuacag

SEQ ID NO: 365782 - RNA, 64 nt, Homo Sapiens
cugauaagacagggguuucucuuuuugugaccuuuauuauuauuauuuuguuaacuguuguaac

SEQ ID NO: 365783 - RNA, 64 nt, Homo Sapiens
auaagacagggguuucucuuuuugugaccuuuauuauuauuauuuuguuaacuguuguaaccag

SEQ ID NO: 365784 - RNA, 64 nt, Homo Sapiens
agacugcauuuuauuuauauauaaauguauuuauuauuauuauaauaaucaguacuuuauauuu

SEQ ID NO: 365785 - RNA, 64 nt, Homo Sapiens
auaagacugcauuuuauuuauuuauaaauguauuuauuauuauuuccauaaucaguacuuuaua

SEQ ID NO: 365786 - RNA, 64 nt, Homo Sapiens
gacaaggucucacucuguuggcugccccuuuuauuauuauuagaauacuucuugguggacucca

SEQ ID NO: 365787 - RNA, 64 nt, Homo Sapiens
agagacaaggucucacucugccagcugccccuuuuauuauuauuacaauacuucuugguggacu

SEQ ID NO: 365788 - RNA, 64 nt, Homo Sapiens
aauuaaugcuuguuaacuuuuuucauauaauauuuauuauuauuagaagaacuuacaauguguu

SEQ ID NO: 365789 - RNA, 64 nt, Homo Sapiens
uaaugcuuguuaacuuuuuucauauaauauuuauuauuauuagaagaacuuacaauguguucag

SEQ ID NO: 365790 - RNA, 64 nt, Homo Sapiens
auuucauuuagcuuuuuuauuuuaauacaaguaauauuauuacuuuaugaacaauuuuuuuuaa

SEQ ID NO: 365791 - RNA, 64 nt, Homo Sapiens
agccuuaagcaaauuuuguauuauuguucucacuuauuauuaauaaugaaguagaaguuacuua

SEQ ID NO: 365792 - RNA, 64 nt, Homo Sapiens
uaccuauauaucacagcuaauaaagauaaaaccauauuauuaaauaugcgauuaaacgaaauga

SEQ ID NO: 365793 - RNA, 64 nt, Homo Sapiens
auaguagaggauaaaagauaauuucuuaauauacuauuauuagaagucugacaacacuaaagaa

SEQ ID NO: 365794 - RNA, 64 nt, Homo Sapiens
guggucacgauuuucuucagauguaaugaauuauuauuauuacacuuucuguauguuaaaguag

SEQ ID NO: 365795 - RNA, 64 nt, Homo Sapiens
acaguggucacgauuuucuuuagauguaaugaauuauuauuauuugacuuucuguauguuaaag

SEQ ID NO: 365796 - RNA, 64 nt, Homo Sapiens
uacuucugcaauuaaauauucuuuagugcuuguuuauuauuacuaaauacuaauuaaguacuaa

SEQ ID NO: 365797 - RNA, 64 nt, Homo Sapiens
aguugauuauacuucaugcuguuuuccagcaugguauuauuaagggauuuaaaguuuggguugc

SEQ ID NO: 365798 - RNA, 64 nt, Homo Sapiens
uaaagaaaacauuuguucccgacauguggccacuuauuauuaccgagcagugaaguuggucagg

SEQ ID NO: 365799 - RNA, 64 nt, Homo Sapiens
uucuaucucuuaguguaacucuucucuacuauccuauuauuagcuugcccaagagcacugagua

SEQ ID NO: 365800 - RNA, 64 nt, Homo Sapiens
uguucuuucaacaccccaggucuaagaagaauauuauuauuauauucauuuaaaaagacuuuug

SEQ ID NO: 365801 - RNA, 64 nt, Homo Sapiens
auauguucuuucaacaccccuugucuaagaagaauauuauuauuaacuucauuuaaaaagacuu

SEQ ID NO: 365802 - RNA, 64 nt, Homo Sapiens
uuucucccauggcuaagcuacaucccaccuuuauuauuauuauuguuucuccccaccuuauccc

SEQ ID NO: 365803 - RNA, 64 nt, Homo Sapiens
auuuuucucccauggcuaagccccaucccaccuuuauuauuauucauguuucuccccaccuuau

SEQ ID NO: 365804 - RNA, 64 nt, Homo Sapiens
aaaugagcaucagagaguguacaucauguuauuuuauuauuauuauuugcuuuucauguagaac

SEQ ID NO: 365805 - RNA, 64 nt, Homo Sapiens
ugagcaucagagaguguacaucauguuauuuuauuauuauuauuugcuuuucauguagaacuca

SEQ ID NO: 365806 - RNA, 64 nt, Homo Sapiens
auuauuuuuuugcgugaaagaacaaauccuuuauuauuauuauaagauuucagcuacauauaug

SEQ ID NO: 365807 - RNA, 64 nt, Homo Sapiens
auaauuauuuuuuugcgugaaugaacaaauccuuuauuauuauuagcagauuucagcuacauau

SEQ ID NO: 365808 - RNA, 64 nt, Homo Sapiens
ucacuuuguguguguuagugcucuaaaguagcaguauuauuauuaaacuguccccagaguaacc

SEQ ID NO: 365809 - RNA, 64 nt, Homo Sapiens
cuuuguguguguuagugcucuaaaguagcaguauuauuauuaaacuguccccagaguaacccug

SEQ ID NO: 365810 - RNA, 64 nt, Homo Sapiens
gucagccugccagguacuguaauuuauucuaucauauuauuauauuauauaucaaguaggacag

SEQ ID NO: 365811 - RNA, 64 nt, Homo Sapiens
ugcagucauggagaaccaccaaaaucaucauuauuauuauuauugugagagcuguacauuaaaa

SEQ ID NO: 365812 - RNA, 64 nt, Homo Sapiens
auuugcagucauggagaaccaaaaaaaucaucauuauuauuauuugugugagagcuguacauua

SEQ ID NO: 365813 - RNA, 64 nt, Homo Sapiens
gacaagaaaaggauuaaacggguggcuccuuuaauauuauuauuauuguuuuugagacaagguc

SEQ ID NO: 365814 - RNA, 64 nt, Homo Sapiens
aagaaaaggauuaaacggguggcuccuuuaauauuauuauuauuguuuuugagacaaggucccu

SEQ ID NO: 365815 - RNA, 64 nt, Homo Sapiens
ccccaagcgcugcuuuucaccuguaccuuuguuuuauuauuauuauuauuauugcuguuguugu

SEQ ID NO: 365816 - RNA, 64 nt, Homo Sapiens
caagcgcugcuuuucaccuguaccuuuguuuuauuauuauuauuauuauugcuguuguugucau

SEQ ID NO: 365817 - RNA, 64 nt, Homo Sapiens
gcgcugcuuuucaccuguaccuuuguuuuauuauuauuauuauuauugcuguuguugucaucgu

SEQ ID NO: 365818 - RNA, 64 nt, Homo Sapiens
cugcuuuucaccuguaccuuuguuuuauuauuauuauuauuauugcuguuguugucaucguuaa

SEQ ID NO: 365819 - RNA, 64 nt, Homo Sapiens
ucccccugaacaauccuuuucaguauuauauuuuuauuauuauuauguuauuauuacacugucu

SEQ ID NO: 365820 - RNA, 64 nt, Homo Sapiens
cccugaacaauccuuuucaguauuauauuuuuauuauuauuauguuauuauuacacugucuuuu

SEQ ID NO: 365821 - RNA, 64 nt, Homo Sapiens
ccuuuucaguauuauauuuuuauuauuauuauguuauuauuacacugucuuuuugccaucaaaa

SEQ ID NO: 365822 - RNA, 64 nt, Homo Sapiens
cccauacccucauuccuccuuacacaauuucuccuauuauuaagauggugcauuaguguggcac

SEQ ID NO: 365823 - RNA, 64 nt, Homo Sapiens
cacauuuguuacaaaugaugaaccaauauuaauuuauuauuaauuauagcccauaguucacauu

SEQ ID NO: 365824 - RNA, 64 nt, Homo Sapiens
gcauagaaaaaguauaaagcucaguuaguuuuuuuauuauuauuauuauuaaaaguuaauucag

SEQ ID NO: 365825 - RNA, 64 nt, Homo Sapiens
uagaaaaaguauaaagcucaguuaguuuuuuuauuauuauuauuauuaaaaguuaauucaggac

SEQ ID NO: 365826 - RNA, 64 nt, Homo Sapiens
aaaaaguauaaagcucaguuaguuuuuuuauuauuauuauuauuaaaaguuaauucaggacuga

SEQ ID NO: 365827 - RNA, 64 nt, Homo Sapiens
aaguauaaagcucaguuaguuuuuuuauuauuauuauuauuaaaaguuaauucaggacugaugu

SEQ ID NO: 365828 - RNA, 64 nt, Homo Sapiens
auuuuuuugugucaugugagauuauugauaauauuauuauuacuauguugcaucguuuauuauu

SEQ ID NO: 365829 - RNA, 64 nt, Homo Sapiens
acuauuuuuuugugucauguauuauuauugauaauauuauuauuauuauguugcaucguuuauu

SEQ ID NO: 365830 - RNA, 64 nt, Homo Sapiens
gauaauauuauuauuacuauguugcaucguuuauuauuauuauuccucucccauaguuuauuau

SEQ ID NO: 365831 - RNA, 64 nt, Homo Sapiens
auugauaauauuauuauuacuauguugcaucguuuauuauuauuagcccucucccauaguuuau

SEQ ID NO: 365832 - RNA, 64 nt, Homo Sapiens
uuccuuccaugcucccaacuuuaauaauaauuauuauuauuauuugguuaucuuguuauuauug

SEQ ID NO: 365833 - RNA, 64 nt, Homo Sapiens
auuuuccuuccaugcucccauuguuaauaauaauuauuauuauugacugguuaucuuguuauua

SEQ ID NO: 365834 - RNA, 64 nt, Homo Sapiens
gucuaaacaaaauugcaauucuuucauaguuuauuauuauuaaaaacacauaaacaauucaugc

SEQ ID NO: 365835 - RNA, 64 nt, Homo Sapiens
aaagucuaaacaaaauugcaugccuuucauaguuuauuauuauuuguaacacauaaacaauuca

SEQ ID NO: 365836 - RNA, 64 nt, Homo Sapiens
uccuuauauguguaaggugauuucacauauguaguauuauuauuuuagggauucauuucuauau

SEQ ID NO: 365837 - RNA, 64 nt, Homo Sapiens
caaugcaauauuuaaaaugaguguguguguauauuauuauuaaugaauauaguuggaaauaaau

SEQ ID NO: 365838 - RNA, 64 nt, Homo Sapiens
aaucaaugcaauauuuaaaaaauguguguguguauauuauuauuuaggaauauaguuggaaaua

SEQ ID NO: 365839 - RNA, 64 nt, Homo Sapiens
cauuuucuaccgacaaggcaagcagccaugcauuuauuauuaaaguugaacgucaggcuaaaaa

SEQ ID NO: 365840 - RNA, 64 nt, Homo Sapiens
aagcauacagucuaaauaauaauguuuucccauauauuauuaaagucaucuuacuaaugaaaau

SEQ ID NO: 365841 - RNA, 64 nt, Homo Sapiens
acaguuggcucaagggccaccagaagcauuucuuuauuauuauuauuuuuuaaccuggacaugc

SEQ ID NO: 365842 - RNA, 64 nt, Homo Sapiens
guuggcucaagggccaccagaagcauuucuuuauuauuauuauuuuuuaaccuggacaugcauu

SEQ ID NO: 365843 - RNA, 64 nt, Homo Sapiens
aguccagguaugauuggauuaauauuuauaaaauuauuauuaggaauuauuuaaguggggccag

SEQ ID NO: 365844 - RNA, 64 nt, Homo Sapiens
ucaaauucaaauagaacauuuaaaaugauuucauuauuauuacccauacuguugccacucauau

SEQ ID NO: 365845 - RNA, 64 nt, Homo Sapiens
gcagccagcaggagccuggccugggaggacgauuuauuauuacacuggggguuuccuuggcagc

SEQ ID NO: 365846 - RNA, 64 nt, Homo Sapiens
aguuacaaacaauccaguuacaaucuuuuuaaguuauuauuauuauuauuauuuuuuuuuuuuu

SEQ ID NO: 365847 - RNA, 64 nt, Homo Sapiens
uacaaacaauccaguuacaaucuuuuuaaguuauuauuauuauuauuauuuuuuuuuuuuuuga

SEQ ID NO: 365848 - RNA, 64 nt, Homo Sapiens
aaacaauccaguuacaaucuuuuuaaguuauuauuauuauuauuauuuuuuuuuuuuuugagau

SEQ ID NO: 365849 - RNA, 64 nt, Homo Sapiens
caauccaguuacaaucuuuuuaaguuauuauuauuauuauuauuuuuuuuuuuuuugagaugga

SEQ ID NO: 365850 - RNA, 64 nt, Homo Sapiens
gauuauaggugugagccacugcgccuggcuaaguuauuauuauuuuuuugagacagucuccugg

SEQ ID NO: 365851 - RNA, 64 nt, Homo Sapiens
auuuuucgagauggaguuuccuuuauuuuauuauuauuauuacuggcuguuucuaaguuguauu

SEQ ID NO: 365852 - RNA, 64 nt, Homo Sapiens
acuauuuuucgagauggaguauucuuuauuuuauuauuauuauuuuuggcuguuucuaaguugu

SEQ ID NO: 365853 - RNA, 64 nt, Homo Sapiens
auuacuauuuuucgagaugguguauucuuuauuuuauuauuauuccauuuggcuguuucuaagu

SEQ ID NO: 365854 - RNA, 64 nt, Homo Sapiens
uuuuacaaaauauauauauguuaaacaaacuuauuauuauuauuuuguauagaaacaaauucau

SEQ ID NO: 365855 - RNA, 64 nt, Homo Sapiens
auuuuuuacaaaauauauaucauuuaaacaaacuuauuauuauuauuuuguauagaaacaaauu

SEQ ID NO: 365856 - RNA, 64 nt, Homo Sapiens
uuuauuuuucuuuuuuuuuuugacaugaaugaauuauuauuauuccucucauuuccuuacacuc

SEQ ID NO: 365857 - RNA, 64 nt, Homo Sapiens
aaaccaaaucaagaguauuuauuacuauuacugcuauuauuauuaggccugccuuuaauuuuca

SEQ ID NO: 365858 - RNA, 64 nt, Homo Sapiens
ccaaaucaagaguauuuauuacuauuacugcuauuauuauuaggccugccuuuaauuuucagug

SEQ ID NO: 365859 - RNA, 64 nt, Homo Sapiens
cacagaaauagagaugcuauagugaacucccaucuauuauuacacaaauuuaaugguuagcaac

SEQ ID NO: 365860 - RNA, 64 nt, Homo Sapiens
guguguauauauauguauauauauuuuuucauuguauuauuacggagacuuucaaacauauaua

SEQ ID NO: 365861 - RNA, 64 nt, Homo Sapiens
gagucgaguugacucucggcauuauuauuauaauuauuauuaugcgguccuuauggugguuauu

SEQ ID NO: 365862 - RNA, 64 nt, Homo Sapiens
auuauuauuauggagucgagauggugguuauuauuauuauuauagcgaggaggccucgguccuu

SEQ ID NO: 365863 - RNA, 64 nt, Homo Sapiens
auaauuauuauuauggaguccuuauggugguuauuauuauuauugcggcgaggaggccucgguc

SEQ ID NO: 365864 - RNA, 64 nt, Homo Sapiens
auuauaauuauuauuauggaguccuuauggugguuauuauuauuguggcggcgaggaggccucg

SEQ ID NO: 365865 - RNA, 64 nt, Homo Sapiens
uuuuuuuuucugcaggucaguggguguuuuucuuuauuauuacuuaguaguuauagggaagaua

SEQ ID NO: 365866 - RNA, 64 nt, Homo Sapiens
guauuuuuguuuguaaguuaucuuuguuuggguuuauuauuacgacguggcagcaagcugaggg

SEQ ID NO: 365867 - RNA, 64 nt, Homo Sapiens
agucaguuuauaauacaaaggauagauuuuuuauuauuauuaaaauucuucucguuaaauucuu

SEQ ID NO: 365868 - RNA, 64 nt, Homo Sapiens
aaaagucaguuuauaauacacuugauagauuuuuuauuauuauucagauucuucucguuaaauu

SEQ ID NO: 365869 - RNA, 64 nt, Homo Sapiens
aauacaaaagaguagagaagguucuuauugcaaauauuauuaggauguggacaugcuauuaggg

SEQ ID NO: 365870 - RNA, 64 nt, Homo Sapiens
uuuaaucuuuacuacacuccugcaacauagacaguauuauuacauucaguauuacaauggcaga

SEQ ID NO: 365871 - RNA, 64 nt, Homo Sapiens
cacacaauuacuauguauaacauauaugaacauauauuauuauuaccuaauauauguauauuuc

SEQ ID NO: 365872 - RNA, 64 nt, Homo Sapiens
acaauuacuauguauaacauauaugaacauauauuauuauuaccuaauauauguauauuucugu

SEQ ID NO: 365873 - RNA, 64 nt, Homo Sapiens
augcaguuuuaaaaaggugaaaucaugcuuaaaauauuauuaccagugaacaucaggcacucug

SEQ ID NO: 365874 - RNA, 64 nt, Homo Sapiens
uuuaaauaaucacacuuggaguguuauuguuuucuauuauuauuugugcucaauuauaaaagcu

SEQ ID NO: 365875 - RNA, 64 nt, Homo Sapiens
auaagcugcauacguaauauuuggaagauagcaguauuauuagcaugucagguauuuacagugg

SEQ ID NO: 365876 - RNA, 64 nt, Homo Sapiens
ucuuuuguuacaucuauuacgccccgggcauuauuauuauuauucagugauauagcauaauaaa

SEQ ID NO: 365877 - RNA, 64 nt, Homo Sapiens
auuucuuuuguuacaucuauaaagccccgggcauuauuauuauugagcagugauauagcauaau

SEQ ID NO: 365878 - RNA, 64 nt, Homo Sapiens
guuauuauuuuuuaggaccaaauucucuaauuauuauuauuauuucaacaugcuguuggguuuu

SEQ ID NO: 365879 - RNA, 64 nt, Homo Sapiens
auuguuauuauuuuuuaggauuuaauucucuaauuauuauuauucauucaacaugcuguugggu

SEQ ID NO: 365880 - RNA, 64 nt, Homo Sapiens
gcuaaauuaaagggacuccauccuguuaugauuauauuauuauuauuauuauuauuauuuuuga

SEQ ID NO: 365881 - RNA, 64 nt, Homo Sapiens
aaauuaaagggacuccauccuguuaugauuauauuauuauuauuauuauuauuauuuuugaggu

SEQ ID NO: 365882 - RNA, 64 nt, Homo Sapiens
uuaaagggacuccauccuguuaugauuauauuauuauuauuauuauuauuauuuuugaggugga

SEQ ID NO: 365883 - RNA, 64 nt, Homo Sapiens
aagggacuccauccuguuaugauuauauuauuauuauuauuauuauuauuuuugagguggaguu

SEQ ID NO: 365884 - RNA, 64 nt, Homo Sapiens
ggacuccauccuguuaugauuauauuauuauuauuauuauuauuauuuuugagguggaguuuca

SEQ ID NO: 365885 - RNA, 64 nt, Homo Sapiens
cuccauccuguuaugauuauauuauuauuauuauuauuauuauuuuugagguggaguuucacuc

SEQ ID NO: 365886 - RNA, 64 nt, Homo Sapiens
uacaggugugagcuaccgcgccuggccaugaugauauuauuaaacaccauuauucacauuucaa

SEQ ID NO: 365887 - RNA, 64 nt, Homo Sapiens
aauaguuauauuuucuauuacacaaguuuaaaaauauuauuaacuuguauuuucuuaauauaca

SEQ ID NO: 365888 - RNA, 64 nt, Homo Sapiens
cuuggcauauuguagggugcucaauggugguuuuuauuauuauuacucagauuccacaguggca

SEQ ID NO: 365889 - RNA, 64 nt, Homo Sapiens
ggcauauuguagggugcucaauggugguuuuuauuauuauuacucagauuccacaguggcaaga

SEQ ID NO: 365890 - RNA, 64 nt, Homo Sapiens
ucaacuuagcacacgugaagauaaauaugugaaauauuauuaucuugagagugauucucuguau

SEQ ID NO: 365891 - RNA, 64 nt, Homo Sapiens
agaauggacugugcagcgaagaaacguagaaauuuauuauuaaaagcuguaauccagagagaag

SEQ ID NO: 365892 - RNA, 64 nt, Homo Sapiens
caauugacuauuaaaucuggaacuuggaaucuauuauuauuaauaauguauacaugccuuguuu

SEQ ID NO: 365893 - RNA, 64 nt, Homo Sapiens
aaucaauugacuauuaaaucuuuaacuuggaaucuauuauuauuuuuaauguauacaugccuug

SEQ ID NO: 365894 - RNA, 64 nt, Homo Sapiens
guuuuauggucuauguucuuuuuuuuucuagguauauuauuagucuuuaacaaucuuguuuggg

SEQ ID NO: 365895 - RNA, 64 nt, Homo Sapiens
uuagaaauggggucuuguuaaauuugggaauuauuauuauuaaucaugagacuuucucuuuguc

SEQ ID NO: 365896 - RNA, 64 nt, Homo Sapiens
aauuuagaaauggggucuuggucaauuugggaauuauuauuauugaccaugagacuuucucuuu

SEQ ID NO: 365897 - RNA, 64 nt, Homo Sapiens
uuuuagacagucucacuuugaaaaugcuuuuuauuauuauuauucauugaccgcgacuaauuuc

SEQ ID NO: 365898 - RNA, 64 nt, Homo Sapiens
auuuuuuagacagucucacuuucaaaaugcuuuuuauuauuauuuugcauugaccgcgacuaau

SEQ ID NO: 365899 - RNA, 64 nt, Homo Sapiens; identical to SEQ ID NO: 81841

SEQ ID NO: 365900 - RNA, 64 nt, Homo Sapiens; identical to SEQ ID NO: 81842

SEQ ID NO: 365901 - RNA, 64 nt, Homo Sapiens; identical to SEQ ID NO: 81843

SEQ ID NO: 365902 - RNA, 64 nt, Homo Sapiens; identical to SEQ ID NO: 81844

SEQ ID NO: 365903 - RNA, 64 nt, Homo Sapiens; identical to SEQ ID NO: 81845

SEQ ID NO: 365904 - RNA, 64 nt, Homo Sapiens; identical to SEQ ID NO: 81846

SEQ ID NO: 365905 - RNA, 64 nt, Homo Sapiens; identical to SEQ ID NO: 81847

SEQ ID NO: 365906 - RNA, 64 nt, Homo Sapiens; identical to SEQ ID NO: 81848

SEQ ID NO: 365907 - RNA, 64 nt, Homo Sapiens; identical to SEQ ID NO: 81849

SEQ ID NO: 365908 - RNA, 64 nt, Homo Sapiens; identical to SEQ ID NO: 81850

SEQ ID NO: 365909 - RNA, 64 nt, Homo Sapiens; identical to SEQ ID NO: 81851

SEQ ID NO: 365910 - RNA, 61 nt, Homo Sapiens; identical to SEQ ID NO: 81852

SEQ ID NO: 365911 - RNA, 64 nt, Homo Sapiens; identical to SEQ ID NO: 81853

SEQ ID NO: 365912 - RNA, 51 nt, Homo Sapiens; identical to SEQ ID NO: 81854

SEQ ID NO: 365913 - RNA, 64 nt, Homo Sapiens; identical to SEQ ID NO: 81855

SEQ ID NO: 365914 - RNA, 64 nt, Homo Sapiens; identical to SEQ ID NO: 81856

SEQ ID NO: 365915 - RNA, 64 nt, Homo Sapiens; identical to SEQ ID NO: 81857

SEQ ID NO: 365916 - RNA, 64 nt, Homo Sapiens; identical to SEQ ID NO: 81858

SEQ ID NO: 365917 - RNA, 64 nt, Homo Sapiens; identical to SEQ ID NO: 81859

SEQ ID NO: 365918 - RNA, 64 nt, Homo Sapiens; identical to SEQ ID NO: 81860

SEQ ID NO: 365919 - RNA, 64 nt, Homo Sapiens; identical to SEQ ID NO: 81861

SEQ ID NO: 365920 - RNA, 64 nt, Homo Sapiens; identical to SEQ ID NO: 81862

SEQ ID NO: 365921 - RNA, 64 nt, Homo Sapiens; identical to SEQ ID NO: 81863

SEQ ID NO: 365922 - RNA, 64 nt, Homo Sapiens; identical to SEQ ID NO: 81864

SEQ ID NO: 365923 - RNA, 64 nt, Homo Sapiens; identical to SEQ ID NO: 81865

SEQ ID NO: 365924 - RNA, 64 nt, Homo Sapiens; identical to SEQ ID NO: 81866

SEQ ID NO: 365925 - RNA, 64 nt, Homo Sapiens; identical to SEQ ID NO: 81867

SEQ ID NO: 365926 - RNA, 64 nt, Homo Sapiens; identical to SEQ ID NO: 81868

SEQ ID NO: 365927 - RNA, 64 nt, Homo Sapiens; identical to SEQ ID NO: 81869

SEQ ID NO: 365928 - RNA, 64 nt, Homo Sapiens; identical to SEQ ID NO: 81870

SEQ ID NO: 365929 - RNA, 64 nt, Homo Sapiens; identical to SEQ ID NO: 81871

SEQ ID NO: 365930 - RNA, 64 nt, Homo Sapiens; identical to SEQ ID NO: 81872

SEQ ID NO: 365931 - RNA, 64 nt, Homo Sapiens; identical to SEQ ID NO: 81873

SEQ ID NO: 365932 - RNA, 64 nt, Homo Sapiens; identical to SEQ ID NO: 81874

SEQ ID NO: 365933 - RNA, 64 nt, Homo Sapiens; identical to SEQ ID NO: 81875

SEQ ID NO: 365934 - RNA, 64 nt, Homo Sapiens; identical to SEQ ID NO: 81876

SEQ ID NO: 365935 - RNA, 64 nt, Homo Sapiens; identical to SEQ ID NO: 81877

SEQ ID NO: 365936 - RNA, 64 nt, Homo Sapiens; identical to SEQ ID NO: 81878

SEQ ID NO: 365937 - RNA, 64 nt, Homo Sapiens; identical to SEQ ID NO: 81879

SEQ ID NO: 365938 - RNA, 64 nt, Homo Sapiens; identical to SEQ ID NO: 81880

SEQ ID NO: 365939 - RNA, 64 nt, Homo Sapiens; identical to SEQ ID NO: 81881

SEQ ID NO: 365940 - RNA, 64 nt, Homo Sapiens; identical to SEQ ID NO: 81882

SEQ ID NO: 365941 - RNA, 64 nt, Homo Sapiens; identical to SEQ ID NO: 81883

SEQ ID NO: 365942 - RNA, 64 nt, Homo Sapiens; identical to SEQ ID NO: 81884

SEQ ID NO: 365943 - RNA, 64 nt, Homo Sapiens; identical to SEQ ID NO: 81885

SEQ ID NO: 365944 - RNA, 64 nt, Homo Sapiens; identical to SEQ ID NO: 81886

SEQ ID NO: 365945 - RNA, 64 nt, Homo Sapiens; identical to SEQ ID NO: 81887

SEQ ID NO: 365946 - RNA, 64 nt, Homo Sapiens; identical to SEQ ID NO: 81888

SEQ ID NO: 365947 - RNA, 64 nt, Homo Sapiens; identical to SEQ ID NO: 81889

SEQ ID NO: 365948 - RNA, 64 nt, Homo Sapiens; identical to SEQ ID NO: 81890

SEQ ID NO: 365949 - RNA, 64 nt, Homo Sapiens; identical to SEQ ID NO: 81891

SEQ ID NO: 365950 - RNA, 64 nt, Homo Sapiens; identical to SEQ ID NO: 81892

SEQ ID NO: 365951 - RNA, 64 nt, Homo Sapiens; identical to SEQ ID NO: 81893

SEQ ID NO: 365952 - RNA, 64 nt, Homo Sapiens; identical to SEQ ID NO: 81894

SEQ ID NO: 365953 - RNA, 64 nt, Homo Sapiens; identical to SEQ ID NO: 81895

SEQ ID NO: 365954 - RNA, 64 nt, Homo Sapiens; identical to SEQ ID NO: 81896

SEQ ID NO: 365955 - RNA, 64 nt, Homo Sapiens; identical to SEQ ID NO: 81897

SEQ ID NO: 365956 - RNA, 64 nt, Homo Sapiens; identical to SEQ ID NO: 81898

SEQ ID NO: 365957 - RNA, 64 nt, Homo Sapiens; identical to SEQ ID NO: 81899

SEQ ID NO: 365958 - RNA, 64 nt, Homo Sapiens; identical to SEQ ID NO: 81900

SEQ ID NO: 365959 - RNA, 64 nt, Homo Sapiens; identical to SEQ ID NO: 81901

SEQ ID NO: 365960 - RNA, 64 nt, Homo Sapiens; identical to SEQ ID NO: 81902

SEQ ID NO: 365961 - RNA, 64 nt, Homo Sapiens; identical to SEQ ID NO: 81903

SEQ ID NO: 365962 - RNA, 64 nt, Homo Sapiens; identical to SEQ ID NO: 81904

SEQ ID NO: 365963 - RNA, 64 nt, Homo Sapiens; identical to SEQ ID NO: 81905

SEQ ID NO: 365964 - RNA, 64 nt, Homo Sapiens; identical to SEQ ID NO: 81906

SEQ ID NO: 365965 - RNA, 64 nt, Homo Sapiens; identical to SEQ ID NO: 81907

SEQ ID NO: 365966 - RNA, 64 nt, Homo Sapiens; identical to SEQ ID NO: 81908

SEQ ID NO: 365967 - RNA, 64 nt, Homo Sapiens; identical to SEQ ID NO: 81909

SEQ ID NO: 365968 - RNA, 64 nt, Homo Sapiens; identical to SEQ ID NO: 81910

SEQ ID NO: 365969 - RNA, 64 nt, Homo Sapiens; identical to SEQ ID NO: 81911

SEQ ID NO: 365970 - RNA, 64 nt, Homo Sapiens; identical to SEQ ID NO: 81912

SEQ ID NO: 365971 - RNA, 64 nt, Homo Sapiens; identical to SEQ ID NO: 81913

SEQ ID NO: 365972 - RNA, 64 nt, Homo Sapiens; identical to SEQ ID NO: 81914

SEQ ID NO: 365973 - RNA, 64 nt, Homo Sapiens; identical to SEQ ID NO: 81915

SEQ ID NO: 365974 - RNA, 64 nt, Homo Sapiens; identical to SEQ ID NO: 81916

SEQ ID NO: 365975 - RNA, 64 nt, Homo Sapiens; identical to SEQ ID NO: 81917

SEQ ID NO: 365976 - RNA, 64 nt, Homo Sapiens; identical to SEQ ID NO: 81918

SEQ ID NO: 365977 - RNA, 64 nt, Homo Sapiens; identical to SEQ ID NO: 81919

SEQ ID NO: 365978 - RNA, 64 nt, Homo Sapiens; identical to SEQ ID NO: 81920

SEQ ID NO: 365979 - RNA, 64 nt, Homo Sapiens; identical to SEQ ID NO: 81921

SEQ ID NO: 365980 - RNA, 64 nt, Homo Sapiens; identical to SEQ ID NO: 81922

SEQ ID NO: 365981 - RNA, 64 nt, Homo Sapiens; identical to SEQ ID NO: 81923

SEQ ID NO: 365982 - RNA, 64 nt, Homo Sapiens; identical to SEQ ID NO: 81924

SEQ ID NO: 365983 - RNA, 64 nt, Homo Sapiens; identical to SEQ ID NO: 81925

SEQ ID NO: 365984 - RNA, 64 nt, Homo Sapiens; identical to SEQ ID NO: 81926

SEQ ID NO: 365985 - RNA, 64 nt, Homo Sapiens; identical to SEQ ID NO: 81927

SEQ ID NO: 365986 - RNA, 64 nt, Homo Sapiens; identical to SEQ ID NO: 81928

SEQ ID NO: 365987 - RNA, 64 nt, Homo Sapiens; identical to SEQ ID NO: 81929

SEQ ID NO: 365988 - RNA, 64 nt, Homo Sapiens; identical to SEQ ID NO: 81930

SEQ ID NO: 365989 - RNA, 64 nt, Homo Sapiens; identical to SEQ ID NO: 81931

SEQ ID NO: 365990 - RNA, 64 nt, Homo Sapiens; identical to SEQ ID NO: 81932

SEQ ID NO: 365991 - RNA, 64 nt, Homo Sapiens; identical to SEQ ID NO: 81933

SEQ ID NO: 365992 - RNA, 64 nt, Homo Sapiens; identical to SEQ ID NO: 81934

SEQ ID NO: 365993 - RNA, 64 nt, Homo Sapiens; identical to SEQ ID NO: 81935

SEQ ID NO: 365994 - RNA, 64 nt, Homo Sapiens; identical to SEQ ID NO: 81936

SEQ ID NO: 365995 - RNA, 64 nt, Homo Sapiens; identical to SEQ ID NO: 81937

SEQ ID NO: 365996 - RNA, 64 nt, Homo Sapiens; identical to SEQ ID NO: 81938

SEQ ID NO: 365997 - RNA, 64 nt, Homo Sapiens; identical to SEQ ID NO: 81939

SEQ ID NO: 365998 - RNA, 64 nt, Homo Sapiens; identical to SEQ ID NO: 81940

SEQ ID NO: 365999 - RNA, 64 nt, Homo Sapiens; identical to SEQ ID NO: 81941

SEQ ID NO: 366000 - RNA, 64 nt, Homo Sapiens; identical to SEQ ID NO: 81942

SEQ ID NO: 366001 - RNA, 64 nt, Homo Sapiens; identical to SEQ ID NO: 81943

SEQ ID NO: 366002 - RNA, 64 nt, Homo Sapiens; identical to SEQ ID NO: 81944

SEQ ID NO: 366003 - RNA, 63 nt, Homo Sapiens
agaagguuuuuaaggaggggcuucugaauacuugggagauacggaacggaccaaggaccacac

SEQ ID NO: 366004 - RNA, 63 nt, Homo Sapiens
uuaugagugagcuguuaacucuaaaauguacuugggagauaggccaagcgagaggucaugggc

SEQ ID NO: 366005 - RNA, 64 nt, Homo Sapiens
ucucugcuuggauucuggaccaccaccugggaccaaccuucagcucuggaaccuucauaaagca

SEQ ID NO: 366006 - RNA, 64 nt, Homo Sapiens
uggaccaccaccugggaccaaccuucagcucuggaaccuucauaaagcaggucagcguggccug

SEQ ID NO: 366007 - RNA, 64 nt, Homo Sapiens
auuucauaggauuauuuugguauuaaaccuucacaaccuucaugcaaaagagagggugucuuca

SEQ ID NO: 366008 - RNA, 64 nt, Homo Sapiens
accuucaugauuucauaggagugucuucauauuaaaccuucacaaaaagcacacaaaagagagg

SEQ ID NO: 366009 - RNA, 64 nt, Homo Sapiens
guagguagaguuuuagguaauauuuggcaucaaaaaccuucaugucuuugaugucaguuccaau

SEQ ID NO: 366010 - RNA, 64 nt, Homo Sapiens
gguugucaaaggucaucaagggacuagguaauaaaaccuucaaacaucucuuaucucuauacag

SEQ ID NO: 366011 - RNA, 64 nt, Homo Sapiens
aguuaauagaagugagaucacuuuaacugcuguaaaccuucaaacauacauagaagcaaaaaua

SEQ ID NO: 366012 - RNA, 64 nt, Homo Sapiens
cauagaagcaaaaauacuuuaaaaugauuuuuuuaaccuucauagcucuuguauuuuaugaaaa

SEQ ID NO: 366013 - RNA, 64 nt, Homo Sapiens
uagcuaagucuaccuuaaaaagaauuacaauuuuaaccuucaugugaauagcauucaguaauua

SEQ ID NO: 366014 - RNA, 64 nt, Homo Sapiens
auuucuuugaaggauuuccucccagcacuucuguaaccuucagcgauaaagcgucugaucuaau

SEQ ID NO: 366015 - RNA, 64 nt, Homo Sapiens
augccagcaugggucaggccuacaggccucucacaaccuucagcagcuacacgaucaucuuugc

SEQ ID NO: 366016 - RNA, 64 nt, Homo Sapiens
agcauuucccaaaaguaugccucccuugcuuggcaaccuucaccguuccccccacaagaagcac

SEQ ID NO: 366017 - RNA, 64 nt, Homo Sapiens
aaaaagaaaaucaggaaaaaguuucuacaaaaauaaccuucaggucuuuucccuuuuuaccaug

SEQ ID NO: 366018 - RNA, 64 nt, Homo Sapiens
cauagacugaagcagcucaacauaauuucaguaaaaccuucagauuuuucuccuaaaacuggac

SEQ ID NO: 366019 - RNA, 64 nt, Homo Sapiens
uguaaauuuuuuaaaauuucaguuaguuaacaugaaccuucauuccuuaugaugauugugugca

SEQ ID NO: 366020 - RNA, 64 nt, Homo Sapiens
gauagucuuuaaucucugauugccuuaaaagugaaaccuucaugcuugcauaaaaaaggguucu

SEQ ID NO: 366021 - RNA, 64 nt, Homo Sapiens
gauaaaaaacauauaaauguaagaaauguagaaaaaccuucagccaggaggcuggcaagauggc

SEQ ID NO: 366022 - RNA, 64 nt, Homo Sapiens
cagcaugagaacuucgugaagcauacagaagaaaaaccuucagccagauugaaugcuuuacagg

SEQ ID NO: 366023 - RNA, 64 nt, Homo Sapiens
gacacauggcagugcagcauucaauucuuugggaaaccuucaaauaaggaauguaggaaguccu

SEQ ID NO: 366024 - RNA, 64 nt, Homo Sapiens
uauugccacucguuucaaacaaacaauuuuggaaaaccuucagugagagaagcguaauacacgu

SEQ ID NO: 366025 - RNA, 64 nt, Homo Sapiens; identical to SEQ ID NO: 54328

SEQ ID NO: 366026 - RNA, 64 nt, Homo Sapiens; identical to SEQ ID NO: 54329

SEQ ID NO: 366027 - RNA, 64 nt, Homo Sapiens; identical to SEQ ID NO: 54330

SEQ ID NO: 366028 - RNA, 64 nt, Homo Sapiens; identical to SEQ ID NO: 54331

SEQ ID NO: 366029 - RNA, 64 nt, Homo Sapiens; identical to SEQ ID NO: 54332

SEQ ID NO: 366030 - RNA, 64 nt, Homo Sapiens; identical to SEQ ID NO: 54333

SEQ ID NO: 366031 - RNA, 64 nt, Homo Sapiens; identical to SEQ ID NO: 54334

SEQ ID NO: 366032 - RNA, 64 nt, Homo Sapiens; identical to SEQ ID NO: 54335

SEQ ID NO: 366033 - RNA, 64 nt, Homo Sapiens; identical to SEQ ID NO: 54336

SEQ ID NO: 366034 - RNA, 64 nt, Homo Sapiens; identical to SEQ ID NO: 54337

SEQ ID NO: 366035 - RNA, 64 nt, Homo Sapiens; identical to SEQ ID NO: 54338

SEQ ID NO: 366036 - RNA, 64 nt, Homo Sapiens; identical to SEQ ID NO: 54339

SEQ ID NO: 366037 - RNA, 64 nt, Homo Sapiens; identical to SEQ ID NO: 54340

SEQ ID NO: 366038 - RNA, 64 nt, Homo Sapiens; identical to SEQ ID NO: 54341

SEQ ID NO: 366039 - RNA, 64 nt, Homo Sapiens; identical to SEQ ID NO: 54342

SEQ ID NO: 366040 - RNA, 64 nt, Homo Sapiens; identical to SEQ ID NO: 54343

SEQ ID NO: 366041 - RNA, 64 nt, Homo Sapiens; identical to SEQ ID NO: 54344

SEQ ID NO: 366042 - RNA, 64 nt, Homo Sapiens; identical to SEQ ID NO: 54345

SEQ ID NO: 366043 - RNA, 64 nt, Homo Sapiens; identical to SEQ ID NO: 54346

SEQ ID NO: 366044 - RNA, 64 nt, Homo Sapiens; identical to SEQ ID NO: 54347

SEQ ID NO: 366045 - RNA, 64 nt, Homo Sapiens; identical to SEQ ID NO: 54348

SEQ ID NO: 366046 - RNA, 64 nt, Homo Sapiens; identical to SEQ ID NO: 54349

SEQ ID NO: 366047 - RNA, 64 nt, Homo Sapiens; identical to SEQ ID NO: 54350

SEQ ID NO: 366048 - RNA, 64 nt, Homo Sapiens; identical to SEQ ID NO: 54351

SEQ ID NO: 366049 - RNA, 64 nt, Homo Sapiens; identical to SEQ ID NO: 54352

SEQ ID NO: 366050 - RNA, 64 nt, Homo Sapiens; identical to SEQ ID NO: 54353

SEQ ID NO: 366051 - RNA, 64 nt, Homo Sapiens; identical to SEQ ID NO: 54354

SEQ ID NO: 366052 - RNA, 64 nt, Homo Sapiens; identical to SEQ ID NO: 54355

SEQ ID NO: 366053 - RNA, 64 nt, Homo Sapiens; identical to SEQ ID NO: 54356

SEQ ID NO: 366054 - RNA, 64 nt, Homo Sapiens; identical to SEQ ID NO: 54357

SEQ ID NO: 366055 - RNA, 64 nt, Homo Sapiens; identical to SEQ ID NO: 54358

SEQ ID NO: 366056 - RNA, 64 nt, Homo Sapiens; identical to SEQ ID NO: 54359

SEQ ID NO: 366057 - RNA, 64 nt, Homo Sapiens; identical to SEQ ID NO: 54360

SEQ ID NO: 366058 - RNA, 64 nt, Homo Sapiens; identical to SEQ ID NO: 54361

SEQ ID NO: 366059 - RNA, 64 nt, Homo Sapiens; identical to SEQ ID NO: 54362

SEQ ID NO: 366060 - RNA, 64 nt, Homo Sapiens; identical to SEQ ID NO: 54363

SEQ ID NO: 366061 - RNA, 64 nt, Homo Sapiens; identical to SEQ ID NO: 54364

SEQ ID NO: 366062 - RNA, 64 nt, Homo Sapiens; identical to SEQ ID NO: 54365

SEQ ID NO: 366063 - RNA, 64 nt, Homo Sapiens; identical to SEQ ID NO: 54366

SEQ ID NO: 366064 - RNA, 64 nt, Homo Sapiens; identical to SEQ ID NO: 54367

SEQ ID NO: 366065 - RNA, 64 nt, Homo Sapiens; identical to SEQ ID NO: 54368

SEQ ID NO: 366066 - RNA, 64 nt, Homo Sapiens; identical to SEQ ID NO: 54369

SEQ ID NO: 366067 - RNA, 64 nt, Homo Sapiens; identical to SEQ ID NO: 54370

SEQ ID NO: 366068 - RNA, 64 nt, Homo Sapiens; identical to SEQ ID NO: 54371

SEQ ID NO: 366069 - RNA, 64 nt, Homo Sapiens; identical to SEQ ID NO: 54372

SEQ ID NO: 366070 - RNA, 64 nt, Homo Sapiens; identical to SEQ ID NO: 54373

SEQ ID NO: 366071 - RNA, 64 nt, Homo Sapiens; identical to SEQ ID NO: 54374

SEQ ID NO: 366072 - RNA, 64 nt, Homo Sapiens; identical to SEQ ID NO: 54375

SEQ ID NO: 366073 - RNA, 64 nt, Homo Sapiens; identical to SEQ ID NO: 54376

SEQ ID NO: 366074 - RNA, 64 nt, Homo Sapiens; identical to SEQ ID NO: 54377

SEQ ID NO: 366075 - RNA, 64 nt, Homo Sapiens; identical to SEQ ID NO: 54378

SEQ ID NO: 366076 - RNA, 64 nt, Homo Sapiens; identical to SEQ ID NO: 54379

SEQ ID NO: 366077 - RNA, 64 nt, Homo Sapiens; identical to SEQ ID NO: 54380

SEQ ID NO: 366078 - RNA, 64 nt, Homo Sapiens; identical to SEQ ID NO: 54381

SEQ ID NO: 366079 - RNA, 64 nt, Homo Sapiens; identical to SEQ ID NO: 54382

SEQ ID NO: 366080 - RNA, 64 nt, Homo Sapiens; identical to SEQ ID NO: 54383

SEQ ID NO: 366081 - RNA, 64 nt, Homo Sapiens; identical to SEQ ID NO: 54384

SEQ ID NO: 366082 - RNA, 64 nt, Homo Sapiens; identical to SEQ ID NO: 54385

SEQ ID NO: 366083 - RNA, 64 nt, Homo Sapiens; identical to SEQ ID NO: 54386

SEQ ID NO: 366084 - RNA, 64 nt, Homo Sapiens; identical to SEQ ID NO: 54387

SEQ ID NO: 366085 - RNA, 64 nt, Homo Sapiens; identical to SEQ ID NO: 54388

SEQ ID NO: 366086 - RNA, 64 nt, Homo Sapiens; identical to SEQ ID NO: 54389

SEQ ID NO: 366087 - RNA, 64 nt, Homo Sapiens; identical to SEQ ID NO: 54390

SEQ ID NO: 366088 - RNA, 64 nt, Homo Sapiens; identical to SEQ ID NO: 54391

SEQ ID NO: 366089 - RNA, 64 nt, Homo Sapiens; identical to SEQ ID NO: 54392

SEQ ID NO: 366090 - RNA, 64 nt, Homo Sapiens; identical to SEQ ID NO: 54393

SEQ ID NO: 366091 - RNA, 64 nt, Homo Sapiens; identical to SEQ ID NO: 54394

SEQ ID NO: 366092 - RNA, 64 nt, Homo Sapiens; identical to SEQ ID NO: 54395

SEQ ID NO: 366093 - RNA, 64 nt, Homo Sapiens; identical to SEQ ID NO: 54396

SEQ ID NO: 366094 - RNA, 64 nt, Homo Sapiens; identical to SEQ ID NO: 54397

SEQ ID NO: 366095 - RNA, 64 nt, Homo Sapiens; identical to SEQ ID NO: 54398

SEQ ID NO: 366096 - RNA, 64 nt, Homo Sapiens; identical to SEQ ID NO: 54399

SEQ ID NO: 366097 - RNA, 64 nt, Homo Sapiens; identical to SEQ ID NO: 54400

SEQ ID NO: 366098 - RNA, 64 nt, Homo Sapiens; identical to SEQ ID NO: 54401

SEQ ID NO: 366099 - RNA, 64 nt, Homo Sapiens; identical to SEQ ID NO: 54402

SEQ ID NO: 366100 - RNA, 64 nt, Homo Sapiens; identical to SEQ ID NO: 54403

SEQ ID NO: 366101 - RNA, 64 nt, Homo Sapiens; identical to SEQ ID NO: 54404

SEQ ID NO: 366102 - RNA, 64 nt, Homo Sapiens; identical to SEQ ID NO: 54405

SEQ ID NO: 366103 - RNA, 64 nt, Homo Sapiens; identical to SEQ ID NO: 54406

SEQ ID NO: 366104 - RNA, 64 nt, Homo Sapiens; identical to SEQ ID NO: 54407

SEQ ID NO: 366105 - RNA, 64 nt, Homo Sapiens; identical to SEQ ID NO: 54408

SEQ ID NO: 366106 - RNA, 64 nt, Homo Sapiens; identical to SEQ ID NO: 54409

SEQ ID NO: 366107 - RNA, 64 nt, Homo Sapiens; identical to SEQ ID NO: 54410

SEQ ID NO: 366108 - RNA, 64 nt, Homo Sapiens; identical to SEQ ID NO: 54411

SEQ ID NO: 366109 - RNA, 64 nt, Homo Sapiens; identical to SEQ ID NO: 54412

SEQ ID NO: 366110 - RNA, 64 nt, Homo Sapiens; identical to SEQ ID NO: 54413

SEQ ID NO: 366111 - RNA, 64 nt, Homo Sapiens; identical to SEQ ID NO: 54414

SEQ ID NO: 366112 - RNA, 64 nt, Homo Sapiens; identical to SEQ ID NO: 54415

SEQ ID NO: 366113 - RNA, 64 nt, Homo Sapiens; identical to SEQ ID NO: 54416

SEQ ID NO: 366114 - RNA, 64 nt, Homo Sapiens; identical to SEQ ID NO: 54417

SEQ ID NO: 366115 - RNA, 64 nt, Homo Sapiens; identical to SEQ ID NO: 54418

SEQ ID NO: 366116 - RNA, 64 nt, Homo Sapiens; identical to SEQ ID NO: 54419

SEQ ID NO: 366117 - RNA, 64 nt, Homo Sapiens; identical to SEQ ID NO: 54420

SEQ ID NO: 366118 - RNA, 64 nt, Homo Sapiens; identical to SEQ ID NO: 54421

SEQ ID NO: 366119 - RNA, 64 nt, Homo Sapiens; identical to SEQ ID NO: 54422

SEQ ID NO: 366120 - RNA, 64 nt, Homo Sapiens; identical to SEQ ID NO: 54423

SEQ ID NO: 366121 - RNA, 64 nt, Homo Sapiens; identical to SEQ ID NO: 54424

SEQ ID NO: 366122 - RNA, 64 nt, Homo Sapiens; identical to SEQ ID NO: 54425

SEQ ID NO: 366123 - RNA, 64 nt, Homo Sapiens; identical to SEQ ID NO: 54426

SEQ ID NO: 366124 - RNA, 64 nt, Homo Sapiens; identical to SEQ ID NO: 54427

SEQ ID NO: 366125 - RNA, 64 nt, Homo Sapiens; identical to SEQ ID NO: 54428

SEQ ID NO: 366126 - RNA, 64 nt, Homo Sapiens; identical to SEQ ID NO: 54429

SEQ ID NO: 366127 - RNA, 64 nt, Homo Sapiens; identical to SEQ ID NO: 54430

SEQ ID NO: 366128 - RNA, 64 nt, Homo Sapiens; identical to SEQ ID NO: 54431

SEQ ID NO: 366129 - RNA, 64 nt, Homo Sapiens; identical to SEQ ID NO: 54432

SEQ ID NO: 366130 - RNA, 64 nt, Homo Sapiens; identical to SEQ ID NO: 54433

SEQ ID NO: 366131 - RNA, 64 nt, Homo Sapiens; identical to SEQ ID NO: 54434

SEQ ID NO: 366132 - RNA, 64 nt, Homo Sapiens; identical to SEQ ID NO: 54435

SEQ ID NO: 366133 - RNA, 64 nt, Homo Sapiens; identical to SEQ ID NO: 54436

SEQ ID NO: 366134 - RNA, 64 nt, Homo Sapiens; identical to SEQ ID NO: 54437

SEQ ID NO: 366135 - RNA, 64 nt, Homo Sapiens; identical to SEQ ID NO: 54438

SEQ ID NO: 366136 - RNA, 64 nt, Homo Sapiens; identical to SEQ ID NO: 54439

SEQ ID NO: 366137 - RNA, 64 nt, Homo Sapiens; identical to SEQ ID NO: 54440

SEQ ID NO: 366138 - RNA, 64 nt, Homo Sapiens; identical to SEQ ID NO: 54441

SEQ ID NO: 366139 - RNA, 64 nt, Homo Sapiens; identical to SEQ ID NO: 54442

SEQ ID NO: 366140 - RNA, 64 nt, Homo Sapiens; identical to SEQ ID NO: 54443

SEQ ID NO: 366141 - RNA, 64 nt, Homo Sapiens; identical to SEQ ID NO: 54444

SEQ ID NO: 366142 - RNA, 64 nt, Homo Sapiens; identical to SEQ ID NO: 54445

SEQ ID NO: 366143 - RNA, 64 nt, Homo Sapiens; identical to SEQ ID NO: 54446

SEQ ID NO: 366144 - RNA, 64 nt, Homo Sapiens; identical to SEQ ID NO: 54447

SEQ ID NO: 366145 - RNA, 64 nt, Homo Sapiens; identical to SEQ ID NO: 54448

SEQ ID NO: 366146 - RNA, 64 nt, Homo Sapiens; identical to SEQ ID NO: 54449

SEQ ID NO: 366147 - RNA, 64 nt, Homo Sapiens; identical to SEQ ID NO: 54450

SEQ ID NO: 366148 - RNA, 64 nt, Homo Sapiens; identical to SEQ ID NO: 54451

SEQ ID NO: 366149 - RNA, 64 nt, Homo Sapiens; identical to SEQ ID NO: 54452

SEQ ID NO: 366150 - RNA, 58 nt, Homo Sapiens; identical to SEQ ID NO: 54453

SEQ ID NO: 366151 - RNA, 64 nt, Homo Sapiens; identical to SEQ ID NO: 54454

SEQ ID NO: 366152 - RNA, 64 nt, Homo Sapiens; identical to SEQ ID NO: 54455

SEQ ID NO: 366153 - RNA, 64 nt, Homo Sapiens; identical to SEQ ID NO: 54456

SEQ ID NO: 366154 - RNA, 64 nt, Homo Sapiens; identical to SEQ ID NO: 54457

SEQ ID NO: 366155 - RNA, 64 nt, Homo Sapiens; identical to SEQ ID NO: 54458

SEQ ID NO: 366156 - RNA, 64 nt, Homo Sapiens; identical to SEQ ID NO: 54459

SEQ ID NO: 366157 - RNA, 64 nt, Homo Sapiens; identical to SEQ ID NO: 54460

SEQ ID NO: 366158 - RNA, 64 nt, Homo Sapiens; identical to SEQ ID NO: 54461

SEQ ID NO: 366159 - RNA, 64 nt, Homo Sapiens; identical to SEQ ID NO: 54462

SEQ ID NO: 366160 - RNA, 64 nt, Homo Sapiens; identical to SEQ ID NO: 54463

SEQ ID NO: 366161 - RNA, 64 nt, Homo Sapiens; identical to SEQ ID NO: 54464

SEQ ID NO: 366162 - RNA, 53 nt, Homo Sapiens; identical to SEQ ID NO: 54465

SEQ ID NO: 366163 - RNA, 64 nt, Homo Sapiens; identical to SEQ ID NO: 54466

SEQ ID NO: 366164 - RNA, 64 nt, Homo Sapiens; identical to SEQ ID NO: 54467

SEQ ID NO: 366165 - RNA, 64 nt, Homo Sapiens; identical to SEQ ID NO: 54468

SEQ ID NO: 366166 - RNA, 64 nt, Homo Sapiens; identical to SEQ ID NO: 54469

SEQ ID NO: 366167 - RNA, 64 nt, Homo Sapiens; identical to SEQ ID NO: 54470

SEQ ID NO: 366168 - RNA, 64 nt, Homo Sapiens; identical to SEQ ID NO: 54471

SEQ ID NO: 366169 - RNA, 64 nt, Homo Sapiens; identical to SEQ ID NO: 54472

SEQ ID NO: 366170 - RNA, 64 nt, Homo Sapiens; identical to SEQ ID NO: 54473

SEQ ID NO: 366171 - RNA, 64 nt, Homo Sapiens; identical to SEQ ID NO: 54474

SEQ ID NO: 366172 - RNA, 64 nt, Homo Sapiens; identical to SEQ ID NO: 54475

SEQ ID NO: 366173 - RNA, 64 nt, Homo Sapiens; identical to SEQ ID NO: 54476

SEQ ID NO: 366174 - RNA, 64 nt, Homo Sapiens; identical to SEQ ID NO: 54477

SEQ ID NO: 366175 - RNA, 64 nt, Homo Sapiens; identical to SEQ ID NO: 54478

SEQ ID NO: 366176 - RNA, 64 nt, Homo Sapiens; identical to SEQ ID NO: 54479

SEQ ID NO: 366177 - RNA, 64 nt, Homo Sapiens; identical to SEQ ID NO: 54480

SEQ ID NO: 366178 - RNA, 64 nt, Homo Sapiens; identical to SEQ ID NO: 54481

SEQ ID NO: 366179 - RNA, 64 nt, Homo Sapiens; identical to SEQ ID NO: 54482

SEQ ID NO: 366180 - RNA, 64 nt, Homo Sapiens; identical to SEQ ID NO: 54483

SEQ ID NO: 366181 - RNA, 64 nt, Homo Sapiens; identical to SEQ ID NO: 54484

SEQ ID NO: 366182 - RNA, 64 nt, Homo Sapiens; identical to SEQ ID NO: 54485

SEQ ID NO: 366183 - RNA, 64 nt, Homo Sapiens; identical to SEQ ID NO: 54486

SEQ ID NO: 366184 - RNA, 64 nt, Homo Sapiens; identical to SEQ ID NO: 54487

SEQ ID NO: 366185 - RNA, 64 nt, Homo Sapiens; identical to SEQ ID NO: 54488

SEQ ID NO: 366186 - RNA, 64 nt, Homo Sapiens; identical to SEQ ID NO: 54489

SEQ ID NO: 366187 - RNA, 64 nt, Homo Sapiens; identical to SEQ ID NO: 54490

SEQ ID NO: 366188 - RNA, 64 nt, Homo Sapiens; identical to SEQ ID NO: 54491

SEQ ID NO: 366189 - RNA, 64 nt, Homo Sapiens; identical to SEQ ID NO: 54492

SEQ ID NO: 366190 - RNA, 64 nt, Homo Sapiens; identical to SEQ ID NO: 54493

SEQ ID NO: 366191 - RNA, 64 nt, Homo Sapiens; identical to SEQ ID NO: 54494

SEQ ID NO: 366192 - RNA, 64 nt, Homo Sapiens; identical to SEQ ID NO: 54495

SEQ ID NO: 366193 - RNA, 64 nt, Homo Sapiens; identical to SEQ ID NO: 54496

SEQ ID NO: 366194 - RNA, 64 nt, Homo Sapiens; identical to SEQ ID NO: 54497

SEQ ID NO: 366195 - RNA, 64 nt, Homo Sapiens; identical to SEQ ID NO: 54498

SEQ ID NO: 366196 - RNA, 64 nt, Homo Sapiens; identical to SEQ ID NO: 54499

SEQ ID NO: 366197 - RNA, 64 nt, Homo Sapiens; identical to SEQ ID NO: 54500

SEQ ID NO: 366198 - RNA, 64 nt, Homo Sapiens; identical to SEQ ID NO: 54501

SEQ ID NO: 366199 - RNA, 64 nt, Homo Sapiens; identical to SEQ ID NO: 54502

SEQ ID NO: 366200 - RNA, 64 nt, Homo Sapiens; identical to SEQ ID NO: 54503

SEQ ID NO: 366201 - RNA, 64 nt, Homo Sapiens; identical to SEQ ID NO: 54504

SEQ ID NO: 366202 - RNA, 64 nt, Homo Sapiens; identical to SEQ ID NO: 54505

SEQ ID NO: 366203 - RNA, 64 nt, Homo Sapiens; identical to SEQ ID NO: 54506

SEQ ID NO: 366204 - RNA, 64 nt, Homo Sapiens; identical to SEQ ID NO: 54507

SEQ ID NO: 366205 - RNA, 64 nt, Homo Sapiens; identical to SEQ ID NO: 54508

SEQ ID NO: 366206 - RNA, 64 nt, Homo Sapiens; identical to SEQ ID NO: 54509

SEQ ID NO: 366207 - RNA, 64 nt, Homo Sapiens; identical to SEQ ID NO: 54510

SEQ ID NO: 366208 - RNA, 64 nt, Homo Sapiens; identical to SEQ ID NO: 54511

SEQ ID NO: 366209 - RNA, 64 nt, Homo Sapiens; identical to SEQ ID NO: 54512

SEQ ID NO: 366210 - RNA, 64 nt, Homo Sapiens; identical to SEQ ID NO: 54513

SEQ ID NO: 366211 - RNA, 64 nt, Homo Sapiens; identical to SEQ ID NO: 54514

SEQ ID NO: 366212 - RNA, 64 nt, Homo Sapiens; identical to SEQ ID NO: 54515

SEQ ID NO: 366213 - RNA, 64 nt, Homo Sapiens; identical to SEQ ID NO: 54516

SEQ ID NO: 366214 - RNA, 64 nt, Homo Sapiens; identical to SEQ ID NO: 54517

SEQ ID NO: 366215 - RNA, 64 nt, Homo Sapiens; identical to SEQ ID NO: 54518

SEQ ID NO: 366216 - RNA, 64 nt, Homo Sapiens; identical to SEQ ID NO: 54519

SEQ ID NO: 366217 - RNA, 64 nt, Homo Sapiens; identical to SEQ ID NO: 54520

SEQ ID NO: 366218 - RNA, 64 nt, Homo Sapiens; identical to SEQ ID NO: 54521

SEQ ID NO: 366219 - RNA, 64 nt, Homo Sapiens; identical to SEQ ID NO: 54522

SEQ ID NO: 366220 - RNA, 64 nt, Homo Sapiens; identical to SEQ ID NO: 54523

SEQ ID NO: 366221 - RNA, 64 nt, Homo Sapiens; identical to SEQ ID NO: 54524

SEQ ID NO: 366222 - RNA, 64 nt, Homo Sapiens; identical to SEQ ID NO: 54525

SEQ ID NO: 366223 - RNA, 64 nt, Homo Sapiens; identical to SEQ ID NO: 54526

SEQ ID NO: 366224 - RNA, 64 nt, Homo Sapiens; identical to SEQ ID NO: 54527

SEQ ID NO: 366225 - RNA, 64 nt, Homo Sapiens; identical to SEQ ID NO: 54528

SEQ ID NO: 366226 - RNA, 64 nt, Homo Sapiens; identical to SEQ ID NO: 54529

SEQ ID NO: 366227 - RNA, 64 nt, Homo Sapiens; identical to SEQ ID NO: 54530

SEQ ID NO: 366228 - RNA, 64 nt, Homo Sapiens; identical to SEQ ID NO: 54531

SEQ ID NO: 366229 - RNA, 64 nt, Homo Sapiens; identical to SEQ ID NO: 54532

SEQ ID NO: 366230 - RNA, 64 nt, Homo Sapiens; identical to SEQ ID NO: 54533

SEQ ID NO: 366231 - RNA, 64 nt, Homo Sapiens; identical to SEQ ID NO: 54534

SEQ ID NO: 366232 - RNA, 64 nt, Homo Sapiens; identical to SEQ ID NO: 54535

SEQ ID NO: 366233 - RNA, 64 nt, Homo Sapiens; identical to SEQ ID NO: 54536

SEQ ID NO: 366234 - RNA, 64 nt, Homo Sapiens; identical to SEQ ID NO: 54537

SEQ ID NO: 366235 - RNA, 64 nt, Homo Sapiens; identical to SEQ ID NO: 54538

SEQ ID NO: 366236 - RNA, 64 nt, Homo Sapiens; identical to SEQ ID NO: 54539

SEQ ID NO: 366237 - RNA, 64 nt, Homo Sapiens; identical to SEQ ID NO: 54540

SEQ ID NO: 366238 - RNA, 64 nt, Homo Sapiens; identical to SEQ ID NO: 54541

SEQ ID NO: 366239 - RNA, 64 nt, Homo Sapiens; identical to SEQ ID NO: 54542

SEQ ID NO: 366240 - RNA, 64 nt, Homo Sapiens; identical to SEQ ID NO: 54543

SEQ ID NO: 366241 - RNA, 64 nt, Homo Sapiens; identical to SEQ ID NO: 54544

SEQ ID NO: 366242 - RNA, 64 nt, Homo Sapiens; identical to SEQ ID NO: 54545

SEQ ID NO: 366243 - RNA, 64 nt, Homo Sapiens; identical to SEQ ID NO: 54546

SEQ ID NO: 366244 - RNA, 64 nt, Homo Sapiens; identical to SEQ ID NO: 54547

SEQ ID NO: 366245 - RNA, 64 nt, Homo Sapiens; identical to SEQ ID NO: 54548

SEQ ID NO: 366246 - RNA, 64 nt, Homo Sapiens; identical to SEQ ID NO: 54549

SEQ ID NO: 366247 - RNA, 64 nt, Homo Sapiens; identical to SEQ ID NO: 54550

SEQ ID NO: 366248 - RNA, 64 nt, Homo Sapiens; identical to SEQ ID NO: 54551

SEQ ID NO: 366249 - RNA, 64 nt, Homo Sapiens; identical to SEQ ID NO: 54552

SEQ ID NO: 366250 - RNA, 64 nt, Homo Sapiens; identical to SEQ ID NO: 54553

SEQ ID NO: 366251 - RNA, 64 nt, Homo Sapiens; identical to SEQ ID NO: 54554

SEQ ID NO: 366252 - RNA, 64 nt, Homo Sapiens; identical to SEQ ID NO: 54555

SEQ ID NO: 366253 - RNA, 64 nt, Homo Sapiens; identical to SEQ ID NO: 54556

SEQ ID NO: 366254 - RNA, 64 nt, Homo Sapiens; identical to SEQ ID NO: 54557

SEQ ID NO: 366255 - RNA, 64 nt, Homo Sapiens; identical to SEQ ID NO: 54558

SEQ ID NO: 366256 - RNA, 64 nt, Homo Sapiens; identical to SEQ ID NO: 54559

SEQ ID NO: 366257 - RNA, 64 nt, Homo Sapiens; identical to SEQ ID NO: 54560

SEQ ID NO: 366258 - RNA, 64 nt, Homo Sapiens; identical to SEQ ID NO: 54561

SEQ ID NO: 366259 - RNA, 64 nt, Homo Sapiens; identical to SEQ ID NO: 54562

SEQ ID NO: 366260 - RNA, 64 nt, Homo Sapiens; identical to SEQ ID NO: 54563

SEQ ID NO: 366261 - RNA, 64 nt, Homo Sapiens; identical to SEQ ID NO: 54564

SEQ ID NO: 366262 - RNA, 64 nt, Homo Sapiens; identical to SEQ ID NO: 54565

SEQ ID NO: 366263 - RNA, 64 nt, Homo Sapiens; identical to SEQ ID NO: 54566

SEQ ID NO: 366264 - RNA, 64 nt, Homo Sapiens; identical to SEQ ID NO: 54567

SEQ ID NO: 366265 - RNA, 64 nt, Homo Sapiens; identical to SEQ ID NO: 54568

SEQ ID NO: 366266 - RNA, 64 nt, Homo Sapiens; identical to SEQ ID NO: 54569

SEQ ID NO: 366267 - RNA, 64 nt, Homo Sapiens; identical to SEQ ID NO: 54570

SEQ ID NO: 366268 - RNA, 64 nt, Homo Sapiens; identical to SEQ ID NO: 54571

SEQ ID NO: 366269 - RNA, 64 nt, Homo Sapiens; identical to SEQ ID NO: 54572

SEQ ID NO: 366270 - RNA, 64 nt, Homo Sapiens; identical to SEQ ID NO: 54573

SEQ ID NO: 366271 - RNA, 64 nt, Homo Sapiens; identical to SEQ ID NO: 54574

SEQ ID NO: 366272 - RNA, 64 nt, Homo Sapiens; identical to SEQ ID NO: 54575

SEQ ID NO: 366273 - RNA, 64 nt, Homo Sapiens; identical to SEQ ID NO: 54576

SEQ ID NO: 366274 - RNA, 64 nt, Homo Sapiens; identical to SEQ ID NO: 54577

SEQ ID NO: 366275 - RNA, 64 nt, Homo Sapiens; identical to SEQ ID NO: 54578

SEQ ID NO: 366276 - RNA, 64 nt, Homo Sapiens; identical to SEQ ID NO: 54579

SEQ ID NO: 366277 - RNA, 64 nt, Homo Sapiens; identical to SEQ ID NO: 54580

SEQ ID NO: 366278 - RNA, 64 nt, Homo Sapiens; identical to SEQ ID NO: 54581

SEQ ID NO: 366279 - RNA, 64 nt, Homo Sapiens; identical to SEQ ID NO: 54582

SEQ ID NO: 366280 - RNA, 64 nt, Homo Sapiens; identical to SEQ ID NO: 54583

SEQ ID NO: 366281 - RNA, 64 nt, Homo Sapiens; identical to SEQ ID NO: 188817

SEQ ID NO: 366282 - RNA, 64 nt, Homo Sapiens; identical to SEQ ID NO: 188818

SEQ ID NO: 366283 - RNA, 64 nt, Homo Sapiens; identical to SEQ ID NO: 188819

SEQ ID NO: 366284 - RNA, 64 nt, Homo Sapiens; identical to SEQ ID NO: 188820

SEQ ID NO: 366285 - RNA, 64 nt, Homo Sapiens; identical to SEQ ID NO: 188821

SEQ ID NO: 366286 - RNA, 64 nt, Homo Sapiens; identical to SEQ ID NO: 188822

SEQ ID NO: 366287 - RNA, 64 nt, Homo Sapiens; identical to SEQ ID NO: 188823

SEQ ID NO: 366288 - RNA, 64 nt, Homo Sapiens; identical to SEQ ID NO: 188824

SEQ ID NO: 366289 - RNA, 64 nt, Homo Sapiens; identical to SEQ ID NO: 188825

SEQ ID NO: 366290 - RNA, 64 nt, Homo Sapiens; identical to SEQ ID NO: 188826

SEQ ID NO: 366291 - RNA, 64 nt, Homo Sapiens
uuuccuuaaguuuugaucuccgucuuccugaugaagcaggcagagcucagaggaucuuggcauc

SEQ ID NO: 366292 - RNA, 64 nt, Homo Sapiens
uaucuucccccaccuucuacaugguauuagucccagcaggcaucccuggggcagacgugcuuug

SEQ ID NO: 366293 - RNA, 64 nt, Homo Sapiens
ccagcccugauguggagacaagaggaaguaagguagcaggcaguuguuggcuacaugaguauuu

SEQ ID NO: 366294 - RNA, 64 nt, Homo Sapiens
acuuuucugcucccuuucucgaggaggagaagccagcaggcacccugucuucaggcugccaggg

SEQ ID NO: 366295 - RNA, 64 nt, Homo Sapiens
uaggccugggauugagcuaaccugaaacaaagguagcaggcaggaccuaaugaccagagguuaa

SEQ ID NO: 366296 - RNA, 64 nt, Homo Sapiens
ggccaacauuggugucccuguccccagagggaggagcaggcaggagagagaggggaaggaggua

SEQ ID NO: 366297 - RNA, 64 nt, Homo Sapiens
cauaaauacaaagcagcuuccaucaggaacauggagcaggcagggacuccauuuuacagaauua

SEQ ID NO: 366298 - RNA, 64 nt, Homo Sapiens
gcaggggccggagugagggggcugcuggcuuaacagcaggcaucugggcaggccaguccucaaa

SEQ ID NO: 366299 - RNA, 64 nt, Homo Sapiens
accgugucuguggucgggugccucucacuccagcagcaggcagacugcagccucagaaaccagg

SEQ ID NO: 366300 - RNA, 64 nt, Homo Sapiens
ucuuguugccaauuuacaaagccucagggcagccagcaggcaggcugugggagcagacccgugg

SEQ ID NO: 366301 - RNA, 64 nt, Homo Sapiens
gaaggcgcuggagccugcggggcagcaggggccaagcaggcacucuggggcuggcaccagcagg

SEQ ID NO: 366302 - RNA, 64 nt, Homo Sapiens
gcaggggccaagcaggcacucuggggcuggcaccagcaggcacugaagcugcggcccugaucuc

SEQ ID NO: 366303 - RNA, 64 nt, Homo Sapiens
ccuguuaauaugcucauugaaaacauggcauugaagcaggcacuugcguggauguuucucacuu

SEQ ID NO: 366304 - RNA, 64 nt, Homo Sapiens
uaccuuuggaucugugagaaggugaauacaaagcagcaggcagaguaaaaucugcugggacugc

SEQ ID NO: 366305 - RNA, 64 nt, Homo Sapiens
gagccugggucuaggcuaagugagggccaggagcagcaggcaagcucauccacuugagggcgcc

SEQ ID NO: 366306 - RNA, 64 nt, Homo Sapiens
uucgagaacggauccagaaagagcucugagcagcagcaggcaacccgggggggacucaacagca

SEQ ID NO: 366307 - RNA, 64 nt, Homo Sapiens
guggaggcagccauccccugacucgagucccuggagcaggcagucaaggcucuccguggagugg

SEQ ID NO: 366308 - RNA, 64 nt, Homo Sapiens
ugcagccgggaaagccaggggggacuggagcuggagcaggcacuuggagccaugaggaggggcu

SEQ ID NO: 366309 - RNA, 64 nt, Homo Sapiens
gccugccucagcaugcuucggugccuagcuccagagcaggcacauccugaccucuucccaggca

SEQ ID NO: 366310 - RNA, 64 nt, Homo Sapiens
gaugcuagagggugaugaccccagggcaggcaggagcaggcacugaagugguggagccucaggg

SEQ ID NO: 366311 - RNA, 64 nt, Homo Sapiens
cuucuaagacaggaaggaaagugaaggcagagugagcaggcaaaguagaaaauucgaaaagguc

SEQ ID NO: 366312 - RNA, 64 nt, Homo Sapiens
auuguugcaaugacuugggagugccauagcaccuagcaggcagaagccagaaacaccaaauguc

SEQ ID NO: 366313 - RNA, 64 nt, Homo Sapiens
augccggagagacagccccuugugcugugagcagagcaggcaguggcucuggaggcugccugug

SEQ ID NO: 366314 - RNA, 64 nt, Homo Sapiens
caagguuuccucucuucccccaggaccugggcagagcaggcaugagcugggcuguggugcagag

SEQ ID NO: 366315 - RNA, 64 nt, Homo Sapiens
ucaggugauuuccuagggagagguucccagucccagcaggcagaaugcccaaaaccaggagcac

SEQ ID NO: 366316 - RNA, 64 nt, Homo Sapiens
acucccugguuucuuccuggcaugguguuugggcagcaggcaucauuuuccuuuucuagcuuca

SEQ ID NO: 366317 - RNA, 64 nt, Homo Sapiens
caguaauaagaaucuaggaggaauuccaaaccgaagcaggcagggucuggaacccaaaggacag

SEQ ID NO: 366318 - RNA, 64 nt, Homo Sapiens
cucagcacgcucacuaacccagcaugccacuuccagcaggcaugcaguccuggcccagcucuau

SEQ ID NO: 366319 - RNA, 64 nt, Homo Sapiens
gguucuugcaagagcgcguggggacaguucuuccagcaggcacugguuuuguugccccagggcu

SEQ ID NO: 366320 - RNA, 64 nt, Homo Sapiens
acgugcaugcuuuaaaaaacacagucacgcaccaagcaggcaaauagcuuuaguccuucucacc

SEQ ID NO: 366321 - RNA, 64 nt, Homo Sapiens
ccggauaguaagaaaacaaacagcccaagugaaaagcaggcaaaagacuugaauagacacuuca

SEQ ID NO: 366322 - RNA, 64 nt, Homo Sapiens
caguccaaggaauaucaaaauuuaaucuuccucuagcaggcaugagccauuuuggcugcuguuc

SEQ ID NO: 366323 - RNA, 64 nt, Homo Sapiens
caguccaaggaauaucaaaauuuaauuuuccucuagcaggcaugaaccauuuuggcugcugcuc

SEQ ID NO: 366324 - RNA, 64 nt, Homo Sapiens
augcgucgauuuuuuuuuuuaggaagacguugcaagcaggcaaaacccugacgucccccagcaa

SEQ ID NO: 366325 - RNA, 64 nt, Homo Sapiens
uggccugacccaugagaccgucuggaguccaggaagcaggcaacccucagccauggcaagucca

SEQ ID NO: 366326 - RNA, 64 nt, Homo Sapiens
acaacaggcugugccuuauuuugauaauuuucugauucccuagaagagaacccucuacuuuuug

SEQ ID NO: 366327 - RNA, 64 nt, Homo Sapiens
ugcugcaacugggcauaaaccugaccuggucuauauucccuagaguuccagucucuuuugcuua

SEQ ID NO: 366328 - RNA, 64 nt, Homo Sapiens
gccuguccuuuacuucauccacaccuaugaagcuauucccuaaauaaggcauuucccaaguuag

SEQ ID NO: 366329 - RNA, 64 nt, Homo Sapiens
caacugauggcaccauugaugugcaaauaaugagauucccuaucuccuuuuagaccugggacgg

SEQ ID NO: 366330 - RNA, 64 nt, Homo Sapiens
cuugccccaagaaaagaggccaaagcaagagcagauucccuaggcaagagcagcagcacaacua

SEQ ID NO: 366331 - RNA, 64 nt, Homo Sapiens
auuuauguuuugaaagaucauguguucccaaaguauucccuauuguuggcuccacagccuuaaa

SEQ ID NO: 366332 - RNA, 64 nt, Homo Sapiens
uccuaaacucucuuccagcaaaaauggagguugcauucccuacucccuccagccuccagucugu

SEQ ID NO: 366333 - RNA, 64 nt, Homo Sapiens
ggcagcuggagagaucugugacacuguucuguauauucccuauaacagucauucuuugaaggug

SEQ ID NO: 366334 - RNA, 64 nt, Homo Sapiens
agcacagggaucucagcucucuggaaguuggagaauucccuaucaaagggcagccccaggcugu

SEQ ID NO: 366335 - RNA, 64 nt, Homo Sapiens
cuaagggugccuuagaaucaaugucuauuuugaaauucccuauguuguaagcagccaacuguaa

SEQ ID NO: 366336 - RNA, 64 nt, Homo Sapiens
acuaaaaauuuauaaauaugagcuuucuuagagaauucccuagauuaaaaauuauauucaucuc

SEQ ID NO: 366337 - RNA, 64 nt, Homo Sapiens
cuuucaugaggucaucccuagaggggaagaacagauucccuaaagaugggaaugaggaaggagu

SEQ ID NO: 366338 - RNA, 64 nt, Homo Sapiens
aauuuauuuagacuuaauuuacucccauuguggaauucccuagcguagagaaaaauuuucauug

SEQ ID NO: 366339 - RNA, 64 nt, Homo Sapiens
cugacuccuuccccaaacccccuagccauguggaauucccuacccaguguacugaggguacugg

SEQ ID NO: 366340 - RNA, 64 nt, Homo Sapiens
ucucgggaccucguuugggaauccuuuccacccuauucccuaaccuuccagaagaugcccucca

SEQ ID NO: 366341 - RNA, 64 nt, Homo Sapiens
gucugcuuuagagaaggggggccugaccuaauguauucccuaggcccuguaguauuugcugugg

SEQ ID NO: 366342 - RNA, 64 nt, Homo Sapiens
uguuuucuucuguauguuaggaugucuaauaguuauucccuauuguagauuuuuaacgaaugaa

SEQ ID NO: 366343 - RNA, 64 nt, Homo Sapiens
uuuauguuuauuuaauccauuuggaacaguauauauucccuauuaucuaaagaggaaaaguuug

SEQ ID NO: 366344 - RNA, 64 nt, Homo Sapiens
ccacagucaucuuuggacagcagagaaccauggcauucccuauucccauagugugggggaccug

SEQ ID NO: 366345 - RNA, 64 nt, Homo Sapiens
agauggauuuuuuuuuuuuuucuucauauucuuuauucccuacccugagacugacucccuuauc

SEQ ID NO: 366346 - RNA, 64 nt, Homo Sapiens
uuuaaauaaucagaauauccgggauaaaaaagggauucccuaacggcccauuuuauuggguggg

SEQ ID NO: 366347 - RNA, 64 nt, Homo Sapiens
cacacauuaccuucuaauuauaguuugaaaauagauucccuacacauacauacauauguaugca

SEQ ID NO: 366348 - RNA, 64 nt, Homo Sapiens
agagucauuccaaguccuauggccuggaaauuguauucccuauaauauacaaauuuuccuguaa

SEQ ID NO: 366349 - RNA, 64 nt, Homo Sapiens
uuuagcauugccuuggcauaacaagggcccaucgauucccuacuaaugagaggcagggagagca

SEQ ID NO: 366350 - RNA, 64 nt, Homo Sapiens
uaauauuuauuuguaugucaguauuuuucauuugauucccuauuagaauuaauuuuaaaacuug

SEQ ID NO: 366351 - RNA, 64 nt, Homo Sapiens
auuacuauaacaucuaagcaucaucugauuugauauucccuaaaaaacauuuggaauauaugcu

SEQ ID NO: 366352 - RNA, 64 nt, Homo Sapiens
gaagugggugggaaauaagguaaaauuuugaaccauucccuagucauuuccaaacuugaaaaca

SEQ ID NO: 366353 - RNA, 64 nt, Homo Sapiens
auccacaguguuuucauuuaacaggggccaauaaauucccuaacagaaaaacaaaaaacaaaaa

SEQ ID NO: 366354 - RNA, 64 nt, Homo Sapiens
aaaacauaucaauucaacacaaauuaagagauacauucccuaucauaauuuucaagagaagaaa

SEQ ID NO: 366355 - RNA, 64 nt, Homo Sapiens
aaggguauaauuuuacacaggcuuacaagagccuauucccuauaaggaaauaaguuaaaaggca

SEQ ID NO: 366356 - RNA, 64 nt, Homo Sapiens
caacuggcaauaguauuccuaaugaggggagaauauucccuaaguauauuauuccugaaaauaa

SEQ ID NO: 366357 - RNA, 64 nt, Homo Sapiens
acagugguuuuuaccacuguaccauuugcuccaaauucccuagacauguaaacucauuucggcu

SEQ ID NO: 366358 - RNA, 64 nt, Homo Sapiens
uaccuggaaaguucuacaguucaggcaauuucacauucccuaauguaguugggaugaaauggcc

SEQ ID NO: 366359 - RNA, 64 nt, Homo Sapiens
acuggaaccccagcuucccuccagccucuccuccauucccuauggguucugugaccacugcugg

SEQ ID NO: 366360 - RNA, 64 nt, Homo Sapiens
agugguuucccggagccaguagucacgguggaccauucccuacuugcuuuuccuuggaucacua

SEQ ID NO: 366361 - RNA, 64 nt, Homo Sapiens
uaaagaucuggggaccucugggucuguucugaccauucccuagucuccauggccaagcacucaa

SEQ ID NO: 366362 - RNA, 64 nt, Homo Sapiens
caucucccccagcccacuuguuuuccccccuuuuauucccuaggcccuuuucagacuccugggc

SEQ ID NO: 366363 - RNA, 64 nt, Homo Sapiens
ugagaacaaauggaugugaucaugaaggaaucagauucccuauguaaagcaguuuaaaauggaa

SEQ ID NO: 366364 - RNA, 64 nt, Homo Sapiens
uaaacucuuugccaaaauccuggggcuuugcugcauucccuaagauaauuacaggaaaaagaaa

SEQ ID NO: 366365 - RNA, 64 nt, Homo Sapiens
gucaaugaauguguaguaucuccuucugacaagcauucccuauugggauuuuaaagcuaugugc

SEQ ID NO: 366366 - RNA, 64 nt, Homo Sapiens
auggaggcaaaauaccacaugccccaaccacagcauucccuaacggagugcuggagcuccagca

SEQ ID NO: 366367 - RNA, 64 nt, Homo Sapiens
cacccuguucuuucccagacugcccuuacuauccauucccuauauugaugcccucuagauuagg

SEQ ID NO: 366368 - RNA, 64 nt, Homo Sapiens
uggagauuaaauguuagaaaauuucugaccuccaauucccuaaguggggcaugguauuuuauuc

SEQ ID NO: 366369 - RNA, 64 nt, Homo Sapiens
cccugagcaagucaggcuccucacucuuggucccauucccuagggcucuggagaagaagcugga

SEQ ID NO: 366370 - RNA, 64 nt, Homo Sapiens
gaggccucugagggccuccaaccucagugauuuuauucccuaguaaacgagauguggaaggaga

SEQ ID NO: 366371 - RNA, 64 nt, Homo Sapiens
ccaauuaucuaaaucuuccuuuuacaauuuauguauucccuaauacucuagaaauggagaccga

SEQ ID NO: 366372 - RNA, 64 nt, Homo Sapiens
uuuuaguuuuaguugcagaaucccaacuccuauaauucccuaucucguuaguaucuaacaugua

SEQ ID NO: 366373 - RNA, 64 nt, Homo Sapiens
aggaaggguugguuuuuuuccauuuucuacauggauucccuacuuugaagagugugggggaaag

SEQ ID NO: 366374 - RNA, 64 nt, Homo Sapiens
cucccuuagccauccccuccccuuuuguccuaucauucccuagaacaagccaccugucaauugu

SEQ ID NO: 366375 - RNA, 64 nt, Homo Sapiens
uuuaauagugcaaagcacaguuuaaaagcaggacauucccuaccuuaaaguuaaagggaugacu

SEQ ID NO: 366376 - RNA, 64 nt, Homo Sapiens
cgagugggagaaagaugucccagggaaucuuagaauucccuacagguauggaaagaucuauugu

SEQ ID NO: 366377 - RNA, 64 nt, Homo Sapiens
aaccuccaccagcaaccugguuuaaacaacuaggauucccuacugucaggcauccauuuugccu

SEQ ID NO: 366378 - RNA, 64 nt, Homo Sapiens
uuucucucgagcucacaaaugaaacccuuguauaauucccuacaugaacucacaaaguguucaa

SEQ ID NO: 366379 - RNA, 64 nt, Homo Sapiens
uuaaauaauaauaauaacuauuauauauaugaauauucccuauguauuauagacuuuguaccug

SEQ ID NO: 366380 - RNA, 64 nt, Homo Sapiens
aacuugaggaaggaagaugaugguuuuacuuaauauucccuaaacaugucuuagcacugauuau

SEQ ID NO: 366381 - RNA, 64 nt, Homo Sapiens
uuauucuauagcuccaacuuaaggugccuuuuuaauucccuacaguuuuauggguguuaucagu

SEQ ID NO: 366382 - RNA, 64 nt, Homo Sapiens
cgcgauacuaaaauccagugagcuuugggagaucauucccuaaagguauguggguugucugaag

SEQ ID NO: 366383 - RNA, 64 nt, Homo Sapiens
auguauacuaucuuuuuaucuugaauuuuaagggauucccuaaugaugguguauaacucuagag

SEQ ID NO: 366384 - RNA, 64 nt, Homo Sapiens
gacuaacuugaaaagaaaacuuaguuaaaaaaaaauucccuaaauuauacaccuuagucuuucc

SEQ ID NO: 366385 - RNA, 64 nt, Homo Sapiens
acuuaaaauguguauauauaccaaaauaaacuuuauucccuauaauuuuguuuaacacuaucug

SEQ ID NO: 366386 - RNA, 64 nt, Homo Sapiens
ucuuucuauuccaaagugccucacuguaagacucauucccuagagguaggccuaaugaaggagu

SEQ ID NO: 366387 - RNA, 64 nt, Homo Sapiens
uaaacacaugaagcucuggggacuagaguggaagauucccuauucaacacacugugauaaaggg

SEQ ID NO: 366388 - RNA, 64 nt, Homo Sapiens
caaaucucagccccauguugucugcacucaguuuauucccuacuuaauuuaauuauaugauuug

SEQ ID NO: 366389 - RNA, 64 nt, Homo Sapiens
aauggauuuaguucugaggauuucacugcucuaaauucccuaugacucugcggcgugaaaucua

SEQ ID NO: 366390 - RNA, 64 nt, Homo Sapiens
agagaguuccuccaauucugaccgagugcugaucauucccuagagacaccaguaaccccgggcu

SEQ ID NO: 366391 - RNA, 64 nt, Homo Sapiens
uuuagcugcuuguuuuaaguccuuuuuaugugacauucccuacccccaauguugucagcugcuu

SEQ ID NO: 366392 - RNA, 64 nt, Homo Sapiens
gcuuuugcuuuguuuauuuauuuuuuuaauccucauucccuauguccacuugccuuccucuccg

SEQ ID NO: 366393 - RNA, 64 nt, Homo Sapiens
cuuugguccauuucuuaugauggguggccuucuuauucccuagccugugauuguaggggguugc

SEQ ID NO: 366394 - RNA, 64 nt, Homo Sapiens
caggcuccccucauuucaccacaauuaucucugaauucccuaucaaucacauuacuaaaugcca

SEQ ID NO: 366395 - RNA, 64 nt, Homo Sapiens
ucccauuuguccgagaggcuaaacucauagaaccauucccuagacucccaguuagcugccugga

SEQ ID NO: 366396 - RNA, 64 nt, Homo Sapiens
aaaaaaaaguucuuguguguucguaucuuuauuuauucccuaguuugcagaacugucugaauaa

SEQ ID NO: 366397 - RNA, 64 nt, Homo Sapiens
caccagugcaucacaucugcacacucucuucuccauucccuagcaggaacuucuagcucauuua

SEQ ID NO: 366398 - RNA, 64 nt, Homo Sapiens
agguuagugagauccuaagcucucaaaauagcauauucccuagagcucaagaaagcugguccag

SEQ ID NO: 366399 - RNA, 64 nt, Homo Sapiens
cuguguggcaaauuaaacaacuguuuguucucuuauucccuagucuggcacuacucaguuauua

SEQ ID NO: 366400 - RNA, 64 nt, Homo Sapiens
ugguuaaugacaucaucgaauguccuuccacuauauucccuauuuuccucuauuugcuucauuc

SEQ ID NO: 366401 - RNA, 64 nt, Homo Sapiens
gagagugugauguucacuauaaccccauaccuacauucccuaaugauacagccaaugacaggug

SEQ ID NO: 366402 - RNA, 64 nt, Homo Sapiens
aagauucucuaauugucauauuuuacuuuuuaggauucccuaauaguggacuguuuauuugcag

SEQ ID NO: 366403 - RNA, 64 nt, Homo Sapiens
uucauauugugauccuaaauuuuauauucacuauauucccuaaaguauaccuuaauaaauauuu

SEQ ID NO: 366404 - RNA, 64 nt, Homo Sapiens
ugguccugucaagcaaccuaacaggcuaguucuaauucccuauuggguagaugaggggaugaca

SEQ ID NO: 366405 - RNA, 64 nt, Homo Sapiens
gaguagcugcuuggugggacagcugauuucuuugauucccuagcugcaaaaccugaaauugacc

SEQ ID NO: 366406 - RNA, 64 nt, Homo Sapiens
uuucaucgggagaaaccacucagagauggaucccauucccuaaaggucucacagcaaaggagca

SEQ ID NO: 366407 - RNA, 64 nt, Homo Sapiens
ugaggaagcaaaaccccagggcccaccuccaucaauucccuaugaagucucuuaaagccaucua

SEQ ID NO: 366408 - RNA, 64 nt, Homo Sapiens
cgguuuugaaguuauauucuguccuguuuugucaauucccuagacuccguucugaagguucugc

SEQ ID NO: 366409 - RNA, 64 nt, Homo Sapiens
uuaaauuagauuugaagagguuuucaauaaucuuauucccuauaaaaaucaggaaaaaaauuuu

SEQ ID NO: 366410 - RNA, 64 nt, Homo Sapiens
acuuauacaagauaccauuuacacugaacauagaauucccuaguggaaugucaucuauaguuca

SEQ ID NO: 366411 - RNA, 64 nt, Homo Sapiens
caaauuucauucagaaccauuuuaguguuuuccuauucccuaccccucccacuacuuucaauga

SEQ ID NO: 366412 - RNA, 64 nt, Homo Sapiens
aacugaauguaaaacacuccuagccaguuguugcauucccuauauuuauuuacuuccaauauuu

SEQ ID NO: 366413 - RNA, 64 nt, Homo Sapiens
aaaaaaaauucuuguugaaauauuuugaaaacaaauucccuacuaucaucacaugccuccccaa

SEQ ID NO: 366414 - RNA, 64 nt, Homo Sapiens
uaaaucauuugagauuuuugguuuuuugauuucuauucccuaacuugugaagacaaugaaaaau

SEQ ID NO: 366415 - RNA, 64 nt, Homo Sapiens
acguaucucuguaaauucuucuacagucacuuagauucccuauuuggaaaauugauccaaguua

SEQ ID NO: 366416 - RNA, 64 nt, Homo Sapiens
gucccuuccuucccugaaacccugcucuauugcaauucccuauuauauucugcaucagaaaaac

SEQ ID NO: 366417 - RNA, 64 nt, Homo Sapiens
cugaacacagugucuguucagcaaacuaaccagcauucccuacagccuagggcagacaauagua

SEQ ID NO: 366418 - RNA, 64 nt, Homo Sapiens
aauuuuaugucauaagagauuuucugauaaacccauucccuaccaggguauguuuuguaucccc

SEQ ID NO: 366419 - RNA, 64 nt, Homo Sapiens
ucauccuugcugagcuaaaucccacaugauggccauucccuacuagcaguucuaagagacacug

SEQ ID NO: 366420 - RNA, 64 nt, Homo Sapiens
aacuuccaaauccccuaagccauuccugggaaauauucccuagagacucauucugaaggagccc

SEQ ID NO: 366421 - RNA, 64 nt, Homo Sapiens
gaucuuuuugaaaauauaggugguaugcaucagaauucccuauaaagaaauggguuuuaaacuu

SEQ ID NO: 366422 - RNA, 64 nt, Homo Sapiens
gcugccccgcagaggggcuuuggccccucugaggauucccuaggcagcccccagggcuuccuuc

SEQ ID NO: 366423 - RNA, 64 nt, Homo Sapiens
uacagugcaggaaccaaaacuuguucaucucaugauucccuacaucugacauaaggaaaguaag

SEQ ID NO: 366424 - RNA, 64 nt, Homo Sapiens
ccccugaggaaauggaaugaaccacucccugcccauucccuauaagaauaucccaagacccagg

SEQ ID NO: 366425 - RNA, 64 nt, Homo Sapiens
uaaaaaacuccuguguggcagaaaguaaaagaaaauucccuaaauuauagcaaggaacaugaau

SEQ ID NO: 366426 - RNA, 64 nt, Homo Sapiens
cauccugugccucaccacaggccuguucucugccauucccuagucuugaacugacaguaggcca

SEQ ID NO: 366427 - RNA, 64 nt, Homo Sapiens
acccuauucuuaccuagccuucucacuuacccccauucccuauucucuccuugcuuuucucacc

SEQ ID NO: 366428 - RNA, 64 nt, Homo Sapiens
ucccuccugccccuggucuggggaggccaaggccauucccuaacccugcagccuggaaagagga

SEQ ID NO: 366429 - RNA, 64 nt, Homo Sapiens
cugauuggaagugguuucuuugacuuucaaggucauucccuaucaguuacuacuaagaguucuc

SEQ ID NO: 366430 - RNA, 64 nt, Homo Sapiens
cuguauuuaucacuggcacaauugauguguuuugauucccuaaaacaaaauuagggagucaaac

SEQ ID NO: 366431 - RNA, 64 nt, Homo Sapiens
aucugauguauuaucagugaaaaccaugcugcuuauucccuaauacaaugguucucaaacuuua

SEQ ID NO: 366432 - RNA, 64 nt, Homo Sapiens
gguuuaguucucaggcagcuacaaaugccuauuuauucccuaauguaccugaacacuaguacca

SEQ ID NO: 366433 - RNA, 64 nt, Homo Sapiens
agaaacuacuuacaugugcauagcaccaaauuccauucccuagauuauuugucugcccuaccca

SEQ ID NO: 366434 - RNA, 64 nt, Homo Sapiens
cuuccuuccgagggagucagaucuuaguucuuccauucccuacuucaccuggggaagccccgga

SEQ ID NO: 366435 - RNA, 64 nt, Homo Sapiens
ucgaauuuauugguaccaaaaucuaaaaaaaccgauucccuaauaaaauacucuguaauucuac

SEQ ID NO: 366436 - RNA, 64 nt, Homo Sapiens
cacaauuuuaugaagggagagcuuaauuguuaauauucccuaaaaaaauuacuauuguauacaa

SEQ ID NO: 366437 - RNA, 64 nt, Homo Sapiens
ucuuugaucccuuuuccccccaugugugcugaguauucccuauuuuguauguauuguggaucug

SEQ ID NO: 366438 - RNA, 64 nt, Homo Sapiens
uacuuguacauaugauuuguacuucugcugugagauucccuagugucaaaauuaaaucaauaaa

SEQ ID NO: 366439 - RNA, 64 nt, Homo Sapiens
ccuguuugcucuucaggaaagaagaucgugacaaauucccuaccauuagagccgcuuccauuaa

SEQ ID NO: 366440 - RNA, 64 nt, Homo Sapiens
uuuaaaaaaccauuucaguguacauuguguacuaauucccuacuagccaguuugggacauuggc

SEQ ID NO: 366441 - RNA, 64 nt, Homo Sapiens
ugauaguaccaucucuuucacauacuacauacaaauucccuaauaaucaaaagauuguacacau

SEQ ID NO: 366442 - RNA, 64 nt, Homo Sapiens
agcacaauacuaucuccugaaagagauaagagacauucccuagauucaaaggcaaaacagaaga

SEQ ID NO: 366443 - RNA, 64 nt, Homo Sapiens
cagcugauguuaaacuuuucauauuucaaauuagauucccuaggagguauaauauauauuucuu

SEQ ID NO: 366444 - RNA, 64 nt, Homo Sapiens
gauuaggguucuucuuauccucagggacaugagcauucccuauaccuuacugaccuguccuccu

SEQ ID NO: 366445 - RNA, 64 nt, Homo Sapiens
uagcaaggccaacccugaagaggcccuuugaggcauucccuauggcuuagaguuguagacuuac

SEQ ID NO: 366446 - RNA, 64 nt, Homo Sapiens
aggagaggccuugggcccagccaucccccacuggauucccuacaaagaggcuguagucaugucc

SEQ ID NO: 366447 - RNA, 64 nt, Homo Sapiens
cugcaaaccuuuccaacuuccccacucccaauucauucccuaaccgaaaugggugccgccggcc

SEQ ID NO: 366448 - RNA, 64 nt, Homo Sapiens
ugugcuguguucgugucuugguugcuuccuccugauucccuaauauuucauucuuugugaaaug

SEQ ID NO: 366449 - RNA, 64 nt, Homo Sapiens
aaggcccagaccuccugguaaagcacacacguccauucccuacuccggugccugcagccuucau

SEQ ID NO: 366450 - RNA, 64 nt, Homo Sapiens
ucaaaagguugguuuauuuguauuuuauuuucaaauucccuauuccaaaaauagugccgggugg

SEQ ID NO: 366451 - RNA, 64 nt, Homo Sapiens
uuaauaaaaguugccauuucaacuacgucccaacauucccuaauaggguauucagggaaccugu

SEQ ID NO: 366452 - RNA, 64 nt, Homo Sapiens
aaaguaaaguaaugcauuugagcauggccagacuauucccuaggacaaggaagcagagggaaau

SEQ ID NO: 366453 - RNA, 64 nt, Homo Sapiens
gugcaugugacucaguaacuucacauagaauaugauucccuaaguaugcuacacagcaucauau

SEQ ID NO: 366454 - RNA, 64 nt, Homo Sapiens
uagcaacagugguuagaugaauaauuaaauaaauauucccuaugauuaauagagauagcaaggg

SEQ ID NO: 366455 - RNA, 64 nt, Homo Sapiens
uuuuuuacauuccgagcaagagauuucauagagaauucccuaaaucaacuaugagguggaucgg

SEQ ID NO: 366456 - RNA, 64 nt, Homo Sapiens
cacauugaauccuuuuugccuccauuuucuuuggauucccuauucaaucccuauuuuugucugu

SEQ ID NO: 366457 - RNA, 64 nt, Homo Sapiens
aaguaaauucauuuacaaugacacagccacauaaauucccuaggugggcuugcaaccucucauc

SEQ ID NO: 366458 - RNA, 64 nt, Homo Sapiens
ugcuuauaaaguaaauuuacuuacuaaauaaagaauucccuagcugaacuuuuauguuaggaca

SEQ ID NO: 366459 - RNA, 64 nt, Homo Sapiens
ggaaaggugauaccagcucuuaauuucaggcagcauucccuauguuuuaccuuugggaauaugu

SEQ ID NO: 366460 - RNA, 64 nt, Homo Sapiens
uauuugacaaaaaauccaguguuauuuaaagagaauucccuauuggccaugaagugaggagaug

SEQ ID NO: 366461 - RNA, 64 nt, Homo Sapiens
uuaucguaauagaaacuuauccaguuugaaaaucauucccuaaagcaugcaauaggaaaaagaa

SEQ ID NO: 366462 - RNA, 64 nt, Homo Sapiens
uacagugaaauucuaucuuguuaggaugaacuagauucccuaauacaugcaaaagacuauuaag

SEQ ID NO: 366463 - RNA, 64 nt, Homo Sapiens
gacaaaccugacaaaaacaagcaauggggaaaggauucccuauuuaauaaauggugcugggaaa

SEQ ID NO: 366464 - RNA, 64 nt, Homo Sapiens
ucagggcauuaccgcuaacgucugcaggagcuuuauucccuauuaauagaaaaccgucacagug

SEQ ID NO: 366465 - RNA, 64 nt, Homo Sapiens
aaauacccaaaugucccugcaagcccguuaaauaauucccuaugcuacccuuaauaacauacaa

SEQ ID NO: 366466 - RNA, 64 nt, Homo Sapiens
aagagaaucuaaucuaauuguuuuuauaaaaauuauucccuauugaauauuuauauaaugaggu

SEQ ID NO: 366467 - RNA, 64 nt, Homo Sapiens
uuaauauaagaaaccuacuagcauucaaauaaucauucccuauuuuacaaugcaucaguucugu

SEQ ID NO: 366468 - RNA, 64 nt, Homo Sapiens
uacuaaacaugaacagacauuuuuucuugucauuauucccuaaacuauauaguauaauaaauau

SEQ ID NO: 366469 - RNA, 64 nt, Homo Sapiens
agaaucguuaauaguggagcccaaaacaggccucauucccuacccuugacugguuuagcugugg

SEQ ID NO: 366470 - RNA, 64 nt, Homo Sapiens
ucuuuccaggaugcagaaagggaugauagcuuggauucccuagggguucccugaaggaggagag

SEQ ID NO: 366471 - RNA, 64 nt, Homo Sapiens
cuagcaaaccagauaagaaaagauguuaaugcccauucccuaacuuaugucuuagaccaaaauu

SEQ ID NO: 366472 - RNA, 64 nt, Homo Sapiens
cucacuccuguucccuuauucuucauucccaguaauucccuaccaaaugguggggacccugagc

SEQ ID NO: 366473 - RNA, 64 nt, Homo Sapiens
acacuggccuugccaucuuguuuuguggcuuaccauucccuagcgcucucagaucucuauuuca

SEQ ID NO: 366474 - RNA, 64 nt, Homo Sapiens
gaaggagacaccuuuuccccucaccacguuauauauucccuaccuucugccuagugacagguua

SEQ ID NO: 366475 - RNA, 64 nt, Homo Sapiens
gauuuuuggagaaaggauuuaagaaaaaggaugcauucccuacauccaaggaaacgccuguagg

SEQ ID NO: 366476 - RNA, 64 nt, Homo Sapiens
gagauuccaccccaauaucaggggguucucgccaauucccuaauucagucccccaguccugagu

SEQ ID NO: 366477 - RNA, 64 nt, Homo Sapiens
gccuccuagggucccuuuuucugaugaagucuuaauucccuaaaagcgccucuuuggacacuga

SEQ ID NO: 366478 - RNA, 64 nt, Homo Sapiens
ugucuuauuucauagguacauuugcacuggacauauucccuaccgcacaggugugaguccucug

SEQ ID NO: 366479 - RNA, 64 nt, Homo Sapiens
uguuuuauuucauagguacauuugcacuggacauauucccuaccgcacaggugugaguccucug

SEQ ID NO: 366480 - RNA, 64 nt, Homo Sapiens
gccaaaauuucuccuggauccccaggcaaauaaaauucccuaaacaauuauuucccccauuuuu

SEQ ID NO: 366481 - RNA, 64 nt, Homo Sapiens
aggccugccacagccuagauggaacuuuuuguccauucccuagucucagccaguggaacgugcc

SEQ ID NO: 366482 - RNA, 64 nt, Homo Sapiens
uugauaacaauggaagcgaguuuaauauaaaacaauucccuaagcauuuauuuuuuuuuuaaaa

SEQ ID NO: 366483 - RNA, 64 nt, Homo Sapiens
ugaaccaugagggcccucugcccaggugaugggcauucccuaagcugcuauggaaucugcuccc

SEQ ID NO: 366484 - RNA, 64 nt, Homo Sapiens
auuuuuuucuauaaucacuaugaccguguucacgauucccuacucugcaacucucagcaugcau

SEQ ID NO: 366485 - RNA, 64 nt, Homo Sapiens
accagaggacuuucuuguuagcaucccuuuccugauucccuauuuuguuaauuuuaaugauaag

SEQ ID NO: 366486 - RNA, 64 nt, Homo Sapiens
cacaaaacagccuuagccuccuuguugccaaauaauucccuaacuguggaguuuuaggaaguca

SEQ ID NO: 366487 - RNA, 64 nt, Homo Sapiens
ccucaccaccucuuucuacagccuaauuuauuggauucccuauucguagccaucuccguggcca

SEQ ID NO: 366488 - RNA, 64 nt, Homo Sapiens
gcuuguuggaggaacuaguucuggauccgaguagauucccuaggacaguguuuccaagagcaag

SEQ ID NO: 366489 - RNA, 64 nt, Homo Sapiens
cagggaauuuacuacccuauaucucacuggcugcauucccuacagagcccuucuaccuggcucu

SEQ ID NO: 366490 - RNA, 64 nt, Homo Sapiens
uacaaacaucagcguuauuacuaaaaugacauuuauucccuagcgcaaacugaccggccuaaaa

SEQ ID NO: 366491 - RNA, 64 nt, Homo Sapiens
gaguuaaugaaacagacacuugugaauaaaauggaaauugcauuagaguagaggauacaaguga

SEQ ID NO: 366492 - RNA, 64 nt, Homo Sapiens
guccauaaguaaaguuuuauauuauaugaaauucaaauugcaguauauuuugugucacaugaaa

SEQ ID NO: 366493 - RNA, 64 nt, Homo Sapiens
cauauaaauaaguguuuuuguuacugaaaaaugcaaauugcaauaggucugaggaugauguaga

SEQ ID NO: 366494 - RNA, 64 nt, Homo Sapiens
cagaggggcacgucugggcacaggcagagacugaaaauugcagaugccucccucaaaggaccug

SEQ ID NO: 366495 - RNA, 64 nt, Homo Sapiens
uguucuccuacaagcaaccugugagaaacugaucaaauugcacuauuaucagcucaguagagca

SEQ ID NO: 366496 - RNA, 64 nt, Homo Sapiens
ugcauauuugucuauuuuuuguuggaaaagcuguaaauugcaugaagugaagcacaaggauuaa

SEQ ID NO: 366497 - RNA, 64 nt, Homo Sapiens
uugugcaacagaaccauuaagcuucuaaugugguaaauugcacaaugcaauuuuacuuugucua

SEQ ID NO: 366498 - RNA, 64 nt, Homo Sapiens
gacuucuuaaagaaguuugagucuucuccaaaguaaauugcaugaucaaauaucuugcuuuugg

SEQ ID NO: 366499 - RNA, 64 nt, Homo Sapiens
uaguuaacuuuucaucaugucuauaguaauuuagaaauugcaaaccugucacauguuucuguuu

SEQ ID NO: 366500 - RNA, 64 nt, Homo Sapiens
ccccagcauaaauggguuagauuuuucacacaaaaaauugcaacaaagucauugccaaggucug

SEQ ID NO: 366501 - RNA, 64 nt, Homo Sapiens
ccugcaguucuggaccauguggagcuacauggagaaauugcacagacagaaucacuuugccaca

SEQ ID NO: 366502 - RNA, 64 nt, Homo Sapiens
ggcccucccuccaggguagagaugcaccgaauggaaauugcacuaaggaccucuuccuuugcug

SEQ ID NO: 366503 - RNA, 64 nt, Homo Sapiens
gaagcgaucaagaauccagauucuauaacaaaucaaauugcacuuuuggaagcccggugucaug

SEQ ID NO: 366504 - RNA, 64 nt, Homo Sapiens
aacauaacaaaaaguguugcuguaaauccaaaagaaauugcaucuaagggacuuuguugaacuu

SEQ ID NO: 366505 - RNA, 64 nt, Homo Sapiens
auauaaaauuaugagauugguuuuccuguggcauaaauugcaucacuguaucauuuucuuuuuu

SEQ ID NO: 366506 - RNA, 64 nt, Homo Sapiens
auugccucugaaaaguguguauauauuuugugugaaauugcauacuuuguauuuugauuauuuu

SEQ ID NO: 366507 - RNA, 64 nt, Homo Sapiens
auuuggcaaucuucauauaauuaaaauaguguucaaauugcaaaacuuuaaggacauucaaagu

SEQ ID NO: 366508 - RNA, 64 nt, Homo Sapiens
ugauuugauaauuaagcaccgugacagacaaguaaaauugcagguucauaucuagguauccauu

SEQ ID NO: 366509 - RNA, 64 nt, Homo Sapiens
aaaggcucaauauccaagagacuaauggacaaucaaauugcagaaccguguuguaaagauaccc

SEQ ID NO: 366510 - RNA, 64 nt, Homo Sapiens
auuuucuaauuucaagucuuaggaugagccacagaaauugcauaaaucuguuaccaguaggagg

SEQ ID NO: 366511 - RNA, 64 nt, Homo Sapiens
auguaauauaucaaagucaggaauugauugccagaaauugcaagaaauuuugucuauugucuua

SEQ ID NO: 366512 - RNA, 64 nt, Homo Sapiens
gauaagaauagguugauacauuguccugaugucuaaauugcaguaaauuguaagcuauuuuuuu

SEQ ID NO: 366513 - RNA, 64 nt, Homo Sapiens
cugaggauaaauaauaaaacaucagucaucagguaaauugcaaguuaagucaacaaaaugcaau

SEQ ID NO: 366514 - RNA, 64 nt, Homo Sapiens
uuuuaaacucacgauaccaguuaucuguuaaucaaaauugcauuuuacaauuuaauaaugugau

SEQ ID NO: 366515 - RNA, 64 nt, Homo Sapiens
uauuggccaauuaucuuuaauaauuuaccuuuugaaauugcauguuuaucauauauccuuaagu

SEQ ID NO: 366516 - RNA, 64 nt, Homo Sapiens
uuuuuuuuuuuuaaacaguaacauccagagugacaaauugcaggagauuuaauguauaaaauuu

SEQ ID NO: 366517 - RNA, 64 nt, Homo Sapiens
uuccauuccauuauuacaagugaugaaaaacaaaaaauugcaaguaguaugcaaauuauaaaua

SEQ ID NO: 366518 - RNA, 64 nt, Homo Sapiens
ggucaacucuugacaguugccucaagauggagugaaauugcaucgaggguaagacuguguccac

SEQ ID NO: 366519 - RNA, 64 nt, Homo Sapiens
ucuuugggauaauuccuauccuuuucagggaggcaaauugcacgugaguuuaaguaugaaggca

SEQ ID NO: 366520 - RNA, 64 nt, Homo Sapiens
agugaucauaaugagguuugauuuuaggugacugaaauugcaucuauuaauagucaugguucgu

SEQ ID NO: 366521 - RNA, 64 nt, Homo Sapiens
uauguauauagacaugcacagugucaccucccugaaauugcauaucaugaccucucagaauaag

SEQ ID NO: 366522 - RNA, 64 nt, Homo Sapiens
aauaggcucugcuaacgugauugaaauccuuucuaaauugcauggccuuuugguuugggcugua

SEQ ID NO: 366523 - RNA, 64 nt, Homo Sapiens
gagagguugauaugcaccuguaagauacagauguaaauugcauguaaaccaguuucucauugca

SEQ ID NO: 366524 - RNA, 64 nt, Homo Sapiens
uucagauguuuacuacgaggccacacugaaugugaaauugcaugaaccuaugacacuucuuauu

SEQ ID NO: 366525 - RNA, 64 nt, Homo Sapiens
uaaaccacuuucuaauuuuuagaggaauccauguaaauugcaaauauacuaaaccucacaaagu

SEQ ID NO: 366526 - RNA, 64 nt, Homo Sapiens
acauuucaauuauacuaaacgguaauguuccugaaaauugcaauccaccuaauaucaauuugua

SEQ ID NO: 366527 - RNA, 64 nt, Homo Sapiens
uguaaucccagcuacucaggaggcugaggcaggaaaauugcaugaaccuaaguggcagagguug

SEQ ID NO: 366528 - RNA, 64 nt, Homo Sapiens
aauauuuacauauuuugcuguaguauuugaguauaaauugcagauacuauaacacaucacaucu

SEQ ID NO: 366529 - RNA, 64 nt, Homo Sapiens
uuuuaaaauuuauuuuugacuaaaaccccaaaguaaauugcaaagauuagcaaaauuauuaauu

SEQ ID NO: 366530 - RNA, 64 nt, Homo Sapiens
agauuagcaaaauuauuaauuuaaggacauuuuaaaauugcaugacagcccuuaaaauuuuagc

SEQ ID NO: 366531 - RNA, 64 nt, Homo Sapiens
uguuucauggauuuuucaucuucuaccguaugugaaauugcaaguguuugaagauuuauaagua

SEQ ID NO: 366532 - RNA, 64 nt, Homo Sapiens
aaggugccacucaguuuuagccaugucuucacugaaauugcaaaaguacuuuuagggagcagga

SEQ ID NO: 366533 - RNA, 64 nt, Homo Sapiens
ccuaaaucaccuggaaggagagcauuacucaccaaaauugcaaaacaaggguaucaagaauuug

SEQ ID NO: 366534 - RNA, 64 nt, Homo Sapiens
auauuggauauaaugcugcuuuuuagagacaccuaaauugcaguaucagaaugaauguugaugu

SEQ ID NO: 366535 - RNA, 64 nt, Homo Sapiens
gcaaagcuugcuuuggggaguuggauaaugugaaaauuuuaaguaccuaggggagaaagagcca

SEQ ID NO: 366536 - RNA, 64 nt, Homo Sapiens
guaagaccguggacuguuuuuuauaauauggccuaauuuuaaagguccaaaauaacuuguuuuu

SEQ ID NO: 366537 - RNA, 64 nt, Homo Sapiens
uuccucugcccuuuuaacuaaacuaaaacuugugaauuuuaaauuauuaaggggggggugcugu

SEQ ID NO: 366538 - RNA, 64 nt, Homo Sapiens
aagcccaaaaauagauuguggcucccaggauuccaauuuuaauuggagagcuaaguaaguaaag

SEQ ID NO: 366539 - RNA, 64 nt, Homo Sapiens
gugauuuuaaaaaccagaauuuuaguugcaauacaauuuuaauaucacccuacauauuauuuau

SEQ ID NO: 366540 - RNA, 64 nt, Homo Sapiens
caguagauaagcugucgaaaauggaaaacaauucaauuuuaauuuucugcucugaguauuuagu

SEQ ID NO: 366541 - RNA, 64 nt, Homo Sapiens
ucaguguacugcaaggaagccaccuuuuguauuuaauuuuaaagucugcacccuuaccccuuuc

SEQ ID NO: 366542 - RNA, 64 nt, Homo Sapiens
auuuugauuguuugccauaugacuuucuaaguuaaauuuuaaaauuuugaaaauaaugaucuca

SEQ ID NO: 366543 - RNA, 64 nt, Homo Sapiens
ggaaauauauaauaaaaauguuuugucuugaaugaauuuuaaaagccaucgucuuuguuuucuu

SEQ ID NO: 366544 - RNA, 64 nt, Homo Sapiens
gacauugauuccacauguaaaauucuuuaucugaaauuuuaaaauguaugucuccucaaaugaa

SEQ ID NO: 366545 - RNA, 64 nt, Homo Sapiens
auacuacaauauuuaacuaauuuuucaauauacaaauuuuaaaaacuuaacagcucauuuuguc

SEQ ID NO: 366546 - RNA, 64 nt, Homo Sapiens
ugauugcugacuuggauaauaaucauguuauguuaauuuuaacaaauaucugucaacaguuaau

SEQ ID NO: 366547 - RNA, 64 nt, Homo Sapiens
ugaaaauuaagucuucacuuuaggaaacagguauaauuuuaaugaauauuuugagauauaaaag

SEQ ID NO: 366548 - RNA, 64 nt, Homo Sapiens
gucucuacaacuuugaauaaauccccuuucccggaauuuuaaguugacuuaaauuccuauuuga

SEQ ID NO: 366549 - RNA, 64 nt, Homo Sapiens
gcaguuguuucuuuccuaagcuguuuaaccucagaauuuuaaagcuaaagaacaguuagaguaa

SEQ ID NO: 366550 - RNA, 64 nt, Homo Sapiens
aaacuuuuuaauugugcaaaaaaacaucacuaucaauuuuaaggauauauaauuuaauguaaau

SEQ ID NO: 366551 - RNA, 64 nt, Homo Sapiens
caagaaaugacagucaaaagauguuuuccacauaaauuuuaauuccaauaaaauguaucugcau

SEQ ID NO: 366552 - RNA, 64 nt, Homo Sapiens
uaauuauuuuugacuaugaaaauuuuguuucauaaauuuuaaaaauauuuccuauauaacuaaa

SEQ ID NO: 366553 - RNA, 64 nt, Homo Sapiens
auuauuaagguuuuaugaagaacucuaugaaagcaauuuuaaaaaauuguuuuauaauaaucca

SEQ ID NO: 366554 - RNA, 64 nt, Homo Sapiens
acgcacaaaaaaauacagaacaagcacaguauaaaauuuuaacauuuaucacuguguauuuuuc

SEQ ID NO: 366555 - RNA, 64 nt, Homo Sapiens
ggaaaaauguaucuguuccuauuaggcugcgugaaauuuuaaaaacuacuguucuauuugcaau

SEQ ID NO: 366556 - RNA, 64 nt, Homo Sapiens
uugguacguuauguccugguuuaaaaaggauuaaaauuuuaaaauaauccuugcaucuaaaggc

SEQ ID NO: 366557 - RNA, 64 nt, Homo Sapiens
uuuuuuuuuuugugcuggaagucuguaucuugacaauuuuaauaaaucagcuggaacugauaga

SEQ ID NO: 366558 - RNA, 64 nt, Homo Sapiens
acacucgugugcaugagaaugucauuugcuaaugaauuuuaaaagcauauauaaaacaaaacaa

SEQ ID NO: 366559 - RNA, 64 nt, Homo Sapiens
uaacaauugauuuucccccuaauucuuauuuuauaauuuuaaaauugcagcaguugcuagcaac

SEQ ID NO: 366560 - RNA, 64 nt, Homo Sapiens
uuaacaugcauugcuuuaauuuugcccagggacaaauuuuaauaaucagcaagacugguuugug

SEQ ID NO: 366561 - RNA, 64 nt, Homo Sapiens
ugauuuuuuuuagcugaaaaaugcuggcaagaagaauuuuaaagcuuaaaauaggugguaaauu

SEQ ID NO: 366562 - RNA, 64 nt, Homo Sapiens
ugccagaauuucuaaauaaauccccugguuaggaaauuuuaaaagucaaagcuuguuuucuuca

SEQ ID NO: 366563 - RNA, 64 nt, Homo Sapiens
guuucugugauuauaaagcauuuuuuaagagacaaauuuuaacuuuuaauuuuuauuuuggcaa

SEQ ID NO: 366564 - RNA, 64 nt, Homo Sapiens
aaucguuguacauuucuuauuaaacuaagugcuuaauuuuaaaguauuauguugccaucauaua

SEQ ID NO: 366565 - RNA, 64 nt, Homo Sapiens
auggaauuauguuuauuuuuaugggauuuggguaaauuuuaaauugucuagaaaacugaaauuu

SEQ ID NO: 366566 - RNA, 64 nt, Homo Sapiens
guguaacauauguuaaauaaaacuguuauuuuugaauuuuaaaauuuguuuuuuggggguauga

SEQ ID NO: 366567 - RNA, 64 nt, Homo Sapiens
uaguucacuaaagggugcccacaaaauagagauuaauuuuaacuuaaauuuuaagcuugaagau

SEQ ID NO: 366568 - RNA, 64 nt, Homo Sapiens
gggugcccacaaaauagagauuaauuuuaacuuaaauuuuaagcuugaagauuagguacuaucu

SEQ ID NO: 366569 - RNA, 64 nt, Homo Sapiens
uuaauuaacuaugugauguuaacuauuauuaauaaauuuuaacauuuuccaaaauaaucaaaug

SEQ ID NO: 366570 - RNA, 64 nt, Homo Sapiens
aauuucuugggguuaaccaucuuuaguuaaauggaauuuuaauuuaaaugacgcuuugcuaauu

SEQ ID NO: 366571 - RNA, 64 nt, Homo Sapiens
uuaaauggaauuuuaauuuaaaugacgcuuugcuaauuuuaaguguuaagcauuuugcauuaaa

SEQ ID NO: 366572 - RNA, 64 nt, Homo Sapiens
cuagacaaauaacuacugcaaaaaguacauagugaauuuuaaaauguagaagaaagcaaaaaau

SEQ ID NO: 366573 - RNA, 64 nt, Homo Sapiens
aaaauaaaauaaguccuaaagugaagaagccaucaauuuuaacauuugaugucuagauaacauu

SEQ ID NO: 366574 - RNA, 64 nt, Homo Sapiens
aaauuugauuuuaaauuucaaauaaauuuaaauaaauuuuaaauaaauuuuaaauaaaauuuua

SEQ ID NO: 366575 - RNA, 64 nt, Homo Sapiens
uaaauuucaaauaaauuuaaauaaauuuuaaauaaauuuuaaauaaaauuuuacagagacgugg

SEQ ID NO: 366576 - RNA, 64 nt, Homo Sapiens
ccccaucaaagcugaacuugaaacguuuuagcagaauuuuaaauaugugaaaguucauuguggu

SEQ ID NO: 366577 - RNA, 64 nt, Homo Sapiens
aaguguaacuguaucauacuuuuuuuguauuuuaaauuuuaaaauaaaggcuaauauauuuaga

SEQ ID NO: 366578 - RNA, 64 nt, Homo Sapiens
uauuuagacaggauuuccaaaaacuuugucuucaaauuuuaauuuucuuccuaauauucuucac

SEQ ID NO: 366579 - RNA, 64 nt, Homo Sapiens
auuauaaaacucuugaggcacuugguauguuaaaaauuuuaaacuuuaguaacauuagguuaca

SEQ ID NO: 366580 - RNA, 64 nt, Homo Sapiens
aguuauuauaaauguuaauacacaacuuucagguaauuuuaacugauuauuucuuuugcucuuu

SEQ ID NO: 366581 - RNA, 64 nt, Homo Sapiens
aaguaaccaacugaacgacaaagcaugguauuugaauuuuaaauuaaagcaaaguaaauaaaag

SEQ ID NO: 366582 - RNA, 64 nt, Homo Sapiens
uuuccaauaugcuguauagccuuugucauuuuauaauuuuaauuccugauuaaaacagucugua

SEQ ID NO: 366583 - RNA, 64 nt, Homo Sapiens
aagggaguuuuugauaguugaaucuuuguaccaaaauuuuaaaacauuuuauuaagcuuuuugg

SEQ ID NO: 366584 - RNA, 64 nt, Homo Sapiens
ccauucugauuauugaguucuuaaauuuuaacuaaauuuuaaagauuccaaauucauggcaugc

SEQ ID NO: 366585 - RNA, 64 nt, Homo Sapiens
aaauuuuaaagccauucugaucauggcaugcuuaaauuuuaacuaauauauuaaaauuccaaau

SEQ ID NO: 366586 - RNA, 64 nt, Homo Sapiens
uaugcauuauuaaauuguaacaugaguuaucaugaauuuuaaaguagugaguauagugggguuc

SEQ ID NO: 366587 - RNA, 64 nt, Homo Sapiens
cacaucaccugaaaaguaaaacugcuaguuucuuaauuuuaauugaacuugacuguaguagaau

SEQ ID NO: 366588 - RNA, 64 nt, Homo Sapiens
uuccagaauaaucuccuuugcagcagggcugucaaauuuuaaaggcccaugcaaguccgaaauc

SEQ ID NO: 366589 - RNA, 64 nt, Homo Sapiens
ugucuuuuucuuuucuauuacuucaacaaaaucuaauuuuaaauaaaguugcacuuauaacacc

SEQ ID NO: 366590 - RNA, 64 nt, Homo Sapiens
guguacuucuuaggcuuucauacugacuuuuuaaaauuuuaacaaaggucugaaaugagaaaca

SEQ ID NO: 366591 - RNA, 64 nt, Homo Sapiens
gcuucccuuucuugcagagaucaguaugccuguuaauuuuaagauguaguagaugcuuccagug

SEQ ID NO: 366592 - RNA, 64 nt, Homo Sapiens
agguugcaauguaucaugcuagugguguacauuuaauuuuaaaaagaaguagcuuuuuauuccu

SEQ ID NO: 366593 - RNA, 64 nt, Homo Sapiens
cuaauuguaguuuuuguguauugaauuucaauaaaauuuuaaaguaauuuguuaaauucuaaac

SEQ ID NO: 366594 - RNA, 64 nt, Homo Sapiens
aauguauaauuggcauaucacagguagcaucugaaauuuuaaugucauugagauaagaauaauu

SEQ ID NO: 366595 - RNA, 64 nt, Homo Sapiens
uuuacaacaauaaaccauguucuuugagaaagacaauuuuaauguuuuuuucugauaaauucuu

SEQ ID NO: 366596 - RNA, 64 nt, Homo Sapiens
uugccauauucuguaguauuuuuguuugaguaagaauuuuaauaauugucaguuaauuuauuau

SEQ ID NO: 366597 - RNA, 64 nt, Homo Sapiens
auucuuucauucuuacuuuugaucagacuuugaaaauuuuaaaacacugauuuugaaauacuaa

SEQ ID NO: 366598 - RNA, 64 nt, Homo Sapiens
cguguguaugacacaguaacguugcugauuacagaauuuuaaggaugcgauacggcaccuggug

SEQ ID NO: 366599 - RNA, 64 nt, Homo Sapiens
acaugcaguauuuguaucaugaaaaacagacugaaauuuuaaaguaaacuuuuugaacucagua

SEQ ID NO: 366600 - RNA, 64 nt, Homo Sapiens
ggacucaccaaaaguacuagguaaugccagaaaaaauuuuaagaaaaaagugacucucagauug

SEQ ID NO: 366601 - RNA, 64 nt, Homo Sapiens
aauauuacuaauugcccaaauaaagcuguuguuaaauuuuaaacaguaaagaacaacaacaaaa

SEQ ID NO: 366602 - RNA, 64 nt, Homo Sapiens
gcaccugaaaaaccugggcagugugguaguucuaaauuuuaauuagagugcagccaaugccuuu

SEQ ID NO: 366603 - RNA, 64 nt, Homo Sapiens
auccuuuauaaucaggacugauuuuuaauaauguaauuuuaaaaugaaagaagaauaaauacau

SEQ ID NO: 366604 - RNA, 64 nt, Homo Sapiens
ucucuuagccuacugauuggacucauauguauggaauuuuaaauuaaucggcauuaauaccuag

SEQ ID NO: 366605 - RNA, 64 nt, Homo Sapiens
uguuuaggaaauuuauacaaggggauuuaauuuuaauuuuaaaauuuugugugugcuggaggga

SEQ ID NO: 366606 - RNA, 64 nt, Homo Sapiens
uuaaaauguuuaggaaauuugagggaggggauuuaauuuuaauuuuuuuuuuuugugugugcug

SEQ ID NO: 366607 - RNA, 64 nt, Homo Sapiens
gcccuauucucucagacgguggaauauuuggaaaaauuuuaaaacaauuaaaauuuuaaagcaa

SEQ ID NO: 366608 - RNA, 64 nt, Homo Sapiens
gguggaauauuuggaaaaauuuuaaaacaauuaaaauuuuaaagcaaucuuggcagacuaaaac

SEQ ID NO: 366609 - RNA, 64 nt, Homo Sapiens
uauuuuuaauuaggguauaugaauauuuugcaauaauuuuaauaauuauuaagcuguuugaagg

SEQ ID NO: 366610 - RNA, 64 nt, Homo Sapiens
guggaggauuuuuuuucucauuuuucuaguguuaaauuuuaaccagcauuaacaugguagagug

SEQ ID NO: 366611 - RNA, 64 nt, Homo Sapiens
accuugaaaugauuauaaaauagauuuucaugggaauuuuaaaaacucuauccaaaacauuuuu

SEQ ID NO: 366612 - RNA, 64 nt, Homo Sapiens
gccgaaaagccuauuauguaauuuuuacauucauaauuuuaauguggaugaucaggauuaaauc

SEQ ID NO: 366613 - RNA, 64 nt, Homo Sapiens
uaucuguauuuaaagaugugacaaucuugacaccaauuuuaagaauagcugugagaccgaauua

SEQ ID NO: 366614 - RNA, 64 nt, Homo Sapiens
guaaagacgucuaaacuuguuugaugugacuuuuaauuuuaaauacggguaacaaucugaggca

SEQ ID NO: 366615 - RNA, 64 nt, Homo Sapiens
gagcuuuuagucugauuguuuccauuucccauguaauuuuaaguuaagcuaaaguuuuaaagug

SEQ ID NO: 366616 - RNA, 64 nt, Homo Sapiens
uauacaauggaagcacaauguuauaaggaaagguaauuuuaagcuaacaaccagugcacagccu

SEQ ID NO: 366617 - RNA, 64 nt, Homo Sapiens
caaaaaaguauaaaucuuuuaaggaaaauguuagaauuuuaaaguuuuuuuuugauuguugaag

SEQ ID NO: 366618 - RNA, 64 nt, Homo Sapiens
cauagaagggggacuucuaggaauuuauaaccaaaauuuuaaaacuauuuuuauauuuuuuuaa

SEQ ID NO: 366619 - RNA, 64 nt, Homo Sapiens
uaaaacuauuuuuauauuuuuuuaaaucuuuaaaaauuuuaauuacugugauauugauuauaca

SEQ ID NO: 366620 - RNA, 64 nt, Homo Sapiens
gggaaaauugcauagcuuuuuguaacauuuacuuaauuuuaaaacuaaacucauacuuuugcua

SEQ ID NO: 366621 - RNA, 64 nt, Homo Sapiens
uauauuuaacuauauauaaauacgcauauauuguaauuuuaaugucugcuuagcaccccacuga

SEQ ID NO: 366622 - RNA, 64 nt, Homo Sapiens
ccccacugauaaccaaaucacaguuuauuuaaauaauuuuaaugacuuuucaaaaacaauuuau

SEQ ID NO: 366623 - RNA, 64 nt, Homo Sapiens
agggcaaagauaagaacaauauuagcuguuacgaaauuuuaacuguaucuuccaaaaugagugg

SEQ ID NO: 366624 - RNA, 64 nt, Homo Sapiens
ucacaagaguauaaaagaucucuggcuuugcugaaauuuuaagcaagaaguucuauuuaaugga

SEQ ID NO: 366625 - RNA, 64 nt, Homo Sapiens
gcaggugcaugauacucuucagagcuauuugugaaauuuuaaagacagaagugucucagugaca

SEQ ID NO: 366626 - RNA, 64 nt, Homo Sapiens
ugcuaauauacauuuugucugugaaaauauaguaaauuuuaaaauacuaauauaaugugguauu

SEQ ID NO: 366627 - RNA, 64 nt, Homo Sapiens
aaucuaaaauguuuuaauaaucuguauuucuuauaauuuuaacacuaugagcugccuguauaag

SEQ ID NO: 366628 - RNA, 64 nt, Homo Sapiens
cucuuacguguuuauuuugagucaugagauaaucaauuuuaacccaaagucauuggauuauuua

SEQ ID NO: 366629 - RNA, 64 nt, Homo Sapiens
uauuucauauacauuguauuaaaacugccauaucaauuuuaauguauagauuuugcaaauauua

SEQ ID NO: 366630 - RNA, 64 nt, Homo Sapiens
ucaagggcugucauugcacauaagcuuccauuuuaauuuuaaagugcaaaagggccagcguggc

SEQ ID NO: 366631 - RNA, 64 nt, Homo Sapiens
uaagaauaccacaucaaauaagaaauaaugcuacaauuuuaagaggggagggaagggaaaguuu

SEQ ID NO: 366632 - RNA, 64 nt, Homo Sapiens
gaguuucaguuuuaaaagugauguccacugaugaaauuuuaaagguguuuuaugauaugguugg

SEQ ID NO: 366633 - RNA, 64 nt, Homo Sapiens
uuaucaucgaagguggugaaaaugguguuuuggaaauuuuaaaacgucauauaacucaagaaua

SEQ ID NO: 366634 - RNA, 64 nt, Homo Sapiens
aaaggacaaccacagagggaugaaaaccagaacaaauuuuaacauugaaguacaaaaggaacua

SEQ ID NO: 366635 - RNA, 64 nt, Homo Sapiens
uuaucaucaugaacuaguguuguuuguaaaacuaaauuuuaauucaaaugacaguuucaauuuu

SEQ ID NO: 366636 - RNA, 64 nt, Homo Sapiens
uugaauuuuuuuccuacaaauagugaaaaauaacaauuuuaaaucuucucuugcuaucuaagaa

SEQ ID NO: 366637 - RNA, 64 nt, Homo Sapiens
ucccaaaauacccacuauguauuuccaguaaauaaauuuuaauguaauauguaggaugucucaa

SEQ ID NO: 366638 - RNA, 64 nt, Homo Sapiens
uauaugauuuuauuuuuaacccagauguuuacauaauuuuaaccuugaaucaagaggcucuagg

SEQ ID NO: 366639 - RNA, 64 nt, Homo Sapiens
guaacauaacuguguuuacuaaucauucaaaaguaauuuuaaguucaugaagaaauccuuuauc

SEQ ID NO: 366640 - RNA, 64 nt, Homo Sapiens
uuuuaaaacagcugucaagauggagggaggaagaaauuuuaaauuacagauguguguguuuuuc

SEQ ID NO: 366641 - RNA, 64 nt, Homo Sapiens
guaagaaacuaaaguauaauuuauaauacaaaauaauuuuaaguuuuagauaaccaaguaagua

SEQ ID NO: 366642 - RNA, 64 nt, Homo Sapiens
aaucuuuauaggcuacugucuauacuaaaggauaaauuuuaaaaugcucccuugacacuuauuc

SEQ ID NO: 366643 - RNA, 64 nt, Homo Sapiens
ugugcucccaggaauagacaaaaaucugugcaauaauuuuaaaaaaaaauaaauaaaaauuaaa

SEQ ID NO: 366644 - RNA, 64 nt, Homo Sapiens
uguguucuaaguagaaacugccuuuuaguacuaaaauuuuaaccugucacuaauuauuuugagg

SEQ ID NO: 366645 - RNA, 64 nt, Homo Sapiens
aaugauuuagcacaagcuaaugccucagagcuacaauuuuaaaaacuaaguuuuuauaauaaaa

SEQ ID NO: 366646 - RNA, 64 nt, Homo Sapiens
ucguauuaguuuauguauauguaaauguaugaugaauuuuaaguaggucaagcuaaaaaaugaa

SEQ ID NO: 366647 - RNA, 64 nt, Homo Sapiens
aaaacagcuuuuuacaauuaauuuucaaaguuguaauuuuaaagaauuuggguguauaccuaug

SEQ ID NO: 366648 - RNA, 64 nt, Homo Sapiens
accuuuuauagauguuuuugauuuuguuuuaaauaauuuuaaauuauggagcuugaccuagauu

SEQ ID NO: 366649 - RNA, 64 nt, Homo Sapiens
ucauugguagcacaaauuugagcgaggccuugucaauuuuaagguggaaauaggaaggaccaca

SEQ ID NO: 366650 - RNA, 64 nt, Homo Sapiens
gcugugaacagcauuagaacuuugucuauuucuuaauuuuaaaauaugcugauaugccuuaaac

SEQ ID NO: 366651 - RNA, 64 nt, Homo Sapiens
uuuauugaaaacauugauauauugaauauucauaaauuuuaauuuaacuuucuuuuauaauccu

SEQ ID NO: 366652 - RNA, 64 nt, Homo Sapiens
uaaaacauguauuagacauucaggcuccacaauaaauuuuaaugagcacuacaaauuuagaaua

SEQ ID NO: 366653 - RNA, 64 nt, Homo Sapiens
aaauagacaauaagaugucagcaaaagugccucaaauuuuaacugcgucaaguuaagggcauug

SEQ ID NO: 366654 - RNA, 64 nt, Homo Sapiens
cuuaaugugauagagacaucucuaaaguauuuugaauuuuaaaaaaagauggcagauuuucugc

SEQ ID NO: 366655 - RNA, 64 nt, Homo Sapiens
uugguguuguucgauugucuuucauugaagagauaauuuuaauguuuuauuggcaacguaugcu

SEQ ID NO: 366656 - RNA, 64 nt, Homo Sapiens
aaguagaacccaagcaaauaaaauuauuuaaaauaauuuuaaaguggcuuaguacugccaguca

SEQ ID NO: 366657 - RNA, 64 nt, Homo Sapiens
gggcggggccaaucagucaaugauaaucugaacaaauuuuaagagcagauuuuagauuaauaau

SEQ ID NO: 366658 - RNA, 64 nt, Homo Sapiens
uuacauuuuuaauaaaagcaccaaaugccaagguaauuuuaaauuaauuaauccaauuaaugac

SEQ ID NO: 366659 - RNA, 64 nt, Homo Sapiens
gcauuauuagguuaauuaauuguuuuuuaaaaguaauuuuaagaggaacauuucuguugauaca

SEQ ID NO: 366660 - RNA, 64 nt, Homo Sapiens
uacuuguauguucggagaguaauuaaaaaaucuaaauuuuaacccagaaauuuaccuuuuaaua

SEQ ID NO: 366661 - RNA, 64 nt, Homo Sapiens
aagagcaaucaguauuauugaccuguaucaaaggaauuuuaacacauauucauuuauaaaaagu

SEQ ID NO: 366662 - RNA, 64 nt, Homo Sapiens
gaaauaacuacuguagacuauaguauauagagacaauuuuaaugcaggcuuaccuuuuaaaguu

SEQ ID NO: 366663 - RNA, 64 nt, Homo Sapiens
uauuuagcaaaucguaaacaguacccaugcuuuaaauuuuaaagcuaucuugacaauggacuua

SEQ ID NO: 366664 - RNA, 64 nt, Homo Sapiens
uguugacaccuuaaucggucuuaauaucuugaguaauuuuaaaagccauaaucaucuuuucugg

SEQ ID NO: 366665 - RNA, 64 nt, Homo Sapiens
uguuuuuguagcacaucuuuucauaacauacugaaauuuuaauguuuuuugccuuuaauaauag

SEQ ID NO: 366666 - RNA, 64 nt, Homo Sapiens
gucuaucaaauaucuucauuagacaucccacaguaauuuuaagcucaguguuuccaaacgucaa

SEQ ID NO: 366667 - RNA, 64 nt, Homo Sapiens
ggacaaacauguaaaccuauuuuccuaugaaaaaaauuuuaaaugucccacuugaauaacguaa

SEQ ID NO: 366668 - RNA, 64 nt, Homo Sapiens
agacaguucuaagcccugucuucugggaguuaucaauuuuaaagagaacuuuugugcaauucaa

SEQ ID NO: 366669 - RNA, 64 nt, Homo Sapiens
uagaaaaaaaaaaaaaaagaaaaaaagaauguaaaauuuuaaaaauacaguuuaacagcuguaa

SEQ ID NO: 366670 - RNA, 64 nt, Homo Sapiens
uaaauaaaagcauacuauaguuguaaaaacaaauaauuuuaauaguauauucaguggcugaagu

SEQ ID NO: 366671 - RNA, 64 nt, Homo Sapiens
cccaguuccacagugggaaauuuugcacacuugaaauuuuaaccaaguggcuagauauuauucc

SEQ ID NO: 366672 - RNA, 64 nt, Homo Sapiens
aaaucauuuuucaaucuguucccaguuucuaaacaauuuuaaauauuuaugagaagcaaacccu

SEQ ID NO: 366673 - RNA, 64 nt, Homo Sapiens
caaaggguaaauuauaaauguuucaugaagaaaaaauuuuaaaaaucuacgucuuuauuacaca

SEQ ID NO: 366674 - RNA, 64 nt, Homo Sapiens
aucugagcuuuuaccacuagacucaaggaagaauaauuuuaacagacauguauacuccauagaa

SEQ ID NO: 366675 - RNA, 64 nt, Homo Sapiens
gaucagugagacuaugaagagcacugacuuguuaaauuuuaaaagaaccauaaauucuaaggua

SEQ ID NO: 366676 - RNA, 64 nt, Homo Sapiens
uucuuuucauaaagagaagcuaaacauaaaaaggaauuuuaaauuuaacucuucacauggaaau

SEQ ID NO: 366677 - RNA, 64 nt, Homo Sapiens
gauucccuaauauguauacuuaacucuagaguugaauuuuaaggcaaaaguacuagauggugua

SEQ ID NO: 366678 - RNA, 64 nt, Homo Sapiens
auaaagguccaauuguuucaauuacacuuguuauaauuuuaacuccauguaaaucuauuguauu

SEQ ID NO: 366679 - RNA, 64 nt, Homo Sapiens
aaaauggacugauacccaaaaaaaacauguuuguaauuuuaaguugcucccugcacaugagugu

SEQ ID NO: 366680 - RNA, 64 nt, Homo Sapiens
acagccagaaaaaguauaauaaauaauagauaaaaauuuuaaaaaauagagaaaauaauuuuua

SEQ ID NO: 366681 - RNA, 64 nt, Homo Sapiens
gcauauuuuuaaauguacacaaacaauaaaaaacaauuuuaaauauauuucauacugcccaaca

SEQ ID NO: 366682 - RNA, 64 nt, Homo Sapiens
ccaugaacaaucaaguaccauucauuuauauuuaaauuuuaauuauuauggcauuuauauauag

SEQ ID NO: 366683 - RNA, 64 nt, Homo Sapiens
gacuuuuagcaaacaugcauuguuguuuugauguaauuuuaaaaucucagugaacagguuuuaa

SEQ ID NO: 366684 - RNA, 64 nt, Homo Sapiens
uguauagcuauuuuaaaggguguuuauuauagauaauuuuaaggaauaaugguuauuggggaac

SEQ ID NO: 366685 - RNA, 64 nt, Homo Sapiens
aaaagaggucauuuuagaauguuuuaugaacugaaauuuuaaucauaaagaagcauacuguaau

SEQ ID NO: 366686 - RNA, 64 nt, Homo Sapiens
auuuaaauuaaaaaaauuaauuuaaagaauuaaaaauuuuaaaaacaauuuaaaaauuuuaaau

SEQ ID NO: 366687 - RNA, 64 nt, Homo Sapiens
aauuaaaaauuuuaaaaauuauuuaaaaauuuuaaauuuuaaagauuacauguaaaacaggaca

SEQ ID NO: 366688 - RNA, 64 nt, Homo Sapiens
uuuaaagaauuaaaaauuuucaggacaauuuaaaaauuuuaaaucaaguauauuacauguaaaa

SEQ ID NO: 366689 - RNA, 64 nt, Homo Sapiens
agcauaauaaauuauauuaacuuuuaucaaacagaauuuuaaagguauuuauaauauaccaaug

SEQ ID NO: 366690 - RNA, 64 nt, Homo Sapiens
uauauuuucuuuacagguauacuauuucccuugaaauuuuaaacgucaaagagaaaacuuauau

SEQ ID NO: 366691 - RNA, 64 nt, Homo Sapiens
uuuaggaaauguucuauuuauuuuauguugaauaaauuuuaaaaaaagaaaucagaauuaacau

SEQ ID NO: 366692 - RNA, 64 nt, Homo Sapiens
gcucauaggucuuuccauauaugucagcaaugucaauuuuaaaucuggucacucaaauuuaaga

SEQ ID NO: 366693 - RNA, 64 nt, Homo Sapiens
ggcuagcucuugcccuuauaauguuuaauuuuaaaauuuuaauuuuacaaggaaaaaaggugau

SEQ ID NO: 366694 - RNA, 64 nt, Homo Sapiens
uuuuaauuggcuagcucuugaaggugauauguuuaauuuuaaaacagugcuuuuacaaggaaaa

SEQ ID NO: 366695 - RNA, 64 nt, Homo Sapiens
guaucaaugggcaagacuggaacugagaaggucaaauuuuaauuuaauaaacuugugaacuaag

SEQ ID NO: 366696 - RNA, 53 nt, Homo Sapiens
uuguacaguauugccaugaaugaaauuuuaaacccccagacuacuuccuguaa

SEQ ID NO: 366697 - RNA, 64 nt, Homo Sapiens
cgcagucacugguguuucuuaagggagucugcugaauuuuaaaauuuuuaaaaauaccauauuc

SEQ ID NO: 366698 - RNA, 64 nt, Homo Sapiens
uagauauuuuuauaagauauagcuuuuaggcuaaaauuuuaacguuuuauaaaauugaagcuau

SEQ ID NO: 366699 - RNA, 64 nt, Homo Sapiens
gcugaaauuugcaucaacauuuauuaaguaguuuaauuuuaaugucauuguaggaauauuuaag

SEQ ID NO: 366700 - RNA, 64 nt, Homo Sapiens
caaauaugcacagaaaauaagcucagggauuuauaauuuuaaaagaggaggaagaagaaaaagu

SEQ ID NO: 366701 - RNA, 64 nt, Homo Sapiens
cccugugccugcagccucauagguguuaaucuguaauuuuaaauuuugacaaaagcauuuucac

SEQ ID NO: 366702 - RNA, 64 nt, Homo Sapiens
uuauauucaguaggaaacugaacucagcacucagaauuuuaaauuaaaucaaugaucuucaagu

SEQ ID NO: 366703 - RNA, 64 nt, Homo Sapiens
uuuucucucuuuucuccaccucuccuuuauuuuuaauuuuaauuuuaauuuuugaaacaagauc

SEQ ID NO: 366704 - RNA, 64 nt, Homo Sapiens
cucuuuucuccaccucuccuuuauuuuuaauuuuaauuuuaauuuuugaaacaagaucugacuc

SEQ ID NO: 366705 - RNA, 64 nt, Homo Sapiens
agaauuauauuagguagaauacacauacaaucaaaauuuuaaaaaaaaaagcuaaauaacuuaa

SEQ ID NO: 366706 - RNA, 64 nt, Homo Sapiens
ugagagcugguugacugagacgcacgaacuuuuuaauuuuaaauauauuuuuaggaaacucucg

SEQ ID NO: 366707 - RNA, 64 nt, Homo Sapiens
uuuuuaaaccuuuuuuggcagcucagaugguguaaauuuuaaaauuuuguauagguauuucaua

SEQ ID NO: 366708 - RNA, 64 nt, Homo Sapiens
aaucaaaguaucacaaaauacugcuucaagauuuaauuuuaaaucugcuaauuuaagggauauu

SEQ ID NO: 366709 - RNA, 64 nt, Homo Sapiens
gacucaucaacaugugguuggccuuugauuucugaauuuuaaaguuucagacuuaucuuuuccu

SEQ ID NO: 366710 - RNA, 64 nt, Homo Sapiens
uuguuaauuuguuuuguuaauuuauguuuuuccuaauuuuaagcaucuuuaugaaacaggcaca

SEQ ID NO: 366711 - RNA, 64 nt, Homo Sapiens
ggagaaagccaacuauguuaaguuuacguguccaaauuuuaaugaaauuuuacuaacaauuuua

SEQ ID NO: 366712 - RNA, 64 nt, Homo Sapiens
uuacguguccaaauuuuaaugaaauuuuacuaacaauuuuaaaccauauuuuucuucuucauau

SEQ ID NO: 366713 - RNA, 64 nt, Homo Sapiens
acauugcagguguuuuguauauauacaauggauaaauuuuaagugugugcuaaggcacauggaa

SEQ ID NO: 366714 - RNA, 64 nt, Homo Sapiens
uuuugguauauauccauuccagcuuaaugccucuaauuuuaaugccaacaaaauugguuguaau

SEQ ID NO: 366715 - RNA, 64 nt, Homo Sapiens
cuaauuuuaaugccaacaaaauugguuguaaucaaauuuuaaaauaauaauaauuuggcccccc

SEQ ID NO: 366716 - RNA, 64 nt, Homo Sapiens
gaccugcaucaagucuucugacugugcuaaugugaauuuuaaauauuaucaauuucucauagac

SEQ ID NO: 366717 - RNA, 64 nt, Homo Sapiens
agcaaaugcugugaauuacuggacugaaaaaacaaauuuuaacugugcaguugagaaaacuaga

SEQ ID NO: 366718 - RNA, 64 nt, Homo Sapiens
uuaacuuucaaauccacuagagucuucuaauguaaauuuuaauguuuuaauuaaaaaaucaagg

SEQ ID NO: 366719 - RNA, 64 nt, Homo Sapiens
aaaaaaucaaggagucuucuuuuaaaauuaaauaaauuuuaauucucuuccguuggaaagaaca

SEQ ID NO: 366720 - RNA, 64 nt, Homo Sapiens
cucguuuuuguauucauuuaauuuuuaaauaaagaauuuuaaaaaugaaacauuacaguuagag

SEQ ID NO: 366721 - RNA, 64 nt, Homo Sapiens
aauuucagaagaaauucugcuuuaugcauacaguaauuuuaaguauagcauauguuuuuguaag

SEQ ID NO: 366722 - RNA, 64 nt, Homo Sapiens
cuuguuugacaaauuccaacguucauuuaaauaaaauuuuaauauggcucaauaacuuaaaaac

SEQ ID NO: 366723 - RNA, 64 nt, Homo Sapiens
auuaguauuuucagugguguauuuuuagcuacauaauuuuaagauugcuggacagggugauuua

SEQ ID NO: 366724 - RNA, 64 nt, Homo Sapiens
gggaacaaagcugccauaaauugaugcugcuuccaauuuuaaaauuuuuuccauauugguauuu

SEQ ID NO: 366725 - RNA, 64 nt, Homo Sapiens
uacaagaguuuuugaaauuuuauauaugcuaaauaauuuuaaaaagaaaccugguaucuauuug

SEQ ID NO: 366726 - RNA, 64 nt, Homo Sapiens
uucuagaaaauaugaauuaguuuccaaaugccuuaauuuuaaacuuuggccugaacaguuuuuu

SEQ ID NO: 366727 - RNA, 64 nt, Homo Sapiens
guauaaucagauauaaauauauacuuaauuuuuuaauuuuaaaaauagauaccuguuugacuuu

SEQ ID NO: 366728 - RNA, 64 nt, Homo Sapiens
cugguugagcucaggcacugucauggacacccuuaauuuuaaaagguuuuaaucauucuucuau

SEQ ID NO: 366729 - RNA, 64 nt, Homo Sapiens
ccauuaggaguuacuuuauguauuguugaaagcaaauuuuaaacaugauguuuuagaaguguuu

SEQ ID NO: 366730 - RNA, 64 nt, Homo Sapiens
auuaaaaagugcaggagcccaugacugaugcacaaauuuuaauguuuugacugugcuugauuuc

SEQ ID NO: 366731 - RNA, 64 nt, Homo Sapiens
uuaugugugaucacaagacucggagauauacacaaauuuuaaaaacuuaaaaggauuaaaguaa

SEQ ID NO: 366732 - RNA, 64 nt, Homo Sapiens
guaacuccaauucaguaaauauguucaguuuuugaauuuuaauauggcuugugguuaaaugaau

SEQ ID NO: 366733 - RNA, 64 nt, Homo Sapiens
ggaggaaaugaaugcugauuuaggguuuaugcuuaauuuuaauuaugugcagaagguuacuacc

SEQ ID NO: 366734 - RNA, 64 nt, Homo Sapiens
guucucggggaugcauagaugugaaauaaaaaaaaauuuuaaguguagcuguaagaauuuccca

SEQ ID NO: 366735 - RNA, 64 nt, Homo Sapiens
uuaaaaaggcagauaagacauucuccuguaucugaauuuuaaaaacaagaaagaaagcaggauu

SEQ ID NO: 366736 - RNA, 64 nt, Homo Sapiens
uucuaaauaaucuucgcugacuauuaaagcuccaaauuuuaagugauuuugcagcacugaaaau

SEQ ID NO: 366737 - RNA, 64 nt, Homo Sapiens
aauucaucuuacaagucagguaguaaaugaucacaauuuuaaauuaggagauguauuuuuauca

SEQ ID NO: 366738 - RNA, 64 nt, Homo Sapiens
aaagugaaccagaacaaaucaacagcuaaggaauaauuuuaauaguagguguuucacuauaagg

SEQ ID NO: 366739 - RNA, 64 nt, Homo Sapiens
acggaaaggguuaaauuaaccagaacgaguguaaaauuuuaacagauauauauuuguugaauaa

SEQ ID NO: 366740 - RNA, 64 nt, Homo Sapiens
aaaaucacugcauaugggaaaagaaauccuuuggaauuuuaacuaauggagauauuauaggaaa

SEQ ID NO: 366741 - RNA, 64 nt, Homo Sapiens
guacucaucgcucuugccaaaauuuccagauaguaauuuuaagauggcagauucuaaauaauau

SEQ ID NO: 366742 - RNA, 64 nt, Homo Sapiens
gaguagagagcucaacuuuuucagcauucuuuagaauuuuaaaucuguucugaacuggaauuuu

SEQ ID NO: 366743 - RNA, 64 nt, Homo Sapiens
acucaagguggucaguaaaugacaagaauaauucaauuuuaaagaaguguuacuuuuuguaaac

SEQ ID NO: 366744 - RNA, 64 nt, Homo Sapiens
ccauaacuuauaagcucacuuugcuucugcauaaaauuuuaacucacuggaggaagauuuuccc

SEQ ID NO: 366745 - RNA, 64 nt, Homo Sapiens
aaauccuacuaacaccaccaugcaauucaaaagaaauuuuaaaaucaggucucuggaucuuauu

SEQ ID NO: 366746 - RNA, 64 nt, Homo Sapiens
aaagcuuuuuauauguagaucuugcaucaaguuuaauuuuaaguaauaaauugguuucucauaa

SEQ ID NO: 366747 - RNA, 64 nt, Homo Sapiens
cuaaguuauuccaacacuaacaugcuagaaaauuaauuuuaaaauucaguaagaaagaugucaa

SEQ ID NO: 366748 - RNA, 64 nt, Homo Sapiens
auguaaaauggauauauaaucgaguucaaagcacaauuuuaaacagcagagaguacccauucuu

SEQ ID NO: 366749 - RNA, 64 nt, Homo Sapiens
auuuauuacauaaucucuagcaagauguggcuugaauuuuaaccaucuugacaggcuggaccug

SEQ ID NO: 366750 - RNA, 64 nt, Homo Sapiens
uucuaugaauaaaagaaauuuuuaaaaacuuuaaaauuuuaaauauuagucaaaauacuuuuua

SEQ ID NO: 366751 - RNA, 64 nt, Homo Sapiens
uaaguccugagugcuuacagguaguuguuaaaaaaauuuuaaggccaggcaugguggcucgcuc

SEQ ID NO: 366752 - RNA, 64 nt, Homo Sapiens
uguaaacaaugauuucaaaauacuugaaaaauaaaauuuuaacccaaaugaauaacuaagaaau

SEQ ID NO: 366753 - RNA, 64 nt, Homo Sapiens
uuguauacucucaguucucauucaguauaaauaaaauuuuaaaauccuuucauaguucuauuag

SEQ ID NO: 366754 - RNA, 64 nt, Homo Sapiens
uagguaauuuggaacauuuacaagccauuuguaaaauuuuaagauaaucuguaacuaauacaua

SEQ ID NO: 366755 - RNA, 64 nt, Homo Sapiens
ggaaaugcuuaggaucuucagacccaauagcucuaauuuuaacauuucuacccaauaagaggcu

SEQ ID NO: 366756 - RNA, 64 nt, Homo Sapiens
uagcaaaugugugguaaacauucauauggccauuaauuuuaacauuaaaucguagguagggcaa

SEQ ID NO: 366757 - RNA, 64 nt, Homo Sapiens
uuuguuccaaaauagcagaaacuuaaaucgugggaauuuuaauguucaguucauauuuaaugau

SEQ ID NO: 366758 - RNA, 64 nt, Homo Sapiens
ccaugaaagucuuaauguuuuggaaguucuuuguaauuuuaauucuuccauauaugugguucau

SEQ ID NO: 366759 - RNA, 64 nt, Homo Sapiens
uaucuucacuguagucaacaaugacaauaauuauaauuuuaacauuauuucuaagcucuuggca

SEQ ID NO: 366760 - RNA, 64 nt, Homo Sapiens
acuuaauuuaaaguuacaaugcucugucaucugaaauuuuaaccgaagcuguuaccaguuaucg

SEQ ID NO: 366761 - RNA, 64 nt, Homo Sapiens
gccacagguguugauuguuaucuuaugaaaaccaaauuuuaaaaauuuacuucaguauaaauua

SEQ ID NO: 366762 - RNA, 64 nt, Homo Sapiens
ucuacaaaauaacauucugauuucaccagguuaaaauuuuaauuaccacuuauaucaacuuauu

SEQ ID NO: 366763 - RNA, 64 nt, Homo Sapiens
uaaaauucauagcauccugauuacuacauaauuaaauuuuaaugagcuauaacaacucuauuuu

SEQ ID NO: 366764 - RNA, 64 nt, Homo Sapiens
aauaacauauucuugcuuuccagucaguacacccaauuuuaaaaaagaaagucuaugcuuaggc

SEQ ID NO: 366765 - RNA, 64 nt, Homo Sapiens
uucucaaaauuugaaaugucuuuuguuugacaauaauuuuaaugcauugcuaauguggucugag

SEQ ID NO: 366766 - RNA, 64 nt, Homo Sapiens
caguacauuuuucuucuaauaaaaaugcaauuuaaauuuuaauacuaauuaaaaaacaacuugu

SEQ ID NO: 366767 - RNA, 64 nt, Homo Sapiens
gcagucaguaaagugagcuuuagaaagaaacuggaauuuuaacuucauuuuguaucuugcuuaa

SEQ ID NO: 366768 - RNA, 64 nt, Homo Sapiens
ucuccauuagaaauauggugcaagccacauauguaauuuuaaauauucuaguagccacauuaau

SEQ ID NO: 366769 - RNA, 64 nt, Homo Sapiens
uuuuuuuuggucagcuuuaauauauuuaugccagaauuuuaaaaccaacaaaauuuucuuguuc

SEQ ID NO: 366770 - RNA, 64 nt, Homo Sapiens
auuaccacaguugcugccuccuccagaauuuuugaauuuuaauaaaaggcaaacuuuugagcug

SEQ ID NO: 366771 - RNA, 64 nt, Homo Sapiens
aacaguuucacuuuguggcuuuuaauuauucuagaauuuuaacugcaucucauuuuucuagcau

SEQ ID NO: 366772 - RNA, 64 nt, Homo Sapiens
ucauaucugcacuauuaucugaugacauguugguaauuuuaaagacugcaaggcaguuuagaga

SEQ ID NO: 366773 - RNA, 64 nt, Homo Sapiens
gcagaaauuuuuaguaguugaguugcuuuaagugaauuuuaacaaauaugacacagaaaagguc

SEQ ID NO: 366774 - RNA, 64 nt, Homo Sapiens
augggccuauuuucuaucccauaauuucucaaugaauuuuaaaaacaguuguggagaaaaagua

SEQ ID NO: 366775 - RNA, 64 nt, Homo Sapiens
aucauauguucaaagagcuuaacguaagucaaugaauuuuaauguauguuacguggauguuugu

SEQ ID NO: 366776 - RNA, 64 nt, Homo Sapiens
ucuguguccaaaauaaguuucuuauuuuaaaccaaauuuuaauuuguuucagauuuuugaaaca

SEQ ID NO: 366777 - RNA, 64 nt, Homo Sapiens
cuauuaacuuuuccaaauuuaaaagaaccaacagaauuuuaacuguguuuugcaaaagaaaaag

SEQ ID NO: 366778 - RNA, 64 nt, Homo Sapiens
auucaacacugguguacauacaagacugggguagaauuuuaaaggggggggagggggguaaggc

SEQ ID NO: 366779 - RNA, 64 nt, Homo Sapiens
uuccuugagacuuucaagaagacauucuccacugaauuuuaacuuuugacaauuuugugggaaa

SEQ ID NO: 366780 - RNA, 64 nt, Homo Sapiens
gaaagauuugugcaccacuauguauaguucugugaauuuuaacaaaauugaaauuucuucuugg

SEQ ID NO: 366781 - RNA, 64 nt, Homo Sapiens
aaaguaacaucaguggaggguauuauuuuaaauaaauuuuaauugagaauuuguugcauuuuca

SEQ ID NO: 366782 - RNA, 64 nt, Homo Sapiens
aaauuuuaauugagaauuuguugcauuuucagcaaauuuuaaaacauuuuuagguuuuacagag

SEQ ID NO: 366783 - RNA, 64 nt, Homo Sapiens
uacugagcuggaucuuagagaaaaugaauauuuaaauuuuaaaguuugcacauuucaucuuugu

SEQ ID NO: 366784 - RNA, 64 nt, Homo Sapiens
aaguagaauccuuaccuacuacucuucugauaauaauuuuaauauuuuuuauguuugguugaug

SEQ ID NO: 366785 - RNA, 64 nt, Homo Sapiens
uucauguaauuagauggaagaaaccucacugauuaauuuuaagaaccuuuuagggaugcaggaa

SEQ ID NO: 366786 - RNA, 64 nt, Homo Sapiens
uaauaucaaaauauguguucaaaauugguauuuuaauuuuaauauuuuuguaaguugauuuaaa

SEQ ID NO: 366787 - RNA, 64 nt, Homo Sapiens
uguucuaccuuuuaauuugaaaacaaggaaauuaaauuuuaacagaaaucuuuuaaguauguua

SEQ ID NO: 366788 - RNA, 64 nt, Homo Sapiens
cuucugguugauaccugagacuguuaaggaaaaaaauuuuaaaccccugauuuauauagauauc

SEQ ID NO: 366789 - RNA, 64 nt, Homo Sapiens
uaucuaaaguuauuuuaauaggugguauagcaguaauuuuaaauuuaagaguugcuuuuacagu

SEQ ID NO: 366790 - RNA, 64 nt, Homo Sapiens
uuacuuuaaaaacuuuacacauuucaguuucuaaaauuuuaaauuaacaaaaauuauuucuugu

SEQ ID NO: 366791 - RNA, 64 nt, Homo Sapiens
cguugugcacuacaucauuucucuccugaggaagaauuuuaaacauguacagcucauucaauau

SEQ ID NO: 366792 - RNA, 64 nt, Homo Sapiens
ggagugggaccccucccuggugucacugcuguaaaauuuuaaacgguugugucuuguugggagu

SEQ ID NO: 366793 - RNA, 64 nt, Homo Sapiens
gcccaugcaaguccaaaauucagcagggcagucaaauuuuaaaccuccaaaaugaucaccuuug

SEQ ID NO: 366794 - RNA, 64 nt, Homo Sapiens
uugguuauuuauuuguguaaagacaaaccauuugaauuuuaacauuuacuccuacgguaaauca

SEQ ID NO: 366795 - RNA, 64 nt, Homo Sapiens
aaacaaaguaucauuagugaauuuugccuuuguuaauuuuaaacaaugugacuauuucauaugc

SEQ ID NO: 366796 - RNA, 64 nt, Homo Sapiens
uaaaauaauugggaaagaagacuagcaacauuagaauuuuaaaaucuuuaauccauuaccuggc

SEQ ID NO: 366797 - RNA, 64 nt, Homo Sapiens
agauuuccuuuuccuaguaagaauucuuuuuuaaaauuuuaauugccaugguaaauaauuuuca

SEQ ID NO: 366798 - RNA, 64 nt, Homo Sapiens
cuaauggaauguuucaaaggauucucauugugagaauuuuaauaauguguuaaauaugaaccau

SEQ ID NO: 366799 - RNA, 64 nt, Homo Sapiens
uguucuggaaguguuuuugauuuaaugcaaaggaaauuuuaaaagcuuucuaucauuuuuaugu

SEQ ID NO: 366800 - RNA, 64 nt, Homo Sapiens
caaaucaugucuguaaaacuacauugucaaaguaaauuuuaauuguacuuuaaaagaaguuugu

SEQ ID NO: 366801 - RNA, 64 nt, Homo Sapiens
uaaacuuuuuuuaaaaaaaacauuuguggcuagaaauuuuaaucccaccacacauccaccgaug

SEQ ID NO: 366802 - RNA, 64 nt, Homo Sapiens
uggccaaugauguauacaugugaauuauuaaaacaauuuuaaaauuaauuguaauuaagggaaa

SEQ ID NO: 366803 - RNA, 64 nt, Homo Sapiens
uuuuuauuaagaugaguaaauauuugaaccacugaauuuuaauaacaaaauuuuaaaauuggca

SEQ ID NO: 366804 - RNA, 64 nt, Homo Sapiens
aguaaauauuugaaccacugaauuuuaauaacaaaauuuuaaaauuggcaugaauacggaauac

SEQ ID NO: 366805 - RNA, 64 nt, Homo Sapiens
uuucuguggcucaaauaaugaugauuauggaaugaauuuuaaugucccuacuugugaauaauua

SEQ ID NO: 366806 - RNA, 64 nt, Homo Sapiens
aauaauuagcuuucucaaauguaggcuuuuuacaaauuuuaaauuuuaaaauauuaguuuaaau

SEQ ID NO: 366807 - RNA, 64 nt, Homo Sapiens
agcuuucucaaauguaggcuuuuuacaaauuuuaaauuuuaaaauauuaguuuaaauguguguu

SEQ ID NO: 366808 - RNA, 64 nt, Homo Sapiens
gaaccuuugaaagaguuuaaucuuaacguuuucuaauuuuaaaauuuuaaaaucuuguuuaaca

SEQ ID NO: 366809 - RNA, 64 nt, Homo Sapiens
gaaagaguuuaaucuuaacguuuucuaauuuuaaaauuuuaaaaucuuguuuaacaaaagcuug

SEQ ID NO: 366810 - RNA, 64 nt, Homo Sapiens
uauccagagaugucaaacugacuccaucuuagugaauuuuaaauugcucugcuuuuccacuaaa

SEQ ID NO: 366811 - RNA, 64 nt, Homo Sapiens
aggaaaucaggucuuuugcauagagaagaaagauaauuuuaaaagacaucuggcuacauguagg

SEQ ID NO: 366812 - RNA, 64 nt, Homo Sapiens
auuaagagauauacagaugauuuaagggaauaaaaauuuuaaaauucaaaaucuuuuuuuuauu

SEQ ID NO: 366813 - RNA, 64 nt, Homo Sapiens
auuaugaaauacuaaaacuagaauaaaacauccaaauuuuaaguaguaauguuaauuuuacuaa

SEQ ID NO: 366814 - RNA, 64 nt, Homo Sapiens
uuuccuugaauaauccaugaacuaggcagaagccaauuuuaaaaaacaauccagauguauaagu

SEQ ID NO: 366815 - RNA, 64 nt, Homo Sapiens
uuauauuuugugaauauuuuacuuuaguucauuuaauuuuaauuuauugucaccacuggaaguu

SEQ ID NO: 366816 - RNA, 64 nt, Homo Sapiens
uguuuugcuggagaaacaucguaccauuagguuuaauuuuaauucucuggagccucagccagaa

SEQ ID NO: 366817 - RNA, 64 nt, Homo Sapiens
uguaugugguggccggcgggcucacacccucuguaauuuuaagagcugaaccaucuuaggguca

SEQ ID NO: 366818 - RNA, 64 nt, Homo Sapiens
ucacauuuagcuucaaauuguaacaauucaauugaauuuuaaaaugacaccugaaaagauacau

SEQ ID NO: 366819 - RNA, 64 nt, Homo Sapiens
uaacauccaauuaugacuggguaauaagugugaaaauuuuaauuugugguuuucauuuauuaau

SEQ ID NO: 366820 - RNA, 64 nt, Homo Sapiens
auuaaggauggaggugauauuuuccucaauggcaaauuuuaaauuaguuuuuaaaaacuuacuu

SEQ ID NO: 366821 - RNA, 64 nt, Homo Sapiens
cauaccugacucuggguguggugguuaaaauacuaauuuuaaagucuuccagugacuuucgguc

SEQ ID NO: 366822 - RNA, 64 nt, Homo Sapiens
accuauucaaaauuuuauuaaaaaccagcaaauuaauuuuaaucucuagccauaaaaacauaag

SEQ ID NO: 366823 - RNA, 64 nt, Homo Sapiens
uuaacacauguauaaauaaguauauauaaacuccaauuuuaaaucuuaaaauugcugaauuuac

SEQ ID NO: 366824 - RNA, 64 nt, Homo Sapiens
auugauuuucuuuugggagucacuuuuaaucuguaauuuuaaaauacaagucugaauauuuaua

SEQ ID NO: 366825 - RNA, 64 nt, Homo Sapiens
aauuuuucuugcuagguaaauccaguaagccaauaauuuuaaagauucuuuaucugcaucauug

SEQ ID NO: 366826 - RNA, 64 nt, Homo Sapiens
uuuugugguuguuuggagcagggauguacaaaauaauuuuaauguauuaacucauacugccugu

SEQ ID NO: 366827 - RNA, 64 nt, Homo Sapiens
uccaaauugauguguaugauaggaaaaaaaccuuaauuuuaaauauaauauagagccuuaaacu

SEQ ID NO: 366828 - RNA, 64 nt, Homo Sapiens
auaucuucacgaacuugaccgaguuuccaagauuaauuuuaagaagagaaaccucauaggcaca

SEQ ID NO: 366829 - RNA, 64 nt, Homo Sapiens
ggcagacagaaaguuugccuggcauucagacuugaauuuuaauaccugauuggggccuaagaag

SEQ ID NO: 366830 - RNA, 64 nt, Homo Sapiens
ugagcacaaagaacguugaaauuccuguuuuaauaauuuuaaaauuauuugcuuguccuuuuga

SEQ ID NO: 366831 - RNA, 64 nt, Homo Sapiens
aauaaaauacuugguuuuuaugguuuagggucucaauuuuaauuuuaaguuguauagucuuagu

SEQ ID NO: 366832 - RNA, 64 nt, Homo Sapiens
gccugugaguccaaguaaauaccuuucaaugauuaauuuuaauaagugccauaguuuggacagu

SEQ ID NO: 366833 - RNA, 64 nt, Homo Sapiens
gacagugccauaguuuggacguaaaaaaaaaaaaaauuuuaaguaucuggcacaagauagaaug

SEQ ID NO: 366834 - RNA, 64 nt, Homo Sapiens
aauucuggaagaaacagauugauacuaaaauuuuaauuuuaaaaguguuauuuuaauauuucac

SEQ ID NO: 366835 - RNA, 64 nt, Homo Sapiens
uuaaaaaauucuggaagaaauuucacgauacuaaaauuuuaauuuuugggguguuauuuuaaua

SEQ ID NO: 366836 - RNA, 64 nt, Homo Sapiens
uaguauauacuacaacaaaucaggaauuugaguaaauuuuaaauagacucuugucucaaacaaa

SEQ ID NO: 366837 - RNA, 64 nt, Homo Sapiens
cuuuugauacuucguuaugauaccaaauaugcaaaauuuuaaggaauucuuugaauugcugggu

SEQ ID NO: 366838 - RNA, 64 nt, Homo Sapiens
guugaaaauugcauuauauuuuguauauuuucauaauuuuaauuaguuguguugcccaucaauu

SEQ ID NO: 366839 - RNA, 64 nt, Homo Sapiens
aauuacuacauuaccuguucuaaacuuccaaggaaauuuuaaacucauaauuugauacagugcu

SEQ ID NO: 366840 - RNA, 64 nt, Homo Sapiens
gcacuuuagauggcaccuuucaccacuuggucagaauuuuaaaagcuuagguuuaggugaaagu

SEQ ID NO: 366841 - RNA, 64 nt, Homo Sapiens
uuguguuuuaaauuauaguuauaaauuguaagguaauuuuaaauugucccucguauuauuucuc

SEQ ID NO: 366842 - RNA, 64 nt, Homo Sapiens
uccugcuuuuguuuuuuccacuuguauaugcacuaauuuuaauuuuuuaaagacuuuuucugau

SEQ ID NO: 366843 - RNA, 64 nt, Homo Sapiens
cuuccaagcacuugcaacugauguuacugucuucaauuuuaauaauuacacauauuuguauauu

SEQ ID NO: 366844 - RNA, 64 nt, Homo Sapiens
gucccagaauuuucuggccuuucauggcaaugaaaauuuuaagaagaaagauuuaaaguauuuu

SEQ ID NO: 366845 - RNA, 64 nt, Homo Sapiens
ugaaaauuuuaagaagaaagauuuaaaguauuuuaauuuuaaagaguguguuauaaaauaaugu

SEQ ID NO: 366846 - RNA, 64 nt, Homo Sapiens
cucaucagacucuccuuguuuuguuugcauauuuaauuuuaaauuaaaccaaagaauauguuaa

SEQ ID NO: 366847 - RNA, 64 nt, Homo Sapiens
aagcuggccacauuggacaucuuggucacugcagaauuuuaaaaggcaaacuucucagaacaga

SEQ ID NO: 366848 - RNA, 64 nt, Homo Sapiens
uacaagugaaaacuuaaauuguaaaacauguugaaauuuuaaaaauuaauguuaauauggaaau

SEQ ID NO: 366849 - RNA, 64 nt, Homo Sapiens
aaauuuuauguuuuucuaaggaaacuuuccacagaauuuuaaacaacugaugcauccauacuca

SEQ ID NO: 366850 - RNA, 64 nt, Homo Sapiens
uuuucuuagaaauuguguccagauagcuuucacuaauuuuaaauuaagugaacuaaauauauau

SEQ ID NO: 366851 - RNA, 64 nt, Homo Sapiens
cgugaguguuaaagauagaauuuguuuuaggacaaauuuuaagaaaaugugggaauaccaaaug

SEQ ID NO: 366852 - RNA, 64 nt, Homo Sapiens
auauuuucauuuagauauaacaugguuccaguugaauuuuaagccucaaauugaugugaaaugc

SEQ ID NO: 366853 - RNA, 64 nt, Homo Sapiens
auuuagucuuauuucguuguguuuuuuucaaacuaauuuuaagauuaauguaaacaaacugcag

SEQ ID NO: 366854 - RNA, 64 nt, Homo Sapiens
ggaaaauacaaaaacagcugcauuucauugccuuaauuuuaagaauaaccuuaggaacuguagc

SEQ ID NO: 366855 - RNA, 64 nt, Homo Sapiens
uagagauaauuuacugaagcggggauucagauauaauuuuaaaggcaaguucaucucagagaaa

SEQ ID NO: 366856 - RNA, 64 nt, Homo Sapiens
uuaaaauauucagucuacaaauauauagguauauaauuuuaaggaugcagcauaccauaggugu

SEQ ID NO: 366857 - RNA, 64 nt, Homo Sapiens
uuuauaauagaaaaaugauuggcaauaacuuuugaauuuuaauuuuuacugccacaagcacugu

SEQ ID NO: 366858 - RNA, 64 nt, Homo Sapiens
cucaaaucaaccuuuuaauaaauuuaauguuacaaauuuuaacaaauguuugaaauacgaaggu

SEQ ID NO: 366859 - RNA, 64 nt, Homo Sapiens
uaauuuugaaucacuaauaucauuuuagacucucaauuuuaaauaggccuguuaucauagaagu

SEQ ID NO: 366860 - RNA, 64 nt, Homo Sapiens
uccuuuaaaacaacuuuucaauuacucaauuuaaaauuuuaaaaaacuuuuaaaugaagcuuaa

SEQ ID NO: 366861 - RNA, 64 nt, Homo Sapiens
acaguuuuuuuuccucuuauuaggaaaaugaaacaauuuuaacaagcuucgagauaucuuauuc

SEQ ID NO: 366862 - RNA, 64 nt, Homo Sapiens
ccggggagccauaaucugcagaaaaugcuuuagaaauuuuaacuaaaacagaacaaaagcaaag

SEQ ID NO: 366863 - RNA, 64 nt, Homo Sapiens
guagcucacauuuaauuucuaaaauaaagcuugcaauuuuaaaaaaauugaauugguuugauua

SEQ ID NO: 366864 - RNA, 64 nt, Homo Sapiens
uuuaagguugaaaagacaauuauaggaaaacaauaauuuuaacugccuaaaaaguaucauuaca

SEQ ID NO: 366865 - RNA, 64 nt, Homo Sapiens
acugaacaaucagaaaagaaaaaaauguaaugcaaauuuuaagaaauacaggugcaugaccaau

SEQ ID NO: 366866 - RNA, 64 nt, Homo Sapiens
cguuuggauaugcucauuuaauuucuacagaaaaaauuuuaaauuauuucacauuagccauuug

SEQ ID NO: 366867 - RNA, 64 nt, Homo Sapiens
gaauaccaucuuucuaugaaaagcuguguauauuaauuuuaaucucuagggccuuuuuucaaua

SEQ ID NO: 366868 - RNA, 64 nt, Homo Sapiens
cuggugagcugagguagaaaaaaaacaagaaaaaaauuuuaaaaauagcguuaaaaugcauuuu

SEQ ID NO: 366869 - RNA, 64 nt, Homo Sapiens
uugaaaaaauuuaggaaaguuguuuuggggaaaaaauuuuaauucugcaauccuaauucucaca

SEQ ID NO: 366870 - RNA, 64 nt, Homo Sapiens
ucuccuaaugaugaugcauucucugugauuguacaauuuuaaaaucuagguuuguguaaguaca

SEQ ID NO: 366871 - RNA, 64 nt, Homo Sapiens
cuucccuauaauuauacuuccuggauaaagaguuaauuuuaauccagaaagcccugaguucccc

SEQ ID NO: 366872 - RNA, 64 nt, Homo Sapiens
gccaccaagaauguggacauugaauuuauuuuaaaauuuuaauacuuaaauuauucccaagauu

SEQ ID NO: 366873 - RNA, 64 nt, Homo Sapiens
uuuucuagauuacuccaauaaccaaagauguaacaauuuuaaaaaaaguaucacauuuauaaau

SEQ ID NO: 366874 - RNA, 64 nt, Homo Sapiens
guugcuuauuaaagcaacuuuaaaaagguaacagaauuuuaacugaagguuguuauugcaaguu

SEQ ID NO: 366875 - RNA, 64 nt, Homo Sapiens
uuaaguuuguaccuaauagaauaaguggucaugaaauuuuaaugaauuugauuuuuuaaauauu

SEQ ID NO: 366876 - RNA, 64 nt, Homo Sapiens
caguaguuuuacuggccauuuacuuaaagccaacaauuuuaaggaauucaaauuuuaccucugu

SEQ ID NO: 366877 - RNA, 64 nt, Homo Sapiens
aucaagugaaaauuuagaaauaaaucacuuauaaaauuuuaaauggcuuaauuugaugacauaa

SEQ ID NO: 366878 - RNA, 64 nt, Homo Sapiens
ccauucuugaauguagaaauuuccccucacauugaauuuuaauuacuagcuauauuuugcuuuu

SEQ ID NO: 366879 - RNA, 64 nt, Homo Sapiens
uggcucaaacaucucucauuuuuuaucucucaccaauuuuaaaacuaauuuuaaaaaauaaaaa

SEQ ID NO: 366880 - RNA, 64 nt, Homo Sapiens
aauaaaaauuuuaucucucauacaagcugacucuaauuuuaaaaauuucuuuacagugaauaac

SEQ ID NO: 366881 - RNA, 64 nt, Homo Sapiens
uuugauuagacuuuuucagaaguacuaaauaaggaauuuuaacagguuuuuauuaaugcacaga

SEQ ID NO: 366882 - RNA, 64 nt, Homo Sapiens
aggccuacaaugaauagguauggugguuucacagaauuuuaaaauagaguuaaagggaagugau

SEQ ID NO: 366883 - RNA, 64 nt, Homo Sapiens
guauagauguaugucuuaaaaugugggugauaggaauuuuaaagauuuauauaaugcaucaaaa

SEQ ID NO: 366884 - RNA, 64 nt, Homo Sapiens
agaguuuacagcuccuuuaauaaaaugugucaguaauuuuaagguuuauaguucccucaacaca

SEQ ID NO: 366885 - RNA, 64 nt, Homo Sapiens
uuuauuuggaagggagcaguguuuccuugguacuaauuuuaauuuuuuuuuuucuuuuucuuuu

SEQ ID NO: 366886 - RNA, 64 nt, Homo Sapiens
guaauugauaauuaguauuugcuggcagcugagaaauuuuaaaggaaagucccuauaggauaga

SEQ ID NO: 366887 - RNA, 64 nt, Homo Sapiens
acuguccuaucauaaauuaaucucagaaaugguuaauuuuaauauuacaauuucaaaguuacag

SEQ ID NO: 366888 - RNA, 64 nt, Homo Sapiens
uuuuggcuuucauuacuucacaagcaaguuuuaaaauuuuaaugguacugguucuaacaaguaa

SEQ ID NO: 366889 - RNA, 64 nt, Homo Sapiens
gugacagagagacuuugucucaaaaaaaaaagaaaauuuuaauuuuaauguagacaguaugaau

SEQ ID NO: 366890 - RNA, 64 nt, Homo Sapiens
gagagacuuugucucaaaaaaaaaagaaaauuuuaauuuuaauguagacaguaugaauuaucuu

SEQ ID NO: 366891 - RNA, 64 nt, Homo Sapiens
cuucaaauuuuucccucuaauaggaaacaguauaaauuuuaauuaaaaaaaaaaggcaaacuaa

SEQ ID NO: 366892 - RNA, 64 nt, Homo Sapiens
uauuuauaaagacacuaagaaaacccauguuuguaauuuuaauaacauuuuucccaucuuguaa

SEQ ID NO: 366893 - RNA, 64 nt, Homo Sapiens
uaaaaguacuuucuugcuugauucacauaagacgaauuuuaaucgggugauuucauuugccaua

SEQ ID NO: 366894 - RNA, 64 nt, Homo Sapiens
aaauguaaaaacucauaaaaagaucaaguaugcuaauuuuaagcguggagaugggaacuguaaa

SEQ ID NO: 366895 - RNA, 64 nt, Homo Sapiens
ugucuuuauuuuuuaucauuaaauuuuaaugcaaaauuuuaauugaggaauaugguauaauuuu

SEQ ID NO: 366896 - RNA, 64 nt, Homo Sapiens
caaaauuuuaauuugucuuuaugguauaauuuuaaauuuuaaugggcacaugccgaagaggaau

SEQ ID NO: 366897 - RNA, 64 nt, Homo Sapiens
uuuaaugcaaaauuuuaauugaggaauaugguauaauuuuaaaucuggaaaggcacaugccgaa

SEQ ID NO: 366898 - RNA, 64 nt, Homo Sapiens
ucuuuaucauuuaaagaaacagugaucaucuguuaauuuuaaggggaaguuuuaggcugugcau

SEQ ID NO: 366899 - RNA, 64 nt, Homo Sapiens
ugcuccuaagcccauaacuucuauucccaccacaaauuuuaaagauucauaguuauuaaugacc

SEQ ID NO: 366900 - RNA, 64 nt, Homo Sapiens
guauuuuuguugcaguguaguuuuccuuuuguguaauuuuaaagucaguguugaauuuuauuga

SEQ ID NO: 366901 - RNA, 64 nt, Homo Sapiens
uucuuuuccuccaugauguuaauggguuaucucaaauuuuaaguuaaacuaccuaaaauaaaua

SEQ ID NO: 366902 - RNA, 64 nt, Homo Sapiens
uacugauaaaaacaaacauguuuggcauuaaucuaauuuuaaugugacaaauugcacagagcuc

SEQ ID NO: 366903 - RNA, 64 nt, Homo Sapiens
cuuuuauuuuaauccuuuuaauaaaccauucaccaauuuuaaucuuaccugcuugaauacuuga

SEQ ID NO: 366904 - RNA, 64 nt, Homo Sapiens
uuauucuuccucucaaacauuuaacaaauacauaaauuuuaaaagguauauuuuguaaauuuag

SEQ ID NO: 366905 - RNA, 64 nt, Homo Sapiens
aucauuuaaaauuaacaucauuaauaguauguuuaauuuuaaagacucauguuuuauguaauaa

SEQ ID NO: 366906 - RNA, 64 nt, Homo Sapiens
ccucaggguuuuaauuuaaauauuguguaaaacaaauuuuaauuaaauugcacuuaaccaaaac

SEQ ID NO: 366907 - RNA, 64 nt, Homo Sapiens
guuguauauaaagcaaauaacagcuuagugcacaaauuuuaacuccacaauugugaaggcagcu

SEQ ID NO: 366908 - RNA, 64 nt, Homo Sapiens
caguaaaacaaaaugaaacuagccaaacuauuuaaauuuuaaaauuuuaacaaauguagaaaug

SEQ ID NO: 366909 - RNA, 64 nt, Homo Sapiens
aauguagaaaugagccaaacuauuuuaagauuacaauuuuaacauuguaaaguuauuuuuuuaa

SEQ ID NO: 366910 - RNA, 64 nt, Homo Sapiens
aaaaaauuaaauaucuauaauugauauuuucacaaauuuuaaacuaaagauuguuuaaaauauc

SEQ ID NO: 366911 - RNA, 64 nt, Homo Sapiens
uuaguuuucagacauagaauaguagauaaaaacaaauuuuaaguuuuuauaaagauaaauacuu

SEQ ID NO: 366912 - RNA, 64 nt, Homo Sapiens
gaguaaauauuaaugauaauacaaaguauaucacaauuuuaaguaucuuuggcauucuugguau

SEQ ID NO: 366913 - RNA, 64 nt, Homo Sapiens
aagugaugacacaacaauauuaauuuaaaauuuaaauuuuaacauagauuuaguuuguagaauu

SEQ ID NO: 366914 - RNA, 64 nt, Homo Sapiens
uuuugaaaggacuuauuaauaauaauaggauugaaauuuuaaaagagauaauugcuuuuauuau

SEQ ID NO: 366915 - RNA, 64 nt, Homo Sapiens
agcuucuacucuuauuuuuggggugaucuaggaaaauuuuaaauucccagguccugcacccuua

SEQ ID NO: 366916 - RNA, 64 nt, Homo Sapiens
uuuugucuaacuccccuucaaggggagaugggaaaauuuuaaguugaaguuauaucaugggguc

SEQ ID NO: 366917 - RNA, 64 nt, Homo Sapiens
uuaaaaagaaaagcaugcugaaacauguuaauguaauuuuaaaucacaagucuaauaauuauua

SEQ ID NO: 366918 - RNA, 64 nt, Homo Sapiens
ucauuauuauugaacucuaucagcuaugaagcuaaauuuuaaagucaacugcucuuccuacuga

SEQ ID NO: 366919 - RNA, 64 nt, Homo Sapiens
caaaaauauuaaauggaaaauuccagaaauaaagaauuuuaagucucaaauggugugcccuucu

SEQ ID NO: 366920 - RNA, 64 nt, Homo Sapiens
uaaagucuuugaaaguguaacuggaauauuguguaauuuuaauaaauaauaacuauuguuguuu

SEQ ID NO: 366921 - RNA, 64 nt, Homo Sapiens
cuggguguccggggcagacaguacaaaagagagaaauuuuaaaguugagaaauaaagggacaga

SEQ ID NO: 366922 - RNA, 64 nt, Homo Sapiens
caaugagguuaaaaacacaguuagaaauuaauuuaauuuuaaauaauaccgcagaccaaauggc

SEQ ID NO: 366923 - RNA, 64 nt, Homo Sapiens
uuauuuuuuauuauguaacaaaugguaagugaacaauuuuaaauaaauuaaauuuuuaagaguu

SEQ ID NO: 366924 - RNA, 64 nt, Homo Sapiens
auuaagucuguaaauaucagaaaaauuuuuuaaaaauuuuaauccauauuuuugcagauacagg

SEQ ID NO: 366925 - RNA, 64 nt, Homo Sapiens
agacauauuacacuuggacccugucucuaaaauaaauuuuaaaacugggugacagagcaagacc

SEQ ID NO: 366926 - RNA, 64 nt, Homo Sapiens
uuagcugggcgugguggugucgcaucuacagaaaaauuuuaaaaugggcaacacagcaagacac

SEQ ID NO: 366927 - RNA, 64 nt, Homo Sapiens
aaucaacaucuugagguuguaaaaguuggcuaaaaauuuuaaaaauuuuucuaggcauaaaaau

SEQ ID NO: 366928 - RNA, 64 nt, Homo Sapiens
aaugguuaugaaauaauguuaugagauaaaauuuaauuuuaaaaaaaacuggcugaauggcuga

SEQ ID NO: 366929 - RNA, 64 nt, Homo Sapiens
uaucucuccauauagguauuucuuugauacuuguaauuuuaaauuucagcuucacgauauaaaa

SEQ ID NO: 366930 - RNA, 64 nt, Homo Sapiens
uuuuuaacaguuugcuauagcuuacugcuuaacuaauuuuaaauaaggaaauaaguauguuaga

SEQ ID NO: 366931 - RNA, 64 nt, Homo Sapiens
aaauacuaugcuuuauuggucccauguuuugugcaauuuuaaagagauggcuuucuauuaagua

SEQ ID NO: 366932 - RNA, 64 nt, Homo Sapiens
gaagcugguuuucugucacaauuguaauuucccaaauuuuaaaauaucuuauaauaaaauaaaa

SEQ ID NO: 366933 - RNA, 64 nt, Homo Sapiens
auaauaaaauucaccauagcggccagggaaacaaaauuuuaaaaaugucaaugaaaugcuaggg

SEQ ID NO: 366934 - RNA, 64 nt, Homo Sapiens
aguuaccaaagguuuuuauuguguuucguacaaaaauuuuaaaacuagaaagcauggaaauuaa

SEQ ID NO: 366935 - RNA, 64 nt, Homo Sapiens
cuguaugcuuaauguuuacaauaauguggccuugaauuuuaacucgacaaaagagacaaucgau

SEQ ID NO: 366936 - RNA, 64 nt, Homo Sapiens
ggaauugucugauauuuaagguuugucaaaugaaaauuuuaacuaaaugcgcaucucuuucuuu

SEQ ID NO: 366937 - RNA, 64 nt, Homo Sapiens
uuuucuguuaguacaaguuguuaaaaauaggaagaauuuuaauaacuaaccucccuguuugaua

SEQ ID NO: 366938 - RNA, 64 nt, Homo Sapiens
acuggugauagaugucaaauccuuuuacuuugcuaauuuuaaaacugaaaagacuaaugggaug

SEQ ID NO: 366939 - RNA, 64 nt, Homo Sapiens
gccuagcuggucauuucuuuguaagguaguuagcaauuuuaagucuuucuuuggucaacuuuuu

SEQ ID NO: 366940 - RNA, 64 nt, Homo Sapiens
ugcuguuauuuuuuccagauuuaccugccauugaaauuuuaaggaguucuguaauuucaaacac

SEQ ID NO: 366941 - RNA, 64 nt, Homo Sapiens
ucaagaaauguaauuauaaaucuacaucaaacagaauuuuaaggaaaaaugcagagggagaaau

SEQ ID NO: 366942 - RNA, 64 nt, Homo Sapiens
auguguugauauuguggcuauuguugauguugaaaauuuuaaacuuggggaagauuaagaaaag

SEQ ID NO: 366943 - RNA, 64 nt, Homo Sapiens
uuaaaaaacaaacccuuuuagucacuuuaaucagaauuuuaaauguucauguuacauaccaaau

SEQ ID NO: 366944 - RNA, 64 nt, Homo Sapiens
acaaaaagccaauugauguuucuuauucuuuuuaaauuuuaaauauuuuguuauaaauacucac

SEQ ID NO: 366945 - RNA, 64 nt, Homo Sapiens
ucuguggugaagucauuuucuaaguggaagaggaaauuuuaaagugugguagauacagugaaau

SEQ ID NO: 366946 - RNA, 64 nt, Homo Sapiens
auacagcuuauuagagugugggaauagggaucuaaauuuuaaauaaaauuauauauauauauaa

SEQ ID NO: 366947 - RNA, 64 nt, Homo Sapiens
uccauuuuuagugaaauauuauuuuauagcuacuaauuuuaaaaugucuugcuugauuguaugg

SEQ ID NO: 366948 - RNA, 64 nt, Homo Sapiens
uauggcuugaguuuaaauuguaauaggcguaacuaauuuuaacucuauaauguguucauucugg

SEQ ID NO: 366949 - RNA, 64 nt, Homo Sapiens
uaguaggauaugccugcucuuuggccugaugaccaauuuuaacuuagagcuuuuuuuuuuuaau

SEQ ID NO: 366950 - RNA, 64 nt, Homo Sapiens
uguugaugcaauccuuacaaaugauugcuuuuaaaauuuuaagcuaggaaaagaaaucuauaga

SEQ ID NO: 366951 - RNA, 64 nt, Homo Sapiens
augugauugcucuaauaaagguuauaauuuuuugaauuuuaaaauucaaaugaucaaaaauaua

SEQ ID NO: 366952 - RNA, 64 nt, Homo Sapiens
uaaauaaauaauuuaaauuuucuuaugggcuucuaauuuuaauauuaaaaaaaucuaaagcagc

SEQ ID NO: 366953 - RNA, 64 nt, Homo Sapiens
uuaaagauaauuuaguuuuauacacagucaauuaaauuuuaacagcagcaauugcacaguuaca

SEQ ID NO: 366954 - RNA, 64 nt, Homo Sapiens
auuuggagcuccauguacugaaucuggcauuaaaaauuuuaagucuauaauaauauuucacuaa

SEQ ID NO: 366955 - RNA, 64 nt, Homo Sapiens
aaauaacaaagauguuuagagcugccuccagaacaauuuuaagaaaaaaagaggacuugcauca

SEQ ID NO: 366956 - RNA, 64 nt, Homo Sapiens
ugauauauaagacauuuuuuuuuuuauaaaaauaaauuuuaaaaacgcaaaauaauguugugag

SEQ ID NO: 366957 - RNA, 64 nt, Homo Sapiens
cuuuccccaagaagucagagaugcuguuacuugaaugauuuaggaaaugagugugugcaccaaa

SEQ ID NO: 366958 - RNA, 64 nt, Homo Sapiens
uccagaucaccugcaauagcagcagugggauaaaaugauuuaaaaacacuguacaauuuaacuc

SEQ ID NO: 366959 - RNA, 64 nt, Homo Sapiens
cuccaucuaggcucugccaacucaugucaaugacaugauuuaaggucguugugccagcagaaau

SEQ ID NO: 366960 - RNA, 64 nt, Homo Sapiens
cacuaacaggcaaauucagaugcugggauuggcaaugauuuaagcaccuucacuaaagucuuau

SEQ ID NO: 366961 - RNA, 64 nt, Homo Sapiens
gaaagagcaaauuagucauuauuuacugaacaugaugauuuacuaaaucucuccaucugcauua

SEQ ID NO: 366962 - RNA, 64 nt, Homo Sapiens
guuauuucaaagcaaacauacuagugauauauauaugauuuauggauguugacgccaauguuca

SEQ ID NO: 366963 - RNA, 64 nt, Homo Sapiens
guagugucacaugaauauucguauuguuaacuaaaugauuuauauuuuacugauuuaauauuac

SEQ ID NO: 366964 - RNA, 64 nt, Homo Sapiens
caacaauccuggcagacaauugaguaauauuuugaugauuuauuuuguuuguaauuaguuauua

SEQ ID NO: 366965 - RNA, 64 nt, Homo Sapiens
ugauuuuaauuuuaacauuucuaaauuggguaagaugauuuaaaauaaucuaguacugaaauua

SEQ ID NO: 366966 - RNA, 64 nt, Homo Sapiens
uuauggcacuagaaaauuuaucuuaauuauuaaaaugauuuacuuaucauaaacuauuuaugua

SEQ ID NO: 366967 - RNA, 64 nt, Homo Sapiens
gacuuacagugccaacauuuaaaaaaguaugaaaaugauuuauuuuuauaugauguauacccau

SEQ ID NO: 366968 - RNA, 64 nt, Homo Sapiens
auaugaaauguauuuuaaaauuucacucuggcauaugauuuaucuaucaccauuacuuuuuuuu

SEQ ID NO: 366969 - RNA, 64 nt, Homo Sapiens
cauaugagcacaugaguuaagauugugacugaucaugauuuauuugaagauggagcacugcuga

SEQ ID NO: 366970 - RNA, 64 nt, Homo Sapiens
agaaagacuuuacccaauucaguugucagacauaaugauuuauuugaaggcuuguuuuauuuga

SEQ ID NO: 366971 - RNA, 64 nt, Homo Sapiens
aagugccugauacucccuuacacugaaucauguuaugauuuauagaaauaccuuuccuguagcu

SEQ ID NO: 366972 - RNA, 64 nt, Homo Sapiens
uuacauuguauuagguguuauaagcaaucuagagaugauuuagcaaguauacaggaggaugugc

SEQ ID NO: 366973 - RNA, 64 nt, Homo Sapiens
acuuuaauuuucuaaacauaucuauauauaaaccaugauuuaaaauagauuaaauguaucauua

SEQ ID NO: 366974 - RNA, 64 nt, Homo Sapiens
uguuuuugugucaucccuacgaaugacugucaauaugauuuauuuuauucuuuuuuaguagagg

SEQ ID NO: 366975 - RNA, 64 nt, Homo Sapiens
caaagaacauguauaguuuuuguacccagagacuaugauuuauauugauugcacuugccugcca

SEQ ID NO: 366976 - RNA, 64 nt, Homo Sapiens
agacuaugauuuauauugauugcacuugccugccaugauuuagauaagauuuuuuuugcauggu

SEQ ID NO: 366977 - RNA, 64 nt, Homo Sapiens
gugacaaagaaucaauauguaaaaaguauaaugaaugauuuagauuuuaagugccuuuucacug

SEQ ID NO: 366978 - RNA, 64 nt, Homo Sapiens
aguuucuauuuuguaaauacaguacuuaaguuauaugauuuauauuaaaacauuuauugacaaa

SEQ ID NO: 366979 - RNA, 64 nt, Homo Sapiens
uagauauugguuuaaaugauacaguauuuuagguaugauuuaagacuaugauuuaccuauacau

SEQ ID NO: 366980 - RNA, 64 nt, Homo Sapiens
aaaugauacaguauuuuagguaugauuuaagacuaugauuuaccuauacauuauauauauuuua

SEQ ID NO: 366981 - RNA, 64 nt, Homo Sapiens
uaacaagaaaacauuucuucuuagcuguaugaauaugauuuaauuauuuuauuucuguaaaaua

SEQ ID NO: 366982 - RNA, 64 nt, Homo Sapiens
gaggguuuacacaaagugcccgaaucuguuuuucaugauuuauaauuauuaaauccaggcauuu

SEQ ID NO: 366983 - RNA, 64 nt, Homo Sapiens
guugucccuacuuucucucuugcucaaauuacuaaugauuuagucauaugccuuggaggaaaug

SEQ ID NO: 366984 - RNA, 64 nt, Homo Sapiens
gacuacaauaaaaccaaacauaaugaaguauuacaugauuuaaauuauguggaauaauacauac

SEQ ID NO: 366985 - RNA, 64 nt, Homo Sapiens
gguaauuaaauguucacauuaaauuacuucauauaugauuuaaauuuggaaguguauagcaugu

SEQ ID NO: 366986 - RNA, 64 nt, Homo Sapiens
uuaauucagccaaacauaaagugaauugacguuuaugauuuaugacaauuugcacuguacacua

SEQ ID NO: 366987 - RNA, 64 nt, Homo Sapiens
ggcaaaaugcuaauacuaacauuuguagcacuugaugauuuacaaaguccuuuuacaucuguuu

SEQ ID NO: 366988 - RNA, 64 nt, Homo Sapiens
ugcacacacaccgauacauuuaccuuuuaaaaaaaugauuuauaagugaacuguuaggcuccag

SEQ ID NO: 366989 - RNA, 64 nt, Homo Sapiens
acaaaauaaaagagcgaggacaaauuacuauaugaugauuuaaagcugaaguuagucuuaaacu

SEQ ID NO: 366990 - RNA, 64 nt, Homo Sapiens
aaauacuuucaauauuauucgucacuguuauuaaaugauuuaggccaaaucuuuauuuauugug

SEQ ID NO: 366991 - RNA, 64 nt, Homo Sapiens
aaucaccacuuucuucuagugaugcuuuaccaauaugauuuacauuuguuaacuucucccccua

SEQ ID NO: 366992 - RNA, 64 nt, Homo Sapiens
uuguuuggaaggcagggcaggcugccguugcuaaaugauuuaauaauauuguaauucuguauuu

SEQ ID NO: 366993 - RNA, 64 nt, Homo Sapiens
uucgggcaauuauguuuagcaaaguaaaaacuacaugauuuauuaucuucuggucugaccacuu

SEQ ID NO: 366994 - RNA, 64 nt, Homo Sapiens
uuugaaauguguugccagacauauuuauaguuaaaugauuuauagucuccugaauguccucuga

SEQ ID NO: 366995 - RNA, 64 nt, Homo Sapiens
aaaaagaaaauuccugggcaaaaauacauuaaagaugauuuaaaaugaggcaaaaaaauuauua

SEQ ID NO: 366996 - RNA, 64 nt, Homo Sapiens
ugguaaaugaggcaaaaaaaaucuauuuauuuagaugauuuaucuugguaagagacuguauagc

SEQ ID NO: 366997 - RNA, 64 nt, Homo Sapiens
gagugauuaacagaggucuauucuagugaguuauaugauuuacgugucuuaccucuacugaaua

SEQ ID NO: 366998 - RNA, 64 nt, Homo Sapiens
aaagacacccaagccagaggucccucuauaaauuaugauuuacaaugcaaagguaaaucaaagu

SEQ ID NO: 366999 - RNA, 64 nt, Homo Sapiens; identical to SEQ ID NO: 147168

SEQ ID NO: 367000 - RNA, 64 nt, Homo Sapiens; identical to SEQ ID NO: 147169

SEQ ID NO: 367001 - RNA, 64 nt, Homo Sapiens; identical to SEQ ID NO: 147170

SEQ ID NO: 367002 - RNA, 64 nt, Homo Sapiens; identical to SEQ ID NO: 147171

SEQ ID NO: 367003 - RNA, 64 nt, Homo Sapiens; identical to SEQ ID NO: 147172

SEQ ID NO: 367004 - RNA, 64 nt, Homo Sapiens; identical to SEQ ID NO: 147173

SEQ ID NO: 367005 - RNA, 64 nt, Homo Sapiens; identical to SEQ ID NO: 147174

SEQ ID NO: 367006 - RNA, 64 nt, Homo Sapiens; identical to SEQ ID NO: 147175

SEQ ID NO: 367007 - RNA, 64 nt, Homo Sapiens; identical to SEQ ID NO: 147176

SEQ ID NO: 367008 - RNA, 64 nt, Homo Sapiens; identical to SEQ ID NO: 147177

SEQ ID NO: 367009 - RNA, 64 nt, Homo Sapiens; identical to SEQ ID NO: 147178

SEQ ID NO: 367010 - RNA, 64 nt, Homo Sapiens; identical to SEQ ID NO: 147179

SEQ ID NO: 367011 - RNA, 64 nt, Homo Sapiens; identical to SEQ ID NO: 210930

SEQ ID NO: 367012 - RNA, 64 nt, Homo Sapiens; identical to SEQ ID NO: 210931

SEQ ID NO: 367013 - RNA, 64 nt, Homo Sapiens; identical to SEQ ID NO: 210932

SEQ ID NO: 367014 - RNA, 64 nt, Homo Sapiens; identical to SEQ ID NO: 210933

SEQ ID NO: 367015 - RNA, 64 nt, Homo Sapiens; identical to SEQ ID NO: 210934

SEQ ID NO: 367016 - RNA, 64 nt, Homo Sapiens; identical to SEQ ID NO: 210935

SEQ ID NO: 367017 - RNA, 64 nt, Homo Sapiens; identical to SEQ ID NO: 210936

SEQ ID NO: 367018 - RNA, 64 nt, Homo Sapiens; identical to SEQ ID NO: 210937

SEQ ID NO: 367019 - RNA, 64 nt, Homo Sapiens; identical to SEQ ID NO: 210938

SEQ ID NO: 367020 - RNA, 64 nt, Homo Sapiens; identical to SEQ ID NO: 210939

SEQ ID NO: 367021 - RNA, 64 nt, Homo Sapiens; identical to SEQ ID NO: 210940

SEQ ID NO: 367022 - RNA, 64 nt, Homo Sapiens; identical to SEQ ID NO: 210941

SEQ ID NO: 367023 - RNA, 64 nt, Homo Sapiens; identical to SEQ ID NO: 210942

SEQ ID NO: 367024 - RNA, 64 nt, Homo Sapiens; identical to SEQ ID NO: 210943

SEQ ID NO: 367025 - RNA, 64 nt, Homo Sapiens; identical to SEQ ID NO: 210944

SEQ ID NO: 367026 - RNA, 64 nt, Homo Sapiens; identical to SEQ ID NO: 210945

SEQ ID NO: 367027 - RNA, 64 nt, Homo Sapiens; identical to SEQ ID NO: 210946

SEQ ID NO: 367028 - RNA, 64 nt, Homo Sapiens; identical to SEQ ID NO: 210947

SEQ ID NO: 367029 - RNA, 64 nt, Homo Sapiens; identical to SEQ ID NO: 124377

SEQ ID NO: 367030 - RNA, 64 nt, Homo Sapiens; identical to SEQ ID NO: 124378

SEQ ID NO: 367031 - RNA, 64 nt, Homo Sapiens; identical to SEQ ID NO: 124379

SEQ ID NO: 367032 - RNA, 64 nt, Homo Sapiens; identical to SEQ ID NO: 124380

SEQ ID NO: 367033 - RNA, 64 nt, Homo Sapiens; identical to SEQ ID NO: 124381

SEQ ID NO: 367034 - RNA, 64 nt, Homo Sapiens; identical to SEQ ID NO: 124382

SEQ ID NO: 367035 - RNA, 64 nt, Homo Sapiens; identical to SEQ ID NO: 124383

SEQ ID NO: 367036 - RNA, 64 nt, Homo Sapiens; identical to SEQ ID NO: 124384

SEQ ID NO: 367037 - RNA, 64 nt, Homo Sapiens; identical to SEQ ID NO: 271653

SEQ ID NO: 367038 - RNA, 64 nt, Homo Sapiens; identical to SEQ ID NO: 271654

SEQ ID NO: 367039 - RNA, 64 nt, Homo Sapiens; identical to SEQ ID NO: 271655

SEQ ID NO: 367040 - RNA, 64 nt, Homo Sapiens; identical to SEQ ID NO: 271656

SEQ ID NO: 367041 - RNA, 64 nt, Homo Sapiens; identical to SEQ ID NO: 271657

SEQ ID NO: 367042 - RNA, 64 nt, Homo Sapiens; identical to SEQ ID NO: 271658

SEQ ID NO: 367043 - RNA, 64 nt, Homo Sapiens; identical to SEQ ID NO: 271659

SEQ ID NO: 367044 - RNA, 64 nt, Homo Sapiens; identical to SEQ ID NO: 271660

SEQ ID NO: 367045 - RNA, 64 nt, Homo Sapiens; identical to SEQ ID NO: 271661

SEQ ID NO: 367046 - RNA, 64 nt, Homo Sapiens; identical to SEQ ID NO: 271662

SEQ ID NO: 367047 - RNA, 64 nt, Homo Sapiens; identical to SEQ ID NO: 271663

SEQ ID NO: 367048 - RNA, 64 nt, Homo Sapiens; identical to SEQ ID NO: 271664

SEQ ID NO: 367049 - RNA, 64 nt, Homo Sapiens; identical to SEQ ID NO: 271665

SEQ ID NO: 367050 - RNA, 64 nt, Homo Sapiens; identical to SEQ ID NO: 271666

SEQ ID NO: 367051 - RNA, 64 nt, Homo Sapiens; identical to SEQ ID NO: 271667

SEQ ID NO: 367052 - RNA, 64 nt, Homo Sapiens; identical to SEQ ID NO: 271668

SEQ ID NO: 367053 - RNA, 64 nt, Homo Sapiens; identical to SEQ ID NO: 271669

SEQ ID NO: 367054 - RNA, 64 nt, Homo Sapiens; identical to SEQ ID NO: 271670

SEQ ID NO: 367055 - RNA, 64 nt, Homo Sapiens; identical to SEQ ID NO: 271671

SEQ ID NO: 367056 - RNA, 64 nt, Homo Sapiens; identical to SEQ ID NO: 271672

SEQ ID NO: 367057 - RNA, 64 nt, Homo Sapiens; identical to SEQ ID NO: 271673

SEQ ID NO: 367058 - RNA, 64 nt, Homo Sapiens; identical to SEQ ID NO: 271674

SEQ ID NO: 367059 - RNA, 64 nt, Homo Sapiens; identical to SEQ ID NO: 271675

SEQ ID NO: 367060 - RNA, 64 nt, Homo Sapiens; identical to SEQ ID NO: 271676

SEQ ID NO: 367061 - RNA, 64 nt, Homo Sapiens; identical to SEQ ID NO: 271677

SEQ ID NO: 367062 - RNA, 64 nt, Homo Sapiens; identical to SEQ ID NO: 271678

SEQ ID NO: 367063 - RNA, 64 nt, Homo Sapiens; identical to SEQ ID NO: 271679

SEQ ID NO: 367064 - RNA, 64 nt, Homo Sapiens; identical to SEQ ID NO: 271680

SEQ ID NO: 367065 - RNA, 64 nt, Homo Sapiens; identical to SEQ ID NO: 271681

SEQ ID NO: 367066 - RNA, 64 nt, Homo Sapiens; identical to SEQ ID NO: 271682

SEQ ID NO: 367067 - RNA, 64 nt, Homo Sapiens; identical to SEQ ID NO: 271683

SEQ ID NO: 367068 - RNA, 64 nt, Homo Sapiens; identical to SEQ ID NO: 271684

SEQ ID NO: 367069 - RNA, 64 nt, Homo Sapiens; identical to SEQ ID NO: 271685

SEQ ID NO: 367070 - RNA, 64 nt, Homo Sapiens; identical to SEQ ID NO: 271686

SEQ ID NO: 367071 - RNA, 64 nt, Homo Sapiens; identical to SEQ ID NO: 271687

SEQ ID NO: 367072 - RNA, 64 nt, Homo Sapiens; identical to SEQ ID NO: 271688

SEQ ID NO: 367073 - RNA, 64 nt, Homo Sapiens; identical to SEQ ID NO: 271689

SEQ ID NO: 367074 - RNA, 64 nt, Homo Sapiens; identical to SEQ ID NO: 271690

SEQ ID NO: 367075 - RNA, 64 nt, Homo Sapiens; identical to SEQ ID NO: 271691

SEQ ID NO: 367076 - RNA, 64 nt, Homo Sapiens; identical to SEQ ID NO: 271692

SEQ ID NO: 367077 - RNA, 64 nt, Homo Sapiens; identical to SEQ ID NO: 271693

SEQ ID NO: 367078 - RNA, 64 nt, Homo Sapiens; identical to SEQ ID NO: 271694

SEQ ID NO: 367079 - RNA, 64 nt, Homo Sapiens; identical to SEQ ID NO: 271695

SEQ ID NO: 367080 - RNA, 64 nt, Homo Sapiens; identical to SEQ ID NO: 271696

SEQ ID NO: 367081 - RNA, 64 nt, Homo Sapiens; identical to SEQ ID NO: 271697

SEQ ID NO: 367082 - RNA, 64 nt, Homo Sapiens; identical to SEQ ID NO: 235770

SEQ ID NO: 367083 - RNA, 64 nt, Homo Sapiens; identical to SEQ ID NO: 235771

SEQ ID NO: 367084 - RNA, 64 nt, Homo Sapiens; identical to SEQ ID NO: 235772

SEQ ID NO: 367085 - RNA, 64 nt, Homo Sapiens; identical to SEQ ID NO: 235773

SEQ ID NO: 367086 - RNA, 64 nt, Homo Sapiens; identical to SEQ ID NO: 235774

SEQ ID NO: 367087 - RNA, 64 nt, Homo Sapiens; identical to SEQ ID NO: 235775

SEQ ID NO: 367088 - RNA, 64 nt, Homo Sapiens; identical to SEQ ID NO: 237249

SEQ ID NO: 367089 - RNA, 64 nt, Homo Sapiens; identical to SEQ ID NO: 237250

SEQ ID NO: 367090 - RNA, 64 nt, Homo Sapiens; identical to SEQ ID NO: 237251

SEQ ID NO: 367091 - RNA, 64 nt, Homo Sapiens; identical to SEQ ID NO: 237252

SEQ ID NO: 367092 - RNA, 64 nt, Homo Sapiens; identical to SEQ ID NO: 97557

SEQ ID NO: 367093 - RNA, 64 nt, Homo Sapiens; identical to SEQ ID NO: 97558

SEQ ID NO: 367094 - RNA, 64 nt, Homo Sapiens; identical to SEQ ID NO: 97559

SEQ ID NO: 367095 - RNA, 64 nt, Homo Sapiens; identical to SEQ ID NO: 97560

SEQ ID NO: 367096 - RNA, 64 nt, Homo Sapiens; identical to SEQ ID NO: 97561

SEQ ID NO: 367097 - RNA, 64 nt, Homo Sapiens; identical to SEQ ID NO: 97562

SEQ ID NO: 367098 - RNA, 64 nt, Homo Sapiens; identical to SEQ ID NO: 97563

SEQ ID NO: 367099 - RNA, 64 nt, Homo Sapiens; identical to SEQ ID NO: 97564

SEQ ID NO: 367100 - RNA, 64 nt, Homo Sapiens; identical to SEQ ID NO: 97565

SEQ ID NO: 367101 - RNA, 64 nt, Homo Sapiens; identical to SEQ ID NO: 97566

SEQ ID NO: 367102 - RNA, 62 nt, Homo Sapiens; identical to SEQ ID NO: 97567

SEQ ID NO: 367103 - RNA, 64 nt, Homo Sapiens; identical to SEQ ID NO: 97568

SEQ ID NO: 367104 - RNA, 64 nt, Homo Sapiens; identical to SEQ ID NO: 97569

SEQ ID NO: 367105 - RNA, 64 nt, Homo Sapiens; identical to SEQ ID NO: 97570

SEQ ID NO: 367106 - RNA, 64 nt, Homo Sapiens; identical to SEQ ID NO: 97571

SEQ ID NO: 367107 - RNA, 64 nt, Homo Sapiens; identical to SEQ ID NO: 97572

SEQ ID NO: 367108 - RNA, 64 nt, Homo Sapiens
uccaccccaguccuauuuguagauuaaauauaaacacagcaaguuacuacgcauauacgguaag

SEQ ID NO: 367109 - RNA, 64 nt, Homo Sapiens
cucuaucucaaaaaaaagaauccacccuggguaacacagcaagaugagcuaugaucagcugcaa

SEQ ID NO: 367110 - RNA, 64 nt, Homo Sapiens
ccccaucucuacaaaaauauacuagcccagguaacacagcaagacuaauauagaaacucacaua

SEQ ID NO: 367111 - RNA, 64 nt, Homo Sapiens
ccugaggaaagugcuauucuuaucauugaauucucacagcaacugcugauguaagcacuuuagg

SEQ ID NO: 367112 - RNA, 64 nt, Homo Sapiens
ucgaaaccagggagaaagugaacaugaaaaccuccacagcaacauuuuuaauauuuuuuaaugg

SEQ ID NO: 367113 - RNA, 52 nt, Homo Sapiens
aacuggaggagaccagcuagcccacagcaaccaaagagacuuccucuuggcg

SEQ ID NO: 367114 - RNA, 64 nt, Homo Sapiens
aagcuacugcaagguuccaggcuugggccugggccacagcaacagcaguggucaaauaucuaga

SEQ ID NO: 367115 - RNA, 64 nt, Homo Sapiens
cauuuuucuuucaugaaaaucacuuguguuucuacacagcaaacaucuuugguaccaaagauua

SEQ ID NO: 367116 - RNA, 64 nt, Homo Sapiens
ccaagcauauuagaagaggaacugucaggcugcccacagcaacaacaaagcaaauauguucauc

SEQ ID NO: 367117 - RNA, 64 nt, Homo Sapiens
cagaugugagaacaugcugcaagagccugccagccacagcaaucaggacucacagcucuucaag

SEQ ID NO: 367118 - RNA, 64 nt, Homo Sapiens
aggcaguaaccauuacuucuaaccguaacacaaacacagcaaguuuuaaccuuuuaaacuuuuc

SEQ ID NO: 367119 - RNA, 64 nt, Homo Sapiens
aaaggggaaaaggaacuuugccaaugauagugaccacagcaaaagcaaauaauaauaauauuaa

SEQ ID NO: 367120 - RNA, 64 nt, Homo Sapiens
gcugcccggaguuggguccuugccuggauuuugacacagcaacuuccuguagugagcacuuugu

SEQ ID NO: 367121 - RNA, 64 nt, Homo Sapiens
gcuuggauuuuaugcaguaguuucuccaacuguucacagcaaauccuagguucuuccugacugc

SEQ ID NO: 367122 - RNA, 64 nt, Homo Sapiens
acaaacaaacgcaagaagagagggguggaacuugcacagcaaaauggaucaauuucuuuuucau

SEQ ID NO: 367123 - RNA, 64 nt, Homo Sapiens
ccaugugcagggcgucccccccuuccagucauugcacagcaaagcuacugcccaugccgggcgg

SEQ ID NO: 367124 - RNA, 64 nt, Homo Sapiens
gccaaucccgcugaagaggcgccuguucucagggcacagcaacuuucagggaucacacaguucu

SEQ ID NO: 367125 - RNA, 64 nt, Homo Sapiens
cuugccccaacccccagcacccgggcucagggaccacagcaaggcaccugcagguugggccaua

SEQ ID NO: 367126 - RNA, 64 nt, Homo Sapiens
ugcccaggacggggccggccaggugggcgggcagcacagcaaggaggcuggcuggggccuauca

SEQ ID NO: 367127 - RNA, 64 nt, Homo Sapiens
gagaugacucagcacugucccuuagcagggaugacacagcaaggaugacucagcacugccccuc

SEQ ID NO: 367128 - RNA, 64 nt, Homo Sapiens; identical to SEQ ID NO: 367127

SEQ ID NO: 367129 - RNA, 64 nt, Homo Sapiens
gggaugacucagcacugucccuuagcagugaugacacagcaaggaugacucagcacugccccuc

SEQ ID NO: 367130 - RNA, 64 nt, Homo Sapiens
gggaugacucagcagugucccuuagcagcgaugacacagcaaggaugacucagcacugccccuc

SEQ ID NO: 367131 - RNA, 64 nt, Homo Sapiens
gacagagcagccaaugaaaacggccgccugaacccacagcaauaagaaugaaugaggaugccuu

SEQ ID NO: 367132 - RNA, 64 nt, Homo Sapiens
caggcccgggacgaggccuccccuucagcucaggcacagcaacuugcccaggacugacacuguc

SEQ ID NO: 367133 - RNA, 64 nt, Homo Sapiens
ccccaucucuacaaaauauugccagccagggcaacacagcaagacuugaggccagguguuugag

SEQ ID NO: 367134 - RNA, 64 nt, Homo Sapiens
uacauucauaauauacguacgcaggaaggagaagcacagcaauacaggagucuuccggagucag

SEQ ID NO: 367135 - RNA, 64 nt, Homo Sapiens
gccuuuugaugucuuuuuaggacuuucucuucuacacagcaauacgucgugcucgaguauccuu

SEQ ID NO: 367136 - RNA, 64 nt, Homo Sapiens
ggggguggccuguggcuuguauccuucaguccaccacagcaaauguguguagauuucaugcucg

SEQ ID NO: 367137 - RNA, 64 nt, Homo Sapiens
cuccauuauagcuuucacaccuugcagagagacucacagcaacugaacuguuuguucuuggugc

SEQ ID NO: 367138 - RNA, 64 nt, Homo Sapiens
ugcaacaauauguaaaguuguuuaaagggcauagcacagcaaucuuacccugagaaauuaucau

SEQ ID NO: 367139 - RNA, 64 nt, Homo Sapiens; identical to SEQ ID NO: 196032

SEQ ID NO: 367140 - RNA, 64 nt, Homo Sapiens; identical to SEQ ID NO: 196033

SEQ ID NO: 367141 - RNA, 64 nt, Homo Sapiens; identical to SEQ ID NO: 196034

SEQ ID NO: 367142 - RNA, 64 nt, Homo Sapiens; identical to SEQ ID NO: 196035

SEQ ID NO: 367143 - RNA, 64 nt, Homo Sapiens; identical to SEQ ID NO: 196036

SEQ ID NO: 367144 - RNA, 64 nt, Homo Sapiens; identical to SEQ ID NO: 196037

SEQ ID NO: 367145 - RNA, 64 nt, Homo Sapiens; identical to SEQ ID NO: 196038

SEQ ID NO: 367146 - RNA, 64 nt, Homo Sapiens; identical to SEQ ID NO: 196039

SEQ ID NO: 367147 - RNA, 64 nt, Homo Sapiens; identical to SEQ ID NO: 196040

SEQ ID NO: 367148 - RNA, 64 nt, Homo Sapiens; identical to SEQ ID NO: 196041

SEQ ID NO: 367149 - RNA, 64 nt, Homo Sapiens; identical to SEQ ID NO: 196042

SEQ ID NO: 367150 - RNA, 64 nt, Homo Sapiens; identical to SEQ ID NO: 196043

SEQ ID NO: 367151 - RNA, 64 nt, Homo Sapiens; identical to SEQ ID NO: 196044

SEQ ID NO: 367152 - RNA, 64 nt, Homo Sapiens; identical to SEQ ID NO: 196045

SEQ ID NO: 367153 - RNA, 64 nt, Homo Sapiens; identical to SEQ ID NO: 196046

SEQ ID NO: 367154 - RNA, 64 nt, Homo Sapiens; identical to SEQ ID NO: 196047

SEQ ID NO: 367155 - RNA, 64 nt, Homo Sapiens; identical to SEQ ID NO: 196048

SEQ ID NO: 367156 - RNA, 64 nt, Homo Sapiens; identical to SEQ ID NO: 196049

SEQ ID NO: 367157 - RNA, 64 nt, Homo Sapiens; identical to SEQ ID NO: 196050

SEQ ID NO: 367158 - RNA, 64 nt, Homo Sapiens; identical to SEQ ID NO: 196051

SEQ ID NO: 367159 - RNA, 64 nt, Homo Sapiens; identical to SEQ ID NO: 196052

SEQ ID NO: 367160 - RNA, 64 nt, Homo Sapiens; identical to SEQ ID NO: 196053

SEQ ID NO: 367161 - RNA, 64 nt, Homo Sapiens; identical to SEQ ID NO: 196054

SEQ ID NO: 367162 - RNA, 64 nt, Homo Sapiens; identical to SEQ ID NO: 196055

SEQ ID NO: 367163 - RNA, 64 nt, Homo Sapiens; identical to SEQ ID NO: 118026

SEQ ID NO: 367164 - RNA, 64 nt, Homo Sapiens; identical to SEQ ID NO: 118027

SEQ ID NO: 367165 - RNA, 64 nt, Homo Sapiens; identical to SEQ ID NO: 118028

SEQ ID NO: 367166 - RNA, 64 nt, Homo Sapiens; identical to SEQ ID NO: 118029

SEQ ID NO: 367167 - RNA, 64 nt, Homo Sapiens; identical to SEQ ID NO: 118030

SEQ ID NO: 367168 - RNA, 64 nt, Homo Sapiens; identical to SEQ ID NO: 118031

SEQ ID NO: 367169 - RNA, 64 nt, Homo Sapiens; identical to SEQ ID NO: 118032

SEQ ID NO: 367170 - RNA, 64 nt, Homo Sapiens; identical to SEQ ID NO: 118033

SEQ ID NO: 367171 - RNA, 64 nt, Homo Sapiens; identical to SEQ ID NO: 118034

SEQ ID NO: 367172 - RNA, 64 nt, Homo Sapiens; identical to SEQ ID NO: 118035

SEQ ID NO: 367173 - RNA, 64 nt, Homo Sapiens; identical to SEQ ID NO: 118036

SEQ ID NO: 367174 - RNA, 64 nt, Homo Sapiens; identical to SEQ ID NO: 118037

SEQ ID NO: 367175 - RNA, 64 nt, Homo Sapiens; identical to SEQ ID NO: 118038

SEQ ID NO: 367176 - RNA, 64 nt, Homo Sapiens; identical to SEQ ID NO: 118039

SEQ ID NO: 367177 - RNA, 64 nt, Homo Sapiens; identical to SEQ ID NO: 118040

SEQ ID NO: 367178 - RNA, 64 nt, Homo Sapiens; identical to SEQ ID NO: 118041

SEQ ID NO: 367179 - RNA, 64 nt, Homo Sapiens; identical to SEQ ID NO: 118042

SEQ ID NO: 367180 - RNA, 64 nt, Homo Sapiens; identical to SEQ ID NO: 118043

SEQ ID NO: 367181 - RNA, 64 nt, Homo Sapiens; identical to SEQ ID NO: 118044

SEQ ID NO: 367182 - RNA, 64 nt, Homo Sapiens; identical to SEQ ID NO: 118045

SEQ ID NO: 367183 - RNA, 64 nt, Homo Sapiens; identical to SEQ ID NO: 118046

SEQ ID NO: 367184 - RNA, 64 nt, Homo Sapiens; identical to SEQ ID NO: 118047

SEQ ID NO: 367185 - RNA, 64 nt, Homo Sapiens; identical to SEQ ID NO: 118048

SEQ ID NO: 367186 - RNA, 64 nt, Homo Sapiens; identical to SEQ ID NO: 118049

SEQ ID NO: 367187 - RNA, 64 nt, Homo Sapiens; identical to SEQ ID NO: 118050

SEQ ID NO: 367188 - RNA, 64 nt, Homo Sapiens; identical to SEQ ID NO: 118051

SEQ ID NO: 367189 - RNA, 64 nt, Homo Sapiens; identical to SEQ ID NO: 118052

SEQ ID NO: 367190 - RNA, 64 nt, Homo Sapiens; identical to SEQ ID NO: 118053

SEQ ID NO: 367191 - RNA, 64 nt, Homo Sapiens; identical to SEQ ID NO: 118054

SEQ ID NO: 367192 - RNA, 64 nt, Homo Sapiens; identical to SEQ ID NO: 118055

SEQ ID NO: 367193 - RNA, 64 nt, Homo Sapiens; identical to SEQ ID NO: 118056

SEQ ID NO: 367194 - RNA, 64 nt, Homo Sapiens; identical to SEQ ID NO: 118057

SEQ ID NO: 367195 - RNA, 64 nt, Homo Sapiens; identical to SEQ ID NO: 118058

SEQ ID NO: 367196 - RNA, 64 nt, Homo Sapiens; identical to SEQ ID NO: 118059

SEQ ID NO: 367197 - RNA, 64 nt, Homo Sapiens; identical to SEQ ID NO: 118060

SEQ ID NO: 367198 - RNA, 64 nt, Homo Sapiens; identical to SEQ ID NO: 118061

SEQ ID NO: 367199 - RNA, 64 nt, Homo Sapiens; identical to SEQ ID NO: 118062

SEQ ID NO: 367200 - RNA, 64 nt, Homo Sapiens; identical to SEQ ID NO: 118063

SEQ ID NO: 367201 - RNA, 64 nt, Homo Sapiens; identical to SEQ ID NO: 118064

SEQ ID NO: 367202 - RNA, 64 nt, Homo Sapiens; identical to SEQ ID NO: 118065

SEQ ID NO: 367203 - RNA, 64 nt, Homo Sapiens; identical to SEQ ID NO: 118066

SEQ ID NO: 367204 - RNA, 64 nt, Homo Sapiens; identical to SEQ ID NO: 148065

SEQ ID NO: 367205 - RNA, 64 nt, Homo Sapiens; identical to SEQ ID NO: 148066

SEQ ID NO: 367206 - RNA, 64 nt, Homo Sapiens; identical to SEQ ID NO: 148067

SEQ ID NO: 367207 - RNA, 64 nt, Homo Sapiens; identical to SEQ ID NO: 148068

SEQ ID NO: 367208 - RNA, 64 nt, Homo Sapiens; identical to SEQ ID NO: 148069

SEQ ID NO: 367209 - RNA, 64 nt, Homo Sapiens; identical to SEQ ID NO: 148070

SEQ ID NO: 367210 - RNA, 64 nt, Homo Sapiens; identical to SEQ ID NO: 148071

SEQ ID NO: 367211 - RNA, 64 nt, Homo Sapiens; identical to SEQ ID NO: 148072

SEQ ID NO: 367212 - RNA, 64 nt, Homo Sapiens; identical to SEQ ID NO: 148073

SEQ ID NO: 367213 - RNA, 64 nt, Homo Sapiens; identical to SEQ ID NO: 148074

SEQ ID NO: 367214 - RNA, 64 nt, Homo Sapiens; identical to SEQ ID NO: 148075

SEQ ID NO: 367215 - RNA, 64 nt, Homo Sapiens; identical to SEQ ID NO: 148076

SEQ ID NO: 367216 - RNA, 64 nt, Homo Sapiens; identical to SEQ ID NO: 148077

SEQ ID NO: 367217 - RNA, 64 nt, Homo Sapiens; identical to SEQ ID NO: 148078

SEQ ID NO: 367218 - RNA, 64 nt, Homo Sapiens; identical to SEQ ID NO: 148079

SEQ ID NO: 367219 - RNA, 64 nt, Homo Sapiens; identical to SEQ ID NO: 148080

SEQ ID NO: 367220 - RNA, 64 nt, Homo Sapiens; identical to SEQ ID NO: 148081

SEQ ID NO: 367221 - RNA, 64 nt, Homo Sapiens; identical to SEQ ID NO: 148082

SEQ ID NO: 367222 - RNA, 64 nt, Homo Sapiens; identical to SEQ ID NO: 148083

SEQ ID NO: 367223 - RNA, 64 nt, Homo Sapiens; identical to SEQ ID NO: 148084

SEQ ID NO: 367224 - RNA, 64 nt, Homo Sapiens; identical to SEQ ID NO: 148085

SEQ ID NO: 367225 - RNA, 64 nt, Homo Sapiens; identical to SEQ ID NO: 148086

SEQ ID NO: 367226 - RNA, 64 nt, Homo Sapiens; identical to SEQ ID NO: 148087

SEQ ID NO: 367227 - RNA, 64 nt, Homo Sapiens; identical to SEQ ID NO: 148088

SEQ ID NO: 367228 - RNA, 64 nt, Homo Sapiens; identical to SEQ ID NO: 148089

SEQ ID NO: 367229 - RNA, 64 nt, Homo Sapiens; identical to SEQ ID NO: 148090

SEQ ID NO: 367230 - RNA, 64 nt, Homo Sapiens; identical to SEQ ID NO: 148091

SEQ ID NO: 367231 - RNA, 64 nt, Homo Sapiens; identical to SEQ ID NO: 148092

SEQ ID NO: 367232 - RNA, 64 nt, Homo Sapiens; identical to SEQ ID NO: 148093

SEQ ID NO: 367233 - RNA, 64 nt, Homo Sapiens; identical to SEQ ID NO: 148094

SEQ ID NO: 367234 - RNA, 64 nt, Homo Sapiens; identical to SEQ ID NO: 148095

SEQ ID NO: 367235 - RNA, 64 nt, Homo Sapiens; identical to SEQ ID NO: 148096

SEQ ID NO: 367236 - RNA, 64 nt, Homo Sapiens; identical to SEQ ID NO: 148097

SEQ ID NO: 367237 - RNA, 64 nt, Homo Sapiens; identical to SEQ ID NO: 148098

SEQ ID NO: 367238 - RNA, 64 nt, Homo Sapiens; identical to SEQ ID NO: 148099

SEQ ID NO: 367239 - RNA, 64 nt, Homo Sapiens; identical to SEQ ID NO: 148100

SEQ ID NO: 367240 - RNA, 64 nt, Homo Sapiens; identical to SEQ ID NO: 148101

SEQ ID NO: 367241 - RNA, 64 nt, Homo Sapiens; identical to SEQ ID NO: 148102

SEQ ID NO: 367242 - RNA, 64 nt, Homo Sapiens
gcacacuaagggaccauccccagugucccaauaaaaaguggacuagucaguguuuuugaaaauu

SEQ ID NO: 367243 - RNA, 64 nt, Homo Sapiens
ugauuuuuauuaaggcuguuuuaagagagaaaacaaaguggacuguucguuaugauuugucugu

SEQ ID NO: 367244 - RNA, 64 nt, Homo Sapiens
uauaggaaaugccaggccuuaggugagcaaaaagaaaguggagcaauuggggcagguaggguuc

SEQ ID NO: 367245 - RNA, 64 nt, Homo Sapiens
ucugcagcgcaaaugagagcugagccagucagggaaaguggagugaguuucagacucagccuuc

SEQ ID NO: 367246 - RNA, 64 nt, Homo Sapiens
uguuuuaacagaugccaauuaugcuguucguucaaaaguggaguagagagaucuugagagagaa

SEQ ID NO: 367247 - RNA, 64 nt, Homo Sapiens
ggaucacagauuuuugguaggcaucaggauacucaaaguggaaacugauguugaaacugcuuga

SEQ ID NO: 367248 - RNA, 64 nt, Homo Sapiens
aauuuaaucaaauaguaaaguuguuguaaaaauaaaaguggauuuagaaagauccaguucuuga

SEQ ID NO: 367249 - RNA, 64 nt, Homo Sapiens
auuuuauacgaguugguaauuuuugcuuuuuaauaaaguggaagcuugcuuuuuuaacucuuuu

SEQ ID NO: 367250 - RNA, 64 nt, Homo Sapiens
cagaaggcuaaugggucacaggcuuucugcacugaaaguggaaggcucaccuguaucacugcag

SEQ ID NO: 367251 - RNA, 64 nt, Homo Sapiens
gucagaccagaugaugcucuguuuccuuaucugcaaaguggaagcuucuucuuccuagcuuuca

SEQ ID NO: 367252 - RNA, 64 nt, Homo Sapiens
uggaauuuggaccauacacuauguuacaaaacuaaaaguggaaaaaacuuauuggugaaugaau

SEQ ID NO: 367253 - RNA, 64 nt, Homo Sapiens
uuguguaauaccugacaaacaggcaaccaaagcaaaaguggacaaaugggaucacaucaaguua

SEQ ID NO: 367254 - RNA, 64 nt, Homo Sapiens
cauggcggcagcaagagaaaaugagaaagaagcaaaaguggaaaccccuaauaaaccuaucaga

SEQ ID NO: 367255 - RNA, 64 nt, Homo Sapiens
cauggugguggcaagagaaaaugaagaagaagcaaaaguggaaaccccugauaaacccaucaga

SEQ ID NO: 367256 - RNA, 64 nt, Homo Sapiens
ccugugggauguccaccacaguaaaaggcuuauuaaaguggaugggguugugaccaagaagagg

SEQ ID NO: 367257 - RNA, 64 nt, Homo Sapiens
ucaugaaagauaagcuuuugguaauauucauuuuaaaguggacuuauuaaaauuggaugcuaga

SEQ ID NO: 367258 - RNA, 64 nt, Homo Sapiens
uccauuugccuauaaauaccucuuuaucugucuuaaaguggaaaaugcuauuuuaaucucacau

SEQ ID NO: 367259 - RNA, 64 nt, Homo Sapiens
ugguuugaguagcagaaaacagggaaugaugauaaaaguggauuauacugaaacuuuggaauau

SEQ ID NO: 367260 - RNA, 64 nt, Homo Sapiens
cuccaagcccaggauucuggcaagagaggugaagaaaguggaugcgcagaguucggcuggaaaa

SEQ ID NO: 367261 - RNA, 64 nt, Homo Sapiens
guccuguucacagguucuccuucuucaucaagaaaaaguggaaccagcugucccuccagcaaaa

SEQ ID NO: 367262 - RNA, 64 nt, Homo Sapiens
aucuguccauuccuaccuggacaugucccauuaaaaaguggaagauuuuaaauaauuucuuuac

SEQ ID NO: 367263 - RNA, 64 nt, Homo Sapiens
gggauauggcuuuugguacccaaaagaaacuuaaaaaguggaauuguuaaugccugucagugau

SEQ ID NO: 367264 - RNA, 64 nt, Homo Sapiens
gguacucuacaacaaaucugguucucaugcuauaaaaguggacaaauaaauaguugauuguacu

SEQ ID NO: 367265 - RNA, 64 nt, Homo Sapiens
uuccccauaaaaauuguccauaaaucucuccgcuaaaguggacauuauucuagaaauccagucu

SEQ ID NO: 367266 - RNA, 64 nt, Homo Sapiens
guauuuacagcuuguuaaauagagauggguccccaaaguggaguccuucaugaaauugcaguac

SEQ ID NO: 367267 - RNA, 64 nt, Homo Sapiens; identical to SEQ ID NO: 148065

SEQ ID NO: 367268 - RNA, 64 nt, Homo Sapiens; identical to SEQ ID NO: 148066

SEQ ID NO: 367269 - RNA, 64 nt, Homo Sapiens; identical to SEQ ID NO: 148067

SEQ ID NO: 367270 - RNA, 64 nt, Homo Sapiens; identical to SEQ ID NO: 148068

SEQ ID NO: 367271 - RNA, 64 nt, Homo Sapiens; identical to SEQ ID NO: 148069

SEQ ID NO: 367272 - RNA, 64 nt, Homo Sapiens; identical to SEQ ID NO: 148070

SEQ ID NO: 367273 - RNA, 64 nt, Homo Sapiens; identical to SEQ ID NO: 148071

SEQ ID NO: 367274 - RNA, 64 nt, Homo Sapiens; identical to SEQ ID NO: 148072

SEQ ID NO: 367275 - RNA, 64 nt, Homo Sapiens; identical to SEQ ID NO: 148073

SEQ ID NO: 367276 - RNA, 64 nt, Homo Sapiens; identical to SEQ ID NO: 148074

SEQ ID NO: 367277 - RNA, 64 nt, Homo Sapiens; identical to SEQ ID NO: 148075

SEQ ID NO: 367278 - RNA, 64 nt, Homo Sapiens; identical to SEQ ID NO: 148076

SEQ ID NO: 367279 - RNA, 64 nt, Homo Sapiens; identical to SEQ ID NO: 148077

SEQ ID NO: 367280 - RNA, 64 nt, Homo Sapiens; identical to SEQ ID NO: 148078

SEQ ID NO: 367281 - RNA, 64 nt, Homo Sapiens; identical to SEQ ID NO: 148079

SEQ ID NO: 367282 - RNA, 64 nt, Homo Sapiens; identical to SEQ ID NO: 148080

SEQ ID NO: 367283 - RNA, 64 nt, Homo Sapiens; identical to SEQ ID NO: 148081

SEQ ID NO: 367284 - RNA, 64 nt, Homo Sapiens; identical to SEQ ID NO: 148082

SEQ ID NO: 367285 - RNA, 64 nt, Homo Sapiens; identical to SEQ ID NO: 148083

SEQ ID NO: 367286 - RNA, 64 nt, Homo Sapiens; identical to SEQ ID NO: 148084

SEQ ID NO: 367287 - RNA, 64 nt, Homo Sapiens; identical to SEQ ID NO: 148085

SEQ ID NO: 367288 - RNA, 64 nt, Homo Sapiens; identical to SEQ ID NO: 148086

SEQ ID NO: 367289 - RNA, 64 nt, Homo Sapiens; identical to SEQ ID NO: 148087

SEQ ID NO: 367290 - RNA, 64 nt, Homo Sapiens; identical to SEQ ID NO: 148088

SEQ ID NO: 367291 - RNA, 64 nt, Homo Sapiens; identical to SEQ ID NO: 148089

SEQ ID NO: 367292 - RNA, 64 nt, Homo Sapiens; identical to SEQ ID NO: 148090

SEQ ID NO: 367293 - RNA, 64 nt, Homo Sapiens; identical to SEQ ID NO: 148091

SEQ ID NO: 367294 - RNA, 64 nt, Homo Sapiens; identical to SEQ ID NO: 148092

SEQ ID NO: 367295 - RNA, 64 nt, Homo Sapiens; identical to SEQ ID NO: 148093

SEQ ID NO: 367296 - RNA, 64 nt, Homo Sapiens; identical to SEQ ID NO: 148094

SEQ ID NO: 367297 - RNA, 64 nt, Homo Sapiens; identical to SEQ ID NO: 148095

SEQ ID NO: 367298 - RNA, 64 nt, Homo Sapiens; identical to SEQ ID NO: 148096

SEQ ID NO: 367299 - RNA, 64 nt, Homo Sapiens; identical to SEQ ID NO: 148097

SEQ ID NO: 367300 - RNA, 64 nt, Homo Sapiens; identical to SEQ ID NO: 148098

SEQ ID NO: 367301 - RNA, 64 nt, Homo Sapiens; identical to SEQ ID NO: 148099

SEQ ID NO: 367302 - RNA, 64 nt, Homo Sapiens; identical to SEQ ID NO: 148100

SEQ ID NO: 367303 - RNA, 64 nt, Homo Sapiens; identical to SEQ ID NO: 148101

SEQ ID NO: 367304 - RNA, 64 nt, Homo Sapiens; identical to SEQ ID NO: 148102

SEQ ID NO: 367305 - RNA, 64 nt, Homo Sapiens; identical to SEQ ID NO: 367242

SEQ ID NO: 367306 - RNA, 64 nt, Homo Sapiens; identical to SEQ ID NO: 367243

SEQ ID NO: 367307 - RNA, 64 nt, Homo Sapiens; identical to SEQ ID NO: 367244

SEQ ID NO: 367308 - RNA, 64 nt, Homo Sapiens; identical to SEQ ID NO: 367245

SEQ ID NO: 367309 - RNA, 64 nt, Homo Sapiens; identical to SEQ ID NO: 367246

SEQ ID NO: 367310 - RNA, 64 nt, Homo Sapiens; identical to SEQ ID NO: 367247

SEQ ID NO: 367311 - RNA, 64 nt, Homo Sapiens; identical to SEQ ID NO: 367248

SEQ ID NO: 367312 - RNA, 64 nt, Homo Sapiens; identical to SEQ ID NO: 367249

SEQ ID NO: 367313 - RNA, 64 nt, Homo Sapiens; identical to SEQ ID NO: 367250

SEQ ID NO: 367314 - RNA, 64 nt, Homo Sapiens; identical to SEQ ID NO: 367251

SEQ ID NO: 367315 - RNA, 64 nt, Homo Sapiens; identical to SEQ ID NO: 367252

SEQ ID NO: 367316 - RNA, 64 nt, Homo Sapiens; identical to SEQ ID NO: 367253

SEQ ID NO: 367317 - RNA, 64 nt, Homo Sapiens; identical to SEQ ID NO: 367254

SEQ ID NO: 367318 - RNA, 64 nt, Homo Sapiens; identical to SEQ ID NO: 367255

SEQ ID NO: 367319 - RNA, 64 nt, Homo Sapiens; identical to SEQ ID NO: 367256

SEQ ID NO: 367320 - RNA, 64 nt, Homo Sapiens; identical to SEQ ID NO: 367257

SEQ ID NO: 367321 - RNA, 64 nt, Homo Sapiens; identical to SEQ ID NO: 367258

SEQ ID NO: 367322 - RNA, 64 nt, Homo Sapiens; identical to SEQ ID NO: 367259

SEQ ID NO: 367323 - RNA, 64 nt, Homo Sapiens; identical to SEQ ID NO: 367260

SEQ ID NO: 367324 - RNA, 64 nt, Homo Sapiens; identical to SEQ ID NO: 367261

SEQ ID NO: 367325 - RNA, 64 nt, Homo Sapiens; identical to SEQ ID NO: 367262

SEQ ID NO: 367326 - RNA, 64 nt, Homo Sapiens; identical to SEQ ID NO: 367263

SEQ ID NO: 367327 - RNA, 64 nt, Homo Sapiens; identical to SEQ ID NO: 367264

SEQ ID NO: 367328 - RNA, 64 nt, Homo Sapiens; identical to SEQ ID NO: 367265

SEQ ID NO: 367329 - RNA, 64 nt, Homo Sapiens; identical to SEQ ID NO: 367266

SEQ ID NO: 367330 - RNA, 64 nt, Homo Sapiens; identical to SEQ ID NO: 148065

SEQ ID NO: 367331 - RNA, 64 nt, Homo Sapiens; identical to SEQ ID NO: 148066

SEQ ID NO: 367332 - RNA, 64 nt, Homo Sapiens; identical to SEQ ID NO: 148067

SEQ ID NO: 367333 - RNA, 64 nt, Homo Sapiens; identical to SEQ ID NO: 148068

SEQ ID NO: 367334 - RNA, 64 nt, Homo Sapiens; identical to SEQ ID NO: 148069

SEQ ID NO: 367335 - RNA, 64 nt, Homo Sapiens; identical to SEQ ID NO: 148070

SEQ ID NO: 367336 - RNA, 64 nt, Homo Sapiens; identical to SEQ ID NO: 148071

SEQ ID NO: 367337 - RNA, 64 nt, Homo Sapiens; identical to SEQ ID NO: 148072

SEQ ID NO: 367338 - RNA, 64 nt, Homo Sapiens; identical to SEQ ID NO: 148073

SEQ ID NO: 367339 - RNA, 64 nt, Homo Sapiens; identical to SEQ ID NO: 148074

SEQ ID NO: 367340 - RNA, 64 nt, Homo Sapiens; identical to SEQ ID NO: 148075

SEQ ID NO: 367341 - RNA, 64 nt, Homo Sapiens; identical to SEQ ID NO: 148076

SEQ ID NO: 367342 - RNA, 64 nt, Homo Sapiens; identical to SEQ ID NO: 148077

SEQ ID NO: 367343 - RNA, 64 nt, Homo Sapiens; identical to SEQ ID NO: 148078

SEQ ID NO: 367344 - RNA, 64 nt, Homo Sapiens; identical to SEQ ID NO: 148079

SEQ ID NO: 367345 - RNA, 64 nt, Homo Sapiens; identical to SEQ ID NO: 148080

SEQ ID NO: 367346 - RNA, 64 nt, Homo Sapiens; identical to SEQ ID NO: 148081

SEQ ID NO: 367347 - RNA, 64 nt, Homo Sapiens; identical to SEQ ID NO: 148082

SEQ ID NO: 367348 - RNA, 64 nt, Homo Sapiens; identical to SEQ ID NO: 148083

SEQ ID NO: 367349 - RNA, 64 nt, Homo Sapiens; identical to SEQ ID NO: 148084

SEQ ID NO: 367350 - RNA, 64 nt, Homo Sapiens; identical to SEQ ID NO: 148085

SEQ ID NO: 367351 - RNA, 64 nt, Homo Sapiens; identical to SEQ ID NO: 148086

SEQ ID NO: 367352 - RNA, 64 nt, Homo Sapiens; identical to SEQ ID NO: 148087

SEQ ID NO: 367353 - RNA, 64 nt, Homo Sapiens; identical to SEQ ID NO: 148088

SEQ ID NO: 367354 - RNA, 64 nt, Homo Sapiens; identical to SEQ ID NO: 148089

SEQ ID NO: 367355 - RNA, 64 nt, Homo Sapiens; identical to SEQ ID NO: 148090

SEQ ID NO: 367356 - RNA, 64 nt, Homo Sapiens; identical to SEQ ID NO: 148091

SEQ ID NO: 367357 - RNA, 64 nt, Homo Sapiens; identical to SEQ ID NO: 148092

SEQ ID NO: 367358 - RNA, 64 nt, Homo Sapiens; identical to SEQ ID NO: 148093

SEQ ID NO: 367359 - RNA, 64 nt, Homo Sapiens; identical to SEQ ID NO: 148094

SEQ ID NO: 367360 - RNA, 64 nt, Homo Sapiens; identical to SEQ ID NO: 148095

SEQ ID NO: 367361 - RNA, 64 nt, Homo Sapiens; identical to SEQ ID NO: 148096

SEQ ID NO: 367362 - RNA, 64 nt, Homo Sapiens; identical to SEQ ID NO: 148097

SEQ ID NO: 367363 - RNA, 64 nt, Homo Sapiens; identical to SEQ ID NO: 148098

SEQ ID NO: 367364 - RNA, 64 nt, Homo Sapiens; identical to SEQ ID NO: 148099

SEQ ID NO: 367365 - RNA, 64 nt, Homo Sapiens; identical to SEQ ID NO: 148100

SEQ ID NO: 367366 - RNA, 64 nt, Homo Sapiens; identical to SEQ ID NO: 148101

SEQ ID NO: 367367 - RNA, 64 nt, Homo Sapiens; identical to SEQ ID NO: 148102

SEQ ID NO: 367368 - RNA, 64 nt, Homo Sapiens; identical to SEQ ID NO: 367242

SEQ ID NO: 367369 - RNA, 64 nt, Homo Sapiens; identical to SEQ ID NO: 367243

SEQ ID NO: 367370 - RNA, 64 nt, Homo Sapiens; identical to SEQ ID NO: 367244

SEQ ID NO: 367371 - RNA, 64 nt, Homo Sapiens; identical to SEQ ID NO: 367245

SEQ ID NO: 367372 - RNA, 64 nt, Homo Sapiens; identical to SEQ ID NO: 367246

SEQ ID NO: 367373 - RNA, 64 nt, Homo Sapiens; identical to SEQ ID NO: 367247

SEQ ID NO: 367374 - RNA, 64 nt, Homo Sapiens; identical to SEQ ID NO: 367248

SEQ ID NO: 367375 - RNA, 64 nt, Homo Sapiens; identical to SEQ ID NO: 367249

SEQ ID NO: 367376 - RNA, 64 nt, Homo Sapiens; identical to SEQ ID NO: 367250

SEQ ID NO: 367377 - RNA, 64 nt, Homo Sapiens; identical to SEQ ID NO: 367251

SEQ ID NO: 367378 - RNA, 64 nt, Homo Sapiens; identical to SEQ ID NO: 367252

SEQ ID NO: 367379 - RNA, 64 nt, Homo Sapiens; identical to SEQ ID NO: 367253

SEQ ID NO: 367380 - RNA, 64 nt, Homo Sapiens; identical to SEQ ID NO: 367254

SEQ ID NO: 367381 - RNA, 64 nt, Homo Sapiens; identical to SEQ ID NO: 367255

SEQ ID NO: 367382 - RNA, 64 nt, Homo Sapiens; identical to SEQ ID NO: 367256

SEQ ID NO: 367383 - RNA, 64 nt, Homo Sapiens; identical to SEQ ID NO: 367257

SEQ ID NO: 367384 - RNA, 64 nt, Homo Sapiens; identical to SEQ ID NO: 367258

SEQ ID NO: 367385 - RNA, 64 nt, Homo Sapiens; identical to SEQ ID NO: 367259

SEQ ID NO: 367386 - RNA, 64 nt, Homo Sapiens; identical to SEQ ID NO: 367260

SEQ ID NO: 367387 - RNA, 64 nt, Homo Sapiens; identical to SEQ ID NO: 367261

SEQ ID NO: 367388 - RNA, 64 nt, Homo Sapiens; identical to SEQ ID NO: 367262

SEQ ID NO: 367389 - RNA, 64 nt, Homo Sapiens; identical to SEQ ID NO: 367263

SEQ ID NO: 367390 - RNA, 64 nt, Homo Sapiens; identical to SEQ ID NO: 367264

SEQ ID NO: 367391 - RNA, 64 nt, Homo Sapiens; identical to SEQ ID NO: 367265

SEQ ID NO: 367392 - RNA, 64 nt, Homo Sapiens; identical to SEQ ID NO: 367266

SEQ ID NO: 367393 - RNA, 64 nt, Homo Sapiens; identical to SEQ ID NO: 96889

SEQ ID NO: 367394 - RNA, 64 nt, Homo Sapiens; identical to SEQ ID NO: 96890

SEQ ID NO: 367395 - RNA, 64 nt, Homo Sapiens; identical to SEQ ID NO: 96891

SEQ ID NO: 367396 - RNA, 64 nt, Homo Sapiens; identical to SEQ ID NO: 96892

SEQ ID NO: 367397 - RNA, 64 nt, Homo Sapiens; identical to SEQ ID NO: 96893

SEQ ID NO: 367398 - RNA, 64 nt, Homo Sapiens; identical to SEQ ID NO: 96894

SEQ ID NO: 367399 - RNA, 64 nt, Homo Sapiens; identical to SEQ ID NO: 96895

SEQ ID NO: 367400 - RNA, 64 nt, Homo Sapiens; identical to SEQ ID NO: 96896

SEQ ID NO: 367401 - RNA, 64 nt, Homo Sapiens; identical to SEQ ID NO: 96897

SEQ ID NO: 367402 - RNA, 64 nt, Homo Sapiens; identical to SEQ ID NO: 96898

SEQ ID NO: 367403 - RNA, 64 nt, Homo Sapiens; identical to SEQ ID NO: 96899

SEQ ID NO: 367404 - RNA, 64 nt, Homo Sapiens; identical to SEQ ID NO: 96900

SEQ ID NO: 367405 - RNA, 64 nt, Homo Sapiens; identical to SEQ ID NO: 96901

SEQ ID NO: 367406 - RNA, 64 nt, Homo Sapiens; identical to SEQ ID NO: 96902

SEQ ID NO: 367407 - RNA, 64 nt, Homo Sapiens; identical to SEQ ID NO: 96903

SEQ ID NO: 367408 - RNA, 64 nt, Homo Sapiens; identical to SEQ ID NO: 96904

SEQ ID NO: 367409 - RNA, 64 nt, Homo Sapiens; identical to SEQ ID NO: 96905

SEQ ID NO: 367410 - RNA, 64 nt, Homo Sapiens; identical to SEQ ID NO: 96906

SEQ ID NO: 367411 - RNA, 64 nt, Homo Sapiens; identical to SEQ ID NO: 96907

SEQ ID NO: 367412 - RNA, 64 nt, Homo Sapiens; identical to SEQ ID NO: 96908

SEQ ID NO: 367413 - RNA, 64 nt, Homo Sapiens; identical to SEQ ID NO: 96909

SEQ ID NO: 367414 - RNA, 64 nt, Homo Sapiens; identical to SEQ ID NO: 96910

SEQ ID NO: 367415 - RNA, 64 nt, Homo Sapiens; identical to SEQ ID NO: 96911

SEQ ID NO: 367416 - RNA, 64 nt, Homo Sapiens; identical to SEQ ID NO: 96912

SEQ ID NO: 367417 - RNA, 64 nt, Homo Sapiens; identical to SEQ ID NO: 96913

SEQ ID NO: 367418 - RNA, 64 nt, Homo Sapiens; identical to SEQ ID NO: 96914

SEQ ID NO: 367419 - RNA, 64 nt, Homo Sapiens; identical to SEQ ID NO: 96915

SEQ ID NO: 367420 - RNA, 64 nt, Homo Sapiens; identical to SEQ ID NO: 96916

SEQ ID NO: 367421 - RNA, 64 nt, Homo Sapiens; identical to SEQ ID NO: 113812

SEQ ID NO: 367422 - RNA, 64 nt, Homo Sapiens; identical to SEQ ID NO: 113813

SEQ ID NO: 367423 - RNA, 64 nt, Homo Sapiens; identical to SEQ ID NO: 113814

SEQ ID NO: 367424 - RNA, 64 nt, Homo Sapiens; identical to SEQ ID NO: 113815

SEQ ID NO: 367425 - RNA, 64 nt, Homo Sapiens; identical to SEQ ID NO: 113816

SEQ ID NO: 367426 - RNA, 64 nt, Homo Sapiens; identical to SEQ ID NO: 113817

SEQ ID NO: 367427 - RNA, 64 nt, Homo Sapiens; identical to SEQ ID NO: 113818

SEQ ID NO: 367428 - RNA, 64 nt, Homo Sapiens; identical to SEQ ID NO: 113819

SEQ ID NO: 367429 - RNA, 64 nt, Homo Sapiens; identical to SEQ ID NO: 113820

SEQ ID NO: 367430 - RNA, 64 nt, Homo Sapiens; identical to SEQ ID NO: 113821

SEQ ID NO: 367431 - RNA, 64 nt, Homo Sapiens; identical to SEQ ID NO: 78620

SEQ ID NO: 367432 - RNA, 64 nt, Homo Sapiens; identical to SEQ ID NO: 78621

SEQ ID NO: 367433 - RNA, 64 nt, Homo Sapiens; identical to SEQ ID NO: 78622

SEQ ID NO: 367434 - RNA, 64 nt, Homo Sapiens; identical to SEQ ID NO: 78623

SEQ ID NO: 367435 - RNA, 64 nt, Homo Sapiens; identical to SEQ ID NO: 78624

SEQ ID NO: 367436 - RNA, 64 nt, Homo Sapiens; identical to SEQ ID NO: 78625

SEQ ID NO: 367437 - RNA, 64 nt, Homo Sapiens; identical to SEQ ID NO: 78626

SEQ ID NO: 367438 - RNA, 64 nt, Homo Sapiens; identical to SEQ ID NO: 78627

SEQ ID NO: 367439 - RNA, 64 nt, Homo Sapiens; identical to SEQ ID NO: 78628

SEQ ID NO: 367440 - RNA, 64 nt, Homo Sapiens; identical to SEQ ID NO: 78629

SEQ ID NO: 367441 - RNA, 64 nt, Homo Sapiens; identical to SEQ ID NO: 78630

SEQ ID NO: 367442 - RNA, 64 nt, Homo Sapiens; identical to SEQ ID NO: 78631

SEQ ID NO: 367443 - RNA, 64 nt, Homo Sapiens; identical to SEQ ID NO: 78632

SEQ ID NO: 367444 - RNA, 64 nt, Homo Sapiens; identical to SEQ ID NO: 78633

SEQ ID NO: 367445 - RNA, 64 nt, Homo Sapiens; identical to SEQ ID NO: 78634

SEQ ID NO: 367446 - RNA, 64 nt, Homo Sapiens; identical to SEQ ID NO: 78635

SEQ ID NO: 367447 - RNA, 64 nt, Homo Sapiens; identical to SEQ ID NO: 78636

SEQ ID NO: 367448 - RNA, 64 nt, Homo Sapiens; identical to SEQ ID NO: 78637

SEQ ID NO: 367449 - RNA, 64 nt, Homo Sapiens; identical to SEQ ID NO: 78638

SEQ ID NO: 367450 - RNA, 64 nt, Homo Sapiens; identical to SEQ ID NO: 78639

SEQ ID NO: 367451 - RNA, 64 nt, Homo Sapiens; identical to SEQ ID NO: 78640

SEQ ID NO: 367452 - RNA, 64 nt, Homo Sapiens; identical to SEQ ID NO: 78641

SEQ ID NO: 367453 - RNA, 64 nt, Homo Sapiens; identical to SEQ ID NO: 78642

SEQ ID NO: 367454 - RNA, 64 nt, Homo Sapiens; identical to SEQ ID NO: 78643

SEQ ID NO: 367455 - RNA, 64 nt, Homo Sapiens; identical to SEQ ID NO: 78644

SEQ ID NO: 367456 - RNA, 64 nt, Homo Sapiens; identical to SEQ ID NO: 78645

SEQ ID NO: 367457 - RNA, 64 nt, Homo Sapiens; identical to SEQ ID NO: 78646

SEQ ID NO: 367458 - RNA, 64 nt, Homo Sapiens; identical to SEQ ID NO: 78647

SEQ ID NO: 367459 - RNA, 64 nt, Homo Sapiens; identical to SEQ ID NO: 78648

SEQ ID NO: 367460 - RNA, 64 nt, Homo Sapiens; identical to SEQ ID NO: 78649

SEQ ID NO: 367461 - RNA, 64 nt, Homo Sapiens; identical to SEQ ID NO: 78650

SEQ ID NO: 367462 - RNA, 64 nt, Homo Sapiens; identical to SEQ ID NO: 78651

SEQ ID NO: 367463 - RNA, 64 nt, Homo Sapiens; identical to SEQ ID NO: 78652

SEQ ID NO: 367464 - RNA, 64 nt, Homo Sapiens; identical to SEQ ID NO: 78653

SEQ ID NO: 367465 - RNA, 64 nt, Homo Sapiens; identical to SEQ ID NO: 78654

SEQ ID NO: 367466 - RNA, 64 nt, Homo Sapiens; identical to SEQ ID NO: 78655

SEQ ID NO: 367467 - RNA, 64 nt, Homo Sapiens; identical to SEQ ID NO: 78656

SEQ ID NO: 367468 - RNA, 64 nt, Homo Sapiens; identical to SEQ ID NO: 78657

SEQ ID NO: 367469 - RNA, 64 nt, Homo Sapiens; identical to SEQ ID NO: 78658

SEQ ID NO: 367470 - RNA, 64 nt, Homo Sapiens; identical to SEQ ID NO: 78659

SEQ ID NO: 367471 - RNA, 64 nt, Homo Sapiens; identical to SEQ ID NO: 78660

SEQ ID NO: 367472 - RNA, 64 nt, Homo Sapiens; identical to SEQ ID NO: 78661

SEQ ID NO: 367473 - RNA, 64 nt, Homo Sapiens; identical to SEQ ID NO: 78662

SEQ ID NO: 367474 - RNA, 64 nt, Homo Sapiens; identical to SEQ ID NO: 78663

SEQ ID NO: 367475 - RNA, 64 nt, Homo Sapiens; identical to SEQ ID NO: 78664

SEQ ID NO: 367476 - RNA, 59 nt, Homo Sapiens
ccuuaauauuuaucaauggauguuugaagaccagcuacuaacccuuuaacuuuuuacgg

SEQ ID NO: 367477 - RNA, 59 nt, Homo Sapiens
cuauuuuuucauaaaggcauauaauuuaaaccagcuauggacuuuuguuuuugggguuu

SEQ ID NO: 367478 - RNA, 64 nt, Homo Sapiens
ccuuacaaggggagcaucagcuuuggaaagugugacucuguaggaguguagaaggcaguggugu

SEQ ID NO: 367479 - RNA, 64 nt, Homo Sapiens
ugugugucuccuuaugacuccauuucuguaagcuacucuguaacuuugauauaugcuguauuuu

SEQ ID NO: 367480 - RNA, 64 nt, Homo Sapiens
cugucaucuuuucgccuaccuaguuuauggauugacucuguaucucagaacaguuauaaauauu

SEQ ID NO: 367481 - RNA, 64 nt, Homo Sapiens
auucagaacaguuauaaauaacacauauuuuuagacucuguauauuacaggaaugaaguagcug

SEQ ID NO: 367482 - RNA, 64 nt, Homo Sapiens
gcgccuauuuccugccuucuuuccccuauagggaacucuguaggcugagccacuguccugcucu

SEQ ID NO: 367483 - RNA, 64 nt, Homo Sapiens
uguguauuuuuguguaugugugcauauagcagcuacucuguagcagagguggguagagacacuu

SEQ ID NO: 367484 - RNA, 64 nt, Homo Sapiens
uaccaucuccugccucccuugcuuucuuacacuaacucuguaccggucccccagccucucuugg

SEQ ID NO: 367485 - RNA, 64 nt, Homo Sapiens
gcaucaucauccuuggagaggaagugacaccaguacucuguaaacccgaugccacccaguacag

SEQ ID NO: 367486 - RNA, 64 nt, Homo Sapiens
uggccacagaugauggucuccuaugguauaguucacucuguagaagauguaugcaaagugaaau

SEQ ID NO: 367487 - RNA, 64 nt, Homo Sapiens
gccaucugauggcugaaagaggggcguauuuuucacucuguagugaaaggcuuggaggaguuuc

SEQ ID NO: 367488 - RNA, 64 nt, Homo Sapiens
uggacuguacuauguuugaugucuucucuuacuuacucuguaucucuuuguacucuguaucuau

SEQ ID NO: 367489 - RNA, 64 nt, Homo Sapiens
gaugucuucucuuacuuacucuguaucucuuuguacucuguaucuauauaucaaaagcugcugc

SEQ ID NO: 367490 - RNA, 64 nt, Homo Sapiens
gcuagcaauagguuuguaaaaugcacccaucagcacucuguaaaacgcaccaaucagcacucug

SEQ ID NO: 367491 - RNA, 64 nt, Homo Sapiens
acccaucagcacucuguaaaacgcaccaaucagcacucuguaaaaugcaccaaucagcaggauu

SEQ ID NO: 367492 - RNA, 64 nt, Homo Sapiens
uguuucuagcaugugcugcaaaaaacaacaaaaaacucuguaucaucaucugguaaaauaguua

SEQ ID NO: 367493 - RNA, 64 nt, Homo Sapiens
ucuuuuguggaugaguuuugcugucugucaaaagacucuguauaaggacuccagagcaguggga

SEQ ID NO: 367494 - RNA, 64 nt, Homo Sapiens
gucuagcuaagggauuguaaauacaccgaugggcacucuguaucuagcucaagguuuguaaaca

SEQ ID NO: 367495 - RNA, 64 nt, Homo Sapiens
gucuagcucaguguuugugaaugcaccaauccacacucuguaucuggcuacucugguggggacu

SEQ ID NO: 367496 - RNA, 64 nt, Homo Sapiens
cucugguggggacuuggagaaccuuuguguccacacucuguaucuagcuaaucuaguggggaug

SEQ ID NO: 367497 - RNA, 64 nt, Homo Sapiens; identical to SEQ ID NO: 154084

SEQ ID NO: 367498 - RNA, 64 nt, Homo Sapiens; identical to SEQ ID NO: 154085

SEQ ID NO: 367499 - RNA, 64 nt, Homo Sapiens; identical to SEQ ID NO: 154086

SEQ ID NO: 367500 - RNA, 64 nt, Homo Sapiens; identical to SEQ ID NO: 154087

SEQ ID NO: 367501 - RNA, 64 nt, Homo Sapiens; identical to SEQ ID NO: 154088

SEQ ID NO: 367502 - RNA, 64 nt, Homo Sapiens; identical to SEQ ID NO: 154089

SEQ ID NO: 367503 - RNA, 64 nt, Homo Sapiens; identical to SEQ ID NO: 154090

SEQ ID NO: 367504 - RNA, 64 nt, Homo Sapiens; identical to SEQ ID NO: 154091

SEQ ID NO: 367505 - RNA, 64 nt, Homo Sapiens; identical to SEQ ID NO: 154092

SEQ ID NO: 367506 - RNA, 64 nt, Homo Sapiens; identical to SEQ ID NO: 154093

SEQ ID NO: 367507 - RNA, 64 nt, Homo Sapiens; identical to SEQ ID NO: 154094

SEQ ID NO: 367508 - RNA, 64 nt, Homo Sapiens; identical to SEQ ID NO: 154095

SEQ ID NO: 367509 - RNA, 64 nt, Homo Sapiens; identical to SEQ ID NO: 154096

SEQ ID NO: 367510 - RNA, 64 nt, Homo Sapiens; identical to SEQ ID NO: 154097

SEQ ID NO: 367511 - RNA, 64 nt, Homo Sapiens; identical to SEQ ID NO: 154098

SEQ ID NO: 367512 - RNA, 64 nt, Homo Sapiens; identical to SEQ ID NO: 154099

SEQ ID NO: 367513 - RNA, 64 nt, Homo Sapiens; identical to SEQ ID NO: 154100

SEQ ID NO: 367514 - RNA, 64 nt, Homo Sapiens; identical to SEQ ID NO: 154101

SEQ ID NO: 367515 - RNA, 64 nt, Homo Sapiens; identical to SEQ ID NO: 154102

SEQ ID NO: 367516 - RNA, 64 nt, Homo Sapiens; identical to SEQ ID NO: 154103

SEQ ID NO: 367517 - RNA, 64 nt, Homo Sapiens; identical to SEQ ID NO: 154104

SEQ ID NO: 367518 - RNA, 64 nt, Homo Sapiens; identical to SEQ ID NO: 154105

SEQ ID NO: 367519 - RNA, 64 nt, Homo Sapiens; identical to SEQ ID NO: 154106

SEQ ID NO: 367520 - RNA, 64 nt, Homo Sapiens; identical to SEQ ID NO: 154107

SEQ ID NO: 367521 - RNA, 51 nt, Homo Sapiens; identical to SEQ ID NO: 154108

SEQ ID NO: 367522 - RNA, 64 nt, Homo Sapiens; identical to SEQ ID NO: 154109

SEQ ID NO: 367523 - RNA, 64 nt, Homo Sapiens; identical to SEQ ID NO: 154110

SEQ ID NO: 367524 - RNA, 64 nt, Homo Sapiens; identical to SEQ ID NO: 154111

SEQ ID NO: 367525 - RNA, 64 nt, Homo Sapiens; identical to SEQ ID NO: 154112

SEQ ID NO: 367526 - RNA, 64 nt, Homo Sapiens; identical to SEQ ID NO: 154113

SEQ ID NO: 367527 - RNA, 64 nt, Homo Sapiens; identical to SEQ ID NO: 154114

SEQ ID NO: 367528 - RNA, 64 nt, Homo Sapiens; identical to SEQ ID NO: 154115

SEQ ID NO: 367529 - RNA, 64 nt, Homo Sapiens; identical to SEQ ID NO: 154116

SEQ ID NO: 367530 - RNA, 64 nt, Homo Sapiens; identical to SEQ ID NO: 154117

SEQ ID NO: 367531 - RNA, 64 nt, Homo Sapiens; identical to SEQ ID NO: 154118

SEQ ID NO: 367532 - RNA, 64 nt, Homo Sapiens; identical to SEQ ID NO: 154118

SEQ ID NO: 367533 - RNA, 64 nt, Homo Sapiens; identical to SEQ ID NO: 154120

SEQ ID NO: 367534 - RNA, 64 nt, Homo Sapiens; identical to SEQ ID NO: 154121

SEQ ID NO: 367535 - RNA, 64 nt, Homo Sapiens; identical to SEQ ID NO: 154122

SEQ ID NO: 367536 - RNA, 64 nt, Homo Sapiens; identical to SEQ ID NO: 154123

SEQ ID NO: 367537 - RNA, 64 nt, Homo Sapiens; identical to SEQ ID NO: 154124

SEQ ID NO: 367538 - RNA, 64 nt, Homo Sapiens; identical to SEQ ID NO: 154125

SEQ ID NO: 367539 - RNA, 64 nt, Homo Sapiens; identical to SEQ ID NO: 154126

SEQ ID NO: 367540 - RNA, 64 nt, Homo Sapiens; identical to SEQ ID NO: 154127

SEQ ID NO: 367541 - RNA, 64 nt, Homo Sapiens; identical to SEQ ID NO: 154128

SEQ ID NO: 367542 - RNA, 64 nt, Homo Sapiens; identical to SEQ ID NO: 154129

SEQ ID NO: 367543 - RNA, 64 nt, Homo Sapiens; identical to SEQ ID NO: 154130

SEQ ID NO: 367544 - RNA, 64 nt, Homo Sapiens; identical to SEQ ID NO: 154131

SEQ ID NO: 367545 - RNA, 64 nt, Homo Sapiens; identical to SEQ ID NO: 154132

SEQ ID NO: 367546 - RNA, 64 nt, Homo Sapiens; identical to SEQ ID NO: 154133

SEQ ID NO: 367547 - RNA, 64 nt, Homo Sapiens; identical to SEQ ID NO: 154134

SEQ ID NO: 367548 - RNA, 57 nt, Homo Sapiens; identical to SEQ ID NO: 154135

SEQ ID NO: 367549 - RNA, 64 nt, Homo Sapiens; identical to SEQ ID NO: 154136

SEQ ID NO: 367550 - RNA, 64 nt, Homo Sapiens; identical to SEQ ID NO: 154137

SEQ ID NO: 367551 - RNA, 64 nt, Homo Sapiens; identical to SEQ ID NO: 154138

SEQ ID NO: 367552 - RNA, 64 nt, Homo Sapiens; identical to SEQ ID NO: 154139

SEQ ID NO: 367553 - RNA, 64 nt, Homo Sapiens; identical to SEQ ID NO: 154140

SEQ ID NO: 367554 - RNA, 64 nt, Homo Sapiens; identical to SEQ ID NO: 154141

SEQ ID NO: 367555 - RNA, 64 nt, Homo Sapiens; identical to SEQ ID NO: 154142

SEQ ID NO: 367556 - RNA, 64 nt, Homo Sapiens; identical to SEQ ID NO: 154143

SEQ ID NO: 367557 - RNA, 64 nt, Homo Sapiens; identical to SEQ ID NO: 154144

SEQ ID NO: 367558 - RNA, 64 nt, Homo Sapiens; identical to SEQ ID NO: 154145

SEQ ID NO: 367559 - RNA, 64 nt, Homo Sapiens; identical to SEQ ID NO: 154146

SEQ ID NO: 367560 - RNA, 64 nt, Homo Sapiens; identical to SEQ ID NO: 154147

SEQ ID NO: 367561 - RNA, 64 nt, Homo Sapiens; identical to SEQ ID NO: 154148

SEQ ID NO: 367562 - RNA, 64 nt, Homo Sapiens; identical to SEQ ID NO: 154149

SEQ ID NO: 367563 - RNA, 64 nt, Homo Sapiens; identical to SEQ ID NO: 154150

SEQ ID NO: 367564 - RNA, 64 nt, Homo Sapiens; identical to SEQ ID NO: 154151

SEQ ID NO: 367565 - RNA, 64 nt, Homo Sapiens; identical to SEQ ID NO: 154152

SEQ ID NO: 367566 - RNA, 64 nt, Homo Sapiens; identical to SEQ ID NO: 154153

SEQ ID NO: 367567 - RNA, 64 nt, Homo Sapiens; identical to SEQ ID NO: 154154

SEQ ID NO: 367568 - RNA, 64 nt, Homo Sapiens; identical to SEQ ID NO: 154155

SEQ ID NO: 367569 - RNA, 64 nt, Homo Sapiens; identical to SEQ ID NO: 154156

SEQ ID NO: 367570 - RNA, 64 nt, Homo Sapiens; identical to SEQ ID NO: 154157

SEQ ID NO: 367571 - RNA, 64 nt, Homo Sapiens; identical to SEQ ID NO: 154158

SEQ ID NO: 367572 - RNA, 64 nt, Homo Sapiens; identical to SEQ ID NO: 154159

SEQ ID NO: 367573 - RNA, 64 nt, Homo Sapiens; identical to SEQ ID NO: 154160

SEQ ID NO: 367574 - RNA, 64 nt, Homo Sapiens; identical to SEQ ID NO: 154161

SEQ ID NO: 367575 - RNA, 64 nt, Homo Sapiens; identical to SEQ ID NO: 154162

SEQ ID NO: 367576 - RNA, 64 nt, Homo Sapiens; identical to SEQ ID NO: 154163

SEQ ID NO: 367577 - RNA, 64 nt, Homo Sapiens; identical to SEQ ID NO: 154164

SEQ ID NO: 367578 - RNA, 63 nt, Homo Sapiens; identical to SEQ ID NO: 154165

SEQ ID NO: 367579 - RNA, 64 nt, Homo Sapiens; identical to SEQ ID NO: 154166

SEQ ID NO: 367580 - RNA, 50 nt, Homo Sapiens; identical to SEQ ID NO: 154167

SEQ ID NO: 367581 - RNA, 64 nt, Homo Sapiens; identical to SEQ ID NO: 154168

SEQ ID NO: 367582 - RNA, 64 nt, Homo Sapiens; identical to SEQ ID NO: 154169

SEQ ID NO: 367583 - RNA, 64 nt, Homo Sapiens; identical to SEQ ID NO: 154170

SEQ ID NO: 367584 - RNA, 64 nt, Homo Sapiens; identical to SEQ ID NO: 154171

SEQ ID NO: 367585 - RNA, 64 nt, Homo Sapiens; identical to SEQ ID NO: 154172

SEQ ID NO: 367586 - RNA, 64 nt, Homo Sapiens; identical to SEQ ID NO: 154173

SEQ ID NO: 367587 - RNA, 64 nt, Homo Sapiens; identical to SEQ ID NO: 154174

SEQ ID NO: 367588 - RNA, 64 nt, Homo Sapiens; identical to SEQ ID NO: 154175

SEQ ID NO: 367589 - RNA, 64 nt, Homo Sapiens; identical to SEQ ID NO: 154176

SEQ ID NO: 367590 - RNA, 64 nt, Homo Sapiens; identical to SEQ ID NO: 154177

SEQ ID NO: 367591 - RNA, 64 nt, Homo Sapiens; identical to SEQ ID NO: 154178

SEQ ID NO: 367592 - RNA, 64 nt, Homo Sapiens; identical to SEQ ID NO: 154179

SEQ ID NO: 367593 - RNA, 64 nt, Homo Sapiens; identical to SEQ ID NO: 154180

SEQ ID NO: 367594 - RNA, 64 nt, Homo Sapiens; identical to SEQ ID NO: 154181

SEQ ID NO: 367595 - RNA, 64 nt, Homo Sapiens; identical to SEQ ID NO: 154182

SEQ ID NO: 367596 - RNA, 64 nt, Homo Sapiens; identical to SEQ ID NO: 154183

SEQ ID NO: 367597 - RNA, 64 nt, Homo Sapiens; identical to SEQ ID NO: 154184

SEQ ID NO: 367598 - RNA, 64 nt, Homo Sapiens; identical to SEQ ID NO: 154185

SEQ ID NO: 367599 - RNA, 64 nt, Homo Sapiens; identical to SEQ ID NO: 154186

SEQ ID NO: 367600 - RNA, 64 nt, Homo Sapiens; identical to SEQ ID NO: 154187

SEQ ID NO: 367601 - RNA, 64 nt, Homo Sapiens; identical to SEQ ID NO: 154188

SEQ ID NO: 367602 - RNA, 64 nt, Homo Sapiens; identical to SEQ ID NO: 154189

SEQ ID NO: 367603 - RNA, 64 nt, Homo Sapiens; identical to SEQ ID NO: 154190

SEQ ID NO: 367604 - RNA, 64 nt, Homo Sapiens; identical to SEQ ID NO: 154191

SEQ ID NO: 367605 - RNA, 64 nt, Homo Sapiens; identical to SEQ ID NO: 154192

SEQ ID NO: 367606 - RNA, 64 nt, Homo Sapiens; identical to SEQ ID NO: 154193

SEQ ID NO: 367607 - RNA, 64 nt, Homo Sapiens; identical to SEQ ID NO: 154194

SEQ ID NO: 367608 - RNA, 64 nt, Homo Sapiens; identical to SEQ ID NO: 154195

SEQ ID NO: 367609 - RNA, 64 nt, Homo Sapiens; identical to SEQ ID NO: 154196

SEQ ID NO: 367610 - RNA, 64 nt, Homo Sapiens; identical to SEQ ID NO: 154197

SEQ ID NO: 367611 - RNA, 64 nt, Homo Sapiens; identical to SEQ ID NO: 154198

SEQ ID NO: 367612 - RNA, 64 nt, Homo Sapiens; identical to SEQ ID NO: 154199

SEQ ID NO: 367613 - RNA, 64 nt, Homo Sapiens; identical to SEQ ID NO: 154200

SEQ ID NO: 367614 - RNA, 64 nt, Homo Sapiens; identical to SEQ ID NO: 154201

SEQ ID NO: 367615 - RNA, 64 nt, Homo Sapiens; identical to SEQ ID NO: 154202

SEQ ID NO: 367616 - RNA, 64 nt, Homo Sapiens; identical to SEQ ID NO: 154203

SEQ ID NO: 367617 - RNA, 64 nt, Homo Sapiens; identical to SEQ ID NO: 154204

SEQ ID NO: 367618 - RNA, 64 nt, Homo Sapiens; identical to SEQ ID NO: 154205

SEQ ID NO: 367619 - RNA, 64 nt, Homo Sapiens; identical to SEQ ID NO: 154206

SEQ ID NO: 367620 - RNA, 64 nt, Homo Sapiens; identical to SEQ ID NO: 154207

SEQ ID NO: 367621 - RNA, 59 nt, Homo Sapiens; identical to SEQ ID NO: 154208

SEQ ID NO: 367622 - RNA, 64 nt, Homo Sapiens; identical to SEQ ID NO: 154209

SEQ ID NO: 367623 - RNA, 64 nt, Homo Sapiens; identical to SEQ ID NO: 154210

SEQ ID NO: 367624 - RNA, 64 nt, Homo Sapiens; identical to SEQ ID NO: 154211

SEQ ID NO: 367625 - RNA, 64 nt, Homo Sapiens; identical to SEQ ID NO: 154212

SEQ ID NO: 367626 - RNA, 64 nt, Homo Sapiens; identical to SEQ ID NO: 154213

SEQ ID NO: 367627 - RNA, 64 nt, Homo Sapiens; identical to SEQ ID NO: 154214

SEQ ID NO: 367628 - RNA, 64 nt, Homo Sapiens; identical to SEQ ID NO: 154215

SEQ ID NO: 367629 - RNA, 64 nt, Homo Sapiens; identical to SEQ ID NO: 154216

SEQ ID NO: 367630 - RNA, 64 nt, Homo Sapiens; identical to SEQ ID NO: 154217

SEQ ID NO: 367631 - RNA, 64 nt, Homo Sapiens; identical to SEQ ID NO: 154218

SEQ ID NO: 367632 - RNA, 64 nt, Homo Sapiens; identical to SEQ ID NO: 154219

SEQ ID NO: 367633 - RNA, 64 nt, Homo Sapiens; identical to SEQ ID NO: 154220

SEQ ID NO: 367634 - RNA, 61 nt, Homo Sapiens; identical to SEQ ID NO: 154221

SEQ ID NO: 367635 - RNA, 64 nt, Homo Sapiens; identical to SEQ ID NO: 154222

SEQ ID NO: 367636 - RNA, 64 nt, Homo Sapiens; identical to SEQ ID NO: 154223

SEQ ID NO: 367637 - RNA, 64 nt, Homo Sapiens; identical to SEQ ID NO: 154224

SEQ ID NO: 367638 - RNA, 64 nt, Homo Sapiens; identical to SEQ ID NO: 154225

SEQ ID NO: 367639 - RNA, 64 nt, Homo Sapiens; identical to SEQ ID NO: 154226

SEQ ID NO: 367640 - RNA, 64 nt, Homo Sapiens; identical to SEQ ID NO: 154227

SEQ ID NO: 367641 - RNA, 64 nt, Homo Sapiens; identical to SEQ ID NO: 154228

SEQ ID NO: 367642 - RNA, 64 nt, Homo Sapiens; identical to SEQ ID NO: 154229

SEQ ID NO: 367643 - RNA, 64 nt, Homo Sapiens; identical to SEQ ID NO: 154230

SEQ ID NO: 367644 - RNA, 64 nt, Homo Sapiens; identical to SEQ ID NO: 154231

SEQ ID NO: 367645 - RNA, 64 nt, Homo Sapiens; identical to SEQ ID NO: 154232

SEQ ID NO: 367646 - RNA, 64 nt, Homo Sapiens; identical to SEQ ID NO: 154233

SEQ ID NO: 367647 - RNA, 64 nt, Homo Sapiens; identical to SEQ ID NO: 154234

SEQ ID NO: 367648 - RNA, 64 nt, Homo Sapiens; identical to SEQ ID NO: 154235

SEQ ID NO: 367649 - RNA, 64 nt, Homo Sapiens; identical to SEQ ID NO: 154236

SEQ ID NO: 367650 - RNA, 64 nt, Homo Sapiens; identical to SEQ ID NO: 154237

SEQ ID NO: 367651 - RNA, 62 nt, Homo Sapiens; identical to SEQ ID NO: 154238

SEQ ID NO: 367652 - RNA, 64 nt, Homo Sapiens; identical to SEQ ID NO: 154239

SEQ ID NO: 367653 - RNA, 62 nt, Homo Sapiens; identical to SEQ ID NO: 154240

SEQ ID NO: 367654 - RNA, 64 nt, Homo Sapiens; identical to SEQ ID NO: 154241

SEQ ID NO: 367655 - RNA, 64 nt, Homo Sapiens; identical to SEQ ID NO: 154242

SEQ ID NO: 367656 - RNA, 64 nt, Homo Sapiens; identical to SEQ ID NO: 154243

SEQ ID NO: 367657 - RNA, 64 nt, Homo Sapiens; identical to SEQ ID NO: 154244

SEQ ID NO: 367658 - RNA, 64 nt, Homo Sapiens; identical to SEQ ID NO: 154245

SEQ ID NO: 367659 - RNA, 64 nt, Homo Sapiens; identical to SEQ ID NO: 154246

SEQ ID NO: 367660 - RNA, 64 nt, Homo Sapiens; identical to SEQ ID NO: 154247

SEQ ID NO: 367661 - RNA, 64 nt, Homo Sapiens; identical to SEQ ID NO: 154248

SEQ ID NO: 367662 - RNA, 64 nt, Homo Sapiens; identical to SEQ ID NO: 154249

SEQ ID NO: 367663 - RNA, 64 nt, Homo Sapiens
agggaaaaucuauaaaaacaagguuagcauauucucaacacagauaccaccacuuucuuuuucc

SEQ ID NO: 367664 - RNA, 64 nt, Homo Sapiens
agcauacuucaucucugagcuuuguugugauuccucaacacauuacccuaaccagccagcagua

SEQ ID NO: 367665 - RNA, 64 nt, Homo Sapiens
aggaauacaggagaacuuaccaugauaaaaccucucaacacagagacaaaauccaauauccauu

SEQ ID NO: 367666 - RNA, 64 nt, Homo Sapiens
uaguuuacagaauggaaaagcauuugaguaaccaucaacacaauauaacaaacugguacuuuua

SEQ ID NO: 367667 - RNA, 64 nt, Homo Sapiens
gacacaggaagaaugggcugagauuagagguuugucaacacaaaugucaacacaaagacaugga

SEQ ID NO: 367668 - RNA, 64 nt, Homo Sapiens
gacauggaagauuagagguugaagguuagguuugucaacacaaauuugucaacaaaaagacaug

SEQ ID NO: 367669 - RNA, 64 nt, Homo Sapiens
gacauggaagguuagagguucauggagagguuugucaacacaaaauagggucagaugcaccacc

SEQ ID NO: 367670 - RNA, 64 nt, Homo Sapiens
ccuggacgccugaggggcagcuuaucacagugcaaggggacaggguaaacagcagggggugggg

SEQ ID NO: 367671 - RNA, 64 nt, Homo Sapiens
aggccaggguucgggaaguacacugccaucggucaggggacagcugccucccaccuugccuggg

SEQ ID NO: 367672 - RNA, 64 nt, Homo Sapiens
cuggggcugcccagagacuggaaucagaguggggaggggacagcgguccaaggucuuuguccua

SEQ ID NO: 367673 - RNA, 64 nt, Homo Sapiens
guguaggagcuccccauguaaucagcgauaggugaggggacacaccuccagcuggaugcugggg

SEQ ID NO: 367674 - RNA, 64 nt, Homo Sapiens
gcagggaggugugggguaaggccaagggcacagcaggggacagugcaggcugcagggcauucca

SEQ ID NO: 367675 - RNA, 64 nt, Homo Sapiens
aaaugccugugucuggccaguucaguggcucuucaggggacagguagaucucuuuugugcuggg

SEQ ID NO: 367676 - RNA, 64 nt, Homo Sapiens
caaguguucacaaccuggaagugcuucgggaagaaggggacaauggcagaacagguguugguga

SEQ ID NO: 367677 - RNA, 64 nt, Homo Sapiens
gaagacuuuuguuaugaggagcugcagauuagcuaggggacagcuggaauuaugcuggcuucug

SEQ ID NO: 367678 - RNA, 64 nt, Homo Sapiens
cccuggguccguaacauuuuuuccgaggaugaacaggggacaucuuuagguuucucaacucuug

SEQ ID NO: 367679 - RNA, 64 nt, Homo Sapiens
ugcagagucaacagcccaucagcccauguuuuagaggggacacuuugguccucgguucccaccc

SEQ ID NO: 367680 - RNA, 64 nt, Homo Sapiens
agacuuucugaccugagaacuccuucauuugcagaggggacaacaauuucaagguccucaccac

SEQ ID NO: 367681 - RNA, 64 nt, Homo Sapiens
aucccaucuuuuccuucggcuaaucacuuuucuuaggggacagaugucuuugcugggcaucucg

SEQ ID NO: 367682 - RNA, 64 nt, Homo Sapiens
uguggagggcauuucccguggaggcugugggugcaggggacacccgugguggugcaggggacaa

SEQ ID NO: 367683 - RNA, 64 nt, Homo Sapiens
aggcugugggugcaggggacgcucgugguggugcaggggacaagggacacauuucacaccucag

SEQ ID NO: 367684 - RNA, 64 nt, Homo Sapiens
cgaagggacaucuuuggaaaacgcugcuaacuccaggggacagaaugagccaagagcccucuuc

SEQ ID NO: 367685 - RNA, 64 nt, Homo Sapiens
gcccucuggagcucgcugggcgcccgcgccuccgaggggacagcugcgccgcuucccgccgcag

SEQ ID NO: 367686 - RNA, 64 nt, Homo Sapiens
uuucuagaaaagccacaccuccccuuugcaggugaggggacagccauaugagaugacgaggaaa

SEQ ID NO: 367687 - RNA, 64 nt, Homo Sapiens
cgugggaccgcgugagaauuaauacagcagauguaggggacagcaaacagagagaacgagccug

SEQ ID NO: 367688 - RNA, 64 nt, Homo Sapiens
ucugguugccuuggaggcaggaggggagauguggaggggacacacugucacaacaauaagcagg

SEQ ID NO: 367689 - RNA, 64 nt, Homo Sapiens
agacggcccugcugcggacgcggcgaggcuagcgaggggacagggggcuuggagggaggagggc

SEQ ID NO: 367690 - RNA, 64 nt, Homo Sapiens; identical to SEQ ID NO: 259948

SEQ ID NO: 367691 - RNA, 64 nt, Homo Sapiens; identical to SEQ ID NO: 259949

SEQ ID NO: 367692 - RNA, 64 nt, Homo Sapiens; identical to SEQ ID NO: 259950

SEQ ID NO: 367693 - RNA, 64 nt, Homo Sapiens; identical to SEQ ID NO: 259951

SEQ ID NO: 367694 - RNA, 64 nt, Homo Sapiens; identical to SEQ ID NO: 259952

SEQ ID NO: 367695 - RNA, 64 nt, Homo Sapiens; identical to SEQ ID NO: 259953

SEQ ID NO: 367696 - RNA, 64 nt, Homo Sapiens; identical to SEQ ID NO: 259954

SEQ ID NO: 367697 - RNA, 64 nt, Homo Sapiens; identical to SEQ ID NO: 259955

SEQ ID NO: 367698 - RNA, 64 nt, Homo Sapiens; identical to SEQ ID NO: 259956

SEQ ID NO: 367699 - RNA, 64 nt, Homo Sapiens; identical to SEQ ID NO: 259957

SEQ ID NO: 367700 - RNA, 64 nt, Homo Sapiens; identical to SEQ ID NO: 259958

SEQ ID NO: 367701 - RNA, 64 nt, Homo Sapiens; identical to SEQ ID NO: 259959

SEQ ID NO: 367702 - RNA, 64 nt, Homo Sapiens; identical to SEQ ID NO: 259960

SEQ ID NO: 367703 - RNA, 64 nt, Homo Sapiens; identical to SEQ ID NO: 259961

SEQ ID NO: 367704 - RNA, 64 nt, Homo Sapiens; identical to SEQ ID NO: 259962

SEQ ID NO: 367705 - RNA, 64 nt, Homo Sapiens; identical to SEQ ID NO: 259963

SEQ ID NO: 367706 - RNA, 64 nt, Homo Sapiens; identical to SEQ ID NO: 259964

SEQ ID NO: 367707 - RNA, 64 nt, Homo Sapiens; identical to SEQ ID NO: 259965

SEQ ID NO: 367708 - RNA, 64 nt, Homo Sapiens; identical to SEQ ID NO: 259966

SEQ ID NO: 367709 - RNA, 64 nt, Homo Sapiens; identical to SEQ ID NO: 259967

SEQ ID NO: 367710 - RNA, 64 nt, Homo Sapiens; identical to SEQ ID NO: 259968

SEQ ID NO: 367711 - RNA, 64 nt, Homo Sapiens; identical to SEQ ID NO: 259969

SEQ ID NO: 367712 - RNA, 64 nt, Homo Sapiens
gguagaccuagccaaggagaagugggagacguuuggcuagcaccccaggaagaugugagaggga

SEQ ID NO: 367713 - RNA, 64 nt, Homo Sapiens
augcgguauuuuaacuuucuagggaacucauaaaggcuagcagcaaaggcuuagaaaaggcgua

SEQ ID NO: 367714 - RNA, 64 nt, Homo Sapiens
cucccuucagaugaccauugauguuggauguccaggcuagcaccgacugcauaagugaugccaa

SEQ ID NO: 367715 - RNA, 64 nt, Homo Sapiens
uagcauuucagcagagggacaaagccagaauuacggcuagcaccauauuugggguuuugguuuu

SEQ ID NO: 367716 - RNA, 64 nt, Homo Sapiens
ucuuucucuauuauccuucuuauaucaacaucagggcuagcacaguucuguauaccaaaguggc

SEQ ID NO: 367717 - RNA, 64 nt, Homo Sapiens
cggguguaucgccugggcccguggggcaccuuggggcuagcacagugaggagcugucuggacca

SEQ ID NO: 367718 - RNA, 64 nt, Homo Sapiens
ggcgcagccuagacccaauugcuugcccccaugaggcuagcacuaauaggaaacccuuuuuugu

SEQ ID NO: 367719 - RNA, 64 nt, Homo Sapiens
gcuccaccguauuagcuccauuagcuuggagccuggcuagcaacacucacugucaguuaggcag

SEQ ID NO: 367720 - RNA, 64 nt, Homo Sapiens
accuguguuaucacaguaacccagagcuguauuuggcuagcaaucugccuguaucucucacuau

SEQ ID NO: 367721 - RNA, 64 nt, Homo Sapiens
ccugucucccuagggaauuccugcuaugacagcuggcuagcauuccucaggaaggacaugggug

SEQ ID NO: 367722 - RNA, 64 nt, Homo Sapiens
auguccuacgggaacgugggcuggcccagcauagggcuagcaaauuugaguuggaugauuguuu

SEQ ID NO: 367723 - RNA, 64 nt, Homo Sapiens
gucugugguuggcagugugucugugguugagucuggcuagcacuucuggagaacauaagggcug

SEQ ID NO: 367724 - RNA, 64 nt, Homo Sapiens
ugucacagauaggcagggcacagaauugucuguuggcuagcagcucaagagauaacuucauaac

SEQ ID NO: 367725 - RNA, 64 nt, Homo Sapiens
ugcauugaggggagucuggggccaggagcugaggggcuagcaccuucugcaggggaggaaggcu

SEQ ID NO: 367726 - RNA, 64 nt, Homo Sapiens
auuuugguuaaaaucauguucugcugaugugguaggcuagcaauccgccugcaccagugccguc

SEQ ID NO: 367727 - RNA, 64 nt, Homo Sapiens
cccagcccuuaauccacgucccuccucccccuugggcuagcaucauacuucacuaacaguacac

SEQ ID NO: 367728 - RNA, 64 nt, Homo Sapiens
ucccuuugagucaugaugacuggaaaaaugguguggcuagcauuguguaaagcaguggcuucac

SEQ ID NO: 367729 - RNA, 64 nt, Homo Sapiens
aaaaaacaaaacaaaacugugaaacacauuuucuggcuagcagacuucaaagcccaaaugaaua

SEQ ID NO: 367730 - RNA, 64 nt, Homo Sapiens
aaugauauuuaaagcaauaagcaacucuuuuuggggcuagcaaucauacacuuagcuauguuuu

SEQ ID NO: 367731 - RNA, 64 nt, Homo Sapiens
auucagauguuaaugccacuugaagaaguugguaggcuagcaaagaggaugagacaugaacugu

SEQ ID NO: 367732 - RNA, 64 nt, Homo Sapiens
aguucuggcccagucuccuccuucccagcagccaggcuagcaccgugaagacguauuuuuucuu

SEQ ID NO: 367733 - RNA, 64 nt, Homo Sapiens
caauggugugaccucggcuugcucuuguugcccaggcuagcauguuuuuuuuagacagcguuuc

SEQ ID NO: 367734 - RNA, 64 nt, Homo Sapiens
aggcuuaacacugauucuuaaguuaaaaauaauuggcuagcaaccuucaaaccucaaagagcca

SEQ ID NO: 367735 - RNA, 64 nt, Homo Sapiens
uuagaaacaccauucaucucaacuugacccagguggcuagcaaaauaaauacacuuccugcuua

SEQ ID NO: 367736 - RNA, 64 nt, Homo Sapiens
aucguagguguuuauuaggcaaagccuugggcagggcuagcaacuagaacgggacgucuucuaa

SEQ ID NO: 367737 - RNA, 64 nt, Homo Sapiens
auucuaaaccugcacuugucccucuccagcaagaggcuagcacugaauucauucuacucauacu

SEQ ID NO: 367738 - RNA, 64 nt, Homo Sapiens
aagcagcaggccccaggugaguccugaaggaagaggcuagcacucuguaaggccuccagugucc

SEQ ID NO: 367739 - RNA, 64 nt, Homo Sapiens
aaacugucagaaucaguuuucccauaaaagggugggcuagcauugcagcugcauuugggaccau

SEQ ID NO: 367740 - RNA, 64 nt, Homo Sapiens
aguauaaagugaucaguauggcagcuccccugggggcuagcagagcacucacaugccgccccca

SEQ ID NO: 367741 - RNA, 64 nt, Homo Sapiens
gauggauagcuucuuugucauuucugucgucccaggcuagcagaaguuccuuuaugaagaggcu

SEQ ID NO: 367742 - RNA, 64 nt, Homo Sapiens
acugggcagggugggggcaacccagaggacccauggcuagcagggaagggccugggcuugaaug

SEQ ID NO: 367743 - RNA, 64 nt, Homo Sapiens
agcaccacuauagcacugucguguugaaauacucggcuagcaucuauuucugacauuuagagua

SEQ ID NO: 367744 - RNA, 64 nt, Homo Sapiens
augccuugccaaauuucuccccauuucucuacggggcuagcaaaaaucuucagcuuuaucacuc

SEQ ID NO: 367745 - RNA, 64 nt, Homo Sapiens
uaauguuuuuagauuuuaauuguccuauugaugaggcuagcaccuuaaucacuguuuaguuuug

SEQ ID NO: 367746 - RNA, 64 nt, Homo Sapiens
gcucgagaucuuauaccacucuguauuggacaaaggcuagcacagggcuaggcaccaauaaaga

SEQ ID NO: 367747 - RNA, 64 nt, Homo Sapiens
ccacccucacucauguacucguugcagggaggcaggcuagcaggugaugggaaggaggcccagu

SEQ ID NO: 367748 - RNA, 64 nt, Homo Sapiens
gguugagacugcagccuggcgugcauuuuuacacggcuagcagggguuaccccacccugacaga

SEQ ID NO: 367749 - RNA, 64 nt, Homo Sapiens
cauacuuuucuacuguaaauagaauuugaaguuuggcuagcauccggaauaacucugcagugac

SEQ ID NO: 367750 - RNA, 64 nt, Homo Sapiens
ggagguaagggugguaugggccgagggccggguaggcuagcacguuggggcggcaagcgguggg

SEQ ID NO: 367751 - RNA, 64 nt, Homo Sapiens
ucaguaauuaaaaauuaagccagggcauuuaaguggcuagcaaagugaaauauaagcuuuuuaa

SEQ ID NO: 367752 - RNA, 64 nt, Homo Sapiens
gaguacccgcaugguaucaggggcuggaucugggggcuagcagucccgccagccuccuccucuc

SEQ ID NO: 367753 - RNA, 64 nt, Homo Sapiens
uugcagucuauguuuaaugagaauuuggucuacaggcuagcagugcaaauaauacuuagagguu

SEQ ID NO: 367754 - RNA, 56 nt, Homo Sapiens
gccaguguuguagcaacugaggggguggcuagcagcaaacaaguauggagcuagca

SEQ ID NO: 367755 - RNA, 64 nt, Homo Sapiens
ggcuacuguaaguguucugagcauauuuaagacaggcuagcauuuucaauuuacaauauuuuca

SEQ ID NO: 367756 - RNA, 64 nt, Homo Sapiens
gucagaagagcuucauagaaaguugggcaaaacaggcuagcaauugcaaagucaggcuuugacc

SEQ ID NO: 367757 - RNA, 64 nt, Homo Sapiens
acccucccuuggcuucgcccggaaggcucugaguggcuagcaggaaaguuacuguguggauaca

SEQ ID NO: 367758 - RNA, 64 nt, Homo Sapiens
uggaaaaacaacuuagaggagaaauauuguuuaaggcuagcacaugucacaaguacagaagaga

SEQ ID NO: 367759 - RNA, 64 nt, Homo Sapiens
ugcccagccuucagagugugauuuugucucaacuggcuagcaaaacccaggcaaccaacaccug

SEQ ID NO: 367760 - RNA, 64 nt, Homo Sapiens
uucuuuaccacuaucuuguuuaguguuauuuuuuggcuagcauuaauacgcaccuauuucucaa

SEQ ID NO: 367761 - RNA, 64 nt, Homo Sapiens
ggcauggcccagacccucggagggccaggcaacaggcuagcaaggcccacagggagggagcaga

SEQ ID NO: 367762 - RNA, 64 nt, Homo Sapiens
aaccauuuuagguguacuguuuuucucaaauaaaggcuagcagaauuggggauuuuuguguaaa

SEQ ID NO: 367763 - RNA, 64 nt, Homo Sapiens
augagcagcagcaacaacugaauguccugguccuggcuagcagcagcaccguggugaugcagga

SEQ ID NO: 367764 - RNA, 64 nt, Homo Sapiens
ugugcucagugaggaggcaguaaaugaaguuacaggcuagcacaauaccuaacucauguuuccc

SEQ ID NO: 367765 - RNA, 64 nt, Homo Sapiens
guuuggaguaagcguuguugcugaagugaguucaggcuagcauuaaauuguaaguucugaagcu

SEQ ID NO: 367766 - RNA, 64 nt, Homo Sapiens
ggggagaaugacuuucccuuuuuugccccauaagggcuagcauaagcugagguagaacuuaucu

SEQ ID NO: 367767 - RNA, 64 nt, Homo Sapiens
ucacgccuguaaucccagcacuuugggagggcgaggcuagcagaucacuugagguuaggaguuc

SEQ ID NO: 367768 - RNA, 64 nt, Homo Sapiens
cgagucugcguccauuagagcacaguccacccgaggcuagcaccgugucugugucugucucccc

SEQ ID NO: 367769 - RNA, 64 nt, Homo Sapiens
aaaguaucuagcaaggauauuacuugugccuugaggcuagcaauuauaggauagauucaucuaa

SEQ ID NO: 367770 - RNA, 64 nt, Homo Sapiens
guuuuagguuuaucuuccuuaucugucugccgaaggcuagcaugucuguaagaaguacaaugcc

SEQ ID NO: 367771 - RNA, 64 nt, Homo Sapiens
ccugaggagccaggccgggcuccuuagucucaagggcuagcaucuaguuucccugaaggaacau

SEQ ID NO: 367772 - RNA, 64 nt, Homo Sapiens
caguucagaagaaauaaacuuaagcagggagcugggcuagcagaggccggcccuggccaucggg

SEQ ID NO: 367773 - RNA, 64 nt, Homo Sapiens
ucuuaagcaguuaugcucuuaaugcuuaaaagaaggcuagcauuguuugcacaaaaaguuggug

SEQ ID NO: 367774 - RNA, 64 nt, Homo Sapiens
agaggcuucaccgcaucaccucucugccugcaggggcuagcagcggccgaggcaucuggaacuu

SEQ ID NO: 367775 - RNA, 64 nt, Homo Sapiens
ggugggaggcagugggguuaccucacugaggcagggcuagcaggcagcuccugcccccgccuuc

SEQ ID NO: 367776 - RNA, 64 nt, Homo Sapiens
guggaaguugcuccuugcgcugauguggucacucggcuagcaggcccuucuguggucaaccaca

SEQ ID NO: 367777 - RNA, 64 nt, Homo Sapiens
cugcugggccacaccccaagcguccaccugcccuggcuagcaugaccggugcauccgcccagug

SEQ ID NO: 367778 - RNA, 64 nt, Homo Sapiens
acacaaucucgccagggaaaaccuaauggccacuggcuagcagcaaaccuaacgucccugggua

SEQ ID NO: 367779 - RNA, 64 nt, Homo Sapiens
guuuguuuguuuguuuuuuucucuaaagcugaguggcuagcagcggcgcccauagccaucgggu

SEQ ID NO: 367780 - RNA, 64 nt, Homo Sapiens
ccacggggccacacagagaagagcagggcuuaggggcuagcagcggggguggggggggcccagg

SEQ ID NO: 367781 - RNA, 64 nt, Homo Sapiens
uguucaagguuagcacgcaaaucugagaaagggaggcuagcaugauuacuuuagaucuuuccaa

SEQ ID NO: 367782 - RNA, 64 nt, Homo Sapiens
uagaaguuuuguauguuaacagaaaucaguuucuggcuagcaacugcagcuuguuaguggguuc

SEQ ID NO: 367783 - RNA, 64 nt, Homo Sapiens
ucagucucagauggaagcugggccuggguggggaggcuagcaugcguggcucccuggguauuuc

SEQ ID NO: 367784 - RNA, 64 nt, Homo Sapiens
ugucguuguucauucuggggauaaaggggaacuaggcuagcaguucuaaugugacauucuuuaa

SEQ ID NO: 367785 - RNA, 64 nt, Homo Sapiens
gccuucuccaccggggccccccugccccgccccuggcuagcagcccuaaguccccaccugggcu

SEQ ID NO: 367786 - RNA, 64 nt, Homo Sapiens
auuuaagcaagaccaugggguggaaggagaaaggggcuagcacuggauggagcuggagggucgu

SEQ ID NO: 367787 - RNA, 64 nt, Homo Sapiens
guaauuuauucagacuguauacgucuaauuguauggcuagcaauaaugaacugacugguaagug

SEQ ID NO: 367788 - RNA, 64 nt, Homo Sapiens; identical to SEQ ID NO: 143712

SEQ ID NO: 367789 - RNA, 64 nt, Homo Sapiens; identical to SEQ ID NO: 143713

SEQ ID NO: 367790 - RNA, 64 nt, Homo Sapiens; identical to SEQ ID NO: 143714

SEQ ID NO: 367791 - RNA, 64 nt, Homo Sapiens; identical to SEQ ID NO: 143715

SEQ ID NO: 367792 - RNA, 64 nt, Homo Sapiens; identical to SEQ ID NO: 143716

SEQ ID NO: 367793 - RNA, 64 nt, Homo Sapiens; identical to SEQ ID NO: 143717

SEQ ID NO: 367794 - RNA, 64 nt, Homo Sapiens; identical to SEQ ID NO: 143718

SEQ ID NO: 367795 - RNA, 64 nt, Homo Sapiens; identical to SEQ ID NO: 143719

SEQ ID NO: 367796 - RNA, 64 nt, Homo Sapiens; identical to SEQ ID NO: 143720

SEQ ID NO: 367797 - RNA, 64 nt, Homo Sapiens; identical to SEQ ID NO: 143721

SEQ ID NO: 367798 - RNA, 64 nt, Homo Sapiens; identical to SEQ ID NO: 143722

SEQ ID NO: 367799 - RNA, 64 nt, Homo Sapiens; identical to SEQ ID NO: 143723

SEQ ID NO: 367800 - RNA, 64 nt, Homo Sapiens; identical to SEQ ID NO: 143724

SEQ ID NO: 367801 - RNA, 64 nt, Homo Sapiens; identical to SEQ ID NO: 143725

SEQ ID NO: 367802 - RNA, 64 nt, Homo Sapiens; identical to SEQ ID NO: 143726

SEQ ID NO: 367803 - RNA, 64 nt, Homo Sapiens; identical to SEQ ID NO: 143727

SEQ ID NO: 367804 - RNA, 64 nt, Homo Sapiens; identical to SEQ ID NO: 143728

SEQ ID NO: 367805 - RNA, 64 nt, Homo Sapiens; identical to SEQ ID NO: 143729

SEQ ID NO: 367806 - RNA, 64 nt, Homo Sapiens; identical to SEQ ID NO: 143730

SEQ ID NO: 367807 - RNA, 64 nt, Homo Sapiens; identical to SEQ ID NO: 143731

SEQ ID NO: 367808 - RNA, 64 nt, Homo Sapiens; identical to SEQ ID NO: 143732

SEQ ID NO: 367809 - RNA, 64 nt, Homo Sapiens; identical to SEQ ID NO: 143733

SEQ ID NO: 367810 - RNA, 64 nt, Homo Sapiens; identical to SEQ ID NO: 143734

SEQ ID NO: 367811 - RNA, 64 nt, Homo Sapiens; identical to SEQ ID NO: 143735

SEQ ID NO: 367812 - RNA, 64 nt, Homo Sapiens; identical to SEQ ID NO: 143736

SEQ ID NO: 367813 - RNA, 64 nt, Homo Sapiens; identical to SEQ ID NO: 143737

SEQ ID NO: 367814 - RNA, 64 nt, Homo Sapiens; identical to SEQ ID NO: 143738

SEQ ID NO: 367815 - RNA, 64 nt, Homo Sapiens; identical to SEQ ID NO: 143739

SEQ ID NO: 367816 - RNA, 64 nt, Homo Sapiens; identical to SEQ ID NO: 143740

SEQ ID NO: 367817 - RNA, 64 nt, Homo Sapiens; identical to SEQ ID NO: 143741

SEQ ID NO: 367818 - RNA, 64 nt, Homo Sapiens; identical to SEQ ID NO: 143742

SEQ ID NO: 367819 - RNA, 64 nt, Homo Sapiens; identical to SEQ ID NO: 143743

SEQ ID NO: 367820 - RNA, 64 nt, Homo Sapiens; identical to SEQ ID NO: 143744

SEQ ID NO: 367821 - RNA, 64 nt, Homo Sapiens; identical to SEQ ID NO: 143745

SEQ ID NO: 367822 - RNA, 64 nt, Homo Sapiens; identical to SEQ ID NO: 143746

SEQ ID NO: 367823 - RNA, 64 nt, Homo Sapiens; identical to SEQ ID NO: 143747

SEQ ID NO: 367824 - RNA, 64 nt, Homo Sapiens; identical to SEQ ID NO: 143748

SEQ ID NO: 367825 - RNA, 64 nt, Homo Sapiens; identical to SEQ ID NO: 143749

SEQ ID NO: 367826 - RNA, 64 nt, Homo Sapiens; identical to SEQ ID NO: 143750

SEQ ID NO: 367827 - RNA, 64 nt, Homo Sapiens; identical to SEQ ID NO: 143751

SEQ ID NO: 367828 - RNA, 64 nt, Homo Sapiens; identical to SEQ ID NO: 143752

SEQ ID NO: 367829 - RNA, 64 nt, Homo Sapiens; identical to SEQ ID NO: 143753

SEQ ID NO: 367830 - RNA, 64 nt, Homo Sapiens; identical to SEQ ID NO: 143754

SEQ ID NO: 367831 - RNA, 64 nt, Homo Sapiens; identical to SEQ ID NO: 143755

SEQ ID NO: 367832 - RNA, 64 nt, Homo Sapiens; identical to SEQ ID NO: 143756

SEQ ID NO: 367833 - RNA, 64 nt, Homo Sapiens; identical to SEQ ID NO: 143757

SEQ ID NO: 367834 - RNA, 64 nt, Homo Sapiens; identical to SEQ ID NO: 143758

SEQ ID NO: 367835 - RNA, 64 nt, Homo Sapiens; identical to SEQ ID NO: 143759

SEQ ID NO: 367836 - RNA, 64 nt, Homo Sapiens; identical to SEQ ID NO: 143760

SEQ ID NO: 367837 - RNA, 64 nt, Homo Sapiens; identical to SEQ ID NO: 143761

SEQ ID NO: 367838 - RNA, 64 nt, Homo Sapiens; identical to SEQ ID NO: 143762

SEQ ID NO: 367839 - RNA, 64 nt, Homo Sapiens; identical to SEQ ID NO: 143763

SEQ ID NO: 367840 - RNA, 64 nt, Homo Sapiens; identical to SEQ ID NO: 143764

SEQ ID NO: 367841 - RNA, 64 nt, Homo Sapiens; identical to SEQ ID NO: 143765

SEQ ID NO: 367842 - RNA, 64 nt, Homo Sapiens; identical to SEQ ID NO: 143766

SEQ ID NO: 367843 - RNA, 64 nt, Homo Sapiens; identical to SEQ ID NO: 143767

SEQ ID NO: 367844 - RNA, 64 nt, Homo Sapiens; identical to SEQ ID NO: 143768

SEQ ID NO: 367845 - RNA, 64 nt, Homo Sapiens; identical to SEQ ID NO: 143769

SEQ ID NO: 367846 - RNA, 64 nt, Homo Sapiens; identical to SEQ ID NO: 143770

SEQ ID NO: 367847 - RNA, 64 nt, Homo Sapiens; identical to SEQ ID NO: 143771

SEQ ID NO: 367848 - RNA, 64 nt, Homo Sapiens; identical to SEQ ID NO: 143772

SEQ ID NO: 367849 - RNA, 64 nt, Homo Sapiens; identical to SEQ ID NO: 143773

SEQ ID NO: 367850 - RNA, 64 nt, Homo Sapiens; identical to SEQ ID NO: 143774

SEQ ID NO: 367851 - RNA, 64 nt, Homo Sapiens; identical to SEQ ID NO: 143775

SEQ ID NO: 367852 - RNA, 64 nt, Homo Sapiens; identical to SEQ ID NO: 143776

SEQ ID NO: 367853 - RNA, 64 nt, Homo Sapiens; identical to SEQ ID NO: 143777

SEQ ID NO: 367854 - RNA, 64 nt, Homo Sapiens; identical to SEQ ID NO: 143778

SEQ ID NO: 367855 - RNA, 64 nt, Homo Sapiens; identical to SEQ ID NO: 143779

SEQ ID NO: 367856 - RNA, 64 nt, Homo Sapiens; identical to SEQ ID NO: 143780

SEQ ID NO: 367857 - RNA, 64 nt, Homo Sapiens; identical to SEQ ID NO: 143781

SEQ ID NO: 367858 - RNA, 64 nt, Homo Sapiens; identical to SEQ ID NO: 143782

SEQ ID NO: 367859 - RNA, 64 nt, Homo Sapiens; identical to SEQ ID NO: 143783

SEQ ID NO: 367860 - RNA, 64 nt, Homo Sapiens; identical to SEQ ID NO: 143784

SEQ ID NO: 367861 - RNA, 64 nt, Homo Sapiens; identical to SEQ ID NO: 143785

SEQ ID NO: 367862 - RNA, 64 nt, Homo Sapiens; identical to SEQ ID NO: 143786

SEQ ID NO: 367863 - RNA, 64 nt, Homo Sapiens; identical to SEQ ID NO: 143787

SEQ ID NO: 367864 - RNA, 64 nt, Homo Sapiens; identical to SEQ ID NO: 143788

SEQ ID NO: 367865 - RNA, 64 nt, Homo Sapiens; identical to SEQ ID NO: 143789

SEQ ID NO: 367866 - RNA, 57 nt, Homo Sapiens; identical to SEQ ID NO: 143790

SEQ ID NO: 367867 - RNA, 64 nt, Homo Sapiens; identical to SEQ ID NO: 143791

SEQ ID NO: 367868 - RNA, 64 nt, Homo Sapiens; identical to SEQ ID NO: 143792

SEQ ID NO: 367869 - RNA, 64 nt, Homo Sapiens; identical to SEQ ID NO: 143793

SEQ ID NO: 367870 - RNA, 64 nt, Homo Sapiens; identical to SEQ ID NO: 143794

SEQ ID NO: 367871 - RNA, 64 nt, Homo Sapiens; identical to SEQ ID NO: 143795

SEQ ID NO: 367872 - RNA, 64 nt, Homo Sapiens; identical to SEQ ID NO: 143796

SEQ ID NO: 367873 - RNA, 64 nt, Homo Sapiens; identical to SEQ ID NO: 143797

SEQ ID NO: 367874 - RNA, 64 nt, Homo Sapiens; identical to SEQ ID NO: 143798

SEQ ID NO: 367875 - RNA, 64 nt, Homo Sapiens; identical to SEQ ID NO: 143799

SEQ ID NO: 367876 - RNA, 64 nt, Homo Sapiens; identical to SEQ ID NO: 143800

SEQ ID NO: 367877 - RNA, 64 nt, Homo Sapiens; identical to SEQ ID NO: 143801

SEQ ID NO: 367878 - RNA, 64 nt, Homo Sapiens; identical to SEQ ID NO: 143802

SEQ ID NO: 367879 - RNA, 64 nt, Homo Sapiens; identical to SEQ ID NO: 143803

SEQ ID NO: 367880 - RNA, 64 nt, Homo Sapiens; identical to SEQ ID NO: 143804

SEQ ID NO: 367881 - RNA, 64 nt, Homo Sapiens; identical to SEQ ID NO: 143805

SEQ ID NO: 367882 - RNA, 64 nt, Homo Sapiens; identical to SEQ ID NO: 143806

SEQ ID NO: 367883 - RNA, 64 nt, Homo Sapiens; identical to SEQ ID NO: 143807

SEQ ID NO: 367884 - RNA, 64 nt, Homo Sapiens; identical to SEQ ID NO: 143808

SEQ ID NO: 367885 - RNA, 64 nt, Homo Sapiens; identical to SEQ ID NO: 143809

SEQ ID NO: 367886 - RNA, 64 nt, Homo Sapiens; identical to SEQ ID NO: 143810

SEQ ID NO: 367887 - RNA, 64 nt, Homo Sapiens; identical to SEQ ID NO: 143811

SEQ ID NO: 367888 - RNA, 64 nt, Homo Sapiens; identical to SEQ ID NO: 143812

SEQ ID NO: 367889 - RNA, 64 nt, Homo Sapiens; identical to SEQ ID NO: 164859

SEQ ID NO: 367890 - RNA, 64 nt, Homo Sapiens; identical to SEQ ID NO: 164860

SEQ ID NO: 367891 - RNA, 64 nt, Homo Sapiens; identical to SEQ ID NO: 164861

SEQ ID NO: 367892 - RNA, 64 nt, Homo Sapiens; identical to SEQ ID NO: 164862

SEQ ID NO: 367893 - RNA, 64 nt, Homo Sapiens; identical to SEQ ID NO: 164863

SEQ ID NO: 367894 - RNA, 64 nt, Homo Sapiens; identical to SEQ ID NO: 164864

SEQ ID NO: 367895 - RNA, 64 nt, Homo Sapiens; identical to SEQ ID NO: 164865

SEQ ID NO: 367896 - RNA, 64 nt, Homo Sapiens; identical to SEQ ID NO: 164866

SEQ ID NO: 367897 - RNA, 64 nt, Homo Sapiens; identical to SEQ ID NO: 164867

SEQ ID NO: 367898 - RNA, 64 nt, Homo Sapiens; identical to SEQ ID NO: 164868

SEQ ID NO: 367899 - RNA, 64 nt, Homo Sapiens; identical to SEQ ID NO: 164869

SEQ ID NO: 367900 - RNA, 64 nt, Homo Sapiens; identical to SEQ ID NO: 164870

SEQ ID NO: 367901 - RNA, 64 nt, Homo Sapiens; identical to SEQ ID NO: 164871

SEQ ID NO: 367902 - RNA, 64 nt, Homo Sapiens; identical to SEQ ID NO: 164872

SEQ ID NO: 367903 - RNA, 64 nt, Homo Sapiens; identical to SEQ ID NO: 164873

SEQ ID NO: 367904 - RNA, 64 nt, Homo Sapiens; identical to SEQ ID NO: 164874

SEQ ID NO: 367905 - RNA, 64 nt, Homo Sapiens; identical to SEQ ID NO: 164875

SEQ ID NO: 367906 - RNA, 64 nt, Homo Sapiens; identical to SEQ ID NO: 164876

SEQ ID NO: 367907 - RNA, 64 nt, Homo Sapiens; identical to SEQ ID NO: 164877

SEQ ID NO: 367908 - RNA, 64 nt, Homo Sapiens; identical to SEQ ID NO: 164878

SEQ ID NO: 367909 - RNA, 64 nt, Homo Sapiens; identical to SEQ ID NO: 164879

SEQ ID NO: 367910 - RNA, 64 nt, Homo Sapiens; identical to SEQ ID NO: 164880

SEQ ID NO: 367911 - RNA, 64 nt, Homo Sapiens; identical to SEQ ID NO: 164881

SEQ ID NO: 367912 - RNA, 64 nt, Homo Sapiens; identical to SEQ ID NO: 164882

SEQ ID NO: 367913 - RNA, 64 nt, Homo Sapiens; identical to SEQ ID NO: 164883

SEQ ID NO: 367914 - RNA, 64 nt, Homo Sapiens; identical to SEQ ID NO: 164884

SEQ ID NO: 367915 - RNA, 64 nt, Homo Sapiens; identical to SEQ ID NO: 164885

SEQ ID NO: 367916 - RNA, 64 nt, Homo Sapiens; identical to SEQ ID NO: 164886

SEQ ID NO: 367917 - RNA, 64 nt, Homo Sapiens
aguguauauuccguaucuuggcaagguuugcaaagagugaaacugacuucagggacaggaaaaa

SEQ ID NO: 367918 - RNA, 64 nt, Homo Sapiens
uuuaagaaaaaugaaauuuauuuaggagccacgugagugaaaguaaaugaaaagcauuuggaag

SEQ ID NO: 367919 - RNA, 64 nt, Homo Sapiens
uucacaaagauuugcguuaaagauccuacaguaagagugaaacaauuauuguaaaacauauuca

SEQ ID NO: 367920 - RNA, 64 nt, Homo Sapiens
uuggaacgcauauaaaucuuguagaagaauuccugagugaaaagucaaauggaacacagacagu

SEQ ID NO: 367921 - RNA, 64 nt, Homo Sapiens
cccagcauuccagacuucugguaaauuguuaaaggagugaaaauguaguuugccuggcagauga

SEQ ID NO: 367922 - RNA, 64 nt, Homo Sapiens
gaggccugagaaccuaauagaacucauauagugugagugaaauuugauuaaagauguuggaaaa

SEQ ID NO: 367923 - RNA, 64 nt, Homo Sapiens
gucucaaaaaaaaaaaaaaaaaaaaaaaaaccaggagugaaaaaggaaaguagaaggcagcugc

SEQ ID NO: 367924 - RNA, 64 nt, Homo Sapiens
guuggaagugauuucagcacauucuuuuuuaguggagugaaaguucugaagcccccuuuuaacu

SEQ ID NO: 367925 - RNA, 64 nt, Homo Sapiens
gacuucuucacaacagacaugggguacucacugggagugaaaauaaauacaacccaaggcaacu

SEQ ID NO: 367926 - RNA, 64 nt, Homo Sapiens
aauguuacauuuuccagcuggguagagcuggugugagugaaauuugcuaagcacugucuuaaga

SEQ ID NO: 367927 - RNA, 64 nt, Homo Sapiens
uuggugcuuccagacaucuauucccaguccaucagagugaaaugaaggcuauuugccaucccug

SEQ ID NO: 367928 - RNA, 64 nt, Homo Sapiens
ugaaggcuauuugccaucccugccuuagacagaggagugaaagaauuaaguggguagacaccaa

SEQ ID NO: 367929 - RNA, 64 nt, Homo Sapiens
uccaugguuccugcuuugugugagguggaugggggagugaaaucuggaugggggagugaaauug

SEQ ID NO: 367930 - RNA, 64 nt, Homo Sapiens
gugagguggaugggggagugugagguggaugggggagugaaauugugcuagauuaauuucauug

SEQ ID NO: 367931 - RNA, 64 nt, Homo Sapiens
acaugcuacaaugaggcagcgagugaaaacacuagagugaaaacauucauaaacacagagugua

SEQ ID NO: 367932 - RNA, 64 nt, Homo Sapiens
acuagagugaaaacacaugcaaacacagaguguagagugaaaacagcucaggcuauucauucau

SEQ ID NO: 367933 - RNA, 60 nt, Homo Sapiens
auauaaaggcgacugaauagauggaugagggagugaaaacuuugcauagaauccucacgc

SEQ ID NO: 367934 - RNA, 64 nt, Homo Sapiens
auuaacuuacaaaaagucacaaaaacuuacaugagagugaaaauuuguuaugacuguuuugaga

SEQ ID NO: 367935 - RNA, 64 nt, Homo Sapiens; identical to SEQ ID NO: 21144

SEQ ID NO: 367936 - RNA, 64 nt, Homo Sapiens; identical to SEQ ID NO: 21145

SEQ ID NO: 367937 - RNA, 64 nt, Homo Sapiens; identical to SEQ ID NO: 21146

SEQ ID NO: 367938 - RNA, 64 nt, Homo Sapiens; identical to SEQ ID NO: 21147

SEQ ID NO: 367939 - RNA, 64 nt, Homo Sapiens; identical to SEQ ID NO: 21148

SEQ ID NO: 367940 - RNA, 64 nt, Homo Sapiens; identical to SEQ ID NO: 21149

SEQ ID NO: 367941 - RNA, 64 nt, Homo Sapiens
cucuauaacucuaauccauugauuuagaguauuuuggacaaaugguugaccuuuuguaauauuu

SEQ ID NO: 367942 - RNA, 64 nt, Homo Sapiens
uucuggcauaauauuugaagugaacaugaauauuuggacaaaauaacuaugugucucuguuuac

SEQ ID NO: 367943 - RNA, 64 nt, Homo Sapiens
cuccaaacauccucuuccauauggauccacuggcuggacaaacugcaccaguugcugcuucaau

SEQ ID NO: 367944 - RNA, 64 nt, Homo Sapiens
ugggauccacgacgcuuaaauacagcuuuuggauuggacaaaaugacuugaagacuuacagcaa

SEQ ID NO: 367945 - RNA, 64 nt, Homo Sapiens
ucauguaacuuuuaugucuggacuacaguucaaguggacaaaaacauuucuguauuuuuuuuaa

SEQ ID NO: 367946 - RNA, 64 nt, Homo Sapiens
agauaaacuugaauugacacgugguguaauaaaauggacaaauucuguagaguagacacaguga

SEQ ID NO: 367947 - RNA, 64 nt, Homo Sapiens
gagucagagaagagaagcaacgacaaaaugucucuggacaaagaugagcugcacugaaacuuua

SEQ ID NO: 367948 - RNA, 64 nt, Homo Sapiens
aaucugcuuaagauccugucccagcaacaugaaauggacaaaccgccuuagaggggccuacaaa

SEQ ID NO: 367949 - RNA, 64 nt, Homo Sapiens
ggcugccauuggagccaauguguggcucagugccuggacaaaugaugccauggcagacaguaga

SEQ ID NO: 367950 - RNA, 64 nt, Homo Sapiens
aacacuaucauggacuacaccaggguccugguccuggacaaaggaguaguagcugaauuugauu

SEQ ID NO: 367951 - RNA, 64 nt, Homo Sapiens
cuccaaggccacaaacuguucaacacacacaaaguggacaaauggcguucagcagcggguuugg

SEQ ID NO: 367952 - RNA, 64 nt, Homo Sapiens
agugggaguacugagauguguggguuuuugccauuggacaaagaaugagguuagaagacugcag

SEQ ID NO: 367953 - RNA, 64 nt, Homo Sapiens
gggaagggggacccaaggcaggagguacaccagcuggacaaauugcagggaggggagggagcga

SEQ ID NO: 367954 - RNA, 64 nt, Homo Sapiens
gcaggacacuguggccaugccacggagggggcaguggacaaaaccaauccaaagccaagccggg

SEQ ID NO: 367955 - RNA, 64 nt, Homo Sapiens; identical to SEQ ID NO: 139215

SEQ ID NO: 367956 - RNA, 64 nt, Homo Sapiens; identical to SEQ ID NO: 139216

SEQ ID NO: 367957 - RNA, 64 nt, Homo Sapiens; identical to SEQ ID NO: 139217

SEQ ID NO: 367958 - RNA, 64 nt, Homo Sapiens; identical to SEQ ID NO: 139218

SEQ ID NO: 367959 - RNA, 64 nt, Homo Sapiens; identical to SEQ ID NO: 139219

SEQ ID NO: 367960 - RNA, 64 nt, Homo Sapiens; identical to SEQ ID NO: 139220

SEQ ID NO: 367961 - RNA, 64 nt, Homo Sapiens; identical to SEQ ID NO: 139221

SEQ ID NO: 367962 - RNA, 64 nt, Homo Sapiens; identical to SEQ ID NO: 139222

SEQ ID NO: 367963 - RNA, 64 nt, Homo Sapiens; identical to SEQ ID NO: 139223

SEQ ID NO: 367964 - RNA, 64 nt, Homo Sapiens; identical to SEQ ID NO: 139224

SEQ ID NO: 367965 - RNA, 64 nt, Homo Sapiens; identical to SEQ ID NO: 139225

SEQ ID NO: 367966 - RNA, 64 nt, Homo Sapiens; identical to SEQ ID NO: 139226

SEQ ID NO: 367967 - RNA, 64 nt, Homo Sapiens; identical to SEQ ID NO: 139227

SEQ ID NO: 367968 - RNA, 64 nt, Homo Sapiens; identical to SEQ ID NO: 139228

SEQ ID NO: 367969 - RNA, 64 nt, Homo Sapiens; identical to SEQ ID NO: 139229

SEQ ID NO: 367970 - RNA, 64 nt, Homo Sapiens; identical to SEQ ID NO: 206328

SEQ ID NO: 367971 - RNA, 64 nt, Homo Sapiens; identical to SEQ ID NO: 206329

SEQ ID NO: 367972 - RNA, 64 nt, Homo Sapiens; identical to SEQ ID NO: 206330

SEQ ID NO: 367973 - RNA, 64 nt, Homo Sapiens; identical to SEQ ID NO: 206330

SEQ ID NO: 367974 - RNA, 64 nt, Homo Sapiens; identical to SEQ ID NO: 206332

SEQ ID NO: 367975 - RNA, 64 nt, Homo Sapiens; identical to SEQ ID NO: 206333

SEQ ID NO: 367976 - RNA, 64 nt, Homo Sapiens; identical to SEQ ID NO: 206334

SEQ ID NO: 367977 - RNA, 63 nt, Homo Sapiens
cuaucuauaauaaaaaugugagccacagcaaaccacacuuaacuccauuauaaauauaucuuu

SEQ ID NO: 367978 - RNA, 63 nt, Homo Sapiens
aacacgugaaacuauuuaugauuuguuuggucacacacuuaaugguuguuaguacuuauuuua

SEQ ID NO: 367979 - RNA, 63 nt, Homo Sapiens
cucauggggagggcccuucaaaacccugagcuucacacuuaaauggggggccgugcacacccc

SEQ ID NO: 367980 - RNA, 63 nt, Homo Sapiens
ggucuaguuuguccguuuuaaggccaacuagaccacacuuauuaauauguagucaaggcagcc

SEQ ID NO: 367981 - RNA, 63 nt, Homo Sapiens
ugcagcuggagaugaacuuuuaaaaauccccuucacacuuaauguacugaccgagacagaagu

SEQ ID NO: 367982 - RNA, 63 nt, Homo Sapiens
uaauuuaugacauggaaaugccuuacgugguaucacacuuagucuugaaaaaaacaccaaggu

SEQ ID NO: 367983 - RNA, 63 nt, Homo Sapiens
ugcauuggguuuggaugcucuccuguugucugucacacuuaacucuugcaucuccuuguccau

SEQ ID NO: 367984 - RNA, 63 nt, Homo Sapiens
aagcauuguuuuuauuuucaggcuuagccugagcacacuuauuuuugaaaaugauauaaugua

SEQ ID NO: 367985 - RNA, 63 nt, Homo Sapiens
cugcccuaugguucuggcuccuacccccugcggcacacuuaucuucaaauaccauagaauucu

SEQ ID NO: 367986 - RNA, 63 nt, Homo Sapiens
uuuacacuuuuugacuaacuagcaucuauauuccacacuuagcuuuuuugucacacuuauccu

SEQ ID NO: 367987 - RNA, 63 nt, Homo Sapiens
cuagcaucuauauuccacacuuagcuuuuuugucacacuuauccuuugucuccguaaauuuca

SEQ ID NO: 367988 - RNA, 63 nt, Homo Sapiens
ggacagcucagaauaauuuagcauauuuccuuucacacuuaaaguucuuaagaugagacugug

SEQ ID NO: 367989 - RNA, 63 nt, Homo Sapiens
caaaagaucugaauucacauuaaguuccccuugcacacuuaccuauuuaaaaaacuaaacuug

SEQ ID NO: 367990 - RNA, 63 nt, Homo Sapiens
aauacuuccaggaaaugcuuuauuacaaaccaucacacuuagaacaucuuuucauuuguuaua

SEQ ID NO: 367991 - RNA, 63 nt, Homo Sapiens
gacagugaugcucugugcugcauucucccccggcacacuuagucacaccgccaagcagcucag

SEQ ID NO: 367992 - RNA, 64 nt, Homo Sapiens; identical to SEQ ID NO: 95478

SEQ ID NO: 367993 - RNA, 64 nt, Homo Sapiens; identical to SEQ ID NO: 95479

SEQ ID NO: 367994 - RNA, 64 nt, Homo Sapiens; identical to SEQ ID NO: 95480

SEQ ID NO: 367995 - RNA, 64 nt, Homo Sapiens; identical to SEQ ID NO: 95481

SEQ ID NO: 367996 - RNA, 64 nt, Homo Sapiens; identical to SEQ ID NO: 95482

SEQ ID NO: 367997 - RNA, 64 nt, Homo Sapiens; identical to SEQ ID NO: 95483

SEQ ID NO: 367998 - RNA, 64 nt, Homo Sapiens; identical to SEQ ID NO: 95484

SEQ ID NO: 367999 - RNA, 64 nt, Homo Sapiens; identical to SEQ ID NO: 95485

SEQ ID NO: 368000 - RNA, 64 nt, Homo Sapiens; identical to SEQ ID NO: 95486

SEQ ID NO: 368001 - RNA, 64 nt, Homo Sapiens; identical to SEQ ID NO: 95487

SEQ ID NO: 368002 - RNA, 64 nt, Homo Sapiens; identical to SEQ ID NO: 95488

SEQ ID NO: 368003 - RNA, 64 nt, Homo Sapiens; identical to SEQ ID NO: 95489

SEQ ID NO: 368004 - RNA, 64 nt, Homo Sapiens; identical to SEQ ID NO: 95490

SEQ ID NO: 368005 - RNA, 64 nt, Homo Sapiens; identical to SEQ ID NO: 95491

SEQ ID NO: 368006 - RNA, 64 nt, Homo Sapiens; identical to SEQ ID NO: 95492

SEQ ID NO: 368007 - RNA, 64 nt, Homo Sapiens; identical to SEQ ID NO: 95493

SEQ ID NO: 368008 - RNA, 64 nt, Homo Sapiens; identical to SEQ ID NO: 95494

SEQ ID NO: 368009 - RNA, 64 nt, Homo Sapiens; identical to SEQ ID NO: 95495

SEQ ID NO: 368010 - RNA, 64 nt, Homo Sapiens; identical to SEQ ID NO: 95496

SEQ ID NO: 368011 - RNA, 64 nt, Homo Sapiens; identical to SEQ ID NO: 95497

SEQ ID NO: 368012 - RNA, 64 nt, Homo Sapiens; identical to SEQ ID NO: 95498

SEQ ID NO: 368013 - RNA, 64 nt, Homo Sapiens; identical to SEQ ID NO: 95499

SEQ ID NO: 368014 - RNA, 64 nt, Homo Sapiens; identical to SEQ ID NO: 95500

SEQ ID NO: 368015 - RNA, 64 nt, Homo Sapiens; identical to SEQ ID NO: 95501

SEQ ID NO: 368016 - RNA, 64 nt, Homo Sapiens; identical to SEQ ID NO: 95502

SEQ ID NO: 368017 - RNA, 64 nt, Homo Sapiens; identical to SEQ ID NO: 95503

SEQ ID NO: 368018 - RNA, 64 nt, Homo Sapiens; identical to SEQ ID NO: 95504

SEQ ID NO: 368019 - RNA, 64 nt, Homo Sapiens; identical to SEQ ID NO: 95505

SEQ ID NO: 368020 - RNA, 64 nt, Homo Sapiens; identical to SEQ ID NO: 95506

SEQ ID NO: 368021 - RNA, 64 nt, Homo Sapiens; identical to SEQ ID NO: 95507

SEQ ID NO: 368022 - RNA, 64 nt, Homo Sapiens; identical to SEQ ID NO: 95508

SEQ ID NO: 368023 - RNA, 64 nt, Homo Sapiens; identical to SEQ ID NO: 95509

SEQ ID NO: 368024 - RNA, 64 nt, Homo Sapiens; identical to SEQ ID NO: 95510

SEQ ID NO: 368025 - RNA, 64 nt, Homo Sapiens; identical to SEQ ID NO: 95511

SEQ ID NO: 368026 - RNA, 64 nt, Homo Sapiens; identical to SEQ ID NO: 95512

SEQ ID NO: 368027 - RNA, 64 nt, Homo Sapiens; identical to SEQ ID NO: 95513

SEQ ID NO: 368028 - RNA, 64 nt, Homo Sapiens; identical to SEQ ID NO: 95514

SEQ ID NO: 368029 - RNA, 64 nt, Homo Sapiens; identical to SEQ ID NO: 95515

SEQ ID NO: 368030 - RNA, 64 nt, Homo Sapiens; identical to SEQ ID NO: 95516

SEQ ID NO: 368031 - RNA, 64 nt, Homo Sapiens; identical to SEQ ID NO: 95517

SEQ ID NO: 368032 - RNA, 64 nt, Homo Sapiens; identical to SEQ ID NO: 95518

SEQ ID NO: 368033 - RNA, 64 nt, Homo Sapiens; identical to SEQ ID NO: 95519

SEQ ID NO: 368034 - RNA, 64 nt, Homo Sapiens; identical to SEQ ID NO: 95520

SEQ ID NO: 368035 - RNA, 64 nt, Homo Sapiens; identical to SEQ ID NO: 95521

SEQ ID NO: 368036 - RNA, 64 nt, Homo Sapiens; identical to SEQ ID NO: 95522

SEQ ID NO: 368037 - RNA, 64 nt, Homo Sapiens; identical to SEQ ID NO: 95523

SEQ ID NO: 368038 - RNA, 64 nt, Homo Sapiens; identical to SEQ ID NO: 95524

SEQ ID NO: 368039 - RNA, 64 nt, Homo Sapiens; identical to SEQ ID NO: 95525

SEQ ID NO: 368040 - RNA, 64 nt, Homo Sapiens; identical to SEQ ID NO: 189531

SEQ ID NO: 368041 - RNA, 64 nt, Homo Sapiens; identical to SEQ ID NO: 189532

SEQ ID NO: 368042 - RNA, 64 nt, Homo Sapiens; identical to SEQ ID NO: 189533

SEQ ID NO: 368043 - RNA, 64 nt, Homo Sapiens; identical to SEQ ID NO: 189534

SEQ ID NO: 368044 - RNA, 64 nt, Homo Sapiens; identical to SEQ ID NO: 189535

SEQ ID NO: 368045 - RNA, 64 nt, Homo Sapiens; identical to SEQ ID NO: 189536

SEQ ID NO: 368046 - RNA, 64 nt, Homo Sapiens; identical to SEQ ID NO: 189537

SEQ ID NO: 368047 - RNA, 64 nt, Homo Sapiens; identical to SEQ ID NO: 189538

SEQ ID NO: 368048 - RNA, 64 nt, Homo Sapiens; identical to SEQ ID NO: 189539

SEQ ID NO: 368049 - RNA, 64 nt, Homo Sapiens; identical to SEQ ID NO: 189540

SEQ ID NO: 368050 - RNA, 64 nt, Homo Sapiens; identical to SEQ ID NO: 189541

SEQ ID NO: 368051 - RNA, 64 nt, Homo Sapiens; identical to SEQ ID NO: 189542

SEQ ID NO: 368052 - RNA, 64 nt, Homo Sapiens; identical to SEQ ID NO: 189543

SEQ ID NO: 368053 - RNA, 64 nt, Homo Sapiens; identical to SEQ ID NO: 189544

SEQ ID NO: 368054 - RNA, 64 nt, Homo Sapiens; identical to SEQ ID NO: 189545

SEQ ID NO: 368055 - RNA, 64 nt, Homo Sapiens; identical to SEQ ID NO: 189546

SEQ ID NO: 368056 - RNA, 64 nt, Homo Sapiens; identical to SEQ ID NO: 189547

SEQ ID NO: 368057 - RNA, 64 nt, Homo Sapiens; identical to SEQ ID NO: 189548

SEQ ID NO: 368058 - RNA, 64 nt, Homo Sapiens; identical to SEQ ID NO: 189549

SEQ ID NO: 368059 - RNA, 64 nt, Homo Sapiens; identical to SEQ ID NO: 189550

SEQ ID NO: 368060 - RNA, 64 nt, Homo Sapiens; identical to SEQ ID NO: 189551

SEQ ID NO: 368061 - RNA, 64 nt, Homo Sapiens; identical to SEQ ID NO: 189552

SEQ ID NO: 368062 - RNA, 64 nt, Homo Sapiens; identical to SEQ ID NO: 189553

SEQ ID NO: 368063 - RNA, 64 nt, Homo Sapiens; identical to SEQ ID NO: 189554

SEQ ID NO: 368064 - RNA, 64 nt, Homo Sapiens; identical to SEQ ID NO: 189555

SEQ ID NO: 368065 - RNA, 64 nt, Homo Sapiens; identical to SEQ ID NO: 189556

SEQ ID NO: 368066 - RNA, 64 nt, Homo Sapiens; identical to SEQ ID NO: 189557

SEQ ID NO: 368067 - RNA, 64 nt, Homo Sapiens; identical to SEQ ID NO: 189558

SEQ ID NO: 368068 - RNA, 64 nt, Homo Sapiens; identical to SEQ ID NO: 189559

SEQ ID NO: 368069 - RNA, 53 nt, Homo Sapiens; identical to SEQ ID NO: 189560

SEQ ID NO: 368070 - RNA, 64 nt, Homo Sapiens; identical to SEQ ID NO: 189561

SEQ ID NO: 368071 - RNA, 64 nt, Homo Sapiens; identical to SEQ ID NO: 189562

SEQ ID NO: 368072 - RNA, 63 nt, Homo Sapiens; identical to SEQ ID NO: 189563

SEQ ID NO: 368073 - RNA, 64 nt, Homo Sapiens; identical to SEQ ID NO: 189564

SEQ ID NO: 368074 - RNA, 64 nt, Homo Sapiens; identical to SEQ ID NO: 189565

SEQ ID NO: 368075 - RNA, 64 nt, Homo Sapiens; identical to SEQ ID NO: 189566

SEQ ID NO: 368076 - RNA, 64 nt, Homo Sapiens; identical to SEQ ID NO: 189567

SEQ ID NO: 368077 - RNA, 64 nt, Homo Sapiens; identical to SEQ ID NO: 189568

SEQ ID NO: 368078 - RNA, 64 nt, Homo Sapiens; identical to SEQ ID NO: 189569

SEQ ID NO: 368079 - RNA, 64 nt, Homo Sapiens; identical to SEQ ID NO: 189570

SEQ ID NO: 368080 - RNA, 64 nt, Homo Sapiens; identical to SEQ ID NO: 189571

SEQ ID NO: 368081 - RNA, 64 nt, Homo Sapiens; identical to SEQ ID NO: 189572

SEQ ID NO: 368082 - RNA, 64 nt, Homo Sapiens; identical to SEQ ID NO: 189573

SEQ ID NO: 368083 - RNA, 64 nt, Homo Sapiens; identical to SEQ ID NO: 189574

SEQ ID NO: 368084 - RNA, 64 nt, Homo Sapiens; identical to SEQ ID NO: 189575

SEQ ID NO: 368085 - RNA, 64 nt, Homo Sapiens; identical to SEQ ID NO: 189576

SEQ ID NO: 368086 - RNA, 64 nt, Homo Sapiens; identical to SEQ ID NO: 189577

SEQ ID NO: 368087 - RNA, 64 nt, Homo Sapiens; identical to SEQ ID NO: 189578

SEQ ID NO: 368088 - RNA, 64 nt, Homo Sapiens; identical to SEQ ID NO: 189579

SEQ ID NO: 368089 - RNA, 64 nt, Homo Sapiens; identical to SEQ ID NO: 189580

SEQ ID NO: 368090 - RNA, 64 nt, Homo Sapiens; identical to SEQ ID NO: 189581

SEQ ID NO: 368091 - RNA, 64 nt, Homo Sapiens; identical to SEQ ID NO: 189582

SEQ ID NO: 368092 - RNA, 64 nt, Homo Sapiens; identical to SEQ ID NO: 189583

SEQ ID NO: 368093 - RNA, 64 nt, Homo Sapiens; identical to SEQ ID NO: 189584

SEQ ID NO: 368094 - RNA, 64 nt, Homo Sapiens; identical to SEQ ID NO: 189585

SEQ ID NO: 368095 - RNA, 64 nt, Homo Sapiens; identical to SEQ ID NO: 189586

SEQ ID NO: 368096 - RNA, 64 nt, Homo Sapiens; identical to SEQ ID NO: 189587

SEQ ID NO: 368097 - RNA, 64 nt, Homo Sapiens; identical to SEQ ID NO: 189588

SEQ ID NO: 368098 - RNA, 64 nt, Homo Sapiens; identical to SEQ ID NO: 189589

SEQ ID NO: 368099 - RNA, 64 nt, Homo Sapiens; identical to SEQ ID NO: 189590

SEQ ID NO: 368100 - RNA, 64 nt, Homo Sapiens; identical to SEQ ID NO: 189591

SEQ ID NO: 368101 - RNA, 64 nt, Homo Sapiens; identical to SEQ ID NO: 189592

SEQ ID NO: 368102 - RNA, 64 nt, Homo Sapiens; identical to SEQ ID NO: 189593

SEQ ID NO: 368103 - RNA, 64 nt, Homo Sapiens; identical to SEQ ID NO: 189594

SEQ ID NO: 368104 - RNA, 64 nt, Homo Sapiens; identical to SEQ ID NO: 189595

SEQ ID NO: 368105 - RNA, 64 nt, Homo Sapiens; identical to SEQ ID NO: 189596

SEQ ID NO: 368106 - RNA, 64 nt, Homo Sapiens; identical to SEQ ID NO: 189597

SEQ ID NO: 368107 - RNA, 64 nt, Homo Sapiens; identical to SEQ ID NO: 189598

SEQ ID NO: 368108 - RNA, 64 nt, Homo Sapiens; identical to SEQ ID NO: 199615

SEQ ID NO: 368109 - RNA, 64 nt, Homo Sapiens; identical to SEQ ID NO: 199616

SEQ ID NO: 368110 - RNA, 64 nt, Homo Sapiens; identical to SEQ ID NO: 199617

SEQ ID NO: 368111 - RNA, 64 nt, Homo Sapiens; identical to SEQ ID NO: 199618

SEQ ID NO: 368112 - RNA, 64 nt, Homo Sapiens; identical to SEQ ID NO: 199619

SEQ ID NO: 368113 - RNA, 64 nt, Homo Sapiens; identical to SEQ ID NO: 199620

SEQ ID NO: 368114 - RNA, 64 nt, Homo Sapiens; identical to SEQ ID NO: 199621

SEQ ID NO: 368115 - RNA, 64 nt, Homo Sapiens; identical to SEQ ID NO: 199622

SEQ ID NO: 368116 - RNA, 64 nt, Homo Sapiens; identical to SEQ ID NO: 199623

SEQ ID NO: 368117 - RNA, 64 nt, Homo Sapiens; identical to SEQ ID NO: 199624

SEQ ID NO: 368118 - RNA, 64 nt, Homo Sapiens; identical to SEQ ID NO: 199625

SEQ ID NO: 368119 - RNA, 64 nt, Homo Sapiens; identical to SEQ ID NO: 199626

SEQ ID NO: 368120 - RNA, 64 nt, Homo Sapiens; identical to SEQ ID NO: 199627

SEQ ID NO: 368121 - RNA, 64 nt, Homo Sapiens; identical to SEQ ID NO: 199628

SEQ ID NO: 368122 - RNA, 64 nt, Homo Sapiens
caccaaaugacaagucacacccuccccauuaguauccuguuaggggaaaauaguagcagaguca

SEQ ID NO: 368123 - RNA, 64 nt, Homo Sapiens
ucuaagauuguacauaaagucauauauauggaaauccuguuacuuaaauagcaucugcucuucu

SEQ ID NO: 368124 - RNA, 64 nt, Homo Sapiens
uucuuagggauacuugguuacauaaaugaaaauauccuguuauuuuuggggagguuggcuugaa

SEQ ID NO: 368125 - RNA, 64 nt, Homo Sapiens
aucuaagaacucugugguuuggaaccauuuuuuuuccuguuaccuuuccccaagaauugcaacc

SEQ ID NO: 368126 - RNA, 64 nt, Homo Sapiens
ggaaauuaaaguuugucuauuguuaaauuaauauuccuguuaaaggugauggcuuauggaaggc

SEQ ID NO: 368127 - RNA, 64 nt, Homo Sapiens
gauacuauaagugaccuaaaaaaaacaggugugauccuguuacuuauucauccugguguuacug

SEQ ID NO: 368128 - RNA, 64 nt, Homo Sapiens
gaauuaagaacacauucuaaugugcucuacuccuuccuguuaaugucguacugguuuuaaaccu

SEQ ID NO: 368129 - RNA, 64 nt, Homo Sapiens; identical to SEQ ID NO: 368128

SEQ ID NO: 368130 - RNA, 64 nt, Homo Sapiens
ccguaggcuucuuaaucuucuaccuacucuuggcuccuguuacuugaugcuuacugagaacuau

SEQ ID NO: 368131 - RNA, 64 nt, Homo Sapiens
uccucugcaggauacaguucacaucaccaacagauccuguuauuaacugauaaaaaauaaugca

SEQ ID NO: 368132 - RNA, 64 nt, Homo Sapiens
aucagucugcuagaacuuuaaaaugaaggacaaauccuguuaaagaaauauuguuaaaaaucuu

SEQ ID NO: 368133 - RNA, 64 nt, Homo Sapiens
caucagaagcaguaggaauggccguauacaaccauccuguuaaacauuuaaauuuagcucugau

SEQ ID NO: 368134 - RNA, 64 nt, Homo Sapiens
guauuuaacuaauauauuauauaaccccuauuuuuccuguuauuaauaaggggaaaaagauaaa

SEQ ID NO: 368135 - RNA, 64 nt, Homo Sapiens
gcggcccaaggacaggaaacucuaucccaucccuuccuguuacuugaaagagaccucagagguc

SEQ ID NO: 368136 - RNA, 64 nt, Homo Sapiens
uacaaggaagaguuguuuuuaccuuuuaagaauuuccuguuaagaucgucuccauuuuuaugcu

SEQ ID NO: 368137 - RNA, 64 nt, Homo Sapiens
aguuuuggaauuguuaacguuucuuucaacaagcuccuguuaaaaguauaugaaccugaguacu

SEQ ID NO: 368138 - RNA, 64 nt, Homo Sapiens
uaaaugugaacauuuauuguaaauguugacccuauccuguuauuaaagcugacccacugguuga

SEQ ID NO: 368139 - RNA, 64 nt, Homo Sapiens
cuggaaaaaccuauuguuuuucaucauguaaaauuccuguuauuuaccgacagaaauagacauu

SEQ ID NO: 368140 - RNA, 64 nt, Homo Sapiens
uggcauagaucuaucuuuacagucuggaguuaauuccuguuaacucauuuuauccauuccuuac

SEQ ID NO: 368141 - RNA, 64 nt, Homo Sapiens
aacucauuuuauccauuccuuacauaaucuucuuuccuguuaguccaguuugauggugugaaug

SEQ ID NO: 368142 - RNA, 64 nt, Homo Sapiens
aguugagacaggguuucacugucccuuaagaccauccuguuagccaagauggucuugaucuccu

SEQ ID NO: 368143 - RNA, 64 nt, Homo Sapiens
uuaaagacagauauaucucauggcaaauuugguauccuguuacagccuuggcucuuaaacaacu

SEQ ID NO: 368144 - RNA, 64 nt, Homo Sapiens
guggcuaaaccagcauuucuguguuugagagauuuccuguuaggugcuucgucugaaagugaac

SEQ ID NO: 368145 - RNA, 64 nt, Homo Sapiens
ucuaagagcuugguguagggcaauuggaauaauguccuguuagauaaacagacauuuagcaauc

SEQ ID NO: 368146 - RNA, 64 nt, Homo Sapiens
cuuccaagaaguaugcuaaagcuuuucauuugguuccuguuaaaguuguucucacugaccagca

SEQ ID NO: 368147 - RNA, 64 nt, Homo Sapiens
aucaaacauuccucucauguuauguauauuuuguuccuguuauauuggcuuuauuuucaaaauu

SEQ ID NO: 368148 - RNA, 64 nt, Homo Sapiens
uuacaaacacaacugcauucauaaaugggaauagaacgugaaagccagcucuuucagaauaucc

SEQ ID NO: 368149 - RNA, 64 nt, Homo Sapiens
uugcacagaaacuugugugggugcuuuaguaaaaaacgugaauggagcagcucccuugucuguu

SEQ ID NO: 368150 - RNA, 64 nt, Homo Sapiens
auuucagagaaucaguguaguuaaggagccuaauaacgugaaacuuauaguuaauauuuuguuc

SEQ ID NO: 368151 - RNA, 64 nt, Homo Sapiens
ucuauugaaaacagugucuuagaaccaaaccgcaaacgugaaaugcaguucaugucugaaacag

SEQ ID NO: 368152 - RNA, 64 nt, Homo Sapiens
aauuaugaagcauacuaauguaaagaguauaucuaacgugaauauauguaauauuugauaucua

SEQ ID NO: 368153 - RNA, 64 nt, Homo Sapiens
cucucaggggucuaggaggggguuuauugcuggcaacgugaauuugccccacugaggugcuguu

SEQ ID NO: 368154 - RNA, 64 nt, Homo Sapiens
auauuugacacacacauucaguguauauguuauaaacgugaaauuaaagauuguaugcauauau

SEQ ID NO: 368155 - RNA, 64 nt, Homo Sapiens
cuuguugugaaagacacagauacccaguaugcuuaacgugaaaagaaaauguguucuguuuugu

SEQ ID NO: 368156 - RNA, 64 nt, Homo Sapiens
uucuuuuuguguggggucaugggcuccaaaagccaacgugaacaauuaaaaauguauugagcau

SEQ ID NO: 368157 - RNA, 64 nt, Homo Sapiens
uuuccuuuuccauuuucaauuaucagagguggacaacgugaagacuccaguuaagacaggaucu

SEQ ID NO: 368158 - RNA, 64 nt, Homo Sapiens
gaaaugauggggaggaaaaacugucuccaaaggcaacgugaaaacgagcugccuacaaauuacu

SEQ ID NO: 368159 - RNA, 64 nt, Homo Sapiens
uauguugauggcagugagaguaaucaugucuuuaaacgugaaguuuuuuuuucuuuaguuuugc

SEQ ID NO: 368160 - RNA, 64 nt, Homo Sapiens
uaaaacaugaaugaaaccucuguggcucuuucgaaacgugaaaaugugaagaaagcuacuaacu

SEQ ID NO: 368161 - RNA, 64 nt, Homo Sapiens
ugguaaagaguuaguuugaguuacuaucaugucaaacgugaaaaugcuguauuagucacagaga

SEQ ID NO: 368162 - RNA, 64 nt, Homo Sapiens
uuugauucugcagcugaaauuuaggacaguugcaaacgugaaaagaagaaaauuauucaaauuu

SEQ ID NO: 368163 - RNA, 64 nt, Homo Sapiens
gugcgcuaaacggggaaacccaaagccuucagcgaacgugaaaugcucuguuucccccucuccc

SEQ ID NO: 368164 - RNA, 64 nt, Homo Sapiens
agguuuacaauuuagcuuacauuuuucgacugugaacgugaauaggcugcuuuuugcuuucuuc

SEQ ID NO: 368165 - RNA, 64 nt, Homo Sapiens
ucuuauacuccugguuugauuugauuagcauauuaacgugaaaguaggauagcuacuaaauaua

SEQ ID NO: 368166 - RNA, 64 nt, Homo Sapiens
aggcauauagagauguugucauaacuaggucuucaacgugaaaauuaauuuuuauuguaucaug

SEQ ID NO: 368167 - RNA, 64 nt, Homo Sapiens
acaaaggacuauuuaaaaauacaguuuauuaacaaacgugaacuacuuucuguuacauuaggug

SEQ ID NO: 368168 - RNA, 64 nt, Homo Sapiens
aagaauguuuguuuauauauauuuuuuuuuaaucaacgugaaugcacagggaaauggaucauug

SEQ ID NO: 368169 - RNA, 64 nt, Homo Sapiens
auuggguuuucaggcccucuagggguugauuugaaacgugaagggucccaggcagcaccaggcc

SEQ ID NO: 368170 - RNA, 64 nt, Homo Sapiens
aagauuuccuuuggcaauauucacaugccuucuaaacgugaacucaacauuagaauauuguaac

SEQ ID NO: 368171 - RNA, 64 nt, Homo Sapiens
gggguuuuccguuuguuaauauuaagcacaucagaacgugaauugccaaagucuucauuagaag

SEQ ID NO: 368172 - RNA, 64 nt, Homo Sapiens
uuuauacaguagccucuucauguuaccacguuauaacgugaauaauaugcuauggagcuauuuu

SEQ ID NO: 368173 - RNA, 64 nt, Homo Sapiens
ccauuaacuggaauaauugaaaguuaaacuauuuaacgugaaaucucuucagaaagcccauuga

SEQ ID NO: 368174 - RNA, 64 nt, Homo Sapiens
cacaggcggauuaaagugaauuccucuuaccuuuaacgugaacuuuugaauugcagggcuguga

SEQ ID NO: 368175 - RNA, 64 nt, Homo Sapiens
gcuguuugguuugaaccgugugaggcagcucuggaacgugaagaccugugaucugugcuagcug

SEQ ID NO: 368176 - RNA, 64 nt, Homo Sapiens
cugagaguuagaucugguuuuuuuuuuuuuaauaaacgugaaaacauguacccauugcuaguuu

SEQ ID NO: 368177 - RNA, 64 nt, Homo Sapiens
auuucucauugaaaugcuuuggagagaacuugguaacgugaagucugaauguugccauauuaaa

SEQ ID NO: 368178 - RNA, 64 nt, Homo Sapiens
guuuggucuuuucuagaaauucuguuauguccugaacgugaaauucugucaacacucucaauga

SEQ ID NO: 368179 - RNA, 64 nt, Homo Sapiens
caguggaaggcagaggguuugugccagagcugcgaacgugaacaaaaaagugccagaugcccca

SEQ ID NO: 368180 - RNA, 64 nt, Homo Sapiens
uuguuaucuuuguaaaaugauuaagacauuuaaaaacgugaaauaacauuacaacuauguuguu

SEQ ID NO: 368181 - RNA, 64 nt, Homo Sapiens
aguauguaaaugucacgagaucauuuuuacauuaaacgugaaaaaaaaucaacuuugccggauc

SEQ ID NO: 368182 - RNA, 64 nt, Homo Sapiens
ucuucacaaaguugucuuuucacuguguuuugucaacgugaaauuaaauuguaguuauaagcaa

SEQ ID NO: 368183 - RNA, 64 nt, Homo Sapiens
gcuguggcaucaggguagggacuaggguuuaggaaacgugaaaggcagauggagaucagagguu

SEQ ID NO: 368184 - RNA, 64 nt, Homo Sapiens
ugcugacuauauccuggaagauggaacugaagugaacgugaauaaagcugaaauccaucuguga

SEQ ID NO: 368185 - RNA, 64 nt, Homo Sapiens
gccacaaaaauagagaaaauauccucuugagagaaacgugaaacauccaccaccaaaauuauua

SEQ ID NO: 368186 - RNA, 64 nt, Homo Sapiens
acaucacagagagacagugcggaagaaccaaaauaacgugaagagugggggcuuuggcagcuau

SEQ ID NO: 368187 - RNA, 64 nt, Homo Sapiens
uaaagcaucagugaaauuauggaaaauuacuuaaaacgugaauacaucaucacaguagaauuua

SEQ ID NO: 368188 - RNA, 64 nt, Homo Sapiens
caguagcugaaccugucugagacagcugggcuggaacgugaacuaaauccaguuuucaaucuuc

SEQ ID NO: 368189 - RNA, 64 nt, Homo Sapiens
cuuugaagaguucaaguucuguacagguuuuuaaaacgugaaguaauguuugaacuggaagaug

SEQ ID NO: 368190 - RNA, 64 nt, Homo Sapiens
aaggaccagccccuugaccgacgaggcagaccacaacgugaaagcugcuagcccagaccugugg

SEQ ID NO: 368191 - RNA, 64 nt, Homo Sapiens
aaugacccuaucuuuguaacaaauuaaauaauauaacgugaauagaacuguauuuuugccuuua

SEQ ID NO: 368192 - RNA, 64 nt, Homo Sapiens
aacuuagaaagggaaggaaauuuuagaaaaggaaaacgugaacaagucuaguuuccugguuccg

SEQ ID NO: 368193 - RNA, 64 nt, Homo Sapiens
uuuuagguuuucacucaaucuuuccugucacaguaacgugaaaacugauuauucuuuacuccaa

SEQ ID NO: 368194 - RNA, 64 nt, Homo Sapiens
gugcagaauccuugcugggguuucuacaguccccaacgugaacaguauuaagcaagagguggac

SEQ ID NO: 368195 - RNA, 64 nt, Homo Sapiens
gaguaaguuuguauccugcguuggucucagaaagaacgugaaugcuuaagauuuugaaaguaca

SEQ ID NO: 368196 - RNA, 64 nt, Homo Sapiens
gacgcagaaggugaaggugcucacgggcacggguaacgugaacauuauucagccuaacuauccu

SEQ ID NO: 368197 - RNA, 64 nt, Homo Sapiens
gagucuccaaggucuccauguacuuaggugucuuaacgugaauuauauuuaccuggaggacucg

SEQ ID NO: 368198 - RNA, 64 nt, Homo Sapiens
aaagcuacugcccccuagugucuuccuggaugccaacgugaagggccuuccggccccagaagga

SEQ ID NO: 368199 - RNA, 64 nt, Homo Sapiens
aauugcauuugauaacugcucuucaguagaaugaaacgugaagaccauugucgucauugguugg

SEQ ID NO: 368200 - RNA, 64 nt, Homo Sapiens
ugggugaauucugcagguuuuaugggcuugucacaacgugaagggcuggaauguauauuaccaa

SEQ ID NO: 368201 - RNA, 64 nt, Homo Sapiens
uaaaguggaagagaauaacacuuugcaugcuauaaacgugaaaacuaacauuuuuggccagaca

SEQ ID NO: 368202 - RNA, 64 nt, Homo Sapiens
gucaguauuguuauuggcuuuucguauuccucuuaacgugaaccgucuguucauuguuuuuacc

SEQ ID NO: 368203 - RNA, 64 nt, Homo Sapiens
uccuccaaggcauccucuaccuagcuaggucaccaacgugaagaaguuaugccacugccacuuu

SEQ ID NO: 368204 - RNA, 64 nt, Homo Sapiens
uugguagacugugccaccacggcguguguugugaaacgugaaauaaaaagagcaagaaagaaaa

SEQ ID NO: 368205 - RNA, 64 nt, Homo Sapiens
guacauucaucauccacccagcaucuuuaggggaaacgugaaugcaaccagcccaucaucuaca

SEQ ID NO: 368206 - RNA, 56 nt, Homo Sapiens
ucaaacaagaacacaacaagcaucuuaacgugaagauggauaaaaaagcucaauag

SEQ ID NO: 368207 - RNA, 64 nt, Homo Sapiens
uuccuaacauucuauuuuaugcccuugcguauuaaacgugaaaguacucccacuuuucuauauu

SEQ ID NO: 368208 - RNA, 64 nt, Homo Sapiens
caagggcucccagggcaaaccuaauuccccccaaaacgugaagucggggaagcugcggcuacac

SEQ ID NO: 368209 - RNA, 64 nt, Homo Sapiens
ggauaaaacauuaaaaacucaacaauuuuuuucuaacgugaaaaugaauuuauggugcuauuua

SEQ ID NO: 368210 - RNA, 64 nt, Homo Sapiens
gugccauuuuuagaauaacuuuucauuuuauaccaacgugaaaaaaaauuucaucuuaaagcac

SEQ ID NO: 368211 - RNA, 64 nt, Homo Sapiens
guguagugccauugggaccagcugucugugauugaacgugaaauggagccucuguuuuggaagg

SEQ ID NO: 368212 - RNA, 64 nt, Homo Sapiens
gggcacgagacauccacuugccaucuccagcuggaacgugaagacuaugacaacagggagaacc

SEQ ID NO: 368213 - RNA, 64 nt, Homo Sapiens
gaauuagaaggccuguaagaguaagguuugcuaaaacgugaaacacuguaacacuuuuaaccac

SEQ ID NO: 368214 - RNA, 64 nt, Homo Sapiens
gacuagcccaacuaugagaaauagcuguucugugaacgugaaaaggggacagcaguuuucccag

SEQ ID NO: 368215 - RNA, 64 nt, Homo Sapiens
ggccaucucacauuuuacaaauccccagcucaugaacgugaagcugauaggaaaucaccccagg

SEQ ID NO: 368216 - RNA, 64 nt, Homo Sapiens
gcugugauguuucugcccugcuuucgugguuccuaacgugaaguacgugugucagguucccacu

SEQ ID NO: 368217 - RNA, 64 nt, Homo Sapiens
uuccugcaaaguauuauuguguccuauggcagaaaacgugaacauuuugagacccuuugcucca

SEQ ID NO: 368218 - RNA, 64 nt, Homo Sapiens
ugccucaacucauagaagaugaacccuucaagaaaacgugaaguagaacgggugggccagaaau

SEQ ID NO: 368219 - RNA, 64 nt, Homo Sapiens
cagaccuccaaagggcaacagaagaguauuaauaaacgugaaaacuuaccuccaggcuguucug

SEQ ID NO: 368220 - RNA, 64 nt, Homo Sapiens
uucuccuaguacaaccaaacagauaaccagaugcaacgugaagaucuagacuggacccugguuu

SEQ ID NO: 368221 - RNA, 64 nt, Homo Sapiens
ugaugauaugcuuuugugagcaagcaaaagcagaaacgugaagccgugauacaaauuggugaac

SEQ ID NO: 368222 - RNA, 64 nt, Homo Sapiens
acacaaauaugcaaaugugaaauaaccgaucuauaacgugaaggaggcagacaugagcuguacu

SEQ ID NO: 368223 - RNA, 64 nt, Homo Sapiens
cuaguaguccccagcucccaaacacugaaaggaaaacgugaaaacacucaaggccuagggggag

SEQ ID NO: 368224 - RNA, 64 nt, Homo Sapiens
ugugauauaagguuuucuuucaguggcuuacaugaacgugaaacaaagauucauucauguugca

SEQ ID NO: 368225 - RNA, 64 nt, Homo Sapiens
ggaggcaguugugacaauccccagugcuucugugaacgugaauuuuguucaguuguccacagga

SEQ ID NO: 368226 - RNA, 64 nt, Homo Sapiens
cuguaauucuauguguuacuccgucugggacuaaaacgugaacucagucucgagccucagucuc

SEQ ID NO: 368227 - RNA, 64 nt, Homo Sapiens
aaaucacauaggagauaagcuauuucauuucagaaacgugaaagggaaaagcauucauuaauuu

SEQ ID NO: 368228 - RNA, 64 nt, Homo Sapiens
augugacaaaggcuucaaccagagaaacacuacaaacgugaagacauaagaaaauucaugcugg

SEQ ID NO: 368229 - RNA, 64 nt, Homo Sapiens
augugacaaaguuuucauucauagaaaucuuacaaacgugaacacaucauagacuucauacugc

SEQ ID NO: 368230 - RNA, 64 nt, Homo Sapiens
uguaauguuauaugcugcaaacauuuacuauguaaacgugaaguagccaauaauaucucaauag

SEQ ID NO: 368231 - RNA, 64 nt, Homo Sapiens
cugucucauguuacagagcuuccauuacauauuaaacgugaaaucuaugacuccuguaccuuac

SEQ ID NO: 368232 - RNA, 64 nt, Homo Sapiens
gcuugagagaagggauauuuuaaaugagaucauuaacgugaaacuauuacuaguauauguuuuu

SEQ ID NO: 368233 - RNA, 64 nt, Homo Sapiens
aacgcaaauggcuuccucuugagaaaggcucagcaacgugaaaucuucagauuguucaacauga

SEQ ID NO: 368234 - RNA, 64 nt, Homo Sapiens
uacugguacuugauagccucuguaacagcugaccaacgugaagauugugaacuggugggccgua

SEQ ID NO: 368235 - RNA, 64 nt, Homo Sapiens
agaaaugaaugcagaaggaagauuuucaguccugaacgugaauuauagagguagaacgucgcua

SEQ ID NO: 368236 - RNA, 64 nt, Homo Sapiens
gagcugaggacucucacgauaugcaaguucauccaacgugaagauaccauaagcuuuuucucug

SEQ ID NO: 368237 - RNA, 64 nt, Homo Sapiens
ucuuugcaaugccaacauaagggagaucuuggccaacgugaaauaaaauuacucauucaaaacu

SEQ ID NO: 368238 - RNA, 64 nt, Homo Sapiens
ccuguuuugaaugccaaacccagcuguccacugaaacgugaaguugcugcugcaacccuuuccc

SEQ ID NO: 368239 - RNA, 64 nt, Homo Sapiens
ugacauguacuauaaaagucaccuaggauugggaauuugggacaauuuuguaacuugauaucuu

SEQ ID NO: 368240 - RNA, 64 nt, Homo Sapiens
auuuacuuggaaauccuaagcuuuguaauacuugauuugggagcaguugcuaauuaauuagcag

SEQ ID NO: 368241 - RNA, 64 nt, Homo Sapiens
aggaaaagaguugggaaaaucaaaacguuggacuauuugggaaacugccucauauauuucuccu

SEQ ID NO: 368242 - RNA, 64 nt, Homo Sapiens
acagauccauccagaugguguuuacauuugauuuauuugggaucuuauugacaucagguauacu

SEQ ID NO: 368243 - RNA, 64 nt, Homo Sapiens
ugaacaccggaaagucauuacucagugauuuguaauuugggacuuggauuauuuaucuagagau

SEQ ID NO: 368244 - RNA, 64 nt, Homo Sapiens
auuguuuagguuauaugggacccagucuacuauuauuugggaaaaccuuaauguguauagagac

SEQ ID NO: 368245 - RNA, 64 nt, Homo Sapiens
cagaucuauucuaacucauuuuauugugugcuaaauuugggaaacuuucucuaauccacugaaa

SEQ ID NO: 368246 - RNA, 64 nt, Homo Sapiens
aguauaauuuguggagaaauacauuauuuaaaauauuugggaguugcagauuacugaauauaau

SEQ ID NO: 368247 - RNA, 64 nt, Homo Sapiens
uuguguagggaucauggcccaagcacaugguuacauuugggaacuaagcaggaagauagacgug

SEQ ID NO: 368248 - RNA, 64 nt, Homo Sapiens
aauaggggcacgugagauaaucuccuugucacuuauuugggagaucccucagugauccuuuuac

SEQ ID NO: 368249 - RNA, 64 nt, Homo Sapiens
uuauacuucaguaugguuucuuguuuucuuuccaauuugggaaucaugagacuaccaaguuugu

SEQ ID NO: 368250 - RNA, 64 nt, Homo Sapiens
auuugacuuccuugggacucauguaaagggcuacauuugggaacggcaggcuucccuggugccg

SEQ ID NO: 368251 - RNA, 64 nt, Homo Sapiens
caugggcauaaucagguaguagaaaaaucaagguauuugggaaagcagaugaaaugucaauaua

SEQ ID NO: 368252 - RNA, 64 nt, Homo Sapiens
ccuucccggugccagguccagauuucccuccaugauuugggaaccagcuuaggcaaaagagucc

SEQ ID NO: 368253 - RNA, 64 nt, Homo Sapiens
uuauaauaacucuguacuuugguuucagggugacauuugggaaggauuuuguuuagaauuaaug

SEQ ID NO: 368254 - RNA, 64 nt, Homo Sapiens
uuaaguauaaugcugaucugacaauugacguguaauuugggaagucauuuugauaauuuugcuu

SEQ ID NO: 368255 - RNA, 64 nt, Homo Sapiens
ggauaagggccuccccaguccucuccgggagaugauuugggaaauuuuauaaugcuuguucugu

SEQ ID NO: 368256 - RNA, 64 nt, Homo Sapiens
acuuuuaguaaauucagcuuaaauauaaguugaaauuugggaaauaauuuccaagcucuuggaa

SEQ ID NO: 368257 - RNA, 64 nt, Homo Sapiens
uuuuuuuuuucauggaaaaacucaaaccucuguuauuugggagcucaguauuguguggacacuu

SEQ ID NO: 368258 - RNA, 64 nt, Homo Sapiens
uuaauaccaaguauucauuuuacauuuucuugaaauuugggaggauauacaucuguaguuauuc

SEQ ID NO: 368259 - RNA, 64 nt, Homo Sapiens; identical to SEQ ID NO: 368258

SEQ ID NO: 368260 - RNA, 64 nt, Homo Sapiens
cuguguguaauggucuugaggaaaagggcuacagauuugggaagacagcuuucaugagguuaca

SEQ ID NO: 368261 - RNA, 64 nt, Homo Sapiens
gcagaugggucaugcuuuugcugguccacauggcauuugggaaaucccuggcucaccaaugcgu

SEQ ID NO: 368262 - RNA, 64 nt, Homo Sapiens
uaccacaaaccaggugcuaugaaagcuaccauugauuugggaggaaauacuuguguucauuugg

SEQ ID NO: 368263 - RNA, 64 nt, Homo Sapiens
gcuaccauugauuugggaggaaauacuuguguucauuugggaaagaacaaacaugaggagccuc

SEQ ID NO: 368264 - RNA, 64 nt, Homo Sapiens
uucgaugaaaaagcguucagagugcucugcuuuuauuugggaauauuucuauuuagcaaaaaug

SEQ ID NO: 368265 - RNA, 64 nt, Homo Sapiens
cuuagcuugcaagcuuguggauuccaaagccuuuauuugggaguaacagccuucuagcuaaaaa

SEQ ID NO: 368266 - RNA, 64 nt, Homo Sapiens; identical to SEQ ID NO: 225502

SEQ ID NO: 368267 - RNA, 64 nt, Homo Sapiens; identical to SEQ ID NO: 225503

SEQ ID NO: 368268 - RNA, 64 nt, Homo Sapiens; identical to SEQ ID NO: 225504

SEQ ID NO: 368269 - RNA, 64 nt, Homo Sapiens; identical to SEQ ID NO: 225505

SEQ ID NO: 368270 - RNA, 64 nt, Homo Sapiens; identical to SEQ ID NO: 225506

SEQ ID NO: 368271 - RNA, 64 nt, Homo Sapiens; identical to SEQ ID NO: 225507

SEQ ID NO: 368272 - RNA, 64 nt, Homo Sapiens; identical to SEQ ID NO: 225508

SEQ ID NO: 368273 - RNA, 64 nt, Homo Sapiens; identical to SEQ ID NO: 225509

SEQ ID NO: 368274 - RNA, 64 nt, Homo Sapiens; identical to SEQ ID NO: 225510

SEQ ID NO: 368275 - RNA, 64 nt, Homo Sapiens; identical to SEQ ID NO: 225511

SEQ ID NO: 368276 - RNA, 64 nt, Homo Sapiens; identical to SEQ ID NO: 225512

SEQ ID NO: 368277 - RNA, 64 nt, Homo Sapiens; identical to SEQ ID NO: 153628

SEQ ID NO: 368278 - RNA, 64 nt, Homo Sapiens; identical to SEQ ID NO: 153629

SEQ ID NO: 368279 - RNA, 64 nt, Homo Sapiens; identical to SEQ ID NO: 153630

SEQ ID NO: 368280 - RNA, 64 nt, Homo Sapiens; identical to SEQ ID NO: 153631

SEQ ID NO: 368281 - RNA, 64 nt, Homo Sapiens; identical to SEQ ID NO: 153632

SEQ ID NO: 368282 - RNA, 64 nt, Homo Sapiens; identical to SEQ ID NO: 153633

SEQ ID NO: 368283 - RNA, 64 nt, Homo Sapiens; identical to SEQ ID NO: 153634

SEQ ID NO: 368284 - RNA, 64 nt, Homo Sapiens; identical to SEQ ID NO: 153635

SEQ ID NO: 368285 - RNA, 64 nt, Homo Sapiens; identical to SEQ ID NO: 153636

SEQ ID NO: 368286 - RNA, 64 nt, Homo Sapiens; identical to SEQ ID NO: 153637

SEQ ID NO: 368287 - RNA, 64 nt, Homo Sapiens
accgaccccaagcucaucacagcgacgacgccaccgcgcuuauggggaggcccugccagcuccc

SEQ ID NO: 368288 - RNA, 64 nt, Homo Sapiens
cugggcccucgcacccuugggugcucccggccgccgcgcuuaagaacauugccucuggguguca

SEQ ID NO: 368289 - RNA, 64 nt, Homo Sapiens
uuuucuuccccuuccucucucccccaccagggggcgcgcuuaaauuuccagacagagaccagaa

SEQ ID NO: 368290 - RNA, 64 nt, Homo Sapiens
accuggcuagaacacaagguggcaacaguacagucgcgcuuacgagggggagcugggguugcag

SEQ ID NO: 368291 - RNA, 64 nt, Homo Sapiens; identical to SEQ ID NO: 58517

SEQ ID NO: 368292 - RNA, 64 nt, Homo Sapiens; identical to SEQ ID NO: 58518

SEQ ID NO: 368293 - RNA, 64 nt, Homo Sapiens; identical to SEQ ID NO: 58519

SEQ ID NO: 368294 - RNA, 64 nt, Homo Sapiens; identical to SEQ ID NO: 58520

SEQ ID NO: 368295 - RNA, 64 nt, Homo Sapiens; identical to SEQ ID NO: 58521

SEQ ID NO: 368296 - RNA, 64 nt, Homo Sapiens; identical to SEQ ID NO: 58522

SEQ ID NO: 368297 - RNA, 64 nt, Homo Sapiens; identical to SEQ ID NO: 58523

SEQ ID NO: 368298 - RNA, 64 nt, Homo Sapiens; identical to SEQ ID NO: 58524

SEQ ID NO: 368299 - RNA, 64 nt, Homo Sapiens; identical to SEQ ID NO: 58525

SEQ ID NO: 368300 - RNA, 64 nt, Homo Sapiens; identical to SEQ ID NO: 58526

SEQ ID NO: 368301 - RNA, 64 nt, Homo Sapiens; identical to SEQ ID NO: 58527

SEQ ID NO: 368302 - RNA, 64 nt, Homo Sapiens; identical to SEQ ID NO: 58528

SEQ ID NO: 368303 - RNA, 64 nt, Homo Sapiens; identical to SEQ ID NO: 58529

SEQ ID NO: 368304 - RNA, 64 nt, Homo Sapiens; identical to SEQ ID NO: 58530

SEQ ID NO: 368305 - RNA, 64 nt, Homo Sapiens; identical to SEQ ID NO: 58531

SEQ ID NO: 368306 - RNA, 64 nt, Homo Sapiens; identical to SEQ ID NO: 58532

SEQ ID NO: 368307 - RNA, 64 nt, Homo Sapiens; identical to SEQ ID NO: 147948

SEQ ID NO: 368308 - RNA, 64 nt, Homo Sapiens; identical to SEQ ID NO: 147949

SEQ ID NO: 368309 - RNA, 64 nt, Homo Sapiens; identical to SEQ ID NO: 147950

SEQ ID NO: 368310 - RNA, 64 nt, Homo Sapiens; identical to SEQ ID NO: 147951

SEQ ID NO: 368311 - RNA, 64 nt, Homo Sapiens; identical to SEQ ID NO: 147952

SEQ ID NO: 368312 - RNA, 64 nt, Homo Sapiens; identical to SEQ ID NO: 147953

SEQ ID NO: 368313 - RNA, 64 nt, Homo Sapiens; identical to SEQ ID NO: 147954

SEQ ID NO: 368314 - RNA, 64 nt, Homo Sapiens; identical to SEQ ID NO: 147955

SEQ ID NO: 368315 - RNA, 64 nt, Homo Sapiens; identical to SEQ ID NO: 147956

SEQ ID NO: 368316 - RNA, 64 nt, Homo Sapiens; identical to SEQ ID NO: 147957

SEQ ID NO: 368317 - RNA, 64 nt, Homo Sapiens; identical to SEQ ID NO: 147958

SEQ ID NO: 368318 - RNA, 64 nt, Homo Sapiens; identical to SEQ ID NO: 147959

SEQ ID NO: 368319 - RNA, 64 nt, Homo Sapiens; identical to SEQ ID NO: 93643

SEQ ID NO: 368320 - RNA, 64 nt, Homo Sapiens; identical to SEQ ID NO: 93644

SEQ ID NO: 368321 - RNA, 64 nt, Homo Sapiens; identical to SEQ ID NO: 93645

SEQ ID NO: 368322 - RNA, 64 nt, Homo Sapiens; identical to SEQ ID NO: 93646

SEQ ID NO: 368323 - RNA, 64 nt, Homo Sapiens; identical to SEQ ID NO: 93647

SEQ ID NO: 368324 - RNA, 64 nt, Homo Sapiens; identical to SEQ ID NO: 93648

SEQ ID NO: 368325 - RNA, 64 nt, Homo Sapiens; identical to SEQ ID NO: 93649

SEQ ID NO: 368326 - RNA, 64 nt, Homo Sapiens; identical to SEQ ID NO: 93650

SEQ ID NO: 368327 - RNA, 64 nt, Homo Sapiens; identical to SEQ ID NO: 93651

SEQ ID NO: 368328 - RNA, 64 nt, Homo Sapiens; identical to SEQ ID NO: 93652

SEQ ID NO: 368329 - RNA, 64 nt, Homo Sapiens; identical to SEQ ID NO: 93653

SEQ ID NO: 368330 - RNA, 64 nt, Homo Sapiens; identical to SEQ ID NO: 93654

SEQ ID NO: 368331 - RNA, 64 nt, Homo Sapiens; identical to SEQ ID NO: 93655

SEQ ID NO: 368332 - RNA, 64 nt, Homo Sapiens; identical to SEQ ID NO: 93656

SEQ ID NO: 368333 - RNA, 64 nt, Homo Sapiens; identical to SEQ ID NO: 93657

SEQ ID NO: 368334 - RNA, 64 nt, Homo Sapiens; identical to SEQ ID NO: 93658

SEQ ID NO: 368335 - RNA, 64 nt, Homo Sapiens; identical to SEQ ID NO: 93659

SEQ ID NO: 368336 - RNA, 64 nt, Homo Sapiens; identical to SEQ ID NO: 93660

SEQ ID NO: 368337 - RNA, 64 nt, Homo Sapiens; identical to SEQ ID NO: 93661

SEQ ID NO: 368338 - RNA, 64 nt, Homo Sapiens; identical to SEQ ID NO: 93662

SEQ ID NO: 368339 - RNA, 64 nt, Homo Sapiens; identical to SEQ ID NO: 93663

SEQ ID NO: 368340 - RNA, 64 nt, Homo Sapiens; identical to SEQ ID NO: 93664

SEQ ID NO: 368341 - RNA, 64 nt, Homo Sapiens; identical to SEQ ID NO: 211969

SEQ ID NO: 368342 - RNA, 64 nt, Homo Sapiens; identical to SEQ ID NO: 211970

SEQ ID NO: 368343 - RNA, 60 nt, Homo Sapiens; identical to SEQ ID NO: 211971

SEQ ID NO: 368344 - RNA, 64 nt, Homo Sapiens; identical to SEQ ID NO: 211972

SEQ ID NO: 368345 - RNA, 64 nt, Homo Sapiens; identical to SEQ ID NO: 211973

SEQ ID NO: 368346 - RNA, 64 nt, Homo Sapiens; identical to SEQ ID NO: 211974

SEQ ID NO: 368347 - RNA, 64 nt, Homo Sapiens; identical to SEQ ID NO: 211975

SEQ ID NO: 368348 - RNA, 64 nt, Homo Sapiens; identical to SEQ ID NO: 211976

SEQ ID NO: 368349 - RNA, 64 nt, Homo Sapiens; identical to SEQ ID NO: 211977

SEQ ID NO: 368350 - RNA, 64 nt, Homo Sapiens; identical to SEQ ID NO: 211978

SEQ ID NO: 368351 - RNA, 64 nt, Homo Sapiens; identical to SEQ ID NO: 211979

SEQ ID NO: 368352 - RNA, 64 nt, Homo Sapiens; identical to SEQ ID NO: 211980

SEQ ID NO: 368353 - RNA, 64 nt, Homo Sapiens; identical to SEQ ID NO: 211981

SEQ ID NO: 368354 - RNA, 64 nt, Homo Sapiens; identical to SEQ ID NO: 211982

SEQ ID NO: 368355 - RNA, 64 nt, Homo Sapiens; identical to SEQ ID NO: 211983

SEQ ID NO: 368356 - RNA, 64 nt, Homo Sapiens; identical to SEQ ID NO: 211984

SEQ ID NO: 368357 - RNA, 64 nt, Homo Sapiens; identical to SEQ ID NO: 211985

SEQ ID NO: 368358 - RNA, 64 nt, Homo Sapiens; identical to SEQ ID NO: 211986

SEQ ID NO: 368359 - RNA, 64 nt, Homo Sapiens; identical to SEQ ID NO: 211987

SEQ ID NO: 368360 - RNA, 64 nt, Homo Sapiens; identical to SEQ ID NO: 211988

SEQ ID NO: 368361 - RNA, 64 nt, Homo Sapiens; identical to SEQ ID NO: 211989

SEQ ID NO: 368362 - RNA, 64 nt, Homo Sapiens; identical to SEQ ID NO: 211990

SEQ ID NO: 368363 - RNA, 64 nt, Homo Sapiens; identical to SEQ ID NO: 211991

SEQ ID NO: 368364 - RNA, 64 nt, Homo Sapiens; identical to SEQ ID NO: 211992

SEQ ID NO: 368365 - RNA, 64 nt, Homo Sapiens; identical to SEQ ID NO: 211993

SEQ ID NO: 368366 - RNA, 64 nt, Homo Sapiens; identical to SEQ ID NO: 211994

SEQ ID NO: 368367 - RNA, 64 nt, Homo Sapiens; identical to SEQ ID NO: 211995

SEQ ID NO: 368368 - RNA, 64 nt, Homo Sapiens
cccugaccuuguccuacuucacugccuuugucuguguuacuaguggccccaguauaccugggau

SEQ ID NO: 368369 - RNA, 64 nt, Homo Sapiens
cucuuguggaggucacaaucuagcggagaaaggauguuacuagaaguacacaaauugggcccgg

SEQ ID NO: 368370 - RNA, 64 nt, Homo Sapiens
agagcauagggaaagguccacuucuaguuuugucuguuacuaaggguagaagauuauugcuuuu

SEQ ID NO: 368371 - RNA, 64 nt, Homo Sapiens
ccaauccaaguuugcacucuucuggccugccccauguuacuaugugauggaaccagcacaccuc

SEQ ID NO: 368372 - RNA, 64 nt, Homo Sapiens
uagcgacauugugcugaauuacuucauaacccaauguuacuagucucguuugaugaaaaaaccg

SEQ ID NO: 368373 - RNA, 64 nt, Homo Sapiens
ugagcaauuuaaaaagguguauauauauucuagcuguuacuagauuuuaaauuuugaauuggca

SEQ ID NO: 368374 - RNA, 64 nt, Homo Sapiens
ucaacaguuggaauuaguuggugaagccuuuacuuguuacuacuuauucaucaaggaaagccug

SEQ ID NO: 368375 - RNA, 64 nt, Homo Sapiens
auccaugacauucaguggccuuaagcuuuucauuuguuacuaauuaguucaaucugccauagac

SEQ ID NO: 368376 - RNA, 64 nt, Homo Sapiens
gaucaaaccgguucuguucuuucuuguguugccauguuacuaugccucaagcccaguuugcuuu

SEQ ID NO: 368377 - RNA, 64 nt, Homo Sapiens
gcucuguguauacacagcuucacacccaccagauuguuacuacaguggguuggguuuucauaca

SEQ ID NO: 368378 - RNA, 64 nt, Homo Sapiens
auaucgauagacuaugaaugaaccuaaaacaagauguuacuauucuuccuaauaggaauucauu

SEQ ID NO: 368379 - RNA, 64 nt, Homo Sapiens
cugcuguaaguuauuuauuaacuuuuuugagguguguuacuauauaggaauuagugaaaaaaga

SEQ ID NO: 368380 - RNA, 64 nt, Homo Sapiens
aauaaaagaacacuuuuggaauuuauacaauauauguuacuagaaagugcauauaaaauagagu

SEQ ID NO: 368381 - RNA, 64 nt, Homo Sapiens
aauuacauguacuuuauaaguauauaguaaaauauguuacuauaaauaugauuuuuuccauaug

SEQ ID NO: 368382 - RNA, 64 nt, Homo Sapiens
uugcuuauuuuaccuuuuucaauuuagagggauuuguuacuagucgaucaauuagaaugaaccu

SEQ ID NO: 368383 - RNA, 64 nt, Homo Sapiens
acugaaaauaaccacuuguaaacauuccuaugauuguuacuaaaauguauuuucauguuuaaaa

SEQ ID NO: 368384 - RNA, 64 nt, Homo Sapiens
agacuugggggagugaaggcagagccuggugcagauggacgaggucugcagacggagggcagag

SEQ ID NO: 368385 - RNA, 64 nt, Homo Sapiens
ggccaccaagccgcaccugugccugagacuccggauggacgacacagucgucacgucgcucuuc

SEQ ID NO: 368386 - RNA, 64 nt, Homo Sapiens
guacaguuagaaaugauacuuccuuuguugucacauggacgauacaaaagccagcaauaauucu

SEQ ID NO: 368387 - RNA, 64 nt, Homo Sapiens
ccacccucugcugcacaguaguguuggguggaggauggacgagugagcuaccaggaagaggggc

SEQ ID NO: 368388 - RNA, 64 nt, Homo Sapiens
aaccaagccuuggguagcaucaguuaacaguuuuauggacgauuccucagaugaaaagcuucag

SEQ ID NO: 368389 - RNA, 64 nt, Homo Sapiens
ugccuaaaaaugugccaggccccagacauaauuuauggacgaaaaccuggccacuguuuaggca

SEQ ID NO: 368390 - RNA, 64 nt, Homo Sapiens
ugaacauaggguggcuggcauuuuuggccaucagauggacgaucacugagcccaggucuggacu

SEQ ID NO: 368391 - RNA, 64 nt, Homo Sapiens
ccugggaggagggcagaaggcuggagcugaaggaauggacgagcauggacguguggaggaggcg

SEQ ID NO: 368392 - RNA, 64 nt, Homo Sapiens
ugucuacugcauugggcagcggcgcuuccacaccauggacgagcugguggaacacuacaaaaag

SEQ ID NO: 368393 - RNA, 64 nt, Homo Sapiens
aaaaagaacuguuccagaaucuuuuuuuucccuaauggacgaaggaacaacacacacacaaaaa

SEQ ID NO: 368394 - RNA, 64 nt, Homo Sapiens
auggguuugagaaggaccccgcacagacucacauauggacgaggcaccauccaggaagacccca

SEQ ID NO: 368395 - RNA, 64 nt, Homo Sapiens
cuauauagagugaauauagaaugcaaugucuaaaauggacgaauuauugucugacugcauugaa

SEQ ID NO: 368396 - RNA, 64 nt, Homo Sapiens
ugcugccacuucucaucuacaguacaagcugcccauggacgaccgucgaggguauugggccggg

SEQ ID NO: 368397 - RNA, 64 nt, Homo Sapiens
gcucuccaagggaaugccugacagagggucucagauggacgagggacaugugaagagaagcaag

SEQ ID NO: 368398 - RNA, 64 nt, Homo Sapiens
uauuugcacaguacugcaugauuuaaggauuccaauggacgaccagaccaagccuuugcccaga

SEQ ID NO: 368399 - RNA, 64 nt, Homo Sapiens
cucaguccacucuaaagaagcaucggcguuuuggauggacgaaugcugcuucaugcgacuccau

SEQ ID NO: 368400 - RNA, 64 nt, Homo Sapiens
uuccuuuuucccuuauaucuuccuuuuggucuucauggacgagaugaaugaggauucugcugcc

SEQ ID NO: 368401 - RNA, 64 nt, Homo Sapiens
cacuguucaguuucauauaucugcaaugacuguaauggacgaucuuaaucucuuuucagauucu

SEQ ID NO: 368402 - RNA, 64 nt, Homo Sapiens
caacaaauaugucaagaacaacagagugaacuuaauggacgaaguuucagaagaaaggcauugc

SEQ ID NO: 368403 - RNA, 64 nt, Homo Sapiens
ugggaaggcacagggagaagcaagaccuaggcucauggacgagacagccuccaacacaaggcuc

SEQ ID NO: 368404 - RNA, 64 nt, Homo Sapiens
ccggcauggcuccagguggccuggugacuccaugauggacgaucuugcucccaggaccugccuc

SEQ ID NO: 368405 - RNA, 64 nt, Homo Sapiens
ucuugagcaaaaggaggggagaguuggagaaggaauggacgaauggcgggggugguggugaaga

SEQ ID NO: 368406 - RNA, 64 nt, Homo Sapiens
ggcacaagguggaggggggagguuccuggucuuuauggacgaagcugcauacauguggccccca

SEQ ID NO: 368407 - RNA, 64 nt, Homo Sapiens
uauacugggacagcgugaaacacuggaauccuucauggacgagggcauauacaaugaugggaca

SEQ ID NO: 368408 - RNA, 64 nt, Homo Sapiens
cuuuuucaauuauacuauuauuucugagaaugaaauggacgauuacacuuagaaaaugaguaau

SEQ ID NO: 368409 - RNA, 64 nt, Homo Sapiens
guguagccgccaccgagggacagccgagggaccgauggacgaggggacaggcuggugggauggg

SEQ ID NO: 368410 - RNA, 64 nt, Homo Sapiens
guauuuuuauaccaaacauuuuaaguaugcugggauggacgaucuuacacugguuuggaucaca

SEQ ID NO: 368411 - RNA, 64 nt, Homo Sapiens
augaaugucacauuugaauuaaucugugcuggccauggacgaauuaaauggaauucguguuaug

SEQ ID NO: 368412 - RNA, 64 nt, Homo Sapiens
agcugcggaaguggaaggugccacgcuccaggccauggacgagaugugcuggcgcaggaugaag

SEQ ID NO: 368413 - RNA, 64 nt, Homo Sapiens
ccauuaacauucaucuaaaaauguuaggcucuaaauggacgaaaaauucucucgccaucuuaau

SEQ ID NO: 368414 - RNA, 64 nt, Homo Sapiens
gaacgccucgcuucugcagguuuugcucgucuucauggacgagucacuuuuguagucacuuugc

SEQ ID NO: 368415 - RNA, 64 nt, Homo Sapiens
uguuuauagucuugugugugcaguuauauuuuauauggacgaccaaauuuuuuauuaagaugag

SEQ ID NO: 368416 - RNA, 64 nt, Homo Sapiens
auugaaguauuuacaguggacucaacgcagaagaauggacgaaaugaccauccaacgugauuaa

SEQ ID NO: 368417 - RNA, 54 nt, Homo Sapiens
uggcccaaacucuuuauuaggaaaauggacgaauugaauagcaaaugguaagaa

SEQ ID NO: 368418 - RNA, 64 nt, Homo Sapiens
agcacaugagaggugggcacccggugccgaggacauggacgagggacugguggcugggagggag

SEQ ID NO: 368419 - RNA, 64 nt, Homo Sapiens
auucacguuccagaaaagagagcugccucagaugauggacgaggugggucgcauucucuguaac

SEQ ID NO: 368420 - RNA, 64 nt, Homo Sapiens
aggcagagugagucacugcacgcaccuggccuccauggacgagcaagggcaucccagaaacgug

SEQ ID NO: 368421 - RNA, 57 nt, Homo Sapiens
uauugcagucuuaccauuaaguuaacaauggacgaagagaugacgcuuugcuuuuug

SEQ ID NO: 368422 - RNA, 64 nt, Homo Sapiens
aauguuaacaggcuucaacauaguaugugugcagauggacgauggauuuaaagagcauaccuua

SEQ ID NO: 368423 - RNA, 64 nt, Homo Sapiens
gcagcccagcccucaugcccgcaguaugcacagaauggacgaguauggauaugaaaaauucaag

SEQ ID NO: 368424 - RNA, 64 nt, Homo Sapiens
acccccuccagagcaaggagcccccccaccaaggauggacgaagcugaaaaggggcugggcacc

SEQ ID NO: 368425 - RNA, 64 nt, Homo Sapiens
ccagccuuuguuccccacuggagcagaaggggagauggacgacacggucggggcaucuggccug

SEQ ID NO: 368426 - RNA, 64 nt, Homo Sapiens
auuuuucaauuuauuuuuuaaugauucuuaaggcauggacgaggaagaucacgaaggugugcaa

SEQ ID NO: 368427 - RNA, 64 nt, Homo Sapiens
caaugcauuagggaugccuccuuucccgcaggggauggacgaucucccaccuuucgggccaugu

SEQ ID NO: 368428 - RNA, 64 nt, Homo Sapiens
uccagcucucaguuacaagucucacuaugcugcuauggacgaccauacccucaucaaaaacacu

SEQ ID NO: 368429 - RNA, 64 nt, Homo Sapiens
aagaugacugaguucuagagaccccacaagcacuauggacgaagcgugggaccccagcacgggc

SEQ ID NO: 368430 - RNA, 64 nt, Homo Sapiens
agccuuauauguaauuccuucacauuugggcagcauggacgagaaggaagaauuugcaaguuug

SEQ ID NO: 368431 - RNA, 64 nt, Homo Sapiens
acgaaacaaucacggugcgauccaaaauguccgcauggacgaucuagcugacccgggugggcau

SEQ ID NO: 368432 - RNA, 64 nt, Homo Sapiens
aggggccaaacuggugggagucaaggaaaggaggauggacgaacccuggccccugaccucaaga

SEQ ID NO: 368433 - RNA, 64 nt, Homo Sapiens
acaauucgggggucagaccuaaaugcuggccuuuauggacgagcacugugugccauaauuuggc

SEQ ID NO: 368434 - RNA, 64 nt, Homo Sapiens; identical to SEQ ID NO: 199302

SEQ ID NO: 368435 - RNA, 64 nt, Homo Sapiens; identical to SEQ ID NO: 199303

SEQ ID NO: 368436 - RNA, 64 nt, Homo Sapiens; identical to SEQ ID NO: 199304

SEQ ID NO: 368437 - RNA, 64 nt, Homo Sapiens; identical to SEQ ID NO: 199305

SEQ ID NO: 368438 - RNA, 64 nt, Homo Sapiens; identical to SEQ ID NO: 199306

SEQ ID NO: 368439 - RNA, 64 nt, Homo Sapiens; identical to SEQ ID NO: 199307

SEQ ID NO: 368440 - RNA, 64 nt, Homo Sapiens; identical to SEQ ID NO: 199308

SEQ ID NO: 368441 - RNA, 64 nt, Homo Sapiens; identical to SEQ ID NO: 199309

SEQ ID NO: 368442 - RNA, 64 nt, Homo Sapiens; identical to SEQ ID NO: 199310

SEQ ID NO: 368443 - RNA, 64 nt, Homo Sapiens; identical to SEQ ID NO: 199311

SEQ ID NO: 368444 - RNA, 64 nt, Homo Sapiens
caauaccgcgauccaugagggcuccccaaaucaccacaaccaacccugcauugcucucccucgu

SEQ ID NO: 368445 - RNA, 64 nt, Homo Sapiens
ucauaacauauagcagaccacaccaauacacggacacaaccaaauguucagccugaccccgccu

SEQ ID NO: 368446 - RNA, 64 nt, Homo Sapiens
cacacaaaugggggcaaccacacaaccacacacacacaaccacacucagcuguggccaccaaca

SEQ ID NO: 368447 - RNA, 64 nt, Homo Sapiens
cacacacaaccacacacacauguggccaccaacacacaaccacaucuggugacagaggcucagc

SEQ ID NO: 368448 - RNA, 64 nt, Homo Sapiens
uggaguucucaggggggcccugugacccccucuccacaaccauggccagcaucggcuucuugcu

SEQ ID NO: 368449 - RNA, 64 nt, Homo Sapiens
agcgccagucagcaaggaagccgggugucgcucacacaaccagaaggagcugaguuuggcaaca

SEQ ID NO: 368450 - RNA, 64 nt, Homo Sapiens
cuggaguguguagccccuuucaaaacaaaaguuccacaaccagcugacgagcaaaacuccaucu

SEQ ID NO: 368451 - RNA, 64 nt, Homo Sapiens
ccgggcaugguggcucaugcuucccgugaaguuccacaaccaggcauuguaaugacaaaauaaa

SEQ ID NO: 368452 - RNA, 64 nt, Homo Sapiens
cagccacagcuauaaccagcaucacguucacaaccacaaccacgacgguccccaccacgacaca

SEQ ID NO: 368453 - RNA, 64 nt, Homo Sapiens
accacgcagccacagcuauagacacaaucacguucacaaccacaacaaccacgguccccaccac

SEQ ID NO: 368454 - RNA, 64 nt, Homo Sapiens
ucccagagccuccuaaaauucuagccauuugucacacaaccacagcaagaaacguguucuauau

SEQ ID NO: 368455 - RNA, 64 nt, Homo Sapiens
ccaagaugguagaacuagguuaggaaaaauuccacacaaccaaacagucugccuuaaaagugac

SEQ ID NO: 368456 - RNA, 64 nt, Homo Sapiens; identical to SEQ ID NO: 163640

SEQ ID NO: 368457 - RNA, 64 nt, Homo Sapiens; identical to SEQ ID NO: 163641

SEQ ID NO: 368458 - RNA, 64 nt, Homo Sapiens; identical to SEQ ID NO: 163642

SEQ ID NO: 368459 - RNA, 64 nt, Homo Sapiens; identical to SEQ ID NO: 163643

SEQ ID NO: 368460 - RNA, 64 nt, Homo Sapiens; identical to SEQ ID NO: 163644

SEQ ID NO: 368461 - RNA, 64 nt, Homo Sapiens; identical to SEQ ID NO: 163645

SEQ ID NO: 368462 - RNA, 64 nt, Homo Sapiens; identical to SEQ ID NO: 163646

SEQ ID NO: 368463 - RNA, 64 nt, Homo Sapiens; identical to SEQ ID NO: 163647

SEQ ID NO: 368464 - RNA, 64 nt, Homo Sapiens; identical to SEQ ID NO: 163648

SEQ ID NO: 368465 - RNA, 64 nt, Homo Sapiens; identical to SEQ ID NO: 163649

SEQ ID NO: 368466 - RNA, 64 nt, Homo Sapiens; identical to SEQ ID NO: 163650

SEQ ID NO: 368467 - RNA, 64 nt, Homo Sapiens; identical to SEQ ID NO: 163651

SEQ ID NO: 368468 - RNA, 64 nt, Homo Sapiens; identical to SEQ ID NO: 163652

SEQ ID NO: 368469 - RNA, 64 nt, Homo Sapiens; identical to SEQ ID NO: 163653

SEQ ID NO: 368470 - RNA, 64 nt, Homo Sapiens; identical to SEQ ID NO: 163654

SEQ ID NO: 368471 - RNA, 64 nt, Homo Sapiens; identical to SEQ ID NO: 163655

SEQ ID NO: 368472 - RNA, 64 nt, Homo Sapiens; identical to SEQ ID NO: 163656

SEQ ID NO: 368473 - RNA, 64 nt, Homo Sapiens; identical to SEQ ID NO: 163657

SEQ ID NO: 368474 - RNA, 64 nt, Homo Sapiens; identical to SEQ ID NO: 163658

SEQ ID NO: 368475 - RNA, 64 nt, Homo Sapiens; identical to SEQ ID NO: 163659

SEQ ID NO: 368476 - RNA, 64 nt, Homo Sapiens; identical to SEQ ID NO: 163660

SEQ ID NO: 368477 - RNA, 64 nt, Homo Sapiens; identical to SEQ ID NO: 163661

SEQ ID NO: 368478 - RNA, 62 nt, Homo Sapiens; identical to SEQ ID NO: 163662

SEQ ID NO: 368479 - RNA, 64 nt, Homo Sapiens; identical to SEQ ID NO: 163663

SEQ ID NO: 368480 - RNA, 64 nt, Homo Sapiens; identical to SEQ ID NO: 163664

SEQ ID NO: 368481 - RNA, 64 nt, Homo Sapiens; identical to SEQ ID NO: 163665

SEQ ID NO: 368482 - RNA, 64 nt, Homo Sapiens; identical to SEQ ID NO: 163666

SEQ ID NO: 368483 - RNA, 64 nt, Homo Sapiens; identical to SEQ ID NO: 163667

SEQ ID NO: 368484 - RNA, 64 nt, Homo Sapiens; identical to SEQ ID NO: 163668

SEQ ID NO: 368485 - RNA, 64 nt, Homo Sapiens; identical to SEQ ID NO: 163669

SEQ ID NO: 368486 - RNA, 64 nt, Homo Sapiens; identical to SEQ ID NO: 163670

SEQ ID NO: 368487 - RNA, 64 nt, Homo Sapiens; identical to SEQ ID NO: 163671

SEQ ID NO: 368488 - RNA, 64 nt, Homo Sapiens; identical to SEQ ID NO: 163672

SEQ ID NO: 368489 - RNA, 64 nt, Homo Sapiens; identical to SEQ ID NO: 163673

SEQ ID NO: 368490 - RNA, 64 nt, Homo Sapiens; identical to SEQ ID NO: 163674

SEQ ID NO: 368491 - RNA, 64 nt, Homo Sapiens; identical to SEQ ID NO: 163675

SEQ ID NO: 368492 - RNA, 64 nt, Homo Sapiens; identical to SEQ ID NO: 163676

SEQ ID NO: 368493 - RNA, 64 nt, Homo Sapiens; identical to SEQ ID NO: 163677

SEQ ID NO: 368494 - RNA, 64 nt, Homo Sapiens; identical to SEQ ID NO: 163678

SEQ ID NO: 368495 - RNA, 64 nt, Homo Sapiens; identical to SEQ ID NO: 163679

SEQ ID NO: 368496 - RNA, 64 nt, Homo Sapiens; identical to SEQ ID NO: 163680

SEQ ID NO: 368497 - RNA, 64 nt, Homo Sapiens; identical to SEQ ID NO: 163681

SEQ ID NO: 368498 - RNA, 64 nt, Homo Sapiens; identical to SEQ ID NO: 163682

SEQ ID NO: 368499 - RNA, 64 nt, Homo Sapiens; identical to SEQ ID NO: 163683

SEQ ID NO: 368500 - RNA, 64 nt, Homo Sapiens; identical to SEQ ID NO: 163684

SEQ ID NO: 368501 - RNA, 64 nt, Homo Sapiens; identical to SEQ ID NO: 163685

SEQ ID NO: 368502 - RNA, 64 nt, Homo Sapiens; identical to SEQ ID NO: 163686

SEQ ID NO: 368503 - RNA, 64 nt, Homo Sapiens; identical to SEQ ID NO: 163687

SEQ ID NO: 368504 - RNA, 64 nt, Homo Sapiens; identical to SEQ ID NO: 163688

SEQ ID NO: 368505 - RNA, 64 nt, Homo Sapiens; identical to SEQ ID NO: 163689

SEQ ID NO: 368506 - RNA, 64 nt, Homo Sapiens; identical to SEQ ID NO: 163690

SEQ ID NO: 368507 - RNA, 64 nt, Homo Sapiens; identical to SEQ ID NO: 163691

SEQ ID NO: 368508 - RNA, 64 nt, Homo Sapiens; identical to SEQ ID NO: 163692

SEQ ID NO: 368509 - RNA, 64 nt, Homo Sapiens; identical to SEQ ID NO: 163693

SEQ ID NO: 368510 - RNA, 64 nt, Homo Sapiens; identical to SEQ ID NO: 163694

SEQ ID NO: 368511 - RNA, 64 nt, Homo Sapiens; identical to SEQ ID NO: 163695

SEQ ID NO: 368512 - RNA, 64 nt, Homo Sapiens; identical to SEQ ID NO: 163696

SEQ ID NO: 368513 - RNA, 64 nt, Homo Sapiens; identical to SEQ ID NO: 163697

SEQ ID NO: 368514 - RNA, 64 nt, Homo Sapiens; identical to SEQ ID NO: 163698

SEQ ID NO: 368515 - RNA, 64 nt, Homo Sapiens; identical to SEQ ID NO: 163699

SEQ ID NO: 368516 - RNA, 64 nt, Homo Sapiens; identical to SEQ ID NO: 163700

SEQ ID NO: 368517 - RNA, 64 nt, Homo Sapiens; identical to SEQ ID NO: 163701

SEQ ID NO: 368518 - RNA, 64 nt, Homo Sapiens; identical to SEQ ID NO: 163702

SEQ ID NO: 368519 - RNA, 64 nt, Homo Sapiens; identical to SEQ ID NO: 163703

SEQ ID NO: 368520 - RNA, 64 nt, Homo Sapiens; identical to SEQ ID NO: 163704

SEQ ID NO: 368521 - RNA, 64 nt, Homo Sapiens; identical to SEQ ID NO: 163705

SEQ ID NO: 368522 - RNA, 64 nt, Homo Sapiens; identical to SEQ ID NO: 163706

SEQ ID NO: 368523 - RNA, 64 nt, Homo Sapiens; identical to SEQ ID NO: 163707

SEQ ID NO: 368524 - RNA, 64 nt, Homo Sapiens; identical to SEQ ID NO: 163708

SEQ ID NO: 368525 - RNA, 64 nt, Homo Sapiens; identical to SEQ ID NO: 163709

SEQ ID NO: 368526 - RNA, 64 nt, Homo Sapiens; identical to SEQ ID NO: 163710

SEQ ID NO: 368527 - RNA, 64 nt, Homo Sapiens; identical to SEQ ID NO: 163711

SEQ ID NO: 368528 - RNA, 64 nt, Homo Sapiens; identical to SEQ ID NO: 163712

SEQ ID NO: 368529 - RNA, 64 nt, Homo Sapiens; identical to SEQ ID NO: 163713

SEQ ID NO: 368530 - RNA, 64 nt, Homo Sapiens; identical to SEQ ID NO: 163714

SEQ ID NO: 368531 - RNA, 64 nt, Homo Sapiens; identical to SEQ ID NO: 163715

SEQ ID NO: 368532 - RNA, 64 nt, Homo Sapiens; identical to SEQ ID NO: 163716

SEQ ID NO: 368533 - RNA, 64 nt, Homo Sapiens; identical to SEQ ID NO: 163717

SEQ ID NO: 368534 - RNA, 64 nt, Homo Sapiens; identical to SEQ ID NO: 163718

SEQ ID NO: 368535 - RNA, 64 nt, Homo Sapiens; identical to SEQ ID NO: 163719

SEQ ID NO: 368536 - RNA, 64 nt, Homo Sapiens; identical to SEQ ID NO: 163720

SEQ ID NO: 368537 - RNA, 64 nt, Homo Sapiens; identical to SEQ ID NO: 163721

SEQ ID NO: 368538 - RNA, 64 nt, Homo Sapiens; identical to SEQ ID NO: 163722

SEQ ID NO: 368539 - RNA, 64 nt, Homo Sapiens; identical to SEQ ID NO: 163723

SEQ ID NO: 368540 - RNA, 64 nt, Homo Sapiens; identical to SEQ ID NO: 163724

SEQ ID NO: 368541 - RNA, 64 nt, Homo Sapiens; identical to SEQ ID NO: 163725

SEQ ID NO: 368542 - RNA, 64 nt, Homo Sapiens; identical to SEQ ID NO: 163726

SEQ ID NO: 368543 - RNA, 64 nt, Homo Sapiens; identical to SEQ ID NO: 163727

SEQ ID NO: 368544 - RNA, 64 nt, Homo Sapiens; identical to SEQ ID NO: 163728

SEQ ID NO: 368545 - RNA, 64 nt, Homo Sapiens; identical to SEQ ID NO: 163729

SEQ ID NO: 368546 - RNA, 64 nt, Homo Sapiens; identical to SEQ ID NO: 163730

SEQ ID NO: 368547 - RNA, 64 nt, Homo Sapiens; identical to SEQ ID NO: 163731

SEQ ID NO: 368548 - RNA, 64 nt, Homo Sapiens; identical to SEQ ID NO: 163732

SEQ ID NO: 368549 - RNA, 64 nt, Homo Sapiens; identical to SEQ ID NO: 163733

SEQ ID NO: 368550 - RNA, 64 nt, Homo Sapiens; identical to SEQ ID NO: 163734

SEQ ID NO: 368551 - RNA, 64 nt, Homo Sapiens; identical to SEQ ID NO: 163735

SEQ ID NO: 368552 - RNA, 64 nt, Homo Sapiens; identical to SEQ ID NO: 163736

SEQ ID NO: 368553 - RNA, 64 nt, Homo Sapiens; identical to SEQ ID NO: 163737

SEQ ID NO: 368554 - RNA, 64 nt, Homo Sapiens; identical to SEQ ID NO: 163738

SEQ ID NO: 368555 - RNA, 64 nt, Homo Sapiens; identical to SEQ ID NO: 163739

SEQ ID NO: 368556 - RNA, 64 nt, Homo Sapiens; identical to SEQ ID NO: 163740

SEQ ID NO: 368557 - RNA, 64 nt, Homo Sapiens; identical to SEQ ID NO: 163741

SEQ ID NO: 368558 - RNA, 64 nt, Homo Sapiens; identical to SEQ ID NO: 163742

SEQ ID NO: 368559 - RNA, 64 nt, Homo Sapiens; identical to SEQ ID NO: 163743

SEQ ID NO: 368560 - RNA, 62 nt, Homo Sapiens; identical to SEQ ID NO: 163744

SEQ ID NO: 368561 - RNA, 64 nt, Homo Sapiens; identical to SEQ ID NO: 163745

SEQ ID NO: 368562 - RNA, 64 nt, Homo Sapiens; identical to SEQ ID NO: 163746

SEQ ID NO: 368563 - RNA, 64 nt, Homo Sapiens
agcauugucagccugaagaucagagcugcagccagucaggcaggggagagauuuuucuuuuaag

SEQ ID NO: 368564 - RNA, 64 nt, Homo Sapiens
gugacuucuggcuuaugcucagaagccagucugcgucaggcacgucuccugcugcgugacaugu

SEQ ID NO: 368565 - RNA, 64 nt, Homo Sapiens
gagacauagggaaggaaugggucaggcacugaaugucaggcauuacaugccaaaugcugauucu

SEQ ID NO: 368566 - RNA, 64 nt, Homo Sapiens
gaaugucaggcauugagacacaaaugcugauucugucaggcacuugccauauccaaggacaugc

SEQ ID NO: 368567 - RNA, 64 nt, Homo Sapiens
ggguuaugucgaggaagggaagaaagaaacagaagucaggcagaggcgugucugugcaaacugg

SEQ ID NO: 368568 - RNA, 64 nt, Homo Sapiens
cauuuagcacauauuuauugggcaucggugaugugucaggcacaguccuuggcacacagaauac

SEQ ID NO: 368569 - RNA, 64 nt, Homo Sapiens
aggugcgucagcaauuuccugcuccucuugguuggucaggcacugaagcuccuacacaggucac

SEQ ID NO: 368570 - RNA, 64 nt, Homo Sapiens
cagcuguaugaaagggacgguuguggugaaguuugucaggcacaguaagcaugcugaguggcgg

SEQ ID NO: 368571 - RNA, 64 nt, Homo Sapiens
uucccuugucuagaggguggacauuggcuacaggcucuuccaucucucaugacuucauggaccc

SEQ ID NO: 368572 - RNA, 64 nt, Homo Sapiens
ggaaggagggcaccccaaaggacagcgccuucuucucuuccacccaugcacggccuugggugau

SEQ ID NO: 368573 - RNA, 64 nt, Homo Sapiens
aaucgggaacaaaggguuuuaucuaauaaagugucucuuccauucacguugcuaccuuacccac

SEQ ID NO: 368574 - RNA, 64 nt, Homo Sapiens
cacacccagccacuguaaagagguaacuuggguccucuuccauugcaguccugaugauccuaac

SEQ ID NO: 368575 - RNA, 64 nt, Homo Sapiens
ugcugcugcuuuuuuugccauaccagcagcugaucucuuccacgaggaagugaagcuggcuuag

SEQ ID NO: 368576 - RNA, 64 nt, Homo Sapiens
guccugccccacgaaggauccuccugcuucucagcucuuccaccugucuguugucugcccucug

SEQ ID NO: 368577 - RNA, 64 nt, Homo Sapiens
ccucagaguuuucuucuccacuccuccuaccuuucucuuccacugaagagcccugcuucccugc

SEQ ID NO: 368578 - RNA, 64 nt, Homo Sapiens
cccugcugcccaggaguugcugcaaccagggucccucuuccaugcguuaccaggagcccugaca

SEQ ID NO: 368579 - RNA, 64 nt, Homo Sapiens
cauggagauccuccauccuaaguuggugaauggacucuuccaggucccagcacauugaggaugu

SEQ ID NO: 368580 - RNA, 64 nt, Homo Sapiens
agcaugaguccuggagagcuccuuccaggcuacacucuuccaucgauguugcucuacauucaaa

SEQ ID NO: 368581 - RNA, 64 nt, Homo Sapiens
aaauuggaagcuuuuuuuaagguuuugcuuuucucucuuccacaaagcacuggauaaauuguuu

SEQ ID NO: 368582 - RNA, 64 nt, Homo Sapiens
aguugagauucgcauauuuggaaagaaaggauuucucuuccaacaggaggaaauagacuuagac

SEQ ID NO: 368583 - RNA, 64 nt, Homo Sapiens
ugaccucaugcaucuccaccuccuaucagccugucucuuccauauucccaaaggacuccaccca

SEQ ID NO: 368584 - RNA, 64 nt, Homo Sapiens
auguccccaaaccugcaagggucuucauuaagcccucuuccaucccccugauuacaccagccuc

SEQ ID NO: 368585 - RNA, 64 nt, Homo Sapiens
agacagacuggacauuucccuguuucgagccaggcucuuccaaggggccagcuggguccccgga

SEQ ID NO: 368586 - RNA, 64 nt, Homo Sapiens
cccgaggcucccgguuccaagucccaucgugcuccucuuccaaugccacacugccucugagccc

SEQ ID NO: 368587 - RNA, 64 nt, Homo Sapiens
ccacggugaucuuggaguaggcgcccagcccuggcucuuccaugcucugccccuuuccuggaug

SEQ ID NO: 368588 - RNA, 64 nt, Homo Sapiens
ucccugauuggugucucagcauuuauuuuccugucucuuccaccaaaagccagcuguagcuuua

SEQ ID NO: 368589 - RNA, 64 nt, Homo Sapiens
uugaagaaggcauccagaaguggaauuaaagggacucuuccauuauuuccaaagaacugcacuc

SEQ ID NO: 368590 - RNA, 64 nt, Homo Sapiens
uuccaugcagcuagcagucaucuggaaagaagaccucuuccaucaccacuucugguuccuuuca

SEQ ID NO: 368591 - RNA, 64 nt, Homo Sapiens
cgagaaguuccugucccagagggguacagccccucucuuccaacgauugagaaccaccacccga

SEQ ID NO: 368592 - RNA, 64 nt, Homo Sapiens
gcugccucugccuuuauccugguggcaacagcuccucuuccagagguccuguuuguaaaacaac

SEQ ID NO: 368593 - RNA, 64 nt, Homo Sapiens
ucaacuacuaaaacuucccgccacccugcuauuucucuuccaauuacuguucaaacauuuuugg

SEQ ID NO: 368594 - RNA, 64 nt, Homo Sapiens
gguuuaguguaaacugaguaccacuuuauauuuucucuuccauagugagauguaugcaguaugu

SEQ ID NO: 368595 - RNA, 64 nt, Homo Sapiens
ugugaauagugcucucuaccuguggguggccguucucuuccacuugcucgucuccccccagccc

SEQ ID NO: 368596 - RNA, 64 nt, Homo Sapiens
cuucccaguaagauugugcaauuuuuauucacagcucuuccauguagacuuaccuuuccucaua

SEQ ID NO: 368597 - RNA, 64 nt, Homo Sapiens
cauccugggucagccuuucccugcuuucugccuccucuuccacagacagggcuggagacugugu

SEQ ID NO: 368598 - RNA, 64 nt, Homo Sapiens
uggagaaggacugagccccaagagcugggcuuggcucuuccagcgggcuuuugcugggcucucc

SEQ ID NO: 368599 - RNA, 64 nt, Homo Sapiens
ccccagccuacccuuccugcauuucucuucucagcucuuccaugauggauuccccccccuuucc

SEQ ID NO: 368600 - RNA, 64 nt, Homo Sapiens
ucuuuugucucccagcaguagugagccacucagucucuuccacaggaaguuuggagccuacauu

SEQ ID NO: 368601 - RNA, 64 nt, Homo Sapiens
cacuggcaaugcagugaugaacuacguucccagccucuuccaggcguauauuuauugagugcca

SEQ ID NO: 368602 - RNA, 64 nt, Homo Sapiens
cuuucuacuugaucuccagcuccugucccuggaacucuuccagcccaggaccuggcuggaugcu

SEQ ID NO: 368603 - RNA, 64 nt, Homo Sapiens
gagacaggugacugagagcugcaggccuccucugcucuuccaaacacguagcauuugcaccccu

SEQ ID NO: 368604 - RNA, 64 nt, Homo Sapiens
agagaacugcacagugaccacuguauuuuucacgcucuuccagggaucccugucccccgacauu

SEQ ID NO: 368605 - RNA, 64 nt, Homo Sapiens
uucugcccuuucccacaccucugccccuggcuuccucuuccaugcugucuugaucccccccucc

SEQ ID NO: 368606 - RNA, 64 nt, Homo Sapiens
uucugcccuuucccacaugucugccccuggcuuccucuuccauguggagcuuggggaccccucc

SEQ ID NO: 368607 - RNA, 64 nt, Homo Sapiens
cuuugcuguuccccagcagcacauccaccugcuucucuuccaggggucaucaaugccccaguuc

SEQ ID NO: 368608 - RNA, 64 nt, Homo Sapiens
ggugggauuucuaagaccgacuguaugagcucgccucuuccagauagcuggcagagggcagggc

SEQ ID NO: 368609 - RNA, 64 nt, Homo Sapiens
uaagaaauugaaaauacauacaugcuugucucaacucuuccacuuguaggaauuuauucuauaa

SEQ ID NO: 368610 - RNA, 64 nt, Homo Sapiens
cacagucccaugagggccccuccggggcgaccuucucuuccagcggugucuucagccuccaacc

SEQ ID NO: 368611 - RNA, 64 nt, Homo Sapiens
uugaccaggacugcaccaagggcacagaggagcgcucuuccaucccaccccugcacagcagcug

SEQ ID NO: 368612 - RNA, 64 nt, Homo Sapiens
agaggggugcccagcggaggggguucagaggggacucuuccaggggaggggaaggggaagcuug

SEQ ID NO: 368613 - RNA, 64 nt, Homo Sapiens
ccuguaggggagacaaaaccagugacuucucccucucuuccaguuggcuucccugccagugagg

SEQ ID NO: 368614 - RNA, 64 nt, Homo Sapiens
auuucuucugagagcaugguuucaugguuuuucucuaugaaaugacucaauauuccaaauguuu

SEQ ID NO: 368615 - RNA, 64 nt, Homo Sapiens
ccccugcugcacacgcuagcauaucuggaaccuacuaugaaaaugaaaggacccuuauagguac

SEQ ID NO: 368616 - RNA, 64 nt, Homo Sapiens
ggguagaccucucagcggaaauugacuggacacccuaugaaaguccaguggacuguacucacaa

SEQ ID NO: 368617 - RNA, 63 nt, Homo Sapiens
auccugugaguuauuuccucuaauuuagccaggcuaugaaaucaucaggaguuaaucaaguag

SEQ ID NO: 368618 - RNA, 64 nt, Homo Sapiens
ucuuuuuuucuuuuugguauauuuggcuuggaggcuaugaaaugaagauuauagucauuguaua

SEQ ID NO: 368619 - RNA, 64 nt, Homo Sapiens
aauuuuaaaaauuauuaagguaauaauccaaacucuaugaaagcucugacauuuaauuguuuua

SEQ ID NO: 368620 - RNA, 64 nt, Homo Sapiens
uugcacaaauacaagccaagcuagaaggaagcaccuaugaaagcaacaacuuuguuucucaucc

SEQ ID NO: 368621 - RNA, 64 nt, Homo Sapiens
auugcuacacuuacaaguaaugaauuuuaugugacuaugaaacgaauauaagcuuaaaauaagu

SEQ ID NO: 368622 - RNA, 64 nt, Homo Sapiens
uuuagucaacagaaacuauuagacaaugaaugaacuaugaaagacuuagcucugugcucucacc

SEQ ID NO: 368623 - RNA, 64 nt, Homo Sapiens
ggaaauaauuaucuuagaauaacuguacuaguuacuaugaaaauccugagagaaugcuagucau

SEQ ID NO: 368624 - RNA, 64 nt, Homo Sapiens
uauuccugguuggcuagaacugggugaccaacagcuaugaaacaaauuucagcuguuugaaguu

SEQ ID NO: 368625 - RNA, 64 nt, Homo Sapiens
uaagaacuaugggccagacauuuaaucucuccaucuaugaaauaguccauucucauuuaucuac

SEQ ID NO: 368626 - RNA, 64 nt, Homo Sapiens
aaauaacaaaugaaaauaaauucucuguaaucugcuaugaaagagaaaccagagguuucuuucu

SEQ ID NO: 368627 - RNA, 64 nt, Homo Sapiens
ugcucuggccucgucuucuacacacugcuaauuacuaugaaagcuugacuggacccucaguucc

SEQ ID NO: 368628 - RNA, 64 nt, Homo Sapiens
gauauggaaacuucuaaaauucaaacuuuguuuucuaugaaaauuguuuaaauguuacuuguuu

SEQ ID NO: 368629 - RNA, 64 nt, Homo Sapiens
cuuuccauaucaucaaaacuaugaauguuugaugcuaugaaaagucccugugcauuugcaccag

SEQ ID NO: 368630 - RNA, 64 nt, Homo Sapiens
uuuaacuuuuaaaauguuguuuaaaagugugaagcuaugaaaagccugauaaugugacuacaga

SEQ ID NO: 368631 - RNA, 64 nt, Homo Sapiens
guguguguauauauauauauauauauauauauuucuaugaaauuguccagauguguucaggaac

SEQ ID NO: 368632 - RNA, 64 nt, Homo Sapiens
agagagagagagagcgagagagagagacauguuacuaugaaagacuuguauuuuuuauugucuc

SEQ ID NO: 368633 - RNA, 64 nt, Homo Sapiens
uaguuuugcauggcuguuugacugccuuuccgcccuaugaaaaucaagaaaaucuuuuuuaaaa

SEQ ID NO: 368634 - RNA, 64 nt, Homo Sapiens
uauauucacugcagagcaauaagcucacccuagacuaugaaaaugaaaauuauucaccauuuug

SEQ ID NO: 368635 - RNA, 64 nt, Homo Sapiens
ggaaaaaagugcccaguucucuacuuuaaugcagcuaugaaaagauggugcaugucauugagaa

SEQ ID NO: 368636 - RNA, 64 nt, Homo Sapiens
caagacagacuccacucaaauaacccagaagacacuaugaaaaauuuugugcuggguucuaccu

SEQ ID NO: 368637 - RNA, 64 nt, Homo Sapiens
uggggcccaaaauuucacacggacaacgguuuagcuaugaaauugaguagggggcauuccacag

SEQ ID NO: 368638 - RNA, 64 nt, Homo Sapiens
auacuuuuucuuuccagaaauaauuucauaccgccuaugaaauaucagauaaauuaccuuagcu

SEQ ID NO: 368639 - RNA, 64 nt, Homo Sapiens
cauguaaaauauuuaggauuugaccacacaauggcuaugaaaaugcaaguaguuuccucgcgug

SEQ ID NO: 368640 - RNA, 64 nt, Homo Sapiens
uuuguaaauuuaguuuauugugugauaggcauaucuaugaaaccgauuguuuuuauuuuaaacu

SEQ ID NO: 368641 - RNA, 64 nt, Homo Sapiens
guggacuuuuuugaagguuuuguaaaguagcuuccuaugaaaauuggaguacauguauuuucuu

SEQ ID NO: 368642 - RNA, 64 nt, Homo Sapiens
ccacacauucucucucaauuucagcuucggaacgcuaugaaaauaauacaugauuaaaguuuca

SEQ ID NO: 368643 - RNA, 64 nt, Homo Sapiens
uaaagcagguaugcagguaugugggugaaagugacuaugaaaagacuuaaugaauucugggauu

SEQ ID NO: 368644 - RNA, 64 nt, Homo Sapiens
uucacaggcagugcaugugaagcaugcuuugcugcuaugaaaaugagcaucagagaguguacau

SEQ ID NO: 368645 - RNA, 64 nt, Homo Sapiens
uuaacaaaucuaaucucuuauucuaauaaauauacuaugaaauaaaaaaaaaaggaugaaagcu

SEQ ID NO: 368646 - RNA, 64 nt, Homo Sapiens
gacagaaaaucugacuacuaggaagacuucuaggcuaugaaacugacuucuaggcuaugaaacu

SEQ ID NO: 368647 - RNA, 64 nt, Homo Sapiens
ggaagacuucuaggcuaugaaacugacuucuaggcuaugaaacuuacaggguaugggugggcac

SEQ ID NO: 368648 - RNA, 64 nt, Homo Sapiens
auucuuuuuuauuaggcauuauuuaugaccuuuucuaugaaaagauaaggacauuaaaauguaa

SEQ ID NO: 368649 - RNA, 64 nt, Homo Sapiens
aaguuagucauauguuauuuuauuaauuguacuucuaugaaauaauaugcagucuauuuuuaaa

SEQ ID NO: 368650 - RNA, 64 nt, Homo Sapiens
aagauagacacauuuggauuauaugagauacauacuaugaaaugaaaaaauaaaagaucguaug

SEQ ID NO: 368651 - RNA, 64 nt, Homo Sapiens
ugcuagagcaccaauguauacauaauuugguaaccuaugaaagaaguuuacuugauuguggcug

SEQ ID NO: 368652 - RNA, 64 nt, Homo Sapiens
uugugggugauguuugaccuucagagccagccggcuaugaaagggagcgagccccucggcucug

SEQ ID NO: 368653 - RNA, 64 nt, Homo Sapiens
cugccaguggggaaggaggccaagcagugccugccuaugaaauuucaacuuuuccuuucauacg

SEQ ID NO: 368654 - RNA, 64 nt, Homo Sapiens
auacccaauauauauuuuuuggcacaggacagcccuaugaaaaaagucugucuaccuuuagcca

SEQ ID NO: 368655 - RNA, 64 nt, Homo Sapiens
acaaaccaaaauaugcucuuccuuuaccccuagucuaugaaaaauauuuucuuaguagugcaga

SEQ ID NO: 368656 - RNA, 64 nt, Homo Sapiens; identical to SEQ ID NO: 74844

SEQ ID NO: 368657 - RNA, 64 nt, Homo Sapiens; identical to SEQ ID NO: 74845

SEQ ID NO: 368658 - RNA, 64 nt, Homo Sapiens; identical to SEQ ID NO: 74846

SEQ ID NO: 368659 - RNA, 64 nt, Homo Sapiens; identical to SEQ ID NO: 74847

SEQ ID NO: 368660 - RNA, 64 nt, Homo Sapiens; identical to SEQ ID NO: 74848

SEQ ID NO: 368661 - RNA, 64 nt, Homo Sapiens; identical to SEQ ID NO: 74849

SEQ ID NO: 368662 - RNA, 64 nt, Homo Sapiens; identical to SEQ ID NO: 74850

SEQ ID NO: 368663 - RNA, 64 nt, Homo Sapiens; identical to SEQ ID NO: 74851

SEQ ID NO: 368664 - RNA, 64 nt, Homo Sapiens; identical to SEQ ID NO: 74852

SEQ ID NO: 368665 - RNA, 64 nt, Homo Sapiens; identical to SEQ ID NO: 74853

SEQ ID NO: 368666 - RNA, 64 nt, Homo Sapiens; identical to SEQ ID NO: 289244

SEQ ID NO: 368667 - RNA, 64 nt, Homo Sapiens; identical to SEQ ID NO: 289245

SEQ ID NO: 368668 - RNA, 64 nt, Homo Sapiens; identical to SEQ ID NO: 289246

SEQ ID NO: 368669 - RNA, 64 nt, Homo Sapiens; identical to SEQ ID NO: 289247

SEQ ID NO: 368670 - RNA, 64 nt, Homo Sapiens; identical to SEQ ID NO: 289248

SEQ ID NO: 368671 - RNA, 64 nt, Homo Sapiens; identical to SEQ ID NO: 289249

SEQ ID NO: 368672 - RNA, 64 nt, Homo Sapiens; identical to SEQ ID NO: 289250

SEQ ID NO: 368673 - RNA, 64 nt, Homo Sapiens; identical to SEQ ID NO: 289251

SEQ ID NO: 368674 - RNA, 64 nt, Homo Sapiens; identical to SEQ ID NO: 289252

SEQ ID NO: 368675 - RNA, 64 nt, Homo Sapiens; identical to SEQ ID NO: 289253

SEQ ID NO: 368676 - RNA, 64 nt, Homo Sapiens; identical to SEQ ID NO: 289254

SEQ ID NO: 368677 - RNA, 64 nt, Homo Sapiens; identical to SEQ ID NO: 289255

SEQ ID NO: 368678 - RNA, 64 nt, Homo Sapiens; identical to SEQ ID NO: 289256

SEQ ID NO: 368679 - RNA, 64 nt, Homo Sapiens; identical to SEQ ID NO: 289257

SEQ ID NO: 368680 - RNA, 64 nt, Homo Sapiens; identical to SEQ ID NO: 289258

SEQ ID NO: 368681 - RNA, 64 nt, Homo Sapiens; identical to SEQ ID NO: 289259

SEQ ID NO: 368682 - RNA, 64 nt, Homo Sapiens; identical to SEQ ID NO: 289260

SEQ ID NO: 368683 - RNA, 64 nt, Homo Sapiens; identical to SEQ ID NO: 289261

SEQ ID NO: 368684 - RNA, 64 nt, Homo Sapiens; identical to SEQ ID NO: 289262

SEQ ID NO: 368685 - RNA, 64 nt, Homo Sapiens; identical to SEQ ID NO: 289263

SEQ ID NO: 368686 - RNA, 64 nt, Homo Sapiens; identical to SEQ ID NO: 257365

SEQ ID NO: 368687 - RNA, 64 nt, Homo Sapiens; identical to SEQ ID NO: 257366

SEQ ID NO: 368688 - RNA, 64 nt, Homo Sapiens; identical to SEQ ID NO: 257367

SEQ ID NO: 368689 - RNA, 64 nt, Homo Sapiens; identical to SEQ ID NO: 257368

SEQ ID NO: 368690 - RNA, 64 nt, Homo Sapiens; identical to SEQ ID NO: 257369

SEQ ID NO: 368691 - RNA, 64 nt, Homo Sapiens; identical to SEQ ID NO: 257370

SEQ ID NO: 368692 - RNA, 64 nt, Homo Sapiens; identical to SEQ ID NO: 257371

SEQ ID NO: 368693 - RNA, 64 nt, Homo Sapiens; identical to SEQ ID NO: 257372

SEQ ID NO: 368694 - RNA, 64 nt, Homo Sapiens; identical to SEQ ID NO: 257373

SEQ ID NO: 368695 - RNA, 64 nt, Homo Sapiens; identical to SEQ ID NO: 257374

SEQ ID NO: 368696 - RNA, 64 nt, Homo Sapiens; identical to SEQ ID NO: 257375

SEQ ID NO: 368697 - RNA, 64 nt, Homo Sapiens; identical to SEQ ID NO: 257376

SEQ ID NO: 368698 - RNA, 64 nt, Homo Sapiens; identical to SEQ ID NO: 257377

SEQ ID NO: 368699 - RNA, 64 nt, Homo Sapiens; identical to SEQ ID NO: 257378

SEQ ID NO: 368700 - RNA, 64 nt, Homo Sapiens; identical to SEQ ID NO: 257379

SEQ ID NO: 368701 - RNA, 64 nt, Homo Sapiens; identical to SEQ ID NO: 257380

SEQ ID NO: 368702 - RNA, 64 nt, Homo Sapiens; identical to SEQ ID NO: 257381

SEQ ID NO: 368703 - RNA, 64 nt, Homo Sapiens; identical to SEQ ID NO: 257382

SEQ ID NO: 368704 - RNA, 64 nt, Homo Sapiens; identical to SEQ ID NO: 257383

SEQ ID NO: 368705 - RNA, 64 nt, Homo Sapiens; identical to SEQ ID NO: 257384

SEQ ID NO: 368706 - RNA, 64 nt, Homo Sapiens; identical to SEQ ID NO: 257385

SEQ ID NO: 368707 - RNA, 64 nt, Homo Sapiens; identical to SEQ ID NO: 257386

SEQ ID NO: 368708 - RNA, 64 nt, Homo Sapiens; identical to SEQ ID NO: 257387

SEQ ID NO: 368709 - RNA, 64 nt, Homo Sapiens; identical to SEQ ID NO: 257388

SEQ ID NO: 368710 - RNA, 64 nt, Homo Sapiens; identical to SEQ ID NO: 257389

SEQ ID NO: 368711 - RNA, 64 nt, Homo Sapiens; identical to SEQ ID NO: 257390

SEQ ID NO: 368712 - RNA, 64 nt, Homo Sapiens; identical to SEQ ID NO: 257391

SEQ ID NO: 368713 - RNA, 64 nt, Homo Sapiens; identical to SEQ ID NO: 257392

SEQ ID NO: 368714 - RNA, 64 nt, Homo Sapiens; identical to SEQ ID NO: 257393

SEQ ID NO: 368715 - RNA, 64 nt, Homo Sapiens; identical to SEQ ID NO: 257394

SEQ ID NO: 368716 - RNA, 64 nt, Homo Sapiens; identical to SEQ ID NO: 257395

SEQ ID NO: 368717 - RNA, 64 nt, Homo Sapiens; identical to SEQ ID NO: 257396

SEQ ID NO: 368718 - RNA, 64 nt, Homo Sapiens; identical to SEQ ID NO: 257397

SEQ ID NO: 368719 - RNA, 64 nt, Homo Sapiens; identical to SEQ ID NO: 257398

SEQ ID NO: 368720 - RNA, 64 nt, Homo Sapiens; identical to SEQ ID NO: 257399

SEQ ID NO: 368721 - RNA, 64 nt, Homo Sapiens; identical to SEQ ID NO: 257400

SEQ ID NO: 368722 - RNA, 64 nt, Homo Sapiens; identical to SEQ ID NO: 257401

SEQ ID NO: 368723 - RNA, 64 nt, Homo Sapiens; identical to SEQ ID NO: 257402

SEQ ID NO: 368724 - RNA, 64 nt, Homo Sapiens; identical to SEQ ID NO: 257403

SEQ ID NO: 368725 - RNA, 64 nt, Homo Sapiens; identical to SEQ ID NO: 257404

SEQ ID NO: 368726 - RNA, 64 nt, Homo Sapiens; identical to SEQ ID NO: 257405

SEQ ID NO: 368727 - RNA, 64 nt, Homo Sapiens; identical to SEQ ID NO: 257406

SEQ ID NO: 368728 - RNA, 64 nt, Homo Sapiens; identical to SEQ ID NO: 257407

SEQ ID NO: 368729 - RNA, 64 nt, Homo Sapiens; identical to SEQ ID NO: 257408

SEQ ID NO: 368730 - RNA, 64 nt, Homo Sapiens; identical to SEQ ID NO: 257409

SEQ ID NO: 368731 - RNA, 64 nt, Homo Sapiens; identical to SEQ ID NO: 257410

SEQ ID NO: 368732 - RNA, 64 nt, Homo Sapiens; identical to SEQ ID NO: 257411

SEQ ID NO: 368733 - RNA, 64 nt, Homo Sapiens; identical to SEQ ID NO: 257412

SEQ ID NO: 368734 - RNA, 64 nt, Homo Sapiens; identical to SEQ ID NO: 257413

SEQ ID NO: 368735 - RNA, 64 nt, Homo Sapiens; identical to SEQ ID NO: 257414

SEQ ID NO: 368736 - RNA, 64 nt, Homo Sapiens; identical to SEQ ID NO: 257415

SEQ ID NO: 368737 - RNA, 64 nt, Homo Sapiens; identical to SEQ ID NO: 257416

SEQ ID NO: 368738 - RNA, 64 nt, Homo Sapiens; identical to SEQ ID NO: 257417

SEQ ID NO: 368739 - RNA, 64 nt, Homo Sapiens; identical to SEQ ID NO: 257418

SEQ ID NO: 368740 - RNA, 64 nt, Homo Sapiens; identical to SEQ ID NO: 257419

SEQ ID NO: 368741 - RNA, 64 nt, Homo Sapiens; identical to SEQ ID NO: 257420

SEQ ID NO: 368742 - RNA, 64 nt, Homo Sapiens; identical to SEQ ID NO: 257421

SEQ ID NO: 368743 - RNA, 64 nt, Homo Sapiens; identical to SEQ ID NO: 257422

SEQ ID NO: 368744 - RNA, 64 nt, Homo Sapiens; identical to SEQ ID NO: 257423

SEQ ID NO: 368745 - RNA, 64 nt, Homo Sapiens; identical to SEQ ID NO: 257424

SEQ ID NO: 368746 - RNA, 64 nt, Homo Sapiens; identical to SEQ ID NO: 257425

SEQ ID NO: 368747 - RNA, 64 nt, Homo Sapiens; identical to SEQ ID NO: 257426

SEQ ID NO: 368748 - RNA, 64 nt, Homo Sapiens; identical to SEQ ID NO: 257427

SEQ ID NO: 368749 - RNA, 64 nt, Homo Sapiens; identical to SEQ ID NO: 257428

SEQ ID NO: 368750 - RNA, 64 nt, Homo Sapiens; identical to SEQ ID NO: 257429

SEQ ID NO: 368751 - RNA, 64 nt, Homo Sapiens; identical to SEQ ID NO: 257430

SEQ ID NO: 368752 - RNA, 64 nt, Homo Sapiens; identical to SEQ ID NO: 257431

SEQ ID NO: 368753 - RNA, 64 nt, Homo Sapiens; identical to SEQ ID NO: 257432

SEQ ID NO: 368754 - RNA, 64 nt, Homo Sapiens; identical to SEQ ID NO: 257433

SEQ ID NO: 368755 - RNA, 64 nt, Homo Sapiens; identical to SEQ ID NO: 257434

SEQ ID NO: 368756 - RNA, 64 nt, Homo Sapiens; identical to SEQ ID NO: 257435

SEQ ID NO: 368757 - RNA, 64 nt, Homo Sapiens; identical to SEQ ID NO: 257436

SEQ ID NO: 368758 - RNA, 64 nt, Homo Sapiens; identical to SEQ ID NO: 257437

SEQ ID NO: 368759 - RNA, 64 nt, Homo Sapiens; identical to SEQ ID NO: 257438

SEQ ID NO: 368760 - RNA, 64 nt, Homo Sapiens; identical to SEQ ID NO: 257439

SEQ ID NO: 368761 - RNA, 64 nt, Homo Sapiens; identical to SEQ ID NO: 257440

SEQ ID NO: 368762 - RNA, 64 nt, Homo Sapiens; identical to SEQ ID NO: 257441

SEQ ID NO: 368763 - RNA, 64 nt, Homo Sapiens; identical to SEQ ID NO: 257442

SEQ ID NO: 368764 - RNA, 64 nt, Homo Sapiens; identical to SEQ ID NO: 257443

SEQ ID NO: 368765 - RNA, 64 nt, Homo Sapiens; identical to SEQ ID NO: 257444

SEQ ID NO: 368766 - RNA, 64 nt, Homo Sapiens; identical to SEQ ID NO: 257445

SEQ ID NO: 368767 - RNA, 64 nt, Homo Sapiens; identical to SEQ ID NO: 257446

SEQ ID NO: 368768 - RNA, 64 nt, Homo Sapiens; identical to SEQ ID NO: 257447

SEQ ID NO: 368769 - RNA, 64 nt, Homo Sapiens; identical to SEQ ID NO: 257448

SEQ ID NO: 368770 - RNA, 64 nt, Homo Sapiens; identical to SEQ ID NO: 257449

SEQ ID NO: 368771 - RNA, 64 nt, Homo Sapiens; identical to SEQ ID NO: 257450

SEQ ID NO: 368772 - RNA, 64 nt, Homo Sapiens; identical to SEQ ID NO: 257451

SEQ ID NO: 368773 - RNA, 64 nt, Homo Sapiens; identical to SEQ ID NO: 257452

SEQ ID NO: 368774 - RNA, 64 nt, Homo Sapiens; identical to SEQ ID NO: 257453

SEQ ID NO: 368775 - RNA, 64 nt, Homo Sapiens; identical to SEQ ID NO: 257454

SEQ ID NO: 368776 - RNA, 64 nt, Homo Sapiens; identical to SEQ ID NO: 257455

SEQ ID NO: 368777 - RNA, 64 nt, Homo Sapiens; identical to SEQ ID NO: 257456

SEQ ID NO: 368778 - RNA, 64 nt, Homo Sapiens; identical to SEQ ID NO: 257457

SEQ ID NO: 368779 - RNA, 64 nt, Homo Sapiens; identical to SEQ ID NO: 257458

SEQ ID NO: 368780 - RNA, 64 nt, Homo Sapiens; identical to SEQ ID NO: 257459

SEQ ID NO: 368781 - RNA, 64 nt, Homo Sapiens; identical to SEQ ID NO: 257460

SEQ ID NO: 368782 - RNA, 64 nt, Homo Sapiens; identical to SEQ ID NO: 257461

SEQ ID NO: 368783 - RNA, 64 nt, Homo Sapiens; identical to SEQ ID NO: 257462

SEQ ID NO: 368784 - RNA, 64 nt, Homo Sapiens; identical to SEQ ID NO: 257463

SEQ ID NO: 368785 - RNA, 64 nt, Homo Sapiens; identical to SEQ ID NO: 257464

SEQ ID NO: 368786 - RNA, 64 nt, Homo Sapiens; identical to SEQ ID NO: 257465

SEQ ID NO: 368787 - RNA, 64 nt, Homo Sapiens; identical to SEQ ID NO: 257466

SEQ ID NO: 368788 - RNA, 64 nt, Homo Sapiens; identical to SEQ ID NO: 257467

SEQ ID NO: 368789 - RNA, 64 nt, Homo Sapiens; identical to SEQ ID NO: 257468

SEQ ID NO: 368790 - RNA, 64 nt, Homo Sapiens
ccccaaacuccacgggugccccuagcuggcccagagccggcagugugagcccaaguccgggcug

SEQ ID NO: 368791 - RNA, 64 nt, Homo Sapiens
caguuuacagacgcauggcucuuccucccagagcagccggcagcuaccuggaccggaaaugucc

SEQ ID NO: 368792 - RNA, 64 nt, Homo Sapiens
uggcugucuaccacaagggaagcaccucucagacagccggcacgcuguaucacagaugugcuac

SEQ ID NO: 368793 - RNA, 64 nt, Homo Sapiens
cuaugcucuacagcuuccaguccgccuucuauccagccggcaccucuguacccccagaugugua

SEQ ID NO: 368794 - RNA, 64 nt, Homo Sapiens
ucugcuguuccucucuacaagaaccugggaggccaacgccuaaagaucauaauaucacacaaug

SEQ ID NO: 368795 - RNA, 64 nt, Homo Sapiens
gagugagacaguggggcacagguuggguuugccaaacgccuaauuaccaggccaggaagcaugc

SEQ ID NO: 368796 - RNA, 64 nt, Homo Sapiens
uuaucauuaucucagaaugcuuauuuccaauuaaaacgccuacagcugccuccuagaauauaga

SEQ ID NO: 368797 - RNA, 64 nt, Homo Sapiens
uagaacuuuguagcuguagauuaguuauguuuaaaacgccuacuugcaagucuugcuucuuugg

SEQ ID NO: 368798 - RNA, 64 nt, Homo Sapiens
guucgcaucaagauccaaaucuugauuucauauuaacgccuaaggauugccugugugcuggaaa

SEQ ID NO: 368799 - RNA, 54 nt, Homo Sapiens
ucugcccugguuaauuuagcccagaacgccuacugguuuaggucccagaaauga

SEQ ID NO: 368800 - RNA, 64 nt, Homo Sapiens
ggccggcggggagcuuuuacauuaaaaaucuacuaacgccuacuuuuuaaaaaaugagauucuu

SEQ ID NO: 368801 - RNA, 64 nt, Homo Sapiens
aagugucagccuuagauaaacguucagcauuaaaaacgccuauuauuucauuuacuagcauuuu

SEQ ID NO: 368802 - RNA, 53 nt, Homo Sapiens
ucuaaaacccaaaaggcucugcgaacgccuacucggcgcccaagaagaaauag

SEQ ID NO: 368803 - RNA, 64 nt, Homo Sapiens
caaaaaaaaaaaaaaaaaaaauuaaccucaaccaaacgccuauuuuuuaaugcuuaguuuuggc

SEQ ID NO: 368804 - RNA, 64 nt, Homo Sapiens
ccucgguauuagccagccgcaaagcggaccaacuaacgccuaaauccaugcucuuccucggguc

SEQ ID NO: 368805 - RNA, 64 nt, Homo Sapiens
uauuccuuaagaacucuguguuauauuaccauggaacgccuaauaaagcaaaaugugguuguuu

SEQ ID NO: 368806 - RNA, 64 nt, Homo Sapiens
ucaacuuuauugagauucaauuuucauauaguaaaacgccuauuuaaguguacaagguuuugaa

SEQ ID NO: 368807 - RNA, 64 nt, Homo Sapiens
uugcuuucuucuuaaccuaugcaaacucagugcaaacgccuagaaauguagcaauggcacuguu

SEQ ID NO: 368808 - RNA, 64 nt, Homo Sapiens
auaagcauugggccauaguuuguuaaucucaacuaacgccuacauuacauucuccuugaucguu

SEQ ID NO: 368809 - RNA, 50 nt, Homo Sapiens
ccaaagguuccgugguaugaaacgccuagugcagggaaugcuucccggga

SEQ ID NO: 368810 - RNA, 64 nt, Homo Sapiens
uuuaauuccugguaagagcaugcauucauuuuccaacgccuacacuuaugaucuggauauauuu

SEQ ID NO: 368811 - RNA, 64 nt, Homo Sapiens
aaccuccaugugguagcuccgcuuucuuguuugaaacgccuacagcucgugucuuaaccuaagu

SEQ ID NO: 368812 - RNA, 64 nt, Homo Sapiens
cacuguuaaaauuuaaaaaggugcuuuaaaauaaaacgccuauaaagauugugcaguaagaauu

SEQ ID NO: 368813 - RNA, 64 nt, Homo Sapiens
gaugugucacgggcccugacugagcuacagcgccaacgccuagagcccuuccgccagcgccucu

SEQ ID NO: 368814 - RNA, 64 nt, Homo Sapiens
aauuuguaaucaaacaauaggaggggaaucugugaacgccuagaaaaugagcagaauaaaggau

SEQ ID NO: 368815 - RNA, 64 nt, Homo Sapiens
cuucauuguagguaagauaauucauacuggagaaaacgccuacaugugugaacaauauggcaaa

SEQ ID NO: 368816 - RNA, 64 nt, Homo Sapiens
cccccagucgugucgcgucuagcuggagaacugcaacgccuacgacauaguaucgggugaggcc

SEQ ID NO: 368817 - RNA, 64 nt, Homo Sapiens; identical to SEQ ID NO: 84248

SEQ ID NO: 368818 - RNA, 64 nt, Homo Sapiens; identical to SEQ ID NO: 84249

SEQ ID NO: 368819 - RNA, 64 nt, Homo Sapiens; identical to SEQ ID NO: 84250

SEQ ID NO: 368820 - RNA, 64 nt, Homo Sapiens; identical to SEQ ID NO: 84251

SEQ ID NO: 368821 - RNA, 64 nt, Homo Sapiens; identical to SEQ ID NO: 84252

SEQ ID NO: 368822 - RNA, 64 nt, Homo Sapiens; identical to SEQ ID NO: 84253

SEQ ID NO: 368823 - RNA, 64 nt, Homo Sapiens; identical to SEQ ID NO: 84254

SEQ ID NO: 368824 - RNA, 64 nt, Homo Sapiens; identical to SEQ ID NO: 84255

SEQ ID NO: 368825 - RNA, 64 nt, Homo Sapiens; identical to SEQ ID NO: 84256

SEQ ID NO: 368826 - RNA, 64 nt, Homo Sapiens; identical to SEQ ID NO: 84257

SEQ ID NO: 368827 - RNA, 64 nt, Homo Sapiens; identical to SEQ ID NO: 84258

SEQ ID NO: 368828 - RNA, 64 nt, Homo Sapiens; identical to SEQ ID NO: 84259

SEQ ID NO: 368829 - RNA, 64 nt, Homo Sapiens; identical to SEQ ID NO: 84260

SEQ ID NO: 368830 - RNA, 55 nt, Homo Sapiens; identical to SEQ ID NO: 84261

SEQ ID NO: 368831 - RNA, 64 nt, Homo Sapiens; identical to SEQ ID NO: 84262

SEQ ID NO: 368832 - RNA, 64 nt, Homo Sapiens; identical to SEQ ID NO: 84263

SEQ ID NO: 368833 - RNA, 64 nt, Homo Sapiens; identical to SEQ ID NO: 84264

SEQ ID NO: 368834 - RNA, 64 nt, Homo Sapiens; identical to SEQ ID NO: 84265

SEQ ID NO: 368835 - RNA, 64 nt, Homo Sapiens; identical to SEQ ID NO: 84266

SEQ ID NO: 368836 - RNA, 64 nt, Homo Sapiens; identical to SEQ ID NO: 84267

SEQ ID NO: 368837 - RNA, 64 nt, Homo Sapiens; identical to SEQ ID NO: 84268

SEQ ID NO: 368838 - RNA, 64 nt, Homo Sapiens
auuacacaagcacagccgcccagugugcacaucaugugcagacaccuuggaaaccuuucccaag

SEQ ID NO: 368839 - RNA, 64 nt, Homo Sapiens
aggcaagggcuggucuucaggauggaggccagccugugcagaaggcugcagcugacaacagcga

SEQ ID NO: 368840 - RNA, 64 nt, Homo Sapiens
cucuuuaauuuaauuagaucauaguuucuuuugaugugcagaagugagccaccacaucuggcca

SEQ ID NO: 368841 - RNA, 64 nt, Homo Sapiens
auuuuaucacacaauuauuaucauggggguuuggugugcagauauuacauagguaaacugcaug

SEQ ID NO: 368842 - RNA, 64 nt, Homo Sapiens
cggagcugcaccgagggcaaccaggacagcugugugugcagaccucauguguuggguucucucc

SEQ ID NO: 368843 - RNA, 64 nt, Homo Sapiens
agucauuuuucuguguaccagguugccuaaaucaugugcagaugguucuaaaaaaaaaaaaaaa

SEQ ID NO: 368844 - RNA, 64 nt, Homo Sapiens
guccagguccuuuagucagcgucacuccaucugaugugcagaagcugggcugcaccugcggggg

SEQ ID NO: 368845 - RNA, 64 nt, Homo Sapiens
cuugugguguugccagacgggccucauggucugcugugcagagagaggcaggaaggaucccuga

SEQ ID NO: 368846 - RNA, 64 nt, Homo Sapiens
cuuugcccaggcuucucacccacacacaccugucugugcagaugugggaccuggugggcucaac

SEQ ID NO: 368847 - RNA, 64 nt, Homo Sapiens
ucuaggcagcaccuuagggaggaguaagaaugugugugcagaauagaaagcccugugcuuuggg

SEQ ID NO: 368848 - RNA, 64 nt, Homo Sapiens
gaauuguuuaaauuugcuaguggauuuugucuaaugugcagaaauauauaugucuaaugugcag

SEQ ID NO: 368849 - RNA, 64 nt, Homo Sapiens
auuuugucuaaugugcagaaauauauaugucuaaugugcagaaauauauauguguguaugugug

SEQ ID NO: 368850 - RNA, 64 nt, Homo Sapiens
uaggaagaaauuuuuuucagugcuguaauuauccugugcagaacgggacuuuucccaugucuuc

SEQ ID NO: 368851 - RNA, 64 nt, Homo Sapiens
ggugauguugggauggaaaagaagaauuuuuagcugugcagauaguaaaagaagcagauugaau

SEQ ID NO: 368852 - RNA, 64 nt, Homo Sapiens
uuuaugaaguggugaaauuuuuauuuacucagugugugcagauauaaggcuaugugauagaggg

SEQ ID NO: 368853 - RNA, 64 nt, Homo Sapiens
gcauaaaagcaaaucaacacuucuaccugcaagaugugcagagguuucccucagcugacuggug

SEQ ID NO: 368854 - RNA, 64 nt, Homo Sapiens
ccugugcaguguugcuaccagcaagaaugaagguugugcagagcaguacugugagguaggcacc

SEQ ID NO: 368855 - RNA, 64 nt, Homo Sapiens
aguacugugagguaggcaccgugacucggcugccugugcagaagguggagguggcaggcggaug

SEQ ID NO: 368856 - RNA, 64 nt, Homo Sapiens
uugggaccuguuuuuuuucucauuugauuuugcuugugcagaaaauaguuuccagcacauggau

SEQ ID NO: 368857 - RNA, 64 nt, Homo Sapiens
gaugcccauuucuguggcuaaggcuuagguuuggugugcagagccuggccugcucuugugggcu

SEQ ID NO: 368858 - RNA, 64 nt, Homo Sapiens
cacaccccugcagcccugcaucccagcucuggggugugcagagguuugugucuccagggaaccc

SEQ ID NO: 368859 - RNA, 64 nt, Homo Sapiens
ggaacuggaguuugugagugagcagagcagguuaugugcagacagggaaacgagaacuuuggac

SEQ ID NO: 368860 - RNA, 64 nt, Homo Sapiens
gccagaggacuagaggccaagcagauuacaucaaugugcagaaaacucuuaccaaaaugagugu

SEQ ID NO: 368861 - RNA, 64 nt, Homo Sapiens
acaucaaugugcagaaagcccuuaccaaaaugagugugcagauuuucaaggaagacacaagacu

SEQ ID NO: 368862 - RNA, 64 nt, Homo Sapiens
uuauugauaucuuuguaguagcuuuuuuuaaaagacuaccaaaauguaugguuguccuuuuuuu

SEQ ID NO: 368863 - RNA, 64 nt, Homo Sapiens
uauguagucauuggcaacaauugcauacaauuuuacuaccaagagaagguauaguauggaaagu

SEQ ID NO: 368864 - RNA, 64 nt, Homo Sapiens; identical to SEQ ID NO: 189745

SEQ ID NO: 368865 - RNA, 64 nt, Homo Sapiens; identical to SEQ ID NO: 189746

SEQ ID NO: 368866 - RNA, 64 nt, Homo Sapiens; identical to SEQ ID NO: 189747

SEQ ID NO: 368867 - RNA, 64 nt, Homo Sapiens; identical to SEQ ID NO: 189748

SEQ ID NO: 368868 - RNA, 64 nt, Homo Sapiens; identical to SEQ ID NO: 189749

SEQ ID NO: 368869 - RNA, 55 nt, Homo Sapiens; identical to SEQ ID NO: 189750

SEQ ID NO: 368870 - RNA, 64 nt, Homo Sapiens; identical to SEQ ID NO: 189751

SEQ ID NO: 368871 - RNA, 64 nt, Homo Sapiens; identical to SEQ ID NO: 189752

SEQ ID NO: 368872 - RNA, 64 nt, Homo Sapiens; identical to SEQ ID NO: 189753

SEQ ID NO: 368873 - RNA, 64 nt, Homo Sapiens; identical to SEQ ID NO: 189754

SEQ ID NO: 368874 - RNA, 64 nt, Homo Sapiens; identical to SEQ ID NO: 189755

SEQ ID NO: 368875 - RNA, 64 nt, Homo Sapiens; identical to SEQ ID NO: 189756

SEQ ID NO: 368876 - RNA, 64 nt, Homo Sapiens
agucccuccugauuuugugugugugugucuguguuuaagcaagcguucgguugguauaguuuuu

SEQ ID NO: 368877 - RNA, 64 nt, Homo Sapiens
aauauugcaguuggaauucuugcuguauuauuuuuuaagcaaguguuaggugcauuuaacugcu

SEQ ID NO: 368878 - RNA, 64 nt, Homo Sapiens
augcuauaauaaaaacaaaacugcuugcuguaaauuaagcaaacaacaagacccagcuuauuuu

SEQ ID NO: 368879 - RNA, 64 nt, Homo Sapiens
gucacaucuuuugagcuuucaggauuagucaguuuuaagcaagauuuaagguaauuuggggaaa

SEQ ID NO: 368880 - RNA, 64 nt, Homo Sapiens
ucuagagauuuucuuggcaguauuccaugggauguuaagcaaaggaaaccaaaggaaucguuuc

SEQ ID NO: 368881 - RNA, 64 nt, Homo Sapiens
cuugugcugagaauagugucugauuauacgacuuuuaagcaaaguuggguguaauuaggugaaa

SEQ ID NO: 368882 - RNA, 64 nt, Homo Sapiens
uuccuagcaucccaaagcagucaacagugauuucuuaagcaauuugaucuguaccuuuacuugu

SEQ ID NO: 368883 - RNA, 64 nt, Homo Sapiens
uuugcuuagugugaauucuggcacuuuaaaaagauuaagcaagugaaauucugcugcccuccac

SEQ ID NO: 368884 - RNA, 64 nt, Homo Sapiens
ucucuagugugucggacacaggcaaaacuacucauuaagcaauuaugacaaguauuacuuuuug

SEQ ID NO: 368885 - RNA, 64 nt, Homo Sapiens
uuaucuauguggacugcuuacaucguggcaauccuuaagcaacaguaaaaagaauaacagaaug

SEQ ID NO: 368886 - RNA, 64 nt, Homo Sapiens
uuuccuuuuuuguuuuuuuuguuuuguuuuguuuuuaagcaaagaugaagggaaaacgaacuaa

SEQ ID NO: 368887 - RNA, 64 nt, Homo Sapiens
agauugcaaacuggaaauguaaaacucaugaaauuuaagcaauauagguuuagcuaucuguguu

SEQ ID NO: 368888 - RNA, 64 nt, Homo Sapiens
uaaaguaguaaaagaaaaacaagcauuugugcuuuuaagcaaauuaggaaguuacugcaagcac

SEQ ID NO: 368889 - RNA, 64 nt, Homo Sapiens
acuguagcaaaagccacuucuuucacuugugccauuaagcaagcaguguuugccuuauucagcu

SEQ ID NO: 368890 - RNA, 64 nt, Homo Sapiens
cuggcuuuguaguccugaugaauuuggggaaaguuuaagcaaauugugaucuauaaaaaaucau

SEQ ID NO: 368891 - RNA, 51 nt, Homo Sapiens
auguaacuggucuugacuugauuaagcaacaacuuggccucuuaucgauga

SEQ ID NO: 368892 - RNA, 64 nt, Homo Sapiens
uuuuaaaaauauuuuuuaucuauuuacuguguguuuaagcaagcaacagugcacugaucuggua

SEQ ID NO: 368893 - RNA, 64 nt, Homo Sapiens
gucuguuguguucagcugagaugcaaaaaagaaauuaagcaaaaaagaaaaagaugaagacuuu

SEQ ID NO: 368894 - RNA, 64 nt, Homo Sapiens
uuguuuguuuguuugcaauacacucagugcagccuuaagcaaaugagaucauuuucagauuuca

SEQ ID NO: 368895 - RNA, 64 nt, Homo Sapiens
uaacucuuuccaaccguagcaggguuguuuucuguuaagcaaagccgagauccagugcaauacc

SEQ ID NO: 368896 - RNA, 64 nt, Homo Sapiens
uggugcaucuguggauagaauccaacagugaggguuaagcaacaaacuggaaacaaucuagaua

SEQ ID NO: 368897 - RNA, 64 nt, Homo Sapiens
acuuuucauguuggggugggcauauauuauuuauuuaagcaauucaucuaggccugggcaggaa

SEQ ID NO: 368898 - RNA, 64 nt, Homo Sapiens
cuaagcacugcucuaaaaucuuauauuaauuuuauuaagcaaggguucgccagagaaacagaac

SEQ ID NO: 368899 - RNA, 64 nt, Homo Sapiens
aaaaaaaaaagagagggcggggacaaauaucaaauuaagcaaguaaagaaaaagaacagguaag

SEQ ID NO: 368900 - RNA, 64 nt, Homo Sapiens
guugcauauccaaaccuuagugaguuuugaagcuuuaagcaaauucuuuuaaaaaauucuugua

SEQ ID NO: 368901 - RNA, 64 nt, Homo Sapiens
uucuuguauuucuagcauuacuagauauuaaaaguuaagcaaauagauuaaugacguauacaua

SEQ ID NO: 368902 - RNA, 64 nt, Homo Sapiens
ucaagaaccagaaauaaauaaggauggugauagagagcuagaaaauuuuauggcuaucgaagaa

SEQ ID NO: 368903 - RNA, 64 nt, Homo Sapiens
uacguugcgggaagaaauugccaugcuaagacuggagcuagacacaaugaaacaucagagccag

SEQ ID NO: 368904 - RNA, 64 nt, Homo Sapiens
cugccucaggucaggccagggcagugcugcugcagagcuagaaggcccugcagcuacagcugcu

SEQ ID NO: 368905 - RNA, 64 nt, Homo Sapiens
cguuccagaacuugcauacacugagcgggcuacagagcuagaaggcccugcagcuacagcugcu

SEQ ID NO: 368906 - RNA, 64 nt, Homo Sapiens
auugguuuccuugcuucccuaagaggcagagcaagagcuagagaauugggggguggaggagaau

SEQ ID NO: 368907 - RNA, 64 nt, Homo Sapiens
aagcccuccaaacuggcccccuacagagacuauagagcuagacaggaccgguguugguaggugc

SEQ ID NO: 368908 - RNA, 64 nt, Homo Sapiens
ucccaccuaugucuuuccaaccuccagggcugcugagcuagaauugagcccuguuccugcucuc

SEQ ID NO: 368909 - RNA, 64 nt, Homo Sapiens
cccugcucccccuguccccaaacagcuacacagggagcuagaacguuaggaagagagacuuggg

SEQ ID NO: 368910 - RNA, 64 nt, Homo Sapiens
cacuugauaaaugaauauuuauuagcugguuggagagcuagaaccuggagagcuagaaccugga

SEQ ID NO: 368911 - RNA, 64 nt, Homo Sapiens
uauuuauuagcugguuggagagcuagaaccuggagagcuagaaccuggagaacuagaaccugga

SEQ ID NO: 368912 - RNA, 64 nt, Homo Sapiens
cuggaggggcuagaaccuagagaagcuaaaaccugagcuagaagcuggaggacuagaaccugga

SEQ ID NO: 368913 - RNA, 64 nt, Homo Sapiens
uggaggacuagaaccuggagggcuggaaucuggagagcuagaaccuggagggcuagaaccugga

SEQ ID NO: 368914 - RNA, 64 nt, Homo Sapiens
uggagggcuagaaccuggagggcuagaaucuggagagcuagaaccuggagggcuagaaucugga

SEQ ID NO: 368915 - RNA, 64 nt, Homo Sapiens
uggagagcuagaaccuggagggcuagaaucuggagagcuagaaccuggagggcuagaaccugga

SEQ ID NO: 368916 - RNA, 64 nt, Homo Sapiens
uggagagcuagaaccuggagggcuagaaccuggagagcuagaaccuagaagggcuagaaccugg

SEQ ID NO: 368917 - RNA, 64 nt, Homo Sapiens
agaagggcuagaaccuggagggcuggaaucuggagagcuagaaccuggagggcuagaaccugga

SEQ ID NO: 368918 - RNA, 64 nt, Homo Sapiens; identical to SEQ ID NO: 368917

SEQ ID NO: 368919 - RNA, 64 nt, Homo Sapiens
ggagggcuagaaccuggaagggcuagaaccuguagagcuagaacauggagagcuagaacccggc

SEQ ID NO: 368920 - RNA, 64 nt, Homo Sapiens
ggaagggcuagaaccuguagagcuagaacauggagagcuagaacccggcaggcuagaaccuggc

SEQ ID NO: 368921 - RNA, 64 nt, Homo Sapiens; identical to SEQ ID NO: 368876

SEQ ID NO: 368922 - RNA, 64 nt, Homo Sapiens; identical to SEQ ID NO: 368877

SEQ ID NO: 368923 - RNA, 64 nt, Homo Sapiens; identical to SEQ ID NO: 368878

SEQ ID NO: 368924 - RNA, 64 nt, Homo Sapiens; identical to SEQ ID NO: 368879

SEQ ID NO: 368925 - RNA, 64 nt, Homo Sapiens; identical to SEQ ID NO: 368880

SEQ ID NO: 368926 - RNA, 64 nt, Homo Sapiens; identical to SEQ ID NO: 368881

SEQ ID NO: 368927 - RNA, 64 nt, Homo Sapiens; identical to SEQ ID NO: 368882

SEQ ID NO: 368928 - RNA, 64 nt, Homo Sapiens; identical to SEQ ID NO: 368883

SEQ ID NO: 368929 - RNA, 64 nt, Homo Sapiens; identical to SEQ ID NO: 368884

SEQ ID NO: 368930 - RNA, 64 nt, Homo Sapiens; identical to SEQ ID NO: 368885

SEQ ID NO: 368931 - RNA, 64 nt, Homo Sapiens; identical to SEQ ID NO: 368886

SEQ ID NO: 368932 - RNA, 64 nt, Homo Sapiens; identical to SEQ ID NO: 368887

SEQ ID NO: 368933 - RNA, 64 nt, Homo Sapiens; identical to SEQ ID NO: 368888

SEQ ID NO: 368934 - RNA, 64 nt, Homo Sapiens; identical to SEQ ID NO: 368889

SEQ ID NO: 368935 - RNA, 64 nt, Homo Sapiens; identical to SEQ ID NO: 368890

SEQ ID NO: 368936 - RNA, 51 nt, Homo Sapiens; identical to SEQ ID NO: 368891

SEQ ID NO: 368937 - RNA, 64 nt, Homo Sapiens; identical to SEQ ID NO: 368892

SEQ ID NO: 368938 - RNA, 64 nt, Homo Sapiens; identical to SEQ ID NO: 368893

SEQ ID NO: 368939 - RNA, 64 nt, Homo Sapiens; identical to SEQ ID NO: 368894

SEQ ID NO: 368940 - RNA, 64 nt, Homo Sapiens; identical to SEQ ID NO: 368895

SEQ ID NO: 368941 - RNA, 64 nt, Homo Sapiens; identical to SEQ ID NO: 368896

SEQ ID NO: 368942 - RNA, 64 nt, Homo Sapiens; identical to SEQ ID NO: 368897

SEQ ID NO: 368943 - RNA, 64 nt, Homo Sapiens; identical to SEQ ID NO: 368898

SEQ ID NO: 368944 - RNA, 64 nt, Homo Sapiens; identical to SEQ ID NO: 368899

SEQ ID NO: 368945 - RNA, 64 nt, Homo Sapiens; identical to SEQ ID NO: 368900

SEQ ID NO: 368946 - RNA, 64 nt, Homo Sapiens; identical to SEQ ID NO: 368901

SEQ ID NO: 368947 - RNA, 64 nt, Homo Sapiens; identical to SEQ ID NO: 368902

SEQ ID NO: 368948 - RNA, 64 nt, Homo Sapiens; identical to SEQ ID NO: 368903

SEQ ID NO: 368949 - RNA, 64 nt, Homo Sapiens; identical to SEQ ID NO: 368904

SEQ ID NO: 368950 - RNA, 64 nt, Homo Sapiens; identical to SEQ ID NO: 368905

SEQ ID NO: 368951 - RNA, 64 nt, Homo Sapiens; identical to SEQ ID NO: 368906

SEQ ID NO: 368952 - RNA, 64 nt, Homo Sapiens; identical to SEQ ID NO: 368907

SEQ ID NO: 368953 - RNA, 64 nt, Homo Sapiens; identical to SEQ ID NO: 368908

SEQ ID NO: 368954 - RNA, 64 nt, Homo Sapiens; identical to SEQ ID NO: 368909

SEQ ID NO: 368955 - RNA, 64 nt, Homo Sapiens; identical to SEQ ID NO: 368910

SEQ ID NO: 368956 - RNA, 64 nt, Homo Sapiens; identical to SEQ ID NO: 368911

SEQ ID NO: 368957 - RNA, 64 nt, Homo Sapiens; identical to SEQ ID NO: 368912

SEQ ID NO: 368958 - RNA, 64 nt, Homo Sapiens; identical to SEQ ID NO: 368913

SEQ ID NO: 368959 - RNA, 64 nt, Homo Sapiens; identical to SEQ ID NO: 368914

SEQ ID NO: 368960 - RNA, 64 nt, Homo Sapiens; identical to SEQ ID NO: 368915

SEQ ID NO: 368961 - RNA, 64 nt, Homo Sapiens; identical to SEQ ID NO: 368916

SEQ ID NO: 368962 - RNA, 64 nt, Homo Sapiens; identical to SEQ ID NO: 368917

SEQ ID NO: 368963 - RNA, 64 nt, Homo Sapiens; identical to SEQ ID NO: 368917

SEQ ID NO: 368964 - RNA, 64 nt, Homo Sapiens; identical to SEQ ID NO: 368919

SEQ ID NO: 368965 - RNA, 64 nt, Homo Sapiens; identical to SEQ ID NO: 368920

SEQ ID NO: 368966 - RNA, 64 nt, Homo Sapiens
aaaacagauggaagcuucguuguucucauagaaccaacagcaucugagcccucaacaccaacag

SEQ ID NO: 368967 - RNA, 64 nt, Homo Sapiens
cucauagaaccaacagcaucugagcccucaacaccaacagcaccauccucuguagcagacaggc

SEQ ID NO: 368968 - RNA, 64 nt, Homo Sapiens
cauuagauaccaucaacauccugcuguaugaugacaacagcaucaugaccuucaaccucaguca

SEQ ID NO: 368969 - RNA, 64 nt, Homo Sapiens
gcacccugcccaccagccccucggaagcaugugacaacagcagaggguacaccagggacaacag

SEQ ID NO: 368970 - RNA, 64 nt, Homo Sapiens
gugauguauuauuuucaaugugacugggaucacucaacagcacucuuuccauucucaaauccug

SEQ ID NO: 368971 - RNA, 64 nt, Homo Sapiens
guuauuguaguguggcaguuaggaauacuuggaacaacagcaguagggcuggugaggggcucag

SEQ ID NO: 368972 - RNA, 64 nt, Homo Sapiens
ucuuucuuuuuuuuuaaauuuuguauuuuccauccaacagcaguguguagagagaauauuaugc

SEQ ID NO: 368973 - RNA, 64 nt, Homo Sapiens
cuauccuuucuccaccauggacucaaucugagaacaacagcauucauuuccauucauuuccaua

SEQ ID NO: 368974 - RNA, 64 nt, Homo Sapiens
aaccauuguauuuaauuucccaccuuaugaaacacaacagcagcucccugacugguucgccuuu

SEQ ID NO: 368975 - RNA, 64 nt, Homo Sapiens
acaaaugcuguuaaaucaccuuaugcgucguuuucaacagcaguggggcuaauuacccggaaua

SEQ ID NO: 368976 - RNA, 64 nt, Homo Sapiens
cagcagccugugaagauuuuaauauaauuaaaagcaacagcaaguaaaauuucaaaguuuaauu

SEQ ID NO: 368977 - RNA, 64 nt, Homo Sapiens
aacacgaagaugauaccaaaagaggaaaaagcaacaacagcaacaguuuguuugaauguguaga

SEQ ID NO: 368978 - RNA, 64 nt, Homo Sapiens
aaagcuggaauagaaaaccuguuuaaaaccaucacaacagcaauauuuuuauucugggccaccu

SEQ ID NO: 368979 - RNA, 64 nt, Homo Sapiens
cucaucccaugguaaaauauucaaguaacuaagacaacagcauggcauuuauuugugugagugu

SEQ ID NO: 368980 - RNA, 64 nt, Homo Sapiens
gcggcucccucuggcaggaaauccccguggugcgcaacagcaccgugcugcucuccaugaccca

SEQ ID NO: 368981 - RNA, 64 nt, Homo Sapiens
aucaggaacgcaccuuccagagccugaugaauagcaacagcaauuuccgggaggucuuggagaa

SEQ ID NO: 368982 - RNA, 64 nt, Homo Sapiens
agagccaggcagucacuguuaguugagccagcgacaacagcaccgccauccccaguucuuagcc

SEQ ID NO: 368983 - RNA, 64 nt, Homo Sapiens
gcuuuggccaagcccuugucccuuugaaacuucccaacagcaggucaagccucagaagccaacu

SEQ ID NO: 368984 - RNA, 64 nt, Homo Sapiens
auaaaaucccaacaacuauuacaaaccaaaccgucaacagcauaucaacagcaaacaaaaccac

SEQ ID NO: 368985 - RNA, 64 nt, Homo Sapiens
caaaaccacacaaaccaaacaagagagaaaaaaucaacagcaaaggcauagccaugcugguagc

SEQ ID NO: 368986 - RNA, 64 nt, Homo Sapiens
cucuccagaugcagccccauaugagaguacaccccaacagcacccccaacagcacccucuccag

SEQ ID NO: 368987 - RNA, 64 nt, Homo Sapiens
cucuccagaugagaguacacaugagaguacaccccaacagcacccccaacagcacccucuccag

SEQ ID NO: 368988 - RNA, 64 nt, Homo Sapiens; identical to SEQ ID NO: 368987

SEQ ID NO: 368989 - RNA, 64 nt, Homo Sapiens
cucuccagaugagaguacacgaugggagugcccccaacagcaccccccaacagcacccucucca

SEQ ID NO: 368990 - RNA, 64 nt, Homo Sapiens
cucuccagaugggagugcccccaggaguacaccccaacagcaccccucuauggccccugccuuc

SEQ ID NO: 368991 - RNA, 64 nt, Homo Sapiens; identical to SEQ ID NO: 236646

SEQ ID NO: 368992 - RNA, 64 nt, Homo Sapiens; identical to SEQ ID NO: 236647

SEQ ID NO: 368993 - RNA, 64 nt, Homo Sapiens; identical to SEQ ID NO: 236648

SEQ ID NO: 368994 - RNA, 64 nt, Homo Sapiens; identical to SEQ ID NO: 236649

SEQ ID NO: 368995 - RNA, 64 nt, Homo Sapiens; identical to SEQ ID NO: 236650

SEQ ID NO: 368996 - RNA, 64 nt, Homo Sapiens; identical to SEQ ID NO: 236651

SEQ ID NO: 368997 - RNA, 64 nt, Homo Sapiens; identical to SEQ ID NO: 236652

SEQ ID NO: 368998 - RNA, 64 nt, Homo Sapiens; identical to SEQ ID NO: 236653

SEQ ID NO: 368999 - RNA, 64 nt, Homo Sapiens; identical to SEQ ID NO: 236654

SEQ ID NO: 369000 - RNA, 62 nt, Homo Sapiens; identical to SEQ ID NO: 236655

SEQ ID NO: 369001 - RNA, 64 nt, Homo Sapiens; identical to SEQ ID NO: 236656

SEQ ID NO: 369002 - RNA, 64 nt, Homo Sapiens; identical to SEQ ID NO: 236657

SEQ ID NO: 369003 - RNA, 64 nt, Homo Sapiens; identical to SEQ ID NO: 236658

SEQ ID NO: 369004 - RNA, 64 nt, Homo Sapiens; identical to SEQ ID NO: 236659

SEQ ID NO: 369005 - RNA, 64 nt, Homo Sapiens; identical to SEQ ID NO: 236660

SEQ ID NO: 369006 - RNA, 64 nt, Homo Sapiens; identical to SEQ ID NO: 236661

SEQ ID NO: 369007 - RNA, 50 nt, Homo Sapiens; identical to SEQ ID NO: 236662

SEQ ID NO: 369008 - RNA, 64 nt, Homo Sapiens; identical to SEQ ID NO: 236663

SEQ ID NO: 369009 - RNA, 64 nt, Homo Sapiens; identical to SEQ ID NO: 236664

SEQ ID NO: 369010 - RNA, 64 nt, Homo Sapiens; identical to SEQ ID NO: 236665

SEQ ID NO: 369011 - RNA, 64 nt, Homo Sapiens; identical to SEQ ID NO: 236666

SEQ ID NO: 369012 - RNA, 64 nt, Homo Sapiens; identical to SEQ ID NO: 236667

SEQ ID NO: 369013 - RNA, 64 nt, Homo Sapiens; identical to SEQ ID NO: 236668

SEQ ID NO: 369014 - RNA, 64 nt, Homo Sapiens; identical to SEQ ID NO: 236669

SEQ ID NO: 369015 - RNA, 64 nt, Homo Sapiens; identical to SEQ ID NO: 236670

SEQ ID NO: 369016 - RNA, 64 nt, Homo Sapiens; identical to SEQ ID NO: 236671

SEQ ID NO: 369017 - RNA, 64 nt, Homo Sapiens; identical to SEQ ID NO: 236672

SEQ ID NO: 369018 - RNA, 64 nt, Homo Sapiens; identical to SEQ ID NO: 236673

SEQ ID NO: 369019 - RNA, 64 nt, Homo Sapiens; identical to SEQ ID NO: 236674

SEQ ID NO: 369020 - RNA, 64 nt, Homo Sapiens; identical to SEQ ID NO: 236675

SEQ ID NO: 369021 - RNA, 64 nt, Homo Sapiens; identical to SEQ ID NO: 236676

SEQ ID NO: 369022 - RNA, 64 nt, Homo Sapiens; identical to SEQ ID NO: 236677

SEQ ID NO: 369023 - RNA, 64 nt, Homo Sapiens; identical to SEQ ID NO: 236678

SEQ ID NO: 369024 - RNA, 64 nt, Homo Sapiens; identical to SEQ ID NO: 236679

SEQ ID NO: 369025 - RNA, 64 nt, Homo Sapiens; identical to SEQ ID NO: 236680

SEQ ID NO: 369026 - RNA, 64 nt, Homo Sapiens; identical to SEQ ID NO: 236681

SEQ ID NO: 369027 - RNA, 64 nt, Homo Sapiens; identical to SEQ ID NO: 236682

SEQ ID NO: 369028 - RNA, 64 nt, Homo Sapiens; identical to SEQ ID NO: 236683

SEQ ID NO: 369029 - RNA, 64 nt, Homo Sapiens; identical to SEQ ID NO: 236684

SEQ ID NO: 369030 - RNA, 64 nt, Homo Sapiens; identical to SEQ ID NO: 236685

SEQ ID NO: 369031 - RNA, 64 nt, Homo Sapiens; identical to SEQ ID NO: 236686

SEQ ID NO: 369032 - RNA, 64 nt, Homo Sapiens; identical to SEQ ID NO: 236687

SEQ ID NO: 369033 - RNA, 64 nt, Homo Sapiens; identical to SEQ ID NO: 236688

SEQ ID NO: 369034 - RNA, 64 nt, Homo Sapiens; identical to SEQ ID NO: 236689

SEQ ID NO: 369035 - RNA, 64 nt, Homo Sapiens; identical to SEQ ID NO: 236690

SEQ ID NO: 369036 - RNA, 64 nt, Homo Sapiens; identical to SEQ ID NO: 236691

SEQ ID NO: 369037 - RNA, 64 nt, Homo Sapiens; identical to SEQ ID NO: 236692

SEQ ID NO: 369038 - RNA, 64 nt, Homo Sapiens; identical to SEQ ID NO: 162601

SEQ ID NO: 369039 - RNA, 64 nt, Homo Sapiens; identical to SEQ ID NO: 162602

SEQ ID NO: 369040 - RNA, 64 nt, Homo Sapiens; identical to SEQ ID NO: 162603

SEQ ID NO: 369041 - RNA, 64 nt, Homo Sapiens; identical to SEQ ID NO: 162604

SEQ ID NO: 369042 - RNA, 64 nt, Homo Sapiens; identical to SEQ ID NO: 162605

SEQ ID NO: 369043 - RNA, 64 nt, Homo Sapiens; identical to SEQ ID NO: 162606

SEQ ID NO: 369044 - RNA, 64 nt, Homo Sapiens; identical to SEQ ID NO: 162607

SEQ ID NO: 369045 - RNA, 64 nt, Homo Sapiens; identical to SEQ ID NO: 162608

SEQ ID NO: 369046 - RNA, 64 nt, Homo Sapiens; identical to SEQ ID NO: 162609

SEQ ID NO: 369047 - RNA, 64 nt, Homo Sapiens; identical to SEQ ID NO: 162610

SEQ ID NO: 369048 - RNA, 64 nt, Homo Sapiens; identical to SEQ ID NO: 162611

SEQ ID NO: 369049 - RNA, 64 nt, Homo Sapiens; identical to SEQ ID NO: 162612

SEQ ID NO: 369050 - RNA, 64 nt, Homo Sapiens; identical to SEQ ID NO: 162613

SEQ ID NO: 369051 - RNA, 64 nt, Homo Sapiens; identical to SEQ ID NO: 162614

SEQ ID NO: 369052 - RNA, 64 nt, Homo Sapiens; identical to SEQ ID NO: 162615

SEQ ID NO: 369053 - RNA, 64 nt, Homo Sapiens; identical to SEQ ID NO: 162616

SEQ ID NO: 369054 - RNA, 64 nt, Homo Sapiens; identical to SEQ ID NO: 162617

SEQ ID NO: 369055 - RNA, 64 nt, Homo Sapiens; identical to SEQ ID NO: 162618

SEQ ID NO: 369056 - RNA, 64 nt, Homo Sapiens; identical to SEQ ID NO: 162619

SEQ ID NO: 369057 - RNA, 64 nt, Homo Sapiens; identical to SEQ ID NO: 162620

SEQ ID NO: 369058 - RNA, 64 nt, Homo Sapiens; identical to SEQ ID NO: 162621

SEQ ID NO: 369059 - RNA, 64 nt, Homo Sapiens; identical to SEQ ID NO: 162622

SEQ ID NO: 369060 - RNA, 64 nt, Homo Sapiens; identical to SEQ ID NO: 162623

SEQ ID NO: 369061 - RNA, 64 nt, Homo Sapiens; identical to SEQ ID NO: 162624

SEQ ID NO: 369062 - RNA, 64 nt, Homo Sapiens; identical to SEQ ID NO: 162625

SEQ ID NO: 369063 - RNA, 64 nt, Homo Sapiens; identical to SEQ ID NO: 162626

SEQ ID NO: 369064 - RNA, 64 nt, Homo Sapiens; identical to SEQ ID NO: 162627

SEQ ID NO: 369065 - RNA, 64 nt, Homo Sapiens; identical to SEQ ID NO: 162628

SEQ ID NO: 369066 - RNA, 64 nt, Homo Sapiens; identical to SEQ ID NO: 162629

SEQ ID NO: 369067 - RNA, 64 nt, Homo Sapiens; identical to SEQ ID NO: 162630

SEQ ID NO: 369068 - RNA, 64 nt, Homo Sapiens; identical to SEQ ID NO: 162631

SEQ ID NO: 369069 - RNA, 64 nt, Homo Sapiens; identical to SEQ ID NO: 162632

SEQ ID NO: 369070 - RNA, 64 nt, Homo Sapiens; identical to SEQ ID NO: 162633

SEQ ID NO: 369071 - RNA, 64 nt, Homo Sapiens; identical to SEQ ID NO: 162634

SEQ ID NO: 369072 - RNA, 64 nt, Homo Sapiens; identical to SEQ ID NO: 162635

SEQ ID NO: 369073 - RNA, 64 nt, Homo Sapiens; identical to SEQ ID NO: 162636

SEQ ID NO: 369074 - RNA, 64 nt, Homo Sapiens; identical to SEQ ID NO: 162637

SEQ ID NO: 369075 - RNA, 64 nt, Homo Sapiens; identical to SEQ ID NO: 162638

SEQ ID NO: 369076 - RNA, 64 nt, Homo Sapiens; identical to SEQ ID NO: 162639

SEQ ID NO: 369077 - RNA, 64 nt, Homo Sapiens; identical to SEQ ID NO: 162640

SEQ ID NO: 369078 - RNA, 64 nt, Homo Sapiens; identical to SEQ ID NO: 162641

SEQ ID NO: 369079 - RNA, 64 nt, Homo Sapiens; identical to SEQ ID NO: 162642

SEQ ID NO: 369080 - RNA, 64 nt, Homo Sapiens; identical to SEQ ID NO: 162643

SEQ ID NO: 369081 - RNA, 64 nt, Homo Sapiens; identical to SEQ ID NO: 162644

SEQ ID NO: 369082 - RNA, 64 nt, Homo Sapiens; identical to SEQ ID NO: 162645

SEQ ID NO: 369083 - RNA, 64 nt, Homo Sapiens; identical to SEQ ID NO: 162646

SEQ ID NO: 369084 - RNA, 64 nt, Homo Sapiens; identical to SEQ ID NO: 162647

SEQ ID NO: 369085 - RNA, 64 nt, Homo Sapiens; identical to SEQ ID NO: 162648

SEQ ID NO: 369086 - RNA, 64 nt, Homo Sapiens; identical to SEQ ID NO: 162649

SEQ ID NO: 369087 - RNA, 64 nt, Homo Sapiens; identical to SEQ ID NO: 162650

SEQ ID NO: 369088 - RNA, 64 nt, Homo Sapiens; identical to SEQ ID NO: 162651

SEQ ID NO: 369089 - RNA, 64 nt, Homo Sapiens; identical to SEQ ID NO: 162652

SEQ ID NO: 369090 - RNA, 64 nt, Homo Sapiens; identical to SEQ ID NO: 162653

SEQ ID NO: 369091 - RNA, 64 nt, Homo Sapiens; identical to SEQ ID NO: 162654

SEQ ID NO: 369092 - RNA, 64 nt, Homo Sapiens; identical to SEQ ID NO: 162655

SEQ ID NO: 369093 - RNA, 64 nt, Homo Sapiens; identical to SEQ ID NO: 162656

SEQ ID NO: 369094 - RNA, 64 nt, Homo Sapiens; identical to SEQ ID NO: 162657

SEQ ID NO: 369095 - RNA, 64 nt, Homo Sapiens; identical to SEQ ID NO: 162658

SEQ ID NO: 369096 - RNA, 64 nt, Homo Sapiens; identical to SEQ ID NO: 162659

SEQ ID NO: 369097 - RNA, 64 nt, Homo Sapiens; identical to SEQ ID NO: 162660

SEQ ID NO: 369098 - RNA, 64 nt, Homo Sapiens; identical to SEQ ID NO: 162661

SEQ ID NO: 369099 - RNA, 64 nt, Homo Sapiens; identical to SEQ ID NO: 162662

SEQ ID NO: 369100 - RNA, 64 nt, Homo Sapiens; identical to SEQ ID NO: 162663

SEQ ID NO: 369101 - RNA, 64 nt, Homo Sapiens; identical to SEQ ID NO: 162664

SEQ ID NO: 369102 - RNA, 64 nt, Homo Sapiens; identical to SEQ ID NO: 162665

SEQ ID NO: 369103 - RNA, 64 nt, Homo Sapiens; identical to SEQ ID NO: 162666

SEQ ID NO: 369104 - RNA, 64 nt, Homo Sapiens; identical to SEQ ID NO: 162667

SEQ ID NO: 369105 - RNA, 64 nt, Homo Sapiens; identical to SEQ ID NO: 162668

SEQ ID NO: 369106 - RNA, 64 nt, Homo Sapiens; identical to SEQ ID NO: 162669

SEQ ID NO: 369107 - RNA, 64 nt, Homo Sapiens; identical to SEQ ID NO: 162670

SEQ ID NO: 369108 - RNA, 64 nt, Homo Sapiens; identical to SEQ ID NO: 162671

SEQ ID NO: 369109 - RNA, 64 nt, Homo Sapiens; identical to SEQ ID NO: 162672

SEQ ID NO: 369110 - RNA, 64 nt, Homo Sapiens; identical to SEQ ID NO: 162673

SEQ ID NO: 369111 - RNA, 64 nt, Homo Sapiens; identical to SEQ ID NO: 162674

SEQ ID NO: 369112 - RNA, 64 nt, Homo Sapiens; identical to SEQ ID NO: 162675

SEQ ID NO: 369113 - RNA, 64 nt, Homo Sapiens; identical to SEQ ID NO: 162676

SEQ ID NO: 369114 - RNA, 64 nt, Homo Sapiens; identical to SEQ ID NO: 162677

SEQ ID NO: 369115 - RNA, 64 nt, Homo Sapiens; identical to SEQ ID NO: 162678

SEQ ID NO: 369116 - RNA, 64 nt, Homo Sapiens; identical to SEQ ID NO: 162679

SEQ ID NO: 369117 - RNA, 64 nt, Homo Sapiens; identical to SEQ ID NO: 162680

SEQ ID NO: 369118 - RNA, 64 nt, Homo Sapiens; identical to SEQ ID NO: 162681

SEQ ID NO: 369119 - RNA, 64 nt, Homo Sapiens; identical to SEQ ID NO: 162682

SEQ ID NO: 369120 - RNA, 64 nt, Homo Sapiens; identical to SEQ ID NO: 162683

SEQ ID NO: 369121 - RNA, 64 nt, Homo Sapiens; identical to SEQ ID NO: 162684

SEQ ID NO: 369122 - RNA, 64 nt, Homo Sapiens; identical to SEQ ID NO: 162685

SEQ ID NO: 369123 - RNA, 64 nt, Homo Sapiens; identical to SEQ ID NO: 162686

SEQ ID NO: 369124 - RNA, 64 nt, Homo Sapiens; identical to SEQ ID NO: 162687

SEQ ID NO: 369125 - RNA, 64 nt, Homo Sapiens; identical to SEQ ID NO: 162688

SEQ ID NO: 369126 - RNA, 64 nt, Homo Sapiens; identical to SEQ ID NO: 162689

SEQ ID NO: 369127 - RNA, 64 nt, Homo Sapiens; identical to SEQ ID NO: 162690

SEQ ID NO: 369128 - RNA, 64 nt, Homo Sapiens; identical to SEQ ID NO: 162691

SEQ ID NO: 369129 - RNA, 64 nt, Homo Sapiens; identical to SEQ ID NO: 162692

SEQ ID NO: 369130 - RNA, 64 nt, Homo Sapiens; identical to SEQ ID NO: 162693

SEQ ID NO: 369131 - RNA, 64 nt, Homo Sapiens; identical to SEQ ID NO: 162694

SEQ ID NO: 369132 - RNA, 64 nt, Homo Sapiens; identical to SEQ ID NO: 162695

SEQ ID NO: 369133 - RNA, 64 nt, Homo Sapiens; identical to SEQ ID NO: 162696

SEQ ID NO: 369134 - RNA, 64 nt, Homo Sapiens; identical to SEQ ID NO: 162697

SEQ ID NO: 369135 - RNA, 64 nt, Homo Sapiens; identical to SEQ ID NO: 162698

SEQ ID NO: 369136 - RNA, 64 nt, Homo Sapiens; identical to SEQ ID NO: 162699

SEQ ID NO: 369137 - RNA, 64 nt, Homo Sapiens; identical to SEQ ID NO: 162700

SEQ ID NO: 369138 - RNA, 64 nt, Homo Sapiens; identical to SEQ ID NO: 162701

SEQ ID NO: 369139 - RNA, 64 nt, Homo Sapiens; identical to SEQ ID NO: 162702

SEQ ID NO: 369140 - RNA, 64 nt, Homo Sapiens; identical to SEQ ID NO: 162703

SEQ ID NO: 369141 - RNA, 64 nt, Homo Sapiens; identical to SEQ ID NO: 162704

SEQ ID NO: 369142 - RNA, 64 nt, Homo Sapiens; identical to SEQ ID NO: 162705

SEQ ID NO: 369143 - RNA, 64 nt, Homo Sapiens; identical to SEQ ID NO: 162706

SEQ ID NO: 369144 - RNA, 64 nt, Homo Sapiens; identical to SEQ ID NO: 162707

SEQ ID NO: 369145 - RNA, 64 nt, Homo Sapiens; identical to SEQ ID NO: 162708

SEQ ID NO: 369146 - RNA, 64 nt, Homo Sapiens; identical to SEQ ID NO: 162709

SEQ ID NO: 369147 - RNA, 64 nt, Homo Sapiens; identical to SEQ ID NO: 162710

SEQ ID NO: 369148 - RNA, 64 nt, Homo Sapiens; identical to SEQ ID NO: 162711

SEQ ID NO: 369149 - RNA, 64 nt, Homo Sapiens; identical to SEQ ID NO: 162712

SEQ ID NO: 369150 - RNA, 64 nt, Homo Sapiens; identical to SEQ ID NO: 162713

SEQ ID NO: 369151 - RNA, 64 nt, Homo Sapiens; identical to SEQ ID NO: 162714

SEQ ID NO: 369152 - RNA, 64 nt, Homo Sapiens; identical to SEQ ID NO: 162715

SEQ ID NO: 369153 - RNA, 64 nt, Homo Sapiens; identical to SEQ ID NO: 162716

SEQ ID NO: 369154 - RNA, 64 nt, Homo Sapiens; identical to SEQ ID NO: 162717

SEQ ID NO: 369155 - RNA, 64 nt, Homo Sapiens; identical to SEQ ID NO: 162718

SEQ ID NO: 369156 - RNA, 64 nt, Homo Sapiens; identical to SEQ ID NO: 162719

SEQ ID NO: 369157 - RNA, 64 nt, Homo Sapiens; identical to SEQ ID NO: 162720

SEQ ID NO: 369158 - RNA, 64 nt, Homo Sapiens; identical to SEQ ID NO: 162721

SEQ ID NO: 369159 - RNA, 64 nt, Homo Sapiens; identical to SEQ ID NO: 162722

SEQ ID NO: 369160 - RNA, 64 nt, Homo Sapiens; identical to SEQ ID NO: 162723

SEQ ID NO: 369161 - RNA, 64 nt, Homo Sapiens; identical to SEQ ID NO: 162724

SEQ ID NO: 369162 - RNA, 64 nt, Homo Sapiens; identical to SEQ ID NO: 162725

SEQ ID NO: 369163 - RNA, 64 nt, Homo Sapiens; identical to SEQ ID NO: 162726

SEQ ID NO: 369164 - RNA, 64 nt, Homo Sapiens; identical to SEQ ID NO: 162727

SEQ ID NO: 369165 - RNA, 64 nt, Homo Sapiens; identical to SEQ ID NO: 162728

SEQ ID NO: 369166 - RNA, 64 nt, Homo Sapiens; identical to SEQ ID NO: 162729

SEQ ID NO: 369167 - RNA, 64 nt, Homo Sapiens; identical to SEQ ID NO: 162730

SEQ ID NO: 369168 - RNA, 64 nt, Homo Sapiens; identical to SEQ ID NO: 162731

SEQ ID NO: 369169 - RNA, 64 nt, Homo Sapiens; identical to SEQ ID NO: 162732

SEQ ID NO: 369170 - RNA, 64 nt, Homo Sapiens; identical to SEQ ID NO: 162733

SEQ ID NO: 369171 - RNA, 64 nt, Homo Sapiens; identical to SEQ ID NO: 162734

SEQ ID NO: 369172 - RNA, 64 nt, Homo Sapiens; identical to SEQ ID NO: 162735

SEQ ID NO: 369173 - RNA, 64 nt, Homo Sapiens; identical to SEQ ID NO: 162736

SEQ ID NO: 369174 - RNA, 64 nt, Homo Sapiens; identical to SEQ ID NO: 162737

SEQ ID NO: 369175 - RNA, 64 nt, Homo Sapiens; identical to SEQ ID NO: 162738

SEQ ID NO: 369176 - RNA, 64 nt, Homo Sapiens; identical to SEQ ID NO: 162739

SEQ ID NO: 369177 - RNA, 64 nt, Homo Sapiens; identical to SEQ ID NO: 162740

SEQ ID NO: 369178 - RNA, 64 nt, Homo Sapiens; identical to SEQ ID NO: 162741

SEQ ID NO: 369179 - RNA, 64 nt, Homo Sapiens; identical to SEQ ID NO: 162742

SEQ ID NO: 369180 - RNA, 64 nt, Homo Sapiens; identical to SEQ ID NO: 162743

SEQ ID NO: 369181 - RNA, 64 nt, Homo Sapiens; identical to SEQ ID NO: 162744

SEQ ID NO: 369182 - RNA, 63 nt, Homo Sapiens; identical to SEQ ID NO: 162745

SEQ ID NO: 369183 - RNA, 64 nt, Homo Sapiens; identical to SEQ ID NO: 162746

SEQ ID NO: 369184 - RNA, 64 nt, Homo Sapiens; identical to SEQ ID NO: 162747

SEQ ID NO: 369185 - RNA, 64 nt, Homo Sapiens; identical to SEQ ID NO: 162748

SEQ ID NO: 369186 - RNA, 64 nt, Homo Sapiens; identical to SEQ ID NO: 162749

SEQ ID NO: 369187 - RNA, 64 nt, Homo Sapiens; identical to SEQ ID NO: 162750

SEQ ID NO: 369188 - RNA, 64 nt, Homo Sapiens; identical to SEQ ID NO: 162751

SEQ ID NO: 369189 - RNA, 64 nt, Homo Sapiens; identical to SEQ ID NO: 162752

SEQ ID NO: 369190 - RNA, 64 nt, Homo Sapiens; identical to SEQ ID NO: 162753

SEQ ID NO: 369191 - RNA, 64 nt, Homo Sapiens; identical to SEQ ID NO: 162754

SEQ ID NO: 369192 - RNA, 64 nt, Homo Sapiens; identical to SEQ ID NO: 162755

SEQ ID NO: 369193 - RNA, 64 nt, Homo Sapiens; identical to SEQ ID NO: 162756

SEQ ID NO: 369194 - RNA, 64 nt, Homo Sapiens; identical to SEQ ID NO: 162757

SEQ ID NO: 369195 - RNA, 64 nt, Homo Sapiens; identical to SEQ ID NO: 162758

SEQ ID NO: 369196 - RNA, 64 nt, Homo Sapiens; identical to SEQ ID NO: 162759

SEQ ID NO: 369197 - RNA, 64 nt, Homo Sapiens; identical to SEQ ID NO: 162760

SEQ ID NO: 369198 - RNA, 64 nt, Homo Sapiens; identical to SEQ ID NO: 162761

SEQ ID NO: 369199 - RNA, 64 nt, Homo Sapiens; identical to SEQ ID NO: 162762

SEQ ID NO: 369200 - RNA, 64 nt, Homo Sapiens; identical to SEQ ID NO: 162763

SEQ ID NO: 369201 - RNA, 64 nt, Homo Sapiens; identical to SEQ ID NO: 162764

SEQ ID NO: 369202 - RNA, 64 nt, Homo Sapiens; identical to SEQ ID NO: 162765

SEQ ID NO: 369203 - RNA, 64 nt, Homo Sapiens; identical to SEQ ID NO: 162766

SEQ ID NO: 369204 - RNA, 64 nt, Homo Sapiens; identical to SEQ ID NO: 162767

SEQ ID NO: 369205 - RNA, 64 nt, Homo Sapiens; identical to SEQ ID NO: 162768

SEQ ID NO: 369206 - RNA, 64 nt, Homo Sapiens; identical to SEQ ID NO: 162769

SEQ ID NO: 369207 - RNA, 64 nt, Homo Sapiens; identical to SEQ ID NO: 162770

SEQ ID NO: 369208 - RNA, 64 nt, Homo Sapiens; identical to SEQ ID NO: 162771

SEQ ID NO: 369209 - RNA, 64 nt, Homo Sapiens; identical to SEQ ID NO: 162772

SEQ ID NO: 369210 - RNA, 64 nt, Homo Sapiens; identical to SEQ ID NO: 162773

SEQ ID NO: 369211 - RNA, 64 nt, Homo Sapiens; identical to SEQ ID NO: 162774

SEQ ID NO: 369212 - RNA, 64 nt, Homo Sapiens; identical to SEQ ID NO: 162775

SEQ ID NO: 369213 - RNA, 64 nt, Homo Sapiens; identical to SEQ ID NO: 162776

SEQ ID NO: 369214 - RNA, 64 nt, Homo Sapiens; identical to SEQ ID NO: 162777

SEQ ID NO: 369215 - RNA, 64 nt, Homo Sapiens; identical to SEQ ID NO: 162778

SEQ ID NO: 369216 - RNA, 64 nt, Homo Sapiens; identical to SEQ ID NO: 162779

SEQ ID NO: 369217 - RNA, 64 nt, Homo Sapiens; identical to SEQ ID NO: 162780

SEQ ID NO: 369218 - RNA, 64 nt, Homo Sapiens; identical to SEQ ID NO: 162781

SEQ ID NO: 369219 - RNA, 64 nt, Homo Sapiens; identical to SEQ ID NO: 162782

SEQ ID NO: 369220 - RNA, 64 nt, Homo Sapiens; identical to SEQ ID NO: 162783

SEQ ID NO: 369221 - RNA, 64 nt, Homo Sapiens; identical to SEQ ID NO: 162784

SEQ ID NO: 369222 - RNA, 64 nt, Homo Sapiens; identical to SEQ ID NO: 162785

SEQ ID NO: 369223 - RNA, 64 nt, Homo Sapiens; identical to SEQ ID NO: 162786

SEQ ID NO: 369224 - RNA, 64 nt, Homo Sapiens; identical to SEQ ID NO: 162787

SEQ ID NO: 369225 - RNA, 64 nt, Homo Sapiens; identical to SEQ ID NO: 162788

SEQ ID NO: 369226 - RNA, 64 nt, Homo Sapiens; identical to SEQ ID NO: 162789

SEQ ID NO: 369227 - RNA, 64 nt, Homo Sapiens; identical to SEQ ID NO: 162790

SEQ ID NO: 369228 - RNA, 64 nt, Homo Sapiens; identical to SEQ ID NO: 162791

SEQ ID NO: 369229 - RNA, 64 nt, Homo Sapiens; identical to SEQ ID NO: 162792

SEQ ID NO: 369230 - RNA, 64 nt, Homo Sapiens; identical to SEQ ID NO: 162793

SEQ ID NO: 369231 - RNA, 64 nt, Homo Sapiens; identical to SEQ ID NO: 162794

SEQ ID NO: 369232 - RNA, 64 nt, Homo Sapiens; identical to SEQ ID NO: 162795

SEQ ID NO: 369233 - RNA, 64 nt, Homo Sapiens; identical to SEQ ID NO: 162796

SEQ ID NO: 369234 - RNA, 64 nt, Homo Sapiens; identical to SEQ ID NO: 162797

SEQ ID NO: 369235 - RNA, 64 nt, Homo Sapiens; identical to SEQ ID NO: 162798

SEQ ID NO: 369236 - RNA, 64 nt, Homo Sapiens; identical to SEQ ID NO: 162799

SEQ ID NO: 369237 - RNA, 64 nt, Homo Sapiens; identical to SEQ ID NO: 162800

SEQ ID NO: 369238 - RNA, 64 nt, Homo Sapiens; identical to SEQ ID NO: 162801

SEQ ID NO: 369239 - RNA, 64 nt, Homo Sapiens; identical to SEQ ID NO: 162802

SEQ ID NO: 369240 - RNA, 64 nt, Homo Sapiens; identical to SEQ ID NO: 162803

SEQ ID NO: 369241 - RNA, 64 nt, Homo Sapiens; identical to SEQ ID NO: 162804

SEQ ID NO: 369242 - RNA, 64 nt, Homo Sapiens; identical to SEQ ID NO: 162805

SEQ ID NO: 369243 - RNA, 64 nt, Homo Sapiens; identical to SEQ ID NO: 162806

SEQ ID NO: 369244 - RNA, 64 nt, Homo Sapiens; identical to SEQ ID NO: 162807

SEQ ID NO: 369245 - RNA, 64 nt, Homo Sapiens; identical to SEQ ID NO: 162808

SEQ ID NO: 369246 - RNA, 64 nt, Homo Sapiens; identical to SEQ ID NO: 162809

SEQ ID NO: 369247 - RNA, 64 nt, Homo Sapiens; identical to SEQ ID NO: 162810

SEQ ID NO: 369248 - RNA, 64 nt, Homo Sapiens; identical to SEQ ID NO: 162811

SEQ ID NO: 369249 - RNA, 64 nt, Homo Sapiens; identical to SEQ ID NO: 162812

SEQ ID NO: 369250 - RNA, 64 nt, Homo Sapiens; identical to SEQ ID NO: 162813

SEQ ID NO: 369251 - RNA, 62 nt, Homo Sapiens; identical to SEQ ID NO: 162814

SEQ ID NO: 369252 - RNA, 64 nt, Homo Sapiens; identical to SEQ ID NO: 162815

SEQ ID NO: 369253 - RNA, 64 nt, Homo Sapiens; identical to SEQ ID NO: 162816

SEQ ID NO: 369254 - RNA, 64 nt, Homo Sapiens; identical to SEQ ID NO: 162817

SEQ ID NO: 369255 - RNA, 64 nt, Homo Sapiens; identical to SEQ ID NO: 162818

SEQ ID NO: 369256 - RNA, 64 nt, Homo Sapiens; identical to SEQ ID NO: 162819

SEQ ID NO: 369257 - RNA, 64 nt, Homo Sapiens; identical to SEQ ID NO: 162820

SEQ ID NO: 369258 - RNA, 64 nt, Homo Sapiens; identical to SEQ ID NO: 162821

SEQ ID NO: 369259 - RNA, 64 nt, Homo Sapiens; identical to SEQ ID NO: 162822

SEQ ID NO: 369260 - RNA, 64 nt, Homo Sapiens; identical to SEQ ID NO: 162823

SEQ ID NO: 369261 - RNA, 64 nt, Homo Sapiens; identical to SEQ ID NO: 162824

SEQ ID NO: 369262 - RNA, 64 nt, Homo Sapiens; identical to SEQ ID NO: 162825

SEQ ID NO: 369263 - RNA, 64 nt, Homo Sapiens; identical to SEQ ID NO: 162826

SEQ ID NO: 369264 - RNA, 64 nt, Homo Sapiens; identical to SEQ ID NO: 162827

SEQ ID NO: 369265 - RNA, 64 nt, Homo Sapiens; identical to SEQ ID NO: 162828

SEQ ID NO: 369266 - RNA, 64 nt, Homo Sapiens; identical to SEQ ID NO: 162829

SEQ ID NO: 369267 - RNA, 64 nt, Homo Sapiens; identical to SEQ ID NO: 162830

SEQ ID NO: 369268 - RNA, 64 nt, Homo Sapiens; identical to SEQ ID NO: 162831

SEQ ID NO: 369269 - RNA, 64 nt, Homo Sapiens; identical to SEQ ID NO: 162832

SEQ ID NO: 369270 - RNA, 64 nt, Homo Sapiens; identical to SEQ ID NO: 162833

SEQ ID NO: 369271 - RNA, 64 nt, Homo Sapiens; identical to SEQ ID NO: 162834

SEQ ID NO: 369272 - RNA, 64 nt, Homo Sapiens; identical to SEQ ID NO: 162835

SEQ ID NO: 369273 - RNA, 64 nt, Homo Sapiens; identical to SEQ ID NO: 162836

SEQ ID NO: 369274 - RNA, 64 nt, Homo Sapiens; identical to SEQ ID NO: 162837

SEQ ID NO: 369275 - RNA, 64 nt, Homo Sapiens; identical to SEQ ID NO: 162838

SEQ ID NO: 369276 - RNA, 64 nt, Homo Sapiens; identical to SEQ ID NO: 162839

SEQ ID NO: 369277 - RNA, 64 nt, Homo Sapiens; identical to SEQ ID NO: 162840

SEQ ID NO: 369278 - RNA, 64 nt, Homo Sapiens; identical to SEQ ID NO: 162841

SEQ ID NO: 369279 - RNA, 64 nt, Homo Sapiens; identical to SEQ ID NO: 162842

SEQ ID NO: 369280 - RNA, 64 nt, Homo Sapiens; identical to SEQ ID NO: 162843

SEQ ID NO: 369281 - RNA, 64 nt, Homo Sapiens; identical to SEQ ID NO: 162844

SEQ ID NO: 369282 - RNA, 64 nt, Homo Sapiens; identical to SEQ ID NO: 162845

SEQ ID NO: 369283 - RNA, 64 nt, Homo Sapiens; identical to SEQ ID NO: 162846

SEQ ID NO: 369284 - RNA, 64 nt, Homo Sapiens; identical to SEQ ID NO: 162847

SEQ ID NO: 369285 - RNA, 64 nt, Homo Sapiens; identical to SEQ ID NO: 162848

SEQ ID NO: 369286 - RNA, 64 nt, Homo Sapiens; identical to SEQ ID NO: 162849

SEQ ID NO: 369287 - RNA, 64 nt, Homo Sapiens; identical to SEQ ID NO: 162850

SEQ ID NO: 369288 - RNA, 64 nt, Homo Sapiens; identical to SEQ ID NO: 162851

SEQ ID NO: 369289 - RNA, 64 nt, Homo Sapiens; identical to SEQ ID NO: 162852

SEQ ID NO: 369290 - RNA, 64 nt, Homo Sapiens; identical to SEQ ID NO: 162853

SEQ ID NO: 369291 - RNA, 64 nt, Homo Sapiens; identical to SEQ ID NO: 162854

SEQ ID NO: 369292 - RNA, 64 nt, Homo Sapiens; identical to SEQ ID NO: 162855

SEQ ID NO: 369293 - RNA, 64 nt, Homo Sapiens; identical to SEQ ID NO: 162856

SEQ ID NO: 369294 - RNA, 64 nt, Homo Sapiens; identical to SEQ ID NO: 162857

SEQ ID NO: 369295 - RNA, 64 nt, Homo Sapiens; identical to SEQ ID NO: 162858

SEQ ID NO: 369296 - RNA, 64 nt, Homo Sapiens; identical to SEQ ID NO: 162859

SEQ ID NO: 369297 - RNA, 64 nt, Homo Sapiens; identical to SEQ ID NO: 162860

SEQ ID NO: 369298 - RNA, 64 nt, Homo Sapiens; identical to SEQ ID NO: 162861

SEQ ID NO: 369299 - RNA, 64 nt, Homo Sapiens; identical to SEQ ID NO: 162862

SEQ ID NO: 369300 - RNA, 64 nt, Homo Sapiens; identical to SEQ ID NO: 162863

SEQ ID NO: 369301 - RNA, 64 nt, Homo Sapiens; identical to SEQ ID NO: 162864

SEQ ID NO: 369302 - RNA, 64 nt, Homo Sapiens; identical to SEQ ID NO: 162865

SEQ ID NO: 369303 - RNA, 64 nt, Homo Sapiens; identical to SEQ ID NO: 162866

SEQ ID NO: 369304 - RNA, 64 nt, Homo Sapiens; identical to SEQ ID NO: 162867

SEQ ID NO: 369305 - RNA, 64 nt, Homo Sapiens; identical to SEQ ID NO: 162868

SEQ ID NO: 369306 - RNA, 64 nt, Homo Sapiens; identical to SEQ ID NO: 162869

SEQ ID NO: 369307 - RNA, 64 nt, Homo Sapiens; identical to SEQ ID NO: 162870

SEQ ID NO: 369308 - RNA, 64 nt, Homo Sapiens; identical to SEQ ID NO: 162871

SEQ ID NO: 369309 - RNA, 64 nt, Homo Sapiens; identical to SEQ ID NO: 162872

SEQ ID NO: 369310 - RNA, 64 nt, Homo Sapiens; identical to SEQ ID NO: 162873

SEQ ID NO: 369311 - RNA, 64 nt, Homo Sapiens; identical to SEQ ID NO: 162874

SEQ ID NO: 369312 - RNA, 64 nt, Homo Sapiens; identical to SEQ ID NO: 162875

SEQ ID NO: 369313 - RNA, 64 nt, Homo Sapiens; identical to SEQ ID NO: 162876

SEQ ID NO: 369314 - RNA, 64 nt, Homo Sapiens; identical to SEQ ID NO: 162877

SEQ ID NO: 369315 - RNA, 64 nt, Homo Sapiens; identical to SEQ ID NO: 162878

SEQ ID NO: 369316 - RNA, 64 nt, Homo Sapiens; identical to SEQ ID NO: 162879

SEQ ID NO: 369317 - RNA, 64 nt, Homo Sapiens; identical to SEQ ID NO: 162880

SEQ ID NO: 369318 - RNA, 64 nt, Homo Sapiens; identical to SEQ ID NO: 162881

SEQ ID NO: 369319 - RNA, 64 nt, Homo Sapiens; identical to SEQ ID NO: 162882

SEQ ID NO: 369320 - RNA, 64 nt, Homo Sapiens; identical to SEQ ID NO: 162883

SEQ ID NO: 369321 - RNA, 64 nt, Homo Sapiens; identical to SEQ ID NO: 162884

SEQ ID NO: 369322 - RNA, 64 nt, Homo Sapiens; identical to SEQ ID NO: 162885

SEQ ID NO: 369323 - RNA, 64 nt, Homo Sapiens; identical to SEQ ID NO: 162886

SEQ ID NO: 369324 - RNA, 64 nt, Homo Sapiens; identical to SEQ ID NO: 162887

SEQ ID NO: 369325 - RNA, 64 nt, Homo Sapiens; identical to SEQ ID NO: 162888

SEQ ID NO: 369326 - RNA, 64 nt, Homo Sapiens; identical to SEQ ID NO: 162889

SEQ ID NO: 369327 - RNA, 64 nt, Homo Sapiens; identical to SEQ ID NO: 162890

SEQ ID NO: 369328 - RNA, 64 nt, Homo Sapiens; identical to SEQ ID NO: 162891

SEQ ID NO: 369329 - RNA, 64 nt, Homo Sapiens; identical to SEQ ID NO: 162892

SEQ ID NO: 369330 - RNA, 64 nt, Homo Sapiens; identical to SEQ ID NO: 162893

SEQ ID NO: 369331 - RNA, 64 nt, Homo Sapiens; identical to SEQ ID NO: 162894

SEQ ID NO: 369332 - RNA, 64 nt, Homo Sapiens; identical to SEQ ID NO: 162895

SEQ ID NO: 369333 - RNA, 64 nt, Homo Sapiens; identical to SEQ ID NO: 162896

SEQ ID NO: 369334 - RNA, 64 nt, Homo Sapiens; identical to SEQ ID NO: 162897

SEQ ID NO: 369335 - RNA, 64 nt, Homo Sapiens; identical to SEQ ID NO: 162898

SEQ ID NO: 369336 - RNA, 64 nt, Homo Sapiens; identical to SEQ ID NO: 162899

SEQ ID NO: 369337 - RNA, 64 nt, Homo Sapiens; identical to SEQ ID NO: 162900

SEQ ID NO: 369338 - RNA, 64 nt, Homo Sapiens; identical to SEQ ID NO: 162901

SEQ ID NO: 369339 - RNA, 64 nt, Homo Sapiens; identical to SEQ ID NO: 162902

SEQ ID NO: 369340 - RNA, 64 nt, Homo Sapiens; identical to SEQ ID NO: 162903

SEQ ID NO: 369341 - RNA, 64 nt, Homo Sapiens; identical to SEQ ID NO: 162904

SEQ ID NO: 369342 - RNA, 64 nt, Homo Sapiens; identical to SEQ ID NO: 162905

SEQ ID NO: 369343 - RNA, 64 nt, Homo Sapiens; identical to SEQ ID NO: 162906

SEQ ID NO: 369344 - RNA, 64 nt, Homo Sapiens; identical to SEQ ID NO: 162907

SEQ ID NO: 369345 - RNA, 64 nt, Homo Sapiens; identical to SEQ ID NO: 162908

SEQ ID NO: 369346 - RNA, 64 nt, Homo Sapiens; identical to SEQ ID NO: 162909

SEQ ID NO: 369347 - RNA, 64 nt, Homo Sapiens; identical to SEQ ID NO: 162910

SEQ ID NO: 369348 - RNA, 64 nt, Homo Sapiens; identical to SEQ ID NO: 162911

SEQ ID NO: 369349 - RNA, 64 nt, Homo Sapiens; identical to SEQ ID NO: 162912

SEQ ID NO: 369350 - RNA, 64 nt, Homo Sapiens; identical to SEQ ID NO: 162913

SEQ ID NO: 369351 - RNA, 64 nt, Homo Sapiens; identical to SEQ ID NO: 162914

SEQ ID NO: 369352 - RNA, 64 nt, Homo Sapiens; identical to SEQ ID NO: 162915

SEQ ID NO: 369353 - RNA, 64 nt, Homo Sapiens; identical to SEQ ID NO: 162916

SEQ ID NO: 369354 - RNA, 64 nt, Homo Sapiens; identical to SEQ ID NO: 162917

SEQ ID NO: 369355 - RNA, 64 nt, Homo Sapiens; identical to SEQ ID NO: 162918

SEQ ID NO: 369356 - RNA, 64 nt, Homo Sapiens; identical to SEQ ID NO: 162919

SEQ ID NO: 369357 - RNA, 64 nt, Homo Sapiens; identical to SEQ ID NO: 162920

SEQ ID NO: 369358 - RNA, 64 nt, Homo Sapiens; identical to SEQ ID NO: 162921

SEQ ID NO: 369359 - RNA, 64 nt, Homo Sapiens; identical to SEQ ID NO: 162922

SEQ ID NO: 369360 - RNA, 53 nt, Homo Sapiens; identical to SEQ ID NO: 162923

SEQ ID NO: 369361 - RNA, 64 nt, Homo Sapiens; identical to SEQ ID NO: 162924

SEQ ID NO: 369362 - RNA, 64 nt, Homo Sapiens; identical to SEQ ID NO: 162925

SEQ ID NO: 369363 - RNA, 64 nt, Homo Sapiens; identical to SEQ ID NO: 162926

SEQ ID NO: 369364 - RNA, 64 nt, Homo Sapiens; identical to SEQ ID NO: 162927

SEQ ID NO: 369365 - RNA, 64 nt, Homo Sapiens; identical to SEQ ID NO: 162928

SEQ ID NO: 369366 - RNA, 64 nt, Homo Sapiens; identical to SEQ ID NO: 162929

SEQ ID NO: 369367 - RNA, 64 nt, Homo Sapiens; identical to SEQ ID NO: 162930

SEQ ID NO: 369368 - RNA, 64 nt, Homo Sapiens; identical to SEQ ID NO: 162931

SEQ ID NO: 369369 - RNA, 64 nt, Homo Sapiens; identical to SEQ ID NO: 162932

SEQ ID NO: 369370 - RNA, 64 nt, Homo Sapiens; identical to SEQ ID NO: 162933

SEQ ID NO: 369371 - RNA, 64 nt, Homo Sapiens; identical to SEQ ID NO: 162934

SEQ ID NO: 369372 - RNA, 64 nt, Homo Sapiens; identical to SEQ ID NO: 162935

SEQ ID NO: 369373 - RNA, 64 nt, Homo Sapiens; identical to SEQ ID NO: 162936

SEQ ID NO: 369374 - RNA, 64 nt, Homo Sapiens; identical to SEQ ID NO: 162937

SEQ ID NO: 369375 - RNA, 64 nt, Homo Sapiens; identical to SEQ ID NO: 162938

SEQ ID NO: 369376 - RNA, 64 nt, Homo Sapiens; identical to SEQ ID NO: 162939

SEQ ID NO: 369377 - RNA, 64 nt, Homo Sapiens; identical to SEQ ID NO: 162940

SEQ ID NO: 369378 - RNA, 64 nt, Homo Sapiens; identical to SEQ ID NO: 162941

SEQ ID NO: 369379 - RNA, 64 nt, Homo Sapiens; identical to SEQ ID NO: 162942

SEQ ID NO: 369380 - RNA, 64 nt, Homo Sapiens; identical to SEQ ID NO: 162943

SEQ ID NO: 369381 - RNA, 64 nt, Homo Sapiens; identical to SEQ ID NO: 162944

SEQ ID NO: 369382 - RNA, 64 nt, Homo Sapiens; identical to SEQ ID NO: 162945

SEQ ID NO: 369383 - RNA, 64 nt, Homo Sapiens; identical to SEQ ID NO: 162946

SEQ ID NO: 369384 - RNA, 64 nt, Homo Sapiens; identical to SEQ ID NO: 162947

SEQ ID NO: 369385 - RNA, 64 nt, Homo Sapiens; identical to SEQ ID NO: 162948

SEQ ID NO: 369386 - RNA, 64 nt, Homo Sapiens; identical to SEQ ID NO: 162949

SEQ ID NO: 369387 - RNA, 64 nt, Homo Sapiens; identical to SEQ ID NO: 162950

SEQ ID NO: 369388 - RNA, 64 nt, Homo Sapiens; identical to SEQ ID NO: 162951

SEQ ID NO: 369389 - RNA, 64 nt, Homo Sapiens; identical to SEQ ID NO: 162952

SEQ ID NO: 369390 - RNA, 64 nt, Homo Sapiens; identical to SEQ ID NO: 162953

SEQ ID NO: 369391 - RNA, 64 nt, Homo Sapiens; identical to SEQ ID NO: 162954

SEQ ID NO: 369392 - RNA, 64 nt, Homo Sapiens; identical to SEQ ID NO: 162955

SEQ ID NO: 369393 - RNA, 64 nt, Homo Sapiens; identical to SEQ ID NO: 162956

SEQ ID NO: 369394 - RNA, 64 nt, Homo Sapiens; identical to SEQ ID NO: 162957

SEQ ID NO: 369395 - RNA, 64 nt, Homo Sapiens; identical to SEQ ID NO: 162958

SEQ ID NO: 369396 - RNA, 64 nt, Homo Sapiens; identical to SEQ ID NO: 162959

SEQ ID NO: 369397 - RNA, 64 nt, Homo Sapiens; identical to SEQ ID NO: 162960

SEQ ID NO: 369398 - RNA, 64 nt, Homo Sapiens; identical to SEQ ID NO: 162961

SEQ ID NO: 369399 - RNA, 64 nt, Homo Sapiens; identical to SEQ ID NO: 162962

SEQ ID NO: 369400 - RNA, 64 nt, Homo Sapiens; identical to SEQ ID NO: 162963

SEQ ID NO: 369401 - RNA, 64 nt, Homo Sapiens; identical to SEQ ID NO: 162964

SEQ ID NO: 369402 - RNA, 64 nt, Homo Sapiens; identical to SEQ ID NO: 162965

SEQ ID NO: 369403 - RNA, 64 nt, Homo Sapiens; identical to SEQ ID NO: 162966

SEQ ID NO: 369404 - RNA, 64 nt, Homo Sapiens; identical to SEQ ID NO: 162967

SEQ ID NO: 369405 - RNA, 64 nt, Homo Sapiens; identical to SEQ ID NO: 162968

SEQ ID NO: 369406 - RNA, 64 nt, Homo Sapiens; identical to SEQ ID NO: 162969

SEQ ID NO: 369407 - RNA, 64 nt, Homo Sapiens; identical to SEQ ID NO: 162970

SEQ ID NO: 369408 - RNA, 64 nt, Homo Sapiens; identical to SEQ ID NO: 162971

SEQ ID NO: 369409 - RNA, 64 nt, Homo Sapiens; identical to SEQ ID NO: 162972

SEQ ID NO: 369410 - RNA, 64 nt, Homo Sapiens; identical to SEQ ID NO: 162973

SEQ ID NO: 369411 - RNA, 64 nt, Homo Sapiens; identical to SEQ ID NO: 162974

SEQ ID NO: 369412 - RNA, 64 nt, Homo Sapiens; identical to SEQ ID NO: 162975

SEQ ID NO: 369413 - RNA, 64 nt, Homo Sapiens; identical to SEQ ID NO: 162976

SEQ ID NO: 369414 - RNA, 64 nt, Homo Sapiens; identical to SEQ ID NO: 162977

SEQ ID NO: 369415 - RNA, 64 nt, Homo Sapiens; identical to SEQ ID NO: 162978

SEQ ID NO: 369416 - RNA, 64 nt, Homo Sapiens; identical to SEQ ID NO: 162979

SEQ ID NO: 369417 - RNA, 64 nt, Homo Sapiens; identical to SEQ ID NO: 162980

SEQ ID NO: 369418 - RNA, 64 nt, Homo Sapiens; identical to SEQ ID NO: 162981

SEQ ID NO: 369419 - RNA, 64 nt, Homo Sapiens; identical to SEQ ID NO: 162982

SEQ ID NO: 369420 - RNA, 64 nt, Homo Sapiens; identical to SEQ ID NO: 162983

SEQ ID NO: 369421 - RNA, 64 nt, Homo Sapiens; identical to SEQ ID NO: 162984

SEQ ID NO: 369422 - RNA, 64 nt, Homo Sapiens; identical to SEQ ID NO: 162985

SEQ ID NO: 369423 - RNA, 64 nt, Homo Sapiens; identical to SEQ ID NO: 162986

SEQ ID NO: 369424 - RNA, 64 nt, Homo Sapiens; identical to SEQ ID NO: 162987

SEQ ID NO: 369425 - RNA, 64 nt, Homo Sapiens; identical to SEQ ID NO: 162988

SEQ ID NO: 369426 - RNA, 64 nt, Homo Sapiens; identical to SEQ ID NO: 162989

SEQ ID NO: 369427 - RNA, 64 nt, Homo Sapiens; identical to SEQ ID NO: 162990

SEQ ID NO: 369428 - RNA, 64 nt, Homo Sapiens; identical to SEQ ID NO: 162991

SEQ ID NO: 369429 - RNA, 64 nt, Homo Sapiens; identical to SEQ ID NO: 162992

SEQ ID NO: 369430 - RNA, 64 nt, Homo Sapiens; identical to SEQ ID NO: 162993

SEQ ID NO: 369431 - RNA, 64 nt, Homo Sapiens; identical to SEQ ID NO: 162994

SEQ ID NO: 369432 - RNA, 64 nt, Homo Sapiens; identical to SEQ ID NO: 162995

SEQ ID NO: 369433 - RNA, 64 nt, Homo Sapiens; identical to SEQ ID NO: 162996

SEQ ID NO: 369434 - RNA, 64 nt, Homo Sapiens; identical to SEQ ID NO: 162997

SEQ ID NO: 369435 - RNA, 64 nt, Homo Sapiens; identical to SEQ ID NO: 162998

SEQ ID NO: 369436 - RNA, 64 nt, Homo Sapiens; identical to SEQ ID NO: 162999

SEQ ID NO: 369437 - RNA, 64 nt, Homo Sapiens; identical to SEQ ID NO: 163000

SEQ ID NO: 369438 - RNA, 64 nt, Homo Sapiens; identical to SEQ ID NO: 163001

SEQ ID NO: 369439 - RNA, 64 nt, Homo Sapiens; identical to SEQ ID NO: 163002

SEQ ID NO: 369440 - RNA, 64 nt, Homo Sapiens; identical to SEQ ID NO: 163003

SEQ ID NO: 369441 - RNA, 64 nt, Homo Sapiens; identical to SEQ ID NO: 163004

SEQ ID NO: 369442 - RNA, 64 nt, Homo Sapiens; identical to SEQ ID NO: 163005

SEQ ID NO: 369443 - RNA, 64 nt, Homo Sapiens; identical to SEQ ID NO: 163006

SEQ ID NO: 369444 - RNA, 64 nt, Homo Sapiens; identical to SEQ ID NO: 163007

SEQ ID NO: 369445 - RNA, 64 nt, Homo Sapiens; identical to SEQ ID NO: 163008

SEQ ID NO: 369446 - RNA, 64 nt, Homo Sapiens; identical to SEQ ID NO: 163009

SEQ ID NO: 369447 - RNA, 64 nt, Homo Sapiens; identical to SEQ ID NO: 163010

SEQ ID NO: 369448 - RNA, 64 nt, Homo Sapiens; identical to SEQ ID NO: 163011

SEQ ID NO: 369449 - RNA, 64 nt, Homo Sapiens; identical to SEQ ID NO: 163012

SEQ ID NO: 369450 - RNA, 64 nt, Homo Sapiens; identical to SEQ ID NO: 163013

SEQ ID NO: 369451 - RNA, 64 nt, Homo Sapiens; identical to SEQ ID NO: 163014

SEQ ID NO: 369452 - RNA, 64 nt, Homo Sapiens; identical to SEQ ID NO: 163015

SEQ ID NO: 369453 - RNA, 64 nt, Homo Sapiens; identical to SEQ ID NO: 163016

SEQ ID NO: 369454 - RNA, 64 nt, Homo Sapiens; identical to SEQ ID NO: 163017

SEQ ID NO: 369455 - RNA, 64 nt, Homo Sapiens; identical to SEQ ID NO: 163018

SEQ ID NO: 369456 - RNA, 64 nt, Homo Sapiens; identical to SEQ ID NO: 163019

SEQ ID NO: 369457 - RNA, 64 nt, Homo Sapiens; identical to SEQ ID NO: 163020

SEQ ID NO: 369458 - RNA, 64 nt, Homo Sapiens; identical to SEQ ID NO: 163021

SEQ ID NO: 369459 - RNA, 64 nt, Homo Sapiens; identical to SEQ ID NO: 163022

SEQ ID NO: 369460 - RNA, 64 nt, Homo Sapiens; identical to SEQ ID NO: 163023

SEQ ID NO: 369461 - RNA, 64 nt, Homo Sapiens; identical to SEQ ID NO: 163024

SEQ ID NO: 369462 - RNA, 64 nt, Homo Sapiens; identical to SEQ ID NO: 163025

SEQ ID NO: 369463 - RNA, 64 nt, Homo Sapiens; identical to SEQ ID NO: 163026

SEQ ID NO: 369464 - RNA, 64 nt, Homo Sapiens; identical to SEQ ID NO: 163027

SEQ ID NO: 369465 - RNA, 64 nt, Homo Sapiens; identical to SEQ ID NO: 163028

SEQ ID NO: 369466 - RNA, 64 nt, Homo Sapiens; identical to SEQ ID NO: 163029

SEQ ID NO: 369467 - RNA, 64 nt, Homo Sapiens; identical to SEQ ID NO: 163030

SEQ ID NO: 369468 - RNA, 64 nt, Homo Sapiens; identical to SEQ ID NO: 163031

SEQ ID NO: 369469 - RNA, 64 nt, Homo Sapiens; identical to SEQ ID NO: 163032

SEQ ID NO: 369470 - RNA, 64 nt, Homo Sapiens; identical to SEQ ID NO: 163033

SEQ ID NO: 369471 - RNA, 64 nt, Homo Sapiens; identical to SEQ ID NO: 163034

SEQ ID NO: 369472 - RNA, 64 nt, Homo Sapiens; identical to SEQ ID NO: 163035

SEQ ID NO: 369473 - RNA, 64 nt, Homo Sapiens; identical to SEQ ID NO: 163036

SEQ ID NO: 369474 - RNA, 64 nt, Homo Sapiens; identical to SEQ ID NO: 163037

SEQ ID NO: 369475 - RNA, 64 nt, Homo Sapiens; identical to SEQ ID NO: 163038

SEQ ID NO: 369476 - RNA, 64 nt, Homo Sapiens; identical to SEQ ID NO: 163039

SEQ ID NO: 369477 - RNA, 64 nt, Homo Sapiens; identical to SEQ ID NO: 163040

SEQ ID NO: 369478 - RNA, 64 nt, Homo Sapiens; identical to SEQ ID NO: 163041

SEQ ID NO: 369479 - RNA, 64 nt, Homo Sapiens; identical to SEQ ID NO: 163042

SEQ ID NO: 369480 - RNA, 64 nt, Homo Sapiens; identical to SEQ ID NO: 163043

SEQ ID NO: 369481 - RNA, 64 nt, Homo Sapiens; identical to SEQ ID NO: 163044

SEQ ID NO: 369482 - RNA, 64 nt, Homo Sapiens; identical to SEQ ID NO: 163045

SEQ ID NO: 369483 - RNA, 64 nt, Homo Sapiens; identical to SEQ ID NO: 163046

SEQ ID NO: 369484 - RNA, 64 nt, Homo Sapiens; identical to SEQ ID NO: 162809

SEQ ID NO: 369485 - RNA, 64 nt, Homo Sapiens; identical to SEQ ID NO: 163048

SEQ ID NO: 369486 - RNA, 64 nt, Homo Sapiens; identical to SEQ ID NO: 163049

SEQ ID NO: 369487 - RNA, 64 nt, Homo Sapiens; identical to SEQ ID NO: 163050

SEQ ID NO: 369488 - RNA, 64 nt, Homo Sapiens; identical to SEQ ID NO: 163051

SEQ ID NO: 369489 - RNA, 64 nt, Homo Sapiens; identical to SEQ ID NO: 163052

SEQ ID NO: 369490 - RNA, 64 nt, Homo Sapiens; identical to SEQ ID NO: 163053

SEQ ID NO: 369491 - RNA, 64 nt, Homo Sapiens; identical to SEQ ID NO: 163054

SEQ ID NO: 369492 - RNA, 64 nt, Homo Sapiens; identical to SEQ ID NO: 163055

SEQ ID NO: 369493 - RNA, 64 nt, Homo Sapiens; identical to SEQ ID NO: 163056

SEQ ID NO: 369494 - RNA, 64 nt, Homo Sapiens; identical to SEQ ID NO: 163057

SEQ ID NO: 369495 - RNA, 64 nt, Homo Sapiens; identical to SEQ ID NO: 163058

SEQ ID NO: 369496 - RNA, 64 nt, Homo Sapiens; identical to SEQ ID NO: 163059

SEQ ID NO: 369497 - RNA, 64 nt, Homo Sapiens; identical to SEQ ID NO: 163060

SEQ ID NO: 369498 - RNA, 64 nt, Homo Sapiens; identical to SEQ ID NO: 163061

SEQ ID NO: 369499 - RNA, 64 nt, Homo Sapiens; identical to SEQ ID NO: 163062

SEQ ID NO: 369500 - RNA, 64 nt, Homo Sapiens; identical to SEQ ID NO: 163063

SEQ ID NO: 369501 - RNA, 64 nt, Homo Sapiens; identical to SEQ ID NO: 163064

SEQ ID NO: 369502 - RNA, 64 nt, Homo Sapiens; identical to SEQ ID NO: 163065

SEQ ID NO: 369503 - RNA, 64 nt, Homo Sapiens; identical to SEQ ID NO: 163066

SEQ ID NO: 369504 - RNA, 64 nt, Homo Sapiens; identical to SEQ ID NO: 163067

SEQ ID NO: 369505 - RNA, 64 nt, Homo Sapiens; identical to SEQ ID NO: 163068

SEQ ID NO: 369506 - RNA, 64 nt, Homo Sapiens; identical to SEQ ID NO: 163069

SEQ ID NO: 369507 - RNA, 64 nt, Homo Sapiens; identical to SEQ ID NO: 163070

SEQ ID NO: 369508 - RNA, 64 nt, Homo Sapiens; identical to SEQ ID NO: 163071

SEQ ID NO: 369509 - RNA, 64 nt, Homo Sapiens; identical to SEQ ID NO: 163072

SEQ ID NO: 369510 - RNA, 64 nt, Homo Sapiens; identical to SEQ ID NO: 163073

SEQ ID NO: 369511 - RNA, 64 nt, Homo Sapiens; identical to SEQ ID NO: 163074

SEQ ID NO: 369512 - RNA, 64 nt, Homo Sapiens; identical to SEQ ID NO: 163075

SEQ ID NO: 369513 - RNA, 64 nt, Homo Sapiens; identical to SEQ ID NO: 163076

SEQ ID NO: 369514 - RNA, 64 nt, Homo Sapiens; identical to SEQ ID NO: 163077

SEQ ID NO: 369515 - RNA, 64 nt, Homo Sapiens; identical to SEQ ID NO: 163078

SEQ ID NO: 369516 - RNA, 64 nt, Homo Sapiens; identical to SEQ ID NO: 163079

SEQ ID NO: 369517 - RNA, 64 nt, Homo Sapiens; identical to SEQ ID NO: 163080

SEQ ID NO: 369518 - RNA, 64 nt, Homo Sapiens; identical to SEQ ID NO: 163081

SEQ ID NO: 369519 - RNA, 64 nt, Homo Sapiens; identical to SEQ ID NO: 163082

SEQ ID NO: 369520 - RNA, 64 nt, Homo Sapiens; identical to SEQ ID NO: 163083

SEQ ID NO: 369521 - RNA, 64 nt, Homo Sapiens; identical to SEQ ID NO: 163084

SEQ ID NO: 369522 - RNA, 64 nt, Homo Sapiens; identical to SEQ ID NO: 163085

SEQ ID NO: 369523 - RNA, 64 nt, Homo Sapiens; identical to SEQ ID NO: 163086

SEQ ID NO: 369524 - RNA, 64 nt, Homo Sapiens; identical to SEQ ID NO: 163087

SEQ ID NO: 369525 - RNA, 64 nt, Homo Sapiens; identical to SEQ ID NO: 163088

SEQ ID NO: 369526 - RNA, 64 nt, Homo Sapiens; identical to SEQ ID NO: 163089

SEQ ID NO: 369527 - RNA, 64 nt, Homo Sapiens; identical to SEQ ID NO: 163090

SEQ ID NO: 369528 - RNA, 64 nt, Homo Sapiens; identical to SEQ ID NO: 163091

SEQ ID NO: 369529 - RNA, 64 nt, Homo Sapiens; identical to SEQ ID NO: 163092

SEQ ID NO: 369530 - RNA, 64 nt, Homo Sapiens; identical to SEQ ID NO: 163093

SEQ ID NO: 369531 - RNA, 64 nt, Homo Sapiens; identical to SEQ ID NO: 163094

SEQ ID NO: 369532 - RNA, 64 nt, Homo Sapiens; identical to SEQ ID NO: 163095

SEQ ID NO: 369533 - RNA, 64 nt, Homo Sapiens; identical to SEQ ID NO: 163096

SEQ ID NO: 369534 - RNA, 64 nt, Homo Sapiens; identical to SEQ ID NO: 163097

SEQ ID NO: 369535 - RNA, 64 nt, Homo Sapiens; identical to SEQ ID NO: 163098

SEQ ID NO: 369536 - RNA, 64 nt, Homo Sapiens; identical to SEQ ID NO: 163099

SEQ ID NO: 369537 - RNA, 64 nt, Homo Sapiens; identical to SEQ ID NO: 163100

SEQ ID NO: 369538 - RNA, 64 nt, Homo Sapiens; identical to SEQ ID NO: 163101

SEQ ID NO: 369539 - RNA, 64 nt, Homo Sapiens; identical to SEQ ID NO: 163102

SEQ ID NO: 369540 - RNA, 64 nt, Homo Sapiens; identical to SEQ ID NO: 163103

SEQ ID NO: 369541 - RNA, 64 nt, Homo Sapiens; identical to SEQ ID NO: 163104

SEQ ID NO: 369542 - RNA, 64 nt, Homo Sapiens; identical to SEQ ID NO: 163105

SEQ ID NO: 369543 - RNA, 64 nt, Homo Sapiens; identical to SEQ ID NO: 163106

SEQ ID NO: 369544 - RNA, 64 nt, Homo Sapiens; identical to SEQ ID NO: 163107

SEQ ID NO: 369545 - RNA, 64 nt, Homo Sapiens; identical to SEQ ID NO: 163108

SEQ ID NO: 369546 - RNA, 64 nt, Homo Sapiens; identical to SEQ ID NO: 163109

SEQ ID NO: 369547 - RNA, 64 nt, Homo Sapiens; identical to SEQ ID NO: 163110

SEQ ID NO: 369548 - RNA, 64 nt, Homo Sapiens; identical to SEQ ID NO: 163111

SEQ ID NO: 369549 - RNA, 64 nt, Homo Sapiens; identical to SEQ ID NO: 163112

SEQ ID NO: 369550 - RNA, 64 nt, Homo Sapiens; identical to SEQ ID NO: 163113

SEQ ID NO: 369551 - RNA, 64 nt, Homo Sapiens; identical to SEQ ID NO: 163114

SEQ ID NO: 369552 - RNA, 64 nt, Homo Sapiens; identical to SEQ ID NO: 163115

SEQ ID NO: 369553 - RNA, 64 nt, Homo Sapiens; identical to SEQ ID NO: 163116

SEQ ID NO: 369554 - RNA, 64 nt, Homo Sapiens; identical to SEQ ID NO: 163117

SEQ ID NO: 369555 - RNA, 64 nt, Homo Sapiens; identical to SEQ ID NO: 163118

SEQ ID NO: 369556 - RNA, 64 nt, Homo Sapiens; identical to SEQ ID NO: 163119

SEQ ID NO: 369557 - RNA, 64 nt, Homo Sapiens; identical to SEQ ID NO: 163120

SEQ ID NO: 369558 - RNA, 64 nt, Homo Sapiens; identical to SEQ ID NO: 163121

SEQ ID NO: 369559 - RNA, 64 nt, Homo Sapiens; identical to SEQ ID NO: 163122

SEQ ID NO: 369560 - RNA, 64 nt, Homo Sapiens; identical to SEQ ID NO: 163123

SEQ ID NO: 369561 - RNA, 64 nt, Homo Sapiens; identical to SEQ ID NO: 163124

SEQ ID NO: 369562 - RNA, 64 nt, Homo Sapiens; identical to SEQ ID NO: 163125

SEQ ID NO: 369563 - RNA, 64 nt, Homo Sapiens; identical to SEQ ID NO: 163126

SEQ ID NO: 369564 - RNA, 64 nt, Homo Sapiens; identical to SEQ ID NO: 163127

SEQ ID NO: 369565 - RNA, 64 nt, Homo Sapiens; identical to SEQ ID NO: 163128

SEQ ID NO: 369566 - RNA, 64 nt, Homo Sapiens; identical to SEQ ID NO: 163129

SEQ ID NO: 369567 - RNA, 64 nt, Homo Sapiens; identical to SEQ ID NO: 163130

SEQ ID NO: 369568 - RNA, 64 nt, Homo Sapiens; identical to SEQ ID NO: 163131

SEQ ID NO: 369569 - RNA, 64 nt, Homo Sapiens; identical to SEQ ID NO: 163132

SEQ ID NO: 369570 - RNA, 64 nt, Homo Sapiens; identical to SEQ ID NO: 163133

SEQ ID NO: 369571 - RNA, 64 nt, Homo Sapiens; identical to SEQ ID NO: 163134

SEQ ID NO: 369572 - RNA, 64 nt, Homo Sapiens; identical to SEQ ID NO: 163135

SEQ ID NO: 369573 - RNA, 64 nt, Homo Sapiens; identical to SEQ ID NO: 163136

SEQ ID NO: 369574 - RNA, 64 nt, Homo Sapiens; identical to SEQ ID NO: 163137

SEQ ID NO: 369575 - RNA, 64 nt, Homo Sapiens; identical to SEQ ID NO: 163138

SEQ ID NO: 369576 - RNA, 64 nt, Homo Sapiens; identical to SEQ ID NO: 163139

SEQ ID NO: 369577 - RNA, 64 nt, Homo Sapiens; identical to SEQ ID NO: 163140

SEQ ID NO: 369578 - RNA, 64 nt, Homo Sapiens; identical to SEQ ID NO: 163141

SEQ ID NO: 369579 - RNA, 64 nt, Homo Sapiens; identical to SEQ ID NO: 163142

SEQ ID NO: 369580 - RNA, 64 nt, Homo Sapiens; identical to SEQ ID NO: 163143

SEQ ID NO: 369581 - RNA, 64 nt, Homo Sapiens; identical to SEQ ID NO: 163144

SEQ ID NO: 369582 - RNA, 64 nt, Homo Sapiens; identical to SEQ ID NO: 163145

SEQ ID NO: 369583 - RNA, 64 nt, Homo Sapiens; identical to SEQ ID NO: 163146

SEQ ID NO: 369584 - RNA, 64 nt, Homo Sapiens; identical to SEQ ID NO: 163147

SEQ ID NO: 369585 - RNA, 64 nt, Homo Sapiens; identical to SEQ ID NO: 163148

SEQ ID NO: 369586 - RNA, 64 nt, Homo Sapiens; identical to SEQ ID NO: 163149

SEQ ID NO: 369587 - RNA, 64 nt, Homo Sapiens; identical to SEQ ID NO: 163150

SEQ ID NO: 369588 - RNA, 64 nt, Homo Sapiens; identical to SEQ ID NO: 163151

SEQ ID NO: 369589 - RNA, 64 nt, Homo Sapiens; identical to SEQ ID NO: 163152

SEQ ID NO: 369590 - RNA, 64 nt, Homo Sapiens; identical to SEQ ID NO: 163153

SEQ ID NO: 369591 - RNA, 64 nt, Homo Sapiens; identical to SEQ ID NO: 163154

SEQ ID NO: 369592 - RNA, 64 nt, Homo Sapiens; identical to SEQ ID NO: 163155

SEQ ID NO: 369593 - RNA, 64 nt, Homo Sapiens; identical to SEQ ID NO: 163156

SEQ ID NO: 369594 - RNA, 64 nt, Homo Sapiens; identical to SEQ ID NO: 163157

SEQ ID NO: 369595 - RNA, 64 nt, Homo Sapiens; identical to SEQ ID NO: 163158

SEQ ID NO: 369596 - RNA, 64 nt, Homo Sapiens; identical to SEQ ID NO: 163159

SEQ ID NO: 369597 - RNA, 64 nt, Homo Sapiens; identical to SEQ ID NO: 163160

SEQ ID NO: 369598 - RNA, 64 nt, Homo Sapiens; identical to SEQ ID NO: 163161

SEQ ID NO: 369599 - RNA, 64 nt, Homo Sapiens; identical to SEQ ID NO: 163162

SEQ ID NO: 369600 - RNA, 64 nt, Homo Sapiens; identical to SEQ ID NO: 163163

SEQ ID NO: 369601 - RNA, 64 nt, Homo Sapiens; identical to SEQ ID NO: 163164

SEQ ID NO: 369602 - RNA, 64 nt, Homo Sapiens; identical to SEQ ID NO: 163165

SEQ ID NO: 369603 - RNA, 64 nt, Homo Sapiens; identical to SEQ ID NO: 163166

SEQ ID NO: 369604 - RNA, 64 nt, Homo Sapiens; identical to SEQ ID NO: 163167

SEQ ID NO: 369605 - RNA, 64 nt, Homo Sapiens; identical to SEQ ID NO: 163168

SEQ ID NO: 369606 - RNA, 64 nt, Homo Sapiens; identical to SEQ ID NO: 163169

SEQ ID NO: 369607 - RNA, 64 nt, Homo Sapiens; identical to SEQ ID NO: 163170

SEQ ID NO: 369608 - RNA, 64 nt, Homo Sapiens; identical to SEQ ID NO: 163171

SEQ ID NO: 369609 - RNA, 64 nt, Homo Sapiens; identical to SEQ ID NO: 163172

SEQ ID NO: 369610 - RNA, 64 nt, Homo Sapiens; identical to SEQ ID NO: 163173

SEQ ID NO: 369611 - RNA, 64 nt, Homo Sapiens; identical to SEQ ID NO: 163174

SEQ ID NO: 369612 - RNA, 64 nt, Homo Sapiens; identical to SEQ ID NO: 163175

SEQ ID NO: 369613 - RNA, 64 nt, Homo Sapiens; identical to SEQ ID NO: 163176

SEQ ID NO: 369614 - RNA, 64 nt, Homo Sapiens; identical to SEQ ID NO: 163177

SEQ ID NO: 369615 - RNA, 64 nt, Homo Sapiens; identical to SEQ ID NO: 163178

SEQ ID NO: 369616 - RNA, 64 nt, Homo Sapiens; identical to SEQ ID NO: 163179

SEQ ID NO: 369617 - RNA, 64 nt, Homo Sapiens; identical to SEQ ID NO: 163180

SEQ ID NO: 369618 - RNA, 64 nt, Homo Sapiens; identical to SEQ ID NO: 163181

SEQ ID NO: 369619 - RNA, 64 nt, Homo Sapiens; identical to SEQ ID NO: 163182

SEQ ID NO: 369620 - RNA, 64 nt, Homo Sapiens; identical to SEQ ID NO: 163183

SEQ ID NO: 369621 - RNA, 64 nt, Homo Sapiens; identical to SEQ ID NO: 163184

SEQ ID NO: 369622 - RNA, 64 nt, Homo Sapiens
uaccuauuuuagugguugaaaugagagcuagugaugacagaaggauguggaaugucuucuugac

SEQ ID NO: 369623 - RNA, 64 nt, Homo Sapiens
gcucgaaaagaguguccaagaggaguaaaggucaugacagaauuuacucccaggacaaucuaag

SEQ ID NO: 369624 - RNA, 64 nt, Homo Sapiens
gagcaugagaagcauggcucagacaucugcagugugacagaaggugaugaggccgagguaaaag

SEQ ID NO: 369625 - RNA, 64 nt, Homo Sapiens
guccuggauuuugacuccauuuacuguaccuuuaugacagaauuacaagcaaaggagaagagug

SEQ ID NO: 369626 - RNA, 64 nt, Homo Sapiens
ucugacacagacaguagucaagaagaaaaugaagugacagaacauaccccuuuacugagaccuu

SEQ ID NO: 369627 - RNA, 64 nt, Homo Sapiens
ggggcuuuaucggaaucccgcucacaucagaacaugacagaaucuucagacuaugaggaagacg

SEQ ID NO: 369628 - RNA, 64 nt, Homo Sapiens
cauagguguggguguagaguuuuaacuaagaaauugacagaauuagguuucuaggagaguuuug

SEQ ID NO: 369629 - RNA, 64 nt, Homo Sapiens
auacagguucuauuaauaaagaaagcacaauaauugacagaaaauaauucaaagcacaauaauu

SEQ ID NO: 369630 - RNA, 64 nt, Homo Sapiens
acugucauuuuccaucccauccccaccaccugagugacagaaaucuaaacacacauccguccca

SEQ ID NO: 369631 - RNA, 64 nt, Homo Sapiens
cagaccauucagaaucacacagcguauuaaacacugacagaaucuucaucuagauauucgagua

SEQ ID NO: 369632 - RNA, 64 nt, Homo Sapiens
cgcaucgucaaaagauuuuugcuuggaauaagcaugacagaaagauuuaaccuaaguguuagac

SEQ ID NO: 369633 - RNA, 64 nt, Homo Sapiens
aauuuguuacagcaauccuaggaagcuaauacucugacagaaaaaaaucuuggauaauaugcau

SEQ ID NO: 369634 - RNA, 64 nt, Homo Sapiens
agagaagagaauggaaagcauaucuucuccccagugacagaaguucucagaccugugauccgug

SEQ ID NO: 369635 - RNA, 64 nt, Homo Sapiens
uuccauagucugagagaauggaaggaaaaaaaugugacagaaugucuucuuagggaaaucuccu

SEQ ID NO: 369636 - RNA, 64 nt, Homo Sapiens
caggaauuaauuccuaaauagaauuuccucucugugacagaacccaacauaaugcuuaagaaug

SEQ ID NO: 369637 - RNA, 64 nt, Homo Sapiens
ccaguuuguauguacauuauguccuuguugucauugacagaaccuugauaugaaccaacacaua

SEQ ID NO: 369638 - RNA, 64 nt, Homo Sapiens
gcacuguggguaugggaagaaggugcccuucuucugacagaagacaucauccuuauugcacugc

SEQ ID NO: 369639 - RNA, 64 nt, Homo Sapiens
uuuauccaggucucagagcugaauauacuauguaugacagaagccaucagaguucaaauccugu

SEQ ID NO: 369640 - RNA, 64 nt, Homo Sapiens; identical to SEQ ID NO: 325461

SEQ ID NO: 369641 - RNA, 64 nt, Homo Sapiens; identical to SEQ ID NO: 325462

SEQ ID NO: 369642 - RNA, 64 nt, Homo Sapiens; identical to SEQ ID NO: 325463

SEQ ID NO: 369643 - RNA, 64 nt, Homo Sapiens; identical to SEQ ID NO: 325464

SEQ ID NO: 369644 - RNA, 64 nt, Homo Sapiens
ccagguuggugguaaguuggagauacuuaaaacaugcacauauagguuuauugcgagcaggagg

SEQ ID NO: 369645 - RNA, 64 nt, Homo Sapiens
acuguaaaaaauauuucccaggguacuucccauaugcacauagccacuuguacaauuauuuucu

SEQ ID NO: 369646 - RNA, 64 nt, Homo Sapiens
guggcaaggucuuuaagaaguccucaacucuuacugcacauaagaucauucauacuggagagaa

SEQ ID NO: 369647 - RNA, 64 nt, Homo Sapiens
uugguaaauucuuuaacaagucuucaacccuuucugcacauaauauaauucauacuggagagaa

SEQ ID NO: 369648 - RNA, 64 nt, Homo Sapiens
cgcucucccggcacaccucagaguugggaagagaugcacauaaucacugaaugcacugaacuca

SEQ ID NO: 369649 - RNA, 64 nt, Homo Sapiens
uguuagccagcagcuccagauucugcccuggcucugcacauaagccuccuugggagcugggcuc

SEQ ID NO: 369650 - RNA, 64 nt, Homo Sapiens
gaaugcauauauguagaaccaugggaauucaguaugcacauacuaaaaagcagcuuccauuaaa

SEQ ID NO: 369651 - RNA, 64 nt, Homo Sapiens
ucaaauauaauuuuuuuaaauacacauacacacaugcacauauguuaaaguguguauacauaca

SEQ ID NO: 369652 - RNA, 64 nt, Homo Sapiens
gugauaaaauuaauuugagauguaauggacugggccaaucaaauuuagucaguaugucuuuuug

SEQ ID NO: 369653 - RNA, 64 nt, Homo Sapiens
gccaagucagcaagcaaucaucaaagucaugaaaccaaucaacaauugucauaggagggaagcu

SEQ ID NO: 369654 - RNA, 64 nt, Homo Sapiens
uggcacucaugaugggaccucugggcagccaguaccaaucaauuauucuucccagcacaguguu

SEQ ID NO: 369655 - RNA, 64 nt, Homo Sapiens
gcagcacaugggugaugucacauggcagacaucaccaaucaaguggauggugaauggcugugac

SEQ ID NO: 369656 - RNA, 64 nt, Homo Sapiens; identical to SEQ ID NO: 172579

SEQ ID NO: 369657 - RNA, 64 nt, Homo Sapiens; identical to SEQ ID NO: 172580

SEQ ID NO: 369658 - RNA, 64 nt, Homo Sapiens; identical to SEQ ID NO: 172581

SEQ ID NO: 369659 - RNA, 64 nt, Homo Sapiens; identical to SEQ ID NO: 172582

SEQ ID NO: 369660 - RNA, 64 nt, Homo Sapiens; identical to SEQ ID NO: 172583

SEQ ID NO: 369661 - RNA, 64 nt, Homo Sapiens; identical to SEQ ID NO: 172584

SEQ ID NO: 369662 - RNA, 64 nt, Homo Sapiens; identical to SEQ ID NO: 172585

SEQ ID NO: 369663 - RNA, 64 nt, Homo Sapiens; identical to SEQ ID NO: 172586

SEQ ID NO: 369664 - RNA, 64 nt, Homo Sapiens; identical to SEQ ID NO: 172587

SEQ ID NO: 369665 - RNA, 64 nt, Homo Sapiens; identical to SEQ ID NO: 172588

SEQ ID NO: 369666 - RNA, 64 nt, Homo Sapiens; identical to SEQ ID NO: 172589

SEQ ID NO: 369667 - RNA, 64 nt, Homo Sapiens; identical to SEQ ID NO: 172590

SEQ ID NO: 369668 - RNA, 64 nt, Homo Sapiens; identical to SEQ ID NO: 172591

SEQ ID NO: 369669 - RNA, 64 nt, Homo Sapiens; identical to SEQ ID NO: 172592

SEQ ID NO: 369670 - RNA, 64 nt, Homo Sapiens; identical to SEQ ID NO: 172593

SEQ ID NO: 369671 - RNA, 64 nt, Homo Sapiens; identical to SEQ ID NO: 172594

SEQ ID NO: 369672 - RNA, 64 nt, Homo Sapiens; identical to SEQ ID NO: 172595

SEQ ID NO: 369673 - RNA, 64 nt, Homo Sapiens; identical to SEQ ID NO: 172596

SEQ ID NO: 369674 - RNA, 64 nt, Homo Sapiens; identical to SEQ ID NO: 172597

SEQ ID NO: 369675 - RNA, 64 nt, Homo Sapiens; identical to SEQ ID NO: 172598

SEQ ID NO: 369676 - RNA, 64 nt, Homo Sapiens; identical to SEQ ID NO: 172599

SEQ ID NO: 369677 - RNA, 64 nt, Homo Sapiens; identical to SEQ ID NO: 172600

SEQ ID NO: 369678 - RNA, 64 nt, Homo Sapiens; identical to SEQ ID NO: 172601

SEQ ID NO: 369679 - RNA, 64 nt, Homo Sapiens; identical to SEQ ID NO: 172602

SEQ ID NO: 369680 - RNA, 64 nt, Homo Sapiens; identical to SEQ ID NO: 172603

SEQ ID NO: 369681 - RNA, 64 nt, Homo Sapiens; identical to SEQ ID NO: 172604

SEQ ID NO: 369682 - RNA, 64 nt, Homo Sapiens; identical to SEQ ID NO: 172605

SEQ ID NO: 369683 - RNA, 64 nt, Homo Sapiens; identical to SEQ ID NO: 172606

SEQ ID NO: 369684 - RNA, 64 nt, Homo Sapiens; identical to SEQ ID NO: 172607

SEQ ID NO: 369685 - RNA, 64 nt, Homo Sapiens; identical to SEQ ID NO: 172608

SEQ ID NO: 369686 - RNA, 64 nt, Homo Sapiens; identical to SEQ ID NO: 172609

SEQ ID NO: 369687 - RNA, 64 nt, Homo Sapiens; identical to SEQ ID NO: 172610

SEQ ID NO: 369688 - RNA, 64 nt, Homo Sapiens; identical to SEQ ID NO: 172611

SEQ ID NO: 369689 - RNA, 64 nt, Homo Sapiens; identical to SEQ ID NO: 172612

SEQ ID NO: 369690 - RNA, 64 nt, Homo Sapiens; identical to SEQ ID NO: 172613

SEQ ID NO: 369691 - RNA, 64 nt, Homo Sapiens; identical to SEQ ID NO: 172614

SEQ ID NO: 369692 - RNA, 64 nt, Homo Sapiens; identical to SEQ ID NO: 172615

SEQ ID NO: 369693 - RNA, 64 nt, Homo Sapiens; identical to SEQ ID NO: 172616

SEQ ID NO: 369694 - RNA, 64 nt, Homo Sapiens; identical to SEQ ID NO: 172617

SEQ ID NO: 369695 - RNA, 64 nt, Homo Sapiens; identical to SEQ ID NO: 172618

SEQ ID NO: 369696 - RNA, 64 nt, Homo Sapiens; identical to SEQ ID NO: 172619

SEQ ID NO: 369697 - RNA, 64 nt, Homo Sapiens; identical to SEQ ID NO: 172620

SEQ ID NO: 369698 - RNA, 64 nt, Homo Sapiens; identical to SEQ ID NO: 172621

SEQ ID NO: 369699 - RNA, 64 nt, Homo Sapiens; identical to SEQ ID NO: 172622

SEQ ID NO: 369700 - RNA, 64 nt, Homo Sapiens; identical to SEQ ID NO: 172623

SEQ ID NO: 369701 - RNA, 64 nt, Homo Sapiens; identical to SEQ ID NO: 172624

SEQ ID NO: 369702 - RNA, 64 nt, Homo Sapiens; identical to SEQ ID NO: 172625

SEQ ID NO: 369703 - RNA, 64 nt, Homo Sapiens; identical to SEQ ID NO: 172626

SEQ ID NO: 369704 - RNA, 64 nt, Homo Sapiens; identical to SEQ ID NO: 172627

SEQ ID NO: 369705 - RNA, 64 nt, Homo Sapiens; identical to SEQ ID NO: 172628

SEQ ID NO: 369706 - RNA, 64 nt, Homo Sapiens; identical to SEQ ID NO: 172629

SEQ ID NO: 369707 - RNA, 64 nt, Homo Sapiens; identical to SEQ ID NO: 172630

SEQ ID NO: 369708 - RNA, 64 nt, Homo Sapiens; identical to SEQ ID NO: 172631

SEQ ID NO: 369709 - RNA, 64 nt, Homo Sapiens; identical to SEQ ID NO: 172632

SEQ ID NO: 369710 - RNA, 64 nt, Homo Sapiens; identical to SEQ ID NO: 172633

SEQ ID NO: 369711 - RNA, 64 nt, Homo Sapiens; identical to SEQ ID NO: 172634

SEQ ID NO: 369712 - RNA, 64 nt, Homo Sapiens; identical to SEQ ID NO: 172635

SEQ ID NO: 369713 - RNA, 64 nt, Homo Sapiens; identical to SEQ ID NO: 172636

SEQ ID NO: 369714 - RNA, 64 nt, Homo Sapiens; identical to SEQ ID NO: 172637

SEQ ID NO: 369715 - RNA, 64 nt, Homo Sapiens; identical to SEQ ID NO: 172638

SEQ ID NO: 369716 - RNA, 64 nt, Homo Sapiens; identical to SEQ ID NO: 172639

SEQ ID NO: 369717 - RNA, 64 nt, Homo Sapiens; identical to SEQ ID NO: 172640

SEQ ID NO: 369718 - RNA, 64 nt, Homo Sapiens; identical to SEQ ID NO: 172641

SEQ ID NO: 369719 - RNA, 64 nt, Homo Sapiens; identical to SEQ ID NO: 172642

SEQ ID NO: 369720 - RNA, 64 nt, Homo Sapiens; identical to SEQ ID NO: 172643

SEQ ID NO: 369721 - RNA, 64 nt, Homo Sapiens; identical to SEQ ID NO: 172644

SEQ ID NO: 369722 - RNA, 64 nt, Homo Sapiens; identical to SEQ ID NO: 172645

SEQ ID NO: 369723 - RNA, 64 nt, Homo Sapiens; identical to SEQ ID NO: 172646

SEQ ID NO: 369724 - RNA, 64 nt, Homo Sapiens; identical to SEQ ID NO: 172647

SEQ ID NO: 369725 - RNA, 64 nt, Homo Sapiens; identical to SEQ ID NO: 172648

SEQ ID NO: 369726 - RNA, 64 nt, Homo Sapiens; identical to SEQ ID NO: 172649

SEQ ID NO: 369727 - RNA, 64 nt, Homo Sapiens; identical to SEQ ID NO: 172650

SEQ ID NO: 369728 - RNA, 64 nt, Homo Sapiens; identical to SEQ ID NO: 172651

SEQ ID NO: 369729 - RNA, 64 nt, Homo Sapiens; identical to SEQ ID NO: 172652

SEQ ID NO: 369730 - RNA, 64 nt, Homo Sapiens; identical to SEQ ID NO: 21372

SEQ ID NO: 369731 - RNA, 64 nt, Homo Sapiens; identical to SEQ ID NO: 21373

SEQ ID NO: 369732 - RNA, 64 nt, Homo Sapiens; identical to SEQ ID NO: 21374

SEQ ID NO: 369733 - RNA, 64 nt, Homo Sapiens; identical to SEQ ID NO: 21375

SEQ ID NO: 369734 - RNA, 64 nt, Homo Sapiens; identical to SEQ ID NO: 21376

SEQ ID NO: 369735 - RNA, 64 nt, Homo Sapiens; identical to SEQ ID NO: 21377

SEQ ID NO: 369736 - RNA, 64 nt, Homo Sapiens; identical to SEQ ID NO: 21378

SEQ ID NO: 369737 - RNA, 64 nt, Homo Sapiens; identical to SEQ ID NO: 21379

SEQ ID NO: 369738 - RNA, 64 nt, Homo Sapiens; identical to SEQ ID NO: 21380

SEQ ID NO: 369739 - RNA, 64 nt, Homo Sapiens; identical to SEQ ID NO: 21381

SEQ ID NO: 369740 - RNA, 64 nt, Homo Sapiens; identical to SEQ ID NO: 21382

SEQ ID NO: 369741 - RNA, 64 nt, Homo Sapiens; identical to SEQ ID NO: 21383

SEQ ID NO: 369742 - RNA, 64 nt, Homo Sapiens; identical to SEQ ID NO: 21384

SEQ ID NO: 369743 - RNA, 64 nt, Homo Sapiens; identical to SEQ ID NO: 21385

SEQ ID NO: 369744 - RNA, 64 nt, Homo Sapiens; identical to SEQ ID NO: 21386

SEQ ID NO: 369745 - RNA, 64 nt, Homo Sapiens; identical to SEQ ID NO: 21387

SEQ ID NO: 369746 - RNA, 64 nt, Homo Sapiens; identical to SEQ ID NO: 21388

SEQ ID NO: 369747 - RNA, 64 nt, Homo Sapiens; identical to SEQ ID NO: 21389

SEQ ID NO: 369748 - RNA, 64 nt, Homo Sapiens; identical to SEQ ID NO: 21390

SEQ ID NO: 369749 - RNA, 64 nt, Homo Sapiens; identical to SEQ ID NO: 21391

SEQ ID NO: 369750 - RNA, 64 nt, Homo Sapiens; identical to SEQ ID NO: 21392

SEQ ID NO: 369751 - RNA, 64 nt, Homo Sapiens; identical to SEQ ID NO: 21393

SEQ ID NO: 369752 - RNA, 51 nt, Homo Sapiens; identical to SEQ ID NO: 21394

SEQ ID NO: 369753 - RNA, 64 nt, Homo Sapiens; identical to SEQ ID NO: 21395

SEQ ID NO: 369754 - RNA, 64 nt, Homo Sapiens; identical to SEQ ID NO: 21396

SEQ ID NO: 369755 - RNA, 64 nt, Homo Sapiens; identical to SEQ ID NO: 21397

SEQ ID NO: 369756 - RNA, 56 nt, Homo Sapiens; identical to SEQ ID NO: 21398

SEQ ID NO: 369757 - RNA, 64 nt, Homo Sapiens; identical to SEQ ID NO: 21399

SEQ ID NO: 369758 - RNA, 64 nt, Homo Sapiens; identical to SEQ ID NO: 21400

SEQ ID NO: 369759 - RNA, 64 nt, Homo Sapiens; identical to SEQ ID NO: 21401

SEQ ID NO: 369760 - RNA, 64 nt, Homo Sapiens; identical to SEQ ID NO: 21402

SEQ ID NO: 369761 - RNA, 64 nt, Homo Sapiens; identical to SEQ ID NO: 21403

SEQ ID NO: 369762 - RNA, 64 nt, Homo Sapiens; identical to SEQ ID NO: 21404

SEQ ID NO: 369763 - RNA, 64 nt, Homo Sapiens; identical to SEQ ID NO: 21405

SEQ ID NO: 369764 - RNA, 64 nt, Homo Sapiens; identical to SEQ ID NO: 21406

SEQ ID NO: 369765 - RNA, 64 nt, Homo Sapiens; identical to SEQ ID NO: 21407

SEQ ID NO: 369766 - RNA, 64 nt, Homo Sapiens; identical to SEQ ID NO: 21408

SEQ ID NO: 369767 - RNA, 64 nt, Homo Sapiens; identical to SEQ ID NO: 21409

SEQ ID NO: 369768 - RNA, 64 nt, Homo Sapiens; identical to SEQ ID NO: 21410

SEQ ID NO: 369769 - RNA, 64 nt, Homo Sapiens; identical to SEQ ID NO: 21411

SEQ ID NO: 369770 - RNA, 64 nt, Homo Sapiens; identical to SEQ ID NO: 21412

SEQ ID NO: 369771 - RNA, 64 nt, Homo Sapiens; identical to SEQ ID NO: 21413

SEQ ID NO: 369772 - RNA, 64 nt, Homo Sapiens; identical to SEQ ID NO: 21414

SEQ ID NO: 369773 - RNA, 64 nt, Homo Sapiens; identical to SEQ ID NO: 21415

SEQ ID NO: 369774 - RNA, 64 nt, Homo Sapiens; identical to SEQ ID NO: 21416

SEQ ID NO: 369775 - RNA, 64 nt, Homo Sapiens; identical to SEQ ID NO: 21417

SEQ ID NO: 369776 - RNA, 64 nt, Homo Sapiens; identical to SEQ ID NO: 21418

SEQ ID NO: 369777 - RNA, 64 nt, Homo Sapiens; identical to SEQ ID NO: 21419

SEQ ID NO: 369778 - RNA, 64 nt, Homo Sapiens; identical to SEQ ID NO: 21420

SEQ ID NO: 369779 - RNA, 64 nt, Homo Sapiens; identical to SEQ ID NO: 21421

SEQ ID NO: 369780 - RNA, 64 nt, Homo Sapiens; identical to SEQ ID NO: 21422

SEQ ID NO: 369781 - RNA, 64 nt, Homo Sapiens; identical to SEQ ID NO: 21423

SEQ ID NO: 369782 - RNA, 64 nt, Homo Sapiens; identical to SEQ ID NO: 21424

SEQ ID NO: 369783 - RNA, 64 nt, Homo Sapiens; identical to SEQ ID NO: 21425

SEQ ID NO: 369784 - RNA, 64 nt, Homo Sapiens; identical to SEQ ID NO: 21426

SEQ ID NO: 369785 - RNA, 64 nt, Homo Sapiens; identical to SEQ ID NO: 21427

SEQ ID NO: 369786 - RNA, 64 nt, Homo Sapiens; identical to SEQ ID NO: 21428

SEQ ID NO: 369787 - RNA, 64 nt, Homo Sapiens; identical to SEQ ID NO: 21429

SEQ ID NO: 369788 - RNA, 64 nt, Homo Sapiens; identical to SEQ ID NO: 21430

SEQ ID NO: 369789 - RNA, 64 nt, Homo Sapiens; identical to SEQ ID NO: 21431

SEQ ID NO: 369790 - RNA, 64 nt, Homo Sapiens; identical to SEQ ID NO: 21432

SEQ ID NO: 369791 - RNA, 64 nt, Homo Sapiens; identical to SEQ ID NO: 21433

SEQ ID NO: 369792 - RNA, 64 nt, Homo Sapiens; identical to SEQ ID NO: 21434

SEQ ID NO: 369793 - RNA, 64 nt, Homo Sapiens; identical to SEQ ID NO: 21435

SEQ ID NO: 369794 - RNA, 64 nt, Homo Sapiens; identical to SEQ ID NO: 21436

SEQ ID NO: 369795 - RNA, 64 nt, Homo Sapiens; identical to SEQ ID NO: 21437

SEQ ID NO: 369796 - RNA, 64 nt, Homo Sapiens; identical to SEQ ID NO: 21438

SEQ ID NO: 369797 - RNA, 64 nt, Homo Sapiens; identical to SEQ ID NO: 21439

SEQ ID NO: 369798 - RNA, 64 nt, Homo Sapiens; identical to SEQ ID NO: 21440

SEQ ID NO: 369799 - RNA, 64 nt, Homo Sapiens; identical to SEQ ID NO: 21441

SEQ ID NO: 369800 - RNA, 64 nt, Homo Sapiens; identical to SEQ ID NO: 21442

SEQ ID NO: 369801 - RNA, 64 nt, Homo Sapiens; identical to SEQ ID NO: 21443

SEQ ID NO: 369802 - RNA, 64 nt, Homo Sapiens; identical to SEQ ID NO: 21444

SEQ ID NO: 369803 - RNA, 64 nt, Homo Sapiens; identical to SEQ ID NO: 21445

SEQ ID NO: 369804 - RNA, 64 nt, Homo Sapiens; identical to SEQ ID NO: 21446

SEQ ID NO: 369805 - RNA, 64 nt, Homo Sapiens; identical to SEQ ID NO: 21447

SEQ ID NO: 369806 - RNA, 64 nt, Homo Sapiens; identical to SEQ ID NO: 21448

SEQ ID NO: 369807 - RNA, 64 nt, Homo Sapiens; identical to SEQ ID NO: 21449

SEQ ID NO: 369808 - RNA, 64 nt, Homo Sapiens; identical to SEQ ID NO: 21450

SEQ ID NO: 369809 - RNA, 64 nt, Homo Sapiens; identical to SEQ ID NO: 21451

SEQ ID NO: 369810 - RNA, 64 nt, Homo Sapiens; identical to SEQ ID NO: 21452

SEQ ID NO: 369811 - RNA, 64 nt, Homo Sapiens; identical to SEQ ID NO: 21453

SEQ ID NO: 369812 - RNA, 64 nt, Homo Sapiens; identical to SEQ ID NO: 21454

SEQ ID NO: 369813 - RNA, 64 nt, Homo Sapiens; identical to SEQ ID NO: 21455

SEQ ID NO: 369814 - RNA, 64 nt, Homo Sapiens; identical to SEQ ID NO: 21456

SEQ ID NO: 369815 - RNA, 64 nt, Homo Sapiens; identical to SEQ ID NO: 21457

SEQ ID NO: 369816 - RNA, 64 nt, Homo Sapiens; identical to SEQ ID NO: 21458

SEQ ID NO: 369817 - RNA, 64 nt, Homo Sapiens; identical to SEQ ID NO: 21459

SEQ ID NO: 369818 - RNA, 64 nt, Homo Sapiens; identical to SEQ ID NO: 21460

SEQ ID NO: 369819 - RNA, 64 nt, Homo Sapiens; identical to SEQ ID NO: 21461

SEQ ID NO: 369820 - RNA, 64 nt, Homo Sapiens; identical to SEQ ID NO: 21462

SEQ ID NO: 369821 - RNA, 64 nt, Homo Sapiens; identical to SEQ ID NO: 21463

SEQ ID NO: 369822 - RNA, 64 nt, Homo Sapiens; identical to SEQ ID NO: 21464

SEQ ID NO: 369823 - RNA, 64 nt, Homo Sapiens; identical to SEQ ID NO: 21465

SEQ ID NO: 369824 - RNA, 64 nt, Homo Sapiens; identical to SEQ ID NO: 21466

SEQ ID NO: 369825 - RNA, 64 nt, Homo Sapiens; identical to SEQ ID NO: 21467

SEQ ID NO: 369826 - RNA, 64 nt, Homo Sapiens; identical to SEQ ID NO: 21468

SEQ ID NO: 369827 - RNA, 64 nt, Homo Sapiens; identical to SEQ ID NO: 21469

SEQ ID NO: 369828 - RNA, 64 nt, Homo Sapiens; identical to SEQ ID NO: 21470

SEQ ID NO: 369829 - RNA, 64 nt, Homo Sapiens; identical to SEQ ID NO: 21471

SEQ ID NO: 369830 - RNA, 64 nt, Homo Sapiens; identical to SEQ ID NO: 21472

SEQ ID NO: 369831 - RNA, 64 nt, Homo Sapiens; identical to SEQ ID NO: 21473

SEQ ID NO: 369832 - RNA, 64 nt, Homo Sapiens; identical to SEQ ID NO: 21474

SEQ ID NO: 369833 - RNA, 64 nt, Homo Sapiens; identical to SEQ ID NO: 21475

SEQ ID NO: 369834 - RNA, 64 nt, Homo Sapiens; identical to SEQ ID NO: 21476

SEQ ID NO: 369835 - RNA, 64 nt, Homo Sapiens; identical to SEQ ID NO: 21477

SEQ ID NO: 369836 - RNA, 64 nt, Homo Sapiens; identical to SEQ ID NO: 21478

SEQ ID NO: 369837 - RNA, 64 nt, Homo Sapiens; identical to SEQ ID NO: 21479

SEQ ID NO: 369838 - RNA, 64 nt, Homo Sapiens; identical to SEQ ID NO: 21480

SEQ ID NO: 369839 - RNA, 64 nt, Homo Sapiens; identical to SEQ ID NO: 21481

SEQ ID NO: 369840 - RNA, 64 nt, Homo Sapiens; identical to SEQ ID NO: 21482

SEQ ID NO: 369841 - RNA, 64 nt, Homo Sapiens; identical to SEQ ID NO: 21483

SEQ ID NO: 369842 - RNA, 64 nt, Homo Sapiens; identical to SEQ ID NO: 21484

SEQ ID NO: 369843 - RNA, 64 nt, Homo Sapiens; identical to SEQ ID NO: 21485

SEQ ID NO: 369844 - RNA, 64 nt, Homo Sapiens; identical to SEQ ID NO: 21486

SEQ ID NO: 369845 - RNA, 64 nt, Homo Sapiens; identical to SEQ ID NO: 21487

SEQ ID NO: 369846 - RNA, 64 nt, Homo Sapiens; identical to SEQ ID NO: 21488

SEQ ID NO: 369847 - RNA, 64 nt, Homo Sapiens; identical to SEQ ID NO: 21489

SEQ ID NO: 369848 - RNA, 64 nt, Homo Sapiens; identical to SEQ ID NO: 21490

SEQ ID NO: 369849 - RNA, 64 nt, Homo Sapiens; identical to SEQ ID NO: 21491

SEQ ID NO: 369850 - RNA, 64 nt, Homo Sapiens; identical to SEQ ID NO: 21492

SEQ ID NO: 369851 - RNA, 64 nt, Homo Sapiens; identical to SEQ ID NO: 21493

SEQ ID NO: 369852 - RNA, 64 nt, Homo Sapiens; identical to SEQ ID NO: 21494

SEQ ID NO: 369853 - RNA, 64 nt, Homo Sapiens; identical to SEQ ID NO: 21495

SEQ ID NO: 369854 - RNA, 64 nt, Homo Sapiens; identical to SEQ ID NO: 21496

SEQ ID NO: 369855 - RNA, 64 nt, Homo Sapiens; identical to SEQ ID NO: 21497

SEQ ID NO: 369856 - RNA, 64 nt, Homo Sapiens; identical to SEQ ID NO: 21498

SEQ ID NO: 369857 - RNA, 64 nt, Homo Sapiens; identical to SEQ ID NO: 21499

SEQ ID NO: 369858 - RNA, 64 nt, Homo Sapiens; identical to SEQ ID NO: 21500

SEQ ID NO: 369859 - RNA, 64 nt, Homo Sapiens; identical to SEQ ID NO: 21501

SEQ ID NO: 369860 - RNA, 64 nt, Homo Sapiens; identical to SEQ ID NO: 21502

SEQ ID NO: 369861 - RNA, 64 nt, Homo Sapiens; identical to SEQ ID NO: 21503

SEQ ID NO: 369862 - RNA, 64 nt, Homo Sapiens; identical to SEQ ID NO: 21504

SEQ ID NO: 369863 - RNA, 64 nt, Homo Sapiens; identical to SEQ ID NO: 21505

SEQ ID NO: 369864 - RNA, 64 nt, Homo Sapiens; identical to SEQ ID NO: 21506

SEQ ID NO: 369865 - RNA, 64 nt, Homo Sapiens; identical to SEQ ID NO: 21507

SEQ ID NO: 369866 - RNA, 64 nt, Homo Sapiens; identical to SEQ ID NO: 21508

SEQ ID NO: 369867 - RNA, 64 nt, Homo Sapiens; identical to SEQ ID NO: 21509

SEQ ID NO: 369868 - RNA, 64 nt, Homo Sapiens; identical to SEQ ID NO: 21510

SEQ ID NO: 369869 - RNA, 64 nt, Homo Sapiens; identical to SEQ ID NO: 21511

SEQ ID NO: 369870 - RNA, 64 nt, Homo Sapiens; identical to SEQ ID NO: 21512

SEQ ID NO: 369871 - RNA, 64 nt, Homo Sapiens; identical to SEQ ID NO: 21513

SEQ ID NO: 369872 - RNA, 64 nt, Homo Sapiens; identical to SEQ ID NO: 21514

SEQ ID NO: 369873 - RNA, 64 nt, Homo Sapiens; identical to SEQ ID NO: 21515

SEQ ID NO: 369874 - RNA, 64 nt, Homo Sapiens; identical to SEQ ID NO: 21516

SEQ ID NO: 369875 - RNA, 64 nt, Homo Sapiens; identical to SEQ ID NO: 21517

SEQ ID NO: 369876 - RNA, 64 nt, Homo Sapiens; identical to SEQ ID NO: 21518

SEQ ID NO: 369877 - RNA, 64 nt, Homo Sapiens; identical to SEQ ID NO: 21519

SEQ ID NO: 369878 - RNA, 64 nt, Homo Sapiens; identical to SEQ ID NO: 21520

SEQ ID NO: 369879 - RNA, 64 nt, Homo Sapiens; identical to SEQ ID NO: 21521

SEQ ID NO: 369880 - RNA, 64 nt, Homo Sapiens; identical to SEQ ID NO: 21522

SEQ ID NO: 369881 - RNA, 64 nt, Homo Sapiens; identical to SEQ ID NO: 21523

SEQ ID NO: 369882 - RNA, 64 nt, Homo Sapiens; identical to SEQ ID NO: 21524

SEQ ID NO: 369883 - RNA, 64 nt, Homo Sapiens; identical to SEQ ID NO: 21525

SEQ ID NO: 369884 - RNA, 64 nt, Homo Sapiens; identical to SEQ ID NO: 21526

SEQ ID NO: 369885 - RNA, 64 nt, Homo Sapiens; identical to SEQ ID NO: 21527

SEQ ID NO: 369886 - RNA, 64 nt, Homo Sapiens; identical to SEQ ID NO: 21528

SEQ ID NO: 369887 - RNA, 64 nt, Homo Sapiens; identical to SEQ ID NO: 21529

SEQ ID NO: 369888 - RNA, 64 nt, Homo Sapiens; identical to SEQ ID NO: 21530

SEQ ID NO: 369889 - RNA, 64 nt, Homo Sapiens; identical to SEQ ID NO: 21531

SEQ ID NO: 369890 - RNA, 64 nt, Homo Sapiens; identical to SEQ ID NO: 21532

SEQ ID NO: 369891 - RNA, 64 nt, Homo Sapiens; identical to SEQ ID NO: 21533

SEQ ID NO: 369892 - RNA, 64 nt, Homo Sapiens; identical to SEQ ID NO: 21534

SEQ ID NO: 369893 - RNA, 64 nt, Homo Sapiens; identical to SEQ ID NO: 21535

SEQ ID NO: 369894 - RNA, 64 nt, Homo Sapiens; identical to SEQ ID NO: 21536

SEQ ID NO: 369895 - RNA, 64 nt, Homo Sapiens; identical to SEQ ID NO: 21537

SEQ ID NO: 369896 - RNA, 64 nt, Homo Sapiens; identical to SEQ ID NO: 21538

SEQ ID NO: 369897 - RNA, 64 nt, Homo Sapiens; identical to SEQ ID NO: 21539

SEQ ID NO: 369898 - RNA, 64 nt, Homo Sapiens; identical to SEQ ID NO: 21540

SEQ ID NO: 369899 - RNA, 64 nt, Homo Sapiens; identical to SEQ ID NO: 21541

SEQ ID NO: 369900 - RNA, 64 nt, Homo Sapiens; identical to SEQ ID NO: 21542

SEQ ID NO: 369901 - RNA, 64 nt, Homo Sapiens; identical to SEQ ID NO: 21543

SEQ ID NO: 369902 - RNA, 64 nt, Homo Sapiens; identical to SEQ ID NO: 56858

SEQ ID NO: 369903 - RNA, 64 nt, Homo Sapiens; identical to SEQ ID NO: 56859

SEQ ID NO: 369904 - RNA, 64 nt, Homo Sapiens; identical to SEQ ID NO: 56860

SEQ ID NO: 369905 - RNA, 64 nt, Homo Sapiens; identical to SEQ ID NO: 56861

SEQ ID NO: 369906 - RNA, 64 nt, Homo Sapiens; identical to SEQ ID NO: 56862

SEQ ID NO: 369907 - RNA, 64 nt, Homo Sapiens; identical to SEQ ID NO: 56863

SEQ ID NO: 369908 - RNA, 64 nt, Homo Sapiens; identical to SEQ ID NO: 56864

SEQ ID NO: 369909 - RNA, 64 nt, Homo Sapiens; identical to SEQ ID NO: 56865

SEQ ID NO: 369910 - RNA, 64 nt, Homo Sapiens; identical to SEQ ID NO: 56866

SEQ ID NO: 369911 - RNA, 64 nt, Homo Sapiens; identical to SEQ ID NO: 56867

SEQ ID NO: 369912 - RNA, 64 nt, Homo Sapiens; identical to SEQ ID NO: 56868

SEQ ID NO: 369913 - RNA, 64 nt, Homo Sapiens; identical to SEQ ID NO: 56869

SEQ ID NO: 369914 - RNA, 64 nt, Homo Sapiens; identical to SEQ ID NO: 56870

SEQ ID NO: 369915 - RNA, 64 nt, Homo Sapiens; identical to SEQ ID NO: 56871

SEQ ID NO: 369916 - RNA, 64 nt, Homo Sapiens; identical to SEQ ID NO: 56872

SEQ ID NO: 369917 - RNA, 64 nt, Homo Sapiens; identical to SEQ ID NO: 56873

SEQ ID NO: 369918 - RNA, 64 nt, Homo Sapiens; identical to SEQ ID NO: 56874

SEQ ID NO: 369919 - RNA, 64 nt, Homo Sapiens; identical to SEQ ID NO: 56875

SEQ ID NO: 369920 - RNA, 64 nt, Homo Sapiens; identical to SEQ ID NO: 56876

SEQ ID NO: 369921 - RNA, 64 nt, Homo Sapiens; identical to SEQ ID NO: 56877

SEQ ID NO: 369922 - RNA, 64 nt, Homo Sapiens; identical to SEQ ID NO: 56878

SEQ ID NO: 369923 - RNA, 64 nt, Homo Sapiens; identical to SEQ ID NO: 56879

SEQ ID NO: 369924 - RNA, 64 nt, Homo Sapiens; identical to SEQ ID NO: 56880

SEQ ID NO: 369925 - RNA, 64 nt, Homo Sapiens; identical to SEQ ID NO: 56881

SEQ ID NO: 369926 - RNA, 64 nt, Homo Sapiens; identical to SEQ ID NO: 51689

SEQ ID NO: 369927 - RNA, 64 nt, Homo Sapiens; identical to SEQ ID NO: 51690

SEQ ID NO: 369928 - RNA, 64 nt, Homo Sapiens; identical to SEQ ID NO: 51691

SEQ ID NO: 369929 - RNA, 64 nt, Homo Sapiens; identical to SEQ ID NO: 51692

SEQ ID NO: 369930 - RNA, 64 nt, Homo Sapiens
aguguugucuccaccuggcccaggugaagcuuucaucacagaacgguacuaggcccauuguuuc

SEQ ID NO: 369931 - RNA, 64 nt, Homo Sapiens
caggggcccugugguccaggaggugccucaguaaaucacagaccaggggagucagauugugguc

SEQ ID NO: 369932 - RNA, 64 nt, Homo Sapiens
aaagaaauucuggauguuaaaauaauauauacucaucacagaaaaauaaaguauagcaaugucc

SEQ ID NO: 369933 - RNA, 64 nt, Homo Sapiens
ccuaacauuugucucuagccuuugccuuuguacaaucacagauauccuauggagauuuaaggau

SEQ ID NO: 369934 - RNA, 64 nt, Homo Sapiens
aguggccaccggaaucacccaucggaaucacccgaucacagacgccgaucacagacgagcaguc

SEQ ID NO: 369935 - RNA, 64 nt, Homo Sapiens
agcagucaucggaaucacccaccagaaucgcccgaucacagacgccgaucacagacgagcgguc

SEQ ID NO: 369936 - RNA, 64 nt, Homo Sapiens
agcggucaccagaaucgcccaucggacucacccgaucacagacgccgaucacagacgagcaguc

SEQ ID NO: 369937 - RNA, 64 nt, Homo Sapiens
agcagucaucggacucacccaucggaaucacccgaucacagacgccgaucacagacgagcaguc

SEQ ID NO: 369938 - RNA, 64 nt, Homo Sapiens
agcagucaucggaaucacccaccagacucgcccgaucacagacgccgaucacagacgagcgguc

SEQ ID NO: 369939 - RNA, 64 nt, Homo Sapiens
agcggucaccagacucgcccaucggacucacccgaucacagacgccgaucacagacgagcaguc

SEQ ID NO: 369940 - RNA, 64 nt, Homo Sapiens
agcagucaucggacucacccaucggaaucacccgaucacagacgccaaucacagacaagcaguc

SEQ ID NO: 369941 - RNA, 64 nt, Homo Sapiens
agcagucaucggaaucacccaccggaaucgcccaaucacagacaccgaucacagacgagcggcc

SEQ ID NO: 369942 - RNA, 64 nt, Homo Sapiens
agcggccaccggaaucgcccaccggaaucgcccgaucacagacgccgaucacagacgagcgguc

SEQ ID NO: 369943 - RNA, 64 nt, Homo Sapiens
agcggucaccggaaucgcccaucggacucacccgaucacagacgccggucacagacgagcaguc

SEQ ID NO: 369944 - RNA, 64 nt, Homo Sapiens
agcggucaccggaaucgcccuucggaaucacccgaucacagacgaaacaacucugaaugugcgg

SEQ ID NO: 369945 - RNA, 64 nt, Homo Sapiens
guacugugggcucagaaaccacaagcugugugucaucacagauuuuacaugugcauuaaacaga

SEQ ID NO: 369946 - RNA, 64 nt, Homo Sapiens
caucggggugcccgcgauggcagccugccagggaaucacagagaggucucaguauugagaaacg

SEQ ID NO: 369947 - RNA, 64 nt, Homo Sapiens
gauacuggggaguaaacggcgccgcagaggauccaucacagacgacaacccaccauuucugggg

SEQ ID NO: 369948 - RNA, 64 nt, Homo Sapiens
ccagcuggggcgcgaugucaugugcauugguggcaucacagaccaaaaaugaaugucuuguucc

SEQ ID NO: 369949 - RNA, 64 nt, Homo Sapiens
gggugguucggguaaccacugugggcucucucccaucacagaagguggacagggccuacccagg

SEQ ID NO: 369950 - RNA, 64 nt, Homo Sapiens
uauaauaauccuagagaccuuuuuucuaccaaagaucacagaccagaaaaaguuccaucuaaaa

SEQ ID NO: 369951 - RNA, 64 nt, Homo Sapiens
uuaagcuaaacuguuucguuucucauaaaacaguaucacagacauccagagcauguaugaauaa

SEQ ID NO: 369952 - RNA, 64 nt, Homo Sapiens
augggauugaguuaaaacuaguauggcuaacuauaucacagaaacugauuugagaaauuaacca

SEQ ID NO: 369953 - RNA, 64 nt, Homo Sapiens
auuccuguucccacagaacuuuuuuuuuuuuuuaaucacagaauuaaauucuggcaaacuaccc

SEQ ID NO: 369954 - RNA, 64 nt, Homo Sapiens
uccagagaacagaaacaagaaagaauaucugaccaucacagagaccuacaucucuuuuggccaa

SEQ ID NO: 369955 - RNA, 64 nt, Homo Sapiens
uucuuaaaucagcagugugggugguaguaaucugaucacagauauagaugaucggccugcuggu

SEQ ID NO: 369956 - RNA, 64 nt, Homo Sapiens
cagccaaggcucaggaaaaacugcuguguuccagaucacagaggaauaauaacuuccaugcugc

SEQ ID NO: 369957 - RNA, 64 nt, Homo Sapiens
cuagagacaacagucugugcugcagauugguuggaucacagaaugugugucuggggcauuaucu

SEQ ID NO: 369958 - RNA, 64 nt, Homo Sapiens
ggguuuaaaaccagcaccgaggcccagugggggaaucacagacaucaccaagucucgucuucuu

SEQ ID NO: 369959 - RNA, 64 nt, Homo Sapiens
ccgggaacgggcaagacauguuuugaaauguaagaucacagacuguuuuuugcaagaccacauu

SEQ ID NO: 369960 - RNA, 64 nt, Homo Sapiens
ugguaauucugaauaaggaucugaauaaauccagaucacagacuguuccuuuaccaauauguaa

SEQ ID NO: 369961 - RNA, 64 nt, Homo Sapiens; identical to SEQ ID NO: 309743

SEQ ID NO: 369962 - RNA, 64 nt, Homo Sapiens; identical to SEQ ID NO: 309744

SEQ ID NO: 369963 - RNA, 64 nt, Homo Sapiens; identical to SEQ ID NO: 309745

SEQ ID NO: 369964 - RNA, 64 nt, Homo Sapiens; identical to SEQ ID NO: 309746

SEQ ID NO: 369965 - RNA, 64 nt, Homo Sapiens; identical to SEQ ID NO: 309747

SEQ ID NO: 369966 - RNA, 64 nt, Homo Sapiens; identical to SEQ ID NO: 309748

SEQ ID NO: 369967 - RNA, 64 nt, Homo Sapiens; identical to SEQ ID NO: 309749

SEQ ID NO: 369968 - RNA, 56 nt, Homo Sapiens; identical to SEQ ID NO: 83586

SEQ ID NO: 369969 - RNA, 64 nt, Homo Sapiens; identical to SEQ ID NO: 309751

SEQ ID NO: 369970 - RNA, 64 nt, Homo Sapiens; identical to SEQ ID NO: 309752

SEQ ID NO: 369971 - RNA, 64 nt, Homo Sapiens; identical to SEQ ID NO: 309753

SEQ ID NO: 369972 - RNA, 64 nt, Homo Sapiens; identical to SEQ ID NO: 309754

SEQ ID NO: 369973 - RNA, 64 nt, Homo Sapiens; identical to SEQ ID NO: 309755

SEQ ID NO: 369974 - RNA, 64 nt, Homo Sapiens; identical to SEQ ID NO: 309756

SEQ ID NO: 369975 - RNA, 64 nt, Homo Sapiens; identical to SEQ ID NO: 309757

SEQ ID NO: 369976 - RNA, 64 nt, Homo Sapiens; identical to SEQ ID NO: 309758

SEQ ID NO: 369977 - RNA, 64 nt, Homo Sapiens; identical to SEQ ID NO: 309759

SEQ ID NO: 369978 - RNA, 64 nt, Homo Sapiens; identical to SEQ ID NO: 309760

SEQ ID NO: 369979 - RNA, 64 nt, Homo Sapiens; identical to SEQ ID NO: 309761

SEQ ID NO: 369980 - RNA, 64 nt, Homo Sapiens; identical to SEQ ID NO: 309762

SEQ ID NO: 369981 - RNA, 64 nt, Homo Sapiens; identical to SEQ ID NO: 309763

SEQ ID NO: 369982 - RNA, 64 nt, Homo Sapiens; identical to SEQ ID NO: 309764

SEQ ID NO: 369983 - RNA, 64 nt, Homo Sapiens; identical to SEQ ID NO: 309765

SEQ ID NO: 369984 - RNA, 64 nt, Homo Sapiens; identical to SEQ ID NO: 309766

SEQ ID NO: 369985 - RNA, 64 nt, Homo Sapiens; identical to SEQ ID NO: 309767

SEQ ID NO: 369986 - RNA, 64 nt, Homo Sapiens; identical to SEQ ID NO: 309768

SEQ ID NO: 369987 - RNA, 64 nt, Homo Sapiens; identical to SEQ ID NO: 309769

SEQ ID NO: 369988 - RNA, 64 nt, Homo Sapiens; identical to SEQ ID NO: 309770

SEQ ID NO: 369989 - RNA, 64 nt, Homo Sapiens; identical to SEQ ID NO: 309771

SEQ ID NO: 369990 - RNA, 64 nt, Homo Sapiens; identical to SEQ ID NO: 309772

SEQ ID NO: 369991 - RNA, 64 nt, Homo Sapiens; identical to SEQ ID NO: 309773

SEQ ID NO: 369992 - RNA, 64 nt, Homo Sapiens; identical to SEQ ID NO: 309774

SEQ ID NO: 369993 - RNA, 64 nt, Homo Sapiens; identical to SEQ ID NO: 309775

SEQ ID NO: 369994 - RNA, 64 nt, Homo Sapiens
gugcaguaugauauuuccuaaucuuuccuauuucuuaacaaaagauuuuaaaguacuucucuag

SEQ ID NO: 369995 - RNA, 64 nt, Homo Sapiens
acucaaagugccaaaggcuacaguuuuuaaugacuuaacaaauuguaccacauuguuaaggaca

SEQ ID NO: 369996 - RNA, 64 nt, Homo Sapiens
uuuuaucuauaaaauuuuccuacuauuauguucauuaacaaacuucuuuaucacauguaucuuc

SEQ ID NO: 369997 - RNA, 64 nt, Homo Sapiens
uaucuucuacauguaaaacauuucugaugauuuuuuaacaaaaaauauaugaauuucuucauuu

SEQ ID NO: 369998 - RNA, 64 nt, Homo Sapiens
uagggguucuauuuauuccuguuaguaaauaaaauuaacaaauuucuuuguuuaacaaaagauu

SEQ ID NO: 369999 - RNA, 64 nt, Homo Sapiens
ccuguuaguaaauaaaauuaacaaauuucuuuguuuaacaaaagauuaaucuuuaaaccacuaa

SEQ ID NO: 370000 - RNA, 64 nt, Homo Sapiens
uguguaugcuuaugccugggccauauguguauaauuaacaaaccuuuugcaagcacacuuguaa

SEQ ID NO: 370001 - RNA, 64 nt, Homo Sapiens
aaaaaagcuuuaaaaaaaaaucagggugguugguuuaacaaaaauauuucacauguggaaacuu

SEQ ID NO: 370002 - RNA, 64 nt, Homo Sapiens
guauuuucuuauagaagcaaauuaugacuaaaauuuaacaaauacuaugaugagaaacaaugaa

SEQ ID NO: 370003 - RNA, 64 nt, Homo Sapiens
gaguucuauauuuauuauguuauacuguagauuuuuaacaaagcguuuagccuuuacuugaaug

SEQ ID NO: 370004 - RNA, 64 nt, Homo Sapiens
aguccuaaauagcagcccucuccuguuuuuauuauuaacaaaacuguuuuaucuucuauauaau

SEQ ID NO: 370005 - RNA, 64 nt, Homo Sapiens
uaagacccucucaaacuaacaagauuuuccaguuuuaacaaauuaugaauggagccccuauaca

SEQ ID NO: 370006 - RNA, 64 nt, Homo Sapiens
aacaucccugaaaaccucugcauauaggucauuguuaacaaacaauuaacaaauaacauuauua

SEQ ID NO: 370007 - RNA, 64 nt, Homo Sapiens
acauuauuacauauaggucaguugugugaauuuauuaacaaauauuaguuaauuacugcuuugu

SEQ ID NO: 370008 - RNA, 64 nt, Homo Sapiens
guucuucaguaacacaucucaauuuggcuaaauuuuaacaaaaugagcauggaucucgaagcag

SEQ ID NO: 370009 - RNA, 64 nt, Homo Sapiens
gugaaguaacaauuuucugucgguugugucccacuuaacaaauugaggauuuaccaugcccuuu

SEQ ID NO: 370010 - RNA, 64 nt, Homo Sapiens
ucuuaagagaacuuaaagaacuggugauuuuuuuuuaacaaaaaaagggaccauugcaacuuuu

SEQ ID NO: 370011 - RNA, 64 nt, Homo Sapiens
gggagaaaacugaugucuucuaugcauccgauucuuaacaaaacugcagggagcuugaaaaaau

SEQ ID NO: 370012 - RNA, 64 nt, Homo Sapiens
gcauguauguauaaccuguugugaacaaucauacuuaacaaaacuacugaugguuuaugacaac

SEQ ID NO: 370013 - RNA, 64 nt, Homo Sapiens
agaauaaauaggcauaugauacccacuuggacuuuuaacaaaaguaaaggaauaaauuugcaua

SEQ ID NO: 370014 - RNA, 64 nt, Homo Sapiens
gcacguaauuuuuuucacaguuauuauucuucuauuaacaaauuauuuuuaucuuuccuaguac

SEQ ID NO: 370015 - RNA, 64 nt, Homo Sapiens
gcaucauaauagguaaagucuaauauuaguucccuuaacaaaauccuaacuguauaccagaauu

SEQ ID NO: 370016 - RNA, 64 nt, Homo Sapiens
aaagugccugaagcauaauugcuauuugcucacauuaacaaauuaagccuccccgaccccccaa

SEQ ID NO: 370017 - RNA, 64 nt, Homo Sapiens
uguaccacaaaacaauaucgaggaggugagcuaguuaacaaacuugcagucaguuauuauguau

SEQ ID NO: 370018 - RNA, 64 nt, Homo Sapiens
gugugaagaauuugcauuaccuuaugugauuguauuaacaaaaauugacaaaucuuccaaggga

SEQ ID NO: 370019 - RNA, 64 nt, Homo Sapiens
uucauuagaacagcuacuagcugauuccccuauuuuaacaaacugacaagagcacauccauaaa

SEQ ID NO: 370020 - RNA, 64 nt, Homo Sapiens
caguaguacaaccuaaacuuauaauggguacauuuuaacaaacuacaauaaauauuuugaguaa

SEQ ID NO: 370021 - RNA, 64 nt, Homo Sapiens
cauucuauuccucugacccauauuuaggguaaaauuaacaaaucuguugcccacaagcgccuuu

SEQ ID NO: 370022 - RNA, 64 nt, Homo Sapiens
gccagagucuaggcuaagcaauggcccuuaauuauuaacaaaguauaagcaagagacaauaaua

SEQ ID NO: 370023 - RNA, 64 nt, Homo Sapiens
cuuugcuuuguuaucaaauguuuuacccuugaucuuaacaaagcugugugcauugaagauuuua

SEQ ID NO: 370024 - RNA, 64 nt, Homo Sapiens
guugaaauguaaggugugcacagugaucuucaacuuaacaaacacuuacguucuccuuuauaaa

SEQ ID NO: 370025 - RNA, 64 nt, Homo Sapiens
aacuuguugcauuuaaaauauuuuuaaaaccuucuuaacaaaacuucuuaaaacuggaaaaaau

SEQ ID NO: 370026 - RNA, 64 nt, Homo Sapiens
cagaccugaaaggguaaagggcagcaauaugucauuaacaaaucaauaaugaauaaaauaaaaa

SEQ ID NO: 370027 - RNA, 64 nt, Homo Sapiens
ccaauacaacuaauccuauuauauuaacaauauauuaacaaacacaacuaggcaguuuuuaaga

SEQ ID NO: 370028 - RNA, 64 nt, Homo Sapiens
ugaaguuucugggaacacauaauauguagccaguuuaacaaagaagcugucaggugcacagccc

SEQ ID NO: 370029 - RNA, 64 nt, Homo Sapiens
uuacucaaaucaaaguuaaguacagaguuuauuuuuaacaaaugucauagcuaugucaccuuac

SEQ ID NO: 370030 - RNA, 64 nt, Homo Sapiens
auguaaguuuaaaauugagguccauuugauaauuuuaacaaacaguuccauagcaaugagguug

SEQ ID NO: 370031 - RNA, 64 nt, Homo Sapiens
uuagcaaucucucaaugccuauuauuguuuuaacuuaacaaaucucacagucuuuucuagauau

SEQ ID NO: 370032 - RNA, 64 nt, Homo Sapiens
uaaguucuugaaaauauaugcauucuccuaaauauuaacaaaaaugauuuggggaaaugacaug

SEQ ID NO: 370033 - RNA, 64 nt, Homo Sapiens
ucauucaccuguuuuauaugguuuaaaauucucuuuaacaaaauucagaaaauucaccugaaac

SEQ ID NO: 370034 - RNA, 64 nt, Homo Sapiens
uguacaaccuuaaggcucuugguuaucauauaauuuaacaaaauaaaugcauccuaccauucaa

SEQ ID NO: 370035 - RNA, 64 nt, Homo Sapiens
uuuucuucauugauaacugaugauauaaucuucuuuaacaaauaugcacugcuuucauguaaaa

SEQ ID NO: 370036 - RNA, 64 nt, Homo Sapiens
auugucuucaaaaagaauguugcacucugaucucuuaacaaauuguuacguucaaaguuuaaag

SEQ ID NO: 370037 - RNA, 64 nt, Homo Sapiens
acaaauuguuacguucaaaguuuaaagugauauauuaacaaagucaccuaguuauacaaacaau

SEQ ID NO: 370038 - RNA, 64 nt, Homo Sapiens
cuggaaaccuaaaaauauuuggugcacugcucaauuaacaaaccuacauggagaccuuaauuuu

SEQ ID NO: 370039 - RNA, 64 nt, Homo Sapiens
auuaacaaaccuacauggagaccuuaauuuugacuuaacaaauaguuuauguacugcucuuagg

SEQ ID NO: 370040 - RNA, 64 nt, Homo Sapiens
ucuggacacacuaucaccuauuacauuuuacugauuaacaaauaaauuggaauuuaaaaauauc

SEQ ID NO: 370041 - RNA, 64 nt, Homo Sapiens
cccucacuuuucccuacuuccucugcaaaaagauuuaacaaauacauucauaaggaaaugugug

SEQ ID NO: 370042 - RNA, 64 nt, Homo Sapiens
ccuugauaaauauauaugaucauugaaauacuuuuuaacaaaaaacagauucuauauuauuaua

SEQ ID NO: 370043 - RNA, 64 nt, Homo Sapiens
uauccuauauaggaaacuaagcauuguauuuuuuuuaacaaaucuaaaaaagcacuaugaacua

SEQ ID NO: 370044 - RNA, 64 nt, Homo Sapiens
ugucaagucuuuauaguuguuugaacuuucucuuuuaacaaaaaaacacuccccuuaacugucu

SEQ ID NO: 370045 - RNA, 64 nt, Homo Sapiens
uggagcaucugaauuacaucuguguuauuaacaguuaacaaaacugcaaaacuuuguauaauuc

SEQ ID NO: 370046 - RNA, 64 nt, Homo Sapiens
aucagaucccuccuucagcuaaaauugguuucauuuaacaaaagauggccaaauauauaccgug

SEQ ID NO: 370047 - RNA, 64 nt, Homo Sapiens
guaaaacaugacauucccugagguuuaauuucaguuaacaaaauagaucuuugguuuuuuuguc

SEQ ID NO: 370048 - RNA, 64 nt, Homo Sapiens
cagacauguuauucauccccaguaguagacaaaauuaacaaaauaacaaggaaauauagggaaa

SEQ ID NO: 370049 - RNA, 64 nt, Homo Sapiens
aaaacauuuaauaaacauucuccuuuuacuucaguuaacaaaagcauaauucuacaagaauguu

SEQ ID NO: 370050 - RNA, 64 nt, Homo Sapiens
gucauagaagaucucucacagaaauauaaaucccuuaacaaauauuaacaaguaagauucaugu

SEQ ID NO: 370051 - RNA, 64 nt, Homo Sapiens
auuuucaaaaacucaaucaauguaauucaguauuuuaacaaaaggaaugaaaaauuaucaucuc

SEQ ID NO: 370052 - RNA, 64 nt, Homo Sapiens
cccuuguucuuaucccucaaagagacuuccuucauuaacaaagauagauuccaaccccucaauc

SEQ ID NO: 370053 - RNA, 64 nt, Homo Sapiens
cugccccuuaaguccucuugcagaaaccuccccauuaacaaacaugaaucacccaacccuggau

SEQ ID NO: 370054 - RNA, 64 nt, Homo Sapiens
acuuuggauacaagguuuggcaaaaaaaaaaauauuaacaaaauauucuguaagaaucaauugu

SEQ ID NO: 370055 - RNA, 64 nt, Homo Sapiens
cccuuuaucucuguaaaauuuauacacacaaaaauuaacaaaagauucuguaagaauuaauugg

SEQ ID NO: 370056 - RNA, 64 nt, Homo Sapiens
agaucagauguucauccuaauuuggcaaaaugucuuaacaaaucggacccugugcaucugugca

SEQ ID NO: 370057 - RNA, 64 nt, Homo Sapiens
aaugagaauauguaauacuuuguuuucguuguuguuaacaaagguguuuuuuugguuggcuggu

SEQ ID NO: 370058 - RNA, 64 nt, Homo Sapiens
ucaccguggaggcuguggcuuugcccgcuacucagugacccaggccagggccaacaggccgacc

SEQ ID NO: 370059 - RNA, 64 nt, Homo Sapiens
uaaggguguucgugucaguggcggaggcacauuggugacccagcggcucagcugcugugucaga

SEQ ID NO: 370060 - RNA, 64 nt, Homo Sapiens
uucccccucugucccagaagguuggccagagggugugacccaguuacccuuuaacccccacccu

SEQ ID NO: 370061 - RNA, 64 nt, Homo Sapiens
ggccagagcucccguguggcaucugggagccacagugacccagccaccuggcucaggcuaguuc

SEQ ID NO: 370062 - RNA, 64 nt, Homo Sapiens
gucccgaguggccuucuuugaagagcucuagcaggugacccagccaccccaggaccugccacuu

SEQ ID NO: 370063 - RNA, 64 nt, Homo Sapiens
aaguauggauguuguggcccugugucuuccuagugugacccagccaggagcggaagcuucaggc

SEQ ID NO: 370064 - RNA, 64 nt, Homo Sapiens; identical to SEQ ID NO: 348352

SEQ ID NO: 370065 - RNA, 64 nt, Homo Sapiens; identical to SEQ ID NO: 348353

SEQ ID NO: 370066 - RNA, 64 nt, Homo Sapiens; identical to SEQ ID NO: 348354

SEQ ID NO: 370067 - RNA, 64 nt, Homo Sapiens; identical to SEQ ID NO: 348355

SEQ ID NO: 370068 - RNA, 64 nt, Homo Sapiens; identical to SEQ ID NO: 348356

SEQ ID NO: 370069 - RNA, 64 nt, Homo Sapiens; identical to SEQ ID NO: 348357

SEQ ID NO: 370070 - RNA, 64 nt, Homo Sapiens; identical to SEQ ID NO: 348358

SEQ ID NO: 370071 - RNA, 64 nt, Homo Sapiens; identical to SEQ ID NO: 348359

SEQ ID NO: 370072 - RNA, 64 nt, Homo Sapiens; identical to SEQ ID NO: 348360

SEQ ID NO: 370073 - RNA, 64 nt, Homo Sapiens; identical to SEQ ID NO: 348361

SEQ ID NO: 370074 - RNA, 64 nt, Homo Sapiens; identical to SEQ ID NO: 348362

SEQ ID NO: 370075 - RNA, 64 nt, Homo Sapiens; identical to SEQ ID NO: 348363

SEQ ID NO: 370076 - RNA, 64 nt, Homo Sapiens; identical to SEQ ID NO: 348364

SEQ ID NO: 370077 - RNA, 64 nt, Homo Sapiens; identical to SEQ ID NO: 348365

SEQ ID NO: 370078 - RNA, 64 nt, Homo Sapiens; identical to SEQ ID NO: 348366

SEQ ID NO: 370079 - RNA, 64 nt, Homo Sapiens; identical to SEQ ID NO: 348367

SEQ ID NO: 370080 - RNA, 64 nt, Homo Sapiens; identical to SEQ ID NO: 348368

SEQ ID NO: 370081 - RNA, 64 nt, Homo Sapiens; identical to SEQ ID NO: 348369

SEQ ID NO: 370082 - RNA, 64 nt, Homo Sapiens; identical to SEQ ID NO: 348370

SEQ ID NO: 370083 - RNA, 64 nt, Homo Sapiens; identical to SEQ ID NO: 348371

SEQ ID NO: 370084 - RNA, 64 nt, Homo Sapiens; identical to SEQ ID NO: 348372

SEQ ID NO: 370085 - RNA, 64 nt, Homo Sapiens; identical to SEQ ID NO: 348373

SEQ ID NO: 370086 - RNA, 64 nt, Homo Sapiens; identical to SEQ ID NO: 348374

SEQ ID NO: 370087 - RNA, 64 nt, Homo Sapiens; identical to SEQ ID NO: 348375

SEQ ID NO: 370088 - RNA, 64 nt, Homo Sapiens; identical to SEQ ID NO: 348376

SEQ ID NO: 370089 - RNA, 64 nt, Homo Sapiens; identical to SEQ ID NO: 348377

SEQ ID NO: 370090 - RNA, 64 nt, Homo Sapiens; identical to SEQ ID NO: 348378

SEQ ID NO: 370091 - RNA, 64 nt, Homo Sapiens; identical to SEQ ID NO: 348379

SEQ ID NO: 370092 - RNA, 64 nt, Homo Sapiens; identical to SEQ ID NO: 348380

SEQ ID NO: 370093 - RNA, 64 nt, Homo Sapiens; identical to SEQ ID NO: 348381

SEQ ID NO: 370094 - RNA, 64 nt, Homo Sapiens; identical to SEQ ID NO: 348382

SEQ ID NO: 370095 - RNA, 64 nt, Homo Sapiens; identical to SEQ ID NO: 348383

SEQ ID NO: 370096 - RNA, 64 nt, Homo Sapiens; identical to SEQ ID NO: 348384

SEQ ID NO: 370097 - RNA, 64 nt, Homo Sapiens; identical to SEQ ID NO: 348385

SEQ ID NO: 370098 - RNA, 64 nt, Homo Sapiens; identical to SEQ ID NO: 348386

SEQ ID NO: 370099 - RNA, 64 nt, Homo Sapiens; identical to SEQ ID NO: 348387

SEQ ID NO: 370100 - RNA, 64 nt, Homo Sapiens; identical to SEQ ID NO: 348388

SEQ ID NO: 370101 - RNA, 64 nt, Homo Sapiens; identical to SEQ ID NO: 348389

SEQ ID NO: 370102 - RNA, 64 nt, Homo Sapiens; identical to SEQ ID NO: 348390

SEQ ID NO: 370103 - RNA, 64 nt, Homo Sapiens; identical to SEQ ID NO: 348391

SEQ ID NO: 370104 - RNA, 64 nt, Homo Sapiens; identical to SEQ ID NO: 348392

SEQ ID NO: 370105 - RNA, 64 nt, Homo Sapiens; identical to SEQ ID NO: 348393

SEQ ID NO: 370106 - RNA, 64 nt, Homo Sapiens; identical to SEQ ID NO: 348394

SEQ ID NO: 370107 - RNA, 64 nt, Homo Sapiens; identical to SEQ ID NO: 348395

SEQ ID NO: 370108 - RNA, 64 nt, Homo Sapiens; identical to SEQ ID NO: 348396

SEQ ID NO: 370109 - RNA, 64 nt, Homo Sapiens; identical to SEQ ID NO: 348397

SEQ ID NO: 370110 - RNA, 64 nt, Homo Sapiens; identical to SEQ ID NO: 348398

SEQ ID NO: 370111 - RNA, 64 nt, Homo Sapiens; identical to SEQ ID NO: 348399

SEQ ID NO: 370112 - RNA, 64 nt, Homo Sapiens; identical to SEQ ID NO: 348400

SEQ ID NO: 370113 - RNA, 64 nt, Homo Sapiens; identical to SEQ ID NO: 348401

SEQ ID NO: 370114 - RNA, 64 nt, Homo Sapiens; identical to SEQ ID NO: 348402

SEQ ID NO: 370115 - RNA, 64 nt, Homo Sapiens; identical to SEQ ID NO: 348403

SEQ ID NO: 370116 - RNA, 64 nt, Homo Sapiens; identical to SEQ ID NO: 348404

SEQ ID NO: 370117 - RNA, 64 nt, Homo Sapiens; identical to SEQ ID NO: 348405

SEQ ID NO: 370118 - RNA, 64 nt, Homo Sapiens; identical to SEQ ID NO: 348406

SEQ ID NO: 370119 - RNA, 64 nt, Homo Sapiens; identical to SEQ ID NO: 348407

SEQ ID NO: 370120 - RNA, 64 nt, Homo Sapiens; identical to SEQ ID NO: 348408

SEQ ID NO: 370121 - RNA, 64 nt, Homo Sapiens; identical to SEQ ID NO: 348409

SEQ ID NO: 370122 - RNA, 64 nt, Homo Sapiens; identical to SEQ ID NO: 348410

SEQ ID NO: 370123 - RNA, 64 nt, Homo Sapiens; identical to SEQ ID NO: 348411

SEQ ID NO: 370124 - RNA, 64 nt, Homo Sapiens; identical to SEQ ID NO: 348412

SEQ ID NO: 370125 - RNA, 64 nt, Homo Sapiens; identical to SEQ ID NO: 348413

SEQ ID NO: 370126 - RNA, 64 nt, Homo Sapiens; identical to SEQ ID NO: 348414

SEQ ID NO: 370127 - RNA, 64 nt, Homo Sapiens; identical to SEQ ID NO: 348415

SEQ ID NO: 370128 - RNA, 64 nt, Homo Sapiens; identical to SEQ ID NO: 348416

SEQ ID NO: 370129 - RNA, 64 nt, Homo Sapiens; identical to SEQ ID NO: 348417

SEQ ID NO: 370130 - RNA, 64 nt, Homo Sapiens; identical to SEQ ID NO: 348418

SEQ ID NO: 370131 - RNA, 64 nt, Homo Sapiens; identical to SEQ ID NO: 348419

SEQ ID NO: 370132 - RNA, 64 nt, Homo Sapiens; identical to SEQ ID NO: 348420

SEQ ID NO: 370133 - RNA, 64 nt, Homo Sapiens; identical to SEQ ID NO: 348421

SEQ ID NO: 370134 - RNA, 64 nt, Homo Sapiens; identical to SEQ ID NO: 348422

SEQ ID NO: 370135 - RNA, 64 nt, Homo Sapiens; identical to SEQ ID NO: 348423

SEQ ID NO: 370136 - RNA, 64 nt, Homo Sapiens; identical to SEQ ID NO: 348424

SEQ ID NO: 370137 - RNA, 64 nt, Homo Sapiens; identical to SEQ ID NO: 348425

SEQ ID NO: 370138 - RNA, 64 nt, Homo Sapiens; identical to SEQ ID NO: 348426

SEQ ID NO: 370139 - RNA, 64 nt, Homo Sapiens; identical to SEQ ID NO: 348427

SEQ ID NO: 370140 - RNA, 64 nt, Homo Sapiens; identical to SEQ ID NO: 348428

SEQ ID NO: 370141 - RNA, 64 nt, Homo Sapiens; identical to SEQ ID NO: 348429

SEQ ID NO: 370142 - RNA, 64 nt, Homo Sapiens; identical to SEQ ID NO: 348430

SEQ ID NO: 370143 - RNA, 64 nt, Homo Sapiens; identical to SEQ ID NO: 348431

SEQ ID NO: 370144 - RNA, 64 nt, Homo Sapiens; identical to SEQ ID NO: 348432

SEQ ID NO: 370145 - RNA, 64 nt, Homo Sapiens; identical to SEQ ID NO: 348433

SEQ ID NO: 370146 - RNA, 64 nt, Homo Sapiens; identical to SEQ ID NO: 348434

SEQ ID NO: 370147 - RNA, 64 nt, Homo Sapiens; identical to SEQ ID NO: 348435

SEQ ID NO: 370148 - RNA, 64 nt, Homo Sapiens; identical to SEQ ID NO: 348436

SEQ ID NO: 370149 - RNA, 64 nt, Homo Sapiens
ggauauaaaagggacaaaaagguuuuaucauuuugccuaaaauauacauuccuguuauuuucug

SEQ ID NO: 370150 - RNA, 64 nt, Homo Sapiens
aucuuuguugguaugcauauuucugaaugcaagugccuaaaaagcuuauuuauaaaaggaaugu

SEQ ID NO: 370151 - RNA, 64 nt, Homo Sapiens
gugcugagauuacagacgugagccacugcguccugccuaaaaugaauuuucuagaugauugaau

SEQ ID NO: 370152 - RNA, 64 nt, Homo Sapiens
ucucugauaccuucauuuaauauaucaauauugggccuaaaacaguauucuguaaagcuuaaau

SEQ ID NO: 370153 - RNA, 64 nt, Homo Sapiens
acacucagaaacgaggaccuugccuaugcugcuggccuaaaaccuuucuaaggagucucaggga

SEQ ID NO: 370154 - RNA, 64 nt, Homo Sapiens
ggaaacguuaagaaguuggaaggacgcgguuaaugccuaaaaaugcgagagaaagaggaacuga

SEQ ID NO: 370155 - RNA, 64 nt, Homo Sapiens
gccccugcaaagaagggagaaagccagagcccaagccuaaaaagcugcuaaaccugcuccucca

SEQ ID NO: 370156 - RNA, 64 nt, Homo Sapiens
caaggcaaaacaacuuugaugcaaugcaagaauggccuaaaacaguaucaaguauuucuuuaua

SEQ ID NO: 370157 - RNA, 64 nt, Homo Sapiens
gccaguuuuauuuucuaaauucuuucaugagcuugccuaaaauucggaaugguuuucggguugu

SEQ ID NO: 370158 - RNA, 64 nt, Homo Sapiens
gugucacuccauaaaaagaaagcuaauacuaauagccuaaaagauuuugugaaauuucaugaaa

SEQ ID NO: 370159 - RNA, 64 nt, Homo Sapiens
caauuguuuugacaaaauaaauuuacuaaacuuggccuaaaaucaaaccuuggcacagagguau

SEQ ID NO: 370160 - RNA, 64 nt, Homo Sapiens
uauugaacauuuugacaaauauuuauuuuuguaagccuaaaaaugauucuuugaaaguuuaaag

SEQ ID NO: 370161 - RNA, 64 nt, Homo Sapiens; identical to SEQ ID NO: 73896

SEQ ID NO: 370162 - RNA, 64 nt, Homo Sapiens; identical to SEQ ID NO: 73897

SEQ ID NO: 370163 - RNA, 64 nt, Homo Sapiens; identical to SEQ ID NO: 73898

SEQ ID NO: 370164 - RNA, 64 nt, Homo Sapiens; identical to SEQ ID NO: 73899

SEQ ID NO: 370165 - RNA, 64 nt, Homo Sapiens; identical to SEQ ID NO: 73900

SEQ ID NO: 370166 - RNA, 64 nt, Homo Sapiens; identical to SEQ ID NO: 73901

SEQ ID NO: 370167 - RNA, 64 nt, Homo Sapiens; identical to SEQ ID NO: 73902

SEQ ID NO: 370168 - RNA, 64 nt, Homo Sapiens; identical to SEQ ID NO: 73903

SEQ ID NO: 370169 - RNA, 64 nt, Homo Sapiens; identical to SEQ ID NO: 73904

SEQ ID NO: 370170 - RNA, 64 nt, Homo Sapiens; identical to SEQ ID NO: 73905

SEQ ID NO: 370171 - RNA, 64 nt, Homo Sapiens; identical to SEQ ID NO: 73906

SEQ ID NO: 370172 - RNA, 64 nt, Homo Sapiens; identical to SEQ ID NO: 73907

SEQ ID NO: 370173 - RNA, 64 nt, Homo Sapiens; identical to SEQ ID NO: 73908

SEQ ID NO: 370174 - RNA, 64 nt, Homo Sapiens; identical to SEQ ID NO: 73909

SEQ ID NO: 370175 - RNA, 64 nt, Homo Sapiens; identical to SEQ ID NO: 73910

SEQ ID NO: 370176 - RNA, 64 nt, Homo Sapiens; identical to SEQ ID NO: 73911

SEQ ID NO: 370177 - RNA, 64 nt, Homo Sapiens; identical to SEQ ID NO: 73912

SEQ ID NO: 370178 - RNA, 65 nt, Homo Sapiens
cucguguaugacagguagcuagggagcucuuggagauguagcaguugggauugugggagauuacu

SEQ ID NO: 370179 - RNA, 65 nt, Homo Sapiens
aauuaagugaaaaaaguuuaaucccagaagaguaaauguagcaugaugcccuuucuaaaugaaag

SEQ ID NO: 370180 - RNA, 65 nt, Homo Sapiens
aucuuagccuacguuaccaguucuuuggaaaugaaauguagcacaauaaagaccuccaaggguac

SEQ ID NO: 370181 - RNA, 65 nt, Homo Sapiens
gaguggugauacccagaccauauagauguuuguggauguagcacuguuagugacccacaggacag

SEQ ID NO: 370182 - RNA, 65 nt, Homo Sapiens
cccaccuagcucccuggccaaaugcguucugcagcauguagcaugggcagcucuuccugccacug

SEQ ID NO: 370183 - RNA, 65 nt, Homo Sapiens
cgcugcagcuggccacacugacuguuuucugagaaauguagcaucuugacucucccggcucugcc

SEQ ID NO: 370184 - RNA, 65 nt, Homo Sapiens
gaaugaaaauuguugagguuaucucccauucaaucauguagcaagaacuuaaagaaauucacuac

SEQ ID NO: 370185 - RNA, 65 nt, Homo Sapiens
agaaaauagagaauuuaauauauggugauugggauauguagcauucaaaaaaagugaauugccaa

SEQ ID NO: 370186 - RNA, 65 nt, Homo Sapiens
ucaauguguaagauauauguauuucaggguauaagauguagcauucuuggcucucuacacauggc

SEQ ID NO: 370187 - RNA, 65 nt, Homo Sapiens
aaaaauauauuuuaaugaagauuguggucguguuaauguagcacaauucagcuuucuuuaacuua

SEQ ID NO: 370188 - RNA, 65 nt, Homo Sapiens
cacuuagaguaaauggacuuggacauacagugccuauguagcaggcaaugcuaugguuuccaugu

SEQ ID NO: 370189 - RNA, 65 nt, Homo Sapiens
uauggcuuaaucucuuagacuuuuaaugaacuuaaauguagcacaaauaaaagcaugcccucagc

SEQ ID NO: 370190 - RNA, 65 nt, Homo Sapiens
aaaauguuacaacucuacuauaugcugaauuauacauguagcaccauuuuaaaaaggcuuuggcu

SEQ ID NO: 370191 - RNA, 65 nt, Homo Sapiens
aucacacuguauuuaaauugacuacuuuaaaucaaauguagcauuuuggcaauuuauaauuuauu

SEQ ID NO: 370192 - RNA, 65 nt, Homo Sapiens
gacagagcuagacuguaaagaaaaauuugggauucauguagcagacccagaggggaacuugauuc

SEQ ID NO: 370193 - RNA, 65 nt, Homo Sapiens
auaccaggcagacagaaccuuuuugauaugagacaauguagcagauuuugaguuaaaaauggcac

SEQ ID NO: 370194 - RNA, 65 nt, Homo Sapiens
ggcacucuuaaaugaucugccucuaaaagcguuggauguagcauuaugcaauuagguuuuuccuu

SEQ ID NO: 370195 - RNA, 65 nt, Homo Sapiens
cauuguacuaccuguguauauaguuuuuaccuuuuauguagcacauaaacuuuggggaagggagg

SEQ ID NO: 370196 - RNA, 65 nt, Homo Sapiens
uuucaugagggagucaauauguaguggaaagaagcauguagcaaaaaagacaaccuugaucuuua

SEQ ID NO: 370197 - RNA, 65 nt, Homo Sapiens
aaaaaagcagaacccacuggaguagaaaaggaagcauguagcauauacucaguagugaaauuuaa

SEQ ID NO: 370198 - RNA, 65 nt, Homo Sapiens
uauugucuugguugccaguaguaccuuguuuugccauguagcagacaacacacaaaauaaugcag

SEQ ID NO: 370199 - RNA, 65 nt, Homo Sapiens
agccucagcucauagugaacacagcagaccuagaaauguagcagcagccuacugaguagcuuuca

SEQ ID NO: 370200 - RNA, 64 nt, Homo Sapiens
ucccaaagugcugggauuacaggcaugagccaccaugccagacuucccauuuuacuuucugcaa

SEQ ID NO: 370201 - RNA, 64 nt, Homo Sapiens
uggcuauuguccaugcucccagaaucaagcauaaaugccagacacggcgauugagaagccaauc

SEQ ID NO: 370202 - RNA, 64 nt, Homo Sapiens
aaauuuuaagaggacucacccucucagauugguaaugccagaaacauauauugauaaaaaguga

SEQ ID NO: 370203 - RNA, 64 nt, Homo Sapiens
uacuuccauaacuaacucacaauggaaauaagagaugccagaacacagaaguaauggauaacag

SEQ ID NO: 370204 - RNA, 64 nt, Homo Sapiens
gguuuaccccauucacaaaauuuauaguugcuuuaugccagaguuacagauuuuuuuucaaguu

SEQ ID NO: 370205 - RNA, 64 nt, Homo Sapiens
ugaacuuuaaucagucugcauuguaaaaaucagcaugccagacccccgagagggauguuuggca

SEQ ID NO: 370206 - RNA, 64 nt, Homo Sapiens
aaaaugaaaaaggaaauugaggacacuuuugcaaaugccagaauguaagauucauucagugugc

SEQ ID NO: 370207 - RNA, 64 nt, Homo Sapiens
uugcacagagcauaagucuacugggugccuuuacaugccagaggcugaugcugcacuguugaug

SEQ ID NO: 370208 - RNA, 64 nt, Homo Sapiens
cuggaaaguagcuuacccuagaaaacagcugcaaaugccagaaagaugaucccuaaaaauguug

SEQ ID NO: 370209 - RNA, 64 nt, Homo Sapiens
ucugagaguguguacaaguuuuaguauacaugccaugccagaagauaguguaugcaagaagucu

SEQ ID NO: 370210 - RNA, 64 nt, Homo Sapiens
guagcagugcuagcucugccuucaggcaugcaauaugccagaacuacagacaacagcccacagg

SEQ ID NO: 370211 - RNA, 64 nt, Homo Sapiens
ccacaggaugcaaaagugcuuugccaucuuaaaaaugccagaucacucagagccuaugaaugug

SEQ ID NO: 370212 - RNA, 64 nt, Homo Sapiens
ugucuuuuuaacaaaacauuugugagaugauugucaggacuaacuuuuuguacaguauuuugaa

SEQ ID NO: 370213 - RNA, 64 nt, Homo Sapiens
gagccgaguaguugaucuuuuuuucuuuuugagucaggacuauggacagggucuguacuuuuuu

SEQ ID NO: 370214 - RNA, 64 nt, Homo Sapiens
uucauggaauagucaagacaucaagguaaggaaacaggacuauugacaggacuauuguacagua

SEQ ID NO: 370215 - RNA, 64 nt, Homo Sapiens
ucaagacaucaagguaaggaaacaggacuauugacaggacuauuguacaguaugacaagauaag

SEQ ID NO: 370216 - RNA, 64 nt, Homo Sapiens
uaccccuuuccauuuuggauucucggcugaguucucacagaagcauuuuccccauguggcucuc

SEQ ID NO: 370217 - RNA, 64 nt, Homo Sapiens
gagaaguuuuguggugccgcuggugacaaggaacucacagaaagguuucuuagcuggugaagaa

SEQ ID NO: 370218 - RNA, 64 nt, Homo Sapiens
uaguaacagaaucaaacuaagauuaaauaaugauucacagaauuuucuaaucuuuaguagauuu

SEQ ID NO: 370219 - RNA, 64 nt, Homo Sapiens
auccugccuaaggcaaagaaagacacaaucagaaucacagaaaagauaucuucagcuuguaguc

SEQ ID NO: 370220 - RNA, 64 nt, Homo Sapiens
auaaucauggcuaaauauuuggcugccaaggcacucacagaaucagaggaaucaaguucugagu

SEQ ID NO: 370221 - RNA, 64 nt, Homo Sapiens
uuucuggaugauucuguguuuagaggauacaacaucacagaaucuguuucccugacauuuucaa

SEQ ID NO: 370222 - RNA, 64 nt, Homo Sapiens
uagccucagaaggguuuaggcgaccuucugaaacucacagaagucacgugauggagagaggauu

SEQ ID NO: 370223 - RNA, 64 nt, Homo Sapiens
auuugguggcccaucagucuggccaucugucacgucacagaagcaaaccgugccuucuggcucu

SEQ ID NO: 370224 - RNA, 64 nt, Homo Sapiens
acagucaacguugguacauugaaccaccaucaauucacagaauuaguguccaauuguauucaca

SEQ ID NO: 370225 - RNA, 64 nt, Homo Sapiens
accaucaauucacagaauuaguguccaauuguauucacagaaccauucaguuuacccauugcua

SEQ ID NO: 370226 - RNA, 64 nt, Homo Sapiens
ucuugggcccuggcauccugggucacagcugggcucacagaagcgggucucaggaaggucugga

SEQ ID NO: 370227 - RNA, 64 nt, Homo Sapiens
gccagagggucucaggaaggcagcugagagagagucacagaaagcaggaaguacccugggggcu

SEQ ID NO: 370228 - RNA, 64 nt, Homo Sapiens
accaaauauaguugaacauauuuaaaauacauuuucacagaauggaugaauuaguuguuucuuc

SEQ ID NO: 370229 - RNA, 64 nt, Homo Sapiens
cagaagauacucuuuuuuaugcuccuuacugugaucacagaaaaauuaaaaauccaagugcucu

SEQ ID NO: 370230 - RNA, 64 nt, Homo Sapiens
aaguaguugccuuuggucauccaucugcuaauagucacagaauacagugaaaugacauaguuuu

SEQ ID NO: 370231 - RNA, 64 nt, Homo Sapiens
auucagauccaaaauaauuucauaccccauuuuuucacagaauucuuauauaguaaauguauca

SEQ ID NO: 370232 - RNA, 64 nt, Homo Sapiens
uaugaguacuacuuuuguuaaaugugaaaaacccucacagaaagucaucgaggcaaaaagaggc

SEQ ID NO: 370233 - RNA, 64 nt, Homo Sapiens
uuuuuuaguaagcaagauaccuuuuuauuucaauucacagaauggaauuuuuuuguuucauguc

SEQ ID NO: 370234 - RNA, 64 nt, Homo Sapiens
gcuuuuuaaaacaucaucugagaccagccaguagucacagaacugcuguuuacacaguucucag

SEQ ID NO: 370235 - RNA, 64 nt, Homo Sapiens
gcugugguuucuuagaauaugaccaugagccauuucacagaaaaaccaucccaccgaagauauu

SEQ ID NO: 370236 - RNA, 64 nt, Homo Sapiens
gccacuaaauacguuauugcuugaugaagaccuuucacagaauccuauggauugcagcauuuca

SEQ ID NO: 370237 - RNA, 64 nt, Homo Sapiens
caacugagaauuuauuuuuguuucauugguuguuucacagaauuagaacacacacgacuuuuua

SEQ ID NO: 370238 - RNA, 64 nt, Homo Sapiens
agauuuuuuuaaagcauuuguugaggaguuaguaucacagaauuauccccaauugacucagagu

SEQ ID NO: 370239 - RNA, 64 nt, Homo Sapiens
ugccaggcgguucaagugaacacccacucuggagucacagaaucucacaccaccaacaguaagc

SEQ ID NO: 370240 - RNA, 64 nt, Homo Sapiens
aauuuuacaucagaaaaugggauaaacauacauuucacagaaaauaaucaagacuugcucugca

SEQ ID NO: 370241 - RNA, 64 nt, Homo Sapiens
acuugcucugcagccacucaguagucuucuguggucacagaaguaaacauuguuggcuuuguau

SEQ ID NO: 370242 - RNA, 64 nt, Homo Sapiens
ucuauaguugcauuguugcaaucaaaauauguugucacagaaagaauagguggaaggucauagc

SEQ ID NO: 370243 - RNA, 64 nt, Homo Sapiens
ucacuggcuuccaugcacccaccugacgguagccucacagaaguccuggcugucacucaggugg

SEQ ID NO: 370244 - RNA, 64 nt, Homo Sapiens
agaucugaaaacacauguccaaaaaaugaaauauucacagaaucauguaugugacccuacccau

SEQ ID NO: 370245 - RNA, 64 nt, Homo Sapiens
gaagugaaaccaucaaacaucaugauauuauuuaucacagaaauagaacaagacuugaauuuac

SEQ ID NO: 370246 - RNA, 64 nt, Homo Sapiens
uucucacgagggaacguuugccaaggcucugaccucacagaagaugcccagggcccagaagcca

SEQ ID NO: 370247 - RNA, 64 nt, Homo Sapiens
uuuccauuagcugccaugcucugcugccucuaauucacagaaugcacuuucuacccugugugcc

SEQ ID NO: 370248 - RNA, 65 nt, Homo Sapiens; identical to SEQ ID NO: 180914

SEQ ID NO: 370249 - RNA, 65 nt, Homo Sapiens; identical to SEQ ID NO: 180915

SEQ ID NO: 370250 - RNA, 65 nt, Homo Sapiens; identical to SEQ ID NO: 180916

SEQ ID NO: 370251 - RNA, 65 nt, Homo Sapiens; identical to SEQ ID NO: 180917

SEQ ID NO: 370252 - RNA, 65 nt, Homo Sapiens; identical to SEQ ID NO: 180918

SEQ ID NO: 370253 - RNA, 65 nt, Homo Sapiens; identical to SEQ ID NO: 180919

SEQ ID NO: 370254 - RNA, 65 nt, Homo Sapiens; identical to SEQ ID NO: 180920

SEQ ID NO: 370255 - RNA, 65 nt, Homo Sapiens; identical to SEQ ID NO: 180921

SEQ ID NO: 370256 - RNA, 65 nt, Homo Sapiens; identical to SEQ ID NO: 180922

SEQ ID NO: 370257 - RNA, 65 nt, Homo Sapiens; identical to SEQ ID NO: 180923

SEQ ID NO: 370258 - RNA, 65 nt, Homo Sapiens; identical to SEQ ID NO: 180924

SEQ ID NO: 370259 - RNA, 65 nt, Homo Sapiens; identical to SEQ ID NO: 180925

SEQ ID NO: 370260 - RNA, 65 nt, Homo Sapiens; identical to SEQ ID NO: 180926

SEQ ID NO: 370261 - RNA, 65 nt, Homo Sapiens; identical to SEQ ID NO: 180927

SEQ ID NO: 370262 - RNA, 65 nt, Homo Sapiens; identical to SEQ ID NO: 180928

SEQ ID NO: 370263 - RNA, 65 nt, Homo Sapiens; identical to SEQ ID NO: 180929

SEQ ID NO: 370264 - RNA, 65 nt, Homo Sapiens; identical to SEQ ID NO: 180930

SEQ ID NO: 370265 - RNA, 65 nt, Homo Sapiens; identical to SEQ ID NO: 180931

SEQ ID NO: 370266 - RNA, 65 nt, Homo Sapiens; identical to SEQ ID NO: 180932

SEQ ID NO: 370267 - RNA, 65 nt, Homo Sapiens; identical to SEQ ID NO: 180933

SEQ ID NO: 370268 - RNA, 65 nt, Homo Sapiens; identical to SEQ ID NO: 180934

SEQ ID NO: 370269 - RNA, 65 nt, Homo Sapiens; identical to SEQ ID NO: 180935

SEQ ID NO: 370270 - RNA, 65 nt, Homo Sapiens; identical to SEQ ID NO: 180936

SEQ ID NO: 370271 - RNA, 65 nt, Homo Sapiens; identical to SEQ ID NO: 180937

SEQ ID NO: 370272 - RNA, 65 nt, Homo Sapiens; identical to SEQ ID NO: 180938

SEQ ID NO: 370273 - RNA, 65 nt, Homo Sapiens; identical to SEQ ID NO: 180939

SEQ ID NO: 370274 - RNA, 65 nt, Homo Sapiens; identical to SEQ ID NO: 180940

SEQ ID NO: 370275 - RNA, 65 nt, Homo Sapiens; identical to SEQ ID NO: 180941

SEQ ID NO: 370276 - RNA, 65 nt, Homo Sapiens; identical to SEQ ID NO: 180942

SEQ ID NO: 370277 - RNA, 65 nt, Homo Sapiens; identical to SEQ ID NO: 180943

SEQ ID NO: 370278 - RNA, 65 nt, Homo Sapiens; identical to SEQ ID NO: 180944

SEQ ID NO: 370279 - RNA, 65 nt, Homo Sapiens; identical to SEQ ID NO: 180945

SEQ ID NO: 370280 - RNA, 65 nt, Homo Sapiens; identical to SEQ ID NO: 180946

SEQ ID NO: 370281 - RNA, 65 nt, Homo Sapiens; identical to SEQ ID NO: 180947

SEQ ID NO: 370282 - RNA, 65 nt, Homo Sapiens; identical to SEQ ID NO: 180948

SEQ ID NO: 370283 - RNA, 65 nt, Homo Sapiens; identical to SEQ ID NO: 180949

SEQ ID NO: 370284 - RNA, 65 nt, Homo Sapiens; identical to SEQ ID NO: 180950

SEQ ID NO: 370285 - RNA, 65 nt, Homo Sapiens; identical to SEQ ID NO: 180951

SEQ ID NO: 370286 - RNA, 65 nt, Homo Sapiens; identical to SEQ ID NO: 180952

SEQ ID NO: 370287 - RNA, 65 nt, Homo Sapiens; identical to SEQ ID NO: 180953

SEQ ID NO: 370288 - RNA, 65 nt, Homo Sapiens; identical to SEQ ID NO: 180954

SEQ ID NO: 370289 - RNA, 65 nt, Homo Sapiens; identical to SEQ ID NO: 180955

SEQ ID NO: 370290 - RNA, 65 nt, Homo Sapiens; identical to SEQ ID NO: 180956

SEQ ID NO: 370291 - RNA, 65 nt, Homo Sapiens; identical to SEQ ID NO: 180957

SEQ ID NO: 370292 - RNA, 65 nt, Homo Sapiens; identical to SEQ ID NO: 180958

SEQ ID NO: 370293 - RNA, 65 nt, Homo Sapiens; identical to SEQ ID NO: 180959

SEQ ID NO: 370294 - RNA, 65 nt, Homo Sapiens; identical to SEQ ID NO: 180960

SEQ ID NO: 370295 - RNA, 65 nt, Homo Sapiens; identical to SEQ ID NO: 180961

SEQ ID NO: 370296 - RNA, 65 nt, Homo Sapiens; identical to SEQ ID NO: 180962

SEQ ID NO: 370297 - RNA, 65 nt, Homo Sapiens; identical to SEQ ID NO: 180963

SEQ ID NO: 370298 - RNA, 65 nt, Homo Sapiens; identical to SEQ ID NO: 180964

SEQ ID NO: 370299 - RNA, 65 nt, Homo Sapiens; identical to SEQ ID NO: 180965

SEQ ID NO: 370300 - RNA, 65 nt, Homo Sapiens; identical to SEQ ID NO: 180966

SEQ ID NO: 370301 - RNA, 65 nt, Homo Sapiens; identical to SEQ ID NO: 180967

SEQ ID NO: 370302 - RNA, 65 nt, Homo Sapiens; identical to SEQ ID NO: 180968

SEQ ID NO: 370303 - RNA, 65 nt, Homo Sapiens; identical to SEQ ID NO: 180969

SEQ ID NO: 370304 - RNA, 65 nt, Homo Sapiens; identical to SEQ ID NO: 180970

SEQ ID NO: 370305 - RNA, 65 nt, Homo Sapiens; identical to SEQ ID NO: 180971

SEQ ID NO: 370306 - RNA, 65 nt, Homo Sapiens; identical to SEQ ID NO: 180972

SEQ ID NO: 370307 - RNA, 65 nt, Homo Sapiens; identical to SEQ ID NO: 180973

SEQ ID NO: 370308 - RNA, 65 nt, Homo Sapiens; identical to SEQ ID NO: 180974

SEQ ID NO: 370309 - RNA, 65 nt, Homo Sapiens; identical to SEQ ID NO: 180975

SEQ ID NO: 370310 - RNA, 65 nt, Homo Sapiens; identical to SEQ ID NO: 180976

SEQ ID NO: 370311 - RNA, 65 nt, Homo Sapiens; identical to SEQ ID NO: 180977

SEQ ID NO: 370312 - RNA, 65 nt, Homo Sapiens; identical to SEQ ID NO: 180978

SEQ ID NO: 370313 - RNA, 65 nt, Homo Sapiens; identical to SEQ ID NO: 180979

SEQ ID NO: 370314 - RNA, 65 nt, Homo Sapiens; identical to SEQ ID NO: 180980

SEQ ID NO: 370315 - RNA, 65 nt, Homo Sapiens; identical to SEQ ID NO: 180981

SEQ ID NO: 370316 - RNA, 65 nt, Homo Sapiens; identical to SEQ ID NO: 180982

SEQ ID NO: 370317 - RNA, 65 nt, Homo Sapiens; identical to SEQ ID NO: 180983

SEQ ID NO: 370318 - RNA, 65 nt, Homo Sapiens; identical to SEQ ID NO: 180984

SEQ ID NO: 370319 - RNA, 65 nt, Homo Sapiens; identical to SEQ ID NO: 180985

SEQ ID NO: 370320 - RNA, 65 nt, Homo Sapiens; identical to SEQ ID NO: 180986

SEQ ID NO: 370321 - RNA, 65 nt, Homo Sapiens; identical to SEQ ID NO: 180987

SEQ ID NO: 370322 - RNA, 65 nt, Homo Sapiens; identical to SEQ ID NO: 180988

SEQ ID NO: 370323 - RNA, 65 nt, Homo Sapiens; identical to SEQ ID NO: 180989

SEQ ID NO: 370324 - RNA, 65 nt, Homo Sapiens; identical to SEQ ID NO: 180990

SEQ ID NO: 370325 - RNA, 65 nt, Homo Sapiens; identical to SEQ ID NO: 180991

SEQ ID NO: 370326 - RNA, 65 nt, Homo Sapiens; identical to SEQ ID NO: 180992

SEQ ID NO: 370327 - RNA, 65 nt, Homo Sapiens; identical to SEQ ID NO: 180993

SEQ ID NO: 370328 - RNA, 65 nt, Homo Sapiens; identical to SEQ ID NO: 180994

SEQ ID NO: 370329 - RNA, 65 nt, Homo Sapiens; identical to SEQ ID NO: 180995

SEQ ID NO: 370330 - RNA, 65 nt, Homo Sapiens; identical to SEQ ID NO: 180996

SEQ ID NO: 370331 - RNA, 65 nt, Homo Sapiens; identical to SEQ ID NO: 180997

SEQ ID NO: 370332 - RNA, 65 nt, Homo Sapiens; identical to SEQ ID NO: 180998

SEQ ID NO: 370333 - RNA, 65 nt, Homo Sapiens; identical to SEQ ID NO: 180999

SEQ ID NO: 370334 - RNA, 65 nt, Homo Sapiens; identical to SEQ ID NO: 181000

SEQ ID NO: 370335 - RNA, 65 nt, Homo Sapiens; identical to SEQ ID NO: 181001

SEQ ID NO: 370336 - RNA, 65 nt, Homo Sapiens; identical to SEQ ID NO: 181002

SEQ ID NO: 370337 - RNA, 65 nt, Homo Sapiens; identical to SEQ ID NO: 181003

SEQ ID NO: 370338 - RNA, 65 nt, Homo Sapiens; identical to SEQ ID NO: 181004

SEQ ID NO: 370339 - RNA, 65 nt, Homo Sapiens; identical to SEQ ID NO: 181005

SEQ ID NO: 370340 - RNA, 65 nt, Homo Sapiens; identical to SEQ ID NO: 181006

SEQ ID NO: 370341 - RNA, 65 nt, Homo Sapiens; identical to SEQ ID NO: 181007

SEQ ID NO: 370342 - RNA, 65 nt, Homo Sapiens; identical to SEQ ID NO: 181008

SEQ ID NO: 370343 - RNA, 65 nt, Homo Sapiens; identical to SEQ ID NO: 181009

SEQ ID NO: 370344 - RNA, 65 nt, Homo Sapiens; identical to SEQ ID NO: 181010

SEQ ID NO: 370345 - RNA, 65 nt, Homo Sapiens; identical to SEQ ID NO: 181011

SEQ ID NO: 370346 - RNA, 65 nt, Homo Sapiens; identical to SEQ ID NO: 181012

SEQ ID NO: 370347 - RNA, 65 nt, Homo Sapiens; identical to SEQ ID NO: 181013

SEQ ID NO: 370348 - RNA, 65 nt, Homo Sapiens; identical to SEQ ID NO: 181014

SEQ ID NO: 370349 - RNA, 65 nt, Homo Sapiens; identical to SEQ ID NO: 181015

SEQ ID NO: 370350 - RNA, 65 nt, Homo Sapiens; identical to SEQ ID NO: 181016

SEQ ID NO: 370351 - RNA, 65 nt, Homo Sapiens; identical to SEQ ID NO: 181017

SEQ ID NO: 370352 - RNA, 65 nt, Homo Sapiens; identical to SEQ ID NO: 181018

SEQ ID NO: 370353 - RNA, 65 nt, Homo Sapiens; identical to SEQ ID NO: 181019

SEQ ID NO: 370354 - RNA, 65 nt, Homo Sapiens; identical to SEQ ID NO: 181020

SEQ ID NO: 370355 - RNA, 65 nt, Homo Sapiens; identical to SEQ ID NO: 181021

SEQ ID NO: 370356 - RNA, 65 nt, Homo Sapiens; identical to SEQ ID NO: 181022

SEQ ID NO: 370357 - RNA, 65 nt, Homo Sapiens; identical to SEQ ID NO: 181023

SEQ ID NO: 370358 - RNA, 65 nt, Homo Sapiens; identical to SEQ ID NO: 181024

SEQ ID NO: 370359 - RNA, 65 nt, Homo Sapiens; identical to SEQ ID NO: 181025

SEQ ID NO: 370360 - RNA, 65 nt, Homo Sapiens; identical to SEQ ID NO: 181026

SEQ ID NO: 370361 - RNA, 65 nt, Homo Sapiens; identical to SEQ ID NO: 181027

SEQ ID NO: 370362 - RNA, 65 nt, Homo Sapiens; identical to SEQ ID NO: 181028

SEQ ID NO: 370363 - RNA, 65 nt, Homo Sapiens; identical to SEQ ID NO: 181029

SEQ ID NO: 370364 - RNA, 65 nt, Homo Sapiens; identical to SEQ ID NO: 181030

SEQ ID NO: 370365 - RNA, 65 nt, Homo Sapiens; identical to SEQ ID NO: 181031

SEQ ID NO: 370366 - RNA, 65 nt, Homo Sapiens; identical to SEQ ID NO: 181032

SEQ ID NO: 370367 - RNA, 65 nt, Homo Sapiens; identical to SEQ ID NO: 181033

SEQ ID NO: 370368 - RNA, 65 nt, Homo Sapiens; identical to SEQ ID NO: 181034

SEQ ID NO: 370369 - RNA, 65 nt, Homo Sapiens; identical to SEQ ID NO: 181035

SEQ ID NO: 370370 - RNA, 65 nt, Homo Sapiens; identical to SEQ ID NO: 181036

SEQ ID NO: 370371 - RNA, 65 nt, Homo Sapiens; identical to SEQ ID NO: 181037

SEQ ID NO: 370372 - RNA, 65 nt, Homo Sapiens; identical to SEQ ID NO: 181038

SEQ ID NO: 370373 - RNA, 65 nt, Homo Sapiens; identical to SEQ ID NO: 181039

SEQ ID NO: 370374 - RNA, 65 nt, Homo Sapiens; identical to SEQ ID NO: 181040

SEQ ID NO: 370375 - RNA, 65 nt, Homo Sapiens; identical to SEQ ID NO: 181041

SEQ ID NO: 370376 - RNA, 65 nt, Homo Sapiens; identical to SEQ ID NO: 181042

SEQ ID NO: 370377 - RNA, 63 nt, Homo Sapiens; identical to SEQ ID NO: 181043

SEQ ID NO: 370378 - RNA, 65 nt, Homo Sapiens; identical to SEQ ID NO: 181044

SEQ ID NO: 370379 - RNA, 65 nt, Homo Sapiens; identical to SEQ ID NO: 181045

SEQ ID NO: 370380 - RNA, 65 nt, Homo Sapiens; identical to SEQ ID NO: 181046

SEQ ID NO: 370381 - RNA, 65 nt, Homo Sapiens; identical to SEQ ID NO: 181047

SEQ ID NO: 370382 - RNA, 65 nt, Homo Sapiens; identical to SEQ ID NO: 181048

SEQ ID NO: 370383 - RNA, 65 nt, Homo Sapiens; identical to SEQ ID NO: 181049

SEQ ID NO: 370384 - RNA, 65 nt, Homo Sapiens; identical to SEQ ID NO: 181050

SEQ ID NO: 370385 - RNA, 65 nt, Homo Sapiens; identical to SEQ ID NO: 181051

SEQ ID NO: 370386 - RNA, 65 nt, Homo Sapiens; identical to SEQ ID NO: 181052

SEQ ID NO: 370387 - RNA, 65 nt, Homo Sapiens; identical to SEQ ID NO: 181053

SEQ ID NO: 370388 - RNA, 65 nt, Homo Sapiens; identical to SEQ ID NO: 181054

SEQ ID NO: 370389 - RNA, 65 nt, Homo Sapiens; identical to SEQ ID NO: 181055

SEQ ID NO: 370390 - RNA, 65 nt, Homo Sapiens; identical to SEQ ID NO: 181056

SEQ ID NO: 370391 - RNA, 65 nt, Homo Sapiens; identical to SEQ ID NO: 181057

SEQ ID NO: 370392 - RNA, 65 nt, Homo Sapiens; identical to SEQ ID NO: 181058

SEQ ID NO: 370393 - RNA, 65 nt, Homo Sapiens; identical to SEQ ID NO: 181059

SEQ ID NO: 370394 - RNA, 65 nt, Homo Sapiens; identical to SEQ ID NO: 181060

SEQ ID NO: 370395 - RNA, 65 nt, Homo Sapiens; identical to SEQ ID NO: 181061

SEQ ID NO: 370396 - RNA, 65 nt, Homo Sapiens; identical to SEQ ID NO: 181062

SEQ ID NO: 370397 - RNA, 65 nt, Homo Sapiens; identical to SEQ ID NO: 181063

SEQ ID NO: 370398 - RNA, 65 nt, Homo Sapiens; identical to SEQ ID NO: 181064

SEQ ID NO: 370399 - RNA, 65 nt, Homo Sapiens; identical to SEQ ID NO: 181065

SEQ ID NO: 370400 - RNA, 65 nt, Homo Sapiens; identical to SEQ ID NO: 181066

SEQ ID NO: 370401 - RNA, 65 nt, Homo Sapiens; identical to SEQ ID NO: 181067

SEQ ID NO: 370402 - RNA, 65 nt, Homo Sapiens; identical to SEQ ID NO: 181068

SEQ ID NO: 370403 - RNA, 65 nt, Homo Sapiens; identical to SEQ ID NO: 181069

SEQ ID NO: 370404 - RNA, 65 nt, Homo Sapiens; identical to SEQ ID NO: 181070

SEQ ID NO: 370405 - RNA, 65 nt, Homo Sapiens; identical to SEQ ID NO: 181071

SEQ ID NO: 370406 - RNA, 65 nt, Homo Sapiens; identical to SEQ ID NO: 181072

SEQ ID NO: 370407 - RNA, 65 nt, Homo Sapiens; identical to SEQ ID NO: 181073

SEQ ID NO: 370408 - RNA, 65 nt, Homo Sapiens; identical to SEQ ID NO: 181074

SEQ ID NO: 370409 - RNA, 65 nt, Homo Sapiens; identical to SEQ ID NO: 181075

SEQ ID NO: 370410 - RNA, 65 nt, Homo Sapiens; identical to SEQ ID NO: 181076

SEQ ID NO: 370411 - RNA, 65 nt, Homo Sapiens; identical to SEQ ID NO: 181077

SEQ ID NO: 370412 - RNA, 65 nt, Homo Sapiens; identical to SEQ ID NO: 181078

SEQ ID NO: 370413 - RNA, 65 nt, Homo Sapiens; identical to SEQ ID NO: 181079

SEQ ID NO: 370414 - RNA, 65 nt, Homo Sapiens; identical to SEQ ID NO: 181080

SEQ ID NO: 370415 - RNA, 65 nt, Homo Sapiens; identical to SEQ ID NO: 181081

SEQ ID NO: 370416 - RNA, 65 nt, Homo Sapiens; identical to SEQ ID NO: 181082

SEQ ID NO: 370417 - RNA, 65 nt, Homo Sapiens; identical to SEQ ID NO: 181083

SEQ ID NO: 370418 - RNA, 65 nt, Homo Sapiens; identical to SEQ ID NO: 181084

SEQ ID NO: 370419 - RNA, 65 nt, Homo Sapiens; identical to SEQ ID NO: 181085

SEQ ID NO: 370420 - RNA, 65 nt, Homo Sapiens; identical to SEQ ID NO: 181086

SEQ ID NO: 370421 - RNA, 65 nt, Homo Sapiens; identical to SEQ ID NO: 181087

SEQ ID NO: 370422 - RNA, 65 nt, Homo Sapiens; identical to SEQ ID NO: 181088

SEQ ID NO: 370423 - RNA, 65 nt, Homo Sapiens; identical to SEQ ID NO: 181089

SEQ ID NO: 370424 - RNA, 65 nt, Homo Sapiens; identical to SEQ ID NO: 181090

SEQ ID NO: 370425 - RNA, 65 nt, Homo Sapiens; identical to SEQ ID NO: 181091

SEQ ID NO: 370426 - RNA, 65 nt, Homo Sapiens; identical to SEQ ID NO: 181092

SEQ ID NO: 370427 - RNA, 65 nt, Homo Sapiens; identical to SEQ ID NO: 181093

SEQ ID NO: 370428 - RNA, 65 nt, Homo Sapiens; identical to SEQ ID NO: 181094

SEQ ID NO: 370429 - RNA, 65 nt, Homo Sapiens; identical to SEQ ID NO: 181095

SEQ ID NO: 370430 - RNA, 65 nt, Homo Sapiens; identical to SEQ ID NO: 181096

SEQ ID NO: 370431 - RNA, 65 nt, Homo Sapiens; identical to SEQ ID NO: 181097

SEQ ID NO: 370432 - RNA, 65 nt, Homo Sapiens; identical to SEQ ID NO: 181098

SEQ ID NO: 370433 - RNA, 65 nt, Homo Sapiens; identical to SEQ ID NO: 181099

SEQ ID NO: 370434 - RNA, 65 nt, Homo Sapiens; identical to SEQ ID NO: 181100

SEQ ID NO: 370435 - RNA, 65 nt, Homo Sapiens; identical to SEQ ID NO: 181101

SEQ ID NO: 370436 - RNA, 65 nt, Homo Sapiens; identical to SEQ ID NO: 181102

SEQ ID NO: 370437 - RNA, 65 nt, Homo Sapiens; identical to SEQ ID NO: 181103

SEQ ID NO: 370438 - RNA, 65 nt, Homo Sapiens; identical to SEQ ID NO: 181104

SEQ ID NO: 370439 - RNA, 65 nt, Homo Sapiens; identical to SEQ ID NO: 181105

SEQ ID NO: 370440 - RNA, 65 nt, Homo Sapiens; identical to SEQ ID NO: 181106

SEQ ID NO: 370441 - RNA, 65 nt, Homo Sapiens; identical to SEQ ID NO: 181107

SEQ ID NO: 370442 - RNA, 65 nt, Homo Sapiens; identical to SEQ ID NO: 181108

SEQ ID NO: 370443 - RNA, 65 nt, Homo Sapiens; identical to SEQ ID NO: 181109

SEQ ID NO: 370444 - RNA, 65 nt, Homo Sapiens; identical to SEQ ID NO: 181110

SEQ ID NO: 370445 - RNA, 65 nt, Homo Sapiens; identical to SEQ ID NO: 181111

SEQ ID NO: 370446 - RNA, 65 nt, Homo Sapiens; identical to SEQ ID NO: 181112

SEQ ID NO: 370447 - RNA, 65 nt, Homo Sapiens; identical to SEQ ID NO: 181113

SEQ ID NO: 370448 - RNA, 65 nt, Homo Sapiens; identical to SEQ ID NO: 181114

SEQ ID NO: 370449 - RNA, 54 nt, Homo Sapiens; identical to SEQ ID NO: 181115

SEQ ID NO: 370450 - RNA, 65 nt, Homo Sapiens; identical to SEQ ID NO: 181116

SEQ ID NO: 370451 - RNA, 65 nt, Homo Sapiens; identical to SEQ ID NO: 181117

SEQ ID NO: 370452 - RNA, 65 nt, Homo Sapiens; identical to SEQ ID NO: 181118

SEQ ID NO: 370453 - RNA, 65 nt, Homo Sapiens; identical to SEQ ID NO: 181119

SEQ ID NO: 370454 - RNA, 65 nt, Homo Sapiens; identical to SEQ ID NO: 180956

SEQ ID NO: 370455 - RNA, 65 nt, Homo Sapiens; identical to SEQ ID NO: 181121

SEQ ID NO: 370456 - RNA, 65 nt, Homo Sapiens; identical to SEQ ID NO: 181122

SEQ ID NO: 370457 - RNA, 65 nt, Homo Sapiens; identical to SEQ ID NO: 181123

SEQ ID NO: 370458 - RNA, 65 nt, Homo Sapiens; identical to SEQ ID NO: 181124

SEQ ID NO: 370459 - RNA, 65 nt, Homo Sapiens; identical to SEQ ID NO: 181125

SEQ ID NO: 370460 - RNA, 65 nt, Homo Sapiens; identical to SEQ ID NO: 181126

SEQ ID NO: 370461 - RNA, 65 nt, Homo Sapiens; identical to SEQ ID NO: 181127

SEQ ID NO: 370462 - RNA, 65 nt, Homo Sapiens; identical to SEQ ID NO: 181128

SEQ ID NO: 370463 - RNA, 65 nt, Homo Sapiens; identical to SEQ ID NO: 181129

SEQ ID NO: 370464 - RNA, 65 nt, Homo Sapiens; identical to SEQ ID NO: 181130

SEQ ID NO: 370465 - RNA, 65 nt, Homo Sapiens; identical to SEQ ID NO: 181131

SEQ ID NO: 370466 - RNA, 65 nt, Homo Sapiens; identical to SEQ ID NO: 181132

SEQ ID NO: 370467 - RNA, 65 nt, Homo Sapiens; identical to SEQ ID NO: 181133

SEQ ID NO: 370468 - RNA, 65 nt, Homo Sapiens; identical to SEQ ID NO: 181134

SEQ ID NO: 370469 - RNA, 65 nt, Homo Sapiens; identical to SEQ ID NO: 181135

SEQ ID NO: 370470 - RNA, 65 nt, Homo Sapiens; identical to SEQ ID NO: 181136

SEQ ID NO: 370471 - RNA, 65 nt, Homo Sapiens; identical to SEQ ID NO: 181137

SEQ ID NO: 370472 - RNA, 65 nt, Homo Sapiens; identical to SEQ ID NO: 181138

SEQ ID NO: 370473 - RNA, 65 nt, Homo Sapiens; identical to SEQ ID NO: 181139

SEQ ID NO: 370474 - RNA, 65 nt, Homo Sapiens; identical to SEQ ID NO: 181140

SEQ ID NO: 370475 - RNA, 65 nt, Homo Sapiens; identical to SEQ ID NO: 181141

SEQ ID NO: 370476 - RNA, 65 nt, Homo Sapiens; identical to SEQ ID NO: 181142

SEQ ID NO: 370477 - RNA, 65 nt, Homo Sapiens; identical to SEQ ID NO: 181143

SEQ ID NO: 370478 - RNA, 65 nt, Homo Sapiens; identical to SEQ ID NO: 181144

SEQ ID NO: 370479 - RNA, 65 nt, Homo Sapiens; identical to SEQ ID NO: 181145

SEQ ID NO: 370480 - RNA, 65 nt, Homo Sapiens; identical to SEQ ID NO: 181146

SEQ ID NO: 370481 - RNA, 65 nt, Homo Sapiens; identical to SEQ ID NO: 181147

SEQ ID NO: 370482 - RNA, 65 nt, Homo Sapiens; identical to SEQ ID NO: 181148

SEQ ID NO: 370483 - RNA, 65 nt, Homo Sapiens; identical to SEQ ID NO: 181149

SEQ ID NO: 370484 - RNA, 65 nt, Homo Sapiens; identical to SEQ ID NO: 181150

SEQ ID NO: 370485 - RNA, 65 nt, Homo Sapiens; identical to SEQ ID NO: 181151

SEQ ID NO: 370486 - RNA, 65 nt, Homo Sapiens; identical to SEQ ID NO: 181152

SEQ ID NO: 370487 - RNA, 65 nt, Homo Sapiens; identical to SEQ ID NO: 181153

SEQ ID NO: 370488 - RNA, 65 nt, Homo Sapiens; identical to SEQ ID NO: 181154

SEQ ID NO: 370489 - RNA, 65 nt, Homo Sapiens; identical to SEQ ID NO: 181155

SEQ ID NO: 370490 - RNA, 65 nt, Homo Sapiens; identical to SEQ ID NO: 181156

SEQ ID NO: 370491 - RNA, 65 nt, Homo Sapiens; identical to SEQ ID NO: 181157

SEQ ID NO: 370492 - RNA, 65 nt, Homo Sapiens; identical to SEQ ID NO: 181158

SEQ ID NO: 370493 - RNA, 65 nt, Homo Sapiens; identical to SEQ ID NO: 181159

SEQ ID NO: 370494 - RNA, 65 nt, Homo Sapiens; identical to SEQ ID NO: 181160

SEQ ID NO: 370495 - RNA, 65 nt, Homo Sapiens; identical to SEQ ID NO: 181161

SEQ ID NO: 370496 - RNA, 65 nt, Homo Sapiens; identical to SEQ ID NO: 181162

SEQ ID NO: 370497 - RNA, 65 nt, Homo Sapiens; identical to SEQ ID NO: 181163

SEQ ID NO: 370498 - RNA, 65 nt, Homo Sapiens; identical to SEQ ID NO: 181164

SEQ ID NO: 370499 - RNA, 65 nt, Homo Sapiens; identical to SEQ ID NO: 181165

SEQ ID NO: 370500 - RNA, 65 nt, Homo Sapiens; identical to SEQ ID NO: 181166

SEQ ID NO: 370501 - RNA, 65 nt, Homo Sapiens; identical to SEQ ID NO: 181167

SEQ ID NO: 370502 - RNA, 65 nt, Homo Sapiens; identical to SEQ ID NO: 181168

SEQ ID NO: 370503 - RNA, 65 nt, Homo Sapiens; identical to SEQ ID NO: 181169

SEQ ID NO: 370504 - RNA, 65 nt, Homo Sapiens; identical to SEQ ID NO: 181170

SEQ ID NO: 370505 - RNA, 65 nt, Homo Sapiens; identical to SEQ ID NO: 181171

SEQ ID NO: 370506 - RNA, 65 nt, Homo Sapiens; identical to SEQ ID NO: 181172

SEQ ID NO: 370507 - RNA, 65 nt, Homo Sapiens; identical to SEQ ID NO: 181173

SEQ ID NO: 370508 - RNA, 65 nt, Homo Sapiens; identical to SEQ ID NO: 181174

SEQ ID NO: 370509 - RNA, 65 nt, Homo Sapiens; identical to SEQ ID NO: 181175

SEQ ID NO: 370510 - RNA, 65 nt, Homo Sapiens; identical to SEQ ID NO: 181176

SEQ ID NO: 370511 - RNA, 65 nt, Homo Sapiens; identical to SEQ ID NO: 181177

SEQ ID NO: 370512 - RNA, 65 nt, Homo Sapiens; identical to SEQ ID NO: 181178

SEQ ID NO: 370513 - RNA, 65 nt, Homo Sapiens; identical to SEQ ID NO: 181179

SEQ ID NO: 370514 - RNA, 65 nt, Homo Sapiens; identical to SEQ ID NO: 181180

SEQ ID NO: 370515 - RNA, 65 nt, Homo Sapiens; identical to SEQ ID NO: 181181

SEQ ID NO: 370516 - RNA, 65 nt, Homo Sapiens; identical to SEQ ID NO: 181182

SEQ ID NO: 370517 - RNA, 65 nt, Homo Sapiens; identical to SEQ ID NO: 181183

SEQ ID NO: 370518 - RNA, 65 nt, Homo Sapiens; identical to SEQ ID NO: 181184

SEQ ID NO: 370519 - RNA, 65 nt, Homo Sapiens; identical to SEQ ID NO: 181185

SEQ ID NO: 370520 - RNA, 65 nt, Homo Sapiens; identical to SEQ ID NO: 181186

SEQ ID NO: 370521 - RNA, 65 nt, Homo Sapiens; identical to SEQ ID NO: 181187

SEQ ID NO: 370522 - RNA, 65 nt, Homo Sapiens; identical to SEQ ID NO: 181188

SEQ ID NO: 370523 - RNA, 65 nt, Homo Sapiens; identical to SEQ ID NO: 181189

SEQ ID NO: 370524 - RNA, 65 nt, Homo Sapiens; identical to SEQ ID NO: 181190

SEQ ID NO: 370525 - RNA, 65 nt, Homo Sapiens; identical to SEQ ID NO: 181191

SEQ ID NO: 370526 - RNA, 65 nt, Homo Sapiens; identical to SEQ ID NO: 181192

SEQ ID NO: 370527 - RNA, 65 nt, Homo Sapiens; identical to SEQ ID NO: 181193

SEQ ID NO: 370528 - RNA, 65 nt, Homo Sapiens; identical to SEQ ID NO: 181194

SEQ ID NO: 370529 - RNA, 65 nt, Homo Sapiens; identical to SEQ ID NO: 181195

SEQ ID NO: 370530 - RNA, 65 nt, Homo Sapiens; identical to SEQ ID NO: 181196

SEQ ID NO: 370531 - RNA, 65 nt, Homo Sapiens; identical to SEQ ID NO: 181197

SEQ ID NO: 370532 - RNA, 65 nt, Homo Sapiens; identical to SEQ ID NO: 181198

SEQ ID NO: 370533 - RNA, 65 nt, Homo Sapiens; identical to SEQ ID NO: 181199

SEQ ID NO: 370534 - RNA, 65 nt, Homo Sapiens; identical to SEQ ID NO: 181200

SEQ ID NO: 370535 - RNA, 65 nt, Homo Sapiens; identical to SEQ ID NO: 181201

SEQ ID NO: 370536 - RNA, 65 nt, Homo Sapiens; identical to SEQ ID NO: 181202

SEQ ID NO: 370537 - RNA, 65 nt, Homo Sapiens; identical to SEQ ID NO: 181203

SEQ ID NO: 370538 - RNA, 65 nt, Homo Sapiens; identical to SEQ ID NO: 181204

SEQ ID NO: 370539 - RNA, 65 nt, Homo Sapiens; identical to SEQ ID NO: 181205

SEQ ID NO: 370540 - RNA, 65 nt, Homo Sapiens; identical to SEQ ID NO: 181206

SEQ ID NO: 370541 - RNA, 65 nt, Homo Sapiens; identical to SEQ ID NO: 181207

SEQ ID NO: 370542 - RNA, 65 nt, Homo Sapiens; identical to SEQ ID NO: 181208

SEQ ID NO: 370543 - RNA, 65 nt, Homo Sapiens; identical to SEQ ID NO: 181209

SEQ ID NO: 370544 - RNA, 65 nt, Homo Sapiens; identical to SEQ ID NO: 181210

SEQ ID NO: 370545 - RNA, 65 nt, Homo Sapiens; identical to SEQ ID NO: 181211

SEQ ID NO: 370546 - RNA, 65 nt, Homo Sapiens; identical to SEQ ID NO: 181212

SEQ ID NO: 370547 - RNA, 65 nt, Homo Sapiens; identical to SEQ ID NO: 181213

SEQ ID NO: 370548 - RNA, 65 nt, Homo Sapiens; identical to SEQ ID NO: 181214

SEQ ID NO: 370549 - RNA, 65 nt, Homo Sapiens; identical to SEQ ID NO: 181215

SEQ ID NO: 370550 - RNA, 65 nt, Homo Sapiens; identical to SEQ ID NO: 181216

SEQ ID NO: 370551 - RNA, 65 nt, Homo Sapiens; identical to SEQ ID NO: 181217

SEQ ID NO: 370552 - RNA, 65 nt, Homo Sapiens; identical to SEQ ID NO: 181218

SEQ ID NO: 370553 - RNA, 65 nt, Homo Sapiens; identical to SEQ ID NO: 181219

SEQ ID NO: 370554 - RNA, 65 nt, Homo Sapiens; identical to SEQ ID NO: 181220

SEQ ID NO: 370555 - RNA, 65 nt, Homo Sapiens; identical to SEQ ID NO: 181221

SEQ ID NO: 370556 - RNA, 65 nt, Homo Sapiens; identical to SEQ ID NO: 181222

SEQ ID NO: 370557 - RNA, 65 nt, Homo Sapiens; identical to SEQ ID NO: 181223

SEQ ID NO: 370558 - RNA, 65 nt, Homo Sapiens; identical to SEQ ID NO: 181224

SEQ ID NO: 370559 - RNA, 65 nt, Homo Sapiens; identical to SEQ ID NO: 181225

SEQ ID NO: 370560 - RNA, 65 nt, Homo Sapiens; identical to SEQ ID NO: 181226

SEQ ID NO: 370561 - RNA, 65 nt, Homo Sapiens; identical to SEQ ID NO: 181227

SEQ ID NO: 370562 - RNA, 65 nt, Homo Sapiens; identical to SEQ ID NO: 181228

SEQ ID NO: 370563 - RNA, 65 nt, Homo Sapiens; identical to SEQ ID NO: 181229

SEQ ID NO: 370564 - RNA, 65 nt, Homo Sapiens; identical to SEQ ID NO: 181230

SEQ ID NO: 370565 - RNA, 65 nt, Homo Sapiens; identical to SEQ ID NO: 181231

SEQ ID NO: 370566 - RNA, 65 nt, Homo Sapiens; identical to SEQ ID NO: 181232

SEQ ID NO: 370567 - RNA, 65 nt, Homo Sapiens; identical to SEQ ID NO: 181233

SEQ ID NO: 370568 - RNA, 65 nt, Homo Sapiens; identical to SEQ ID NO: 181234

SEQ ID NO: 370569 - RNA, 65 nt, Homo Sapiens; identical to SEQ ID NO: 181235

SEQ ID NO: 370570 - RNA, 65 nt, Homo Sapiens; identical to SEQ ID NO: 181236

SEQ ID NO: 370571 - RNA, 65 nt, Homo Sapiens; identical to SEQ ID NO: 181237

SEQ ID NO: 370572 - RNA, 65 nt, Homo Sapiens; identical to SEQ ID NO: 181238

SEQ ID NO: 370573 - RNA, 65 nt, Homo Sapiens; identical to SEQ ID NO: 181239

SEQ ID NO: 370574 - RNA, 65 nt, Homo Sapiens; identical to SEQ ID NO: 181240

SEQ ID NO: 370575 - RNA, 65 nt, Homo Sapiens; identical to SEQ ID NO: 181241

SEQ ID NO: 370576 - RNA, 65 nt, Homo Sapiens; identical to SEQ ID NO: 181242

SEQ ID NO: 370577 - RNA, 65 nt, Homo Sapiens; identical to SEQ ID NO: 181243

SEQ ID NO: 370578 - RNA, 65 nt, Homo Sapiens; identical to SEQ ID NO: 181244

SEQ ID NO: 370579 - RNA, 65 nt, Homo Sapiens; identical to SEQ ID NO: 181245

SEQ ID NO: 370580 - RNA, 65 nt, Homo Sapiens; identical to SEQ ID NO: 181246

SEQ ID NO: 370581 - RNA, 65 nt, Homo Sapiens; identical to SEQ ID NO: 181247

SEQ ID NO: 370582 - RNA, 65 nt, Homo Sapiens; identical to SEQ ID NO: 181248

SEQ ID NO: 370583 - RNA, 65 nt, Homo Sapiens; identical to SEQ ID NO: 181249

SEQ ID NO: 370584 - RNA, 65 nt, Homo Sapiens; identical to SEQ ID NO: 181250

SEQ ID NO: 370585 - RNA, 65 nt, Homo Sapiens; identical to SEQ ID NO: 181251

SEQ ID NO: 370586 - RNA, 65 nt, Homo Sapiens; identical to SEQ ID NO: 181252

SEQ ID NO: 370587 - RNA, 65 nt, Homo Sapiens; identical to SEQ ID NO: 181253

SEQ ID NO: 370588 - RNA, 62 nt, Homo Sapiens; identical to SEQ ID NO: 181254

SEQ ID NO: 370589 - RNA, 65 nt, Homo Sapiens; identical to SEQ ID NO: 181255

SEQ ID NO: 370590 - RNA, 65 nt, Homo Sapiens; identical to SEQ ID NO: 181256

SEQ ID NO: 370591 - RNA, 65 nt, Homo Sapiens; identical to SEQ ID NO: 181257

SEQ ID NO: 370592 - RNA, 65 nt, Homo Sapiens; identical to SEQ ID NO: 181258

SEQ ID NO: 370593 - RNA, 65 nt, Homo Sapiens; identical to SEQ ID NO: 181259

SEQ ID NO: 370594 - RNA, 65 nt, Homo Sapiens; identical to SEQ ID NO: 181260

SEQ ID NO: 370595 - RNA, 65 nt, Homo Sapiens; identical to SEQ ID NO: 181261

SEQ ID NO: 370596 - RNA, 65 nt, Homo Sapiens; identical to SEQ ID NO: 181262

SEQ ID NO: 370597 - RNA, 65 nt, Homo Sapiens; identical to SEQ ID NO: 181263

SEQ ID NO: 370598 - RNA, 65 nt, Homo Sapiens; identical to SEQ ID NO: 181264

SEQ ID NO: 370599 - RNA, 65 nt, Homo Sapiens; identical to SEQ ID NO: 181265

SEQ ID NO: 370600 - RNA, 65 nt, Homo Sapiens; identical to SEQ ID NO: 181266

SEQ ID NO: 370601 - RNA, 65 nt, Homo Sapiens; identical to SEQ ID NO: 181267

SEQ ID NO: 370602 - RNA, 65 nt, Homo Sapiens; identical to SEQ ID NO: 181268

SEQ ID NO: 370603 - RNA, 65 nt, Homo Sapiens; identical to SEQ ID NO: 181269

SEQ ID NO: 370604 - RNA, 65 nt, Homo Sapiens; identical to SEQ ID NO: 181270

SEQ ID NO: 370605 - RNA, 65 nt, Homo Sapiens; identical to SEQ ID NO: 181271

SEQ ID NO: 370606 - RNA, 65 nt, Homo Sapiens; identical to SEQ ID NO: 181272

SEQ ID NO: 370607 - RNA, 65 nt, Homo Sapiens; identical to SEQ ID NO: 181273

SEQ ID NO: 370608 - RNA, 65 nt, Homo Sapiens; identical to SEQ ID NO: 181274

SEQ ID NO: 370609 - RNA, 65 nt, Homo Sapiens; identical to SEQ ID NO: 181275

SEQ ID NO: 370610 - RNA, 65 nt, Homo Sapiens; identical to SEQ ID NO: 181276

SEQ ID NO: 370611 - RNA, 65 nt, Homo Sapiens; identical to SEQ ID NO: 181277

SEQ ID NO: 370612 - RNA, 65 nt, Homo Sapiens; identical to SEQ ID NO: 181278

SEQ ID NO: 370613 - RNA, 65 nt, Homo Sapiens; identical to SEQ ID NO: 181279

SEQ ID NO: 370614 - RNA, 65 nt, Homo Sapiens; identical to SEQ ID NO: 181280

SEQ ID NO: 370615 - RNA, 65 nt, Homo Sapiens; identical to SEQ ID NO: 181281

SEQ ID NO: 370616 - RNA, 65 nt, Homo Sapiens; identical to SEQ ID NO: 181282

SEQ ID NO: 370617 - RNA, 65 nt, Homo Sapiens; identical to SEQ ID NO: 181283

SEQ ID NO: 370618 - RNA, 65 nt, Homo Sapiens; identical to SEQ ID NO: 181284

SEQ ID NO: 370619 - RNA, 65 nt, Homo Sapiens; identical to SEQ ID NO: 181285

SEQ ID NO: 370620 - RNA, 65 nt, Homo Sapiens; identical to SEQ ID NO: 181286

SEQ ID NO: 370621 - RNA, 65 nt, Homo Sapiens; identical to SEQ ID NO: 181287

SEQ ID NO: 370622 - RNA, 65 nt, Homo Sapiens; identical to SEQ ID NO: 181288

SEQ ID NO: 370623 - RNA, 65 nt, Homo Sapiens; identical to SEQ ID NO: 181289

SEQ ID NO: 370624 - RNA, 65 nt, Homo Sapiens; identical to SEQ ID NO: 181290

SEQ ID NO: 370625 - RNA, 65 nt, Homo Sapiens; identical to SEQ ID NO: 181291

SEQ ID NO: 370626 - RNA, 65 nt, Homo Sapiens; identical to SEQ ID NO: 181292

SEQ ID NO: 370627 - RNA, 65 nt, Homo Sapiens; identical to SEQ ID NO: 181293

SEQ ID NO: 370628 - RNA, 65 nt, Homo Sapiens; identical to SEQ ID NO: 181294

SEQ ID NO: 370629 - RNA, 65 nt, Homo Sapiens; identical to SEQ ID NO: 181295

SEQ ID NO: 370630 - RNA, 65 nt, Homo Sapiens; identical to SEQ ID NO: 181296

SEQ ID NO: 370631 - RNA, 65 nt, Homo Sapiens; identical to SEQ ID NO: 181297

SEQ ID NO: 370632 - RNA, 65 nt, Homo Sapiens; identical to SEQ ID NO: 181298

SEQ ID NO: 370633 - RNA, 65 nt, Homo Sapiens; identical to SEQ ID NO: 181299

SEQ ID NO: 370634 - RNA, 65 nt, Homo Sapiens; identical to SEQ ID NO: 181300

SEQ ID NO: 370635 - RNA, 65 nt, Homo Sapiens; identical to SEQ ID NO: 181301

SEQ ID NO: 370636 - RNA, 65 nt, Homo Sapiens; identical to SEQ ID NO: 181302

SEQ ID NO: 370637 - RNA, 65 nt, Homo Sapiens; identical to SEQ ID NO: 181303

SEQ ID NO: 370638 - RNA, 65 nt, Homo Sapiens; identical to SEQ ID NO: 181304

SEQ ID NO: 370639 - RNA, 65 nt, Homo Sapiens; identical to SEQ ID NO: 181305

SEQ ID NO: 370640 - RNA, 65 nt, Homo Sapiens; identical to SEQ ID NO: 181306

SEQ ID NO: 370641 - RNA, 65 nt, Homo Sapiens; identical to SEQ ID NO: 181307

SEQ ID NO: 370642 - RNA, 65 nt, Homo Sapiens; identical to SEQ ID NO: 181308

SEQ ID NO: 370643 - RNA, 65 nt, Homo Sapiens; identical to SEQ ID NO: 181309

SEQ ID NO: 370644 - RNA, 65 nt, Homo Sapiens; identical to SEQ ID NO: 181310

SEQ ID NO: 370645 - RNA, 65 nt, Homo Sapiens; identical to SEQ ID NO: 181311

SEQ ID NO: 370646 - RNA, 65 nt, Homo Sapiens; identical to SEQ ID NO: 181312

SEQ ID NO: 370647 - RNA, 65 nt, Homo Sapiens; identical to SEQ ID NO: 181313

SEQ ID NO: 370648 - RNA, 65 nt, Homo Sapiens; identical to SEQ ID NO: 181314

SEQ ID NO: 370649 - RNA, 65 nt, Homo Sapiens; identical to SEQ ID NO: 181315

SEQ ID NO: 370650 - RNA, 65 nt, Homo Sapiens; identical to SEQ ID NO: 181316

SEQ ID NO: 370651 - RNA, 65 nt, Homo Sapiens; identical to SEQ ID NO: 181317

SEQ ID NO: 370652 - RNA, 65 nt, Homo Sapiens; identical to SEQ ID NO: 181318

SEQ ID NO: 370653 - RNA, 65 nt, Homo Sapiens; identical to SEQ ID NO: 181319

SEQ ID NO: 370654 - RNA, 65 nt, Homo Sapiens; identical to SEQ ID NO: 181320

SEQ ID NO: 370655 - RNA, 65 nt, Homo Sapiens; identical to SEQ ID NO: 181321

SEQ ID NO: 370656 - RNA, 65 nt, Homo Sapiens; identical to SEQ ID NO: 181322

SEQ ID NO: 370657 - RNA, 65 nt, Homo Sapiens; identical to SEQ ID NO: 181323

SEQ ID NO: 370658 - RNA, 65 nt, Homo Sapiens; identical to SEQ ID NO: 181324

SEQ ID NO: 370659 - RNA, 65 nt, Homo Sapiens; identical to SEQ ID NO: 181325

SEQ ID NO: 370660 - RNA, 65 nt, Homo Sapiens; identical to SEQ ID NO: 181326

SEQ ID NO: 370661 - RNA, 65 nt, Homo Sapiens; identical to SEQ ID NO: 181327

SEQ ID NO: 370662 - RNA, 65 nt, Homo Sapiens; identical to SEQ ID NO: 181328

SEQ ID NO: 370663 - RNA, 65 nt, Homo Sapiens; identical to SEQ ID NO: 181329

SEQ ID NO: 370664 - RNA, 65 nt, Homo Sapiens; identical to SEQ ID NO: 181330

SEQ ID NO: 370665 - RNA, 65 nt, Homo Sapiens; identical to SEQ ID NO: 181331

SEQ ID NO: 370666 - RNA, 65 nt, Homo Sapiens; identical to SEQ ID NO: 181332

SEQ ID NO: 370667 - RNA, 65 nt, Homo Sapiens; identical to SEQ ID NO: 181333

SEQ ID NO: 370668 - RNA, 65 nt, Homo Sapiens; identical to SEQ ID NO: 181334

SEQ ID NO: 370669 - RNA, 65 nt, Homo Sapiens; identical to SEQ ID NO: 181335

SEQ ID NO: 370670 - RNA, 65 nt, Homo Sapiens; identical to SEQ ID NO: 181336

SEQ ID NO: 370671 - RNA, 65 nt, Homo Sapiens; identical to SEQ ID NO: 181337

SEQ ID NO: 370672 - RNA, 65 nt, Homo Sapiens; identical to SEQ ID NO: 181338

SEQ ID NO: 370673 - RNA, 65 nt, Homo Sapiens; identical to SEQ ID NO: 181339

SEQ ID NO: 370674 - RNA, 65 nt, Homo Sapiens; identical to SEQ ID NO: 181340

SEQ ID NO: 370675 - RNA, 65 nt, Homo Sapiens; identical to SEQ ID NO: 181341

SEQ ID NO: 370676 - RNA, 65 nt, Homo Sapiens; identical to SEQ ID NO: 181342

SEQ ID NO: 370677 - RNA, 65 nt, Homo Sapiens; identical to SEQ ID NO: 181343

SEQ ID NO: 370678 - RNA, 65 nt, Homo Sapiens; identical to SEQ ID NO: 181344

SEQ ID NO: 370679 - RNA, 65 nt, Homo Sapiens; identical to SEQ ID NO: 181345

SEQ ID NO: 370680 - RNA, 65 nt, Homo Sapiens; identical to SEQ ID NO: 181346

SEQ ID NO: 370681 - RNA, 65 nt, Homo Sapiens; identical to SEQ ID NO: 181347

SEQ ID NO: 370682 - RNA, 65 nt, Homo Sapiens; identical to SEQ ID NO: 181348

SEQ ID NO: 370683 - RNA, 65 nt, Homo Sapiens; identical to SEQ ID NO: 181349

SEQ ID NO: 370684 - RNA, 65 nt, Homo Sapiens; identical to SEQ ID NO: 181144

SEQ ID NO: 370685 - RNA, 65 nt, Homo Sapiens; identical to SEQ ID NO: 181351

SEQ ID NO: 370686 - RNA, 65 nt, Homo Sapiens; identical to SEQ ID NO: 181352

SEQ ID NO: 370687 - RNA, 65 nt, Homo Sapiens; identical to SEQ ID NO: 181353

SEQ ID NO: 370688 - RNA, 65 nt, Homo Sapiens; identical to SEQ ID NO: 181354

SEQ ID NO: 370689 - RNA, 65 nt, Homo Sapiens; identical to SEQ ID NO: 181355

SEQ ID NO: 370690 - RNA, 65 nt, Homo Sapiens; identical to SEQ ID NO: 181356

SEQ ID NO: 370691 - RNA, 65 nt, Homo Sapiens; identical to SEQ ID NO: 181357

SEQ ID NO: 370692 - RNA, 65 nt, Homo Sapiens; identical to SEQ ID NO: 181358

SEQ ID NO: 370693 - RNA, 65 nt, Homo Sapiens; identical to SEQ ID NO: 181359

SEQ ID NO: 370694 - RNA, 65 nt, Homo Sapiens; identical to SEQ ID NO: 181360

SEQ ID NO: 370695 - RNA, 65 nt, Homo Sapiens; identical to SEQ ID NO: 181361

SEQ ID NO: 370696 - RNA, 65 nt, Homo Sapiens; identical to SEQ ID NO: 181362

SEQ ID NO: 370697 - RNA, 65 nt, Homo Sapiens; identical to SEQ ID NO: 181363

SEQ ID NO: 370698 - RNA, 65 nt, Homo Sapiens; identical to SEQ ID NO: 181364

SEQ ID NO: 370699 - RNA, 65 nt, Homo Sapiens; identical to SEQ ID NO: 181365

SEQ ID NO: 370700 - RNA, 65 nt, Homo Sapiens; identical to SEQ ID NO: 181366

SEQ ID NO: 370701 - RNA, 65 nt, Homo Sapiens; identical to SEQ ID NO: 181367

SEQ ID NO: 370702 - RNA, 65 nt, Homo Sapiens; identical to SEQ ID NO: 181368

SEQ ID NO: 370703 - RNA, 65 nt, Homo Sapiens; identical to SEQ ID NO: 181369

SEQ ID NO: 370704 - RNA, 65 nt, Homo Sapiens; identical to SEQ ID NO: 181370

SEQ ID NO: 370705 - RNA, 65 nt, Homo Sapiens; identical to SEQ ID NO: 181371

SEQ ID NO: 370706 - RNA, 65 nt, Homo Sapiens; identical to SEQ ID NO: 181372

SEQ ID NO: 370707 - RNA, 65 nt, Homo Sapiens; identical to SEQ ID NO: 181373

SEQ ID NO: 370708 - RNA, 65 nt, Homo Sapiens; identical to SEQ ID NO: 181374

SEQ ID NO: 370709 - RNA, 65 nt, Homo Sapiens; identical to SEQ ID NO: 181375

SEQ ID NO: 370710 - RNA, 65 nt, Homo Sapiens; identical to SEQ ID NO: 181376

SEQ ID NO: 370711 - RNA, 65 nt, Homo Sapiens; identical to SEQ ID NO: 181377

SEQ ID NO: 370712 - RNA, 65 nt, Homo Sapiens; identical to SEQ ID NO: 181378

SEQ ID NO: 370713 - RNA, 65 nt, Homo Sapiens; identical to SEQ ID NO: 181379

SEQ ID NO: 370714 - RNA, 65 nt, Homo Sapiens; identical to SEQ ID NO: 181380

SEQ ID NO: 370715 - RNA, 65 nt, Homo Sapiens; identical to SEQ ID NO: 181381

SEQ ID NO: 370716 - RNA, 65 nt, Homo Sapiens; identical to SEQ ID NO: 181382

SEQ ID NO: 370717 - RNA, 65 nt, Homo Sapiens; identical to SEQ ID NO: 181383

SEQ ID NO: 370718 - RNA, 65 nt, Homo Sapiens; identical to SEQ ID NO: 181384

SEQ ID NO: 370719 - RNA, 65 nt, Homo Sapiens; identical to SEQ ID NO: 181385

SEQ ID NO: 370720 - RNA, 65 nt, Homo Sapiens; identical to SEQ ID NO: 181386

SEQ ID NO: 370721 - RNA, 65 nt, Homo Sapiens; identical to SEQ ID NO: 181387

SEQ ID NO: 370722 - RNA, 65 nt, Homo Sapiens; identical to SEQ ID NO: 181388

SEQ ID NO: 370723 - RNA, 65 nt, Homo Sapiens; identical to SEQ ID NO: 181389

SEQ ID NO: 370724 - RNA, 65 nt, Homo Sapiens; identical to SEQ ID NO: 181390

SEQ ID NO: 370725 - RNA, 65 nt, Homo Sapiens; identical to SEQ ID NO: 181391

SEQ ID NO: 370726 - RNA, 65 nt, Homo Sapiens; identical to SEQ ID NO: 181392

SEQ ID NO: 370727 - RNA, 65 nt, Homo Sapiens; identical to SEQ ID NO: 181393

SEQ ID NO: 370728 - RNA, 65 nt, Homo Sapiens; identical to SEQ ID NO: 181394

SEQ ID NO: 370729 - RNA, 65 nt, Homo Sapiens; identical to SEQ ID NO: 181395

SEQ ID NO: 370730 - RNA, 65 nt, Homo Sapiens; identical to SEQ ID NO: 181396

SEQ ID NO: 370731 - RNA, 65 nt, Homo Sapiens; identical to SEQ ID NO: 181397

SEQ ID NO: 370732 - RNA, 65 nt, Homo Sapiens; identical to SEQ ID NO: 181398

SEQ ID NO: 370733 - RNA, 65 nt, Homo Sapiens; identical to SEQ ID NO: 181399

SEQ ID NO: 370734 - RNA, 65 nt, Homo Sapiens; identical to SEQ ID NO: 181400

SEQ ID NO: 370735 - RNA, 65 nt, Homo Sapiens; identical to SEQ ID NO: 181401

SEQ ID NO: 370736 - RNA, 65 nt, Homo Sapiens; identical to SEQ ID NO: 181402

SEQ ID NO: 370737 - RNA, 65 nt, Homo Sapiens; identical to SEQ ID NO: 181403

SEQ ID NO: 370738 - RNA, 65 nt, Homo Sapiens; identical to SEQ ID NO: 181404

SEQ ID NO: 370739 - RNA, 65 nt, Homo Sapiens; identical to SEQ ID NO: 181405

SEQ ID NO: 370740 - RNA, 65 nt, Homo Sapiens; identical to SEQ ID NO: 181406

SEQ ID NO: 370741 - RNA, 65 nt, Homo Sapiens; identical to SEQ ID NO: 181407

SEQ ID NO: 370742 - RNA, 65 nt, Homo Sapiens; identical to SEQ ID NO: 181408

SEQ ID NO: 370743 - RNA, 65 nt, Homo Sapiens; identical to SEQ ID NO: 181409

SEQ ID NO: 370744 - RNA, 65 nt, Homo Sapiens; identical to SEQ ID NO: 181410

SEQ ID NO: 370745 - RNA, 65 nt, Homo Sapiens; identical to SEQ ID NO: 181411

SEQ ID NO: 370746 - RNA, 65 nt, Homo Sapiens; identical to SEQ ID NO: 181412

SEQ ID NO: 370747 - RNA, 65 nt, Homo Sapiens; identical to SEQ ID NO: 181413

SEQ ID NO: 370748 - RNA, 65 nt, Homo Sapiens; identical to SEQ ID NO: 181414

SEQ ID NO: 370749 - RNA, 65 nt, Homo Sapiens; identical to SEQ ID NO: 181415

SEQ ID NO: 370750 - RNA, 65 nt, Homo Sapiens; identical to SEQ ID NO: 181416

SEQ ID NO: 370751 - RNA, 65 nt, Homo Sapiens; identical to SEQ ID NO: 181417

SEQ ID NO: 370752 - RNA, 65 nt, Homo Sapiens; identical to SEQ ID NO: 181418

SEQ ID NO: 370753 - RNA, 65 nt, Homo Sapiens; identical to SEQ ID NO: 181419

SEQ ID NO: 370754 - RNA, 65 nt, Homo Sapiens; identical to SEQ ID NO: 181420

SEQ ID NO: 370755 - RNA, 65 nt, Homo Sapiens; identical to SEQ ID NO: 181421

SEQ ID NO: 370756 - RNA, 65 nt, Homo Sapiens; identical to SEQ ID NO: 181422

SEQ ID NO: 370757 - RNA, 65 nt, Homo Sapiens; identical to SEQ ID NO: 181423

SEQ ID NO: 370758 - RNA, 64 nt, Homo Sapiens; identical to SEQ ID NO: 262248

SEQ ID NO: 370759 - RNA, 64 nt, Homo Sapiens; identical to SEQ ID NO: 262249

SEQ ID NO: 370760 - RNA, 64 nt, Homo Sapiens; identical to SEQ ID NO: 262250

SEQ ID NO: 370761 - RNA, 64 nt, Homo Sapiens; identical to SEQ ID NO: 262251

SEQ ID NO: 370762 - RNA, 64 nt, Homo Sapiens; identical to SEQ ID NO: 262252

SEQ ID NO: 370763 - RNA, 64 nt, Homo Sapiens; identical to SEQ ID NO: 262253

SEQ ID NO: 370764 - RNA, 64 nt, Homo Sapiens; identical to SEQ ID NO: 262254

SEQ ID NO: 370765 - RNA, 64 nt, Homo Sapiens; identical to SEQ ID NO: 262255

SEQ ID NO: 370766 - RNA, 64 nt, Homo Sapiens; identical to SEQ ID NO: 262256

SEQ ID NO: 370767 - RNA, 64 nt, Homo Sapiens; identical to SEQ ID NO: 262257

SEQ ID NO: 370768 - RNA, 64 nt, Homo Sapiens; identical to SEQ ID NO: 262258

SEQ ID NO: 370769 - RNA, 64 nt, Homo Sapiens; identical to SEQ ID NO: 262259

SEQ ID NO: 370770 - RNA, 64 nt, Homo Sapiens; identical to SEQ ID NO: 262260

SEQ ID NO: 370771 - RNA, 64 nt, Homo Sapiens; identical to SEQ ID NO: 262261

SEQ ID NO: 370772 - RNA, 64 nt, Homo Sapiens; identical to SEQ ID NO: 262262

SEQ ID NO: 370773 - RNA, 64 nt, Homo Sapiens; identical to SEQ ID NO: 262263

SEQ ID NO: 370774 - RNA, 64 nt, Homo Sapiens; identical to SEQ ID NO: 262264

SEQ ID NO: 370775 - RNA, 64 nt, Homo Sapiens; identical to SEQ ID NO: 262265

SEQ ID NO: 370776 - RNA, 64 nt, Homo Sapiens; identical to SEQ ID NO: 262266

SEQ ID NO: 370777 - RNA, 64 nt, Homo Sapiens; identical to SEQ ID NO: 262267

SEQ ID NO: 370778 - RNA, 64 nt, Homo Sapiens; identical to SEQ ID NO: 262268

SEQ ID NO: 370779 - RNA, 64 nt, Homo Sapiens; identical to SEQ ID NO: 262269

SEQ ID NO: 370780 - RNA, 64 nt, Homo Sapiens; identical to SEQ ID NO: 262270

SEQ ID NO: 370781 - RNA, 64 nt, Homo Sapiens; identical to SEQ ID NO: 262271

SEQ ID NO: 370782 - RNA, 64 nt, Homo Sapiens; identical to SEQ ID NO: 262272

SEQ ID NO: 370783 - RNA, 64 nt, Homo Sapiens; identical to SEQ ID NO: 262273

SEQ ID NO: 370784 - RNA, 64 nt, Homo Sapiens; identical to SEQ ID NO: 262274

SEQ ID NO: 370785 - RNA, 64 nt, Homo Sapiens; identical to SEQ ID NO: 262275

SEQ ID NO: 370786 - RNA, 64 nt, Homo Sapiens; identical to SEQ ID NO: 262276

SEQ ID NO: 370787 - RNA, 64 nt, Homo Sapiens; identical to SEQ ID NO: 262277

SEQ ID NO: 370788 - RNA, 64 nt, Homo Sapiens; identical to SEQ ID NO: 262278

SEQ ID NO: 370789 - RNA, 64 nt, Homo Sapiens; identical to SEQ ID NO: 262279

SEQ ID NO: 370790 - RNA, 64 nt, Homo Sapiens; identical to SEQ ID NO: 262280

SEQ ID NO: 370791 - RNA, 64 nt, Homo Sapiens; identical to SEQ ID NO: 262281

SEQ ID NO: 370792 - RNA, 64 nt, Homo Sapiens; identical to SEQ ID NO: 262282

SEQ ID NO: 370793 - RNA, 64 nt, Homo Sapiens; identical to SEQ ID NO: 262283

SEQ ID NO: 370794 - RNA, 64 nt, Homo Sapiens; identical to SEQ ID NO: 262284

SEQ ID NO: 370795 - RNA, 64 nt, Homo Sapiens; identical to SEQ ID NO: 262285

SEQ ID NO: 370796 - RNA, 64 nt, Homo Sapiens; identical to SEQ ID NO: 262286

SEQ ID NO: 370797 - RNA, 64 nt, Homo Sapiens; identical to SEQ ID NO: 262287

SEQ ID NO: 370798 - RNA, 64 nt, Homo Sapiens; identical to SEQ ID NO: 262288

SEQ ID NO: 370799 - RNA, 64 nt, Homo Sapiens; identical to SEQ ID NO: 262289

SEQ ID NO: 370800 - RNA, 64 nt, Homo Sapiens; identical to SEQ ID NO: 262290

SEQ ID NO: 370801 - RNA, 64 nt, Homo Sapiens; identical to SEQ ID NO: 262291

SEQ ID NO: 370802 - RNA, 64 nt, Homo Sapiens; identical to SEQ ID NO: 262292

SEQ ID NO: 370803 - RNA, 64 nt, Homo Sapiens; identical to SEQ ID NO: 262293

SEQ ID NO: 370804 - RNA, 64 nt, Homo Sapiens; identical to SEQ ID NO: 262294

SEQ ID NO: 370805 - RNA, 64 nt, Homo Sapiens; identical to SEQ ID NO: 262295

SEQ ID NO: 370806 - RNA, 64 nt, Homo Sapiens; identical to SEQ ID NO: 262296

SEQ ID NO: 370807 - RNA, 64 nt, Homo Sapiens; identical to SEQ ID NO: 262297

SEQ ID NO: 370808 - RNA, 64 nt, Homo Sapiens; identical to SEQ ID NO: 262298

SEQ ID NO: 370809 - RNA, 64 nt, Homo Sapiens; identical to SEQ ID NO: 262299

SEQ ID NO: 370810 - RNA, 64 nt, Homo Sapiens; identical to SEQ ID NO: 262300

SEQ ID NO: 370811 - RNA, 64 nt, Homo Sapiens; identical to SEQ ID NO: 262301

SEQ ID NO: 370812 - RNA, 52 nt, Homo Sapiens; identical to SEQ ID NO: 119717

SEQ ID NO: 370813 - RNA, 64 nt, Homo Sapiens; identical to SEQ ID NO: 119718

SEQ ID NO: 370814 - RNA, 64 nt, Homo Sapiens; identical to SEQ ID NO: 119719

SEQ ID NO: 370815 - RNA, 64 nt, Homo Sapiens; identical to SEQ ID NO: 119720

SEQ ID NO: 370816 - RNA, 64 nt, Homo Sapiens; identical to SEQ ID NO: 119721

SEQ ID NO: 370817 - RNA, 64 nt, Homo Sapiens; identical to SEQ ID NO: 119722

SEQ ID NO: 370818 - RNA, 64 nt, Homo Sapiens; identical to SEQ ID NO: 119723

SEQ ID NO: 370819 - RNA, 64 nt, Homo Sapiens; identical to SEQ ID NO: 119724

SEQ ID NO: 370820 - RNA, 64 nt, Homo Sapiens
uggugugugaugugugugugugcaguggggguaucacagagaguaugacaucugaguugagggu

SEQ ID NO: 370821 - RNA, 64 nt, Homo Sapiens
uuccaacuagaauucuagaaauauuucuagaacacacagagagggaauaagucccucuaucacc

SEQ ID NO: 370822 - RNA, 64 nt, Homo Sapiens
uugcugcuugugaucucacaacaucugaauucaacacagagaaggugccccgacugugggaaag

SEQ ID NO: 370823 - RNA, 64 nt, Homo Sapiens
gacgacauccugugccccgagggcguggcuuccucacagagaggagugcucccucucacuggug

SEQ ID NO: 370824 - RNA, 64 nt, Homo Sapiens
caucuuaaggggacccacaacacacacacacacacacagagacaguaacacacacacacauaca

SEQ ID NO: 370825 - RNA, 64 nt, Homo Sapiens
cacgggcucaaggaacccaagcccuggcuauggucacagagagacugccuucuccugcauugcu

SEQ ID NO: 370826 - RNA, 64 nt, Homo Sapiens
cccacugccucagguuccuaagaaucagucuauccacagagaguuuugcuguuguuucuaaaca

SEQ ID NO: 370827 - RNA, 64 nt, Homo Sapiens
uuccuccgagccggggaguuucaagaauggggaucacagagacagccccuuuucacucccucca

SEQ ID NO: 370828 - RNA, 64 nt, Homo Sapiens
gcacacagauaagcugcccaaaugcacgcacacgcacagagacaugccagaacauacaaggaca

SEQ ID NO: 370829 - RNA, 64 nt, Homo Sapiens
cuaguggcucauccccacugcauucucccccugacacagagaaggggccuugguauuuauauuu

SEQ ID NO: 370830 - RNA, 64 nt, Homo Sapiens
ggcuuccccaucgccuucuggcugcugcagucagcacagagagcagcuuccccaucgccuucug

SEQ ID NO: 370831 - RNA, 64 nt, Homo Sapiens
ggcuuccccauugccuucuggccgcugcagucagcacagagagcggcuuccccaucgccuucug

SEQ ID NO: 370832 - RNA, 64 nt, Homo Sapiens
acaacuuagaagaaauauaaaugguuauagucaacacagagaucaagaauauagcauauuuagu

SEQ ID NO: 370833 - RNA, 64 nt, Homo Sapiens
ugagcuuucaaauuuugcaguccauuccccacuacacagagagguuauauacuaguuaauuucu

SEQ ID NO: 370834 - RNA, 64 nt, Homo Sapiens
uuuaguaauuugcaaaagccaauggaaaaguagucacagagaaaaccaaccaaauuacuuaaga

SEQ ID NO: 370835 - RNA, 64 nt, Homo Sapiens
uaagaaaaugacauuucuggaacaauauauaacacacagagaauuauuugagugaauaggagaa

SEQ ID NO: 370836 - RNA, 64 nt, Homo Sapiens
aguuggugcuuaguuaugugaggaguaacagguucacagagagaaggauuucuauugacuaguc

SEQ ID NO: 370837 - RNA, 64 nt, Homo Sapiens
aaccagaaacggaauaauguuagauuuuauaagccacagagacauuguccaaucuuaucauuag

SEQ ID NO: 370838 - RNA, 64 nt, Homo Sapiens
acaacugaaaaaccacauuuuguuuaaauaguaccacagagaaauuccuuauucuuuuuuauuu

SEQ ID NO: 370839 - RNA, 64 nt, Homo Sapiens
uaacuacggagcccaugcccaugcagcacaguggcacagagagguacacaguuaccagauggga

SEQ ID NO: 370840 - RNA, 64 nt, Homo Sapiens
cagagaacagaaacaagagcgaauaucugaccaucacagagaucuacaucucuuuuggccaaaa

SEQ ID NO: 370841 - RNA, 64 nt, Homo Sapiens
caccauuacauacacagacacagccccuccccgccacagagacacacagacacacaaucacacg

SEQ ID NO: 370842 - RNA, 64 nt, Homo Sapiens
caccauuacauacacagacacacacccuccccgccacagagacacacagacacaaaaucacaca

SEQ ID NO: 370843 - RNA, 64 nt, Homo Sapiens
ccauuacauacacagacacacacacccuccccgccacagagacacacagacacaaaaucacaca

SEQ ID NO: 370844 - RNA, 64 nt, Homo Sapiens
ccauuacauacacagacacacacccccuccccaccacagagacauccccaccucaaaucacaca

SEQ ID NO: 370845 - RNA, 64 nt, Homo Sapiens
cugcagaugucacacgcuuucucagcugcagagacacagagacauguaaauguucugauuugcu

SEQ ID NO: 370846 - RNA, 64 nt, Homo Sapiens
caaauucuuaugacuuuugagccccagccagccacacagagaagucccacccaccccugccucu

SEQ ID NO: 370847 - RNA, 64 nt, Homo Sapiens
ucuauacauauauacauacacauggggaaacacacacagagauacacaugagugugaccucugc

SEQ ID NO: 370848 - RNA, 64 nt, Homo Sapiens
augagaaugcagcaucaaucugcagggacugauccacagagaggugcagaccgcacaggugugc

SEQ ID NO: 370849 - RNA, 64 nt, Homo Sapiens
ccagccccuaugaguaggguuccaaauuccagcacacagagauccuguagauuuauuuccauuu

SEQ ID NO: 370850 - RNA, 64 nt, Homo Sapiens
uucauauauauauacauauaaauauguuucuaaccacagagaauuuuggucuguggcuaguuua

SEQ ID NO: 370851 - RNA, 64 nt, Homo Sapiens
aagagacuccaagauucaaagagacuaauagagacacagagauggaauagaaaagaugagaggc

SEQ ID NO: 370852 - RNA, 64 nt, Homo Sapiens
cauggaugcacacacacacacgccaaugcacacacacagagauaugcacacacacggaugcaca

SEQ ID NO: 370853 - RNA, 64 nt, Homo Sapiens
uaugcacacacacggaugcacacacagauggucacacagagauacgcaaacacaccgaugcaca

SEQ ID NO: 370854 - RNA, 64 nt, Homo Sapiens
ugccaaugcacgcacacaucagugcacacggaugcacagagauaugcacacaccgaugugcgca

SEQ ID NO: 370855 - RNA, 60 nt, Homo Sapiens
cugcucacacuaaaauaugaaccacaaacacacagagaaacaaccuguucaccacuccug

SEQ ID NO: 370856 - RNA, 64 nt, Homo Sapiens
ugcuuaggucuucucugucccuuuacugcugcugcacagagaugauauaaaagaggcucuuugg

SEQ ID NO: 370857 - RNA, 64 nt, Homo Sapiens
uauaggaguguucaguguaugggcguuguguuuccacagagacucaccuugugcuaugacaaug

SEQ ID NO: 370858 - RNA, 64 nt, Homo Sapiens
accuaagcagagguggagaccaguggggaagagucacagagagcccucgucgcccugcaaccuc

SEQ ID NO: 370859 - RNA, 64 nt, Homo Sapiens
aaaggcaguggggcuggggguaguuuuccauggucacagagaacuagugguggcucugagaagg

SEQ ID NO: 370860 - RNA, 64 nt, Homo Sapiens
ucuucggcauugguucccuuugcuccaccccacucacagagacacagggcauccaacugagaaa

SEQ ID NO: 370861 - RNA, 64 nt, Homo Sapiens
uggaaaagucuucaagggcugcuucaaacucaaacacagagagaaacucuauggguaucaaaca

SEQ ID NO: 370862 - RNA, 64 nt, Homo Sapiens
uugccuuuguggcaacugaacguuacgaacaauucacagagaaugcauguugacaccaaccuca

SEQ ID NO: 370863 - RNA, 64 nt, Homo Sapiens
agaucagagaggaaaaacugacugcugacagauacacagagaagagugcugcucccaggagacc

SEQ ID NO: 370864 - RNA, 64 nt, Homo Sapiens
acucugucuccaaaaaaaagagaagaggagaggacacagagacacacagagaagaaagccaugu

SEQ ID NO: 370865 - RNA, 64 nt, Homo Sapiens
caaaaaaaagagaagaggagaggacacagagacacacagagaagaaagccauguggcggcagag

SEQ ID NO: 370866 - RNA, 64 nt, Homo Sapiens
uaaggaacaaaaguguuuuccacacacacacacacacagagagacagacacacacacacacaca

SEQ ID NO: 370867 - RNA, 64 nt, Homo Sapiens
cuugaguacacauacacacauacacacacacacacacagagaccagaagcacuguugaaauuua

SEQ ID NO: 370868 - RNA, 64 nt, Homo Sapiens
cucuccucuccucuccucucaugggaaaccaaggcacagagaggcagaggcccugaaugcacaa

SEQ ID NO: 370869 - RNA, 64 nt, Homo Sapiens
ucuggccaggggauccuaacaguccagaggcagucacagagaccccaagcugcugcacgugcug

SEQ ID NO: 370870 - RNA, 64 nt, Homo Sapiens; identical to SEQ ID NO: 59936

SEQ ID NO: 370871 - RNA, 64 nt, Homo Sapiens; identical to SEQ ID NO: 59937

SEQ ID NO: 370872 - RNA, 64 nt, Homo Sapiens; identical to SEQ ID NO: 59938

SEQ ID NO: 370873 - RNA, 64 nt, Homo Sapiens; identical to SEQ ID NO: 59939

SEQ ID NO: 370874 - RNA, 64 nt, Homo Sapiens; identical to SEQ ID NO: 59940

SEQ ID NO: 370875 - RNA, 64 nt, Homo Sapiens; identical to SEQ ID NO: 59941

SEQ ID NO: 370876 - RNA, 64 nt, Homo Sapiens; identical to SEQ ID NO: 59942

SEQ ID NO: 370877 - RNA, 64 nt, Homo Sapiens; identical to SEQ ID NO: 59943

SEQ ID NO: 370878 - RNA, 64 nt, Homo Sapiens; identical to SEQ ID NO: 59944

SEQ ID NO: 370879 - RNA, 64 nt, Homo Sapiens; identical to SEQ ID NO: 59945

SEQ ID NO: 370880 - RNA, 64 nt, Homo Sapiens; identical to SEQ ID NO: 59946

SEQ ID NO: 370881 - RNA, 64 nt, Homo Sapiens; identical to SEQ ID NO: 59947

SEQ ID NO: 370882 - RNA, 64 nt, Homo Sapiens; identical to SEQ ID NO: 59948

SEQ ID NO: 370883 - RNA, 64 nt, Homo Sapiens; identical to SEQ ID NO: 59949

SEQ ID NO: 370884 - RNA, 64 nt, Homo Sapiens; identical to SEQ ID NO: 59950

SEQ ID NO: 370885 - RNA, 64 nt, Homo Sapiens; identical to SEQ ID NO: 59951

SEQ ID NO: 370886 - RNA, 64 nt, Homo Sapiens; identical to SEQ ID NO: 59952

SEQ ID NO: 370887 - RNA, 64 nt, Homo Sapiens; identical to SEQ ID NO: 59953

SEQ ID NO: 370888 - RNA, 64 nt, Homo Sapiens; identical to SEQ ID NO: 59954

SEQ ID NO: 370889 - RNA, 64 nt, Homo Sapiens; identical to SEQ ID NO: 59955

SEQ ID NO: 370890 - RNA, 64 nt, Homo Sapiens; identical to SEQ ID NO: 87364

SEQ ID NO: 370891 - RNA, 64 nt, Homo Sapiens; identical to SEQ ID NO: 87365

SEQ ID NO: 370892 - RNA, 64 nt, Homo Sapiens; identical to SEQ ID NO: 87366

SEQ ID NO: 370893 - RNA, 64 nt, Homo Sapiens; identical to SEQ ID NO: 87367

SEQ ID NO: 370894 - RNA, 64 nt, Homo Sapiens; identical to SEQ ID NO: 87368

SEQ ID NO: 370895 - RNA, 64 nt, Homo Sapiens; identical to SEQ ID NO: 87369

SEQ ID NO: 370896 - RNA, 64 nt, Homo Sapiens; identical to SEQ ID NO: 87370

SEQ ID NO: 370897 - RNA, 64 nt, Homo Sapiens; identical to SEQ ID NO: 87371

SEQ ID NO: 370898 - RNA, 64 nt, Homo Sapiens; identical to SEQ ID NO: 87372

SEQ ID NO: 370899 - RNA, 64 nt, Homo Sapiens; identical to SEQ ID NO: 87373

SEQ ID NO: 370900 - RNA, 64 nt, Homo Sapiens; identical to SEQ ID NO: 87374

SEQ ID NO: 370901 - RNA, 64 nt, Homo Sapiens; identical to SEQ ID NO: 87375

SEQ ID NO: 370902 - RNA, 64 nt, Homo Sapiens; identical to SEQ ID NO: 87376

SEQ ID NO: 370903 - RNA, 64 nt, Homo Sapiens; identical to SEQ ID NO: 87377

SEQ ID NO: 370904 - RNA, 64 nt, Homo Sapiens; identical to SEQ ID NO: 87378

SEQ ID NO: 370905 - RNA, 64 nt, Homo Sapiens; identical to SEQ ID NO: 87379

SEQ ID NO: 370906 - RNA, 64 nt, Homo Sapiens; identical to SEQ ID NO: 87380

SEQ ID NO: 370907 - RNA, 64 nt, Homo Sapiens; identical to SEQ ID NO: 87381

SEQ ID NO: 370908 - RNA, 64 nt, Homo Sapiens; identical to SEQ ID NO: 87382

SEQ ID NO: 370909 - RNA, 64 nt, Homo Sapiens; identical to SEQ ID NO: 87383

SEQ ID NO: 370910 - RNA, 64 nt, Homo Sapiens; identical to SEQ ID NO: 87384

SEQ ID NO: 370911 - RNA, 64 nt, Homo Sapiens; identical to SEQ ID NO: 87385

SEQ ID NO: 370912 - RNA, 64 nt, Homo Sapiens; identical to SEQ ID NO: 87386

SEQ ID NO: 370913 - RNA, 64 nt, Homo Sapiens; identical to SEQ ID NO: 87387

SEQ ID NO: 370914 - RNA, 64 nt, Homo Sapiens; identical to SEQ ID NO: 87388

SEQ ID NO: 370915 - RNA, 64 nt, Homo Sapiens; identical to SEQ ID NO: 87389

SEQ ID NO: 370916 - RNA, 64 nt, Homo Sapiens; identical to SEQ ID NO: 87390

SEQ ID NO: 370917 - RNA, 64 nt, Homo Sapiens; identical to SEQ ID NO: 87391

SEQ ID NO: 370918 - RNA, 64 nt, Homo Sapiens; identical to SEQ ID NO: 87392

SEQ ID NO: 370919 - RNA, 64 nt, Homo Sapiens; identical to SEQ ID NO: 87393

SEQ ID NO: 370920 - RNA, 64 nt, Homo Sapiens; identical to SEQ ID NO: 87394

SEQ ID NO: 370921 - RNA, 64 nt, Homo Sapiens; identical to SEQ ID NO: 87395

SEQ ID NO: 370922 - RNA, 64 nt, Homo Sapiens; identical to SEQ ID NO: 87396

SEQ ID NO: 370923 - RNA, 64 nt, Homo Sapiens; identical to SEQ ID NO: 87397

SEQ ID NO: 370924 - RNA, 64 nt, Homo Sapiens; identical to SEQ ID NO: 87398

SEQ ID NO: 370925 - RNA, 64 nt, Homo Sapiens; identical to SEQ ID NO: 87399

SEQ ID NO: 370926 - RNA, 64 nt, Homo Sapiens; identical to SEQ ID NO: 87400

SEQ ID NO: 370927 - RNA, 64 nt, Homo Sapiens; identical to SEQ ID NO: 87401

SEQ ID NO: 370928 - RNA, 64 nt, Homo Sapiens; identical to SEQ ID NO: 87402

SEQ ID NO: 370929 - RNA, 64 nt, Homo Sapiens; identical to SEQ ID NO: 87403

SEQ ID NO: 370930 - RNA, 64 nt, Homo Sapiens; identical to SEQ ID NO: 87404

SEQ ID NO: 370931 - RNA, 64 nt, Homo Sapiens; identical to SEQ ID NO: 87405

SEQ ID NO: 370932 - RNA, 64 nt, Homo Sapiens; identical to SEQ ID NO: 87406

SEQ ID NO: 370933 - RNA, 64 nt, Homo Sapiens
ucucgugcgggcgcgugaguggucuucaaacgagggucccgauccccggggcggcaggaagggg

SEQ ID NO: 370934 - RNA, 64 nt, Homo Sapiens
ucuucugccucauuucuuaaaauuagagaauuaaggucccgaagguggaacaugcuucaugguc

SEQ ID NO: 370935 - RNA, 64 nt, Homo Sapiens
ugccccccuacccccucacucuccccgucuccauggucccgaccaggaagggaagccaucggua

SEQ ID NO: 370936 - RNA, 64 nt, Homo Sapiens
ugaccuguucuugccugucaccugggccuacacaggucccgagccaacggggcuuucauaccca

SEQ ID NO: 370937 - RNA, 64 nt, Homo Sapiens
agcaggacuggaggccuguggcccacagcagauaggucccgagcagcagugcccaccuuccuug

SEQ ID NO: 370938 - RNA, 64 nt, Homo Sapiens
gaggagaagaaacgcaacuaccugcgcccuccguggucccgauccuguugcugcugcugcaccg

SEQ ID NO: 370939 - RNA, 64 nt, Homo Sapiens
auguugguccuuccacugggugcagcaggagcugggucccgagagccuggcaggugaaacucug

SEQ ID NO: 370940 - RNA, 64 nt, Homo Sapiens
ucccugggaggcugacagggugcuggggagccguggucccgaguccugguacuuguucagccug

SEQ ID NO: 370941 - RNA, 64 nt, Homo Sapiens
cgucgccggcgcuccaccguggcuacccauccguggucccgacaaccucccugucccuugcccg

SEQ ID NO: 370942 - RNA, 64 nt, Homo Sapiens
ggcuccccaugcaacacuggaggacccggggaggggucccgagaaauagcugccgcuugcgcag

SEQ ID NO: 370943 - RNA, 64 nt, Homo Sapiens
gcauccgucgcuuucugcagaaaggggcuucuucggucccgagcucgcguccagguggccaggc

SEQ ID NO: 370944 - RNA, 64 nt, Homo Sapiens
ccagagaaggaggcugggggaucaccagccccaaggucccgaagggcaggucagagggagagag

SEQ ID NO: 370945 - RNA, 64 nt, Homo Sapiens
ccugagacccggaaggcccuaggguggcuccccaggucccgaagaggacgaguggucaccaaac

SEQ ID NO: 370946 - RNA, 58 nt, Homo Sapiens
ccaggagggaacccgcgcucggcgggcgggucccgagcgcaaacccuucugcgccuga

SEQ ID NO: 370947 - RNA, 64 nt, Homo Sapiens
aucccuucuuccauccuuagagggacccuuccaaggucccgaccccaucccuauccauaguccu

SEQ ID NO: 370948 - RNA, 64 nt, Homo Sapiens
ccaggacauaccaccuggggaugggcugacucagggucccgaggccagagacaaagcuguggga

SEQ ID NO: 370949 - RNA, 64 nt, Homo Sapiens
ugaggcagccccccauaggcuuccgccaagcucuggucccgaagaggcugugcgagcccuuccc

SEQ ID NO: 370950 - RNA, 64 nt, Homo Sapiens
cugccuggccauggaggaaggaucccgcuaggcuggucccgacuggagaagcugcucugccagg

SEQ ID NO: 370951 - RNA, 64 nt, Homo Sapiens
gaugcagugacuuuuugucgagcagcaaggcccaggucccgaaaugucgccaccuuccauguga

SEQ ID NO: 370952 - RNA, 64 nt, Homo Sapiens
uccccacaauaaaaugugaucugccgccccuucaggucccgaccaagccuggggcccaucgugc

SEQ ID NO: 370953 - RNA, 64 nt, Homo Sapiens
augcugucaggagauggaaguguccccuggggaaggucccgaggggguccucugcuuccugugc

SEQ ID NO: 370954 - RNA, 64 nt, Homo Sapiens
augcugucaggagauggaaguguccccuggagaaggucccgaggggguccucugcuuccugagc

SEQ ID NO: 370955 - RNA, 64 nt, Homo Sapiens
ggagacccaccccgagccccccuucaagcaauagggucccgaggcgccaggggccuugccggcc

SEQ ID NO: 370956 - RNA, 64 nt, Homo Sapiens
uugagaggcagcaugguagaaccuguaaauagauggucccgacacucucgacaggcaagagaac

SEQ ID NO: 370957 - RNA, 64 nt, Homo Sapiens
uccugaccucaggugauccgauguugaccaggcuggucccgaacaguagagacgggguuucacc

SEQ ID NO: 370958 - RNA, 64 nt, Homo Sapiens
cgggaaguacauauuggggcccccagagcuugguggucccgaaauccacugccugcauuccagu

SEQ ID NO: 370959 - RNA, 64 nt, Homo Sapiens
ucccuggcaccagggucugccucucacucgcccaggucccgaaggacacugccacagggacgcc

SEQ ID NO: 370960 - RNA, 64 nt, Homo Sapiens
gccacauaacagacugcuguccugggcugccucaggucccgaguaacuuauguucaaugugcca

SEQ ID NO: 370961 - RNA, 64 nt, Homo Sapiens
gcauaaagcggcaaagcccaccauuaggugaggcggucccgaguugagguagaguggggcagag

SEQ ID NO: 370962 - RNA, 64 nt, Homo Sapiens
cccgacuagcuuugcccuaacuuccuucucagggggucccgagcuuccaccaggacucaucucc

SEQ ID NO: 370963 - RNA, 64 nt, Homo Sapiens
acagucuguaucaaacccacaacccuagguucccggucccgaguacaggccucaccucuaccca

SEQ ID NO: 370964 - RNA, 64 nt, Homo Sapiens
ccccuccuagucuuucauccaaaggagagcaagaggucccgaguccacccuuuuuuuuucuggg

SEQ ID NO: 370965 - RNA, 64 nt, Homo Sapiens
ugggacucacguggcuucaacagcuuuggaaaugggucccgagugggccgugcgaggaaggcug

SEQ ID NO: 370966 - RNA, 64 nt, Homo Sapiens
gaggacugugugucuuuuuauguggaacguguucggucccgaguuaauuuccuucugauuucuc

SEQ ID NO: 370967 - RNA, 64 nt, Homo Sapiens
guaucccccgcaggcggaaguagcugagggcaagggucccgaugagggucccauggccugcucc

SEQ ID NO: 370968 - RNA, 64 nt, Homo Sapiens
aagucuccagcaucuguggaucgccagaggucccggucccgaucaagguccagaucaguugaca

SEQ ID NO: 370969 - RNA, 64 nt, Homo Sapiens
gauucuagcacaucauggcagugggaccaagcguggucccgaggaagggccagagccugguaga

SEQ ID NO: 370970 - RNA, 64 nt, Homo Sapiens
gggccuggaggcccagauacagcacauccacccaggucccgagcccucacacccuggacgggaa

SEQ ID NO: 370971 - RNA, 64 nt, Homo Sapiens
ugauggcauccgaaaucuauacuuggauuuugguggucccgagggagaacugguaagaguguuu

SEQ ID NO: 370972 - RNA, 64 nt, Homo Sapiens
ucguccccaagccuggcagaaugagagggguugaggucccgagcgccacuccuagccuugccgc

SEQ ID NO: 370973 - RNA, 64 nt, Homo Sapiens
ccuggccacaugggaccaagcggaaccagaacaaggucccgacagggguagacguuccaccugg

SEQ ID NO: 370974 - RNA, 64 nt, Homo Sapiens
ugcucccggaucacccucagccuuggugcucaguggucccgaggcccuagacccccaccccccg

SEQ ID NO: 370975 - RNA, 64 nt, Homo Sapiens
gggacccuugccugccuccuaggcuggaagccauggucccgaaguguagggcaagggugccuca

SEQ ID NO: 370976 - RNA, 64 nt, Homo Sapiens
ggcaucucuggagugugugggggucugggaggcaggucccgagcccccuguccuucccacggcc

SEQ ID NO: 370977 - RNA, 64 nt, Homo Sapiens
accugccccccacucugcacagccuagacauccaggucccgaaaggggcacugguggccguggu

SEQ ID NO: 370978 - RNA, 64 nt, Homo Sapiens
cagacccuuggagagaaaccguugcuagcuugcuggucccgaaagauugcaacuuuggcugcua

SEQ ID NO: 370979 - RNA, 64 nt, Homo Sapiens
cuagaagacuagaaagccaaggucuuuuauuaaaggucccgacugguuuucccacuguauuucc

SEQ ID NO: 370980 - RNA, 64 nt, Homo Sapiens
ggagguggggccuggcccuggcugccagucuccuggucccgagacugcccaggugaacacagcg

SEQ ID NO: 370981 - RNA, 64 nt, Homo Sapiens
ccaccuccuccccuucauuccugcugcuaccccuggucccgagggcugggaguaccuggggccc

SEQ ID NO: 370982 - RNA, 64 nt, Homo Sapiens
cagcgagucuuccagaaggggugaaaggguugcaggucccgaccacugacccuucccggcugcc

SEQ ID NO: 370983 - RNA, 64 nt, Homo Sapiens
aacucugccuccauccacgugaggggacggcuggggucccgagcgggggccccaucggccugca

SEQ ID NO: 370984 - RNA, 64 nt, Homo Sapiens
uggaaaccauugcccuccagucauagcggacgggggucccgaggugcagaaaaguuggccaggu

SEQ ID NO: 370985 - RNA, 64 nt, Homo Sapiens
gggggccgugccuuugcccaugggggugccagagggucccgagugggggacggcccagcguggg

SEQ ID NO: 370986 - RNA, 64 nt, Homo Sapiens
gggcggggcagcgacugggauccauucagguggaggucccgagugggcagguggaggggagacc

SEQ ID NO: 370987 - RNA, 64 nt, Homo Sapiens
ggaguccagaccugggcccucccggagcugggaaggucccgaauguacuucuguguugugauuc

SEQ ID NO: 370988 - RNA, 64 nt, Homo Sapiens
cgcgggcgaggccggguaccacccugaacccuacggucccgacccaguggaccgcugugcgcga

SEQ ID NO: 370989 - RNA, 64 nt, Homo Sapiens
gacuuuugaaaagugcccuuuacuuuuauuauuuuuuagugaaacuuagaauuuguuuaacugg

SEQ ID NO: 370990 - RNA, 64 nt, Homo Sapiens
caaaugauugcaauuuuucuaagcuguauccuaguuuagugauaugcguuuuuuacugcuuuca

SEQ ID NO: 370991 - RNA, 64 nt, Homo Sapiens
uucuguuaaaaucuauucuguguugcauuauucauuuagugaguuauuccuugaucauuuuggg

SEQ ID NO: 370992 - RNA, 64 nt, Homo Sapiens
uguuuaauuugacuucucugccuuugacauuuaauuuagugaucuuagcauagcuuauuauuga

SEQ ID NO: 370993 - RNA, 64 nt, Homo Sapiens
uuggaacucugcaagaccuacuagauugaauuuauuuagugaaugcuccugaauaaaugugcau

SEQ ID NO: 370994 - RNA, 64 nt, Homo Sapiens
auaggguaagggacuguucugaagaaccuuuccauuuagugaucaagauauggaagcugauuuc

SEQ ID NO: 370995 - RNA, 64 nt, Homo Sapiens
uuucgaguacagcuaauuggauaaucucaaacccuuuagugaaaauaucuuaaaugcauugaga

SEQ ID NO: 370996 - RNA, 64 nt, Homo Sapiens
cccgcccgucuucuaagggcauuuucuguuucuuuuuagugaguucaugaauguuuaacgguuc

SEQ ID NO: 370997 - RNA, 64 nt, Homo Sapiens
gcuguaggauuaauucgaaacauggcuguuaguuuuuagugagucacaaaauguauuauggugc

SEQ ID NO: 370998 - RNA, 64 nt, Homo Sapiens
agaauugagaagaacgugccuuuaguaauuuuaauuuagugaacauggcucuuggcaguuuaaa

SEQ ID NO: 370999 - RNA, 64 nt, Homo Sapiens
gcaauucaguaguccugaagauuucaaauagcauuuuagugaauguggguggcgaguaaguaaa

SEQ ID NO: 371000 - RNA, 64 nt, Homo Sapiens
aagaagaaaggaaaccucauuuaaauguaauuuuuuuagugacaacuuaucuuuauucucaaaa

SEQ ID NO: 371001 - RNA, 64 nt, Homo Sapiens
ccaagauugacauguugcucacaacaugucacaauuuagugaggagcuacauguauuuccaaga

SEQ ID NO: 371002 - RNA, 64 nt, Homo Sapiens
cuauaaacaaaaacuaguuugaggcacccaagcauuuagugagagauugagaaugaugcuuaau

SEQ ID NO: 371003 - RNA, 64 nt, Homo Sapiens
augaacugucuguucuuaggcucuugaaccuuaguuuagugaagugguuuggaguucauuugaa

SEQ ID NO: 371004 - RNA, 64 nt, Homo Sapiens
cagauuugucuguuuguuuugaaacauaagccuuuuuagugauguuuauuugaaauguuuuaaa

SEQ ID NO: 371005 - RNA, 64 nt, Homo Sapiens
aauucaggaugaaaguuuuuuuuuuuucguuuguuuuagugacuauucacaaguuuugguuuuu

SEQ ID NO: 371006 - RNA, 64 nt, Homo Sapiens
aaucauauaaaaccauucacagcauauguauauguuuagugacaaaguuuuuaaaagugcuuug

SEQ ID NO: 371007 - RNA, 64 nt, Homo Sapiens
gcccaaagacuccucuaagacaaguccuguucuguuuagugaagacaaccucuuuuaaaucuaa

SEQ ID NO: 371008 - RNA, 64 nt, Homo Sapiens
uaauucuuucuaaagaugaacuuagaagaaaucauuuagugacuauccaagcaaauggcaacaa

SEQ ID NO: 371009 - RNA, 64 nt, Homo Sapiens
gcugaauccaaguuucauguauguuucuaaaagcuuuagugaaggauauacucacuuuauaugu

SEQ ID NO: 371010 - RNA, 64 nt, Homo Sapiens
uuuuuuuaaacuuacagcauuuuucaacuaauuuuuuagugaaucucuaguguuaaguguauuu

SEQ ID NO: 371011 - RNA, 64 nt, Homo Sapiens
guacuucuuccuauuuuucucuugucggggaaccuuuagugaggucguuggaucugccggaaga

SEQ ID NO: 371012 - RNA, 64 nt, Homo Sapiens
uugcuaaucauugaauucugaaaugggguaaauuuuuagugauggucagugacucauggagaag

SEQ ID NO: 371013 - RNA, 64 nt, Homo Sapiens
gcugacuggcaagauaaaaacucuguggaaguacuuuagugagaacuugggagccaccuucuca

SEQ ID NO: 371014 - RNA, 64 nt, Homo Sapiens
uaccccuuuuaaaaaggugacgcuaagcuguauuuuuagugagcgaagucuuuuuuucuuuuua

SEQ ID NO: 371015 - RNA, 64 nt, Homo Sapiens
ugaagcugccauaaauauuucucaacugagguucuugggauacagaucucagggcucgggagcc

SEQ ID NO: 371016 - RNA, 64 nt, Homo Sapiens
cguaaguggaguccuggaauuuggacaagugcuguugggauauagucaacuuauucuuugagua

SEQ ID NO: 371017 - RNA, 64 nt, Homo Sapiens
ccggcaagguacagguuuugauguucaaguuuuauugggauaagaucuuuugaucccaagguca

SEQ ID NO: 371018 - RNA, 64 nt, Homo Sapiens
caguccaaccuuucauuccuuggaggauuuaguuuugggauaaaauuuugguccuugggcacag

SEQ ID NO: 371019 - RNA, 64 nt, Homo Sapiens
aucucaaaaaaaauaaguucugguugucauugaauugggauaaacagagagcuugaugcuuucu

SEQ ID NO: 371020 - RNA, 64 nt, Homo Sapiens
uucugccuucugucucaggugaugcauugcacauuugggauauuuggaaaggaaaugaggaaag

SEQ ID NO: 371021 - RNA, 64 nt, Homo Sapiens; identical to SEQ ID NO: 108561

SEQ ID NO: 371022 - RNA, 64 nt, Homo Sapiens; identical to SEQ ID NO: 108562

SEQ ID NO: 371023 - RNA, 64 nt, Homo Sapiens; identical to SEQ ID NO: 108563

SEQ ID NO: 371024 - RNA, 64 nt, Homo Sapiens; identical to SEQ ID NO: 108564

SEQ ID NO: 371025 - RNA, 64 nt, Homo Sapiens; identical to SEQ ID NO: 108565

SEQ ID NO: 371026 - RNA, 64 nt, Homo Sapiens; identical to SEQ ID NO: 108566

SEQ ID NO: 371027 - RNA, 64 nt, Homo Sapiens; identical to SEQ ID NO: 108567

SEQ ID NO: 371028 - RNA, 64 nt, Homo Sapiens; identical to SEQ ID NO: 108568

SEQ ID NO: 371029 - RNA, 64 nt, Homo Sapiens; identical to SEQ ID NO: 108569

SEQ ID NO: 371030 - RNA, 64 nt, Homo Sapiens; identical to SEQ ID NO: 108570

SEQ ID NO: 371031 - RNA, 62 nt, Homo Sapiens
ccuccccacugcacccagggggcaacuccaccuggacugaugggcacaggaggcaccaauag

SEQ ID NO: 371032 - RNA, 62 nt, Homo Sapiens
caaugugaacugaagcugaugggcugagaacauggacugagcuuguggugugcuuugcagga

SEQ ID NO: 371033 - RNA, 62 nt, Homo Sapiens
acuguggcuccucacuggggguuucacgggguuggacugagcccugucaccucugugauagu

SEQ ID NO: 371034 - RNA, 62 nt, Homo Sapiens
gugaauggccaagcuggucuaguagaugaggcuggacugaggagggguaggccugcauccac

SEQ ID NO: 371035 - RNA, 62 nt, Homo Sapiens
cuccuucccugcaggccuggagccuguagggcuggacugagguucaggucuccccccagcug

SEQ ID NO: 371036 - RNA, 62 nt, Homo Sapiens
gagcagugagguuuguucuuuccagugaaugguggacugaguggugcgagguggagggcuaa

SEQ ID NO: 371037 - RNA, 62 nt, Homo Sapiens
uagauacuaauagauuaucuuuucugaugcacuggacugaauuuuuaccucaaugugcaaag

SEQ ID NO: 371038 - RNA, 62 nt, Homo Sapiens
gggguugagcagaauguuguacuagcugugccuggacugaguauaacagcuuuaugauuaug

SEQ ID NO: 371039 - RNA, 62 nt, Homo Sapiens
gcauaaauugaaggauccggauuccuuaaugauggacugaaugaugcuuacuuuccuucuuu

SEQ ID NO: 371040 - RNA, 62 nt, Homo Sapiens
uugugaucccagcuggccccuauguuguguucuggacugaggccuuugcugugaacugcagu

SEQ ID NO: 371041 - RNA, 62 nt, Homo Sapiens
uuggcuugaauguacauagaugguaccuggcauggacugauguuuuuaggcacagaaguugg

SEQ ID NO: 371042 - RNA, 62 nt, Homo Sapiens
gcuuuggaccugaccggguguguguaaaaccauggacugagucacagcagacacucgauggu

SEQ ID NO: 371043 - RNA, 62 nt, Homo Sapiens
cucugaugaggaggaaccaccugaucuccccuuggacugauacccuuuucccauucauucac

SEQ ID NO: 371044 - RNA, 62 nt, Homo Sapiens
ccuaagaaguccccaggucaugcugcuguugcuggacugaggaccacacuuugagaaccugu

SEQ ID NO: 371045 - RNA, 62 nt, Homo Sapiens
agccagccagcucauuucacuuuacacgcucauggacugaguuuauacucaccuuuuaugaa

SEQ ID NO: 371046 - RNA, 62 nt, Homo Sapiens
uuccuccccaucucucgcacgcagucuagagauggacugagccuugcuucucacuggcagug

SEQ ID NO: 371047 - RNA, 62 nt, Homo Sapiens
aaugcagacaacaccuuccuccugcagacaccuggacugagccaaggaggccuggggaggcc

SEQ ID NO: 371048 - RNA, 62 nt, Homo Sapiens
acccuccacccccaacucaugaaaagauucuauggacugaaaaagccccaggcugaaaggac

SEQ ID NO: 371049 - RNA, 62 nt, Homo Sapiens
gagugcgugcugggugggguguguuaaggcaauggacugaauaaaacagccccaucaggcuu

SEQ ID NO: 371050 - RNA, 62 nt, Homo Sapiens
acaggugugggcgccagugugcggcucugaguuggacugagggaggaagucccgcucucccc

SEQ ID NO: 371051 - RNA, 62 nt, Homo Sapiens
ggcaguccccucccaccuggccuaggcuaccauggacugaagccagccugugcucccagggg

SEQ ID NO: 371052 - RNA, 62 nt, Homo Sapiens
auccagaaagcuucccugcaugaguccuggacuggacugaacacagucccccagaaacuuag

SEQ ID NO: 371053 - RNA, 62 nt, Homo Sapiens
gucccccaggcccagccaggccugcagguggcuggacugagucaacuggggcaugaacagga

SEQ ID NO: 371054 - RNA, 62 nt, Homo Sapiens
ccaucguggaaagggcuggguggcuucuggaauggacugaguugaagggggcgguguuggcc

SEQ ID NO: 371055 - RNA, 62 nt, Homo Sapiens
ugggggaagaagggauaucuccaugaacaucauggacugagccaggccugaagucuucuccu

SEQ ID NO: 371056 - RNA, 62 nt, Homo Sapiens
gauaggccaagggcuacucuugugugggagccuggacugacauguguguaugacugugugac

SEQ ID NO: 371057 - RNA, 62 nt, Homo Sapiens
aagagggaggagggagccugccaugcugucucuggacugagcaucuaccucugucucuuuaa

SEQ ID NO: 371058 - RNA, 62 nt, Homo Sapiens
cccagugggaccaguguugcaacagcggagccuggacugacaccagcagucguucccagcag

SEQ ID NO: 371059 - RNA, 62 nt, Homo Sapiens
aucuuaguuuuaugauaaaaucacaguuugcauggacugauuuuguuuuguuucauaucaua

SEQ ID NO: 371060 - RNA, 62 nt, Homo Sapiens
gggaucaugaaaguagacagagggcuaugguguggacugaauucuggcuuggccuaucuccu

SEQ ID NO: 371061 - RNA, 62 nt, Homo Sapiens
ggucugcuccaggccacauuguucauaaaacauggacugauggcuacggacacauucagucu

SEQ ID NO: 371062 - RNA, 62 nt, Homo Sapiens
cucuucaugaugagauggaagagaacgccgcguggacugaagggaacccaggaaaaugggag

SEQ ID NO: 371063 - RNA, 62 nt, Homo Sapiens
gcuuugucuaagaugacaaggucccuggccaguggacugaaguugaauuggccauauacagg

SEQ ID NO: 371064 - RNA, 62 nt, Homo Sapiens
gacucaugccagcccuacaguucaguuuaucuuggacugacugauagauguuauucaacucc

SEQ ID NO: 371065 - RNA, 62 nt, Homo Sapiens
aguauucaauccacuuuugggaauuccauuuguggacugaaagaugauuaaguggggucacu

SEQ ID NO: 371066 - RNA, 62 nt, Homo Sapiens
cagucuuaccugagacuggacccuugcauuucuggacugaacaggauucaggagaagcaucu

SEQ ID NO: 371067 - RNA, 62 nt, Homo Sapiens
ugcacucuugguucuuuggagugaaagugaaauggacugauuuagagacccuaucucagaca

SEQ ID NO: 371068 - RNA, 62 nt, Homo Sapiens
gaaacuaugcuauuggaucucuugcuggcauauggacugaaaggcucuucuugggucuugag

SEQ ID NO: 371069 - RNA, 62 nt, Homo Sapiens
uuauacucaccuuuuaugaauuuacacccucauggacugagaagccagccagcucauuucac

SEQ ID NO: 371070 - RNA, 50 nt, Homo Sapiens
ugcuggaguucagggaacuauggacugauuuggccagcccugggugcuga

SEQ ID NO: 371071 - RNA, 62 nt, Homo Sapiens
accugcacuuugcagaggacugcugcuguguguggacugaaccgugacaucagcagugcugg

SEQ ID NO: 371072 - RNA, 62 nt, Homo Sapiens
gagaaaaaagcaaaauucuucuauuuuaaaguuggacugaaggauaagaaggacagaaagga

SEQ ID NO: 371073 - RNA, 62 nt, Homo Sapiens
cuugugccacugggccuuucggcugccugugcuggacugagggguuggggaggguuggggag

SEQ ID NO: 371074 - RNA, 62 nt, Homo Sapiens
uuucaauuugugcacaugccgaaagaguaagguggacugacuccuaagcguucccacucgca

SEQ ID NO: 371075 - RNA, 62 nt, Homo Sapiens
ccaucugaaaagaaagcuaaauaccaguaugguggacugaauucuggacguccugucacucc

SEQ ID NO: 371076 - RNA, 62 nt, Homo Sapiens
uccaagcucacgaccuuggagccccguggagcuggacugaggaggaggcugcacagcgggag

SEQ ID NO: 371077 - RNA, 62 nt, Homo Sapiens
ggacuggcaaccagagccucagcauccaaagauggacugaagugggauggcugacaggcaca

SEQ ID NO: 371078 - RNA, 57 nt, Homo Sapiens
guacucucacgacuggcuaagacuugcuggacugacaccuauggcuggaagaugacu

SEQ ID NO: 371079 - RNA, 62 nt, Homo Sapiens
gacugugguuuagagccuuugauuuccuggacuggacugacggcgagugaauucucuagacc

SEQ ID NO: 371080 - RNA, 62 nt, Homo Sapiens
cagggcacuugauccauuccaaagucaaaaacuggacugaagcuaaauuuguacuuuucaua

SEQ ID NO: 371081 - RNA, 62 nt, Homo Sapiens
ugaauauagucaaagcguggcauugagauaauuggacugaagaccaguuugaugagaagcuu

SEQ ID NO: 371082 - RNA, 62 nt, Homo Sapiens
cacauggcugugcaggccaggaggcccacagauggacugagugcugggaaggggcggcugcg

SEQ ID NO: 371083 - RNA, 62 nt, Homo Sapiens
caggucacugccccuggucucucuaggaggaguggacugaauggaucguugcagagaagacu

SEQ ID NO: 371084 - RNA, 62 nt, Homo Sapiens
gccuccccccagagggccacccgcugugcucguggacugaggcugcgcugcccgggaggccu

SEQ ID NO: 371085 - RNA, 62 nt, Homo Sapiens
uauuugguuaccauggaggcaauagaaaguauuggacugagagaagucaggguauugugcau

SEQ ID NO: 371086 - RNA, 62 nt, Homo Sapiens
uuuugcuguguaacuuguucgauuucauuuuauggacugauaagcuaaccuaaauaaggaag

SEQ ID NO: 371087 - RNA, 62 nt, Homo Sapiens
cucucaaguucacccuuuagguccugaaagaauggacugaagaaguccucgcagaagugcaa

SEQ ID NO: 371088 - RNA, 62 nt, Homo Sapiens
cuaaugcuuccaaaaauguuucacagaaucuauggacugaauacugacuguaguuaauuuug

SEQ ID NO: 371089 - RNA, 62 nt, Homo Sapiens
cguuugucuagacuacauguguuagcaccucuuggacugaauauagugcugcauugucugaa

SEQ ID NO: 371090 - RNA, 62 nt, Homo Sapiens
uccggugccucugccuuaucgagccucacuccuggacugaagauuauuuggguuuaaucucg

SEQ ID NO: 371091 - RNA, 62 nt, Homo Sapiens
uuccacuuggguuuuaucuuauauucaaaagauggacugagcaaaaaauccucauuuuguua

SEQ ID NO: 371092 - RNA, 62 nt, Homo Sapiens
guuugaacuuaacgucuauugcuagugacgaauggacugaugaauuugcccgaagacauaca

SEQ ID NO: 371093 - RNA, 62 nt, Homo Sapiens
guauccacucggaccaucugccauacugagccuggacugaaacuaguggauuccugcaggcc

SEQ ID NO: 371094 - RNA, 62 nt, Homo Sapiens
uugaaauuuuauauccacuccuuugacucauuuggacugaauugcucuguuagcacuuuuuu

SEQ ID NO: 371095 - RNA, 62 nt, Homo Sapiens
cuauugcuaggcuuaaauacagaaauacuaacuggacugaccgauauucaccauuugugagg

SEQ ID NO: 371096 - RNA, 62 nt, Homo Sapiens
ugacagcuucuccugcuguuuccuuccucucuuggacugaguggguacggccagccacucag

SEQ ID NO: 371097 - RNA, 62 nt, Homo Sapiens
uccuuggagagccaucgaggagaaugugcaauuggacugaagcucccuggcugaagauacau

SEQ ID NO: 371098 - RNA, 62 nt, Homo Sapiens
ugaagucauauuuuguuaaugaaauaaaaacauggacugagugucaacuacaugagcuuugg

SEQ ID NO: 371099 - RNA, 62 nt, Homo Sapiens
aagaaaaaacauuuuuacugcugcuuaguuuuuggacugaaaagauauuaaaacucaagaag

SEQ ID NO: 371100 - RNA, 62 nt, Homo Sapiens
cucuacgcucugguuaauguaauguacucuccuggacugaaugcaguguauaauuucugucu

SEQ ID NO: 371101 - RNA, 62 nt, Homo Sapiens
gcaggaaggguaaggaaguggcuaggucuccuuggacugagcauggacaugaguccugugag

SEQ ID NO: 371102 - RNA, 62 nt, Homo Sapiens
acccauucuuaaagcucuaaaaaaccaucucauggacugaaagguagauagacagauggacc

SEQ ID NO: 371103 - RNA, 62 nt, Homo Sapiens
cuuuucagaauugaaggagaaaaugcauuauguggacugaaccgacuuuucuaaagcucuga

SEQ ID NO: 371104 - RNA, 62 nt, Homo Sapiens
uggcaaguugccauuuuguaaacuaaggauuuuggacugagauuucuuaaaucuuucuucaa

SEQ ID NO: 371105 - RNA, 62 nt, Homo Sapiens
ugaaccccuucuuuaggguccagaaggaauuguggacugaaucacuagccuuaggucuuuca

SEQ ID NO: 371106 - RNA, 62 nt, Homo Sapiens
gugggaucgcagcuccgaaguguuuaagcccuuggacugagguuccaguuccgaaaagcaga

SEQ ID NO: 371107 - RNA, 62 nt, Homo Sapiens
cugcgcacaugagcugaaaauauuguacuaaauggacugaugaucauuacuguguaucugug

SEQ ID NO: 371108 - RNA, 62 nt, Homo Sapiens
ccccagggauucccaccccaccccaccuccuguggacugaugccccugaagccaucgcuggc

SEQ ID NO: 371109 - RNA, 62 nt, Homo Sapiens
ugcuccaucaugaagacuugagauguguaaaauggacugaaagugcuguuacuuggccacua

SEQ ID NO: 371110 - RNA, 62 nt, Homo Sapiens
aucucuuuaaauggcuuuauacugguucauauuggacugauaagggauaguccaaagacuua

SEQ ID NO: 371111 - RNA, 62 nt, Homo Sapiens
ggguuauugaaaggacuagcggguuaucuguauggacugacuguggcuugaauauaucccau

SEQ ID NO: 371112 - RNA, 62 nt, Homo Sapiens
uguguauauuuucuugaucucaccaugguggauggacugaaguuuggccuccucaaagcauc

SEQ ID NO: 371113 - RNA, 62 nt, Homo Sapiens
ccauuuccuacagagaagcgaccccuggauccuggacugaagcccauggucgagguuccccu

SEQ ID NO: 371114 - RNA, 62 nt, Homo Sapiens
ugaagaucaauccucacaauauuucugcuggcuggacugaacaacagaaaauugcacaguca

SEQ ID NO: 371115 - RNA, 62 nt, Homo Sapiens
gcuaagagggcggcugcuggaggagauggggauggacugacauuggagcauggaggagcugg

SEQ ID NO: 371116 - RNA, 62 nt, Homo Sapiens
uuuagcguagcuaagugaaaccucuuuuaucuuggacugacauucaguuuuaucuuuaaucu

SEQ ID NO: 371117 - RNA, 62 nt, Homo Sapiens
agauuuucauucagaaucaaaauuaagaaaguuggacugaaaauaugaaaaaugcuuaacua

SEQ ID NO: 371118 - RNA, 62 nt, Homo Sapiens
acuaaguuaucuuuauccaacauuucuccaaauggacugaaagaaacuuuucaaggacagug

SEQ ID NO: 371119 - RNA, 62 nt, Homo Sapiens
auggaugguuccaugagcccccaacccagcccuggacugaggggccauugcuuucaccgauu

SEQ ID NO: 371120 - RNA, 62 nt, Homo Sapiens
auuggccuugaaucaggucauuccugaaaagcuggacugagauccucaccacauagugcuuu

SEQ ID NO: 371121 - RNA, 62 nt, Homo Sapiens
cuuguaucuugaaguuuuguacuugggauuucuggacugauaaaugaaucaucacauucuuc

SEQ ID NO: 371122 - RNA, 62 nt, Homo Sapiens
cugagaauuuuaaucaguuugggcauauaguuuggacugaaucacaucuguaguacuuagcc

SEQ ID NO: 371123 - RNA, 62 nt, Homo Sapiens
augugugaacuuuuaagauggauaauagggcauggacugagugcugcuaucuugaaaugugc

SEQ ID NO: 371124 - RNA, 62 nt, Homo Sapiens
cccuguggagaaauucguuguucccacugaaauggacugacuguaacgauugacaccaaaau

SEQ ID NO: 371125 - RNA, 62 nt, Homo Sapiens
uagugcaugcaucucuuuagauccaaaauaaauggacugaaguuaucauccuauugucuuuu

SEQ ID NO: 371126 - RNA, 62 nt, Homo Sapiens
uggacccaauuuuuccccagugaaagccaaguuggacugaauuucuggaguucucaucagug

SEQ ID NO: 371127 - RNA, 62 nt, Homo Sapiens
uaagcugaacagugaugaucuguagacauuuauggacugaauguaaugguugauauauguac

SEQ ID NO: 371128 - RNA, 62 nt, Homo Sapiens
gccacccgcccacagccaggucaagaccauccuggacugaugcccggcacugcccucagacu

SEQ ID NO: 371129 - RNA, 62 nt, Homo Sapiens
ggauugggucacuuuugaaucuuuuaccuuuauggacugaugugagccgaguuccucacauu

SEQ ID NO: 371130 - RNA, 62 nt, Homo Sapiens
uaaguuacaagccuuucuuauuugugucuccuuggacugaguaggaccccccagcaagucgu

SEQ ID NO: 371131 - RNA, 62 nt, Homo Sapiens
cccaaauaccacagacucacuuuuaaguaaaauggacugauaguguaaaaacauguuuguaa

SEQ ID NO: 371132 - RNA, 62 nt, Homo Sapiens
cuggagaaaauucuauggaaaagcucucauuauggacugaaaguuugaggagcaaggucuuc

SEQ ID NO: 371133 - RNA, 62 nt, Homo Sapiens
uuaaaagucauauuuauucuuauugguaaagauggacugauaaaagaauuauuuuucagaua

SEQ ID NO: 371134 - RNA, 62 nt, Homo Sapiens
agcaaauuuauucuuucgaauugaaaauacaguggacugaaaaagcuuggugauaaucaauu

SEQ ID NO: 371135 - RNA, 62 nt, Homo Sapiens
acauugaugugauucuugaaauauuggacugauggacugaaagaaauagaguugcuccauuc

SEQ ID NO: 371136 - RNA, 62 nt, Homo Sapiens
gacugaaaacauugaugugacuccauucauauuggacugaugaagaaaaagaaauagaguug

SEQ ID NO: 371137 - RNA, 62 nt, Homo Sapiens
guaauaaaucugucuauauccccuguguauguuggacugacucgcgccccuguuuacagcgu

SEQ ID NO: 371138 - RNA, 62 nt, Homo Sapiens
ccaggccuguugcccaccaagguugggcuggcuggacugagccucugaggauagcaaucaga

SEQ ID NO: 371139 - RNA, 62 nt, Homo Sapiens
ugagaucaugccuaugaaguuugugagauuguuggacugauuacaagaugauagaauuaauu

SEQ ID NO: 371140 - RNA, 62 nt, Homo Sapiens
uuaugccuaugaaguccccaucuucauggaaauggacugacucuucuuuccuaauccccuua

SEQ ID NO: 371141 - RNA, 62 nt, Homo Sapiens
gcuacuuccugucucuguuuaggggcccagccuggacugacugagcagagugucgaggaugg

SEQ ID NO: 371142 - RNA, 62 nt, Homo Sapiens
aaguuuagaguuggcccccaccucccaugccauggacugagcagcaggggcccagcaucccu

SEQ ID NO: 371143 - RNA, 62 nt, Homo Sapiens
caggaggcccuggguucucaggccuuuggcuuuggacugagaguuacacaaucagcuucccu

SEQ ID NO: 371144 - RNA, 62 nt, Homo Sapiens
ccugaaugcugcaucauuguguucagugcagcuggacugauugcaccuguguauuugccccu

SEQ ID NO: 371145 - RNA, 62 nt, Homo Sapiens
gcucagaaguauuguugcucaugguguggcaauggacugaacuguaaugaaaauguuauuua

SEQ ID NO: 371146 - RNA, 62 nt, Homo Sapiens
ggccuggguuccagggaaggcuaagcauggccuggacugacugcagcccccuauagucaugg

SEQ ID NO: 371147 - RNA, 62 nt, Homo Sapiens
gaaauagguuuuagguggcauaguggcuuaacuggacugaauucaaauauucuuucaacuuc

SEQ ID NO: 371148 - RNA, 62 nt, Homo Sapiens
aaucagagucuguggcgauaccuacuuguguguggacugagcugucaccauagaaggcaacu

SEQ ID NO: 371149 - RNA, 62 nt, Homo Sapiens
uggggguaucuccccucugcuaucuuugcuuuuggacugaccagcgccaucuucccucccag

SEQ ID NO: 371150 - RNA, 62 nt, Homo Sapiens
gagaugccccuucuacuacuggcccaaauccauggacugaagccuggcugcuucaugccaga

SEQ ID NO: 371151 - RNA, 62 nt, Homo Sapiens
acagaggggcccacacuuccuccgguugggguuggacugagggagcagaggcccugggagug

SEQ ID NO: 371152 - RNA, 62 nt, Homo Sapiens
uuggguucucugcuguccuaaauagguuacuuuggacugaguucugaccgaugguguuuggg

SEQ ID NO: 371153 - RNA, 62 nt, Homo Sapiens
cuacaguuuuuagcuggugccgagagccgaaguggacugaagcacugacaagaggguuuccc

SEQ ID NO: 371154 - RNA, 62 nt, Homo Sapiens
ggagugugcccaggcagcugucgccuggcaacuggacugaggcugccauccacuguauaauu

SEQ ID NO: 371155 - RNA, 62 nt, Homo Sapiens
acuguccucgggaaugaaccucccgcgggcuuuggacugaggucccuguggccucggucucc

SEQ ID NO: 371156 - RNA, 62 nt, Homo Sapiens
ccacucccucaggguccagccaugccccacccuggacugaaguucugcaaaguccuccgagg

SEQ ID NO: 371157 - RNA, 62 nt, Homo Sapiens
uacauaaucacaagaaaggaaagaauuacaguuggacugauugugacagugccuugucgucc

SEQ ID NO: 371158 - RNA, 62 nt, Homo Sapiens
ggcauggagucauuagucucacaaacacacuuuggacugaagaggaucauuucuuuuuguuc

SEQ ID NO: 371159 - RNA, 62 nt, Homo Sapiens
uccacucuguuccucucugcuuuguucuucccuggacugagcucagcgcaggcugugacccc

SEQ ID NO: 371160 - RNA, 62 nt, Homo Sapiens
uccaacuuuuucaaagugugggugguccaguuuggacugaugggaaucuucuugucauucuu

SEQ ID NO: 371161 - RNA, 62 nt, Homo Sapiens
gcacgaucauaguuaccgcagcaucaaauuccuggacugaagcgguccuuuugccucagccu

SEQ ID NO: 371162 - RNA, 62 nt, Homo Sapiens
ggccgcagagacugggucgcucccaacuuuuguggacugagccccccaucaccuacuccagc

SEQ ID NO: 371163 - RNA, 62 nt, Homo Sapiens
acacaucugagcugaacggcgugucucccucuuggacugagcgacugauuaucaauaauaau

SEQ ID NO: 371164 - RNA, 58 nt, Homo Sapiens
acuccggaagaaugacucucuggauggauggacugauaucaaagcucuucuccaguga

SEQ ID NO: 371165 - RNA, 62 nt, Homo Sapiens
gugucugagguucuuucccaaauggaagcgguuggacugaugacccuuuuccuuagcuguaa

SEQ ID NO: 371166 - RNA, 62 nt, Homo Sapiens
agccuuucccucggaccccccucgaagcccccuggacugauucccacccacgacucacaggc

SEQ ID NO: 371167 - RNA, 62 nt, Homo Sapiens
uauauugaaauuuauuuaaugugaguuuggucuggacugacagcaugugcccuccugaggga

SEQ ID NO: 371168 - RNA, 62 nt, Homo Sapiens
cucaggagggcccgguaaaggcugagaugaaguggacugaguagaacuggaggacaggaguc

SEQ ID NO: 371169 - RNA, 62 nt, Homo Sapiens
cugugguuugguuggggcuucacagccacaccuggacugacccugcagguuguucauaguca

SEQ ID NO: 371170 - RNA, 62 nt, Homo Sapiens
acuggcuuccuugguucaaccaccuucuuaccuggacugagccucacuuacagcuucucuag

SEQ ID NO: 371171 - RNA, 62 nt, Homo Sapiens
ggucagagaugagaaagccucgacaaaagaauuggacugauggaaaagacuuccauaaagga

SEQ ID NO: 371172 - RNA, 62 nt, Homo Sapiens
auggaaagacuuuuauuauaccagagccaaaguggacugaacaagcaugacucauccagguu

SEQ ID NO: 371173 - RNA, 62 nt, Homo Sapiens
uguguacacuguguuaaacaaacacuaacuguuggacugacuuucauauauuauuaguaauu

SEQ ID NO: 371174 - RNA, 62 nt, Homo Sapiens
gcuuugucaccugcaggguauuagcacagauguggacugagucaguucacacaauucccugg

SEQ ID NO: 371175 - RNA, 62 nt, Homo Sapiens
uucgcauugaacucuacaacgggacguugaccuggacugaaguaugagagagcauaagccaa

SEQ ID NO: 371176 - RNA, 62 nt, Homo Sapiens
aagggagaacaugguagggaaggaagggcuuauggacugagacgagaaccauuuauacauag

SEQ ID NO: 371177 - RNA, 62 nt, Homo Sapiens
agcuaggugcuucccccuuccccugagacugguggacugaacuccagucaaguugaguucaa

SEQ ID NO: 371178 - RNA, 62 nt, Homo Sapiens
acaaaaccccuuuaugaguucacgcucuuuccuggacugacauaccuauuccuuuccauuug

SEQ ID NO: 371179 - RNA, 62 nt, Homo Sapiens
caacacaacauuugugucacuguacaguuuuguggacugagcgaggaaaaacaacaaauaau

SEQ ID NO: 371180 - RNA, 62 nt, Homo Sapiens
uuggcaaaagguacuucaaacaagggagggccuggacugagggggaccaggucuucuugcug

SEQ ID NO: 371181 - RNA, 62 nt, Homo Sapiens
agaaagacucgugacugcccagcgccccaggcuggacugagccccucacgccgcccugcagc

SEQ ID NO: 371182 - RNA, 62 nt, Homo Sapiens
gucuguucucagaucccuugauguucaacaccuggacugaauauuuuccuauaaugauguug

SEQ ID NO: 371183 - RNA, 62 nt, Homo Sapiens
cccaggaagaaaagcccaaauggcaucucccauggacugauuuuucauguuccaggggcgcu

SEQ ID NO: 371184 - RNA, 62 nt, Homo Sapiens
uagauuuucccauuucuaauuacauguuacauuggacugaaucuucaucuauuauaucauaa

SEQ ID NO: 371185 - RNA, 62 nt, Homo Sapiens
ugguccacagggcaccugccaguaacccccacuggacugaccccagcuccucacucaccuuc

SEQ ID NO: 371186 - RNA, 62 nt, Homo Sapiens
auuuggccacaaccaaauugggccagggugauuggacugagauccucccacgccaggcccug

SEQ ID NO: 371187 - RNA, 62 nt, Homo Sapiens
gccaugacaugacacaguucccuggccggguuuggacugaacaguggauucagaacugcagc

SEQ ID NO: 371188 - RNA, 62 nt, Homo Sapiens
aacauguuacugaccagcaacuugucuuuuucuggacugaagccugcaggaguuaaaaaggg

SEQ ID NO: 371189 - RNA, 62 nt, Homo Sapiens
uugucaggaagggaaggggcucaacacagugauggacugauccagauggcucccggggauga

SEQ ID NO: 371190 - RNA, 62 nt, Homo Sapiens
cagcaaccugccccagaccuggagggucuuuguggacugaagguagacaccagccagcaugg

SEQ ID NO: 371191 - RNA, 61 nt, Homo Sapiens
auguucgcagauaccagugacaccagguggcuggacugauggagacgucuucagacaggag

SEQ ID NO: 371192 - RNA, 62 nt, Homo Sapiens
aaagcagggcagccgggaccugcggcugugccuggacugaagcugucccgcagguccccacc

SEQ ID NO: 371193 - RNA, 62 nt, Homo Sapiens
cuauucacagcuuccucaugguuuuacuucucuggacugaucuggacggugaaaauaaaaga

SEQ ID NO: 371194 - RNA, 62 nt, Homo Sapiens
ggguucucacagugggagccgaccaguaugcuuggacugaagagaacagugagcuuggaaag

SEQ ID NO: 371195 - RNA, 62 nt, Homo Sapiens
cucagccuacacgcucauaucuuucucggcccuggacugaggucaccaagcucuguuuuggc

SEQ ID NO: 371196 - RNA, 61 nt, Homo Sapiens
cuaucuacccgccuuagucuucucaaauuccuggacugaagcacccuguugcccaggcuag

SEQ ID NO: 371197 - RNA, 62 nt, Homo Sapiens
uauaucacacccagguaucauuauaaauugaguggacugauaaccuuuuaucccaaagugcu

SEQ ID NO: 371198 - RNA, 62 nt, Homo Sapiens
auaguugaacaccgggggcucugcugggcuccuggacugagacauaaacuccacugggagca

SEQ ID NO: 371199 - RNA, 62 nt, Homo Sapiens
auggaaugaggacaaggugauacucugagcuguggacugaacuggcagacacaaccuguaca

SEQ ID NO: 371200 - RNA, 62 nt, Homo Sapiens
uuuuuuaacaaaacaaaaugaagacaaaaauauggacugauguauccucgccuggacucagg

SEQ ID NO: 371201 - RNA, 62 nt, Homo Sapiens
agaccggccuuccuuuggaggaaaguguggccuggacugagggaggaaaugagcgaguuccc

SEQ ID NO: 371202 - RNA, 62 nt, Homo Sapiens
uguuuuuagccuaaguauaagaguccuacagauggacugaaaaaaaucagucugagaguauu

SEQ ID NO: 371203 - RNA, 62 nt, Homo Sapiens
cuuuaacccucaguaucaagcacaaaaauugauggacugauaaaagaacuaucuuagaacuc

SEQ ID NO: 371204 - RNA, 62 nt, Homo Sapiens
caagggccccaugaagcugggagcccggaagcuggacugaaccguggcgguggcccuucccg

SEQ ID NO: 371205 - RNA, 62 nt, Homo Sapiens
guugguuuugccuucuggugcccauaguccccuggacugagucccccaggccuuccuucacc

SEQ ID NO: 371206 - RNA, 62 nt, Homo Sapiens
caccaaagccaggcccugaggccugggaguccuggacugagaaaggggguuccugggcccac

SEQ ID NO: 371207 - RNA, 62 nt, Homo Sapiens
gcugguguuaaauaucagcuccuaauaagauguggacugaaaacacuaucacaacacuauga

SEQ ID NO: 371208 - RNA, 62 nt, Homo Sapiens
gcuuucuuaacguugaaauugcacauucacauuggacugagacuuugaaaauaacuuuuaca

SEQ ID NO: 371209 - RNA, 62 nt, Homo Sapiens
gcuauuuucuagcauuugccagucccugugccuggacugauuggaacacuuuguuuuucucc

SEQ ID NO: 371210 - RNA, 62 nt, Homo Sapiens
uggggcagaauccccaguggaaccggaagagcuggacugaugagaaacaucagaagaacaca

SEQ ID NO: 371211 - RNA, 62 nt, Homo Sapiens
ucuucccuuucauccgaagacccuccugcaguuggacugaauggaucuggaaccucucccac

SEQ ID NO: 371212 - RNA, 62 nt, Homo Sapiens
cuguggcacugcgugcgggacugaggccucccuggacugagccguggccacaugcuggaagc

SEQ ID NO: 371213 - RNA, 62 nt, Homo Sapiens
uucaucacaccucagauaaaguacuuucaguuuggacugauagguggaaauuggcagcuggg

SEQ ID NO: 371214 - RNA, 62 nt, Homo Sapiens
uuugugcuuuuuauugaagagcccccugcucuuggacugaauuuaauuugugcauuucauaa

SEQ ID NO: 371215 - RNA, 62 nt, Homo Sapiens
ccuuuauucccucucacaccguccucugccuguggacugagcaauggucaguaccagcccuu

SEQ ID NO: 371216 - RNA, 62 nt, Homo Sapiens
gugcuguuuccugugcuuuugcuguuuccuauuggacugauagcucccagagaaugaauagu

SEQ ID NO: 371217 - RNA, 62 nt, Homo Sapiens
ccagagcccccuguggcccaggacacaccucauggacugaggggauccucggcauagcggac

SEQ ID NO: 371218 - RNA, 62 nt, Homo Sapiens
gcaguuauuuuuauuauuauagucaccaggccuggacugaagaguuggcucuggauaggguc

SEQ ID NO: 371219 - RNA, 62 nt, Homo Sapiens
uucuuaccagcaguuaccuagagaaaagcaacuggacugacuguucguagaccccaggagua

SEQ ID NO: 371220 - RNA, 62 nt, Homo Sapiens
aauuauacuuacuucuggcauccuaacauccuuggacugagaagcaugcucuguaaguugcu

SEQ ID NO: 371221 - RNA, 62 nt, Homo Sapiens
acccaacagcagugcacuauugguuuuauccauggacugaacgguugccuuuaucauccugc

SEQ ID NO: 371222 - RNA, 62 nt, Homo Sapiens
cuccguuggcuucugaacuguuaaucccugucuggacugagcuagauaccagcacaagucgg

SEQ ID NO: 371223 - RNA, 62 nt, Homo Sapiens
cguggcggcugcucccucagaccucccuucuguggacugaccucucaccuccgccuguuguu

SEQ ID NO: 371224 - RNA, 62 nt, Homo Sapiens
uucagagacccuuugggguuccacacuucacguggacugagguagacccugcaugaagauga

SEQ ID NO: 371225 - RNA, 62 nt, Homo Sapiens
gugaugcaaagcugcuuugcucuguaucuggcuggacugaucugucucacaagaagccauga

SEQ ID NO: 371226 - RNA, 62 nt, Homo Sapiens
uuguuguauaauuuucuuuggucagaaacacuuggacugaauagugacacucgguaaggauu

SEQ ID NO: 371227 - RNA, 62 nt, Homo Sapiens
ggguuaacucaguaguuagaucaaagcaaauguggacugaaucugcuuguugaucaguguug

SEQ ID NO: 371228 - RNA, 62 nt, Homo Sapiens
gaagacaaggaaagcucugcuguggcugccucuggacugacacccucccuaaugaguccuga

SEQ ID NO: 371229 - RNA, 62 nt, Homo Sapiens
uuaauggaaaccaagccaauguuauagacguuuggacugauuuguggaaaggaggggggaag

SEQ ID NO: 371230 - RNA, 62 nt, Homo Sapiens
aaucguguccuuuucucuaauuagguuuucuguggacugaaagagacugggacugcucuggg

SEQ ID NO: 371231 - RNA, 62 nt, Homo Sapiens
uucuugcagacaccccaccuugagcccagcacuggacugaagcaucuccugcagaagccagg

SEQ ID NO: 371232 - RNA, 62 nt, Homo Sapiens
uuucuuuaauagugaaccccugcccagaaaccuggacugaucaucuuccuguuuaggccaug

SEQ ID NO: 371233 - RNA, 62 nt, Homo Sapiens
aacuugagauuuaaaaacugacggguggaguuuggacugaucauuuucagcuaaaaaaaaaa

SEQ ID NO: 371234 - RNA, 62 nt, Homo Sapiens
caagggucugcggugcagcaucccugucugguuggacugaguuaccacuugaaggugaacau

SEQ ID NO: 371235 - RNA, 62 nt, Homo Sapiens
cggccacucucuggccgaaggacaucauccuauggacugagccuuuuccuccagccuaaacu

SEQ ID NO: 371236 - RNA, 62 nt, Homo Sapiens
ggaacccaaagaguacuccuuuguuaggcuuauggacugagcagucuggaccuugcauggcu

SEQ ID NO: 371237 - RNA, 62 nt, Homo Sapiens
aaucaguuacaucuuaaguguaugcucacagguggacugagagacauauauuuguguguuua

SEQ ID NO: 371238 - RNA, 62 nt, Homo Sapiens
aaagacugcagaacccccagaagauagaaagcuggacugaccugcggaagccaaaggcagcu

SEQ ID NO: 371239 - RNA, 62 nt, Homo Sapiens
acaccaaccaggccuucaucagaagcauugccuggacugaccgggcuucauuccggacuggc

SEQ ID NO: 371240 - RNA, 62 nt, Homo Sapiens
accuauaauuauaacuauauuuucuuccucuuuggacugaauucuuauaguaacacuaaaac

SEQ ID NO: 371241 - RNA, 62 nt, Homo Sapiens
uuuuuuuaaaaagcaauaccugguuuccaccuuggacugacuuugauccuguuccacuuuug

SEQ ID NO: 371242 - RNA, 62 nt, Homo Sapiens
aaacauuguaauacuacaagcuccauaaauacuggacugaaauguugcugcagccgagugac

SEQ ID NO: 371243 - RNA, 62 nt, Homo Sapiens
guugugugugugugugugugggacauuggucuuggacugagcagacagaaacuaaaugugaa

SEQ ID NO: 371244 - RNA, 62 nt, Homo Sapiens
gccauaugucacuaauagaaagccccugaagcuggacugauguggggaaaacaccuuuuccu

SEQ ID NO: 371245 - RNA, 62 nt, Homo Sapiens
auccaacuaggacacauaucuuuugaguuauuuggacugaaagcuuaagaaaacuuggaaaa

SEQ ID NO: 371246 - RNA, 62 nt, Homo Sapiens
aucagaauauguugcuuugaaaaagccucuaauggacugaccuuaaaacucauccuucuucc

SEQ ID NO: 371247 - RNA, 62 nt, Homo Sapiens
ggcacauccagucuccaucgugcugcagcagcuggacugagggcagagccuguaggugcaga

SEQ ID NO: 371248 - RNA, 62 nt, Homo Sapiens
cccuccugugucaaguagcuaacugcagcagcuggacugagggcagagucugugggugcaga

SEQ ID NO: 371249 - RNA, 62 nt, Homo Sapiens
auuucuuccucugaggacaccaaagcccgcaguggacugaugccuucgaugggcaggaugaa

SEQ ID NO: 371250 - RNA, 62 nt, Homo Sapiens
ugaaccagucauuggcaagaggaacgguguuauggacugaauguucauguuccuccagaauu

SEQ ID NO: 371251 - RNA, 62 nt, Homo Sapiens
aucuccuaggaggcauggagggauccagaaccuggacugaagaaccaccuagaaauaacuca

SEQ ID NO: 371252 - RNA, 62 nt, Homo Sapiens
uuugagggaggaggaggcuguugguauuugcuuggacugacacacaaaaucgaugcguugcu

SEQ ID NO: 371253 - RNA, 62 nt, Homo Sapiens
cuggaauuacuccuguagguuaauaauuaugguggacugaugugguuaggccaaauguugug

SEQ ID NO: 371254 - RNA, 62 nt, Homo Sapiens
acuggugacuggucugugaugugcugauuuuauggacugaggccuggaaccuuccucuggaa

SEQ ID NO: 371255 - RNA, 62 nt, Homo Sapiens
cugauucagaaaauaauuguauuuaauaucaauggacugaguuuacaaucauuucauuuugu

SEQ ID NO: 371256 - RNA, 62 nt, Homo Sapiens
cagcaggagcccuguucacccguucuucccuguggacugaccucuuccacccacgccguggc

SEQ ID NO: 371257 - RNA, 62 nt, Homo Sapiens
cacgaguuuaugugcacaaguguuuuggguuguggacugaagcucagccuguuaaucagacc

SEQ ID NO: 371258 - RNA, 62 nt, Homo Sapiens
agaaagagauagaauacaggugguaccuguuguggacugaauugcgucaaauucauauguug

SEQ ID NO: 371259 - RNA, 62 nt, Homo Sapiens
ggcagggcagggcuggcaccucucaacgucuguggacugaaugaauaaacccuccucaucca

SEQ ID NO: 371260 - RNA, 62 nt, Homo Sapiens
gggagccggggugugaggggacuggaccagcuuggacugagaccugagaccgggccgguggg

SEQ ID NO: 371261 - RNA, 62 nt, Homo Sapiens
caaauaguucaucaaaaugaaucuuugcucuuuggacugaauucuuaccauacugccauuaa

SEQ ID NO: 371262 - RNA, 62 nt, Homo Sapiens
gggugaaaaacugacacagucaauucagaaaauggacugaagucugaauaaggucauugcau

SEQ ID NO: 371263 - RNA, 62 nt, Homo Sapiens
ucuaggugggguucccaaagacgccuucacgcuggacugagcugcucucccacaggguuucu

SEQ ID NO: 371264 - RNA, 62 nt, Homo Sapiens
cuucacuagaauaugccaacugccaaucauguuggacugagcuaauuuguuccucuuucuga

SEQ ID NO: 371265 - RNA, 62 nt, Homo Sapiens
auggagagcuauguaacagagaauuucagaaauggacugaaaggcuaaaggcuaugcgauau

SEQ ID NO: 371266 - RNA, 62 nt, Homo Sapiens
caaagggcuggccacaccaccaaggaugaggcuggacugaggagcugcccccuccuugcccc

SEQ ID NO: 371267 - RNA, 62 nt, Homo Sapiens
ugacugccagauggugggacuaugacugugguuggacugaccaauuccuggaagggcccuga

SEQ ID NO: 371268 - RNA, 62 nt, Homo Sapiens
ccuccacugcugugugcccccuggagaccccauggacugaugggaaagugggacccuccagc

SEQ ID NO: 371269 - RNA, 62 nt, Homo Sapiens
guguugggcaagaccucuucccagcaggcagguggacugacuggucuggaggccgaggacca

SEQ ID NO: 371270 - RNA, 62 nt, Homo Sapiens
aggcuaaaaaaaagucuugcaaaauggggcaguggacugacaggcugacauagaaaauaaac

SEQ ID NO: 371271 - RNA, 62 nt, Homo Sapiens
ggggagggcaagcuggauuuacaggucacggcuggacugaaugggccuuuuuaucuucccac

SEQ ID NO: 371272 - RNA, 62 nt, Homo Sapiens
cuggacgggccagaacugcgcugcacacuuccuggacugaggcggggacuuugggucccacc

SEQ ID NO: 371273 - RNA, 62 nt, Homo Sapiens
ugggccucuuauuucguuucuggggacugcauuggacugagggcuggguaggcaggugucuu

SEQ ID NO: 371274 - RNA, 62 nt, Homo Sapiens
gguuccagggugggccggugccagcuccgggguggacugaacagcggcggcugucccugugc

SEQ ID NO: 371275 - RNA, 62 nt, Homo Sapiens
cuccuaggacccgucuccagcugcugagauccuggacugagggggccuggaugcccccugug

SEQ ID NO: 371276 - RNA, 62 nt, Homo Sapiens
ccgacggagcugcuucugcucccuggggcauauggacugacccaccuccugcugagaaccuu

SEQ ID NO: 371277 - RNA, 61 nt, Homo Sapiens
uucaaaaucugaagccaugagccuucauacauggacugagagucagagcuugaagaaaagc

SEQ ID NO: 371278 - RNA, 62 nt, Homo Sapiens
caggggcacuucaggcuccacaggcgucauguuggacugagaccuaacucacuggacucaga

SEQ ID NO: 371279 - RNA, 62 nt, Homo Sapiens
agcagucagggugggaagaaagaaugcaagaguggacugaaugugccuaauggagaagaccc

SEQ ID NO: 371280 - RNA, 62 nt, Homo Sapiens
guacauggcugugaugggggagguggugcugcuggacugagccaguggagggggaagaucug

SEQ ID NO: 371281 - RNA, 62 nt, Homo Sapiens
uaccaguaggacugaaucagggccuucaaagcuggacugaguugguccuguucuggcacaua

SEQ ID NO: 371282 - RNA, 62 nt, Homo Sapiens
ugggaggcagaaguccccgcacccaucaugcguggacugauaggacaucuuuucguggugug

SEQ ID NO: 371283 - RNA, 62 nt, Homo Sapiens
gggaauguugcugaggagguucagugugugaauggacugaaccaguuggccacucucucaga

SEQ ID NO: 371284 - RNA, 62 nt, Homo Sapiens
uuccaacccugaacaagaccuuacaugagagauggacugauggacugcggcaauccugggcu

SEQ ID NO: 371285 - RNA, 62 nt, Homo Sapiens
caugugaccggaggccccuuguucuugucuccuggacugaacucguauggacuucuggaaaa

SEQ ID NO: 371286 - RNA, 62 nt, Homo Sapiens
ggaaucaagcucugagcagauuaucuggaaaguggacugaacacuguguuucgcauucggcg

SEQ ID NO: 371287 - RNA, 62 nt, Homo Sapiens
ugcccaagcccuuggcucccgggcccuuggucuggacugaauucgcccugccuccaucaccu

SEQ ID NO: 371288 - RNA, 62 nt, Homo Sapiens
acccuccuccccaauuugggccugcuggggguuggacugaaacugaaaucucuggccucacc

SEQ ID NO: 371289 - RNA, 62 nt, Homo Sapiens
gugggcuccuaacugccuccaguggacggccuuggacugaacgucagagucacacggggcuc

SEQ ID NO: 371290 - RNA, 62 nt, Homo Sapiens
cuauuuucuucuccaaacuggucgguggcuucuggacugaagcuccuccuguugaccaguga

SEQ ID NO: 371291 - RNA, 62 nt, Homo Sapiens
ugcaauuuguugaaagggaauucuguacacaguggacugaagaacgaugggaaauguauuac

SEQ ID NO: 371292 - RNA, 62 nt, Homo Sapiens
agggcacacagggccggggaggaggauuaggcuggacugaucgcgggucgcaggugaccccg

SEQ ID NO: 371293 - RNA, 62 nt, Homo Sapiens
cugcugccugcuuuauuauuucuuuaaugaguuggacugaacagugguuaauccugacucug

SEQ ID NO: 371294 - RNA, 62 nt, Homo Sapiens
cacauagauucuccuccgucucauugugcacauggacugaauccagggugauaugcugauuu

SEQ ID NO: 371295 - RNA, 62 nt, Homo Sapiens
acuaaugcaaggacuaugguaauuguucauaguggacugaaacauguuuacaugcagcagau

SEQ ID NO: 371296 - RNA, 62 nt, Homo Sapiens
auacuuaacauucuuuuucuugcaaagcacguuggacugagaacuugucauuuuguugauga

SEQ ID NO: 371297 - RNA, 62 nt, Homo Sapiens
gcugaaguaccuggcaaaaacuacugacucauuggacugaaaugaaauauuaguggaauuug

SEQ ID NO: 371298 - RNA, 62 nt, Homo Sapiens
gcgaggcuuuuggagcggcugugggugucgucuggacugagguuuuuaaauauuucuuucuc

SEQ ID NO: 371299 - RNA, 62 nt, Homo Sapiens
ugcuaugccugugacccccgcggcccacacacuggacugaccugcccugagcggggaugcag

SEQ ID NO: 371300 - RNA, 62 nt, Homo Sapiens
ggacgagcuguagagaggccugccuccagggcuggacugaggccugagcgcuccugccgcag

SEQ ID NO: 371301 - RNA, 62 nt, Homo Sapiens
ccaucucagcucccuugcauccaggugcagcauggacugaguucuugacaacagaauguggu

SEQ ID NO: 371302 - RNA, 62 nt, Homo Sapiens
ccuggccgagcuguaccuggcacggcccauccuggacugagaaacuggaaccucagaggaac

SEQ ID NO: 371303 - RNA, 62 nt, Homo Sapiens
aguucaagaagccaacgcugagucaggcugaguggacugaggccugccccgcccagacugcc

SEQ ID NO: 371304 - RNA, 62 nt, Homo Sapiens
gucccuaaccuauaaucucagcuucccuacccuggacugaagggucugcccauccccccacc

SEQ ID NO: 371305 - RNA, 62 nt, Homo Sapiens
caguuacacugcaggguuucgcccaauaaagguggacugacauucccucuuccaggcccuug

SEQ ID NO: 371306 - RNA, 62 nt, Homo Sapiens
cagggccggggccuggaccaaaccacaugaacuggacugagagggggaagaagcggggagga

SEQ ID NO: 371307 - RNA, 62 nt, Homo Sapiens
ggcuguuucacccguggacuugaacuugccauuggacugagcucuuucucagaagcugcuac

SEQ ID NO: 371308 - RNA, 62 nt, Homo Sapiens
ccgggggauguggccggcacugggcagccccuuggacugaggcaguuuugguggauggggga

SEQ ID NO: 371309 - RNA, 62 nt, Homo Sapiens
uuaacccgcugcacaacaccuucuugcuuuacuggacugauuugaagcucucucuaaauauu

SEQ ID NO: 371310 - RNA, 62 nt, Homo Sapiens
aaugacccccaaaauucguauauuaaguacuuuggacugaacguggaaagagaaaagaauca

SEQ ID NO: 371311 - RNA, 62 nt, Homo Sapiens
gcaugagaugcccuuugaguccgaggaggcgguggacugaaggcgagggcacgggcuguggc

SEQ ID NO: 371312 - RNA, 62 nt, Homo Sapiens
uuccaguccccaccguccugaaacccagacccuggacugauuggccuguccucuuaggacuc

SEQ ID NO: 371313 - RNA, 62 nt, Homo Sapiens
cccuuaacuuguggagucugugggggaagucuuggacugagccuugugaguggcaucugaug

SEQ ID NO: 371314 - RNA, 62 nt, Homo Sapiens
uaugugcacacacccccaucugcccaguagaauggacugaucagacuggccugaaauccccu

SEQ ID NO: 371315 - RNA, 62 nt, Homo Sapiens
aaaaguggccaaaaaaugcaugucuguaauuuuggacugacguuuuaagaauuuguuaccuu

SEQ ID NO: 371316 - RNA, 62 nt, Homo Sapiens
ugggaaaacaaugaaguguuuuaaguccuggguggacugagagaugguuugccuguccagac

SEQ ID NO: 371317 - RNA, 62 nt, Homo Sapiens
guucggggcagccugcucggaugcuuccacccuggacugagugguuggggggugccggggcg

SEQ ID NO: 371318 - RNA, 62 nt, Homo Sapiens
guuuuaaagguagaguuaacagaauauacugguggacugaauguagguugagagaggaagcg

SEQ ID NO: 371319 - RNA, 62 nt, Homo Sapiens
cucaccucagcaaaaguuaagacagcuguaaauggacugaucuacaaaaagguaaaaauucc

SEQ ID NO: 371320 - RNA, 62 nt, Homo Sapiens
cugguagauguaacauucuaccagauuauggauggacugaucugaaaaucgaccucaacuca

SEQ ID NO: 371321 - RNA, 62 nt, Homo Sapiens
aauauaguaauuucauuuuuaccuuucuucaguggacugaauuguauggaaggaaauugauc

SEQ ID NO: 371322 - RNA, 62 nt, Homo Sapiens
gccgggaccacccugagccggccccaggcucguggacugagugggaagcccauccugaccag

SEQ ID NO: 371323 - RNA, 62 nt, Homo Sapiens
cacacugucugcccccguucccggguagccacuggacugacgacuugagugcucaguaguca

SEQ ID NO: 371324 - RNA, 62 nt, Homo Sapiens
gguguaaaugagugaucaguguacauuguguguggacugaaguguagguauguagagaugcu

SEQ ID NO: 371325 - RNA, 62 nt, Homo Sapiens
uuguaaaagacaguguauguacauaucaucuguggacugaccuaaaaaugucacgaauaugg

SEQ ID NO: 371326 - RNA, 62 nt, Homo Sapiens
caggagacccugagggcagccgguuccuacuuuggacugagagaagggagccccaggcugga

SEQ ID NO: 371327 - RNA, 62 nt, Homo Sapiens
ggaagcaguuucagauaaaucaugggcauugcuggacugaugguugcuuugagcccacagga

SEQ ID NO: 371328 - RNA, 62 nt, Homo Sapiens
gccagagaagguggcaugggccugaacccaccuggacugacuucugcacugaagccacagau

SEQ ID NO: 371329 - RNA, 62 nt, Homo Sapiens
agcuguuucuaguuaccaccuaccccuggccguggacugaucagaccagcauucaaaauaaa

SEQ ID NO: 371330 - RNA, 62 nt, Homo Sapiens
ccgggacccagcugugcuacccaccccuuccauggacugaauaagauggacuaacaggccug

SEQ ID NO: 371331 - RNA, 58 nt, Homo Sapiens
gaggggcugcccagcaagacggggcugcuggacugaccugagcagcagcauggccuga

SEQ ID NO: 371332 - RNA, 62 nt, Homo Sapiens
ucccuuuagaggggaguuaugugugggauuccuggacugauuggggagacagcaggaucaca

SEQ ID NO: 371333 - RNA, 62 nt, Homo Sapiens
ggggaaacauaacuccaucuacaccuuggauuuggacugauucuccauuuuaucaccugaag

SEQ ID NO: 371334 - RNA, 62 nt, Homo Sapiens
guguggcgguaccugcugaacguguauccagauggacugacaggccgagagcggauggacua

SEQ ID NO: 371335 - RNA, 62 nt, Homo Sapiens
ucccgccgaccccccagacuaaccuccaggcauggacugaaucugguucuccucuuguacac

SEQ ID NO: 371336 - RNA, 62 nt, Homo Sapiens
gucagaaggacaaagcugguuuguuugggaaauggacugaucgaaagaaaacuugccaaagu

SEQ ID NO: 371337 - RNA, 62 nt, Homo Sapiens
agcugggggaaggacauuucauaaggguuaguuggacugagcaguauggacauuugcuuuuu

SEQ ID NO: 371338 - RNA, 62 nt, Homo Sapiens
uaaagcagacgaaacgaaguaagcuauauuucuggacugaacaaagcucugcuguuuagagc

SEQ ID NO: 371339 - RNA, 60 nt, Homo Sapiens
gaaaguguguguauuccuuucuuaauaaaguguggacugaacaucggugccuggagugag

SEQ ID NO: 371340 - RNA, 62 nt, Homo Sapiens
uucuuggcccgcacagagcuggggcugagggauggacugaugcuuuuagcucaaacguggcu

SEQ ID NO: 371341 - RNA, 62 nt, Homo Sapiens
uuuaaacuauucagucuuacguuggagaaaaauggacugaucaucuagaaguuagggguuuu

SEQ ID NO: 371342 - RNA, 62 nt, Homo Sapiens
auuagaagcaauugaaauacgucccauuguacuggacugaggacuugggaaaaagcaaaaag

SEQ ID NO: 371343 - RNA, 62 nt, Homo Sapiens
uaucuuugcaaguauccacaaauuugaaguuuuggacugaaaacaaacauauuugggugugu

SEQ ID NO: 371344 - RNA, 62 nt, Homo Sapiens
uuggagaccuagccccagaacuggccccucccuggacugacuaauccguccaguccaucuuc

SEQ ID NO: 371345 - RNA, 62 nt, Homo Sapiens
ggacugguugaaaguggccaggggagacacaguggacugaaaugggccugucccaagcgaga

SEQ ID NO: 371346 - RNA, 62 nt, Homo Sapiens
cccagauuuccuucccuugggccgaggccaaguggacugacccuucucccucucaggcagau

SEQ ID NO: 371347 - RNA, 62 nt, Homo Sapiens
ucgccagaugcaucauguccauuuugggaaaauggacugaaguuucuggagcccuugucuga

SEQ ID NO: 371348 - RNA, 63 nt, Homo Sapiens
accuccccacugcacccagggggcaacuccaccuggacugaugggcacaggaggcaccaauag

SEQ ID NO: 371349 - RNA, 63 nt, Homo Sapiens
gcaaugugaacugaagcugaugggcugagaacauggacugagcuuguggugugcuuugcagga

SEQ ID NO: 371350 - RNA, 63 nt, Homo Sapiens
cacuguggcuccucacuggggguuucacgggguuggacugagcccugucaccucugugauagu

SEQ ID NO: 371351 - RNA, 63 nt, Homo Sapiens
agugaauggccaagcuggucuaguagaugaggcuggacugaggagggguaggccugcauccac

SEQ ID NO: 371352 - RNA, 63 nt, Homo Sapiens
ccuccuucccugcaggccuggagccuguagggcuggacugagguucaggucuccccccagcug

SEQ ID NO: 371353 - RNA, 63 nt, Homo Sapiens
agagcagugagguuuguucuuuccagugaaugguggacugaguggugcgagguggagggcuaa

SEQ ID NO: 371354 - RNA, 63 nt, Homo Sapiens
auagauacuaauagauuaucuuuucugaugcacuggacugaauuuuuaccucaaugugcaaag

SEQ ID NO: 371355 - RNA, 63 nt, Homo Sapiens
ugggguugagcagaauguuguacuagcugugccuggacugaguauaacagcuuuaugauuaug

SEQ ID NO: 371356 - RNA, 63 nt, Homo Sapiens
ugcauaaauugaaggauccggauuccuuaaugauggacugaaugaugcuuacuuuccuucuuu

SEQ ID NO: 371357 - RNA, 63 nt, Homo Sapiens
auugugaucccagcuggccccuauguuguguucuggacugaggccuuugcugugaacugcagu

SEQ ID NO: 371358 - RNA, 63 nt, Homo Sapiens
cuuggcuugaauguacauagaugguaccuggcauggacugauguuuuuaggcacagaaguugg

SEQ ID NO: 371359 - RNA, 63 nt, Homo Sapiens
agcuuuggaccugaccggguguguguaaaaccauggacugagucacagcagacacucgauggu

SEQ ID NO: 371360 - RNA, 63 nt, Homo Sapiens
acucugaugaggaggaaccaccugaucuccccuuggacugauacccuuuucccauucauucac

SEQ ID NO: 371361 - RNA, 63 nt, Homo Sapiens
uccuaagaaguccccaggucaugcugcuguugcuggacugaggaccacacuuugagaaccugu

SEQ ID NO: 371362 - RNA, 63 nt, Homo Sapiens
cagccagccagcucauuucacuuuacacgcucauggacugaguuuauacucaccuuuuaugaa

SEQ ID NO: 371363 - RNA, 63 nt, Homo Sapiens
cuuccuccccaucucucgcacgcagucuagagauggacugagccuugcuucucacuggcagug

SEQ ID NO: 371364 - RNA, 63 nt, Homo Sapiens
aaaugcagacaacaccuuccuccugcagacaccuggacugagccaaggaggccuggggaggcc

SEQ ID NO: 371365 - RNA, 63 nt, Homo Sapiens
cacccuccacccccaacucaugaaaagauucuauggacugaaaaagccccaggcugaaaggac

SEQ ID NO: 371366 - RNA, 63 nt, Homo Sapiens
gagugcgugcugggugggguuguguuaaggcaauggacugaaugaaaacagccccaucaggcu

SEQ ID NO: 371367 - RNA, 63 nt, Homo Sapiens
acaggugugggcgccagugucgcggcucugaguuggacugaggugaggaagucccgcucuccc

SEQ ID NO: 371368 - RNA, 63 nt, Homo Sapiens
ggcaguccccucccaccugggccuaggcuaccauggacugaagcccagccugugcucccaggg

SEQ ID NO: 371369 - RNA, 63 nt, Homo Sapiens
auccagaaagcuucccugcagugaguccuggacuggacugaacgacagucccccagaaacuua

SEQ ID NO: 371370 - RNA, 63 nt, Homo Sapiens
gucccccaggcccagccaggaccugcagguggcuggacugaguccaacuggggcaugaacagg

SEQ ID NO: 371371 - RNA, 63 nt, Homo Sapiens
ccaucguggaaagggcugggcuggcuucuggaauggacugaguuugaagggggcgguguuggc

SEQ ID NO: 371372 - RNA, 63 nt, Homo Sapiens
ugggggaagaagggauaucuuccaugaacaucauggacugagcccaggccugaagucuucucc

SEQ ID NO: 371373 - RNA, 63 nt, Homo Sapiens
gauaggccaagggcuacucucugugugggagccuggacugacacuguguguaugacuguguga

SEQ ID NO: 371374 - RNA, 63 nt, Homo Sapiens
aagagggaggagggagccugaccaugcugucucuggacugagcaaucuaccucugucucuuua

SEQ ID NO: 371375 - RNA, 63 nt, Homo Sapiens
cccagugggaccaguguugcgaacagcggagccuggacugacauccagcagucguucccagca

SEQ ID NO: 371376 - RNA, 63 nt, Homo Sapiens
aucuuaguuuuaugauaaaaaucacaguuugcauggacugauuuuuguuuuguuucauaucau

SEQ ID NO: 371377 - RNA, 63 nt, Homo Sapiens
gggaucaugaaaguagacaguagggcuaugguguggacugaaucucuggcuuggccuaucucc

SEQ ID NO: 371378 - RNA, 63 nt, Homo Sapiens
ggucugcuccaggccacauuuguucauaaaacauggacugaugugcuacggacacauucaguc

SEQ ID NO: 371379 - RNA, 63 nt, Homo Sapiens
cucuucaugaugagauggaaggagaacgccgcguggacugaaggggaacccaggaaaauggga

SEQ ID NO: 371380 - RNA, 63 nt, Homo Sapiens
gcuuugucuaagaugacaagggucccuggccaguggacugaagcuugaauuggccauauacag

SEQ ID NO: 371381 - RNA, 63 nt, Homo Sapiens
gacucaugccagcccuacagcuucaguuuaucuuggacugacuggauagauguuauucaacuc

SEQ ID NO: 371382 - RNA, 63 nt, Homo Sapiens
aguauucaauccacuuuuggugaauuccauuuguggacugaaaugaugauuaaguggggucac

SEQ ID NO: 371383 - RNA, 63 nt, Homo Sapiens
cagucuuaccugagacuggaucccuugcauuucuggacugaacaaggauucaggagaagcauc

SEQ ID NO: 371384 - RNA, 63 nt, Homo Sapiens
ugcacucuugguucuuuggaagugaaagugaaauggacugauuuuagagacccuaucucagac

SEQ ID NO: 371385 - RNA, 63 nt, Homo Sapiens
gaaacuaugcuauuggaucugcuugcuggcauauggacugaaauggcucuucuugggucuuga

SEQ ID NO: 371386 - RNA, 63 nt, Homo Sapiens
uuauacucaccuuuuaugaacuuuacacccucauggacugagacagccagccagcucauuuca

SEQ ID NO: 371387 - RNA, 50 nt, Homo Sapiens; identical to SEQ ID NO: 371070

SEQ ID NO: 371388 - RNA, 63 nt, Homo Sapiens
accugcacuuugcagaggacgugcugcuguguguggacugaacccgugacaucagcagugcug

SEQ ID NO: 371389 - RNA, 63 nt, Homo Sapiens
gagaaaaaagcaaaauucuuacuauuuuaaaguuggacugaagugauaagaaggacagaaagg

SEQ ID NO: 371390 - RNA, 63 nt, Homo Sapiens
cuugugccacugggccuuucgggcugccugugcuggacugaggagguuggggaggguugggga

SEQ ID NO: 371391 - RNA, 63 nt, Homo Sapiens
uuucaauuugugcacaugccagaaagaguaagguggacugacuaccuaagcguucccacucgc

SEQ ID NO: 371392 - RNA, 63 nt, Homo Sapiens
accaucugaaaagaaagcuaaauaccaguaugguggacugaauucuggacguccugucacucc

SEQ ID NO: 371393 - RNA, 63 nt, Homo Sapiens
cuccaagcucacgaccuuggagccccguggagcuggacugaggaggaggcugcacagcgggag

SEQ ID NO: 371394 - RNA, 63 nt, Homo Sapiens
aggacuggcaaccagagccucagcauccaaagauggacugaagugggauggcugacaggcaca

SEQ ID NO: 371395 - RNA, 57 nt, Homo Sapiens; identical to SEQ ID NO: 371078

SEQ ID NO: 371396 - RNA, 63 nt, Homo Sapiens
agacugugguuuagagccuuugauuuccuggacuggacugacggcgagugaauucucuagacc

SEQ ID NO: 371397 - RNA, 63 nt, Homo Sapiens
gcagggcacuugauccauuccaaagucaaaaacuggacugaagcuaaauuuguacuuuucaua

SEQ ID NO: 371398 - RNA, 63 nt, Homo Sapiens
gugaauauagucaaagcguggcauugagauaauuggacugaagaccaguuugaugagaagcuu

SEQ ID NO: 371399 - RNA, 63 nt, Homo Sapiens
acacauggcugugcaggccaggaggcccacagauggacugagugcugggaaggggcggcugcg

SEQ ID NO: 371400 - RNA, 63 nt, Homo Sapiens
ccaggucacugccccuggucucucuaggaggaguggacugaauggaucguugcagagaagacu

SEQ ID NO: 371401 - RNA, 63 nt, Homo Sapiens
ugccuccccccagagggccacccgcugugcucguggacugaggcugcgcugcccgggaggccu

SEQ ID NO: 371402 - RNA, 63 nt, Homo Sapiens
uauuugguuaccauggaggcuaauagaaaguauuggacugagaugaagucaggguauugugca

SEQ ID NO: 371403 - RNA, 63 nt, Homo Sapiens
uuuugcuguguaacuuguucggauuucauuuuauggacugauagagcuaaccuaaauaaggaa

SEQ ID NO: 371404 - RNA, 63 nt, Homo Sapiens
cucucaaguucacccuuuagaguccugaaagaauggacugaaggaaguccucgcagaagugca

SEQ ID NO: 371405 - RNA, 63 nt, Homo Sapiens
cuaaugcuuccaaaaauguugucacagaaucuauggacugaaugacugacuguaguuaauuuu

SEQ ID NO: 371406 - RNA, 63 nt, Homo Sapiens
cguuugucuagacuacauguaguuagcaccucuuggacugaauuauagugcugcauugucuga

SEQ ID NO: 371407 - RNA, 63 nt, Homo Sapiens
uccggugccucugccuuaucggagccucacuccuggacugaagcauuauuuggguuuaaucuc

SEQ ID NO: 371408 - RNA, 63 nt, Homo Sapiens
uuccacuuggguuuuaucuuaauauucaaaagauggacugagcaaaaaaauccucauuuuguu

SEQ ID NO: 371409 - RNA, 63 nt, Homo Sapiens
guuugaacuuaacgucuauuagcuagugacgaauggacugauguaauuugcccgaagacauac

SEQ ID NO: 371410 - RNA, 63 nt, Homo Sapiens
guauccacucggaccaucugcccauacugagccuggacugaaaucuaguggauuccugcaggc

SEQ ID NO: 371411 - RNA, 63 nt, Homo Sapiens
uugaaauuuuauauccacucucuuugacucauuuggacugaauuugcucuguuagcacuuuuu

SEQ ID NO: 371412 - RNA, 63 nt, Homo Sapiens
cuauugcuaggcuuaaauacgagaaauacuaacuggacugaccugauauucaccauuugugag

SEQ ID NO: 371413 - RNA, 63 nt, Homo Sapiens
cugacagcuucuccugcuguuuccuuccucucuuggacugaguggguacggccagccacucag

SEQ ID NO: 371414 - RNA, 63 nt, Homo Sapiens
guccuuggagagccaucgaggagaaugugcaauuggacugaagcucccuggcugaagauacau

SEQ ID NO: 371415 - RNA, 63 nt, Homo Sapiens
gugaagucauauuuuguuaaugaaauaaaaacauggacugagugucaacuacaugagcuuugg

SEQ ID NO: 371416 - RNA, 63 nt, Homo Sapiens
caagaaaaaacauuuuuacugcugcuuaguuuuuggacugaaaagauauuaaaacucaagaag

SEQ ID NO: 371417 - RNA, 63 nt, Homo Sapiens
acucuacgcucugguuaauguaauguacucuccuggacugaaugcaguguauaauuucugucu

SEQ ID NO: 371418 - RNA, 63 nt, Homo Sapiens
agcaggaaggguaaggaaguggcuaggucuccuuggacugagcauggacaugaguccugugag

SEQ ID NO: 371419 - RNA, 63 nt, Homo Sapiens
uacccauucuuaaagcucuaaaaaaccaucucauggacugaaagguagauagacagauggacc

SEQ ID NO: 371420 - RNA, 63 nt, Homo Sapiens
acuuuucagaauugaaggagaaaaugcauuauguggacugaaccgacuuuucuaaagcucuga

SEQ ID NO: 371421 - RNA, 63 nt, Homo Sapiens
auggcaaguugccauuuuguaaacuaaggauuuuggacugagauuucuuaaaucuuucuucaa

SEQ ID NO: 371422 - RNA, 63 nt, Homo Sapiens
augaaccccuucuuuaggguccagaaggaauuguggacugaaucacuagccuuaggucuuuca

SEQ ID NO: 371423 - RNA, 63 nt, Homo Sapiens
gugggaucgcagcuccgaagauguuuaagcccuuggacugaggcuuccaguuccgaaaagcag

SEQ ID NO: 371424 - RNA, 63 nt, Homo Sapiens
cugcgcacaugagcugaaaaguauuguacuaaauggacugauguaucauuacuguguaucugu

SEQ ID NO: 371425 - RNA, 63 nt, Homo Sapiens
ccccagggauucccaccccacccccaccuccuguggacugaugaccccugaagccaucgcugg

SEQ ID NO: 371426 - RNA, 63 nt, Homo Sapiens
ugcuccaucaugaagacuugaagauguguaaaauggacugaaaagugcuguuacuuggccacu

SEQ ID NO: 371427 - RNA, 63 nt, Homo Sapiens
aucucuuuaaauggcuuuauaacugguucauauuggacugauaaagggauaguccaaagacuu

SEQ ID NO: 371428 - RNA, 63 nt, Homo Sapiens
ggguuauugaaaggacuagcuggguuaucuguauggacugacuaguggcuugaauauauccca

SEQ ID NO: 371429 - RNA, 63 nt, Homo Sapiens
uguguauauuuucuugaucuccaccaugguggauggacugaagcuuuggccuccucaaagcau

SEQ ID NO: 371430 - RNA, 63 nt, Homo Sapiens
ccauuuccuacagagaagcguaccccuggauccuggacugaagccccauggucgagguucccc

SEQ ID NO: 371431 - RNA, 63 nt, Homo Sapiens
ugaagaucaauccucacaauaauuucugcuggcuggacugaaccaacagaaaauugcacaguc

SEQ ID NO: 371432 - RNA, 63 nt, Homo Sapiens
gcuaagagggcggcugcugggaggagauggggauggacugacaguuggagcauggaggagcug

SEQ ID NO: 371433 - RNA, 63 nt, Homo Sapiens
uuuagcguagcuaagugaaauccucuuuuaucuuggacugacacuucaguuuuaucuuuaauc

SEQ ID NO: 371434 - RNA, 63 nt, Homo Sapiens
aagauuuucauucagaaucaaaauuaagaaaguuggacugaaaauaugaaaaaugcuuaacua

SEQ ID NO: 371435 - RNA, 63 nt, Homo Sapiens
cacuaaguuaucuuuauccaacauuucuccaaauggacugaaagaaacuuuucaaggacagug

SEQ ID NO: 371436 - RNA, 63 nt, Homo Sapiens
auggaugguuccaugagcccuccaacccagcccuggacugaggaggccauugcuuucaccgau

SEQ ID NO: 371437 - RNA, 63 nt, Homo Sapiens
auuggccuugaaucaggucauuuccugaaaagcuggacugagauuccucaccacauagugcuu

SEQ ID NO: 371438 - RNA, 63 nt, Homo Sapiens
ucuuguaucuugaaguuuuguacuugggauuucuggacugauaaaugaaucaucacauucuuc

SEQ ID NO: 371439 - RNA, 63 nt, Homo Sapiens
acugagaauuuuaaucaguuugggcauauaguuuggacugaaucacaucuguaguacuuagcc

SEQ ID NO: 371440 - RNA, 63 nt, Homo Sapiens
aaugugugaacuuuuaagauggauaauagggcauggacugagugcugcuaucuugaaaugugc

SEQ ID NO: 371441 - RNA, 63 nt, Homo Sapiens
acccuguggagaaauucguuguucccacugaaauggacugacuguaacgauugacaccaaaau

SEQ ID NO: 371442 - RNA, 63 nt, Homo Sapiens
uuagugcaugcaucucuuuagauccaaaauaaauggacugaaguuaucauccuauugucuuuu

SEQ ID NO: 371443 - RNA, 63 nt, Homo Sapiens
cuggacccaauuuuuccccagugaaagccaaguuggacugaauuucuggaguucucaucagug

SEQ ID NO: 371444 - RNA, 63 nt, Homo Sapiens
auaagcugaacagugaugaucuguagacauuuauggacugaauguaaugguugauauauguac

SEQ ID NO: 371445 - RNA, 63 nt, Homo Sapiens
gccacccgcccacagccagguucaagaccauccuggacugaugacccggcacugcccucagac

SEQ ID NO: 371446 - RNA, 63 nt, Homo Sapiens
ggauugggucacuuuugaauucuuuuaccuuuauggacugaugcugagccgaguuccucacau

SEQ ID NO: 371447 - RNA, 63 nt, Homo Sapiens
uaaguuacaagccuuucuuauuuugugucuccuuggacugagucaggaccccccagcaagucg

SEQ ID NO: 371448 - RNA, 63 nt, Homo Sapiens
cccaaauaccacagacucacauuuuaaguaaaauggacugauaaguguaaaaacauguuugua

SEQ ID NO: 371449 - RNA, 63 nt, Homo Sapiens
cuggagaaaauucuauggaacaagcucucauuauggacugaaaaguuugaggagcaaggucuu

SEQ ID NO: 371450 - RNA, 63 nt, Homo Sapiens
uuaaaagucauauuuauucuauauugguaaagauggacugauacaaagaauuauuuuucagau

SEQ ID NO: 371451 - RNA, 63 nt, Homo Sapiens
agcaaauuuauucuuucgaauuugaaaauacaguggacugaaacaagcuuggugauaaucaau

SEQ ID NO: 371452 - RNA, 63 nt, Homo Sapiens
acauugaugugauucuugaacauauuggacugauggacugaaaagaaauagaguugcuccauu

SEQ ID NO: 371453 - RNA, 63 nt, Homo Sapiens
gacugaaaacauugaugugagcuccauucauauuggacugauggaagaaaaagaaauagaguu

SEQ ID NO: 371454 - RNA, 63 nt, Homo Sapiens
guaauaaaucugucuauaucucccuguguauguuggacugacuccgcgccccuguuuacagcg

SEQ ID NO: 371455 - RNA, 63 nt, Homo Sapiens
ccaggccuguugcccaccaaagguugggcuggcuggacugagcgcucugaggauagcaaucag

SEQ ID NO: 371456 - RNA, 63 nt, Homo Sapiens
ugagaucaugccuaugaaguuuugugagauuguuggacugauuaacaagaugauagaauuaau

SEQ ID NO: 371457 - RNA, 63 nt, Homo Sapiens
uuaugccuaugaaguccccaaucuucauggaaauggacugacuccuucuuuccuaauccccuu

SEQ ID NO: 371458 - RNA, 63 nt, Homo Sapiens
gcuacuuccugucucuguuugaggggcccagccuggacugacuggagcagagugucgaggaug

SEQ ID NO: 371459 - RNA, 63 nt, Homo Sapiens
caaguuuagaguuggcccccaccucccaugccauggacugagcagcaggggcccagcaucccu

SEQ ID NO: 371460 - RNA, 63 nt, Homo Sapiens
ccaggaggcccuggguucucaggccuuuggcuuuggacugagaguuacacaaucagcuucccu

SEQ ID NO: 371461 - RNA, 63 nt, Homo Sapiens
cccugaaugcugcaucauuguguucagugcagcuggacugauugcaccuguguauuugccccu

SEQ ID NO: 371462 - RNA, 63 nt, Homo Sapiens
agcucagaaguauuguugcucaugguguggcaauggacugaacuguaaugaaaauguuauuua

SEQ ID NO: 371463 - RNA, 63 nt, Homo Sapiens
gggccuggguuccagggaaggcuaagcauggccuggacugacugcagcccccuauagucaugg

SEQ ID NO: 371464 - RNA, 63 nt, Homo Sapiens
ggaaauagguuuuagguggcauaguggcuuaacuggacugaauucaaauauucuuucaacuuc

SEQ ID NO: 371465 - RNA, 63 nt, Homo Sapiens
aaucagagucuguggcgauauccuacuuguguguggacugagcaugucaccauagaaggcaac

SEQ ID NO: 371466 - RNA, 63 nt, Homo Sapiens
uggggguaucuccccucugcguaucuuugcuuuuggacugacccagcgccaucuucccuccca

SEQ ID NO: 371467 - RNA, 63 nt, Homo Sapiens
gagaugccccuucuacuacuaggcccaaauccauggacugaagcccuggcugcuucaugccag

SEQ ID NO: 371468 - RNA, 63 nt, Homo Sapiens
acagaggggcccacacuuccguccgguugggguuggacugaggugagcagaggcccugggagu

SEQ ID NO: 371469 - RNA, 63 nt, Homo Sapiens
uuggguucucugcuguccuagaauagguuacuuuggacugaguuucugaccgaugguguuugg

SEQ ID NO: 371470 - RNA, 63 nt, Homo Sapiens
cuacaguuuuuagcuggugcccgagagccgaaguggacugaagccacugacaagaggguuucc

SEQ ID NO: 371471 - RNA, 63 nt, Homo Sapiens
ggagugugcccaggcagcuguucgccuggcaacuggacugagggcugccauccacuguauaau

SEQ ID NO: 371472 - RNA, 63 nt, Homo Sapiens
gacuguccucgggaaugaaccucccgcgggcuuuggacugaggucccuguggccucggucucc

SEQ ID NO: 371473 - RNA, 63 nt, Homo Sapiens
cccacucccucaggguccagccaugccccacccuggacugaaguucugcaaaguccuccgagg

SEQ ID NO: 371474 - RNA, 63 nt, Homo Sapiens
uuacauaaucacaagaaaggaaagaauuacaguuggacugauugugacagugccuugucgucc

SEQ ID NO: 371475 - RNA, 63 nt, Homo Sapiens
gggcauggagucauuagucucacaaacacacuuuggacugaagaggaucauuucuuuuuguuc

SEQ ID NO: 371476 - RNA, 63 nt, Homo Sapiens
cuccacucuguuccucucugcuuuguucuucccuggacugagcucagcgcaggcugugacccc

SEQ ID NO: 371477 - RNA, 63 nt, Homo Sapiens
cuccaacuuuuucaaagugugggugguccaguuuggacugaugggaaucuucuugucauucuu

SEQ ID NO: 371478 - RNA, 63 nt, Homo Sapiens
ggcacgaucauaguuaccgcagcaucaaauuccuggacugaagcgguccuuuugccucagccu

SEQ ID NO: 371479 - RNA, 63 nt, Homo Sapiens
ggccgcagagacugggucgccucccaacuuuuguggacugagcacccccaucaccuacuccag

SEQ ID NO: 371480 - RNA, 63 nt, Homo Sapiens
acacaucugagcugaacggcugugucucccucuuggacugagcagacugauuaucaauaauaa

SEQ ID NO: 371481 - RNA, 58 nt, Homo Sapiens; identical to SEQ ID NO: 371164

SEQ ID NO: 371482 - RNA, 63 nt, Homo Sapiens
gugucugagguucuuucccaaaauggaagcgguuggacugauggacccuuuuccuuagcugua

SEQ ID NO: 371483 - RNA, 63 nt, Homo Sapiens
cagccuuucccucggaccccccucgaagcccccuggacugauucccacccacgacucacaggc

SEQ ID NO: 371484 - RNA, 63 nt, Homo Sapiens
guauauugaaauuuauuuaaugugaguuuggucuggacugacagcaugugcccuccugaggga

SEQ ID NO: 371485 - RNA, 63 nt, Homo Sapiens
acucaggagggcccgguaaaggcugagaugaaguggacugaguagaacuggaggacaggaguc

SEQ ID NO: 371486 - RNA, 63 nt, Homo Sapiens
ccugugguuugguuggggcuucacagccacaccuggacugacccugcagguuguucauaguca

SEQ ID NO: 371487 - RNA, 63 nt, Homo Sapiens
cacuggcuuccuugguucaaccaccuucuuaccuggacugagccucacuuacagcuucucuag

SEQ ID NO: 371488 - RNA, 63 nt, Homo Sapiens
ggucagagaugagaaagccuacgacaaaagaauuggacugaugagaaaagacuuccauaaagg

SEQ ID NO: 371489 - RNA, 63 nt, Homo Sapiens
auggaaagacuuuuauuauauccagagccaaaguggacugaaccaagcaugacucauccaggu

SEQ ID NO: 371490 - RNA, 63 nt, Homo Sapiens
uguguacacuguguuaaacauaacacuaacuguuggacugacuuuucauauauuauuaguaau

SEQ ID NO: 371491 - RNA, 63 nt, Homo Sapiens
gcuuugucaccugcaggguaguuagcacagauguggacugaguacaguucacacaauucccug

SEQ ID NO: 371492 - RNA, 63 nt, Homo Sapiens
uucgcauugaacucuacaacagggacguugaccuggacugaaguuaugagagagcauaagcca

SEQ ID NO: 371493 - RNA, 63 nt, Homo Sapiens
aagggagaacaugguagggagaggaagggcuuauggacugagaccgagaaccauuuauacaua

SEQ ID NO: 371494 - RNA, 63 nt, Homo Sapiens
gagcuaggugcuucccccuuccccugagacugguggacugaacuccagucaaguugaguucaa

SEQ ID NO: 371495 - RNA, 63 nt, Homo Sapiens
cacaaaaccccuuuaugaguucacgcucuuuccuggacugacauaccuauuccuuuccauuug

SEQ ID NO: 371496 - RNA, 63 nt, Homo Sapiens
gcaacacaacauuugugucacuguacaguuuuguggacugagcgaggaaaaacaacaaauaau

SEQ ID NO: 371497 - RNA, 63 nt, Homo Sapiens
uuuggcaaaagguacuucaaacaagggagggccuggacugagggggaccaggucuucuugcug

SEQ ID NO: 371498 - RNA, 63 nt, Homo Sapiens
aagaaagacucgugacugcccagcgccccaggcuggacugagccccucacgccgcccugcagc

SEQ ID NO: 371499 - RNA, 63 nt, Homo Sapiens
gucuguucucagaucccuuggauguucaacaccuggacugaaucauuuuccuauaaugauguu

SEQ ID NO: 371500 - RNA, 63 nt, Homo Sapiens
cccaggaagaaaagcccaaauuggcaucucccauggacugauuauuucauguuccaggggcgc

SEQ ID NO: 371501 - RNA, 63 nt, Homo Sapiens
uagauuuucccauuucuaauauacauguuacauuggacugaauccuucaucuauuauaucaua

SEQ ID NO: 371502 - RNA, 63 nt, Homo Sapiens
ugguccacagggcaccugcccaguaacccccacuggacugacccccagcuccucacucaccuu

SEQ ID NO: 371503 - RNA, 63 nt, Homo Sapiens
auuuggccacaaccaaauuggggccagggugauuggacugagaauccucccacgccaggcccu

SEQ ID NO: 371504 - RNA, 63 nt, Homo Sapiens
ggccaugacaugacacaguucccuggccggguuuggacugaacaguggauucagaacugcagc

SEQ ID NO: 371505 - RNA, 63 nt, Homo Sapiens
caacauguuacugaccagcaacuugucuuuuucuggacugaagccugcaggaguuaaaaaggg

SEQ ID NO: 371506 - RNA, 63 nt, Homo Sapiens
uuugucaggaagggaaggggcucaacacagugauggacugauccagauggcucccggggauga

SEQ ID NO: 371507 - RNA, 63 nt, Homo Sapiens
ucagcaaccugccccagaccuggagggucuuuguggacugaagguagacaccagccagcaugg

SEQ ID NO: 371508 - RNA, 61 nt, Homo Sapiens; identical to SEQ ID NO: 371191

SEQ ID NO: 371509 - RNA, 63 nt, Homo Sapiens
gaaagcagggcagccgggaccugcggcugugccuggacugaagcugucccgcagguccccacc

SEQ ID NO: 371510 - RNA, 63 nt, Homo Sapiens
cuauucacagcuuccucaugaguuuuacuucucuggacugaucuuggacggugaaaauaaaag

SEQ ID NO: 371511 - RNA, 63 nt, Homo Sapiens
ggguucucacagugggagccggaccaguaugcuuggacugaaggagaacagugagcuuggaaa

SEQ ID NO: 371512 - RNA, 63 nt, Homo Sapiens
cucagccuacacgcucauauccuuucucggcccuggacugagguucaccaagcucuguuuugg

SEQ ID NO: 371513 - RNA, 61 nt, Homo Sapiens; identical to SEQ ID NO: 371196

SEQ ID NO: 371514 - RNA, 63 nt, Homo Sapiens
uauaucacacccagguaucauuuauaaauugaguggacugauacaccuuuuaucccaaagugc

SEQ ID NO: 371515 - RNA, 63 nt, Homo Sapiens
auaguugaacaccgggggcuacugcugggcuccuggacugagaucauaaacuccacugggagc

SEQ ID NO: 371516 - RNA, 63 nt, Homo Sapiens
cauggaaugaggacaaggugauacucugagcuguggacugaacuggcagacacaaccuguaca

SEQ ID NO: 371517 - RNA, 63 nt, Homo Sapiens
uuuuuuuaacaaaacaaaaugaagacaaaaauauggacugauguauccucgccuggacucagg

SEQ ID NO: 371518 - RNA, 63 nt, Homo Sapiens
cagaccggccuuccuuuggaggaaaguguggccuggacugagggaggaaaugagcgaguuccc

SEQ ID NO: 371519 - RNA, 63 nt, Homo Sapiens
auguuuuuagccuaaguauaagaguccuacagauggacugaaaaaaaucagucugagaguauu

SEQ ID NO: 371520 - RNA, 63 nt, Homo Sapiens
ccuuuaacccucaguaucaagcacaaaaauugauggacugauaaaagaacuaucuuagaacuc

SEQ ID NO: 371521 - RNA, 63 nt, Homo Sapiens
ccaagggccccaugaagcugggagcccggaagcuggacugaaccguggcgguggcccuucccg

SEQ ID NO: 371522 - RNA, 63 nt, Homo Sapiens
uguugguuuugccuucuggugcccauaguccccuggacugagucccccaggccuuccuucacc

SEQ ID NO: 371523 - RNA, 63 nt, Homo Sapiens
ccaccaaagccaggcccugaggccugggaguccuggacugagaaaggggguuccugggcccac

SEQ ID NO: 371524 - RNA, 63 nt, Homo Sapiens
ggcugguguuaaauaucagcuccuaauaagauguggacugaaaacacuaucacaacacuauga

SEQ ID NO: 371525 - RNA, 63 nt, Homo Sapiens
ugcuuucuuaacguugaaauugcacauucacauuggacugagacuuugaaaauaacuuuuaca

SEQ ID NO: 371526 - RNA, 63 nt, Homo Sapiens
agcuauuuucuagcauuugccagucccugugccuggacugauuggaacacuuuguuuuucucc

SEQ ID NO: 371527 - RNA, 63 nt, Homo Sapiens
cuggggcagaauccccaguggaaccggaagagcuggacugaugagaaacaucagaagaacaca

SEQ ID NO: 371528 - RNA, 63 nt, Homo Sapiens
ucuucccuuucauccgaagaccccuccugcaguuggacugaauaggaucuggaaccucuccca

SEQ ID NO: 371529 - RNA, 63 nt, Homo Sapiens
cuguggcacugcgugcgggaccugaggccucccuggacugagcccguggccacaugcuggaag

SEQ ID NO: 371530 - RNA, 63 nt, Homo Sapiens
uucaucacaccucagauaaagguacuuucaguuuggacugauaugguggaaauuggcagcugg

SEQ ID NO: 371531 - RNA, 63 nt, Homo Sapiens
uuugugcuuuuuauugaagaagcccccugcucuuggacugaauuuuaauuugugcauuucaua

SEQ ID NO: 371532 - RNA, 63 nt, Homo Sapiens
ccuuuauucccucucacaccuguccucugccuguggacugagcgaauggucaguaccagcccu

SEQ ID NO: 371533 - RNA, 63 nt, Homo Sapiens
gugcuguuuccugugcuuuuugcuguuuccuauuggacugauaagcucccagagaaugaauag

SEQ ID NO: 371534 - RNA, 63 nt, Homo Sapiens
ccagagcccccuguggcccacggacacaccucauggacugagguggauccucggcauagcgga

SEQ ID NO: 371535 - RNA, 63 nt, Homo Sapiens
gcaguuauuuuuauuauuaucagucaccaggccuggacugaaggaguuggcucuggauagggu

SEQ ID NO: 371536 - RNA, 63 nt, Homo Sapiens
uucuuaccagcaguuaccuaagagaaaagcaacuggacugacuaguucguagaccccaggagu

SEQ ID NO: 371537 - RNA, 63 nt, Homo Sapiens
aauuauacuuacuucuggcauuccuaacauccuuggacugagaaagcaugcucuguaaguugc

SEQ ID NO: 371538 - RNA, 63 nt, Homo Sapiens
acccaacagcagugcacuaucugguuuuauccauggacugaacugguugccuuuaucauccug

SEQ ID NO: 371539 - RNA, 63 nt, Homo Sapiens
cuccguuggcuucugaacugguuaaucccugucuggacugagccuagauaccagcacaagucg

SEQ ID NO: 371540 - RNA, 63 nt, Homo Sapiens
ccguggcggcugcucccucagaccucccuucuguggacugaccucucaccuccgccuguuguu

SEQ ID NO: 371541 - RNA, 63 nt, Homo Sapiens
cuucagagacccuuugggguuccacacuucacguggacugagguagacccugcaugaagauga

SEQ ID NO: 371542 - RNA, 63 nt, Homo Sapiens
ggugaugcaaagcugcuuugcucuguaucuggcuggacugaucugucucacaagaagccauga

SEQ ID NO: 371543 - RNA, 63 nt, Homo Sapiens
auuguuguauaauuuucuuuggucagaaacacuuggacugaauagugacacucgguaaggauu

SEQ ID NO: 371544 - RNA, 63 nt, Homo Sapiens
uggguuaacucaguaguuagaucaaagcaaauguggacugaaucugcuuguugaucaguguug

SEQ ID NO: 371545 - RNA, 63 nt, Homo Sapiens
ugaagacaaggaaagcucugcuguggcugccucuggacugacacccucccuaaugaguccuga

SEQ ID NO: 371546 - RNA, 63 nt, Homo Sapiens
uuuaauggaaaccaagccaauguuauagacguuuggacugauuuguggaaaggaggggggaag

SEQ ID NO: 371547 - RNA, 63 nt, Homo Sapiens
aaucguguccuuuucucuaaguuagguuuucuguggacugaaaagagacugggacugcucugg

SEQ ID NO: 371548 - RNA, 63 nt, Homo Sapiens
uucuugcagacaccccaccugugagcccagcacuggacugaagccaucuccugcagaagccag

SEQ ID NO: 371549 - RNA, 63 nt, Homo Sapiens
uuucuuuaauagugaaccccgugcccagaaaccuggacugauccaucuuccuguuuaggccau

SEQ ID NO: 371550 - RNA, 63 nt, Homo Sapiens
aacuugagauuuaaaaacugaacggguggaguuuggacugaucuauuuucagcuaaaaaaaaa

SEQ ID NO: 371551 - RNA, 63 nt, Homo Sapiens
caagggucugcggugcagcauucccugucugguuggacugagucuaccacuugaaggugaaca

SEQ ID NO: 371552 - RNA, 63 nt, Homo Sapiens
cggccacucucuggccgaagugacaucauccuauggacugagcccuuuuccuccagccuaaac

SEQ ID NO: 371553 - RNA, 63 nt, Homo Sapiens
uggaacccaaagaguacuccuuuguuaggcuuauggacugagcagucuggaccuugcauggcu

SEQ ID NO: 371554 - RNA, 63 nt, Homo Sapiens
aaucaguuacaucuuaagugauaugcucacagguggacugagaagacauauauuuguguguuu

SEQ ID NO: 371555 - RNA, 63 nt, Homo Sapiens
aaagacugcagaacccccaguaagauagaaagcuggacugacccugcggaagccaaaggcagc

SEQ ID NO: 371556 - RNA, 63 nt, Homo Sapiens
acaccaaccaggccuucauccagaagcauugccuggacugaccugggcuucauuccggacugg

SEQ ID NO: 371557 - RNA, 63 nt, Homo Sapiens
accuauaauuauaacuauaucuuucuuccucuuuggacugaauuucuuauaguaacacuaaaa

SEQ ID NO: 371558 - RNA, 63 nt, Homo Sapiens
uuuuuuuuaaaaagcaauaccugguuuccaccuuggacugacuuugauccuguuccacuuuug

SEQ ID NO: 371559 - RNA, 63 nt, Homo Sapiens
aaacauuguaauacuacaagccuccauaaauacuggacugaaauuguugcugcagccgaguga

SEQ ID NO: 371560 - RNA, 63 nt, Homo Sapiens
guugugugugugugugugugaggacauuggucuuggacugagcaagacagaaacuaaauguga

SEQ ID NO: 371561 - RNA, 63 nt, Homo Sapiens
ggccauaugucacuaauagaaagccccugaagcuggacugauguggggaaaacaccuuuuccu

SEQ ID NO: 371562 - RNA, 63 nt, Homo Sapiens
uauccaacuaggacacauaucuuuugaguuauuuggacugaaagcuuaagaaaacuuggaaaa

SEQ ID NO: 371563 - RNA, 63 nt, Homo Sapiens
aaucagaauauguugcuuugaaaaagccucuaauggacugaccuuaaaacucauccuucuucc

SEQ ID NO: 371564 - RNA, 63 nt, Homo Sapiens
gggcacauccagucuccaucgugcugcagcagcuggacugagggcagagccuguaggugcaga

SEQ ID NO: 371565 - RNA, 63 nt, Homo Sapiens
ucccuccugugucaaguagcuaacugcagcagcuggacugagggcagagucugugggugcaga

SEQ ID NO: 371566 - RNA, 63 nt, Homo Sapiens
gauuucuuccucugaggacaccaaagcccgcaguggacugaugccuucgaugggcaggaugaa

SEQ ID NO: 371567 - RNA, 63 nt, Homo Sapiens
cugaaccagucauuggcaagaggaacgguguuauggacugaauguucauguuccuccagaauu

SEQ ID NO: 371568 - RNA, 63 nt, Homo Sapiens
uaucuccuaggaggcauggagggauccagaaccuggacugaagaaccaccuagaaauaacuca

SEQ ID NO: 371569 - RNA, 63 nt, Homo Sapiens
uuugagggaggaggaggcuguuugguauuugcuuggacugacaccacaaaaucgaugcguugc

SEQ ID NO: 371570 - RNA, 63 nt, Homo Sapiens
cuggaauuacuccuguagguguaauaauuaugguggacugauguugguuaggccaaauguugu

SEQ ID NO: 371571 - RNA, 63 nt, Homo Sapiens
acuggugacuggucugugauagugcugauuuuauggacugagggccuggaaccuuccucugga

SEQ ID NO: 371572 - RNA, 63 nt, Homo Sapiens
cugauucagaaaauaauuguuauuuaauaucaauggacugaguuuuacaaucauuucauuuug

SEQ ID NO: 371573 - RNA, 63 nt, Homo Sapiens
ucagcaggagcccuguucacccguucuucccuguggacugaccucuuccacccacgccguggc

SEQ ID NO: 371574 - RNA, 63 nt, Homo Sapiens
ccacgaguuuaugugcacaaguguuuuggguuguggacugaagcucagccuguuaaucagacc

SEQ ID NO: 371575 - RNA, 63 nt, Homo Sapiens
aagaaagagauagaauacaggugguaccuguuguggacugaauugcgucaaauucauauguug

SEQ ID NO: 371576 - RNA, 63 nt, Homo Sapiens
gggcagggcagggcuggcaccucucaacgucuguggacugaaugaauaaacccuccucaucca

SEQ ID NO: 371577 - RNA, 63 nt, Homo Sapiens
ggggagccggggugugaggggacuggaccagcuuggacugagaccugagaccgggccgguggg

SEQ ID NO: 371578 - RNA, 63 nt, Homo Sapiens
ucaaauaguucaucaaaaugaaucuuugcucuuuggacugaauucuuaccauacugccauuaa

SEQ ID NO: 371579 - RNA, 63 nt, Homo Sapiens
agggugaaaaacugacacagucaauucagaaaauggacugaagucugaauaaggucauugcau

SEQ ID NO: 371580 - RNA, 63 nt, Homo Sapiens
cucuaggugggguucccaaagacgccuucacgcuggacugagcugcucucccacaggguuucu

SEQ ID NO: 371581 - RNA, 63 nt, Homo Sapiens
gcuucacuagaauaugccaacugccaaucauguuggacugagcuaauuuguuccucuuucuga

SEQ ID NO: 371582 - RNA, 63 nt, Homo Sapiens
auggagagcuauguaacagaugaauuucagaaauggacugaaaaggcuaaaggcuaugcgaua

SEQ ID NO: 371583 - RNA, 63 nt, Homo Sapiens
caaagggcuggccacaccacccaaggaugaggcuggacugaggaagcugcccccuccuugccc

SEQ ID NO: 371584 - RNA, 63 nt, Homo Sapiens
ugacugccagauggugggacauaugacugugguuggacugaccgaauuccuggaagggcccug

SEQ ID NO: 371585 - RNA, 63 nt, Homo Sapiens
ccuccacugcugugugccccccuggagaccccauggacugauguggaaagugggacccuccag

SEQ ID NO: 371586 - RNA, 63 nt, Homo Sapiens
guguugggcaagaccucuucaccagcaggcagguggacugacucggucuggaggccgaggacc

SEQ ID NO: 371587 - RNA, 63 nt, Homo Sapiens
aaggcuaaaaaaaagucuugcaaaauggggcaguggacugacaggcugacauagaaaauaaac

SEQ ID NO: 371588 - RNA, 63 nt, Homo Sapiens
gggggagggcaagcuggauuuacaggucacggcuggacugaaugggccuuuuuaucuucccac

SEQ ID NO: 371589 - RNA, 63 nt, Homo Sapiens
gcuggacgggccagaacugcgcugcacacuuccuggacugaggcggggacuuugggucccacc

SEQ ID NO: 371590 - RNA, 63 nt, Homo Sapiens
cugggccucuuauuucguuucuggggacugcauuggacugagggcuggguaggcaggugucuu

SEQ ID NO: 371591 - RNA, 63 nt, Homo Sapiens
ugguuccagggugggccggugccagcuccgggguggacugaacagcggcggcugucccugugc

SEQ ID NO: 371592 - RNA, 63 nt, Homo Sapiens
gcuccuaggacccgucuccagcugcugagauccuggacugagggggccuggaugcccccugug

SEQ ID NO: 371593 - RNA, 63 nt, Homo Sapiens
cccgacggagcugcuucugcucccuggggcauauggacugacccaccuccugcugagaaccuu

SEQ ID NO: 371594 - RNA, 61 nt, Homo Sapiens; identical to SEQ ID NO: 371277

SEQ ID NO: 371595 - RNA, 63 nt, Homo Sapiens
ucaggggcacuucaggcuccacaggcgucauguuggacugagaccuaacucacuggacucaga

SEQ ID NO: 371596 - RNA, 63 nt, Homo Sapiens
gagcagucagggugggaagaaagaaugcaagaguggacugaaugugccuaauggagaagaccc

SEQ ID NO: 371597 - RNA, 63 nt, Homo Sapiens
gguacauggcugugaugggggagguggugcugcuggacugagccaguggagggggaagaucug

SEQ ID NO: 371598 - RNA, 63 nt, Homo Sapiens
auaccaguaggacugaaucagggccuucaaagcuggacugaguugguccuguucuggcacaua

SEQ ID NO: 371599 - RNA, 63 nt, Homo Sapiens
cugggaggcagaaguccccgcacccaucaugcguggacugauaggacaucuuuucguggugug

SEQ ID NO: 371600 - RNA, 63 nt, Homo Sapiens
ggggaauguugcugaggagguucagugugugaauggacugaaccaguuggccacucucucaga

SEQ ID NO: 371601 - RNA, 63 nt, Homo Sapiens
cuuccaacccugaacaagaccuuacaugagagauggacugauggacugcggcaauccugggcu

SEQ ID NO: 371602 - RNA, 63 nt, Homo Sapiens
caugugaccggaggccccuuaguucuugucuccuggacugaacgucguauggacuucuggaaa

SEQ ID NO: 371603 - RNA, 63 nt, Homo Sapiens
ggaaucaagcucugagcagaguuaucuggaaaguggacugaacgacuguguuucgcauucggc

SEQ ID NO: 371604 - RNA, 63 nt, Homo Sapiens
ugcccaagcccuuggcucccugggcccuuggucuggacugaaucucgcccugccuccaucacc

SEQ ID NO: 371605 - RNA, 63 nt, Homo Sapiens
acccuccuccccaauuugggcccugcuggggguuggacugaaaccugaaaucucuggccucac

SEQ ID NO: 371606 - RNA, 63 nt, Homo Sapiens
gugggcuccuaacugccucccaguggacggccuuggacugaacugucagagucacacggggcu

SEQ ID NO: 371607 - RNA, 63 nt, Homo Sapiens
cuauuuucuucuccaaacugagucgguggcuucuggacugaagccuccuccuguugaccagug

SEQ ID NO: 371608 - RNA, 63 nt, Homo Sapiens
ugcaauuuguugaaagggaacuucuguacacaguggacugaaguaacgaugggaaauguauua

SEQ ID NO: 371609 - RNA, 63 nt, Homo Sapiens
gagggcacacagggccggggaggaggauuaggcuggacugaucgcgggucgcaggugaccccg

SEQ ID NO: 371610 - RNA, 63 nt, Homo Sapiens
acugcugccugcuuuauuauuucuuuaaugaguuggacugaacagugguuaauccugacucug

SEQ ID NO: 371611 - RNA, 63 nt, Homo Sapiens
cacauagauucuccuccgucuucauugugcacauggacugaaucccagggugauaugcugauu

SEQ ID NO: 371612 - RNA, 63 nt, Homo Sapiens
acuaaugcaaggacuaugguuaauuguucauaguggacugaaaacauguuuacaugcagcaga

SEQ ID NO: 371613 - RNA, 63 nt, Homo Sapiens
auacuuaacauucuuuuucuaugcaaagcacguuggacugagagacuugucauuuuguugaug

SEQ ID NO: 371614 - RNA, 63 nt, Homo Sapiens
gcugaaguaccuggcaaaaagcuacugacucauuggacugaaacugaaauauuaguggaauuu

SEQ ID NO: 371615 - RNA, 63 nt, Homo Sapiens
cgcgaggcuuuuggagcggcugugggugucgucuggacugagguuuuuaaauauuucuuucuc

SEQ ID NO: 371616 - RNA, 63 nt, Homo Sapiens
cugcuaugccugugacccccgcggcccacacacuggacugaccugcccugagcggggaugcag

SEQ ID NO: 371617 - RNA, 63 nt, Homo Sapiens
aggacgagcuguagagaggccugccuccagggcuggacugaggccugagcgcuccugccgcag

SEQ ID NO: 371618 - RNA, 63 nt, Homo Sapiens
accaucucagcucccuugcauccaggugcagcauggacugaguucuugacaacagaauguggu

SEQ ID NO: 371619 - RNA, 63 nt, Homo Sapiens
accuggccgagcuguaccuggcacggcccauccuggacugagaaacuggaaccucagaggaac

SEQ ID NO: 371620 - RNA, 63 nt, Homo Sapiens
gaguucaagaagccaacgcugagucaggcugaguggacugaggccugccccgcccagacugcc

SEQ ID NO: 371621 - RNA, 63 nt, Homo Sapiens
ggucccuaaccuauaaucucagcuucccuacccuggacugaagggucugcccauccccccacc

SEQ ID NO: 371622 - RNA, 63 nt, Homo Sapiens
acaguuacacugcaggguuucgcccaauaaagguggacugacauucccucuuccaggcccuug

SEQ ID NO: 371623 - RNA, 63 nt, Homo Sapiens
acagggccggggccuggaccaaaccacaugaacuggacugagagggggaagaagcggggagga

SEQ ID NO: 371624 - RNA, 63 nt, Homo Sapiens
uggcuguuucacccguggacuugaacuugccauuggacugagcucuuucucagaagcugcuac

SEQ ID NO: 371625 - RNA, 63 nt, Homo Sapiens
cccgggggauguggccggcacugggcagccccuuggacugaggcaguuuugguggauggggga

SEQ ID NO: 371626 - RNA, 63 nt, Homo Sapiens
uuaacccgcugcacaacaccuuucuugcuuuacuggacugauuaugaagcucucucuaaauau

SEQ ID NO: 371627 - RNA, 63 nt, Homo Sapiens
aaugacccccaaaauucguaauauuaaguacuuuggacugaacuguggaaagagaaaagaauc

SEQ ID NO: 371628 - RNA, 63 nt, Homo Sapiens
gcaugagaugcccuuugagucccgaggaggcgguggacugaagcgcgagggcacgggcugugg

SEQ ID NO: 371629 - RNA, 63 nt, Homo Sapiens
uuccaguccccaccguccugcaaacccagacccuggacugauuaggccuguccucuuaggacu

SEQ ID NO: 371630 - RNA, 63 nt, Homo Sapiens
cccuuaacuuguggagucuggugggggaagucuuggacugagcccuugugaguggcaucugau

SEQ ID NO: 371631 - RNA, 63 nt, Homo Sapiens
uaugugcacacacccccaucuugcccaguagaauggacugaucuagacuggccugaaaucccc

SEQ ID NO: 371632 - RNA, 63 nt, Homo Sapiens
caaaaguggccaaaaaaugcaugucuguaauuuuggacugacguuuuaagaauuuguuaccuu

SEQ ID NO: 371633 - RNA, 63 nt, Homo Sapiens
uugggaaaacaaugaaguguuuuaaguccuggguggacugagagaugguuugccuguccagac

SEQ ID NO: 371634 - RNA, 63 nt, Homo Sapiens
guucggggcagccugcucgggaugcuuccacccuggacugaguggguuggggggugccggggc

SEQ ID NO: 371635 - RNA, 63 nt, Homo Sapiens
uguuuuaaagguagaguuaacagaauauacugguggacugaauguagguugagagaggaagcg

SEQ ID NO: 371636 - RNA, 63 nt, Homo Sapiens
gcucaccucagcaaaaguuaagacagcuguaaauggacugaucuacaaaaagguaaaaauucc

SEQ ID NO: 371637 - RNA, 63 nt, Homo Sapiens
ucugguagauguaacauucuaccagauuauggauggacugaucugaaaaucgaccucaacuca

SEQ ID NO: 371638 - RNA, 63 nt, Homo Sapiens
aaauauaguaauuucauuuuuaccuuucuucaguggacugaauuguauggaaggaaauugauc

SEQ ID NO: 371639 - RNA, 63 nt, Homo Sapiens
cgccgggaccacccugagccggccccaggcucguggacugagugggaagcccauccugaccag

SEQ ID NO: 371640 - RNA, 63 nt, Homo Sapiens
gcacacugucugcccccguucccggguagccacuggacugacgacuugagugcucaguaguca

SEQ ID NO: 371641 - RNA, 63 nt, Homo Sapiens
ggguguaaaugagugaucaguguacauuguguguggacugaaguguagguauguagagaugcu

SEQ ID NO: 371642 - RNA, 63 nt, Homo Sapiens
uuguaaaagacaguguaugugacauaucaucuguggacugacccuaaaaaugucacgaauaug

SEQ ID NO: 371643 - RNA, 63 nt, Homo Sapiens
ccaggagacccugagggcagccgguuccuacuuuggacugagagaagggagccccaggcugga

SEQ ID NO: 371644 - RNA, 63 nt, Homo Sapiens
gggaagcaguuucagauaaaucaugggcauugcuggacugaugguugcuuugagcccacagga

SEQ ID NO: 371645 - RNA, 63 nt, Homo Sapiens
ggccagagaagguggcaugggccugaacccaccuggacugacuucugcacugaagccacagau

SEQ ID NO: 371646 - RNA, 63 nt, Homo Sapiens
cagcuguuucuaguuaccaccuaccccuggccguggacugaucagaccagcauucaaaauaaa

SEQ ID NO: 371647 - RNA, 63 nt, Homo Sapiens
cccgggacccagcugugcuacccaccccuuccauggacugaauaagauggacuaacaggccug

SEQ ID NO: 371648 - RNA, 58 nt, Homo Sapiens; identical to SEQ ID NO: 371331

SEQ ID NO: 371649 - RNA, 63 nt, Homo Sapiens
ucccuuuagaggggaguuauagugugggauuccuggacugauuuggggagacagcaggaucac

SEQ ID NO: 371650 - RNA, 63 nt, Homo Sapiens
uggggaaacauaacuccaucuacaccuuggauuuggacugauucuccauuuuaucaccugaag

SEQ ID NO: 371651 - RNA, 63 nt, Homo Sapiens
gguguggcgguaccugcugaacguguauccagauggacugacaggccgagagcggauggacua

SEQ ID NO: 371652 - RNA, 63 nt, Homo Sapiens
aucccgccgaccccccagacuaaccuccaggcauggacugaaucugguucuccucuuguacac

SEQ ID NO: 371653 - RNA, 63 nt, Homo Sapiens
ggucagaaggacaaagcugguuuguuugggaaauggacugaucgaaagaaaacuugccaaagu

SEQ ID NO: 371654 - RNA, 63 nt, Homo Sapiens
uagcugggggaaggacauuucauaaggguuaguuggacugagcaguauggacauuugcuuuuu

SEQ ID NO: 371655 - RNA, 63 nt, Homo Sapiens
uuaaagcagacgaaacgaaguaagcuauauuucuggacugaacaaagcucugcuguuuagagc

SEQ ID NO: 371656 - RNA, 61 nt, Homo Sapiens
agaaaguguguguauuccuuucuuaauaaaguguggacugaacaucggugccuggagugag

SEQ ID NO: 371657 - RNA, 63 nt, Homo Sapiens
auucuuggcccgcacagagcuggggcugagggauggacugaugcuuuuagcucaaacguggcu

SEQ ID NO: 371658 - RNA, 63 nt, Homo Sapiens
uuuaaacuauucagucuuacuguuggagaaaaauggacugaucaaucuagaaguuagggguuu

SEQ ID NO: 371659 - RNA, 63 nt, Homo Sapiens
auuagaagcaauugaaauacggucccauuguacuggacugagggacuugggaaaaagcaaaaa

SEQ ID NO: 371660 - RNA, 63 nt, Homo Sapiens
uaucuuugcaaguauccacauaauuugaaguuuuggacugaaaaacaaacauauuugggugug

SEQ ID NO: 371661 - RNA, 63 nt, Homo Sapiens
uuggagaccuagccccagaaccuggccccucccuggacugacugaauccguccaguccaucuu

SEQ ID NO: 371662 - RNA, 63 nt, Homo Sapiens
ggacugguugaaaguggccaaggggagacacaguggacugaaaaugggccugucccaagcgag

SEQ ID NO: 371663 - RNA, 63 nt, Homo Sapiens
cccagauuuccuucccuuggugccgaggccaaguggacugaccgcuucucccucucaggcaga

SEQ ID NO: 371664 - RNA, 63 nt, Homo Sapiens
cucgccagaugcaucauguccauuuugggaaaauggacugaaguuucuggagcccuugucuga

SEQ ID NO: 371665 - RNA, 64 nt, Homo Sapiens; identical to SEQ ID NO: 124377

SEQ ID NO: 371666 - RNA, 64 nt, Homo Sapiens; identical to SEQ ID NO: 124378

SEQ ID NO: 371667 - RNA, 64 nt, Homo Sapiens; identical to SEQ ID NO: 124379

SEQ ID NO: 371668 - RNA, 64 nt, Homo Sapiens; identical to SEQ ID NO: 124380

SEQ ID NO: 371669 - RNA, 64 nt, Homo Sapiens; identical to SEQ ID NO: 124381

SEQ ID NO: 371670 - RNA, 64 nt, Homo Sapiens; identical to SEQ ID NO: 124382

SEQ ID NO: 371671 - RNA, 64 nt, Homo Sapiens; identical to SEQ ID NO: 124383

SEQ ID NO: 371672 - RNA, 64 nt, Homo Sapiens; identical to SEQ ID NO: 124384

SEQ ID NO: 371673 - RNA, 64 nt, Homo Sapiens
accaacacagggaaaacggacucagaggggaagagggugcuaguuuccucuuugcacccagaga

SEQ ID NO: 371674 - RNA, 64 nt, Homo Sapiens
cuuacaggagugagagucugucucagcagcaggggggugcuaccccgcaucuccagagagagcc

SEQ ID NO: 371675 - RNA, 64 nt, Homo Sapiens
gucuuccuucagggauuuccaacuggcacucugugggugcuacacagaaugcaauuuaauggau

SEQ ID NO: 371676 - RNA, 64 nt, Homo Sapiens
aauaaauuuauauacuuuuugagggguucuucuggggugcuaaucaggccccuguuaugcuuag

SEQ ID NO: 371677 - RNA, 64 nt, Homo Sapiens
gcaguaacagguauaaaguacuuagaaaagcaaagggugcuacguacaugugaggcaucauuac

SEQ ID NO: 371678 - RNA, 64 nt, Homo Sapiens
guaccgccuugcacacucagaagccuuugggaaggggugcuauucauuucugcucaaucuguua

SEQ ID NO: 371679 - RNA, 64 nt, Homo Sapiens
ugggugucucccacaugucuacuauggcaaaaaacauuaccauccccacccauaccacagcauc

SEQ ID NO: 371680 - RNA, 64 nt, Homo Sapiens
gcauuucugggaagccccagggacugcaaguggccauuaccaucucuaaggagagcucugauug

SEQ ID NO: 371681 - RNA, 64 nt, Homo Sapiens
ugccaggugugcucucugucagcaauagugaccucauuaccaagggguggcgaccacauuacca

SEQ ID NO: 371682 - RNA, 64 nt, Homo Sapiens
caauagugaccucauuaccaagggguggcgaccacauuaccaagcgcaauuccccauucuccaa

SEQ ID NO: 371683 - RNA, 64 nt, Homo Sapiens
accuuaucacauuuuccccaguucaaugcuaugccauuaccaacuccaaauaaucucaaauaau

SEQ ID NO: 371684 - RNA, 64 nt, Homo Sapiens
gcaaaaaguugaacaaagaugaacuaauguauuacauuaccauugccacugauuuuuuuuuaaa

SEQ ID NO: 371685 - RNA, 63 nt, Homo Sapiens
ucaaacucuccaguguggugugaacucagaagaaacgguuacuggggcugcauggagaauuuc
